United States Patent 9,254,311 (MODIFIED POLYNUCLEOTIDES FOR THE PRODUCTION OF PROTEINS) - sequence listing, part 14

SEQ ID NO: 27925 - DNA, 300 bp, Artificial Sequence
  Description of Artificial Sequence: Synthetic coding sequence
atggatactggctcccgggaggctgccttcactagggaccttcctcgaaagccagcagacgcacaagtaagcccagaaatgagcattactcacaaagagaaggagaatgcccacctgaaagagatactgctctttgtaaacgccgaggcttttagtcagccccaaccccattctgcgccagtgtgcgaaggtcaacagcttaccggaaagttttcgacctcagtccttacccgggctggcggagatgccagcccttgttcttgggagcgcctcctctgctatgggtggagccactgctag

SEQ ID NO: 27926 - DNA, 354 bp, Artificial Sequence
  Description of Artificial Sequence: Synthetic coding sequence
atgcctagctgcagctgcgccctgatggccccgtgtggtcccgctgctggacctgcagccgtcgagagaacacagcaagtggcaagaggcgagccagggtcagcccggggccagttgcaggttagcccggagatgagcataacacacaaagaaaaagagaatgcccacctgaaagagatcctattattcgtgaacgctgaggctttctcacagccgcaaccccacagcgccccagtgtgtgaggggcagcagcttactggtaaattctctacgagcgtgctgacacgcgccgggggggatgcctccccttgctcttgggaacgactgctttgttatggttggagtcactgctag

SEQ ID NO: 27927 - DNA, 450 bp, Artificial Sequence
  Description of Artificial Sequence: Synthetic coding sequence
atgctttctgggccccatccctctccaactttcagaccgaatccctgcccctggccctgtcttcattctctttggatggaaatctcaccgactcagctgtgtttcctaagtccgggtccttctccgcagtctcctagttgttgctttcagggcatgaactcgggctccgagctggggaaactctggcgaaagcttttcaagggaatccccaggttatccgtttcccactttgatttttactgcggtacttgtgtgctgcttggccgacctcagattccgcagggatctagcctgggcaacgatattgaccagtaccccgtcgtattcaggaatgcaagcgatcagggcagctggatgcagctcgaaatgctgttgcgcaaactgtccgaccttgtgtggacatctgatgcgctgagcgataaaatattagaggatggcctcgtcccgtag

SEQ ID NO: 27928 - DNA, 609 bp, Artificial Sequence
  Description of Artificial Sequence: Synthetic coding sequence
atgaagagatggcagatttttgtgctttgggtgttctgggtcctgattctatggctcatgaccccatatttagacctgacaccagaatcagcaccgcaggaaaaaagaatgtatctggtgccacagcattgtgattgcccctggtttagtagcgggaagtgcgggtgtccctcagaaacactaaactgtagcagttgccatcatacagccgatgaatggaattggttggacgcctgcagccgtaaaaccatggggtatctaatgcgcactagagaaagcatgacctcagacaccgttctttggtggctcgggatgaacagtggatctgagcttgggaagctatggcgcaaactgtttaagggcatcccaaggctgtcagtgtcacacttcgatttctattgcggaacctgcgtgctcttgggccgcccccagattccccaggggtcgtctctggggaacgacatcgatcaataccccgtggtgtttcgcaatgccagcgatcagggctcctggatgcagttagagatgcttcttaggaagttgtcagatctagtgtggacatccgatgccctctccgacaagattctggaggatggactcgttccatag

SEQ ID NO: 27929 - DNA, 1152 bp, Artificial Sequence
  Description of Artificial Sequence: Synthetic coding sequence
atgaatgcaggcccctcctggaacaaggtccaacactccaagaacagtagcggcaagagacaatctaagtcccaggtcccacacgcttcctcccagcctaggagctctctaaccgccgttacccagccaactgaggaaaaattaaaggagtccatttcacctgaggccagacggaaaagaaacccacttggttctcgatgccagggcgctagtggcaataaactctttttggactttcagtccatgaaaatcattaaggagaacgcagacgaggatagcgcgagcgacttgtccgatagcgaaaggataccaatcccaccgagtccacttactccccccgatttgaatttgagagctgaggaaatcgatcctgtgtactttgatcttcaccctggtcaagggcatacgaaacctgaatactactatcccaatttccttccatcccccttctccagttgggacctgagagacatggctctactcttgaatgcagagaataaaacagaagctgtcccccgggttgggggccttctgggaaagtacattgaccgactaattcagctggaatggctacaagtgcaaaccgtgcagtgtgagaaggcaaagggaggcaaggcacgccccccgactgccccgggcacctccggagcactgaaatctcctggacgcagcaagcttattgcctccgccctgagtaaacccttgccacaccaggagggcgcttcgaaatccggccccagcagaaagaaagccttccaccacgaggaaatacacccttcgcattacgcgttcgaaacctctcctaggcccatcgacgtcctgggcgggacaaggttttgctctcagcggcagacattggagatgcggactgaggaaaagaagaagaagagctctaagtctaccaagctgcagcgttgggacctgtcaggtagcggttccagttctaaagttgaaaccagcgggcatatacgcgtcccaaaacaggctgccgtaattttggattcagctgatagctgcaaggccagcaagacccaggcacatgctcatccaaggaagaaaggaaaggctgagagctgtggacacgccaccgtttcatctgaaaaaaagctgaaaacaaatggggtgaagcaaaacacctataagctcaagtag

SEQ ID NO: 27930 - DNA, 1152 bp, Artificial Sequence
  Description of Artificial Sequence: Synthetic coding sequence
atgaacgctgggccttcttggaataaggtccaacattccaaaaacagctctggtaagaggcaaagcaaaagtcaggtaccacacgcctcttcccagccaagaagctcattaacggcagtgacccagcccacagaagagaagcttaaggagtccataagccctgaggctcgcagaaagagaaaccctctgggtagtcgctgccagggtgcctcggggaataagctgtttcttgacttccagtcgatgaaaatcataaaggagaatgccgatgaagattcggcaagcgacctgtccgacagtgaaaggattccaatacccccgagcccactgactccacctgacctcaacctgagagcagaagaaattgatcctgtatattttgatttgcacccaggccaagggcatacaaagcctgagtactattacccaaacttcttaccctcaccgttcagctcctgggacttgcgggacatggcactgctgctaaacgccgaaaataaaaccgaagccgtgcccagagtcggcgggctcctgggcaaatatatcgacaggctcatccagttggagtggcttcaggtgcagaccgtccagtgtgagaaagcaaaagggggcaaagctaggccacctacggcccctggcaccagcggcgcattgaagagccctggtaggagtaagcttattgcaagcgcactgtctaaaccactgcctcaccaggagggggcgtctaagtccggtccttccaggaaaaaggcattccatcatgaagagatccacccttcccattacgcgtttgagacgtcacctcggcccatcgatgtgttaggcggaacacggttctgcagccagaggcagaccctggagatgaggacagaggagaaaaagaagaaatctagcaagagtaccaagttacagcgctgggacttatccggctccggaagcagctctaaggttgaaacaagtggccacatcagggtgcccaaacaggcagcagttatcctggactcggctgactcatgtaaggcctccaaaacccaagcacatgctcatccccggaaaaagggcaaggcggagtcttgcggacacgctaccgtgtcctcagagaaaaagctgaagaccaatggcgtgaagcagaacacctataaactcaaatag

SEQ ID NO: 27931 - DNA, 147 bp, Artificial Sequence
  Description of Artificial Sequence: Synthetic coding sequence
atgaatgcaggaccatcatggaataaggtgcagcattccaagaattcatccggcaaacgacagagtaagtcccaagtaccacacgcctccagccagccacgctcctcactaaccgcagtaacgcagcctactgaggagaagctgtag

SEQ ID NO: 27932 - DNA, 153 bp, Artificial Sequence
  Description of Artificial Sequence: Synthetic coding sequence
atggatattctgctggacttagggtggcacttcagtaactgtgatgaggatacgttctatagtcccgttcaaaacacagaaggggatttattgttctttgatcataatctgaaaaccgatagaggacatgtggagcgcagtgttatggactag

SEQ ID NO: 27933 - DNA, 126 bp, Artificial Sequence
  Description of Artificial Sequence: Synthetic coding sequence
gacctaggatggcactttagcaattgtgacgaagataccttttattctcccgtccagaacaccgaaggcgacctgctctttttcgaccacaacctgaagacggatcgcggccacgtggagagatag

SEQ ID NO: 27934 - DNA, 957 bp, Artificial Sequence
  Description of Artificial Sequence: Synthetic coding sequence
atgagcacacacgttgcggggctcgggttggataaaatgaaactggggaatccacagtcattccttgaccaggaggaggccgatgaccagcagctcctcgagcctgaggcttggaaaacatatactgagcggcgcaatgcattaagggaattcctgactagtgatctctcacctcatcttttaaagaggcaccacgcgcgtatgcagctcctgagaaaatgcagctattatattgaggtgctgcctaagcacctggcactaggtgaccaaaacccacttgtgttgccctccgcactctttcaattgatcgatccatggaaatttcaacgcatgaagaaagtcgggactgcccaaacaaagatccaactcctcctgctcggtgatctgctcgagcagctggaccacgggcgggcagaattggacgctctgttgcgatccccagacccccggccattcttggcggactgggccttggtcgagaggaggctcgctgacgtgtctgccgtcatggattcattcttaactatgatggttcctggccgcctacacgtgaaacaccggcttgtgtctgacgtctcagctactaaaatacctcacatctggctaatgctctctacaaagatgcccgttgtcttcgacaggaaggcatccgccgcacatcaagattgggcgcggctcagatggttcgtgacaattcagcctgcgacatctgagcagtatgagcttcgctttaggctgctggatccccggacacagcaggaatgcgctcagtgcggtgtgattccagttgctgcgtgtacattcgacgtcagaaaccttctgcctaacaggagttataagtttacgataaagagagccgagacctccacactcgtctacgaaccatggcgagattctctcactctgcacacgaaaccagagcctctggaaggacccgcgctgtcgcactcggtctag

SEQ ID NO: 27935 - DNA, 957 bp, Artificial Sequence
  Description of Artificial Sequence: Synthetic coding sequence
atgtccacccacgtggcaggcctgggtctggacaaaatgaaactgggcaacccccagtcgtttctggatcaggaggaggcagatgaccaacaacttctggaacccgaagcttggaaaacctacacagagcgtaggaacgcactcagggagttcttgacctcagatctgtcccctcatttattaaagcgacaccacgcccgaatgcagcttctacggaaatgttcttactatattgaggtgctccccaagcatcttgcccttggggaccagaaccccctggttcttccttcagcactttttcagctcattgacccctggaagttccagaggatgaaaaaggtaggcacagcacagacgaagatacagttacttctccttggtgatctgctcgagcagctcgaccacggccgggcagaactcgacgccctcctgcggagccctgatcccaggccctttctggcggattgggcactcgttgaacgcagactcgctgatgtaagcgcggtcatggattcctttctgaccatgatggtgccagggcgtctgcacgttaaacaccgcctagtctctgatgtcagtgcaacaaagatcccgcatatctggctcatgttgtctacgaagatgccagtagtgtttgatcgaaaggcctccgctgctcaccaggactgggcccgcttacggtggtttgtgactatccagccagcaacgtctgagcaatatgagctccggttcaggctcctggacccgaggacacagcaggagtgcgctcaatgtggcgttattccagtcgcggcctgtacgttcgacgtgcgcaacttgcttcctaacaggtcctacaaattcaccatcaagcgggcagagacaagcacactggtttatgaaccgtggcgcgatagccttacgttgcacacaaagcccgagcctttagagggacctgcactctcacactccgtgtag

SEQ ID NO: 27936 - DNA, 618 bp, Artificial Sequence
  Description of Artificial Sequence: Synthetic coding sequence
atggcagctagagacgccacttctgggtccctgtccgaagaatcaagcgcgttagatctgccctcggcatgtgacatacgggattacgtgcttcaggggccaagtcaggaagcaaattcggaagccttctcttctctcgagttccacagcttcccttatagttctgacgtggaccccgacaccagtaacctcaacatcgaacaaaataacagctggactgccgagaatttttggctggatccagcagtgaagggacagtcagagaaagaggaggacgacggcttacgaaagtccttagacaggttctacgaaatgttcgggcatccgcaacccggcagcgcaaactcactcagcgctagtgtgtgtaagtgcttatctcagaaaatcactcaactgcgggggcaggaatcacagaaatacgcactgaggtctttccagatggctagagtgatctttaaccgtgatgggtgttctgtcctacagcgccactccagggacacgcatttttatccactcgaagaaggttcaacatccttggatgacgagaagcccaatcccgggctcagcaaggacattacccattttctcctgcagcaaaacgtgatgaaggatctatag

SEQ ID NO: 27937 - DNA, 456 bp, Artificial Sequence
  Description of Artificial Sequence: Synthetic coding sequence
atggcagctagggacgcaacatccgggtccctctctgaggaaagctctgccttggacctgcccagcgcgtgcgacatccgggactacgtgcttcaagggccctcccaggaggctaatagcgaagccttttcttctcttgagtttcactcattcccgtactcttccgatgtcgacccagatacgtctaatctcaatatcgagcaaaataactcctggacggcggaaaacttctggctagaccccgcggtcaaaggacagtctgagaaagaagaggatgacggtctaagaaaatcgctggatagattttatgagatgttcggacacccacagccgggatctgctaacagcctgtcagccagcgtgtgtaaatgcttgtctcagaaaataacccagctccgcggtcaggagtcacaaaaatacgcacttcggcagcagaacgtcatgaaagatttgtag

SEQ ID NO: 27938 - DNA, 189 bp, Artificial Sequence
  Description of Artificial Sequence: Synthetic coding sequence
atggcagctcgagacgcaacatctggcagtctgagcgaggagtcatctgctcttgatctgccgagtgcctgtgacatccgggattatgtgctgcaagggccttcccaggaagcaaactccgaggctttcagttcacttgaatttcacagctttccatattcctccgatgtggaccccgccgatttgtag

SEQ ID NO: 27939 - DNA, 603 bp, Artificial Sequence
  Description of Artificial Sequence: Synthetic coding sequence
atggagagccactcctgtagcccttcttggtccaccatgactattagcgcccactgtaatctgcgcctgccatccgcctcacagagcgtgggaataacaggagtgagccatcacatctggcccaggatcttctacatgactatggcagcgagggacgcgactagtggctccctcagtgaggagagttcggccctggacctgccatccgcttgcgacatccgggactacgtgctacagggaccgagccaagaagcaaacagcgaggcattttcctccttagagttccactcctttccatactcctcagatgtggaccctgacacttcaaatctcaatatcgaacagaataattcttggactgctgagaacttttggttggaccctgcagtgaaaggtcagtcagagaaggaagaagacgatgggttaagaaagagcctggacaggttctatgagatgttcggccaccctcagcccggatcagctaactctttgtcagcctccgtttgtaagtgcctctctcaaaagattacccaactgcggggccaagagagccagaaatatgcactgcgctccttccagatggcgagggtcatattcaactag

SEQ ID NO: 27940 - DNA, 366 bp, Artificial Sequence
  Description of Artificial Sequence: Synthetic coding sequence
atggcagccagggacgcaaccagcgggagtctgagcgaagaaagttcagccctggatctaccatccgcctgcgatatcagagattatgtactccaggggccgagccaggaggctaattcagaagccttttcctcccttgagttccattcgtttccgtatagctctgatgtggaccccgacacatcaaatctaaacatagaacagaacaattcatggaccgccgagaacttttggctggaccccgcagtcaagggccagtcggagaaggaagaagacgacggcctccgcaagagtctcgaccgattttacgagatgtttggtcacccacagcccggatcagccaactccctgtcggcaagtgtgtag

SEQ ID NO: 27941 - DNA, 321 bp, Artificial Sequence
  Description of Artificial Sequence: Synthetic coding sequence
atggaggtttgcagttgctgccctggatggtctgcaactgtgtctgctcactgcaacctgcgtttcgcatcttcgacttctcagtccgctggaataactggtatgagtcagtgtgcttggccgacctttaccttcctgaccatggctgcgcgggacgccacatcagggtctctgagcgaggagtcgtctgcgctcgacctaccgtcagcatgtgatattagagactatgtgctgcagggccccagtcaggaagctaactccgaagctttttcttctcttgagttccacagcttcccgtactcctcggacgtcgacccgtag

SEQ ID NO: 27942 - DNA, 381 bp, Artificial Sequence
  Description of Artificial Sequence: Synthetic coding sequence
atggtagccctattccagcatagcccctattggcaggccgacggttacggacattcacaccggttaaagtgccagcactttaagcagcaccggcaatataatgacaagctggagattagctctaatctagggccacagtttaacgcattgctcaacatcctgctgaacattgttcatccgacactctcccacgatacaagaaggtcaaaggggcttaagatagaaggtctgctacagtctcgggagctcgggaattcatggaccgtgaccatgtgcatatgggtattgaaggcccttcagtcgagcgcgccaaacaagccactggactggttagatcctatgccctgctttcagaacctgctcgcccgtggcaccccctag

SEQ ID NO: 27943 - DNA, 723 bp, Artificial Sequence
  Description of Artificial Sequence: Synthetic coding sequence
atgcctcctcctgccaaggagggaggccggaaaggccctagggagcgctccggcaaaagtgctcctggtacagcacaaggcgaggagagagccaaaggtgcacctgctactgaaccccctaagcctgggtgggccctcacaccacaaggactcgcagctatgctccccgcccagcgccaccgccacctgctctttggagacctgttagaagacgtgggcgccgccgcctcaacctttccgtgtgggtctgtcgagccaggatatcggatgccggatcccagaccatggactcagtccttggaactgcccgctgaaagacagaaccgattgctgggggtattgaaggctgctgaggcccgtggaagagtgcgagcgttgcggctacgttacactaggatgcgcgccgaagaaattgcattgctgatacagagacagaaaagcgcccgggccgccataagactggagttgtttcttcctccgcaactgaagccagcacggatccctgaccctctggacagacaggaggtgcagacttctcctgggaggggtggggagcgcgggggcgccttgcccgcaagcgctcacgccgggccccagcccctgtctcctgcagctgaggccagaggagatcatcctgggggcgagaggggctggcatcatctcccagccgtgacggccacagaaagtgtgaggcgcgcccccgcctcccacattaagctgtag

SEQ ID NO: 27944 - DNA, 369 bp, Artificial Sequence
  Description of Artificial Sequence: Synthetic coding sequence
atgtataagtcaaaaattccgagagcacagaaccaggtgtctgtcaaggtcactcccaaaaacacagaaatgaaaatcgccgaggagcctagcccctccctgggacagactttagaatggctgagaaaggaactgtcagagatgcagatccaggatcagtcacttctgttgacgcttaggcacctccatagtgttctcgaggaactgcgcgctgattccgcccactgggaagatgcaaggtcatccggtgggacaagtcctatcagagctagagccgggagcgaggggagaggctgccagccagtctgttcccggggtttggctcagttgctgcggggggaagactcacgtcgcagttcattgccctag

SEQ ID NO: 27945 - DNA, 3714 bp, Artificial Sequence
  Description of Artificial Sequence: Synthetic coding sequence
atgtccgtgctgacatcaccccgggggaaagtggaagttgttcactgcagacggaccgaatcccaggacgtatactgcattaagagcctgatccggaagttcacgtgtaagctatttggcaaattaaatattatctatttgttagagaaggcaaatctggctgtaactttgtgcaatgacaaggaggagataatggctcaggccaccttcctagactaccccaattggaatgtcgccaagcaggatgactgggtgagtgttttcagggagctagattcagatatcccttgcactccactcaatacgctgttcatgcatctgtttgtggcggttgacgagtatagtgtgggctgctgcaaggagatcctgcgtacagtttacaaggcggtgccggagttacacttcattttcctgattgtgccctcatacatgagcctgggaagtacactgattacagtgtttgatcaggttggcaatattccctgtctgacctacgaggaggacttcgcagtccacatctgtcaccgccactcccactacccccagctccacgtgagaaaagcccgggtagaggatcatgatgatctgatgcctatctttatgaggtacgataccatcttgaaagagacttacggggaatatttcctggctgaacttatagaggcgcaggatgaggagaaccacgccgtggtctgcgaagtcgaggggactgccgtcggattcatgagcgtgtgcagtagagttaatatgcaactgttgcacgaatgctttgatctgggcccgttccacgggctctgcttcccacatcctgacgacgtgctagaatccccccaagatttaagtgtccggcggagccaggacgccgaattgaggtccagctcccagggaagtcaaaagatagtggaggagttgcaggaacccgtgtccccagataccatggagaatattcagggaaatatcgctcgcgaggccgccagtgaagaagcactgacggctgtccaatccggcaatgtcagtgagccggaggacatcgaaaaactcagcgacatctccacaggctatgcccagtatcatcacgtttcttcccgctccttagcatctctcgtgctgccggaggaacccgtccatttccgtcccatctaccggggtgccagtgcagcattctgtatccaattattttgcatcgacgaaaagtacgaggcccgcagcctagattttatgaactttgtcttttccctgttctccgacaaaaacttttgcgtcatttctttaccgcatctcacaccggaatttttcctcattcagaacttcgttaagatggtcccctttaacacttgtaccctggagcaggacctgtacgtgtttcatcgtgctggtctcctgaagagcatcaatattcggttcgctactctgctagacactcctggggtggaaaatctcgtatcgacactcatgctcaataagagcatcctcgaggatctagaccgctacaataaggcacggaaagaccccgatggaaccttactgcaggccttcgtagccgaggtagcagaacagatcgtgggaatagctgtcatcagaaacgagatggatattgaatacatcagatctcactacaacattgaagattttatttatttcagtcaccatcaaagagaagagcacggacacatgcatcatttcgctctgaaccccatcttccgacattatacgaaattcttcctgaaggagattctgcggctggggttcaaatcttgcctttattacagggtttaccctaaatcacgagagggcaaatttcagaacccctatgcgcactccctgacctctgccttacactatctagtgccagtcagaccacggagacagatcgtttacccacttgagaaactcggcataaacgccccttccaaagctgtgtccaaggacccaatgagttatgccctcaatcacacaaataggaaattgactctggaacctaagattacagtgaatgccaaaatcattgtagttggggcgtcttcagtaggtattagcttcctagaaacgctcgtgttctgtagccatatgaagttcaataacctgactttgatttctacacacggacttccgggcaaaaaactgctggacactgagcagaggaagtttctggcttccgaccattgtttcaatgacaaggattacgctctgatgtccctgtgcagctgggtgaacgtagtggtcgggaggatgacgggaatcgatcgtgccgccaagcacgtggtcctgtcgacagacgaaatcgtgccgtacgaccatctaatactgtgcaccggtcagcaataccaagtgccatgcccaaccgaggcagatatatcccaacatctgacgaaccgagaagtgcctaactcttcccagcggcgttacacaggcaaagtgccatgtaatcatttcaccctgaatgaggaagaggactgttttaaagcacttatctggattcggaacaacagcatcaccaccgaaggcaatattatcgtgtacggaaacactatagatacttacacgaccgtggagacactgctgaacctgggcgtttctggttcgcgcatccacctggtgcagccaccacctgcctccactatcacctgtatcaataactactcagttgaaagcgccgtggcagatgctttgggggctgcaggagtgacaatgtacagagatgcaatcctcgcccagtggaatgatgggttgcatcccgaccccatctactcagcctcctttactaccccaacaaagcctttcagacttcagtgttccatgttcttctctttttgtgaaaaaaacgtggattatgaaacgttcaaggccctgaacgatgcctgcttggtgtatgattctaggctggtaattgatactaacttccacacaaacgatattgcaattcgagcggctggatcgcttaccaaattctcaaatagatactattccaatgaatggacacactccaatttttcttcaaaagaaatcggattccagctggctgctgcaatgctgcacctgttcgacccaaccttggagcctgtgactgaaccccctgccaatctcgatcgcttaatccctatgtataaaggagcgaaaatccaaggcgggatactccccggctcttaccactatctacatatcgcaaagcccgccattcccactcccctggaggtacagatggctcagcccaattatggactagagttagtcacaggcagtgcgaagaatggaacttactttcgtatccacataaacaagtacaaaatggttgagacaatcacatgcttgtccagggaaccctttcctgcttccaactacatccgattattcgggcaacacgagcaacttctgaacaacctctgtgccagatacgacgagaacctgatcacagatctatatagctattttacagagccgtggtgtctggctctattccatgatcgattcatagatcttagaaaagagctccggcagatactggcttcgaaggaagaggaggacctgccgagcatagagcagctggcgcaccagattgaggatgaggaaataaaccctacggagaagcctcgccagtatctgaagcgcgtgtttgaggagagcatatacaagaccttagtggagaggagcacccttgattaccttcactataatcgataccacctcccaatgtatgcatggcccggcatcgtgtag

SEQ ID NO: 27946 - DNA, 765 bp, Artificial Sequence
  Description of Artificial Sequence: Synthetic coding sequence
atgaacttcgtgttttccctgttctcagacaagaacttctgtgtgatttcgctgccgcacctcacgcccgagttctttctgattcagaactttgttaagatggttccctttaacacatgcaccctagaacaagatctgtatgtgttccaccgagctgggctgctcaaaagcatcaacatcagatttgctacattactggatactccaggggttgagaatctggtgtcaaccctgatgctgaacaagtcaatactggaggatctggaccgatataacaaggcgagaaaggaccccgacattgagtatataagaagtcactacaatatcgaggacttcatctactttagtcatcatcaaagggaagaacatgggcatatgcaccacttcgccctgaatcctatttttaggcattacacaaaattcttccttaaggaaatcctcagactgggttttaagtcttgtttgtactacagggtgtaccctaaatctagggagggcaagtttcagaatccttatgcacacagcctgacatccgcactgcactatctcgtacccgtcagaccccggcgacaaatcgtgtatcctttggagaagctcggtattaatgctccgtcaaaggccgtgtctaaggaccccatgtcatatgcactcaatcacactaacagaaagttgacgttagagcctaaaattactgtgaacgcaaagattatcgtggtgggggctagtagtgtcggcattagcttcctggaaacgttggtcttttag

SEQ ID NO: 27947 - DNA, 3534 bp, Artificial Sequence
  Description of Artificial Sequence: Synthetic coding sequence
atgtccgttctgacttcaccacgcggaaaggtggaggttgttcactgtcgtcgcacagaaagccaggacgtatactgcattaagagcctaatccgtaaatttacttgcaagctgttcggtaagctaaatattatctacctgctcgaaaaagcgaacctggcagtgactctctgcaacgataaggaggaaataatggctcaagccacgtttctggattatccaaattggaacgtcgccaaacaagatgactgggtttcggttttcagagagctggattcagatattccttgtactccactgaacactcttttcatgcacctctttgtcgccgtggacgagtacagcgtcggctgttgtaaagagatcttaaggacagtgtataaagccgtgcccgagctccattttatctttctgattgtcccctcttacatgtcgttaggctctacacttatcacggtgtttgatcaggttgggaatattccatgcctgacctacgaggaggactttgccgtccatatatgtcatcggcatagccattacccccagcttcacgtccggaaggctcgagtggaagaccatgatgatctgatgccgatatttatgcggtatgatacaatcctcaaagagacctacggcgagtacttcctggccgagctaatcgaggcacaggatgaagaaaaccatgccgtggtgtgcgaagtggagggaacggccgtgggttttatgtcagtgtgctcacgagtgaacatgcagttactccatgaatgttttgacctgggcccctttcacgggttgtgttttccccatcctgacgatgtgttagaaagcccacaggatctaagtgtgaggcgatcccaagatgcagagctcagatcttcctctcagggctcccagaagattgtagaggagttacaagagcccgtcagtcccgacaccatggagaatatccaggggaacattgcccgggaggccgcctcggaagaagctctgacagcagtacaatctggcaatgtcagcgaacctgagtccttagactttatgaatttcgtgttctctcttttcagtgacaaaaatttctgcgtgatcagcttgccccatctgacaccggaattttttttgatccagaatttcgtcaagatggtaccgttcaacacgtgtactttggagcaggacttgtatgtgttccaccgggctggactactgaagagtatcaacatccgattcgcgaccctgcttgacaccccgggagtagagaacctggtctctactctgatgctgaataagtctatattggaagatctggaccggtataacaaggcgcgtaaggatcccgacggcacgctcctccaggcctttgttgccgaagtagcagagcaaatcgtcggcatcgccgttatacgcaacgagatggacatagaatacatccggagccactataacatcgaggatttcatttacttttcccaccatcagagggaagagcacggccatatgcaccacttcgctctcaaccccatctttagacactatactaagttcttcttgaaggagatcctccgcctggggtttaaaagctgtctctattaccgcgtttaccctaagagccgggagggtaagttccagaacccatatgcccattcattaacctcagctctgcactatcttgttccagtgaggcccagacggcagattgtttaccctcttgagaagctggggatcaacgcaccctctaaggctgtgagcaaagacccaatgtcctacgcactcaatcacacaaatagaaaactgactctcgagccaaagataactgtgaatgccaaaatcatagttgttggggcatccagcgtcgggatcagtttccttgagacactggtattctgcagccatatgaagttcaataacctgacactgatttccacgcacgggctgcccggcaaaaaattgctggatacagagcagagaaagtttctggcgtctgatcattgcttcaacgacaaggactatgcgttaatgtccctgtgttcatgggtcaatgtggtagtgggccggatgacagggatagacagggctgcaaagcacgtagtcttatcaactgacgagattgtgccctatgatcacctcatactgtgcacaggccagcagtaccaggtaccttgcccgactgaggccgacatttctcagcatttgaccaatcgggaggtgcccaactccagccagagaagatacactggaaaggtgccatgtaaccacttcacgctaaatgaggaagaagactgctttaaggccctcatctggatccgcaacaactccataactaccgaaggcaacatcattgtgtacggaaacactattgatacgtacaccacagtagaaaccctgctcaacctcggagtgtccggatctagaattcacctggtccaacccccccctgcatctaccattacctgcatcaataattatagcgttgagtctgccgtcgccgatgcgctgggcgctgccggagttaccatgtaccgtgatgcaatcctggcccaatggaatgatggactgcacccagaccccatctacagtgcctccttcaccactccaactaagccattccgcctgcagtgttcaatgttcttcagcttttgcgagaagaatgtagattacgagacctttaaggctctgaatgatgcctgccttgtttatgattcaagactcgtgatcgatactaactttcacactaatgatatcgccatccgcgcagcaggctcattgacaaaattctctaacagatactactcaaacgaatggacccactctaattttagcagcaaggaaattggatttcagcttgcggcagctatgctgcacctctttgatcccacccttgaacctgtgacagaaccccccgccaatttggacagactgatcccaatgtataaaggggcaaagattcaggggggaatcttgcccggcagctaccattatctccacatcgccaaacccgccattcctacaccgctcgaggtgcagatggcccagcccaactacggcttagaattagtgaccgggtctgctaaaaacggcacctactttaggatacacataaacaagtataagatggtagagacaataacttgccttagtcgcgagcccttccccgccagcaattacattcgtctgttcgggcaacatgagcagctgctaaacaacctctgtgcccgatacgacgagaatctcattacagatttgtatagctactttaccgagccctggtgcctcgcactctttcacgacagattcatcgacctacgaaaggaattgaggcaaattcttgccagtaaggaggaagaagacctgccatccattgagcagctggctcatcagatcgaggacgaagaaattaaccctacagaaaaaccacgccagtacctcaaaagagtgttcgaagaatccatatacaaaacgctcgttgagagatccacgctagattacctgcattataatagataccacctaccaatgtatgcctggcctggtatcgtgtag

SEQ ID NO: 27948 - DNA, 603 bp, Artificial Sequence
  Description of Artificial Sequence: Synthetic coding sequence
atgtcatacgcccttaatcatactaataggaaacttactctcgagcccaagatcacagtaaacgcgaaaattattgtggtgggtgcgagctcagtaggaatttcctttctggaaaccctcgtgttctgtagtcacatgaagtttaacaatctaactctgatctctacccatgggcttccaggtaagaaattactagacaccgaacagcgaaaatttctggctagcgatcactgttttaacgataaggactacgcactgatgtctttgtgttcatgggtcaatgtggtggtgggcaggatgacagggatcgaccgggctgccaagcacgttgtgttgtcgactgatgagatcgttccatatgaccatctaatactgtgcaccgggcagcagtaccaagtcccgtgtccgacagaggccgacatatcccagcacctgaccaatagagaagttcctaacagcagtcagaggcgctacacgggaaaagtgccatgcaaccacttcaccctcaacgaggaagaagactgttttaaagcactgatttggatccggaacaactctataacaacggaagatggcggacgcgcatcagttctcttttgttag

SEQ ID NO: 27949 - DNA, 438 bp, Artificial Sequence
  Description of Artificial Sequence: Synthetic coding sequence
gggctgagagaatccctgtttcgtactcccaggtttgggtgtttttctatctttccccgacgcatccgcgtggaggtggaaggaactgccgtggggtttatgtctgtgtgcagccgagttaacatgcagctgcttcacgagtgcttcgacctggggcctttccacgggttatgcttccctcatcccgatgatgtactagaaagcccacaggatctctcggtgcgtcggagccaggatgccgaactccgaagttcctcccaaggtagtcaaaagattgtcgaggaattgcaagagcctgtgagcccagatacgatggagaacatccaaggtaatattgctagagaggcggccagcgaggaggccctcactgccgtacagagcggaaacgtcagtgagcccgaggttgccggcttttatgagttttgcttccagagctag

SEQ ID NO: 27950 - DNA, 570 bp, Artificial Sequence
  Description of Artificial Sequence: Synthetic coding sequence
atgtccgtgcttacaagcccgcgcggcaaagtggaagtggtgcactgtagaagaacagaaagccaggatgtatactgcattaaatccctgatacggaagttcacatgcaaactgtttggcaaattgaacataatttacctcctagagaaagcaaatctcgcggtaaccctgtgtaatgataaggaagagatcatggcacaggctacatttcttgattaccctaattggaacgtcgccaaacaggacgattgggtgagcgtttttagagagctggatagcgacattccatgtacacctcttaacactctgttcatgcatctattcgttgccgtagatgagtattcagttggatgctgtaaggaaatacttaggactgtgtataaggcagtgcctgaactccatttcatttttttaatcgtcccaagttatatgtcactgggctctaccctgattaccgtgttcgatcaagttggtaatatcccttgcctcacttacgaggaagattttgccgtgcatatttgccacagacatagccattaccctcagttgcatgtgcgcaaagctcggtag

SEQ ID NO: 27951 - DNA, 1413 bp, Artificial Sequence
  Description of Artificial Sequence: Synthetic coding sequence
atgagcgtgctcacgagcccaaggggaaaggtcgaggtcgttcactgtcgacgaactgagtctcaggatgtgtactgcatcaagtcgctgatccggaaattcacatgtaaactgttcgggaagctgaacatcatatacttgctggaaaaagcaaacttggctgtcacgttgtgcaacgataaagaggaaataatggcacaggctacttttctcgactatccaaattggaacgtggccaagcaggacgactgggtgtccgtcttcagggagctagacagcgacatcccatgtactccacttaacacactatttatgcatctcttcgtggcagtcgacgaatatagtgtgggatgctgtaaggaaatcttgagaacagtttacaaagcagtgcccgagctacatttcatatttttaattgttccttcttatatgtcactggggagtaccctcataacagtcttcgatcaggtaggtaatataccatgcctgacgtatgaagaggactttgccgttcatatttgtcacaggcacagccactaccctcaactgcacgtgcggaaagctagggttgaggaccatgacgatctcatgccaatctttatgcgctatgacacgatcctcaaggagacctacggtgagtattttctggcagagctgatcgaagcccaagacgaagaaaatcatgctgtggtgtgtgaggtagaaggcactgctgttggatttatgtcagtctgcagcagggtgaacatgcaactcctacacgagtgctttgatctcggacctttccatgggctctgcttcccccaccctgatgatgtgctggagagcccccaagacctgtccgtccgccggtcccaggacgcagaactgaggagctcatcccaaggcagccagaagatagtggaagaactacaagagcctgtgtcgccagacactatggagaacattcagggaaacatcgctagagaggcagcttcggaagaagctctgactgcagtgcaatcaggcaatgtgtccgaacctgaagacatcgagaaactgtcggacatcagcaccgggtatgcacagtaccaccacgtgagttccaggtcgctggcatctctagtgctcccagaggagcctgtccatttcagacctatctaccggggagctagtgctgccttctgtatccagctcttttgtattgatgaaaagtatgaggccagaagtctcgacttcatgaatttcgttttttccttgttttcagataagaatttttgtgtgatctccctcccacacctcaccccagaattcttcctgattcaaaattttgtgaaaatggttcctttcaatacatgcaccctggaacaggacctgtatgtttttcacagagccgggctgctgaaaaacatttgcctggggcggtcctcctag

SEQ ID NO: 27952 - DNA, 963 bp, Artificial Sequence
  Description of Artificial Sequence: Synthetic coding sequence
atgagttacgccctgaatcatacaaatcggaagctgaccctggaacctaagattactgtgaacgccaagattatcgtggttggagctagttctgtcggcatctcgtttctggaaaccttggtgttttgctcccatatgaaattcaataatttgaccctcatttccacgcacggtctgcccggtaagaagttgttggatactgaacaacggaaatttctggcctcagatcactgttttaacgataaagattacgcacttatgtccttgtgttcctgggtgaatgtggttgttggccgtatgaccggcatcgaccgggcagctaagcatgtcgtgttaagcacagatgaaattgtgccatacgatcacctgatcctatgtactggacaacagtatcaggtcccctgcccaaccgaagcagatatcagtcagcatctcaccaacagagaggtgcctaattcctcccaacgtcgttacaccggcaaggtgccgtgtaatcactttactttgaacgaagaagaggactgtttcaaggcactgatttggattaggaacaattctatcaccactgaggggaatatcattgtctatggcaataccatcgacacatacacaaccgtggaaaccctgctaaatctcggagtaagcggctcaagaatacatctggttcagccccccccagccagtactattacctgcattaacaactattcagtggagtcagctgtggctgacgctctcggtgcagctggcgtgacgatgtatagggacgctatcctagcccagtggaatgacggccttcatcccgaccccatctactccgcctcgttcaccacgcccaccaaaccattcagacttcagtgctcaggggccttctttcttggcctcaccatcatttgcatcctgccgtccctgccatttcagttgccgtggcgctataagtggcacagcctcattatggtgtag

SEQ ID NO: 27953 - DNA, 3612 bp, Artificial Sequence
  Description of Artificial Sequence: Synthetic coding sequence
atgagtgtgctgactagccctagggggaaggtagaggtggttcattgtaggcggactgaatctcaggacgtctactgcataaaatctctgatccgcaagttcacttgtaagctgttcggaaagctgaacatcatttatcttctggagaaggctaacttggctgtgactctttgtaatgataaagaagagattatggcccaggccacgttcttggactatcccaattggaacgtggctaagcaggacgactgggttagcgtcttccgtgagcttgattccgacatcccatgcactcctttgaataccctattcatgcacctctttgtcgctgtggatgagtacagcgtcggctgctgcaaggagatcctgcgcacagtgtacaaggcagttcccgaactacattttattttcctgatcgttccttcgtacatgtccctcggatccacgctgatcaccgtgtttgatcaagtggggaatataccttgcttgacttacgaagaggatttcgcggtccatatttgccacagacattcccattacccacagctccacgtaaggaaagccagagttgaggaccacgatgacctcatgccaatctttatgcggtacgatacaatactaaaggagacttacggcgagtactttctcgccgaactgatcgaggcgcaggacgaagaaaaccacgctgtggtatgtgaggtagaagggactgccgtggggttcatgtccgtgtgttcaagggtcaatatgcagttgttgcatgaatgctttgacctggggcctttccacgggctctgtttcccgcatccagatgacgtcctcgagtcccctcaggatctgtccgtccgacgatcacaggatgctgaactacggtcctcatcccagggaagtcaaaaaatcgtcgaagaacttcaggagcccgtctcgccggataccatggaaaatatccaggggaatatagctcgggaggcagctagcgaagaagcgctcactgccgttcagtctggcaacgttagcgagcccgaagatatcgaaaaactttccgatatctctaccgggtacgcccagtaccaccatgtgagctcaaggtccttagcttctctggtactgccggaagaacccgtgcactttaggcctatatacagaggcgcttccgcagccttctgcattcagctgttttgtattgatgagaaatatgaagctagaagcctcgactttatgaacttcgtgttctctctgttttctaatttcgttaaaatggtcccctttaatacctgtacacttgagcaggacttatatgtctttcatagagcgggtctcctaaagtctatcaatattagatttgcaacgcttctcgacacccccggagtggagaatttggttagcaccctaatgctcaacaagtccatattggaggatttggatcgctacaataaggcaagaaaagaccctgatggtacacttcttcaagcttttgtcgcagaagtagctgagcagattgtcggcatcgcggtgatccgaaatgagatggatattgagtatattcgcagtcactacaatatagaagactttatctacttttcacaccaccagcgagaggagcacggacacatgcatcactttgcgcttaaccctatcttccgacattacaccaagttcttccttaaggagattttgcgcctggggtttaagagctgtctttactacagagtctaccctaagagtagggagggaaagtttcagaatccatacgcgcacagccttacatcagcgctgcactacctcgtccccgttcgaccgcgaaggcagatagtataccccctggagaaactgggtatcaacgcacccagcaaggccgtgagtaaagaccctatgagttacgcactgaaccacaccaatagaaagctgactctcgagcccaagatcaccgtaaatgcaaagatcattgtggttggcgctagtagtgtcgggatcagtttcctggaaactcttgttttctgctcccacatgaaatttaacaatctcactctgatctctacacacggtttaccaggcaaaaaactccttgacaccgaacagagaaaatttctggcaagtgaccattgctttaacgataaggactacgcactcatgtctctctgctcatgggtcaatgttgttgtggggaggatgacaggaattgaccgcgcagcaaaacacgtggtgctctccacggacgagatcgtcccatatgatcatcttattctgtgtacaggccagcaataccaggtaccatgtccaaccgaggcagatattagtcagcacctgaccaacagggaagtgcctaattcctcccaaagaaggtataccggtaaggtcccatgcaaccatttcaccctgaatgaagaagaggattgctttaaagctctaatttggatccgtaataattctattacaacagaggggaatatcatcgtgtacggaaatactattgatacatacacaaccgtagagactcttctgaacttgggagtctccgggagccggatcaataattactccgtggaaagcgccgtcgccgatgccctgggagcagcaggcgtcactatgtaccgggatgccattctggcccagtggaacgacggtttgcacccagatcccatctactcggcctcctttacaactccgacaaagccattcagactgcagtgctcaatgttttttagtttctgcgagaaaaatgtggattacgagacctttaaggcccttaatgacgcctgtctcgtctacgacagtcgtctcgtaatcgatactaatttccataccaacgatatcgccatccgcgccgccggaagcctgactaagttttcaaacaggtattattcaaatgaatggacacacagtaacttctccagcaaggagatagggttccagcttgccgcagcaatgctgcacctgttcgaccccacgctggagcccgtgactgagccccctgctaatctcgatcgcctgattcccatgtacaagggagcgaagattcagggtgggatcctgcccgggtcttatcactacctgcacatcgctaaaccagcaatccccactccgcttgaagtgcagatggctcagcctaactatggacttgagctggttactggatccgccaaaaatggtacctatttccggatccacattaataaatacaaaatggtggaaacaataacttgcctgtcaagagagccctttcccgcctccaattacatcaggcttttcgggcaacatgaacagctgctgaataacctgtgtgctcggtacgatgaaaatttgatcaccgatctgtacagctacttcaccgaaccatggtgcctggcgctgtttcatgatcgatttattgacctccggaaggagcttcgacaaattctggccagtaaagaggaagaggatctgccttcgattgagcagttagcgcaccaaatcgaggatgaagaaataaacccaacagaaaagccccgccagtaccttaagcgagtgtttgaagaaagcatatataaaaccttagtggagcggtctactctggactacttacattataacagataccacttgccaatgtatgcctggcccggaatagtatag

SEQ ID NO: 27954 - DNA, 603 bp, Artificial Sequence
  Description of Artificial Sequence: Synthetic coding sequence
atgagctacgcattgaaccatacaaatcggaaactcaccctcgaaccaaagataactgtgaacgccaagataatagtcgtgggagctagctcagtcggtatttcattcctcgagacccttgtgttttgcagtcacatgaaatttaacaatctaactttgataagcacgcacggactgccgggcaaaaagctgttggatactgaacagagaaaatttctcgctagcgatcactgcttcaacgacaaggactacgccctgatgagtctttgctcctgggtaaacgtggtagtgggcagaatgacaggcattgatagagcagctaagcacgtggtgctctccacggatgagattgtgccttatgaccacttaatcctgtgcacagggcagcaatatcaagtgccctgtcctaccgaggccgatatttcacagcacctgaccaatagggaagttcccaattctagccagcggcggtatacggggaaagtgccctgcaatcatttcacgctcaacgaagaggaggactgcttcaaagcccttatctggatccgcaataattcaataactacagaagacggtggacgggctagtgtgctcttctgctag

SEQ ID NO: 27955 - DNA, 1413 bp, Artificial Sequence
  Description of Artificial Sequence: Synthetic coding sequence
atgagcgtcctgactagtcctcgcggcaaagtggaggtcgtacattgcagaaggacagagagccaggacgtctattgcatcaaatcactgatccgaaaattcacttgcaagttgttcgggaaactgaatattatctacctccttgagaaagctaacctcgcagtgaccctatgcaatgacaaagaggaaattatggctcaggctacttttttggactacccaaattggaacgtcgctaaacaagacgattgggtgagtgtctttcgggagctggattctgatatcccttgcacaccgctgaatacgctgttcatgcacctctttgtcgctgtggatgagtatagcgtcggatgttgcaaagagatcctgaggaccgtttacaaggccgtcccagagctgcactttatcttcctgattgtgccatcttacatgagcttgggatctacgctaattacagtctttgatcaggttgggaacattccctgcctcacgtatgaggaggacttcgctgtgcacatttgccatcgacatagtcactatcctcagctgcatgtgcgaaaagccagagtggaggatcatgacgatctgatgcctatcttcatgcggtacgatacaattctgaaggagacttacggcgaatatttcttagctgagttaatcgaagctcaagatgaggagaaccatgcggttgtctgcgaggtggaaggcaccgcagtgggatttatgtctgtgtgctcaagggtcaacatgcagctgctgcacgagtgcttcgacctcggcccctttcacgggttgtgcttccctcatccggatgacgtgctggaatcaccccaggatctgtctgtaagacggtcccaggatgcagagctccgcagctcgtcccaggggtcccaaaagattgtggaggaactgcaggaacctgtgtctcccgataccatggaaaatattcaggggaatatcgctagggaggcagcctcagaagaagctctgacagccgtgcagagtggcaacgtgtctgaacctgaagatatagaaaaactgtcagacatttcaacaggctatgctcagtatcatcatgtgtcctcccgctccttggcgtcactggtgctgccagaggaacccgttcattttagacctatttataggggggccagtgccgccttttgcatccagctattctgcatagatgagaagtacgaggccaggagtcttgacttcatgaatttcgtttttagcctgtttagcgataaaaatttttgcgtcatctcactgccccacctgactcccgagttttttctcatacagaatttcgtgaagatggttccgttcaatacttgcactctggaacaggacctctacgtctttcatcgtgccggactgctgaagaatatctgtctgggaaggtccagttag

SEQ ID NO: 27956 - DNA, 408 bp, Artificial Sequence
  Description of Artificial Sequence: Synthetic coding sequence
atgtctgtcctgacaagccccagaggcaaggtagaggtggtgcattgccgccggactgagtcacaggacgtctattgcatcaaaagcctgatccggaagtttacttgcaaattgtttgggaaactgaatataatttacctgttggagaaggcaaatttagccgtcacattatgcaatgataaggaagagattatggctcaggccacattcctggattatccgaactggaatgtggccaagcaagacgattgggtgagtgtcttcagagaactggactcagatattccctgcacccccttgaacaccctgtttatgcacctcttcgtggcggtcgacgaatatagtgtgggttgttgcaaggaaattcttaggaccgtctacaaggcagtgccagaattgcacttctag

SEQ ID NO: 27957 - DNA, 1467 bp, Artificial Sequence
  Description of Artificial Sequence: Synthetic coding sequence
atggagccctttctccggcgaaggctcgctttcctatcctttttttgggataagatatggcccgccggtggagaacctgaccacggaacccccggctcccttgacccgaataccgacccagttccaacgctgccagccgaaccttgctctccatttccccagcttttcctggccctgtacgactttactgcgcgctgcggaggtgagctgtccgtaaggaggggtgaccggctgtgtgctctcgaggagggcggggggtacatctttgccaggaggctatctggccagccttccgccggcttggttcccataacccatgtggccaaggctagtcccgagactctttcagatcagccctggtatttctcgggcgtgtccagaacccaggcgcagcagctactgctctcaccaccgaatgaacccggagcttttttgattagaccttctgagagcagtctgggagggtacagtctctcagtgagagctcaagccaaggtttgtcattaccgagtgtctatggccgctgatggttctttatacttgcagaagggtcggctttttccgggcctcgaggaactcctcacctattacaaagcaaactggaaactgatccagaacccactcctccagccgtgtatgccccagaaagccccccggcaggatgtgtgggaacggccacattcagaattcgcactaggccgtaagctgggcgagggctattttggggaggtttgggagggtctgtggttagggtccctcccggtcgccataaaggtgatcaagagcgccaacatgaaactaacggatttggctaaggagatccagacactcaaaggcctgcgtcacgagaggctgatccggcttcacgctgtatgctctgggggagagcctgtttacatcgtcactgaactgatgcgaaagggtaatctgcaagcttttctggggacgcctgaagggcgagcactccgcctcccccccctgctgggatttgcgtgccaggtggcggaagggatgtcatacctggaggaacagagagtggttcatagggacctggccgcaaggaacgttcttgtggacgacggactcgcttgtaaggtggctgatttcggattggcacgtctcttgaaagatgacatctactcacccagttcttcaagcaagattcccgtcaaatggacagctccagaggccgctaactatagagttttttcccagaagtctgacgtgtggtcctttggcgtcctgctgcatgaggtgttcacatatggccagtgcccatacgaggggatgactaaccatgagacattgcagcagattatgcgcgggtataggttgcctaggcccgcagcctgcccggctgaagtgtatgtgctcatgctggagtgctggaggagtagtcctgaagagcgccctagttttgccaccttaagagagaagcttcatgcaatccataggtgtcacccatag

SEQ ID NO: 27958 - DNA, 402 bp, Artificial Sequence
  Description of Artificial Sequence: Synthetic coding sequence
atggcagctgccaataaggggaataaaccaagagtgcgctcaatccggtttgccgccggccacgatgcagaaggcagccactcccacgtccattttgacgagaaattgcatgacagcgtggtgatggtcacccaggagtccgatagctcgtttctcgtcaaggtggggttcctcaagattttgcatcgctatgagattacgtttaccttgcctcctgtccaccggctgtcaaaggacgtgcgtgaggcccctgttccaagcctccacctgaaattgctgagcgtcgttcctgtgcccgaggaccgacaccatggaacacccatgctcctggacggcgtgaaatgtgtgggcgccgagctggaatatgacagtgagcattctgactggcacgggttcgactag

SEQ ID NO: 27959 - DNA, 525 bp, Artificial Sequence
  Description of Artificial Sequence: Synthetic coding sequence
atggccgccgcaaacaaaggcaacaagcctcgcgtcaggtctattagatttgctgccggacacgatgccgaaggctcccattcccatgtccatttcgatgaaaagctgcatgattcggtggtgatggtgactcaagaatcagactcatcttttctggtcaaagttggcttcctcaaaatcttgcacagatatgagatcacatttaccctgccacctgtgcacaggcttagcaaggacgttcgagaggccccagttccgtccctgcatttgaagctgctcagcgtggttccagtgccggaaggttattcggtgaagtgtgaatactctgctcacaaggagggagtgttgaaagaagaaattcttctcgcctgtgaaggcggaaccgggacttgcgtccgggtgactgtgcaggcacgcgtgatggacagacatcacggcactcccatgctactcgatggagtgaaatgcgtcggtgccgaattagagtacgattctgaacatagcgactggcatggattcgactag

SEQ ID NO: 27960 - DNA, 525 bp, Artificial Sequence
  Description of Artificial Sequence: Synthetic coding sequence
atggcggccgccaacaaggggaataaaccgcgcgtgagatctattagattcgccgccggccatgacgctgaaggttctcacagtcatgttcactttgacgagaaactgcatgactcagttgttatggttacccaggagtcagactcctcctttctggtgaaggtcggcttcttaaagatcctgcatcggtacgagattactttcactctgccccccgtgcacaggctaagtaaagatgtccgcgaagcgccagtcccctctctgcacctcaaactgctctcggtggtgccggtgccagagggctatagtgtgaaatgcgagtattcagctcacaaggaaggagttctaaaagaggaaatcctgctcgcatgtgagggaggtacaggcacttgcgtcagggtgaccgtccaggcccgcgttatggatcgtcaccacggcacccctatgctgctggacggcgtgaagtgcgttggggctgaactcgagtacgattccgagcactcagactggcacggcttcgactag

SEQ ID NO: 27961 - DNA, 384 bp, Artificial Sequence
  Description of Artificial Sequence: Synthetic coding sequence
tgaaacaaaccccgagttcgctctatccggttcgcagctggccatgatgccgaggggagccactcacacgtgcacttcgacgaaaaattgcacgactctgtggtaatggttacgcaagagtctgactccagctttctggtgaaagtgggattcctgaagatccttcaccgatatgagattaccttcaccctcccccctgtccacaggctgagtaaggacgtgagggaggcccctgtaccatccctgcacctgaaactgctatcagtcgttccggtgcccgaggatagacaccacggtacccccatgctgctcgatggggtaaagtgtgttggggcggagcttgagtatgatagcgagcactccgactggcatggatttgactag

SEQ ID NO: 27962 - DNA, 603 bp, Artificial Sequence
  Description of Artificial Sequence: Synthetic coding sequence
atggtccatgcctttttgattcacaccctgcgtgcccctaatacagaagacactgggctatgtcgggtcctttatagttgcgtgtttggcgccgaaaaatcacctgatgaccctagacctcacggcgccgagagagacagattattgcggaaggagcagattttggctgttgctcggcaggtagagtctatgtgtcggctccagcagcaggcctctgggcgaccacccatggaccttcagccacaaagttcagacgaacaggttcctctccacgaggcccctaggggcgcctttcggcttgccgctgaaaatcccttccaggaacctcggaccgtggtgtggcttggagtcctaagcctggggtttgcactcgtgctggatgcccatgagaatctgttgctcgcagaaggtactctccggctcctcacccggcttctgctggaccacctgcgcttgctggctccgtcgaccagcctcctgttaagagcagacaggattgaagggatactgaccaggtttttaccacatggccaactgctgttcctgaatgatcagtttgtgcaggggctggagaaagagttctctgccgcctggccgcggtag

SEQ ID NO: 27963 - DNA, 603 bp, Artificial Sequence
  Description of Artificial Sequence: Synthetic coding sequence
atggttcacgcctttctgatacacactctgcgagcccccaatacggaggataccggcctttgtcgtgtcctctattcatgcgtcttcggagccgaaaagtcacccgacgatccacggcctcacggcgccgaaagggaccgtcttcttcggaaggagcagatcttagcagtcgctaggcaggtggagtccatgtgtcggctccagcagcaggcatcagggcgccccccaatggacctgcagccgcagagctctgacgagcaggtgccattgcatgaggcaccacgtggcgcttttcggctggcagcagagaaccccttccaggagccgagaacggtggtatggctgggagtgctgagtctgggctttgcactggtgcttgatgctcacgaaaatttgcttttggctgagggtactctgaggttactgacccgcctgctgctcgaccatcttcgcctactggccccatctaccagcctgctactgcgtgccgaccgtatcgaggggatactgactcggtttctaccgcacggccaacttttatttctcaatgatcagttcgtgcagggcctggagaaggagtttagtgccgcatggcctcgttag

SEQ ID NO: 27964 - DNA, 180 bp, Artificial Sequence
  Description of Artificial Sequence: Synthetic coding sequence
atggttcacgcatttctgatccacaccctccgtgctcctaacacggaggacactggcctgtgcagagtactgtactcctgtgtctttggggctgagaaatcgccagacgacccccgaccccacggcgcagagagagatagactgttacggaaggaacaaatcctggcagtcgcgcgatag

SEQ ID NO: 27965 - DNA, 261 bp, Artificial Sequence
  Description of Artificial Sequence: Synthetic coding sequence
atggttcatgccttcttgatccacacactgcgcgctccgaacacggaagatacaggcctttgtcgggtgctgtatagctgcgtgtttggcgccgaaaagtcacctgatgatccccggccacatggagccgaacgcgaccgcttactgcggaaggaacagatcctagctgtggctcgccaagtagagagcatgtgtcggcttcagcagcaggcttctggaaggccacccatggacctgcagccccagagcagcgacgagtag

SEQ ID NO: 27966 - DNA, 1155 bp, Artificial Sequence
  Description of Artificial Sequence: Synthetic coding sequence
atggctgccgtgcagatggatccagaactggcaaagaggttgtttttcgaaggagctactgtagtcatattaaacatgcctaagggcacagagttcggtattgattacaattcctgggaggtaggaccaaagtttaggggagttaaaatgatccctccaggcatacatttcctccattacagctctgtcgataaggccaaccctaaggaagttggcccgaggatgggctttttcctgagcctacatcagcgtggactgactgtcttacgttggagcaccctgcgcgaagaagtggatctgagcccagcaccagaaagcgaagtcgaagctatgcgagccaatcttcaggagctcgaccagttcctcggcccctacccctacgcaactctgaagaaatggatcagccttactaactttatttcggaagccacagtagaaaagctgcagccagagaaccgacagatttgtgctttcagcgatgtgttacctgtcctgagtatgaaacacaccaaagacagggtgggccaaaacctcccacgctgtggtatcgagtgcaagagctaccaagaggggctggctcgactgccagaaatgaagcctagagccgggaccgaaataaggttttcagagttgcccactcaaatgtttccggagggggccactccagctgaaattacaaagcatagcatggacctgagttatgctctggaaactgtactgaataaacagttcccaagcagccctcaagatgttctcggagagttacagttcgccttcgtatgctttctactaggcaacgtctatgaggcttttgagcactggaagcgactgctcaacttgttgtgccgatcagaagcagccatgatgaagcaccacaccctgtatataaacttgatttctatcctctatcaccaactgggggaaattcccgctgacttttttgtagatattgtttcacaagataattttctcaccagcaccctgcaggtttttttcagtagcgcttgttccattgcagtagacgctacactgcgcaagaaagccgaaaagttccaggcacacctcaccaagaagttccgttgggactttgctgcagagcccgaagattgtgcacctgtggtagtggaacttcctgaggggatcgagatgggatag

SEQ ID NO: 27967 - DNA, 1155 bp, Artificial Sequence
  Description of Artificial Sequence: Synthetic coding sequence
atggccgcagttcaaatggaccccgaactcgctaaaaggctgttttttgagggagcgacagttgtcatactgaacatgcctaagggtacagagtttggcatcgattataatagttgggaggtgggacccaagttcaggggagttaagatgattccccccgggatccatttcttgcattacagcagtgtagacaaggctaacccgaaagaggtggggccccgtatgggtttcttcttgtcacttcatcaacgtgggttaacagtgttgcggtggtctacactgcgggaggaggtggatctgtcgccagcccccgagagcgaggtcgaggctatgcgggccaacctgcaggagttggaccagttcttgggaccttacccatacgccacactgaagaagtggatctctctcacaaatttcattagcgaggcgacagttgagaagctgcagccagagaatagacagatatgcgctttctcagatgtcttaccggtactcagcatgaagcacactaaagatcgggtcggacaaaacctgcctcggtgcggcatcgaatgtaagagctatcaggagggactcgcaaggctgccggaaatgaaaccccgggcagggaccgagatccgtttcagtgagctccctacacagatgttcccagagggcgcaacgcctgccgaaatcaccaaacactctatggatctctcctacgccctagagactgtgttgaataagcaatttccttcatccccccaggacgtactgggagaattacagtttgcatttgtctgctttctgctgggcaatgtctatgaggcgttcgagcactggaagcgtctgctgaatctgttgtgccggagcgaggctgctatgatgaaacaccatactctgtatataaatctgatttccatcctgtatcaccagttgggggaaattcctgccgattttttcgtagatatcgtctcccaggacaacttcttaacatctacactgcaggtgttcttttcctctgcctgctcaatcgctgtcgatgccaccctccggaaaaaggccgagaagtttcaggctcacttgactaaaaagttccgttgggatttcgctgccgagcctgaagattgcgcccccgttgtcgttgaactgccagaggggatagagatggggtag

SEQ ID NO: 27968 - DNA, 921 bp, Artificial Sequence
  Description of Artificial Sequence: Synthetic coding sequence
atgggatgcgacggagggacaattccgaaacgccacgagcttgtgaagggacctaagaaggtcgaaaaggtagacaaagatgccgaattggtggctcagtggaactactgtacgctctcgcaagaaatccttagaaggccaattgtggcatgcgaacttggcaggctgtataataaggatgcggtgatcgagttccttcttgacaagtcagccgaaaaggcactcggcaaagctgcttcgcacatcaaatctattaagaacgtgacagagctaaagctcagcgacaatccggcgtgggagggagacaagggcaataccaaaggtgataaacacgatgatcttcaacgcgctcggttcatttgtcctgtcgtcggcctggagatgaatgggcggcaccggttttgttttctaagatgctgcgggtgtgtcttcagcgagagggccctgaaggaaataaaagccgaggtctgtcacacctgcggagcggcatttcaggaggacgatgtgatcatgttaaacggcaccaaggaggatgtggatgtgttgaaaaccaggatggaggaacggcggcttcgggcgaaacttgagaagaaaaccaagaagccaaaagccgccgagtcagtctcaaagccggacgtgtctgaagaggcccctggcccttctaaagtaaaaactgggaaaccggaggaagcgtccttggactcacgcgaaaaaaagacaaacctggcccctaaatctactgcgatgaacgaatcctcttcaggaaaagcgggcaaaccgccgtgtggcgccactaagaggtctattgcggactccgaagagtccgaggcttataagagtctgttcacaactcactccagtgctaagagatctaaagaggagtcagcacactgggttacacacacatcttattgtttctag

SEQ ID NO: 27969 - DNA, 1011 bp, Artificial Sequence
  Description of Artificial Sequence: Synthetic coding sequence
atgggctgcgacggaggaacaatccccaagcgtcacgagctcgttaaaggcccaaaaaaagtagagaagatctggcaccttaaaaatggcaaggaatggtgctctctgcattctgaagggaaaaacaagaacggaaaggagtgggacatggagtatgacgtggacaaggacgccgaactggtcgcccaatggaattattgtacattatcccaggagatcctgcggagacctatcgttgcctgtgagttggggagattgtataacaaggatgcagtgattgagtttctgctcgataagtcggcagagaaagccttaggcaaagccgcctcccacattaagtccataaaaaacgtcacagaactgaaactcagcgataaccctgcatgggagggggacaagggcaataccaagggcgacaagcatgatgacttacagcgagctcggttcatctgccccgttgtgggcctggagatgaatggtcggcacaggttttgtttcctacgatgttgcgggtgcgttttctctgaacgcgccctcaaggaaattaaggctgaggtttgtcatacatgcggtgctgcatttcaggaggacgatgtcataatgcttaacggcaccaaggaggatgtcgatgtccttaaaaccagaatggaggagcggcgcctgcgcgcaaagttagaaaaaaagactaagaagccaaaggccgcagaatccgtgtccaagccagatgtgtccgaagaggcccctggcccatccaaagttaagaccggcaagccggaagaagcctctctcgacagtagagagaaaaaaactaatcttgcccccaaatctaccgcaatgaatgagagttcttctgggaaggcaggcaagcctccctgcggagcaactaagaggtctatcgcagacagcgaagagtcggaagcatacaaaagtctgttcacaactcactcttccgctaagcgcagcaaggaggaatctgcacattgggtcacccatacctcctattgcttctag

SEQ ID NO: 27970 - DNA, 129 bp, Artificial Sequence
  Description of Artificial Sequence: Synthetic coding sequence
atgggctgtgacgggggcacaataccgaaaaggcacgaattagtcaaagggcctaagaaggtggagaaggccattattgggggcctgcttgatggagcatggtccccggagacaccttcccaggattag

SEQ ID NO: 27971 - DNA, 456 bp, Artificial Sequence
  Description of Artificial Sequence: Synthetic coding sequence
atgttccaagtgtttaagcctcacgccggggaggattacaagtatccaagggagacagagaccatctggtctcacccatacgtggtcgagggctctcacaagtcgccgctcgaatcacttagtctgcacggttgcctcgccgctatggccccatcaatcacttcaagcgaagatagcagtccatctcagcgggataagaaagatctttccctggacttactgctgacccgcaagaagcgaagccagggactccactggtctcactggcagggccttaaccatatgtcaatccgcatccatactcctgagcagggaagccctagcctggggcagaattggtcgtggggcaacagaaaagagaagggcgtcgcacagcggcaggtccctaccacaggcacacacagtttttttcattgtacttcagaaggtaataaagagaagccgcatcacttttag

SEQ ID NO: 27972 - DNA, 471 bp, Artificial Sequence
  Description of Artificial Sequence: Synthetic coding sequence
atgtggaagaggtcagatcaccagcctaagatcaaggcagaagatggcccattggtcgggcagttcgaggtgcttggcagtgtgcctgagcccgccatgccgcatcccctcgaactatcagaattcgagagctttcctgtgtttcaggatatcagactacatatcagggaagtcggcgcacagctggttaagaaggtgaatgccgtttttcagttagacatcacaaaaaatgggaagacaatccttagatggacaattgatctcaaaaacggaagcggcgacatgtaccccgggcccgctcggctgcctgctgacaccgtgtttacgatcccagagagtgtgtttatggagttagtgttgggaaaaatgaaccctcagaaagccttcctagcagggaaattcaaagtctctggtaaggtgctgttaagctggaaactcgagcgggtattcaaagattgggccaagttttag

SEQ ID NO: 27973 - DNA, 414 bp, Artificial Sequence
  Description of Artificial Sequence: Synthetic coding sequence
atggcgcagaaaccactgtctacggccgcagccgagcggatgaatctcgtgggccaggacgagatttggaagtacaggttgaaagctgagtccgaggctcggcagaattggccccagaattggggattcctcactacgccttttgaggaactgatcaaatgtgaggaggacctccccactcccaaacccaaaattgagcttcccgaaagattccgcattcgtccagtcacccctgtggagaagtatattaaagtgtttccgtctcctcccgttcctcagacaacccaagggttcatcgggtggagatctgctgtgcccggactaaataaatgcctcgaactggatgatgccatcagatcctgtaaaggcgcctttgctcgggaactatgctggcccaagcagggtgtacactag

SEQ ID NO: 27974 - DNA, 1227 bp, Artificial Sequence
  Description of Artificial Sequence: Synthetic coding sequence
atggcctcaaagaagttcgccgtgaaatgcggtaactttgccgtgctggtagacttgcacatcctgccccagggctccaacaaagatacctcctggttttccgagcagaagaaagaggaggtctgccttttgctgaaggagactatcgactcccgagttcaggaatatctcgaggtgcgaaaacagcacaggccttccaatgccgaatttacccgttccaatccattgagtctgaaagggtatggatttcagataaccgcttacttcctgaaacggggtatccgcctaagatgcattcggtccacccagaatgcagaactctgtgtgtttcccgatcgattcgtggtctgtgttagtcaattagctttcagccgggatctcctggcctcccagaacgaggatctgaccgaaagggtgctgcacggggtgtctgattactttgcagagtgtgctgagagttcactgcctccaagtgctaaactgcgccgaaacgctcttaaggaaattgtaaaaaggactgaaaccaaatcgagcgtgacatccaaaagccaaactcgtcgggataccgtggagactagctctgactctgtcattgccgagatagcacgccggcggaatgacggacaggccagctcctctccaccctcagagtctatgggccaggctaaagactctatcaaggcagccgaatctcattggggactgccagtgcagaaactggagaaagtgaaccagacccagccggaggacacaagcggtcagcagaagccccacccgggagagcggctgaaaacaggcctgctaagccggtcccctgtgtgtagttgtgagtcagccagtccttgtcctaagcagagccctcgcgtggccaagacccaacaaaagcggcgcaattgctccagtgctgaagactttgaccaccatgggcgggtgagcctcggctctgaccgactagttcctcgcgagattattgtcgaaaagtctaaagctgtcagagtactgcccgcaagtgagctctccgatccgggattgctactgaaacaggacctggctaaaacaacctcaaaggaagagctgcatgttcttgaatcactctcttccaggcatcttatgaagaataatcctgggcaggctcagcagaccggcctggcaaccaatacagaacgactgagtacaattcagaacagccctacgaaaaaacggaagaaatacgaaagaggccattag

SEQ ID NO: 27975 - DNA, 1092 bp, Artificial Sequence
  Description of Artificial Sequence: Synthetic coding sequence
atggcacacgtgttacagaagcctaagcactccggtacccacagcattgtccaggagttccaagtgcccgactacgtgccatggcagcaaagtaagcaagaaactaaaccatccacactacctcctgtgcaacaagccaactccctccacacctcgaaaatgaagaccctaacccgcgttcaaccagtatttcacttcaagcctacaacagtggtgacatcttgtcagccgaaaaacccaagagagctgcacagacgccgtaagttggatccgggcaaaatgcacgcgaaaatttggttgatgaaaactagcttgagaagtggcagagctgcgctccgggaactgcgcagccgggaaaacttccttagtaagctgaacagggaactgattgagactatccaggagatggagaactcgacaacattgcatgttagagccctacttcagcaacaggatacactcgccactatcattgacattctcgagtactcgaacaaaaagagactacagcaactgaagtcagaactgcaagagtgggaggaaaaaaagaaatgtaaaatgtcgtatttggaacagcaggcagagcagttgaatgcaaagatcgaaaaaacccaagaggaagttaattttttaagtacttacatggatcatgagtattctattaagtctgttcagatttcgacactcatgcggcagttgcaacaggttaaagatagccagcaggacgaactggatgaccttggtgagatgaggagaaaggtgctggagtctctgtcggacaaaattcagaagaagaaaaaaaaaatcctcagctctgtcgtagcagagacgcagaggccctacgaagaagccctgctccagaagatgtgggaatcacaggacttcctcaaatgcatgcaaaggttcagagaaattattgaccaattcgaggagaatatgcctgttctgcgggccgaagtagaggaattgcaggcacagaccagggaacctagggaagtgatattcgaagacgtgctgctgcgacggcctaaatgcacgcccgatatggacgtaatcctaaacattccagttgaggaacccctcccattctag

SEQ ID NO: 27976 - DNA, 987 bp, Artificial Sequence
  Description of Artificial Sequence: Synthetic coding sequence
atggaagtgctcagtctgcccaacagcttccaaacacaagcgctgtgggactcgttacacagccccggtgtcccaggcagcgttttccacttcaaaccaaccaccgtagtgacctcttgtcagcctaaaaacccccgtgaacttcacaggcggcggaagctcgatcctggaaagatgcacgcgaagatctggctgatgaaaacatcactccggagcgggagggccgcgctgcgggaactacgatctagggaaaatttcttatccaagttaaaccgggaactgatcgagactatccaagagatggaaaatagtactactctccacgtacgggctcttttacaacagcaggatacactagcgacaatcatcgacattctggaatattcaaacaagaaacgactccagcagctcaaatccgaactccaggaatgggaagaaaaaaaaaaatgtaagatgtcttatctggagcagcaggccgaacaactcaatgccaagattgagaagactcaagaggaggtgaattttctgtccacgtacatggatcacgaatattccattaagagcgtgcagatctcgacgctcatgaggcagctccagcaggtcaaagatagtcagcaagacgaattagatgatcttggagagatgcgaagaaaagtcctggagagtttgagtgacaaaatccagaagaaaaaaaagaagatcttgtcttccgtggtcgcagaaacacagcggccctacgaagaggccttgctgcagaaaatgtgggagagtcaggactttctaaaatgcatgcaaagattccgcgaaattatcgatcagttcgaagaaaacatgcccgtgctgagagccgaagtcgaagaactccaggcccagacgagagagccccgggaagtaattttcgaagacgttctactcagaagacccaagtgtacccccgacatggatgtcattttgaatatccctgtggaggagcccctgccattttag

SEQ ID NO: 27977 - DNA, 771 bp, Artificial Sequence
  Description of Artificial Sequence: Synthetic coding sequence
atgtcatacaaaatgttccatttcaagcctacaaccgttgtgacaagttgtcaacccaaaaatcctcgtgaactccaccgccggcgcaagctcgaccccggtaagatgcatgcaaaaatctggttgatgaaaacctccctgagatcaggtcgtgctgccctcagagagttgcgatctcgggaaaactttctgtccaaattgaatagagagctgattgagaccatccaggagatggaaaattccaccacattacacgtgagagccctcctgcagcagcaggatacgcttgctacaattatcgatatcctcgagtacagcaataagaagcggctccagcagctgaagagcgaactgcaagagtgggaggaaaagaagaagtgcaagatgagctacctggaacaacaggccgaacagctgaacgccaaaatagagaagacccaggaggaagtgaacttcctgagcacctacatggaccacgagtacagtataaagtcagttcagataagtactcttatgcggcaacttcaacaggtgaaggactctcaacaggacgagctggatgatctgggcgagatgaggcgcaaggtgctggaatctcttagcgacaaaattcagaaaaaaaagaaaaagatactctcttcagtagtcgcagagactcagcgcccctatgaagaggcactactccagaagatgtgggagtctcaggattttctcaaatgcatgcagagattcagagaagtgcggggacaaggtaggtggtggtccctgtag

SEQ ID NO: 27978 - DNA, 186 bp, Artificial Sequence
  Description of Artificial Sequence: Synthetic coding sequence
atgggaagagccgacactccccggcaccctccaccaccagccgctggatttggggtacatcgaggcgctttcctgatcccggtcgcgcttagggtcctgctggctggacggacaccacgccctttcacccccgggcttgctgacccacgccgactgggacctcgtcgggtgcaggcggctcaatag

SEQ ID NO: 27979 - DNA, 225 bp, Artificial Sequence
  Description of Artificial Sequence: Synthetic coding sequence
atggaacgggcccagtgtctaagaaaaggcattctgtccttcgaaagatccttagagcaacggagcttgattctatcccctagacttgaatactcgggcgctatcacagcccattgctctctcgacctgctggattccaccaatccgccggcttccgccttctgggtggtggagacaacagatactgaagatgagcgcgaaaaaaaacgggagatcactgagtag

SEQ ID NO: 27980 - DNA, 240 bp, Artificial Sequence
  Description of Artificial Sequence: Synthetic coding sequence
atgcaccatgtacgccaactgatgatgcccatatgtcccatggctctgaatagcactacgtcctcatctacaacgtttggcgccttccgtataatgacactgaatgtcgaggagtgggctactgcttggaaggtcttaattttgttggaagcggccgtggaggaggagaaaagaagtgaggaaaaaaggatcttagtttgcggcacatgcggcacccgctcctcccagaagaacttatag

SEQ ID NO: 27981 - DNA, 240 bp, Artificial Sequence
  Description of Artificial Sequence: Synthetic coding sequence
atgcatcatgtccggcagctcatgatgccaatctgcccaatggctctgaatagcacaactagttctagcaccacatttggtgcatttagaattatgacactgaacgtggaagagtgggctaccgcatggaaagtgctgattcttctagaggcagcagtggaagaagagaagcgctcagaagaaaagcgcattctggtttgcggaacctgtggaacccgcagttctcagaaaaatctgtag

SEQ ID NO: 27982 - DNA, 327 bp, Artificial Sequence
  Description of Artificial Sequence: Synthetic coding sequence
atgctggccaagggagctgaggagggacgctcaggggggccccggccagcgatcactctgcccggaagtctacactttacctgcgacctcaaaacatcaccctactgcctgacaagagccgagctcatggagcatttgccgcttcgcgtcgcagtgcacagtatgagtccatgccaccgatcttgcttctgtggagagctcaagcgcggccatccttggaatacccctcaggtgagcagcttccctagtagcactaccagcctttcacactcctgcacgacgtcacacttagactgttcccagcaagtggagtcggggtctaagtag

SEQ ID NO: 27983 - DNA, 327 bp, Artificial Sequence
  Description of Artificial Sequence: Synthetic coding sequence
atgctagccaagggtgccgaggaagggcgcagcggaggcccaaggcctgccatcacactgccaggtagcctgcactttacctgcgacttaaagacctccccatactgccttacacgggccgaacttatggagcacttgcccctgagagtcgctgtgcattctatgtcaccatgccaccgatcttgtttctgcggagaactgaaaagaggacatccctggaacacaccgcaggtcagcagcttcccgtcgtccaccacaagcctttctcacagctgtactacatcacacctggactgctcccagcaggttgaaagtggctcaaaatag

SEQ ID NO: 27984 - DNA, 969 bp, Artificial Sequence
  Description of Artificial Sequence: Synthetic coding sequence
atggctcgatctcgtctccccgcgaccagcctgagaaaaccgtggaagctggatagacaaaaattaccctctcctgattccgggcactcgctgttatgtggttggagtcccgggggcaaagcccgacccgccggcaacacaggcgcctgggctccggcggaacagttctttcctgcttccaatcggacaagggaaggtggcggcctatggcccccactgcctctgcagtcaagccccgccgccccaacaatgttagattctagcgcagccgagcaggtaacccggctgaccttgaagctgctgggacaaaagttagagcaagagagacaaaatgttgagggaggacccgaaggacttcacctggaacccggcaatgaagaccgaccagacgacgcattacaaaccgccttgaaacgaaggagagacctgttgcagcgactccgtgaacagcatcttctggatgagctcagtcgtgcccaggcttggtctggcccctcccgcggggcactgggcagtgctctgcctcccgaacttccccccacgggcattctgcccaccgccagccccagccccctggcacctgatccacctagaatcatcctgccaaccgtgcctcagccacccgcgaccatcatccagcagcttccccaacaacccctgatcgcccagattcctcctcctcaagccttccccacgcagcgctccggctcaataaaagaggacatggtggagctgcttctgcttcagaatgcgcaggttcatcagctggttctgcagaactggatgcttaaagcgctccctcccgcactgcaggacccaccccacgtcccccctagagtgcctagggcagcacgcccgaggcttccagccgttcaccaccatcatcatcaccaccatgctgtgtggccacctggcgctgccactgtactccaacccgccccctcactttggacccctggcccaccttag

SEQ ID NO: 27985 - DNA, 288 bp, Artificial Sequence
  Description of Artificial Sequence: Synthetic coding sequence
atgctcgattcctcagccgccgaacaggtgaccaggctcacgctcaagctgttagggcagaagctggagcaggaaagacagaacgtggaaggggggcctgaagggctccacctggagccgggaaacgaggacagaccggatgatgccctccagactgctttgaagagaagaagagacctgttgcagaggttaagagaagcaaccttaatgcacattacacttgaaggcagctcctctcatgggcacccagcccggaggggggcttgcacatggcctcggctcgcctag

SEQ ID NO: 27986 - DNA, 855 bp, Artificial Sequence
  Description of Artificial Sequence: Synthetic coding sequence
ggtaaagctcggcctgccggtaatactggtgcatgggccccagccgagcagtttttccccgcttccaacagaaccagagagggaggaggcctctggccccccctacccctccagagctcccctgccgctccaacaatgctcgactccagtgccgctgaacaggtgactagattgactctgaaactgctgggtcagaaactggagcaggaacggcagaatgtggagggagggcctgaaggactacacttggaacctggaaacgaagacagacccgatgacgccttgcagaccgccttgaaaaggcgcagagacttactacagcgcttgcgggagcagcatctgctggatgagctttctcgagcccaagcttggtcaggcccatctaggggcgctctaggctcagccttaccccccgaattgcctccaaccggtatcttgcccaccgcctctcctagtccgctagctcccgatcctccccggattattctccctactgttcctcagccccccgccactatcattcagcaacttccccagcaaccactgatcgcccaaataccgccacctcaggccttccccactcaacggtccgggagcatcaaggaagacatggtggagttgctgttgctgcagaatgcgcaagtgcaccagctcgtgctgcaaaattggatgcttaaggccctgccgcctgctctgcaggatccgccacatgtgcccccgcgcgtgccccgcgctgcgaggcctagactaccagccgtgcatcaccatcatcatcaccatcacgctgtgtggccccccggagcggcaaccgtcctgcagcccgcccctagcctttggacccccggcccaccctag

SEQ ID NO: 27987 - DNA, 660 bp, Artificial Sequence
  Description of Artificial Sequence: Synthetic coding sequence
atggccccccctagccgccactgtcttctactcatttctacgctcggagtctttgctttaaattgttttacgaaaggccagaagaattccactctcatattcaccagggaaaacacaattaggaattgttcctgctcggccgacattagggactgcgattacagtcttgcaaatttaatgtgtaactgcaaaaccgtgttgcccctcgccgttgaaagaacttcgtacaatggccatctcactatatggtttacggacacaagcgccctggggcacctgctgaatttcacactggttcaagacctgaagttatctttgtgttcgaccaataccctgcccaccgaatatctcgccatttgcggcttaaagcgtctcaggatcaatatggaagccaagcaccctttccctgaacagtcccttctgatccactccgggggggattctgactctagggaaaagccaatgtggctgcacaaaggatggcaaccttgcatgtatatctctttcctcgatatggctctgttcaatcgtgactcagccttcaagagttatagcatagagaatgtgacaagcattgccaacaattttccagatttttcctattttcggacgtttcctatgccttcaaataagtcatatgtagtaacattcatctattag

SEQ ID NO: 27988 - DNA, 660 bp, Artificial Sequence
  Description of Artificial Sequence: Synthetic coding sequence
atggcacccccaagcagacattgcctgctgctaatctccaccttgggcgttttcgcgcttaactgttttactaagggccagaagaactccacgctgatcttcacacgcgagaacacgattcgcaattgcagctgttctgcggacattagggattgcgattactcactggcaaacctgatgtgtaattgcaagacggtactgccactggcagtcgaaagaacgtcctacaatggtcacctgaccatctggttcacagacacaagtgcactgggacacctgctgaatttcacactggtccaggacctgaaactgtctctgtgttcaactaatactctccccaccgaatatttggccatttgtggtctcaaaagactgcggatcaacatggaagccaaacatccctttcccgaacagtctctacttatccacagtggaggcgacagcgactctagagagaagcccatgtggctgcacaagggatggcaaccttgcatgtatatttccttcctcgacatggcactgtttaatagagactcggctttcaaatcttactctattgagaacgtgacatccattgccaacaacttccctgacttttcctacttcaggacttttcccatgccctcaaacaagtcttatgtggttacgtttatctactag

SEQ ID NO: 27989 - DNA, 660 bp, Artificial Sequence
  Description of Artificial Sequence: Synthetic coding sequence
atggcacctcccagccgacattgtctgcttctaatttccactctgggagtgttcgccttgaactgttttactaagggccagaaaaactccactctcatcttcacaagagagaacactatacgcaattgttcctgcagcgccgacatccgggactgtgattactctctggcaaatcttatgtgcaactgtaagacagtgcttcccctggctgttgagcgcacctcctacaacggtcaccttacaatctggtttacagatacttccgctctgggccatctcctgaactttacactggtgcaggatctcaaactttccctttgcagcacaaacactctgccaactgaatatttagccatttgcggtttgaagcggctgcgaattaatatggaggctaagcaccccttcccagaacagtctctcttaatacacagcggaggcgattcggactctcgtgagaaacctatgtggctgcataagggatggcagccatgtatgtacataagcttcctggacatggccctctttaatagagattctgcctttaaatcctattccatcgagaatgtgacctccatcgcaaacaacttcccggacttttcatattttaggacttttcctatgccatccaataagagctatgtggtcactttcatttattag

SEQ ID NO: 27990 - DNA, 660 bp, Artificial Sequence
  Description of Artificial Sequence: Synthetic coding sequence
atggctccaccctcacggcactgtctgcttctcatttccactcttggagtgtttgctcttaactgttttacaaaagggcaaaaaaattccacccttatcttcactcgcgaaaatacaatcagaaactgcagctgttctgctgacatccgcgactgtgattacagcctcgccaacctgatgtgcaactgtaagacagtactacctttggcagtggagagaacaagctacaatggccacctaaccatttggtttaccgatacttccgcactgggccacctgttgaactttacactcgtccaggacctgaaactttcattgtgctccacaaacactctgcccacggagtacctggcaatctgcggtcttaagcgtcttagaataaacatggaagctaaacatcctttccccgaacaatctttgctgattcactctggcggcgatagtgattctagagaaaagcccatgtggctgcataagggctggcagccgtgcatgtatatttcctttctggacatggccctatttaacagagatagtgccttcaagtcttactcaattgagaacgtgacctctatcgctaacaatttccctgatttctcttattttagaacgttccccatgcccagtaacaaatcctacgtcgtcacgtttatctactag

SEQ ID NO: 27991 - DNA, 198 bp, Artificial Sequence
  Description of Artificial Sequence: Synthetic coding sequence
atggggaaccctcggttgcctcgactcttatgtgctctgaaattttctggctttttgagcaacattcgaggcccgctggctggagaggatggtatgggtgatactcagctggcaagggtgcgggattcagccttgaagaccccatggcgacctgctccatgccccccccccgcccattcactcgacgactggaagtag

SEQ ID NO: 27992 - DNA, 894 bp, Artificial Sequence
  Description of Artificial Sequence: Synthetic coding sequence
atgaatgaggaggaacagttcgttaacattgatctcaacgacgacaacatctgttccgtctgtaagctgggaaccgacaaggagaccctgtcgttctgccacatttgcttcgaactgaacattgagggtgtgcccaaatcagacctcctgcacacaaaaagtctgcgaggtcacaaggactgctttgagaaataccacctgattgcaaatcagggttgccctcggagtaagttgagcaagagcacttatgaagaggtgaaaaccattctcagcaagaaaataaactggattgtgcagtatgcacagaacaaagatctggacagcgattccgagtgctctaaaaatccccaacatcatctgttcaattttagacacaaacctgaagagaagctgctgcctcagtttgattcccaggtgcctaagtattcagcaaagtggatcgacggaagcgcaggcggcattagtaattgtacccagaggatcctggaacagcgggaaaacactgatttcggactgtctatgctgcaagacagtggcgcaacgctgtgccggaacagcgtgttgtggcctcacagccacaaccaggcccaaaaaaaagaggagaccatctccagccctgaagccaatgtacagacgcagcacccgcactacagccgagaagagctgaactccatgacgttgggggaggtggaacagctgaacgccaagctgcttcaacaaatccaggaggttttcgaggagcttacacaccaggtgcaggaaaaggactcactggcctctcagcttcacgtgcgtcatgtggctatcgaacaactgttgaagaattgctcgaaactgccatgcctccaggttggacgaacaggaatgaaatcccacctccccattaataactag

SEQ ID NO: 27993 - DNA, 891 bp, Artificial Sequence
  Description of Artificial Sequence: Synthetic coding sequence
atgaacgaggaagagcagtttgtgaacatcgacctgaacgatgacaatatctgtagcgtctgcaagctgggcactgataaggaaaccctgagtttttgtcacatttgtttcgaactgaatatcgagggggtgcccaaatctgatcttcttcatacgaaatctctccgcggccacaaggattgtttcgaaaaataccacctcatcgcaaaccagggctgccctcgttctaagttgtccaagtcaacgtatgaggaggtgaagactatcctgtcaaaaaagattaactggattgtccaatacgcgcagaacaaggatttggacagcgattccgagtgctcaaagaatccccaacatcacctttttaatttcagacataaacctgaggagaaattactgcctcaattcgactcccaggtgccaaagtattccgcgaagtggatagatgggtctgcaggagggatatccaattgtacacagcgaattctggagcaaagggaaaataccgactttgggctgtccatgttacaggactccggggccacgctgtgcagaaacagcgtgctttggccccattcacataaccaggcacaaaagaaggaggaaactatctcctcccctgaggctaatgtgcagactcagcatccgcactattcccgagaggagctgaactcaatgacactcggagaggtggagcagctcaatgcgaagctgctgcaacagattcaggtttttgaggagttaacccatcaggtgcaggagaaagacagtctggcaagccaactccacgtcagacacgttgctatcgagcagcttttaaagaactgctctaagctcccctgccttcaagtaggtcgtaccgggatgaaatcacaccttcccattaacaattag

SEQ ID NO: 27994 - DNA, 729 bp, Artificial Sequence
  Description of Artificial Sequence: Synthetic coding sequence
atgaacgaagaagaacagtttgtcaacatcgatttaaacgatgacaatatttgttctgtctgtaaactcggcaccgacaaggaaacactgtccttctgtcacatttgttttgagctaaacatcgaaggcgtgccaaaatcagaccttctccacacgaagagcttacgcggccataaggactgctttgagaaatatcacctgatcgccaaccagggatgcccgaggtcaaaactgtccaagtctacctatgaggaagttaaaacaatcctaagcaagaaaattaactggattgtgcagtacgcacagaataaagacctggatagcgattccgagtgttccaagaacccacagcaccacctgttcaacttccgccacaagcccgaggagaagcttctcccccaattcgactcacaggtccctaagtatagcgccaagtggatcgacggatctgctggcggcatttccaactgcactcaacggattttagagcagagggaaaatacagacttcgggctctctatgctccaggattctggagctaccctgtgcaggaacagtgtactgtggccccactcgcataaccaggcacagaagaaagaggagaccatctctagcccagaggccaacgtccagacccaacaccctcactacagccgggaggagctcaactctatgacgctgggtgaggtagagcagttgaacgccaaattgctccagcaaattcagtag

SEQ ID NO: 27995 - DNA, 666 bp, Artificial Sequence
  Description of Artificial Sequence: Synthetic coding sequence
atgaatgaagaggaacagttcgtcaacatcgatctgaacgatgacaacatctgttctgtgtgcaagcttggaacagacaaggagacgctttccttctgtcacatctgcttcgaactgaatatcgaaggcgtgcccaagagcgatctgctgcatacgaagtcactgaggggacataaagattgtttcgagaagtaccatcttattgctaatcaggggtgccccagatccaagctctctaagagtacatacgaggaagtgaaaacaatcctgagcaagaaaatcaactggattgttcagtatgcccagaacaaagatttagattcagattctgagtgctctaagaaccctcagcaccaccttttcaatttcagacacaagcccgaagaaaagctgctcccccagttcgattctcaagtccctaagtacagtgctaaatggatcgatgggagcgccggcggaatctctaattgcacccagagaatcctggaacagagagagaacacagactttggcctgtcgatgcttcaagactccggcgctactctgtgtcgaaactcggtcttgtggccccacagccacaatcaggctcagaagaaagaggaaaccatttcatcccctgaggcaaatgtccaaacccagcaccctcactatagcagagaagagtag

SEQ ID NO: 27996 - DNA, 723 bp, Artificial Sequence
  Description of Artificial Sequence: Synthetic coding sequence
atgcgcaccgaggctgaggccgccggacccccccttgagccaggggattttgtgcaactgccagttcctgtaattcagcagctctaccattgggattgtggcctggcctgcagcaggatggttctcaggtatctaggacagctcgacgactcggagttcgagcgcgcactgcaaaaactgcaacttacccggtctatctggaccatcgaccttgcctacctgatgcatcacttcggcgtgcgacacaggttctgcacgcagacactgggtgtcgataagggatataaaaaccagtccttttacaggaagcactttgacacagaggagactagagtcaatcaactgttcgcacaagccaaggcatgtaaggtgctcgttgaaaaatgtacagtgagcgtgaaagatattcaggctcacctggcgcaaggtcacgttgcaatagtactggtgaacagcggcgtgcttcattgcgacctttgctcttcgcccgtgaagtattgctgttttacccctagcgggcatcattgcttctgtagaaccccagattatcagggtcacttcatcgttttgagggggtacaatagagccacaggttgcatattctataataatccagcgtatgcagatcccggtatgtgtagcacgtccataagcaatttcgaagaggcgagaacaagctacggcactgatgaggatatactgttcgtatacttagactcttag

SEQ ID NO: 27997 - DNA, 384 bp, Artificial Sequence
  Description of Artificial Sequence: Synthetic coding sequence
atgagaaccgaggcagaagctgccggaccgcccttagagccaggcgactttgtgcagctgccagttcctgtaatccagcagctgtaccattgggattgcggccttgcgtgcagccgcatggtcctccgctatcttggacagttagatgacagtgagtttgagcgagcactccaaaagttacaactaactagatccatatggacgatcgatctggcctatctgatgcaccattttggtgtgaggcatcgcttttgcacgcagaccttgggcgtcgacaagggatacaaaaatcagagtttttaccgcaaacatttcgacaccgaggaaacccgtgtgaaccagctgtttgcgcaagctaaggcatgcaaagttctggttgaatag

SEQ ID NO: 27998 - DNA, 429 bp, Artificial Sequence
  Description of Artificial Sequence: Synthetic coding sequence
atgttcattaaagtaatgtttggggcgggatgctccgtcctggtgaacacatcctgtaggctggtgaacctgacagctcatctacggcagaaggcaggattgccacctgatgcgacaattgccttactcgcagaagatggaaatctggttagcttagaggaagacctgaaggagggagcatcgcgcgcacagactatggggaatagcctgttgaaggaacgtgcgatttatgtgttagtccggattatctctaaggtggctcaggaaggagaggacatggcatcaacacgctatgagagtctgctggagaatttggatgatcattaccccgagctcgctggggctaataggcagcaaccaagccgtaccccactcgccgaatctgggatagccgagaaactccaccagcaggaagggcagggacagtag

SEQ ID NO: 27999 - DNA, 429 bp, Artificial Sequence
  Description of Artificial Sequence: Synthetic coding sequence
atgtttattaaagttatgttcggcgcgggctgtagcgtgttagttaacacatcctgtaggctggtgaaccttacagctcacttgcggcagaaggctgggctcccccctgatgccaccatcgccctgctggccgaagacggcaatctggtgagcttggaggaggacctgaaggagggggccagcagagcgcagactatgggaaattctctattgaaagagcgcgccatctacgtgttagtgcgcattatctctaaagtggcccaggaaggagaggatatggcatccacacgatacgagtcccttttagaaaacctcgatgatcactaccccgagctggcaggagccaatagacagcaaccatcgcgcacaccactcgccgaatccgggatcgccgagaagctgcaccagcaggagggacaaggcccatag

SEQ ID NO: 28000 - DNA, 447 bp, Artificial Sequence
  Description of Artificial Sequence: Synthetic coding sequence
atgtttattaaggtgatgtttggggccggatgctctgtgttggttaatacatcatgccgtctggtgaatttgaccgctcacctgaggcaaaaggctggcttgccccctgatgctaccatagcgctcctggccgaggacgggaacctggtctccctcgaggaagaccttaaagaaggggcaagtcgggcacaaactatgggcaatagcttgctgaaggagcgcgcgatctatgtcctggtgcggattattaagggagaagatatggctagcaccagatatgaaagtctgctagagaacttggatgaccactaccccgaactggccgaagagctgcggcggctgagcggcctgtcatccgtcggacacaattggagaaagagaatgggcacaaggagaggaagacacgaacagagcccaacctcgaggccccggaaagggcccgattag

SEQ ID NO: 28001 - DNA, 654 bp, Artificial Sequence
  Description of Artificial Sequence: Synthetic coding sequence
atggctagccaaaagcagatggaggtagtgactaagggaaccggtttccggagacggcctaagacgattacctacactcctggtacttgtgagctgttaagagttatgatgaaggagagcaaactcacgaacattcagcagcgccacataatggatatcatgaagaggggtgatgcactgccattgcaatgttccccaaccagtagtcagcgcgtactgccaagtaagcagatcgcctcgcccatttacctgcctcccatactggcagcacgcccccacctgcggcccgccaacatgtgtcaggccaacggagcgtactcgcgagaacagttcaagccccaggcaactagagatctggagaaggagaaacaacggctgcagaacatcttcgcaacgggaaaagatatggaagaacgaaagagaaaggctccacccgcaaggcagaaagctcctgccccggaactggaccgctttgaagaactcgtgaaagaaatccaggaaagaaaggaattcctggccgacatggaggcacttggtcagggcaaacagtaccgcgggattattctagctgagatctctcaaaagctcagggaaatggaggatattgatcacagacggtctgaggaactgcgaaaaggtctggctaccacttag

SEQ ID NO: 28002 - DNA, 654 bp, Artificial Sequence
  Description of Artificial Sequence: Synthetic coding sequence
atggcaagccagaaacagatggaggtggtgacaaagggaactggattcaggcgccgaccaaaaaccattacatacacgccagggacttgcgaactgttacgggtgatgatgaaggagagtaaactgactaatatccagcagaggcacatcatggacatcatgaagcgaggagacgccctgcctcttcagtgttcacccactagttcccagcgagtcctcccctccaagcagattgcatcacccatttatctgccccctatcctcgccgccaggccacacctgagaccagccaacatgtgccaggccaatggcgcctattctagggagcagtttaagccgcaagcgacaagggacctcgaaaaagaaaaacagcgtctgcagaacattttcgctactggaaaggatatggaagagaggaagcgaaaggcgcccccagctaggcagaaggctcctgcacccgagttggatcggttcgaggagctggtgaaggagatccaagagcgaaaagaatttttggcagacatggaggccctggggcaaggcaaacagtaccgcgggataattctggcagagattagtcagaagttaagggaaatggaagatatcgaccaccgccgaagtgaagaacttaggaaggggctagccacaacctag

SEQ ID NO: 28003 - DNA, 654 bp, Artificial Sequence
  Description of Artificial Sequence: Synthetic coding sequence
atggctagtcaaaagcagatggaagtcgtgacaaagggcacaggttttaggcgacgtccaaaaaccatcacgtacaccccaggaacttgtgagttactgagagtgatgatgaaggagtcaaaattgaccaatatccagcagcgacacataatggacatcatgaaacggggcgacgcccttcccctgcagtgtagtcctacgtcgtcgcagcgggtgctcccaagtaaacagatcgctagtccaatttatctgcccccgatccttgccgcacgaccacacctgcgtccggctaacatgtgccaggctaacggcgcgtatagtagggagcagttcaaaccccaagccaccagagatctggagaaggagaagcagaggctccagaacatcttcgctactggtaaggacatggaggaaagaaaaagaaaagccccgcccgcccgtcaaaaagccccagccccagagttagaccgcttcgaggagcttgttaaagaaatccaagagcggaaagagttcctagcagatatggaggcccttggacaggggaagcagtaccgcggcatcatccttgccgaaattagccagaagctccgggaaatggaggatatagaccatcgaaggtcagaggagctcagaaagggccttgccacaacgtag

SEQ ID NO: 28004 - DNA, 489 bp, Artificial Sequence
  Description of Artificial Sequence: Synthetic coding sequence
atggctagccagaaacagatggaagtggtcaccaagggaacaggatttcgcaggcgtccgaagactattacctacacacccggcacctgcgaactactgagagtgatgatgaaggaaagtaagttaacaaatatccagcagcgccacattatggatatcatgaaaaggggggacgccctgccacttcagtgcagcccaacctcctcacagagagtcctgccaagtaaacaaattgcaagcccgatttatttacccccaatccttgccgcccgccctcatctccgtccggccaacatgtgtcaagctaacggggcttattcccgtgaacagtttaagccccaggctactcgggacctggagaaagaaaagcagagacttcagaacatatttgccaccggcaaggacatggaagaacgcaaacgcaaagccccgccagcccggcagaaagctccagccccagaacttgatcgctttgaggagctggtgtag

SEQ ID NO: 28005 - DNA, 363 bp, Artificial Sequence
  Description of Artificial Sequence: Synthetic coding sequence
atggcctcgcaaaagcagatggaagtcgtgaccaaaggtaccggttttaggagaaggccaaagacaatcacttacactcccgggacatgtgaactgcttcgcgtcatgatgaaagagagcaaactgaccaacatacagcagcgacatattatggacatcatgaagagaggagatgctctcccattacaatgctcacctacttcctcccagcgcgtgctgccgagcaaacagattgccagtcccatctacctgccacccattctggccgcgcggcctcacctgcgcccggccaatatgtgtcaagctaacggagcatactcccgcgagcagtttaagccacaggctactagggatctcgagtag

SEQ ID NO: 28006 - DNA, 417 bp, Artificial Sequence
  Description of Artificial Sequence: Synthetic coding sequence
atgccggcatcagctacagccgcctggcattgtcctcccctgtgcctgcctccactgcccgcgtccgcccctaccagccctcccaaccccgccacgcgaccagctcctgggccaggtcggcgcgcacgatgcccacagagcgcgcatccagcacccacccggggagcactcactttctgggcccccgggtcttggccacgggttctgctggttccaagatcaccaggacccgtcctgcgtgctccgcgcttaccccatccggctgctagagcaaggcgccgggcttggcacggcgctaggctgccaggtagccctgccagggcaggccgaacattccagcgaggattagttagcaactcatgggcccacgcaattttcctccccagaccacccaacgtgttggaactccaggtgtag

SEQ ID NO: 28007 - DNA, 417 bp, Artificial Sequence
  Description of Artificial Sequence: Synthetic coding sequence
atgccagcaagcgctactgctgcatggcactgcccccccctgtgtctgccaccgttacctgcctccgcaccaacatcccctcccaacccagcgactcgcccagcccccggccccgggcggagagctcggtgtcctcaaagcgcacacccagctccgacccgtggagccctgactttctgggctcctggcagttggccccgggtactgctagtgcctcgttcacctggccccgtactgcgagcccccagactcccccaccccgccgctagggcgcgtaggcgggcatggcacggggcccggttaccaggctcaccggcccgagctggtcggacattccaacggggcctggttagtaattcgtgggcacacgccatcttcctgccgcgcccccccaacgtcttggagcttcaagtctag

SEQ ID NO: 28008 - DNA, 1095 bp, Artificial Sequence
  Description of Artificial Sequence: Synthetic coding sequence
atgccacgaggacgttgccgacagcagggcccgagaatccccatctgggctgccgctaactacgccaacgctcatccctggcagcagatggataaagcctcaccaggggtcgcatacacaccactcgtcgatccatggattgaaagaccatgctgcggtgacaccgtgtgtgtgcgaactaccatggagcagaagtccaccgctagtggcacctgcggcggcaagccggcggaacggggacctctggcaggccatatgccctcatccagaccccaccgcgtggacttttgttgggtccccggctcagaccccggtaccttcgatggcagtccctggctgcttgaccggttcctggcccagcttggggactatatgtcttttcattttgagcattaccaagacaacatctcccgtgtttgtgaaattctgaggcgactgaccgggcgggcccaggcctgggccgcaccctacctggatggggatctgcctttgccagatgattatgagctcttttgccaagacctgaaggaggttgtgcaggatccaaattccttcgccgagtatcacgccgttgtaacttgcccactgcctctcgcttcttctcaattgccagtggcccctcagttacccgtcgtcagacaatatctggcccgctttctcgagggcctggctttggatatgggaactgcacctaggtccctgcctgcggccatggccacgccagcggttagtggcagcaatagtgtctccagatcagcgttatttgaacagcagcttacaaaggagtccactcccggcccgaaagaacctcctgtgttgccctcatccacatgttcgagtaaacctgggcccgtggagcctgcttctagtcaacccgaggaagcagctcctacccccgtgccccgactgtcagagtctgccaatcctcctgcacagagacctgacccagctcaccccggaggaccgaagccccaaaagacggaggaggaagtgctcgagaccgagggggatcaggaagtgagcctagggacaccacaggaagtggtggaagccccagagacccctggcgaacctccactatcccccggcttttag

SEQ ID NO: 28009 - DNA, 1095 bp, Artificial Sequence
  Description of Artificial Sequence: Synthetic coding sequence
atgccccgcggtcggtgtcgacagcaagggccgcgaataccgatctgggccgcagccaattatgccaatgctcacccttggcagcagatggataaagcgtccccaggcgttgcatacactcccctggtcgatccatggatcgaacggccttgctgtggagataccgtgtgcgtccgcaccactatggagcagaagagcactgccagcgggacctgtggaggcaaacctgcagagaggggtccactggctggccatatgccaagttctaggcctcatcgcgttgatttctgctgggtcccaggcagcgatcccggcaccttcgacggatcaccctggcttctggaccgcttccttgcgcagctaggggactacatgtctttccatttcgaacactaccaagacaatatcagcagagtgtgtgaaatcctgagacggttgacaggcagagcccaggcctgggcagctccatatttagatggagacctcccgcttccagacgattatgagttgttttgtcaggatctaaaagaggtggtccaagatccgaatagcttcgccgaataccacgctgtggtgacatgccctttgccgttggcatcatcacagctgcccgtcgccccccagctgccagtggtcagacaatacctcgctagatttctcgaaggcctcgccctcgacatggggaccgctccacggagtttgccggctgcaatggcgacaccagcggtcagcggcagcaacagtgtctcacggagtgccctgttcgagcagcagctgactaaagagtcaaccccaggcccaaaagaaccgccggttctgccgagtagcacatgtagcagtaaaccaggtccagtggaacccgcaagttctcagcccgaagaagccgcaccgacccccgttccaagactttccgaatctgccaaccccccagcacagcgacctgaccctgcgcaccccggagggcccaagcctcagaaaaccgaagaggaagtattggagaccgagggggaccaggaggtgtccttaggcaccccccaggaggttgtggaagctcctgagacgcctggtgagcctcccttgtcaccaggcttttag

SEQ ID NO: 28010 - DNA, 1095 bp, Artificial Sequence
  Description of Artificial Sequence: Synthetic coding sequence
atgcctcggggccgctgcagacagcagggcccccgcattcctatatgggccgctgctaactacgccaatgcgcatccatggcaacagatggacaaagccagcccaggcgtggcctacacccccttagtggacccttggatagaacgcccatgctgtggcgataccgtatgcgtccgcaccacaatggagcagaaaagtaccgcctccggtacttgcggcggcaaaccagccgaaaggggcccgctggctggacacatgcccagcagtcggccccatagagttgacttctgttgggtgcccggctcagatcctggcacttttgatggttctccctggctgctggatcgattcctcgctcagttgggtgactacatgtcctttcactttgagcattatcaggataatattagcagagtgtgcgagatcctgagacgcttgactggccgagcccaagcctgggccgctccatatctggatggtgatctgcctcttcctgatgattatgagctgttctgtcaggatctgaaagaagtcgtccaggaccctaattcattcgctgagtaccatgccgttgtcacttgtccccttcccctggcctcaagtcagctgccagtggccccccagcttccggttgtgaggcagtatctagcccgttttctcgaaggactggccctggacatgggaactgcccccagatcactgcctgctgctatggctactccggctgtcagcggatccaattctgtgtctaggtccgcgctgttcgagcaacagctgacaaaggagagtaccccaggcccaaaagaacccccagttttgccatcatcaacatgctccagcaagcccggacctgtggagccagcaagctcccaaccagaggaggccgcccctacccccgtccctcgtttgagtgagtccgcaaaccctcccgcacagcgcccagaccctgcacatcccggcgggcccaaaccacaaaaaacggaggaagaagtactcgagacggagggtgatcaggaggtctcgctgggcacacctcaggaggtggtggaggctcccgagacacccggcgagcccccgttgagcccgggtttttag

SEQ ID NO: 28011 - DNA, 318 bp, Artificial Sequence
  Description of Artificial Sequence: Synthetic coding sequence
atgggggagactgagggaaaaaaggacgaggctgattacaaacgactgcagacttttccccttgtcagacacagtgatatgccggaagaaatgagggttgagaccatggaactgtgcgtgactgcttgcgagaagttctcaaacaacaatgaaagcgccgccaaaatgatcaaggaaactatggacaagaaattcgggagcagctggcacgtggtgatcggcgaggggttcggcttcgaaatcacccatgaggtcaagaatcttctgtacctgtatttcggaggaaccctggccgtctgtgtgtggaaatgttcgtag

SEQ ID NO: 28012 - DNA, 843 bp, Artificial Sequence
  Description of Artificial Sequence: Synthetic coding sequence
atggagctggggcacggcgcaggaacaacaacgttcacgagagcccatttgaacgacaaagagggccagcaggatctggatccgtggaaggccgcatacagtagcctcgacacctccaaatttaaaaatcagggcctgtcctcacctcagccactgcctctgggcgcgtcggcacaagggagctcgctcggccaatgccacctaaaggagatccctcccccccctcctaccgctgccagcagggattcattaggcatggacccacaatccagaagcttgaagaatgccggcagtcgcagtagctctcgtgagaaccgcgccacgagtggcgaaggggcccagccctgtcagggcacggacgacggaccctctttgggcgcacaggatcaacgctctacacctaccaatcaaaaggggtccattattcccaacaacatccggcataagtttggttcaaatgttgtagatcaactggtgtcggaagagcaggctcagaaggcaatagatgaagtctttgagggccagaaacgggcaagttcttggccatctagaacccagaacccagtcgagattagttcagtgttttctgattattatgatcttggctacaacatgcgcagcaacctcttccggggagctgctgaagagactaagagtctgatgaaggccagctacactcctgaggtgattgagaaatcagtcagagacctggagcactggcatgggagaaaaactgatgatctaggacggtggcatcagaagaacgctatgaacctgaacctacagaaggccctggaggagaaatatggtgagaatagcaaaagtaagtccagtaaatactag

SEQ ID NO: 28013 - DNA, 588 bp, Artificial Sequence
  Description of Artificial Sequence: Synthetic coding sequence
atggacccacaaagtcgtagtttgaagaatgctggcagccggagctcctccagggagaatagagccacctccggcgagggcgctcagccatgccagggaaccgatgatggaccctcactcggtgcgcaggaccagcgcagcaccccaacgaatcagaaaggttccatcatccctaacaacattcgccataagttcggttccaacgtggttgaccagctagtaagcgaagagcaggcacagaaagccatcgacgaggtatttgagggccaaaaaagagcatcctcttggccctccagaacccagaatccagttgagatctcttctgtcttctccgattattatgacctcgggtacaacatgcgttctaatctgttcagaggggcggccgaggagactaagtcactgatgaaagcctcgtacacccccgaggtaattgagaaatccgtcagagaccttgagcactggcacggccgcaagaccgatgatctgggccgatggcatcaaaaaaacgctatgaatctgaacctgcaaaaggctctggaggagaagtacggagaaaattcaaagtcaaaaagttccaaatactag

SEQ ID NO: 28014 - DNA, 843 bp, Artificial Sequence
  Description of Artificial Sequence: Synthetic coding sequence
atggagctgggccacggagctggaacaacaacctttactcgtgcccacctgaatgataaggaaggtcagcaggatctggacccatggaaagccgcctactcaagcttggacacaagcaagttcaaaaaccaggggctgtcgtcaccccagccactccccttgggggcatcagcccaaggatccagtctaggacagtgtcacttaaaggagatacctcctccgccgccgacagccgcttcgcgcgactctctgggcatggacccccagagccggtccttgaaaaatgccggctctcgaagctctagccgagaaaacagagccacatcaggcgagggagctcaaccttgtcagggcaccgatgacggtccctccttgggagctcaggaccagaggtcaactccaaccaaccagaaaggaagtattatccctaacaatattcggcacaagtttggcagcaatgtggtggaccagcttgtgtccgaggagcaggcacaaaaggccattgatgaagtgttcgaggggcagaaacgagcgagctcttggccatctcgtacccagaatcccgtggagattagtagcgttttttccgactattacgacctcgggtacaatatgcgatccaatctctttaggggggcagcagaggagacaaaatctctaatgaaggcttcctataccccagaggtgattgagaaatccgtccgtgaccttgagcactggcacggccgcaagaccgacgacctggggcggtggcaccaaaaaaatgccatgaacctgaatcttcagaaagcactggaagagaaatacggagagaactcgaagagcaagtctagcaaatattag

SEQ ID NO: 28015 - DNA, 552 bp, Artificial Sequence
  Description of Artificial Sequence: Synthetic coding sequence
atgattgtgttccctgaaaccagccaaccaagatttctctattctctccaaaactatgccgtccgagacggcttaggcacgatcctgagagggggagccgaagaggggtcatacgataattggccgcatactcgcaaatcgtggggcccactgagccctgggcatcagcgcgaattgtggacccagcccgatccttggacagaagtgctttcagggcataagggtgatgcgggagcctgcggatgttgctgtttttgtagtcagtttatcaacgccaggtgtgctcatcctttgtgcctagcacggggactggatcgcagagcgagcgaagagatgccgattcttcaagccctgtgtcttctgcccaaggaaaatttacacgacgcaagccgtcgcgtgcatcgcggaaggggcgaagagaacgtggaatggactggggacttgcatccagcccagctggggaggggcggcaggcctgagatatgccattcattggaggctatagccctggtaacaaaagctcgacaccggaaaaccaacaccactttctag

SEQ ID NO: 28016 - DNA, 1089 bp, Artificial Sequence
  Description of Artificial Sequence: Synthetic coding sequence
atgtgtaccgtagatgtggaagggttcgatgacgtgggggagacgctgtctgacgcggtgagggatgggctcggaacgatcctacgagggggcgccgaagaaggatcgtacgataattggccccacactagaaaatcctgggggcctctgagtcccggccatcaacgagagctctggacacagccagatccatggaccgaagtcctaagcggacacaagggagatgcgggtgcttgcgggtgttgttgtttttgctcccaattcatcaacgccaggtgcgctcaccccttatgcctagcccggggtttggatcgtcgtgctagcgaagagatgccgatccttcaagcactgtgtctactccctaaagtcagcaccccttccattactgttctgtccccccaaaggagcgcagctccctccattaccgtcccttcccctcagagatccgcagcccccagcatcaccgtcccttcacctcagagatccgccccaagggcttccctctgtcctcctcacaagggccagcatccagaacaccattgtgcactgccccccaaagggcaacaccctgaacatcattgtgctttaccgaccaaggtgagcactccgtccatcaccgttccgtccccccaaagatctcctcagatgagccttagtagcgccgcccggggctctaataccgatgtcgccggcctctctgtaggcgagtggcctggctggcaactatggggagaggggcaggatggagcacagcagaggcctcacctgccctcagggggcagcggggcaggcgtggccccccaaaggttaccaaagagccgggcctgcattctctgcagtcggcatggcgcccagggcccctgggtgacgggaaggagcgttagccactctcactgtcctatccaggggttgctcgatctgcagaggcccgacctggggactgactggggtagaactaggcccttatgtacccctcaggacctgtgtggggggagacccctcccctcaacatggggtgttactatgcatctgatccattgtctatcggttagccttagtctttgcctttcactcagccactgcgtatag

SEQ ID NO: 28017 - DNA, 429 bp, Artificial Sequence
  Description of Artificial Sequence: Synthetic coding sequence
atgtgccgctgcagcctggtcctgctatccgttgaccatgaggtgccgttcagtagtttttttattggctggaggacagagggtagggcctggcgcgctgggaggcctgacatggctgatgggtctgggtggcaaccgcctcgaccctgtgaagcctatagagctgagtggaagctatgccgctccgctcgacacttcttgcatcactactatgtacatggcgagcgcccagcatgcgagcaatggcagcgggatttggctagttgcagggattgggaggagaggcgcaatgctgaagcacagcagagtctgtgcgaaagcgaacgtgcccgtgtgcgggccgcacgcaagcatattttggtctgggccccaaggcagagcccccccccggactggcacctgcccctccctcaggagaaagacgagtag

SEQ ID NO: 28018 - DNA, 318 bp, Artificial Sequence
  Description of Artificial Sequence: Synthetic coding sequence
atggccgatggttccgggtggcagcctcctaggccctgtgaggcctaccgggcagaatggaagctgtgcaggagtgcgcgacatttcttacaccactactatgtgcacggcgagaggcctgcctgcgaacagtggcagagggatctggcaagctgccgagactgggaagagcggagaaatgcagaggcacagcaatctctgtgtgagagtgagagagcacgggtgcgcgctgcgcgcaagcacatcctggtgtgggctcccagacagtctccacctcccgactggcacctgcccttacctcaggagaaggacgagtag

SEQ ID NO: 28019 - DNA, 354 bp, Artificial Sequence
  Description of Artificial Sequence: Synthetic coding sequence
atgtgtagatgttctctggtcctcctgtcagtagatcacgaagtgccgttctcttcattttttataggctggcggacagaaggccgggcttggagggctgggcgccccgacatggctgacggatcggggtggcaacctccgagaccatgtgaggcctaccgagcagagtggaaactctgccggagtgctagacattttttgcaccattattatgtgcatggtgaaagaccggcgtgtgagcagtggcaacgcgacctggcatcctgccgggattgggaggagagacgcaatgccgaagcccaggtactgtccgtggtggcgcacacatgcaatctgtcttacttgggcggctag

SEQ ID NO: 28020 - DNA, 756 bp, Artificial Sequence
  Description of Artificial Sequence: Synthetic coding sequence
atggggtccaaactgacctgttgtctcgggccgagcgggggcttaaactgcgactgttgccggccggatgtgggcccttgccatgaatgtgaaatcccagagaccgtagctgctacagcacctgcttcaactacagcaaagccagccaagctcgacctcaaggccaagaaagcacaacttatgcagtacctgtccctgcccaagactccaaaaatgctgaagatgtcaaaaggcctggatgccaggtctaaacggtggctcaagattatttggcgaagacacggaatctggcctctcgagaatatcgggcctacagaggatgttcaagcttccgcacacggaggggtggaagaaaacatgacatcagatattgaaatcccagaagcaaaacatgatcacaggccaacagaagatgtacaagtgagcgcccacgggggcgtcgaagagaatatcacatctgacatagagattagcgaagccaagcacgaccaccacttggtagaagacctgtccgagtccctatcagtgtgcctcgaggactttatgacctcggatctcagcgaaagccttagcgtcagcctggaggatttcatgacttctgggctaagcgaatcactgtcagtgtccctcgaggacttgatgactccagaaatggccaaagagcgctacgaagactacctttgctgggtgaaaatggcgagaagccgcctgaacgagccaatctcttctcaagtgctcgggctgctgaggctgtag

SEQ ID NO: 28021 - DNA, 690 bp, Artificial Sequence
  Description of Artificial Sequence: Synthetic coding sequence
atggggaacatcctgacatgttgcatcaatagccattgcggctggccccgaggaaaagacgctccttgctacgaaagtgatactgacatctacgagaccgtcgctgccgccacttctgaatccaccacagtggagcctggtaagctggatgtcggggctactgaagggcaggatctgcagcacatatcgaaccagaaaatgcctacgggccctcctgaggacaggttgagtctaaagtttttgcccagcagtgaggaggataatgatgatgccaagatcctgcctagtcctgtgcagggaagctctgaagataacttgtctctcgtgtgcctgccaagatcagaggacgacgattgcgacgatgacgatgacgacgacgctcagatactcccctctagagtgcagggcggatgttatcgtttcgactcatcaagctgctcctcagaggataacctcagtctggtttgcctacctcgctctgaggatgatgattgcgacgacgacgacgacgatgcccagatactgcctagcccagtgcaagcctgtagcgaggactctttgtttcttcggtgctcactgcgccataaggacgaagaggaagaggacgacgatgatattcatatcactgctcgcatcgagtcagacctcaccttagagagcctgagcgatgaggagattcatccgggttag

SEQ ID NO: 28022 - DNA, 480 bp, Artificial Sequence
  Description of Artificial Sequence: Synthetic coding sequence
atggaacaagactggcaacccggcgaggaggtcacccccggaccagagccttgtagtaagggccaggccccactatatcctatcgtgcacgtcactgagttgaagcacacagacccaaactttccctctaattcaaatgcggtcggtacgtcatcagggtggaacaggattgggactgggtgttctcatacctgggattggagattttcttgtacccagcaggccttattgcccctgttaggcgcctgggaatggtccatcgacacagaggcaggtgggggccgtcgcgagcagtctcagaaaccctgtagcaacggaggcccggccgctgcaggagaagggcgcgtcctccccagtccctgttttccttggtcaacatgtcaggccgcaattcacaaagtatgtaggtggcaggggtgtaccagaccagcactgctggccccctctctggccacattgaaagagcacagctacccctag

SEQ ID NO: 28023 - DNA, 480 bp, Artificial Sequence
  Description of Artificial Sequence: Synthetic coding sequence
atggaacaggattggcagccaggggaagaggttacccctggaccagagccgtgctccaaggggcaggccccactgtacccaatcgtccacgtcactgagctcaaacacacagatcctaacttcccaagcaactctaatgccgtgggcactagctctggctggaatcgcattgggacaggctgcagccacacgtgggactggagatttagctgtacgcagcaagccctcttgcctttgctgggcgcctgggaatggtccatcgacacggaggccgggggagggaggagagaacaatcacagaaaccctgcagcaatggcggaccagccgcagctggggagggacgcgtcctgccatccccctgtttcccgtggagcacatgtcaggccgcaatccacaaggtctgccgttggcagggatgtacccgcccggcgttgctggctcctagcctggctacccttaaggagcactcctatccctag

SEQ ID NO: 28024 - DNA, 669 bp, Artificial Sequence
  Description of Artificial Sequence: Synthetic coding sequence
atggccttaagcgccgagaccgagtcccatatttacagagccttgaggactgctagcggagccgccgctcatctggtggctttgggctttacgatttttgtcgccgtgctggccagaccgggatctagcctgttctcctggcacccagtcctaatgagcctggccttctccttcctcatgacagaagccttactggtgttctcccccgagtcctcattgctgcacagcttgtctcgcaaggggcgcgctagatgtcattgggtgcttcaactgttggcgttgttgtgcgccctgttgggtctgggacttgtaattcttcacaaggagcaattaggaaaagctcatctcgtaaccaggcatggtcaggcaggtttgctggctgtcctctgggcagggctgcaatgtagtggaggtgtggggttactctatccaaagcttctaccacggtggcccctggcaaagctcaaactttaccacgccacctcaggcctggtaggctatcttttaggttccgctagcttactgctcgggatgtgtagtctatggttcactgcatccgtgacaggtgcagcctggtatcttgctgttctgtgccccgttctcacatccctggtgattatgaaccaagtgtccaacgcctacctgtaccggaagcggattcagccctag

SEQ ID NO: 28025 - DNA, 387 bp, Artificial Sequence
  Description of Artificial Sequence: Synthetic coding sequence
atgacttctttgttcgcacaggaaattaggctgagtaaaaggcatgaggagatcgtgagccagcggctcatgctgctgcagcagatggagaacaagcttggcgatcaacacaccgagaaagcttctcaactccagactgtagagacagctttcaagagaaatctgagtctgctgaaagacatcgaggccgcagagaaatcgctgcagaccagaattcaccctctgccaagacccgaagtagtcagcctggagacacgctactgggcttctgttgaagaatatattcccaaatgggaacagtttttactggggagggctccctaccccttcgccgttgaaaatcaaaatgaagccgagaacaccattcagaatgaggctcagaggtag

SEQ ID NO: 28026 - DNA, 192 bp, Artificial Sequence
  Description of Artificial Sequence: Synthetic coding sequence
atgacctcactcttcgcacaggaaattagactgagcaaacgacatgaggaaatcgtaagtcaaaggctgatgctactccaacagatggagaataaattgggggaccagcacaccgagaaagcaagccagctccagactgtggaaaccgcctttaaacgcaatttatccctgctaaaggacatcgaagcttag

SEQ ID NO: 28027 - DNA, 387 bp, Artificial Sequence
  Description of Artificial Sequence: Synthetic coding sequence
atgaccagcctgtttgcccaggagattaggctgagtaaacgccacgaagagatcgtgagtcagagactcatgctgttgcagcagatggagaacaagctaggcgaccaacataccgaaaaagcatcacagttacagaccgtggaaacggcgttcaaaaggaacctttctctgttgaaagacatcgaggccgctgagaaaagtttgcagactcgcattcatcccctgccacgaccagaagttgtttctctggaaactcggtactgggcatctgtcgaagaatatattccgaagtgggaacagttcctgctgggccgagccccatacccattcgccgttgagaaccagaacgaggcagagaacacaattcagaatgaggctcaaaggtag

SEQ ID NO: 28028 - DNA, 387 bp, Artificial Sequence
  Description of Artificial Sequence: Synthetic coding sequence
atgacttctcttttcgcacaggaaattagactgtctaagcggcatgaagagattgtaagtcagcgtcttatgctgctacagcagatggagaacaagttaggagaccagcacacggagaaagcatcccagctgcagacagtcgaaactgccttcaagcggaacctaagcctcctgaaagacattgaggctgcagagaagagtctgcagacacgaatccacccactcccccgccctgaggtcgtgagtctcgagactcggtactgggcatcagtggaggaatacattccaaaatgggagcagttcctgctgggtagggccccctacccctttgccgtcgagaaccagaacgaagctgaaaataccattcaaaatgaagcccagcgttag

SEQ ID NO: 28029 - DNA, 885 bp, Artificial Sequence
  Description of Artificial Sequence: Synthetic coding sequence
atgaccaagggtgattttattgacgaggaagtggaggacatgtatctggtcgactttacccaaaagattatcgataaaaggaaagagatggaggcatctggggcccatagggactcccagaaagcaggggagggtaccactatgcgaaaaacgtttctacgagagagaagtcttttgcccaaaactccagttaagaacgggtggattacctggaccctatggggcgtgcccggcctatacgagaaggacctgcccgatctgttggagatggacaaaaacctgcagggaagactgttcatttctcttctcatgaaaaccctactgtcggaagatatgcggaaagagctgcaaagacagcagtgggaggaggaagaacgcgaggctttgaagcgcccaatgggacccgtgcattacgaagacatcagggaaaacgatggtgatgtgattggcccgttgcctcccgagcccgaagccgtacctactcccaggcctgcagcccagtctagcaaggtggaagtgatcgtgcaggagaggaaggacaccaagcctggagttcctcatatcagagagtgggatagaggaaaggaattctcttttggttactggagcaaaaggcagtctgacttaagagctgagagggatccagagtttgccccccccagcgactactttgtgggacaaaagagaaccggattttccagctcgcaggcctggtcaaggcctggccctgcccaatccgatccgggccagtgcccagaccaatctcatggcccgagcccggagcataccagtcctactcctgcacctgataacccgccacaggctcctacagtgacattcaagacactggacgatatgatctcatactataaacaggtaacttag

SEQ ID NO: 28030 - DNA, 1404 bp, Artificial Sequence
  Description of Artificial Sequence: Synthetic coding sequence
atggatcgccgcaaaaagcctctggacgttacggcatctagtttagtggatttaaaggcagagctatttcgcaagcaggaggagttcaaacaagagaagctattaaaggactccggcgtctttgggaagcctaaaactaccaataaaaagccgtccatttggtctaagcagaacgtgggggttagcaatcgcgcagagaaagatgccgaacagaaaatcgaggaacagaagactctggacaaggcgagagagaagctagaagagaaggccaagctttatgaaaagatgaccaagggggacttcattgacgaggaggtggaagacatgtatttggttgactttactcagaagattatagacaaaagaaaggagatggaggcatctggtgctcatcgggacagccaaaaagccggcgagcgtgatgacgatgaggaaaatctgccagaaggcgaaatccctcccccacaggacccaagtgaagaatgggtcgactatgtggacagtcttggcaggtcccgtcgatgcatgcgcaaggacttacccgacctattggaaatggataagaatctacaaggcaggctgtttatcagcccagccaatgagaaaactttactgtccgaggatatgcgcaaggagttacagcgtcagcaatgggaggaggaggagagggaagctctcaagaggcccatgggaccagtgcattacgaggacattcgggagaatgaggcaaggcagttaggcgtcggatattttgcgttcgcccgggacaaagagttgcgcaataaacaaatgaagaccttggaaatgctccgcgagcagactaccgatcaacgtactaagcgggaaaacatcaaggaaaagagaaaggccatactggaggccaggctagcaaagctgcgacagaaaaagatgaagaaatcaaaggagggcggaaccgaagaggaaaatcgggatggagatgtgatcggccccctgccacctgaacccgaagctgtacctacacctcgtccagccgcacaatctagtaaggtggaggtgatcgtccaggagagaaaggacaccaaacctggggtgcctcacattagagagtgggatcgcggcaaggaattctcctttggctattggagtaaaagacagagtgacctgcgcgctgaacgcgaccctgaatttgctccacctagtgactattttgtcggccagaaaaggactggattctccagctcccaggcctggtcacgacccggacccgcacaaagcgatccaggacagtgcccagatcagtcacatggacccagccccgagcacactagccccacccccgcgcccgataaccctccacaagcgcctacggtgactttcaagacccttgatgacatgatctcatattacaagcaggtgacttag

SEQ ID NO: 28031 - DNA, 426 bp, Artificial Sequence
  Description of Artificial Sequence: Synthetic coding sequence
atggactccagtgcctgcaagaagagccatcagtctaagaagtggcgaatccaggcgcaggagaactttgcaaagaagtttccctacaggttaagctggctgaccgagcctgaccctgagccacttcaaccttgggaggttacgaatgatagcaataccgttcagctcccattgcaaaagaggctggtccccacccggtccatccccgtcaggggcctgggtgcccctgattttacaagtccttctggcagttgtcctgctcccctgccggcaccctcccctccacccttgtgcaacctctgggaactgaagctgctttcccggaggttcccccgacaactggcctttttgctgtcaaccagacacacagaagctgcctgtccgcagacgtcaaaagctgcaggactatcacgggggctgtcatag

SEQ ID NO: 28032 - DNA, 534 bp, Artificial Sequence
  Description of Artificial Sequence: Synthetic coding sequence
atggcaggttatcagctttggtccccctggactcccttagacgagtcctttcagtggctacgacatacaacaccaacaccctcctccaaacaccccttcaaggcttctccatgcttcccgcatactcctagtgatttggaagtacagctctgttttcaggaagtaaccctcgtgctggattccccatttctcgaaagcggtgtcagtccaaaactcccttgccatacatcagaattgaggactatgaataataaaggcctggttaggaaacctcaacccatcaggctgtcgggcgtggactcagttttcgggcgcgtaatcaccgcccaaccccccaagtggaccggcacatttcgggtctccgacaaaagtgccttctgcaaaattatctctcgtgaacatcagtggcctatcggcctgaaagagccgcaaattcagatgacggttacaatgtgcaaacagatgttgagatccatactcctgctgtacgctacctacaagaagtgtacattcgcacttcaacactctaagtag

SEQ ID NO: 28033 - DNA, 534 bp, Artificial Sequence
  Description of Artificial Sequence: Synthetic coding sequence
atggcgggctatcagctgtggagcccttggacacctttagacgaatcctttcaatggctgcggcatacaacgcctacgccaagcagcaagcacccctttaaggcttctccatgttttccacatactccatccgatctcgaggtccaactgtgtttccaggaggtcactctcgtactggacagcccattcctggaatccggcgtctctccaaaactcccctgccacacctcagagctcagaacaatgaacaataagggactcgtgcggaagccacaaccaataaggctttcaggggtcgatagcgtgtttggacgagtaatcacggcccagccccctaaatggacgggaacctttcgtgtttcagacaaatcagctttctgtaaaattatctcacgagagcatcagtggcctatcgggctaaaagaaccccagatccaaatgacagtgacaatgtgtaagcaaatgctgagatccatattgctcttatatgcaacctacaaaaagtgtacctttgcactgcagcactccaaatag

SEQ ID NO: 28034 - DNA, 1719 bp, Artificial Sequence
  Description of Artificial Sequence: Synthetic coding sequence
atggatgatgactacgaggcctaccacagcctgttcctcagcttgctggggctgtgtcccagcaagactccaatcaacgagaacgcccctgtatttgaccccgaacctgtcatagctcattgttttaagcaatttcaacaaaaagatttcaggcttccacagacccgacgtcgtatcattatggtacctcgaaaggaggaccagactccactgaatccagctagccaaccacaggccccgcccaaacccataccatcctttaaggtcctggaagcacgtgacatccaagaacagccggaagaccggaagacatggcttagccaacgctctaagctccgtcaagagctggagtcgttcggtgatgtgaaacgctggctggaaaataagccttccataaccccttcggaggccaaagtgctacacatgatccatgaagaacagagcgcgcagcctaatgctagccaggccaccacccggaccactaggaagaaagctcctcgtctatcccgattatcaagacagatggtgccacaactccaattacctgaaccacctgccctgagcgtaatgtattcatatctccattcccggaagataaagatcctggaaatatttcacaaagtaggacagggagagaaccagcgtataacaagagaggagtttatagcagcagttaaagccgtgggtgttccgctgaaaaaccaggaggtagaggatattgtgatttatttgagctctctcggtaagcacaatactattactatggacattctcgccaatacttacaagcagtggagtatggctcaacagcggagctctctcgccaccgcgcgcgagcactacatcctggccaagcaccgggattccttgaaaggacctttaaaaaagcaggaggtggattccgcaccccagctcccaaaggtggacctgctcacggttcccgcagtggacactcagatggaaacgagaccaatgacacttgaggagatggaggaagttggcaagcgataccgcgaacggcagaggcagcacaaactgactatcccttcaattcagtatactgaacagtgccatctggtgagatgcggtaatcggcactttgatgagcactgcctcccttccacgatccacggagacatgcgcgagctcatcgatagcgcgcgacgccacaactttctggtgtatctgcagtgttggaagttgtgtaagtcttatggtctgcctctgactgaggacattctaatgaaagctctattgtatcctggtgacaaaatcatatttcagatggacaaagtttgtcctatcagacagccaggggggtactattccgattggaaggtgttctcgcccaatttggcactcttgaggagccagggtcccggcaaaagcaagagaaccgataagaaaaccccaaagaagtcaaagaagatgaggttcaaggaattcgaggaattcacaagaaagctcaaagtgaagaggagcagcggactgcagcagacacacccaaatagtttctggcctggtcacctgctggataagcttcaactatacctgcccaccgtggccacagatagaagcctggctctgttcagttgtgtgcagcaccaaccccacgtgtaccccgccacctatcaccctgaccactggtggcctctccgaaataaaaactatatgactcacgctcactacgatgcagccaaggtctattacattaattag

SEQ ID NO: 28035 - DNA, 1719 bp, Artificial Sequence
  Description of Artificial Sequence: Synthetic coding sequence
atggatgatgattacgaggcgtaccactcactgttcctgtccctcctgggcctgtgtcctagcaagactcctattaatgagaacgcacctgtgtttgacccggaacctgtgattgcgcactgtttcaagcaatttcagcagaaagatttcagacttcctcagacacgcagaaggattatcatggtgccgaggaaagaggatcaaacgccattgaatccagctagccagccccaggccccgcctaagcccatcccttcctttaaagtgttggaagcccgcgatattcaggagcagcctgaagataggaagacatggctgtcacagcgctccaaactgagacaggagctggagtcattcggcgacgttaaaaggtggctagagaataagcccagcattacccccagcgaggccaaggtgttacatatgatccacgaggaacagtcagcacagccaaatgcttcacaggctactacccgaactacccgaaagaaggcccccagactctctcgtttaagtcgccagatggtaccacagctgcagctccctgagcctcccgctctgagcgtgatgtatagttacctgcatagccgaaagattaagatcctcgagatattccataaggtcggccagggcgagaatcaacggattactagggaggaatttatcgctgccgtgaaagctgtcggggtgccattgaaaaatcaagaagtggaagacattgtcatctaccttagctccctaggaaagcacaataccatcacgatggacattcttgccaacacttacaaacagtggagcatggctcagcagcgatctagcttggccaccgcccgggagcattacatccttgccaaacaccgggattccctgaagggacctctgaagaagcaggaagtagactctgccccacagctgccaaaggtggacctgctgaccgtaccagctgttgatacacaaatggagactcggcccatgacactggaggagatggaggaagttggaaagcgctaccgagaaaggcagagacagcataaacttaccatcccctcaatacagtacaccgaacagtgccacctcgttcgctgtgggaatcggcacttcgatgaacactgcctcccttccactatccatggcgacatgagagagttgattgacagtgctcgtagacacaactttctggtctatctgcagtgttggaagctgtgtaaaagctacggattgccacttacggaggatattctgatgaaggcactgctctatcccggcgataagatcatctttcagatggataaggtctgccccatccggcagcccggcggctattatagcgattggaaggtgttcagtcccaacctagccctgctaaggagccaggggcccggcaaaagtaagcgcaccgacaaaaaaactcctaaaaaaagtaagaagatgcgttttaaggaatttgaggaattcacccgaaagctgaaggtgaagagatcctccggcttacagcagacacacccaaacagtttttggccagggcatctcttagataagcttcagctgtatctccctacagtggccaccgatcgctcactcgccctgtttagttgtgtgcagcaccagcctcacgtgtatcccgcaacctaccacccggatcattggtggcctctaaggaacaagaattacatgacacatgcccactatgacgccgctaaagtgtattacattaactag

SEQ ID NO: 28036 - DNA, 840 bp, Artificial Sequence
  Description of Artificial Sequence: Synthetic coding sequence
atggccgacgacctcggtgatgagtggtgggagaaccaacctaccggggctggtagctctccagaggccagcgacggagaaggtgagggcgatacagaggtgatgcagcaggaaacggtgcctgtacccgtacccagcgaaaagaccaagcagccaaaagaatgcttcctgatacagcctaaggagcggaaggaaaataccactaagactcggaaacgccgtaaaaaaaagattacagatgtgctggctaagtccgagcctaaacctggcctgcccgaagacctgcaaaaactaatgaaagactactatagctcccgtcgtctggttatcgagctggaagagctgaatttgcccgatagctgctttcttaaggctaacgatctaactcactccctttcctcttatctcaaagagatatgtccaaaatgggtcaagttacggaaaaaccactctgaaaagaaaagcgtgctaatgctcattatatgtagttcggcagttagggcactggaactgatccgcagtatgaccgcctttagaggtgatgggaaagtgattaagttgtttgctaaacatattaaggtccaggcgcaggtaaagctactggagaagcgcgtggttcatcttggcgttggaacccccggccgcattaaagagctcgtgaaacagggggggcttaacctctctcccctgaaattcttagtcttcgactggaactggcgggatcagaaactgcgccgcatgatggacattcccgagatcaggaaagaagtgttcgaacttttggagatgggggtcttgtccctgtgcaagtcagagtctcttaaactgggactgttctag

SEQ ID NO: 28037 - DNA, 450 bp, Artificial Sequence
  Description of Artificial Sequence: Synthetic coding sequence
atgaaggaagcgttgcatcaaatcgtggtgagatgcagcgagttggtcagtagtactagcctgccacgattgtccgtatcgcgtctccagggaccgcccgactctcagcctttgggtaccttgggtcagggaggatggaagctgctggggattgtcgggtctctggctccggaaacactaggggggctgggcactgagttcggcccctgcactcaccccttgcccttcgacatggtaagagagcgcgaacgagacgacgaactgaggcaaggctggcttctgcagtgtccacaatgcgctcgtacattgctgtgccattgcggaccgttcctgactccaccatctcagactagctcctccggttttcagttgtgcagcctgaaaccgtccgggtctctggtgacagcgacggaaccactgagcaacttcgctttcagctacttcccctag

SEQ ID NO: 28038 - DNA, 1611 bp, Artificial Sequence
  Description of Artificial Sequence: Synthetic coding sequence
atggaagagccgccacaagaggccctggcagagccactgaagcacgagtctcctgctgctcctagctctgctgggcacacgaaaggacaagaggaggatgaccaaaagaaccaggccgaaaggaaagccgacaatcataccgcccatcgaatagcagaccaaaccgccctcagggttccttcccaggctgagtcttctatcttttcacaagctacaaacggcgtggccgagcagaatgggcactccactccagggcaggctgggcggcgtgccagtaacccagccgatgtcagcgatttacgcgctgacgatcaggtgaaccaaacccctagtgaacagacgaaggggaaggccagttctcaggccaacaacgttcagcacgagcagtccgacggccaggtctccggattgacggaagagagaaccgctgagcaaactgagcggcgtttgccaacgcaggcagaaaggcgcacatccggccaaatcgacggccggttggctatgccttcagatcagcgaggcagcagacagactgaccatcgcatggctggccaatcagagaggcgagcttctgaacagatggaccgtcggatgtcaggcgaggccgagagacgcacctccgagcagatcacccaccgtctgagcaaactcagcgaacgccgcccatctgtgcaaatcgacagcgggtcctcagtccccagtgatcagtctccttccgttcagattgattctggtagttccgttccaagcgaccagcgcccaagcgtgcagattgatagaagaatgagtggcaaggtgagaagacgcagcagcgaaaagactgactataggcttgccggtctggctgatcccggaaccagcgagcaaaccgatctgagactctacggcctggtcgaccacaagacaagcgtgaagacacaccaccaggtgtacggacaggcaacggaactggccgagcatcaggccatcgaccaggcgcattccaatgcggatcagccccctgtggataacgcacattacacggaaagcgatcagacagaccacctcgccgataggcaggccaaccacaaggaccagctgagttattacgaaacccgggggcagtcagaggaccggatattccctcagttgggtaactctaaggaagataaagaggcagattacagggtgcaaccctgcaaatttgaagatagtcaggttgacctaaactcaaaaccttccgttgagatggaaactcagaatgcaacaacaattccgccctacaatcctgtggacgcccgctttacaagtaacttccaagctaaggaccaggccctttttcccaggttgccgagcatctccagcaaattaaactatacttcatctcaggagaagacacaggctatcgtgactaagtcagatgaattctcggagatagaccagggaaagggctaccacatccggaatcagacataccggcgttttcccagcattgtgtacgaggatccctatcaagtttcattacaatacatggaaaaacatcacattctacagatcttccaacagatcaccgaaaacctcgtgtatgaaaagcccgaggatcccctgaatttcatgctctgtcaggtgtag

SEQ ID NO: 28039 - DNA, 1062 bp, Artificial Sequence
  Description of Artificial Sequence: Synthetic coding sequence
atgccttcccctgtggggctgctgcgggccctgccactgccatggccccaattcctcgcttgtactctccgacgcttagccggccctagagaatcaactggaccttctcagaagccccctccattgtgctccgttccatgccgcgtgccggccatgactgaagaagtggcacgggaggccttgctcagttttgtggactccaagtgctgttattcctctaccgtggctggagacttagtgatacaggagctcaaacgtcagacattatgtcgatataggctggagacctttagcgagagcagaatatccgaatggacttttcaaccttttactaaccattctgtagatggcccacagcgtggcgctagcccaagactatgggacattaaggtgcagggtcctccgatgttccaggaggacactaggaagttccaagtgccccactcctctttagtaaaggaatgccataaatgccacggcagaggaagatacaagtgcagtggctgtcatggcgccggtacagttaggtgtccaagctgttgtggtgccaaaaggaaagcaaagcagagtagacgatgtcagctttgcgccggaagtggacggagaaggtgctctacctgcagtggcaggggaaataagacatgtgcaacctgcaaaggcgaaaagaagctactacacttcattcagctggtgattatgtggaaaaactccttatttgaatttgtgtcggagcatcgactgaattgcccacgagaactgcttgctaaggctaagggcgagaacttgttcaaagatgagaactcagttgtgtatccaatcgtcgatttcccattgcgcgatatttctctggccagccagcgtgggatcgctgaacatagcgccgcactagcatctagagcccgggttcttcagcagagacaaacaatagaactgattccactgactgaagtgcattattggtatcagggaaaaacctatgtgtactacatatatggcaccgatcatcaggtttacgctgtcgattaccccgaaaggtactgctgtggctgcaccatcgtatag

SEQ ID NO: 28040 - DNA, 1062 bp, Artificial Sequence
  Description of Artificial Sequence: Synthetic coding sequence
atgccttcccccgtgggactgcttagagctttaccactgccgtggccacagtttttagcctgcactctacgcagattagctggaccacgtgagtcgaccggcccatcccagaaaccaccaccgctgtgtagcgtgccatgtagggttcccgctatgacagaggaagtggccagggaggctcttctctcatttgttgacagtaagtgctgttactcttccacagtggccggtgacttagtgatacaagagttgaaacgccagaccctctgtcgataccggctcgaaaccttcagcgaatcaagaatttcagagtggactttccaaccctttactaatcattctgtggacgggccacaacggggcgccagtcctagactgtgggatattaaagtgcaagggcctccgatgttccaggaggatacccggaagtttcaggtgccgcatagctcgctggtgaaagagtgccacaaatgccacggaaggggccgctataaatgctctggatgtcatggtgccgggacggttaggtgtccctcctgctgtggcgctaagcgcaaagcaaaacaatctcggcgatgtcagctctgcgctgggtcgggtcgcaggaggtgttccacctgtagcggccgtggaaacaagacttgtgcaacatgtaagggcgaaaaaaagctgctgcacttcatccagctcgtgatcatgtggaagaactcgctgttcgaatttgtgtccgaacatcggctaaattgccccagagagctgctggctaaagcgaaaggagagaacctgtttaaggatgaaaattcagttgtctatcccattgtggacttcccgctacgggacatatcattagcctcccagcgcgggatcgccgagcacagtgcagcgttggcatccagggcacgtgtcctacagcagcgccagactatcgaactgataccgctcaccgaggtgcactactggtaccaaggtaagacatacgtatactatatttatggaaccgaccaccaagtgtacgccgtggattatcccgagagatattgttgcggctgtactattgtatag

SEQ ID NO: 28041 - DNA, 948 bp, Artificial Sequence
  Description of Artificial Sequence: Synthetic coding sequence
atgccttcgcccgtcgggctactgagagccctgcccttgccttggcctcagttcctggcctgcactttaaggcgtctggcgggaccccgggagagcacaggaccaagccagaaacctccacccctctgctccgttccttgtcgcgtgccggcaatgaccgaagaggttgcaagagaggccctgctttctttcgtcgattcaaaatgctgctatagcagcacggtcgcgggcgaccttgtcatccaggaattaaagaggcaaactctctgccgttataggctcgaaaccttttctgaatctcggatatccgagtggacattccaacctttcaccaatcatagtgtggatgggccacagaggggggctagtccgagactctgggacattaaggttcagggtcctcccatgttccaagaagatactcgcaaattccaggtcccccactctagcttggtcaaagaatgtcataagtgtcatggtcggggcaggtataaatgctcggggtgtcacggagccggcacagtaagatgcccttcttgctgtggcgcaaagagaaaagctaaacagtcacggcggtgtcaactgtgtgcgggtagcggtcgtcgccggtgttcaacgtgcagcggacgaggaaataagacctgtgcgacatgtaaaggagaaaaaaagctgctgcacttcatccaactggtgatcatgtggaaaaactcattgttcgagttcgtgagtgaacatcgcttgaactgcccccgggaacttctggcaaaggcaaaaggagagaatctgttcaaggatgagaactctgtcgtgtatcctatcgtggattttcctctgcgtgacatttctttggcgagtcaacggggaatcgcggagcattcagctgccctggcgtctcgggcaagggtcctgcaacaggttagccaaggcggaggcgccatctggttatag

SEQ ID NO: 28042 - DNA, 1128 bp, Artificial Sequence
  Description of Artificial Sequence: Synthetic coding sequence
atggaccgagatctgaatgaagacgatagtgttgtggacctgtccttcgaggcagagtcacctctggcaccccccaccgagctgctggagaggctgccgtcttacgactggctgctgcaaggcggacgtgggcaaatcttcttcccccctctggaagcgccaggaagaccccaggagcaaagaagctggccgagctttctggaacaccgggtgccagctatgactgaagaagttgcccgagaagccctgctgagctttgtggattctaaatgttgttactcctctactgttgctggcgacctggtgatccaggagctcaagcgtcagaccctatgtagataccggttagaaaccttcagcgaaagcaggatcagcgaatggacatttcagccctttacgaaccactcagtcgacggcccccagaggggagcctcacccaggctgtgggacatcaaggtccaggggccgccaatgttccaggaagatacacgcaagttccaggtcccccatagctccctcgtgaaggagtgccacaaatgccacggcagggggaggtacaagtgctcaggatgtcacggtgctggcacggtgcggtgccctagttgttgcggagccaagcgaaaggccaaacagtcacggagatgtcagctgtgtgccgggtctggtaggcgtcggtgtagcacatgttctggaagagggaacaaaacctgtgcaacatgtaaaggtgagaagaagctgctgcacttcatccagcttgtcatcatgtggaagaattccttgttcgagtttgtaagcgagcataggcttaattgcccgagagagctcctggccaaggctaaaggggaaaacctctttaaggacgaaaatagtgtcgtttaccctatcgtggacttcccacttcgcgatattagtctggcttcacagaggggcattgcagagcactctgccgcgctggcctcacgggctagggtcttgcagcagagacagacaatcgagctgatcccattgactgaggttcactactggtaccaaggcaaaacctacgtgtattacatctacggcacggatcaccaggtctatgccgtcgattaccccgagaggtattgttgcggttgtacgattgtatag

SEQ ID NO: 28043 - DNA, 498 bp, Artificial Sequence
  Description of Artificial Sequence: Synthetic coding sequence
atgcaggctgagacaatccttgaaggcttggaggccggattgcctcaggccgtgagttctggtctcagcctcgtccccgccccaggtctggtactgacctgcttgagcgcaccttctggcccaggtggaatggctctggagcctcctcctactacattgcggaaagccttcctagcacaatctactctactggaatcaactctggaaggggcacccgaatgggcggcgcctcacccagaagaacaacgaagatctccaccagcatgttcccaacacacaccacccttacccagcacaccaacaggtccaccaccctgttcacctggtggcaatcatcccctgtgtgctctgtctggacgtggcgggggccgttgttctatcccatctttatctagtagctctacattctccctgttctcctccggctgttggaacccccgggttaaactccgcgtgcgaaaaagtcagtcgcagggacgtgcaggacagctgatttag

SEQ ID NO: 28044 - DNA, 1065 bp, Artificial Sequence
  Description of Artificial Sequence: Synthetic coding sequence
atgtgcggcagaactagctgccacttaccccgggacgtgctcacgagggcctgcgcataccaggatcgaagaggccagcagcggctgccagaatggagggatcctgataagtactgcccctcttacaataaatctccccagagcaactctccagtgctcttgagcaggctgcactttgagaaagacgccgattcaagcgagcgaattatcgctcccatgcgatggggcctcgtgccttcatggtttaaagagtctgacccctcaaagctgcaattcaatacaaccaactgccgtagcgataccgtgatggaaaaaagaagtttcaaagtgccgttaggcaaaggtcgtcgttgcgttgtcttggcagatgggttctatgagtggcaacggtgccaggggacaaaccagagacagccatacttcatctactttccacagatcaaaactgagaaaagcggtagtattggcgccgccgattcaccagaaaattgggagaaggtttgggataactggagactcctgaccatggcagggatttttgactgctgggagcctccggaaggtggagatgtcctgtattcctacaccattatcaccgtcgacagttgtaaaggtctgtcagacatccaccaccgcatgcctgctatcttggacggagaggaggccgtctcaaaatggctggacttcggcgaggtgtccactcaggaggctctgaagcttattcacccaaccgaaaacataacctttcacgctgtgtcctctgtcgttaataactcaaggaataacacacccgaatgcctggcccccgtggacctggtagtgaagaaggaactgagggcaagcggctcctcccagagaatgctgcaatggctggcgactaagagccccaagaaagaggattcgaagactccccaaaaggaagagtcggacgttccgcagtggtcttcccagttcctgcagaagtcccctcttcccaccaagcggggaactgccggcctgcttgaacagtggctgaaacgagagaaggaagaagagcctgtggccaagcgcccttacagtcaatag

SEQ ID NO: 28045 - DNA, 1065 bp, Artificial Sequence
  Description of Artificial Sequence: Synthetic coding sequence
atgtgcggaaggacaagctgccacctgccccgtgatgttctcacacgcgcttgcgcatatcaggataggagggggcagcaacgtcttcccgaatggagagatccagataagtactgcccatcttacaacaaaagtcctcaatccaacagtccagttctgctctcacgccttcattttgaaaaggacgcagattcgtccgaacgaatcatcgcgccaatgaggtggggtctcgtcccttcctggtttaaggaaagtgatccctcaaagctgcagtttaataccacgaattgccgcagcgacaccgttatggaaaaaaggagctttaaggtccctctgggaaaggggcgtcgctgcgtcgttttggccgacggattttatgaatggcagcggtgccagggaacaaatcagaggcagccttatttcatttacttccctcagattaagactgagaagtcagggagcattggagcagccgacagccctgagaactgggagaaagtgtgggacaattggcgacttctgaccatggccggaatcttcgattgttgggagccaccagaaggcggggacgtcctctattcatacactatcatcaccgtcgactcttgcaaagggctgtcagacattcaccacaggatgccagctatcctggatggggaagaagctgtctcaaaatggttggatttcggtgaagtctcaacacaggaggccctgaaattgatccaccctacagaaaatatcactttccacgccgtgtcatccgtcgtcaacaattctcgcaacaacacaccagagtgtctcgctccagtggatcttgttgtaaaaaaggaactacgcgcctcaggatctagccagcgcatgctccagtggctggcaactaaatcccctaagaaggaggactccaagacacctcagaaagaggaaagcgatgtgccacagtggagcagccaattccttcagaagagcccgctcccaacgaagagggggacagccggcctgcttgaacagtggctcaagcgggaaaaagaggaggagcccgtcgccaagaggccctattctcaatag

SEQ ID NO: 28046 - DNA, 1065 bp, Artificial Sequence
  Description of Artificial Sequence: Synthetic coding sequence
atgtgtgggagaacttcctgccacctgccacgtgatgtgttgaccagagcatgcgcctaccaggacaggcggggacaacagcggttgcccgagtggcgggaccccgataaatactgccccagttacaacaagtccccacagtcaaactcccctgtgctcctgagcagattgcattttgaaaaagatgccgattccagtgaacgtataattgcccctatgcgttggggccttgtcccctcctggttcaaggagtccgatcccagtaagttgcagtttaataccacaaactgcaggtcagataccgtcatggaaaagaggtcctttaaggtgcccctgggcaaagggaggagatgcgtggttttggccgatgggttttacgagtggcagagatgtcaaggaaccaaccagcgccagccttatttcatctacttccctcagattaagactgaaaaatcggggtctataggggcggcagactcacccgagaactgggagaaggtctgggataattggcggctcttgacaatggccgggatctttgactgctgggaacccccagagggcggcgacgtgctgtacagctacacaataattaccgtggattcgtgtaaaggtttgtcggatatccaccacagaatgcccgcgattctggatggggaggaagctgtctcaaaatggctggatttcggcgaagtgagtacccaggaggccctcaaacttatacatcccacagagaacattactttccacgccgtgtcatcagtggtcaataactcacgtaataacactccagagtgccttgcccccgttgatctcgtcgttaagaaagaactgcgggcgtcagggtcctcccagagaatgctgcaatggctggccacgaaatctccgaaaaaggaggactcaaaaactccccagaaggaggagtcagatgtgccacagtggtcctctcagtttcttcagaaatcaccactccccaccaaacgggggactgccggtctgttggagcagtggctgaagagagaaaaggaagaagaacccgtcgcaaagcgaccttactctcagtag

SEQ ID NO: 28047 - DNA, 990 bp, Artificial Sequence
  Description of Artificial Sequence: Synthetic coding sequence
atggaaatgagcggcttatcgtttagtgaaatggagggatgcaggaacttactgggtctgctggacaacgatgaaatcatggctttgtgtgatactgtaacaaataggctagtgcagccgcaggaccgacaggacgcggtgcatgccattctggcatactctcaaagcgccgaagagctgctgcgtcgtcggaaggtgcaccgggaggtgattttcaagtatctcgctacccagggtatcgtaataccacccgctacggaaaagcacaatctgattcagcatgcgaaggactactggcaaaagcaacctcaactgaagttaaaagagactcctgagccggtcaccaagaccgaagatatccacctcttccagcagcaagtaaaggaggataaaaaggcggagaaggtcgactttaggcggctgggagaagagttctgtcattggttttttggccttctaaactcacagaacccgtttctcggtcctcctcaggacgagtggggtccgcagcatttctggcacgatgtcaagctgaggttttactataacacctccgagcagaacgtgatggactaccatggggcagaaattgtgagtctgaggctgctgagcctggtgaaagaggaattcctttttctgtctcccaacctggatagtcatggcttaaaatgcgcttcgagccctcatgggctggtcatggtgggagtggccggcacagtgcaccgagggaatacatgtttgggcatttttgaacagatctttggcctgataaggtgcccattcgtcgaaaatacctggaagattaagttcataaacctgaaaattatgggcgagtccagcctggctcctgggactttaccaaagcctagcgtgaagttcgagcaatcagatttggaggcattctataacgtgatcaccgtatgcggaactaatgaggtgcgccacaacgtaaagcaggccagcgacagtgggaccggcgaccaggtgtag

SEQ ID NO: 28048 - DNA, 879 bp, Artificial Sequence
  Description of Artificial Sequence: Synthetic coding sequence
atggcccaaccccagctgtatctcccggagcctttcaagatcgcctatcggaaagttggccagtgtcgacggttccagcagcttaagaaaaaaaatgggtcgttcaagaggaaaggcatcgagaggtggcaccgtgcagtttccacaaacctgctcaaacagaacgttctggttccgaaggaagaaagttcatccgatagcgacatgggcttccatgaatcccagcagaatcagaaatccaatctcaaaacaaaggtgaaaaccgccttcggccgcatgttgtcatataagtataggtccaaacccgcatgcgcctcacaggagggttccaccgaccacaaggaagctctgcttagtaacacccagtctcttctgccccgcatcgttaaagagttctcaagcccgaagttgtttacagctaagatgaggaaactaagtgagaacgcaaccatccagctggatgtcgtggaggcagaaacagaggaaattacacagggcaacaccttgctgagggctcgacgaacgacaaaacggctgtccgtaacctctctcccgtcagggcttcaaaagggtccctacagtcctaagaagagacctcattttccagcacttaagaaaaagaagagaggtatggagaacatactcagaaagtctgacctcaccgtgggaaaactgcagatgcaagtggacgatcttatagagacggtgacagacaaaagcatgaaattgctggctcaacgacatgctgaactccaacagtgtgagttcctgggagacgagatactccagtccagcaagcaattccagcggatttctaagcgcacgatgcggaagtataaactcaagaatatgaccacgaagggacccggggattcctag

SEQ ID NO: 28049 - DNA, 357 bp, Artificial Sequence
  Description of Artificial Sequence: Synthetic coding sequence
atgaaagtcgtgggtaactatagggtcaacaccgcgaactcatccaccgacacctccggagagcatcttacctgtctgcgctctcaactatttgtagcatacaggaacggtcgtgtggatgaagcagtgtctttgggattcctcgactgttggataggaggagatctgaccaactttaagggttgttatctcacgaaccagcttcccatacaaatatttaccgccatattcgatatgaatacagacgtcataatcttgagccagttcatgtattaccgcctcaagaaccagaagaagaagatatctgaggaggacctgcgcaaggaattgcacttttgctgtctccactggccatag

SEQ ID NO: 28050 - DNA, 402 bp, Artificial Sequence
  Description of Artificial Sequence: Synthetic coding sequence
atgaaagtcgtgggcaattaccgagtgaacacagctaattccagcactgacacatcaggggaacatctcacatgcctacggtcccagttattcgtagcctatcgtaacggaagggtggatgaagctgtgtccctggggttcctggactgttggatcggcggagacttaaccaattttaaagggtgttacctcacaaatcaattgcccatacaagacatacctacaagtgttatccaacggcttcaccaccagcgcgaaagccagattgtgacactgggctcaccgctgccctgtatttacccaatattctttcagatatccgaaatcagcatgcccgggtactactcttgtctctgtcatacaaccataaatacgagcaagcgcaggttcatcctgacttag

SEQ ID NO: 28051 - DNA, 408 bp, Artificial Sequence
  Description of Artificial Sequence: Synthetic coding sequence
atgaaggtggttggcaattacagggtaaataccgctaatagctctaccgacacttcgggagaacacctgacttgcctccgcagtcaactgttcgtcgcctatcgcaacggacgagtcgacgaggctgtgagcctgggttttctggactgctggattgggggagacttgacaaatttcaaggggtgctaccttaccaatcagctgccaatccagatctttacagccatctttgatatgaacactgacgtaattattctcagtcagtttatgtattaccgacttaagaaccagaagaagaaaatgatctttcagcctcaactgtttaaggactccattacacgggaaaaggttagactgagcctgtggggcgtgctctgccctgtgtatatcccctactcatttaggtag

SEQ ID NO: 28052 - DNA, 729 bp, Artificial Sequence
  Description of Artificial Sequence: Synthetic coding sequence
atgggaaccggcgccagcgagaagcaggctgagcaaaaagtgagacgggctttcgaggcgtcagaagaggcgcatggcaccctcgctgcatctactccatgggtcgctatggggagtgcttatggcagctgtacgtgtctaggagcccagcctgttacggatctcgcgctgtggcccgtgatttactcatgtatggggttctccccccaggcatatccagccttttgggcctacccttgggtgctctatggggggtacctgtggatgggctaccccccacccgctgccctggtgcccagtgtgtggttatactggcgcggcgcaagctctttcgatccccttatcgggagcccatacctggccgccctggcccccaacctgttcccgtttccgatgaaattccctccaacctattcactggcctcgcctacacttggcggggccacttcttctcactgtccacaggtgggctgctggacccccgccagttccgctcctagagctgcggttgaaggaccttctagaggggccccgtatctcaagacttgtaaggcgccgccttctgagtgggcctcacggtttggaatctgggctcctttgccctgctgctcatcagaactcaggcctctgccaccctcacccatcgaggactcacagctggatccaggctgcagtaggagctcatccagatctccctgccgggccagacgcagactgtttgaatgttag

SEQ ID NO: 28053 - DNA, 804 bp, Artificial Sequence
  Description of Artificial Sequence: Synthetic coding sequence
atgcattatatcaaaacatggtcactgttgggcgagatgtcagaaaaactgcgtcgatgtcgcaaagagctcacagcggcgatcgacagagcgtttgagggtgtttcctattcacaggaatgcacaggacagcaaagactggagctcagcgctgctcccctgtccttttccttacccgtgcatcgtctgttgtgcagacggcatcccctcgcggcttgttccagcgctgccccttttgccgctgtgccctgtgccccggagaacgagaaccccgcattcgccacaaatcacgcgccagtcaacgctaagccacacgccctgtgtcctgaaagaaagccacttacgtccaaggaaaatgtgctgatgcattcaagtatccttgcgcccgagagggagtcttggcgtacggccggagaaggtgagaattggcgcaaagagaacttgcgtaaagacatggaacgcgacttgaaagcggattccaacatgccgctcaataactcttcccaggaggttaccaaagatctgcttgacatgatcgaccacacctcaattcggacgatagaggagctggccggtaagatcgagttcgagaatgaactgaatcatatgtgcggtcattgtcaagactctccatttaaggaggaggcctgggctctgctaatggacaagtctccccaaaaagccactgatgctgatcctgggtccctgaaacaggcttttgacgaccataacatcgtggagaccgtgctggatttagaagaggattataacgtgatgacctcctttaagtaccagattgaatag

SEQ ID NO: 28054 - DNA, 432 bp, Artificial Sequence
  Description of Artificial Sequence: Synthetic coding sequence
atggcaacgccgttggacaactgtctgaggccttttcccgatcccatggtgaaagtcaccgcagaaaccaagaaaatttccgaggttagttcttacgtgtcggccaataacaaaaaaaacagcttttggggcagcggactgctctaccccgtggctctcctgcgttgccaggactgttgggctgggcatcaaacgcacgtcctatccaaggagttcacctcgtacttctcctcgggagccggcagggaggcccagcaccagccaagcgcggtcctcggctctctgatttggcttagaagagtgtaccttctacgcgcaatggttgtgcacggtggttcccagccctgtcagcgctggctggtgatccgtatggaggtaggcgggcaccctagctttcccggtcatgcctggctgacgttccacctcaattag

SEQ ID NO: 28055 - DNA, 1692 bp, Artificial Sequence
  Description of Artificial Sequence: Synthetic coding sequence
atgatcaagcggaagatctggtgcaatctctgtatcgatttggtcgcattcacctctgagatattcaagggagccgtgttccaatccctggatgggattgtcgtgtccgctaactgcaaactcagaaaaatattcaccctgaaatccaagccacaagacacagcagataaagatgccgtctacggagtgccttttagcaccgacgaacccactgacattatccccagatcatgtcaattaatgacggatgtgcctcacgttacccaattgctgaacatgactaaactacgccaaacggaaatcaaattcggcgggcaccccctccgctcagccgaatctgatcaattcatcaaccgggggacctccataactaggaacagtaagaaccaggacgtgtgtcatatcgctttcggaagcaaagtactgggcccgccccccctgtctggcaggcgtaacaatatgaagatctcatctgagaccgtgcggtcagtaggctcaaagaataaccggtcatgccagccttcaaccgtggagaagtgtgtcaatggtaccgagatgtccgcgcttctcatccccgaatccgaagaacaggggaataaagagaatattcaccagatcaagcaaacagttcccatccatgcagcaaacctgcacatcatgcacccgcaccctcctcaagagccatctgcagacaagaataacaaccgccgccgtctgaggctcaagtccacttcgcgggaaaggaccgagacgccttccggatcttctagcgggaacaacagaattgaagacaaagcatcaaccatcctgacaaccgtctcacagcagggggcggaactgctcaattccggcaccctaggaccccagagtccagaccagtctgatgagtggatcttccctgagaatgcggatcatatttcctacctggcctcttcacgtcagagcctgctgctgggcgacgattcatgcaatccatctcatctgtggttagaagctagtaaggagtctgaacatgaccagcaagccgaggagagccaatccgtgcccaaagacattttcaccttctcatctagaccgcgatctgcaccgcacggtaaaacacagaccatgtccccagaagagctaagtttcatcctggatttgaaagaggacaattctgttacgtctagggacacccaatcggaggatgacttctatgggggtgacagctcggaagaggagtatgactggcggaactaccaaccttcacaaatgtccgagagcgagctgcaaatgcttgcatcactgagatggcagcagaacgaggagctggaagacgccgggaccagccacggattgagcgcgagccaggttgacaactgtaacgtgtctatatcaaccagcagcgacgacaccaccacctggaactcctgtctgcccccgcctgtgaaccagggtcgccactatcagaaggaaatgaacccaccaagtccaagtaacccgagggactggctgaacatgctctctcccccgattgtgcctcccagccagcagccagccgagcaaaggcctgattcttgtgagagtctgtcggtgcaaggcgaagaagacctgagcgttgaggaagacgaagaagtgctaactctgctctacgacccttgtctgaactgttattttgatccacagacgggcaaatattatgaactggtctag

SEQ ID NO: 28056 - DNA, 717 bp, Artificial Sequence
  Description of Artificial Sequence: Synthetic coding sequence
atgtcaggcttccctgagaatgccgaccatatatcatacctcgctagctccagacaatcgctgctgttgggtgatgacagctgtaatcctagtcacctgtggttggaggcttccaaggaaagtgaacatgaccagcaggccgaggagagccagtcagtccccaaggatattttcactttttcatccaggccaagaagtgcacctcacgggaagactcagactatgtcacctgaagaattatcctttatcctcgacttgaaggaggacaatagcgtgacaagcagagatacacagtcagaagacgacttctacggaggggatagcagcgaggagggtaatcattctatccagggaagtcgcgggcccaccacagggccatccgaattgactcaactgacgctggagtcgttgctcgggaaggccgcaaagaggactagtaaagagtatttacgttcagcctacaccgaagcaggtgctaccgagagccaagattcgtctatggagcagatcgataggaacaatttcgagatgtctctgttgccgaccacctgcctatcacccactggacggagatgcggatcatgccaaaaaacgcctgagccagtgatcaaggcaaaagacttaagcgcccaacaggtgcccgcttctctgaataagaccagtctcaaggagatcagcggtgagcggctcagctctattccagaagcgagcgagtag

SEQ ID NO: 28057 - DNA, 2070 bp, Artificial Sequence
  Description of Artificial Sequence: Synthetic coding sequence
atgatcaaaaggaaaatctggtgcaacctctgcatcgatttagtggcctttaccagcgagatttttaaaggtgccgtgttccagagccttgatggcatagtggtctccgctaactgcaagcttagaaagatatttactctgaagtcaaagccccaagacacagctgacaaggatgccgtctatggggtgccattctcaacagacgaacccaccgacatcatccctagatcctgtcagctgatgactgatgtgccacacgtgacacagcttcttaatatgaccaagctcagacaaacagaaatcaagtttggcggccacccactgcggagcgctgaaagtgatcagttcattaaccgtggaacaagtattacaagaaactcaaaaaatcaggacgtgtgccacatcgcttttggttcaaaagttctaggcccacctcccctctctgggcgtcggaacaacatgaaaatcagctccgaaacagtgcggtctgtgggttcgaagaataacagaagctgccaaccgtccaccgtcgaaaaatgtgtgaatggcaccgagatgtccgcattgctgatcccagaatctgaggaacagggaaacaaggaaaatatacatcagatcaaacagaccgtgcccattcatgccgccaacttgcacatcatgcacccgcatcccccacaggaaccatccgcggacaaaaataacaatcgtagacgcctccggttaaagtccaccagccgggagaggactgaaaccccaagcggctcaagttctggaaataatcgcattgaggacaaagcaagcacaatactgaccacagttagtcagcagggagccgagctgctgaattctggaacactgggtccacaatcgcccgaccaatccgatgagtggatttttcccgagaatgctgatcatatctcatacctagccagcagcagacagtctctactgttgggtgacgacagctgtaatccatcccatctttggttagaggcaagcaaagagtctgaacatgatcaacaggcagaggaatcacagtctgtcccaaaagatatttttacttttagcagccggcctcgctccgcccctcatggaaaaacccaaacaatgtctcccgaagagctgagcttcattctagacttaaaagaagacaactcagttacctcccgggacacacaaagcgaggatgacttctacggaggcgacagttctgaggaaggaaaccactccattcagggatcacgcggcccgaccacgggcccatcggaactcacacagttaacactggagagtttgctgggcaaagcggctaaacggacttctaaggaatacttgcgcagtgcttatactgaagctggtgcgactgagtctcaggacagcagtatggagcaaattgacagaaacaatttcgagatgagtctcttgccgaccacttgcctgagtccaaccggaaggcggtgtggatcatgtcagaagacaccagagcccgtgatcaaggctaaagacctaagcgcccagcaggtgccagccagcctgaataagacttctctgaaagagatttcaggcgaaagattatcttctatccccgaagcctctgagtatgactggaggaattatcagcccagccaaatgtccgaatctgagttgcaaatgctagcaagtttgcgatggcagcagaatgaggagctcgaagacgccgggacctcgcatggtctgtccgcttcacaggtggacaattgcaacgtgtccatctcgacttcttccgacgacaccacgacctggaattcttgtctaccacctcctgtgaatcagggtcgccattatcagaaagagatgaatcccccttcaccctcgaatccgcgggattggctaaatatgctcagcccaccaatagttccgccctctcagcagcctgcagagcagcggccggactcttgtgagagcctcagcgttcaaggggaagaggatctgtccgtcgaagaggacgaggaagtgctaaccctgctttatgatccgtgtcttaactgctactttgatccccagacgggaaagtactacgagttggtgtag

SEQ ID NO: 28058 - DNA, 753 bp, Artificial Sequence
  Description of Artificial Sequence: Synthetic coding sequence
atgtctgctgctgccagccctgcctcggagcgaggatggaaaagcgagaagctcgatgaggcacaggccctggccaggtcttgcgccgccagacgcccagatttccagccttgcgatggcttgtctatctgtgccacccatagccacggtaaatgctttaaactccactggtgctgtcatcttgggtggtgtcactgtaagtatatgtaccagccaatgacccccgtggaacagctccccagcaccgaaatccccgcacggcccagagagccaaccaatacaatccagatctcggtgagcctaaccgaacattttctcaaatttgctagcgtttttcagccccctttgccaccagattctccacgttactgcatgatatccgacctgttcatcgacaactaccaggtgaagtgcattaacgggaaaatgtgctatgtccagaagcaacccgccccgcatagccaccggatgtcccccgaggaagtctcagcgcacgacgctctcatctctaaagaatccaacacaccaaagattgatcactgcagtagccctagcagctccgaagacagcggcattaatgccatcggcgcacattacgtggagtcttgtgatgaagataccgaagagggcgcagagctgtcttcggaagaggattacagccccgaaagctcatgggagcctgatgagtgtacactgttatctccctcgcagtccgacctggaagtaatcgagactattgaaaccactgtttag

SEQ ID NO: 28059 - DNA, 528 bp, Artificial Sequence
  Description of Artificial Sequence: Synthetic coding sequence
atgacccggactccagttgggagcgctagaacccgcccaaagcctcgcaaactggggccgcagcggggcaaagccctccaagcctcctcccgtctcagtgagtctcccgctttggtgaagaagcgaatgcctgatgcctgtacacttggacgagcaggcatcggacttccaaaaatgtgcctccatatggccgtcagacacagtaaggctcagaagacgggtcccggcatcttacagcagagacagaagcccccggccccccgggccagtggcggaccggccttgctcgggaagcggagagggtgcagcgaagcagggagtgccagtctggagccgctgtcttcttctagggcagcggccggctgcttgaaccaggtgccactgtcgccgttcctggccgggccacgaaacactcggcgtttgcctgccccggagagagaaaggatcgaactagctgccactttgtgcctggagggctggccattgcgctgtctggcatctaagggcaagttacactgcgtgtactag

SEQ ID NO: 28060 - DNA, 492 bp, Artificial Sequence
  Description of Artificial Sequence: Synthetic coding sequence
atgcagagtgtggacagtatgctgggaaccgtcggcggctgtggaggcggggaagcagccagcaccttttcaaaagatccttctggctgttgcgttgggaatgattgccgggatggcggacggggacttgaacgacggcatggcagatggagtcgcggagaaggcggtgaaagcggcttatgcagtggcgggcagatggcatcggaaattgagtactgggatgggctggccataagtgtgatggaagtggagaaggcttttggttccacaaacgttttgtggaagacggaaccttttagtctgtgggcatgtactgctgcgtgtcctcctagcctgagccccactctactagccctgggactcccaagagatggcaaagagctggctgagcaggggtcactttggaccgtcctggagccagggggagattggagccattcccagagccagctggggactcccgggcgcggtaaaggcgccctgggattttag

SEQ ID NO: 28061 - DNA, 801 bp, Artificial Sequence
  Description of Artificial Sequence: Synthetic coding sequence
atgtttgtcgaattgaataatctgctaaatacgacacctgatagggcggaacagggcaagcttacccttctgtgcgatgccaagacagacggtagtttcctggtgcaccacttcctctcattttatttaaaagctaattgtaaagtctgctttgtcgcattgattcaaagcttctcccattatagtatcgtcgggcagaagctgggagtttccctaacgatggcccgggaacgcgggcagttagtcttcctagagggtttgaagagtgccgtggacgtcgtctttcaggcgcagaaggaaccacacccgctccagtttctcagggaggccaatgctgggaatttaaagcctttgtttgagttcgttcgagaagccttaaagccagtggattctggcgaggctagatggacataccccgtgctgcttgtcgatgacctaagcgttttgctgagcctgggcatgggcgcggtcgccgtcctggactttattcactactgtagagctactgtttgttgggagctgaaaggcaatatggtagtgctggtgcacgatagcggagatgcagaggatgaagaaaacgatattttgctgaacgggctaagtcaccagagtcacctaatcctccgagcagagggtctggctaccgggttttgcagggacgtacacggacagctgcggatcctctggaggaggccatcacaaccagccgtgcatagggatcagtcctttacataccagtacaagatacaggataagagtgtctcctttttcgcaaaaggaatgagcccagccgttctatag

SEQ ID NO: 28062 - DNA, 729 bp, Artificial Sequence
  Description of Artificial Sequence: Synthetic coding sequence
atgtttgtggagctgaataatctgctcaataccacgcctgacagggctgaacaggggaaactgacgctgttatgcgatgcaaaaaccgatgggtcttttttggtgcatcacttcttgagcttctaccttaaaggcgtaagcctaaccatggctcgcgaacgtggccaactggtctttctggaaggactcaagtctgcggtggatgtggttttccaggcccagaaggaacctcatcctttgcagtttctgagggaagctaacgccggtaacctgaagcctctatttgagtttgtacgcgaggccctgaagccggtcgattcaggagaagcccgatggacttaccccgtgttgctagtcgatgatttgtctgtgttgctgtctttaggcatgggcgccgtcgccgtgctagattttatccactattgtcgggccacagtgtgctgggaacttaaaggaaatatggtagttctggtgcacgacagtggagatgccgaagatgaggagaatgacatactgctcaacgggttgtctcaccaaagccacctgattctgagggccgaagggctggctactggcttttgccgggacgtgcacggtcagctgagaatcctgtggcgtagacctagccaacctgctgtgcatcgcgaccagtcattcacgtatcagtacaagatccaggacaagagcgtaagtttcttcgctaagggcatgtccccggctgttctgtag

SEQ ID NO: 28063 - DNA, 303 bp, Artificial Sequence
  Description of Artificial Sequence: Synthetic coding sequence
atgcatgtttgcgaccttcagaaactcgtgcgcatccaactcgcttttacaacatttccatggatgttcagttgtcacttgctacccacacccgaactgtcctctaagaggaatcagtgtttgctctacaaaacatcaggctgtttgactcaaatgcctattctttacgggcatcccgccacactattgaaggattacatcctccaagcgatactccagccgggtaagaaaatacagggtggcactgaaatacagcgtggctccttcgctaatcagtatcagaccgatgcaagccatctgtag

SEQ ID NO: 28064 - DNA, 744 bp, Artificial Sequence
  Description of Artificial Sequence: Synthetic coding sequence
atgtggggaccaggcgttacagcagagggattaagcgtggcccctgcacctcctccgttgcttccactcttgctcctgctggctttggcgcttgtggctccctctagaggtggagggggctgtgccgaactggcctgcggtgagcgcgaacgctgctgtgatgctactaatgcaactgctgtgcgatgttgtaagctccctcttcacgcatttttggacaacgtcggctggttcgtgcgcaagctttcgggactgctgatcctcctggtgctgttcgctataggctatttccttcagagaatcatctgtccaagcccgaggagatatcctcgtggccaggcaaggccaggccagcgacccggcccccccggtggagccggccctttaggcggggccggacccccagatgatgatgatgatagcccagctctccttagagacgaggccgcggctggcagccaggatagcctgctcgacagcggaggaggtggcagaggacggggggggggggggagatccgatccatcatgcgccagcgaacatgagatgagagtggtttcccccgtctttctccagctgccctcatacgaggaagttaaatatctgcccacatatgaagagagtatgaggctgcagcagctgagtcccggcgaggtggtcttgcccgttagcgtgctaggaaggcccagaggaggggtggccgccgaaccagatggcggcgagggtagatatccactgatctag

SEQ ID NO: 28065 - DNA, 1080 bp, Artificial Sequence
  Description of Artificial Sequence: Synthetic coding sequence
atgaatctaaaccctccaacgagcgcgctccagattgagggcaaggggtcccacatcatggctcggaatgtgtcttgtttcctagtgcgtcacactccacaccctagacgagtgtgccatattaaaggactgaacaacattcccatttgcactgtgaacgacgatgaaaatgccttcggcaccctgtggggagtcgggcagagcaattacctggagaaaaacaggatcccctttgctaactgctcctacccctcctcgacagctgttcaggaatctcccgtgcggggcatgagtcctgcccccaacggggcgaaggttcccccgaggccccattctgagcccagccgtaagatcaaggaatgttttaaaactagctctgaaaatccactggttattaagaaagaagagataaaagctaagcggcctcccagccctcccaaggcgtgctccacaccaggcagttgttcttccggcatgactagcacaaagaacgatgtgaaagcgaatacgatatgtatccctaactacctcgatcaagagattaagattttggcaaagttgtgcagtatcttgcataccgactcactggctgaggtattgcaatggctcctgcacgctacctctaaggaaaaagagtgggtgtctgctctcattcattctgagttggcagagattaatctcctgacccaccacagaagaaatacttcgatggagccggctgcagaaacgggaaaaccaccaacggttaagagcccaccaacagtcaagctccctcccaattttaccgccaaaagcaaagtgctgacacgggacaccgaaggagatcagcctactcgcgttagctcacagggatcggaggaaaacaaggaggtacctaaagaggctgagcacaaacctcccctgcttatcagaagaaataatatgaagattcctgtagcagagtacttctcaaagccgaactcaccacctcgacccaacacccaggagtcagggtccgcaaagccagtctctgcccgaagcatccaggaatataacctgtgtccacagcgggcgtgttatccatcaacacatcgtaggtag

SEQ ID NO: 28066 - DNA, 945 bp, Artificial Sequence
  Description of Artificial Sequence: Synthetic coding sequence
atggggtgtcggtgctgtaagattatccagagctacctctttgacccagtccaggtgccttccccaggctatgtgaatgaggtgaatagctgtaagctcgatgaggacgataccgataaactgaagggaaagtggtcgtcggaagtcctggttcagaaaaacgatccccaacgccagggcagtaaaaagaccgagtctagctcccgcaccgccgacccttgggaaccttgttggcctcaccaagggcctcttccccagggtgacgctggcggcgagcaccacgcttgcggtgttaatgggataggtcccgccgctaccccccagccaacgggcaacagctcccccacacaagatgaccgtggtagctgggctagcaccgcaaatactgtgccccccactcagccctttctagaggggggaggcacccggaagcaggattgcgtcctgctggcatctgaaggcacccaggtgatgcgcaacggcgacagcagggcgccgagcgaagctgagtctttcgccttggaagtgcaggaccacgtgttccagatccctgcgccggactatctccagcattggggcccagcaggagacaatgtcgaccataatgagaaggattgtgttttcaaaaaccacacagaggatgagtcgctggaagggatccagcctccagtaggtgagcacggcctcaatacccctttttctgtgcggcgctcgtgggactccttgaatgaagacgttgaaacagaagttttgtcgatctgcttcaacgagaaaggtcctgtgcacgctatgcctgtggttgactctggaaaccgccaggaagacacccacggcagcgacggagatggggacggagaaattgtggatgaagatgcagcagttgctgaggcactcgctgcattggaagcagccaccgcaggagaggatttagatgaaacagattag

SEQ ID NO: 28067 - DNA, 945 bp, Artificial Sequence
  Description of Artificial Sequence: Synthetic coding sequence
atgggctgtagatgctgtaagatcattcagtcctacctcttcgacccagtgcaggtcccatctccgggctacgtaaatgaggtgaatagctgcaagttggatgaagacgacactgacaaacttaagggaaagtggtcaagtgaggtgctggtccagaaaaacgaccctcagcggcaaggaagcaagaaaaccgagtcctccagtcgaacagcggatccttgggagccatgctggcctcatcaaggcccactcccacagggggacgctggtggggaacatcatgcttgtggggtcaatgggattggccctgctgctacgccccagccaaccggcaattctagcccaacccaggacgaccgcggctcttgggcctccaccgcaaatactgtacccccgactcagccgttcctggaaggaggggggacccggaagcaggactgtgtcctgctggcctccgaaggaacccaagtgatgcgaaatggtgacagtcgggcccctagtgaagctgaatcttttgcattggaggtacaggaccatgtctttcaaatacccgcacctgactacctgcagcattggggacctgcaggagacaacgtcgaccacaatgagaaggattgtgttttcaagaaccatactgaggacgaaagcctagagggcattcagccacctgtcggtgaacatggcctaaatacgccattcagcgtgagacgctcatgggacagcctgaatgaggacgttgaaactgaggtcttgtctatttgttttaatgagaaagggccagtgcacgcaatgcctgtagtggattctggaaacaggcaggaggacacacacgggtctgacggcgacggagatggcgaaatagtggacgaggatgcagccgtcgcggaggcgctggccgctttggaggcagctacagccggagaggacctggacgaaacggactag

SEQ ID NO: 28068 - DNA, 702 bp, Artificial Sequence
  Description of Artificial Sequence: Synthetic coding sequence
atggatcaagaagaagggttgaaagctctcgataacatagtcacacagttcaacgcatacgaggattttctggattctcaaatcactacagtcgatttgtattatctggaggatgaaacactggcacgacaactggtggagctcggatacagggggactggggaaagggtcaaacgggaagatttcgaggcccgcaaagctgcaatcgaaattgctagactggccgaaagggcccaacagaagaccttgacttccgccggcaaggatttgcaagacaatttccttaccgccttagcaatgcgagaagaggacaaccgcagcgggaagttatcctccgtgatcttcattagggataggaacagtcatgggcaggaaatctctggatatatcgattacgcccaccggctgaagacagaggatttcgaggtgtatttcaccggaaagaaaagactgctgccacgccctaccgatatatctttttacaattgggatgcagacatcgccgtgagtaactcctcccccaactaccaagttattgctgacaatccggagggactgctgttccgctataaaagagatcgcaaaatcctcaatgtggaccccaaggcacagcccggtgataattccacacggatcactatcctgacagagctctacgtgcaggccgtgatttttgaccatatttcgaggcggaaaacgtag

SEQ ID NO: 28069 - DNA, 753 bp, Artificial Sequence
  Description of Artificial Sequence: Synthetic coding sequence
atggatcaagaagaaggactgaaagcactcgacaatatcgtcactcagtttaatgcttacgaggacttcctggacagtcaaataacaaccgtcgatctatattacctcgaagatgagactctagcccgccaactcgtggagttaggttaccgaggcaccggggaaagagtgaaacgggaggacttcgaagcacgaaaggcagccatagagatcgcccgtcttgccgagcgtgcacagcagaaaactctcacaagtgcaggaaaggacctccaggacaatttcctgacggctcttgccatgagggaagaggataaccgttctggtaagctctcgctgaatcagcaggagaccgacgcggctcacatcctaaagaaacagctcgccagcgtaatcttcatccgggaccgcaacagccatgggcaggagatcagcggctatatagattacgcgcatcggctaaaaacagaagatttcgaggtgtactttacaggaaaaaagcgccttctcccacgcccaaccgatatctccttctataattgggacgccgacatcgctgtgtcaaactcgtctccaaactatcaggtgattgccgacaaccccgaggggctgctttttcggtacaaaagagaccgaaagatactgaatgtcgatcctaaagcacagcccggcgacaactccacacgcataacaatcctcaccgagctgtacgttcaggccgtgatattcgaccacattagccgccggaagacatag

SEQ ID NO: 28070 - DNA, 600 bp, Artificial Sequence
  Description of Artificial Sequence: Synthetic coding sequence
atggactttaagatcgagcatacctgggacggctttcctgtgaagcacgagcctgtctttatccggctgaacccgggagaccgcggggtcatgatggatatatcagcgcctttttttagagaccctcccgccccgctgggagagccagggaaaccattcaacgagctgtgggactatgaagtcgttgaagcgttcttccttaatgatatcactgagcagtatctggaagttgaattgtgcccgcacggtcagcatttagttcttctcttgtccgggcggagaaacgtatggaaacaggaactgccactcagctttcggatgtcgcgcggcgagacaaagtgggagggcaaagcatatctgccttggagttacttccccccaaatgtcactaagtttaattctttcgccatccatgggtctaaagataaacgatcttacgaagctctgtatcctgtccctcagcacgaactgcagcagggtcagaaacccgacttccattgcctcgaatacttcaaaagttttaatttcaatacgctgttaggagaggaatggaaacagccagagtcagatctgtggctgattgagaagtgtgacatatag

SEQ ID NO: 28071 - DNA, 600 bp, Artificial Sequence
  Description of Artificial Sequence: Synthetic coding sequence
atggatttcaaaatagaacacacgtgggatggtttcccggtcaagcacgaaccagtgttcatacgtttaaaccctggggatcgcggtgtgatgatggatattagtgctccttttttcagagatcctccagcgcccctgggagaacccgggaagccattcaacgagctgtgggactacgaggtggtcgaagccttttttttaaacgatattactgagcagtatctggaagtggagctgtgtccccatggacaacatttggtactcctgctgtcagggagaaggaatgtgtggaagcaggagcttccccttagcttccggatgtctaggggcgagacaaagtgggaaggcaaagcctaccttccgtggtcctattttcctcccaatgtcacaaagttcaatagctttgccatccatggaagtaaagacaaacgtagttatgaggcactctaccccgtacctcaacacgagctgcagcagggccagaaacctgatttccactgtctagaatactttaaatcttttaattttaacaccctcctgggggaggaatggaagcaaccagagtctgatctgtggctgattgaaaaatgtgacatatag

SEQ ID NO: 28072 - DNA, 195 bp, Artificial Sequence
  Description of Artificial Sequence: Synthetic coding sequence
atggatttcaagattgaacacacttgggacggtttccctgtgaagcacgagcccgtgttcatcaggctgaacccgggcgatcgcggcgtgatgatggatatcagtgcgccgttttttcgtgacccacctgctccactgggggaaccaggaaagccatttaacgagctctgggactatgaggtggtggaggcttag

SEQ ID NO: 28073 - DNA, 354 bp, Artificial Sequence
  Description of Artificial Sequence: Synthetic coding sequence
atggcctatggggtgccgcgaaagaacactgttaaaaccatcctgcgtgggagttgctacaatgtgcaggaaccctgggatatcgcccttcttgctaagacttggtctaccaatcttgccaacataaagttgccgtttttagaggaaatcagctttggaggaagcgtgcagctgacaaagtgcacaaccattaaggacggactactaccttctgcagaatccattaagctggagagagagtacgaagtgaagcgcttgtgcaagctgaagtgccaggagaacacttctaaagaaattcagctgttgttgcgggagcgtcccgctgggctgcgccgccctttgcccagcaagtag

SEQ ID NO: 28074 - DNA, 354 bp, Artificial Sequence
  Description of Artificial Sequence: Synthetic coding sequence
atggcgtacggagtaccccgcaagaacacagtcaagacaatcttgcggggctcctgctacaacgtgcaggagccctgggatatcgcgctgttggccaagacctggagtaccaatctggcgaacattaaactcccctttctggaggagatatctttcggaggaagcgttcaactcactaaatgcacaacgatcaaagacggacttttgccttccgctgagtctattaagctggagagagaatatgaagtgaagcggttgtgcaagttgaagtgtcaagaaaacacctctaaagaaatccaacttctgttgcgagaacgtcctgccggcctccggcggcctctaccctcgaagtag

SEQ ID NO: 28075 - DNA, 246 bp, Artificial Sequence
  Description of Artificial Sequence: Synthetic coding sequence
atggcttacggggtgcctcgcaaaaatactgtgaagacaatcctgagaggaagctgctacaacgttcaagagccatgggatattgcgctgctagctaagacctggagtacaaacttggctaatatcaagctccctttcctcgaggaaattagcttcggaggtagcgtacagttgacaaagtgtactaccataaaggacgggctgctccccagtgctgaaagcataaagctggagagggagtactag

SEQ ID NO: 28076 - DNA, 342 bp, Artificial Sequence
  Description of Artificial Sequence: Synthetic coding sequence
atggcctatggcgtcccgaggaaaaacacggtgaagacaatattacgtggcagctgctacaatgtccaggaaccttgggatattgccttactggctaagacctggagcaccaacctggccaatatcaagctgccttttctggaagaaattagttttggcggctctgtgcagcttaccaaatgcactactatcaaggatggcctgttgccgtccgccgaatcaatcaagttagagcgtgagtatgaagtcaaaagactttgtaagctgaaatgccaagagaatacttccaaggagattcaactgctgctgcgagaaagacccgctggcctacgccgcccttag

SEQ ID NO: 28077 - DNA, 1380 bp, Artificial Sequence
  Description of Artificial Sequence: Synthetic coding sequence
atgtacgaccgtgctcctcggctcttaaaattggctgaggggggcagtactgaagcgcatgtgggtcctgggtcctaccaagttcctttcttgaagcagcaggctaccggctctaatgccccttttctgtccctgaccgcccgcgaaagcacctttacaattgcaagctccatcgagaaggccgtgccgggcccagggcactataacgtgtctgaagctcagaaaataagccgctctcctactctaaccagatccgtcgacgtgccaagcatccccagctgcggtaaatcttacggttaccacatcaatgatgacgggagtatcattaagtgcttccctcccgcctgtgacagcacactcgggcctgcgtactataaaccgcagtttgacgtgtcaaacgccacgctcaagtataaaggcattcactttggcaattcgagtgggcggcaggagcttccaaagaaaagcggacctgggcccggtcagtacgatatagtccaaaagaagacaagttattatgagaacgtgaacattaagcgagaccagcagcagaactattgttctttcattccgcgactctacgagattatcgtgctgcaggagaagaagaagcggtttctccctatgaagagcattacacctgcccccgggacgtacaatgagccaaggaccgccctcaagtccctgaaaaagacctccggattaaaaaacataccctttggccaaagtgctgtaaggtttactcaggacattagaacggaggaaatgccgggcccaggcttttataacgtgctcaacaacaccatcatagcaagcgtgaggaatatctgcagtaagaaacagaaaaagagcgccttcggttcctcagtacctcgcacctttttttccgttcagaaggaggcctgtgctactccaggaccggccgattaccaggagttttggcactctcagggggttggaatatcagatgagttgcctaacctgaccaataaatatgcagctttcctcagccgtgcgaaacggaccatgaaagtgccagatatggtgatccccgctcccggcagctacgacgttcataagtcttacgagatgtcccaggtgaaacacaagtatatgcctcctcgcagtttggtggccaaaaggaaacacgcttctttcttatcagctacgccccgctgcttagagaaagtgaccgacggtcccggcccagcagcctataaccccgtcctgcgtaaatcctgcccgatacccctgttcgtcaaggcctctaagaggtttgaggaatcaaaggagatcacacctgggcccgctacctacgagatcagccaggagaagaagaaaggaaacttgattggtgagatggccgcagacattatgtag

SEQ ID NO: 28078 - DNA, 603 bp, Artificial Sequence
  Description of Artificial Sequence: Synthetic coding sequence
atgacctctgctgagactgctagccgcgcagctgagagtggcggaacacctgtgagaccttgttctcgtccccaccgggcaccctctccagccgctccaagtagacctggcgccccagccgccggcccgcgaaagctgctagtccctggcctgccctgcctcgtgcggggagggtggccatggacgcggccggactcctcaccctttcggcctgccgctagacctcgaatgagcccacaccggtctcccgccgtagctaggagatgcggaagacccaggcgccgggatcctagaaggcgccgcacacccgctctgccccgaccctggcctggacggggcgggccaggcagatctctgctgcataggcatctgttcattcagcagctactgagaacctgctggcccgccctcccccgggacagaactcccgccccaggcggcaccatgcctggggccgccctcgccggaccaggtcgacaggccagtggcagcccggccccacagagtgagggggccccccctagaccatggacacctctgcaaccagggctgcaccatcgtccaccaagcagttcctcaggtctgctgagttcattcttttag

SEQ ID NO: 28079 - DNA, 474 bp, Artificial Sequence
  Description of Artificial Sequence: Synthetic coding sequence
atggagggatgcgcagtccggcgcggctcctgcccccttctgccaggaccaagcgcctggcgagccagtcccgctggctgggccgggcgagcaaagctgaggagttggtgtcgcgccagtggattgcccaatcgcccatacaccctgacaggcggtcggcacgggagcgtctccctcctaagacatcctggtaccacaacctttgtgcaacagcgaagcctgcaccagtcctgggaaaagcgcattgttttctctgcgtgccccgtgtcccggtcttggtgtcctgagaggaactttagcggatcaatccctgccgtcacaccgcctaaattgcctggtcactcgaaaagtgagggcccacctggaaaggtcagaaagcggacaacaataaggtctcagcccctgttcgtaacccgcaccagggggtttggttcagccgtcgggtggttgcccctcggaagccctgtcttatag

SEQ ID NO: 28080 - DNA, 561 bp, Artificial Sequence
  Description of Artificial Sequence: Synthetic coding sequence
atgtggttggtggagtgcacaggtagagacctgaccggcctgtcatgcttactgtcaatggataggcagccccgcaggcggcagcacgtagcagggtgtagagatgtccctccccctcttccccaaggaagctggggtcagacatcccccaggcactcaattttgtgcagcaagtccggctgcgatctactgggaggcggggagtacaacggcgagacttcgggcgaagaattcctcgcccctgcctggacatgtcgagcccagcaggcagccacatggttgtctgtccagcaaacttcccataaggccctgggacccgccgggggggctgcgatgtcatccaagttgagccctgaggaacagtttctatcgaggatacattttctgcgtacattcatgtgctctgtcgccggtgccgaactgcctggtatacctcaggcaacagaaaatggcgaaggatgtaggccagccagagacccagccagctctccttcctccctgagcatggcctccgtatatacacaatgcagcagcgcacaacttgtgtcagccctatcctag

SEQ ID NO: 28081 - DNA, 612 bp, Artificial Sequence
  Description of Artificial Sequence: Synthetic coding sequence
atgccaaaggcaccaaaaggcaagtctgctggccgcgagaaaaaggtcatccacccatacagcagaaaggcagcccagattacccgcgaagcccataagcaggagaaaaaggagaaattaaagaatgagaaggctctgaggctgaacctggttggagagaagctgcagtggttccagaaccacctcgacccacagaagaaaaggtatagcaagaaggatgcctgtgaactcatcgagcgctacctgaatagattctcaagcgaattggagcagatagagctccataactcgattagggatcggcaggggaggaggcactgttcaagagaaaccgttatcaagcaaacgatggaacgtgaacggcagcaatttgaaggatatggcctggaaatccccgacattctaaatgcttcaaacctcaagacttttcgcgagtgggattttgacctcaaaaagttgcctaacataaaaatgcgaaagatttgcgctaacgacgccatacccaagacatgcaagcggaaaacgattattaccgttgatcaggacctgggggagctggaactgaacgatgagtctagcgactctgatgaagagatgaccgctgtggcctag

SEQ ID NO: 28082 - DNA, 837 bp, Artificial Sequence
  Description of Artificial Sequence: Synthetic coding sequence
atggtgcgtggtgccggacctgggcctagtctatccgcgctctcacatcccacaggagcctccggaatggccgcagcggaaggccctggctacctggtgtccccccaggctgagaagcatcggcgggctcggaattggaccgatgctgaaatgcggggcctgatgttggtttgggaggagttttttgatgagctcaaacagaccaagagaaatgcaaaggtgtacgaaaagatggcctccaagctgttcgaaatgaccggggaacgccgactgggggaagagataaagatcaaaattaccaatatgactttccaataccggaagctgaagtgtatgacagatagcgaaagtgcaccccccgactggccatactaccttgcgatcgatggcattttggctaaagtcccagagtcctgcgatggtaagttgcccgacagccagccaccaggaccatctacgagccaaactgaagcctctctttctccccctgccaaatccactccactttacttcccgtataatcaatgcagctatgaaggtaggttcgaggacgacaggtctgatagctcctcctcattgttgagtctgaaatttagaagcgaagagcgacctgttaaaaaaaggaaagtgcaatcttgccatttacaaaaaaagcagctgcgattacttgaagcaatggtggaagagcagagacgcctttcgcgcgctgtcgaagagacatgtagagaggtaaggcgggtattagaccagcaacacattctgcaggtccagtctcttcagcttcaggagcggatgatgagtctgttggaaaggatcataacaaaaagcagcgtgtag

SEQ ID NO: 28083 - DNA, 561 bp, Artificial Sequence
  Description of Artificial Sequence: Synthetic coding sequence
atggcgtctgtttcatatcagaagcctaccagcactacggttggaaagcagatgatcttcaccgggcccgactacattaaggactacctgcccaaaatccatcagcacacatcatacgtgggcgagcagcatctggccctggaaaagacaggagacctgagatacctctggagacctgcgagcaaccgcagtctcccggccaagtacaaacatgagtacgtctccgaaatcggatggagaattcctcagtataatttcattaacaagtctagattagggtccggcttccatattaagtacgaagagctcagccaggcctctctagactcaatcacccacagataccagaacccttggcaaccgaaacctcatgtactggacatgcaggggaagcagtcacgggcttccttcgcgtggcatatgagcgcctttgaagataccgatcaaagaaactcaaagtgggccatcctggtacggcagtgtaaatcatctctgcccagggccagcaagccccccaaactgcccaagctgccaaaaaaagagaaaaagcgaaaacattag

SEQ ID NO: 28084 - DNA, 342 bp, Artificial Sequence
  Description of Artificial Sequence: Synthetic coding sequence
atggctgacccagaagagcttcaagtgagtagtccacccccgccaccgccttcctccccgtcctccagtgacgctagcgctgcatccagtccaggagggcctgtgtcccttggctggccagtgccaagtaggtccagtggcccaactgtggaccaactcgaagaagtagagcttcagattggagacgccgcttttagcctcacaaagctgctggaggctaccagcgccgtgtccgcacaggtcgaggaactcgccttcaaatgcacagagaatgccagattcctgaaaacctggcgagaccttctgaaggagggctacgatagccttaaacccgacgattag

SEQ ID NO: 28085 - DNA, 930 bp, Artificial Sequence
  Description of Artificial Sequence: Synthetic coding sequence
atgcccgctgagggcggcaagactgacatggagaggataggcctgttcagcgaaatggagtatattacagtcggggataagtacgtgagccagtttaacagaccattcaatgaggcggcttctaagaataagcagatgcttccgggggggtccaaggagatgtccgatctgcaagcagggtattttgaccctcactttgtgaggatttttgaaggggaagggtatataaacttgaaccaggtccgcaggcgcgatatggtggaagccgctaagaagaatctcggcaaagcttttctgcccagtaatggggagaagaaaccctgcgggttaggcagctattatgggacaataggggggcccgtccctttcttctcagctcagagtaaacctagagagaaatataaggcacccggcaaaaacctttacactaatccagggaagaaaggaaccgggtatgggtacgccaacatcaccattggaaaacagttcagtcactcagcagatttttacgacgcagctaaattaaaatataagaaggcaaatgaggagcatcacagactgttgaagggggctccttttaagctcaacctgcatcccagagactatttcgacgctaacccctactttagcgaggagagcctgccaccaattaagaaggaggaaaaaaagaaaaccataagtaatacatttaagccttcgtcacctgggaagaaacccggaggaatgaaagctggcacttttgatccttaccccagccatagcgccgatccgtacgttgccaaattagcgaacatttcagggaaagacgataagatatttcaccctccttctggacccaagtctaggccggtggaatccatcatgacactcaacgtgcgccgcgcactcaacagcaaaaattataaaacctccagtgtgccttcttactag

SEQ ID NO: 28086 - DNA, 486 bp, Artificial Sequence
  Description of Artificial Sequence: Synthetic coding sequence
atgccagccgaaggtggaaagactgatatggagcgaatcggcctgttctcagaaatggaatacattacagtaggtgacaaatacgtgagccagtttaacagacccttcaatgaggcggcatcaaaaaacaagcagatgctccctggcggctctaaggagatgtccgatttacaggccggctacttcgacccgcatttcgtccggatttttgagggcgaaggttacataaatctgaatcaggtgaggaggcgggatatggttgaagcagccaaaaaaaatctgggcaaagcattcctaccttcgaatggtgagaagaagccatgcgggttgggttcctactacggcacgattggaggacccgttccatttttctccgcccagagtaagccccgggaaaagtataaggctcctggaaaaaacctgtacacgaatccggggaaaaaaggcacaggctacggctacgcaaacataactatcggcaaatag

SEQ ID NO: 28087 - DNA, 537 bp, Artificial Sequence
  Description of Artificial Sequence: Synthetic coding sequence
atgcctgcagagggtgggaagacggatatggaaagaataggactcttctccgagatggagtacatcaccgtaggcgataagtatgtttcccaattcaacagaccttttaacgaggccgcttccaagaataagcagatgctgcccgggggctccaaggagatgtctgacttgcaagccggctacttcgacccccacttcgtgcggattttcgagggagagggctatattaacctaaaccaggtgagacgcagggacatggtggaggcagcaaagaaaaacctgggcaaagcgttccttccatcaaacggagagaaaaagccatgcggcctgggaagctactacggcacgataggaggtcctgtcccttttttttcggcccagtcaaaaccacgcgagaagtataaggcacctgggaagaatctgtatactaatcccggaaagaaggggacagggtatgggtacgccaacataaccatcgggaaacaatttagtcatagcgcagacttctacgatgctgccaaattgaaatacaagtag

SEQ ID NO: 28088 - DNA, 831 bp, Artificial Sequence
  Description of Artificial Sequence: Synthetic coding sequence
atgctccgagactcagaagcggaggtgaccgaggaggatcccagactccgcgcccaacagctccaccacagagtgttaacgctgcagtgccaattgcgcgaccaaggagccgcccaccaagctagcctggacgaggctacccgtctccaggaagaactgcaggccaaactggaagaactgcaaaagaaacaacatgaagcaaagctggccgtcacaccactcaaagccaaaatcgccagcctggtgcgaaaatgccgagagagaaacagactcataacacatctgctgcaggagcttcatcggcatggacttggaaatctcctgttatccgaattggcacagaatatgctcaacgatgtcgccctagccgagtatacagctactttcttggcaccgggggtgcccgaaacttcccaccacctggacgtaaagagtgaaatgacggccgctctgagggctcagacttacctccttaatccagagatggattcagttctgcagtcatcactttctagcgaatcctggcccatcccggagccggaatggcccgctcaaactgcccagctggacagtctgaagttaccattgtctctggtgagcaccctagatcccggaacttgcctggcagcagtgactgtcgaaccgggcttgcccgcccagcgattgcaagagaagggcggaatgccttgtcccgcgctgcaggtggataatgtcccagctccctctgaactgctctcccccgcgcgaattcttgccttccaccaggagctccgccaatccatatgttccaacagccaggtgcataagagcccactcgaactagagatgtag

SEQ ID NO: 28089 - DNA, 2253 bp, Artificial Sequence
  Description of Artificial Sequence: Synthetic coding sequence
atgctgttcttcgcgggcgagacagggctgcctctgttcccccgatttgccctctcagttgagggggccgagccgacagatcacgggcacccccaggcagtgtctaaaggccacaataggtgtgcccttacaatagacgaattggcacaagacgtcgaagcttgcttccaacaactgagtaccctgcagccaggatctagaggatggcaatgcagcgctagcgcttgtaggggcgagaactggtcatttgcccagaaatggcatagcggttgggaacgggcccactcacaacaggtttggggtaattgggggatctgctctaacgaagaagccaagagtaaggagagcggggagggcgataagccgggaaaaaccactgctcttggaactagcgaggtccctggcaaccccggaactctgcctcactgggacgaagccagccctaatcccccgcaggggcctgccgaaccctggggggccttagagcgggtgagaagtcggtttcaccaactgatctccggactcaaaaagcagcgcagtcagattctgcatgataacactaagttgcacggcgatcaggaaagattccatgaaagagtgtgcgcactggagagggagagggagcgggaggtaacgaaaatctccaggctggaaagagacaatcacagactagtgggggacattagccagctaaaaaaagaattagatcagtatctccaggctatctccgaccttgaagactgcaatgggaagtcttactgcaaaatcctggaattggaggaggaaaacgaaacccttaagggcaacctggggcagcttcaaaaggccacttccgaaagcgtgcgcaagagcaaagacacaatggaacaggtaactctggagaattggaaactgcagactctgatctcggaactcggcgtctcatacaaggagctcattaaggatattgtgctgggcattgaggatatgattcgcgccctctctggggagaacgaacacctgctacgccgggtgcatgtccttgaaagagaagtgaccttgcagcgttccaccgaccaaggccggctggtgcgtggtcgcgagcacctccagggaaaggccaagatgcatgctcttgacaaggaagtccaggtaaccccactgactggccaactgcttagccgcgcttgtggtccccccctcgaagaagaaatgagcctggctgctggccagaccgggcccagtactggaacgggaaatagtcgccgtggcgcggactcgcctcctccttcccttgtatggcggaacaccggagtggcaaatgccttgcaaggcaacgtgagcggcgccgaagtgaaggaggcccaccttgagaaagaggaaaagaggccgcgatgctccgtggctcagggtcaggcacttagttcgctgtctaatggccctatgctacgggacagcgaagctgaagtgacagaggaagaccctaggctgcgggcacaacaattgcatcatagagtcttaaccctgcagtgtcagctgagagatcagggcgccgcccatcaggccagcctcgacgaagccacccggttgcaggaggaactgcaggccaagctggaagaactacaaaagaaacagcatgaggcgaaactggccgtcacccctctgaaagctaaaatcgcttcactggtgcggaagtgtagagagcgaaacaggctaataacccatctgctgcaggaactacaccggcacggcttgggcaatttgctgctcagcgagctcgcacagaacatgctgaacgacgttgccctggcggagtacaccgcaacattcttggcccccggagtccccgagacctctcaccatttggacgtgaagagcgaaatgactgccgccttgagagcccagacctatctgctaaaccctgagatggattccgtgctccagtcgagcttgagcagcgagtcctggcccattccagagccagagtggccagcccaaactgcccagctggacagcctgaaactgcctctgagtctcgtaagtaccctggatcctggcacctgtctggctgccgttacagttgagcctggcctgcccgcacagcgcttgcaggagaaggggggcatgccatgccccgccctccaggtggataacgtccccgctccgtccgaactgctgtccccagcacgaatcctcgcctttcaccaagaattgaggcagtccatctgtagtaattctcaagttcataaatctcccctggaattagaaatgtag

SEQ ID NO: 28090 - DNA, 609 bp, Artificial Sequence
  Description of Artificial Sequence: Synthetic coding sequence
atgtcacactacttttatctcactccacaaattttgcttcccttctcaccgctcaccagccaggaatttgaccttatccgacgaaaagccggggcctcgtggcaagacgagacccggtggtcggacagcagcgttaccacgtacacgggttcctatcgaaaaaaacagttggacaagtcaatgtgtagccagttttccttcagagccggacaacacgagcccgagtgtaagcagatgagcctgaccaactcctctgcatgccacctgctatgctgggccggaacccaggagactaccgacataaaaggattgttcccagatatcacccgaccgtttaagaagtcattcgatgtcaaacatggcgtggcacaccagatctgggacttcggggattgtttccctactccacccaattatggcaaatattgtgtgcgccctaaaaagcccgcccaggaggccctgatcaattacagccgtagggggaaaggagtactcaagcatcttcatggaaggtgcgattctgaaagcaaggtctgttcatccgaagacagcgaagccgatagatactctgactacggatggggaggaccctcaagcccattcaattag

SEQ ID NO: 28091 - DNA, 489 bp, Artificial Sequence
  Description of Artificial Sequence: Synthetic coding sequence
taggattcctctgttacaacttatacggggagttaccgaaaaaaacagctggacaaatcaatgtgcagtcagttctcatttagagcagggcagcacgagcccgaatgtaaacagatgtcactgacaaactcttccgcttgccacctgctgtgctgggcaggtacccaggagactactgacattaaaggtctatttccggacatcacaaggcccttcaagaagtctttcgacgtgaagcatggagtcgcacatcaaatatgggactttggagactgtttcccgacccctcctaattatggaaaatattgcgttaggcccaaaaagcccgctcaggaagcattgatcaactattcaagacgcggaaagggcgtcctgaaacacctgcacggaagatgcgattcggagtccaaagtatgttcaagcgaggatagcgaggctgatagatactcagattatggatggggaggcccttctagtccattcaactag

SEQ ID NO: 28092 - DNA, 507 bp, Artificial Sequence
  Description of Artificial Sequence: Synthetic coding sequence
atggtgaaagaggtttggagagtgctgcgcgaagaaccaggccggcgaaaagaaagccgacagaatcgagcgcgcggcaaccgcgtccagcagaatagcagcaacctgaacccgactcccgcccctggtccacattctaccgaatcaagggggcgaagaagggcggggtctgaggccccacctgttcccgggagtgagtctttgtccacaagctccgagcgcggccatggcccggcagtgggtaatttggtttctgaatccgccgggcgatctgccggccagggttccccagggcccgacgccatgtctcgaaacctccggactgctctgattttcggtggttttattagtctaatcggcgccgcattctaccccatttattttaggcccctgatgcgactcgaggagtacaaaaaagagcaagcaatcaatagggcaggcattgtgcaggaagacgtccagcctcctggccttaaagtatggagcgaccccttcggcaggaagtag

SEQ ID NO: 28093 - DNA, 204 bp, Artificial Sequence
  Description of Artificial Sequence: Synthetic coding sequence
atgagccgcaacctcagaactgccttgatctttggagggttcattagtctgattggcgccgccttttacccgatttacttccgccccctgatgaggctggaagagtacaaaaaagaacaggctattaatcgggccgggattgttcaggaagacgtgcagcccccgggtcttaaagtgtggtctgacccatttggccgtaagtag

SEQ ID NO: 28094 - DNA, 282 bp, Artificial Sequence
  Description of Artificial Sequence: Synthetic coding sequence
atggacacacagaagcagatccataagacacataactctaagaaccagttttttactattttcttcttcctcagtgttgagtttgggaaggagggaacgcgcaaaaatttctatttacttttgtccattggacactatggtagaaaatcacgaagagctgacctgggcactgctgacaccgcagacaaaactgagccagaatgcttcgctgcctcttggacgttcgatcctaacccctccgtgacagtctccggggcccatagcacagctgtccaccagtag

SEQ ID NO: 28095 - DNA, 477 bp, Artificial Sequence
  Description of Artificial Sequence: Synthetic coding sequence
atgcccgagccgccaaccccttcagtgggctcctgtgcagccagggcctccaggatgtccgcagctccatgcagcagggcaccctcgccaatcgaccacccaagagctgaggagtgcggcagggctgcaagggactggcaggcggcccctccagcagctccagtccgcgaccccctcggcgaggcgagctgggcccctgaatctggggaggatatggaaaatctctacgtacagttgaaactgcagtctgtgggaacgtgctttaaccgagaagagcttcctagcgtcctccagggggaggagttaggcgccacaagcgtgactaataaaccaggcctatccgcaatgcgaaaggagactgatcaacaagtgggggagcgcaaattgacatattgcggagaccaggtgactctttttaccgaccaggccctctctcagattctcagttctgaggagggtcggatcaaggtcatgtag

SEQ ID NO: 28096 - DNA, 1329 bp, Artificial Sequence
  Description of Artificial Sequence: Synthetic coding sequence
atgagcgactccgctgggggccgggcggggttgcggcgctaccccaaactgccggtatgggtggtcgaggatcatcaggaggtgctaccatttatttatagggccatcggatctaaacacctgccagccagcaatgtgtcattcctgcactttgatagccatccagacctgttgattccagtaaatatgccggcggatacagttttcgataaggagacactcttcggcgaacttagtatagaaaactggatcatgcccgccgtgtatgcaggtcacttttcccacgtgatctggtttcatcctacctgggcccagcagatacgggaaggtcgacaccacttcttagtggggaaagacacatccactaccacaatcagggtcacctcgacagatcattattttctcagcgacgggttatacgtgcccgaggatcagctggaaaaccagaaaccactgcaactcgatgtgattatggtgaaaccgtataaattgtgtaacaatcaggaggaaaatgacgcagtgtctagcgccaaaaagccaaaacttgcgctggaagatagtgagaatactgcctccaccaattgcgactcctcttctgaagggctggagaaagacactgccacccaaaggagcgaccagacttgcctggagccctcatgttcctgtagttccgagaatcaagagtgccagaccgccgcctccaccggagaaatacttgaaatcctgaagaaggggaaagctttcgtccttgatattgatctcgacttcttctccgtgaagaaccccttcaaagagatgtttacccaagaggaatacaaaatcctgcaggagctgtaccagtttaagaaacctggtacaaatttaaccgaggaggacctcgtggatatagtggacaccagaatacatcagctggaggacttggaagccaccttcgctgatctctgcgatggggatgacgaggaaaccgtgcagcggtgggcgtcaaatcctggaatggaatcccttgtcccactggtccagagccttaagaagcgcatggaggttccagactacgagatggtgcatcaggcagggctgacctgcgactattctgaactgcctcaccacatatctacagaacaagagatcgagtgtctcattcagagcgtgcactacctgctgaaaaacctacccaatcccacactggtgacgatcgctagaagttcactggacgattattgcccttctgaccaagttgacacgatccaggaaaaagtgcttaacatgctgcgagctctgtacggcaacctcgatcttcaagtgtatgcagccgaatcccccccctcatag

SEQ ID NO: 28097 - DNA, 492 bp, Artificial Sequence
  Description of Artificial Sequence: Synthetic coding sequence
atggaagtgccggattacgaaatgtttcctgcctcttcttcatcaccctctgaaaccacctccgcatggatttctctctcaatgtcattatccgccttctggagcaaacccttcaacaaatccttaggcagtagcaagctttccaatatctcgctcccctctagcgagcctagcaagctcttccagcccctccccgtgcctaagctgttgccccacttccaggtccaccaggctggtctcacatgtgattattcagagctgccccatcacatctctactgaacaagagatcgaatgtctgattcagtccgtgcactacttgttaaaaaaccttccaaaccctactctcgtgaccatagcccgctccagcctggacgactactgcccatctgatcaggttgatacaattcaggaaaaagttctaaacatgttgcgggctctgtacggaaaccttgacctgcaggtttacgctgccgagtcaccaccgtcctag

SEQ ID NO: 28098 - DNA, 534 bp, Artificial Sequence
  Description of Artificial Sequence: Synthetic coding sequence
ttggtttcacaagaggaatataagatactgcaggaactctaccaattcaaaaagccaggaacgaaccttaccgaggaagatcttgtggacatagtggacactcgaatacatcagcttgaagacctcgaagcaacgtttgccgacctgtgcgatggcgatgacgaggagacggtgcagagatgggccagtaaccctgggatggagtccctggttccccttgttcaaagcctgaaaaagaggatggaagtcccggattatgagatggtacaccaggcaggcctgacttgtgattactctgagttaccacaccacatctcaaccgagcaagagatagagtgcctaatccaaagcgtccattacctgctcaagaacttgccaaatccgactctcgtgaccatcgccaggtccagcttggacgactactgcccgtcagaccaggtcgataccattcaagagaaagtgttaaacatgctccgagcattatatggcaatttagatctccaggtatacgccgcagagtcccctccttcatag

SEQ ID NO: 28099 - DNA, 567 bp, Artificial Sequence
  Description of Artificial Sequence: Synthetic coding sequence
atgatgcacccagtggcctcaagtaatcccgccttttgtggacctggcaaaccttcttgccttaatgaggatgctatgcgggctgctgatcagtttgatatatacagtagtcaacaatcaaagtactcacacaccgttaaccataagccaatggtgtgccagcgacaggacccactcaacgaaactcacttacagaccacgtcgggcagatcaatcgagattaaggatgaacttaagaagaagaagaaccttaaccgaagcggtaaaaggggcagaccctctggcaccaccaagtccgcaggttatcgtacatcaacgggacgccccctcgggaccaccaaagccgcaggattcaagacctcaccaggacgccccctcgggaccactaaggctgccggctataaagtcagtcctggcagacctcccggttcaattaaggctcttagccgtctggctgacctcgggtacggttgcggcacagcagcctttccttaccccatgatgcatggccgcgcagtacacggagtggaggagaccagcagcgaggtgaaacctcccaacgagtag

SEQ ID NO: 28100 - DNA, 567 bp, Artificial Sequence
  Description of Artificial Sequence: Synthetic coding sequence
atgatgcaccctgtcgcatcatctaatccagccttttgcgggcctggcaaaccatcctgtcttaacgaagacgcgatgagagcggccgatcagtttgatatctactctagccagcaatccaaatacagccatactgtcaatcataaaccaatggtatgccagcgtcaggaccccttgaacgaaacacacctgcagaccacgagtggccgatcaattgaaattaaggatgagctgaaaaagaagaaaaaccttaatcggagcggcaaacgcggtagaccctcgggcaccaccaagagcgctggctacaggaccagtacagggagaccccttggcacaacaaaggctgcagggtttaaaacttctccgggtcgccctctcggaacaacaaaggcagcaggctacaaggtaagtcctggacggccccctgggagcataaaggccctcagccgtctggcagacctgggctacggctgtggcaccgccgcgtttccctaccccatgatgcatgggagggccgtccacggagttgaagagacaagctctgaggtgaaaccccccaacgaatag

SEQ ID NO: 28101 - DNA, 567 bp, Artificial Sequence
  Description of Artificial Sequence: Synthetic coding sequence
atgatgcatccggttgctagctcaaatcccgccttttgtggtcccgggaagccctcctgtctcaatgaggacgccatgcgggccgccgatcagttcgatatatatagctcacaacagagtaaatactcccacactgtgaatcacaaacctatggtttgtcagcggcaggatcctctgaacgaaacacacttacagactaccagcggccgatcaatcgagataaaggacgaattaaaaaagaagaagaacctgaatcggagcggcaaaaggggacggccaagtggcaccactaaatccgcaggctacagaaccagtaccgggcgaccgttgggaacaacaaaggcagcgggttttaaaactagtccgggacgcccactgggcactaccaaagccgctggctacaaggttagccccggtagaccgcccgggtccatcaaggccctgtcacggctggctgacctaggatatggctgtggaaccgccgcttttccttaccccatgatgcatggtagagctgtccacggtgtggaggagacctcatccgaggttaaaccaccaaacgaatag

SEQ ID NO: 28102 - DNA, 24 bp, Artificial Sequence
  Description of Artificial Sequence: Synthetic coding sequence
atgatgcacccggtcgcttcatag

SEQ ID NO: 28103 - DNA, 1002 bp, Artificial Sequence
  Description of Artificial Sequence: Synthetic coding sequence
atgccccgatcgtttgagcaggtcataatactaaagaaatggttcctcaagccatataaagggcaaacgctgcctgggcgcgttctctttctgaggtatgtggtacagacgctggaggatgattttcagcagactctgaggcggcaaagacagcacctccagcagtcaatagccaatatggtactgagctgcgacaaacagccgcataacgtgagagatgttataaagtggctagtgaaagcggtcactgaggacgggcttacgcaacctccaaatggcaatcagacgtccagcggaacaggaatactgaaggcctcctctagccatcccagtagccagcccaatctgactaaaaacacaaatcagctcatcgtgtgtcagttacagagaatgctgagtattgctgttgaagtagacagaacccctacatgcagcagtaataagatcgctgaaatgatgtttggcttcgtgctcgacatacccgaaagatcgcagagggagatgtttttcaccacgatggagagtcacttactgaggtgcaaagtcctggagattatcttcctgcacagttgcgaaacacctacaaggctgccgctttcacttgcccaagccctgtactttcttaacaatagcacttctcttttgaagtgtcagtctgataaatcacagtggcagacatgggatgagctggtggaacatctgcagttcctgctttcctcataccagcacgttcttcgtgagcatctccggagctcagtaatcgaccgaaaggaccttatcatcaagcgaattaagccaaaacctcagcagggcgatgacatcacagtggttgacgtggagaaacagattgaggcctttcgaagcaggttaattcagatgctcggtgaacccttggtgcctcagcttcaggataaagtccacctcctgaagctcttgttgttttacgctgcagatctaaacccagatgccgagcccttccagaaaggctggagcggcagttag

SEQ ID NO: 28104 - DNA, 1374 bp, Artificial Sequence
  Description of Artificial Sequence: Synthetic coding sequence
atggaggacttcattgtaatcagcgacgattcgggaagcgaatcttcaggcggggcacggccagggcgctcgagacgaccccggagagccctctcacgaacctcaggggccttgcctcggcgtacagttaataagggccagaagttagagcccatccctcatcggagactgcggatggtgacgaatactatcgaggagaatttccccctgggcaccgtccaattcctgatggattttgtgtcacctcagcactatccacctagagaaattgtagcccacattattcagaagattctgctgtcgggatcagaaactgtcgatgtgcttaaggaagcctatatgcttttaatgaaaattcagcagctccaccctgccaatgccaagacagtggagtgggattggaaactgcttacatacgtcatggaggaggaaggacaaaccctgccaggacgggtgttgttcctccgatatgtggtccaaacactcgaagacgacttccaacagaccctccgccgccagaggcagcacttacagcagagcattgcaaacatggtgctgtcatgtgataaacagccgcataacgtgagggatgtgatcaagtggcttgttaaggccgtgactgaagatgggctcacccaaccaccaaacggaaatcaaacctctagcgggacaggaattctcaaagcgagcagctctcaccccagctctcagcccaacctgaccaagaatacaaaccagctaatcgtgtgtcagctgcagcgaatgctcagtattgccgtagaagtcgacaggacccctacgtgttcttctaacaaaattgctgagatgatgtttggcttcgtattggacatccctgagcgatctcagagagagatgttcttcacgactatggaaagtcatttgctcagatgtaaagtactcgagataatcttccttcattcatgtgaaaccccaactcgcctccctctctccttggcacaggcactgtacttcctgaacaactcaacctcactgcttaagtgccagtctgataagtcccagtggcagacctgggatgagctcgtagagcacttgcagttcctgctaagctcatatcagcatgtgcttagagagcatcttcggagcagcgtcattgatcgaaaggaccttatcataaaacgaattaagccaaagccccaacaaggcgatgacatcactgtggttgatgtggaaaaacagatagaggccttcagaagccggctgatccagatgcttggggaacctcttgtgccgcagctccaagacaaggtgcacctcttaaaactcctgttgttctacgccgcagacctgaacccggacgccgagccgttccagaagggttggagcggtagctag

SEQ ID NO: 28105 - DNA, 978 bp, Artificial Sequence
  Description of Artificial Sequence: Synthetic coding sequence
atggaaggacacgtcgacaggtcttcacagcctaccgctcgccgcatcattaattctgacccagtggacctagatttagtcgaggaaaacactttcgtcgggccccccccagcaacttccatctccggaggctccgtgtaccccaccgagcccaactgctcatcagcaacatttaccggcaacctttcctttctggctagcttgcaactgtccagcgatgtgagcagcctgtcaccaaccagcaataacagtcgatcgagctcatccagtagcaaccagaaagcccctttaccctgtccgcaacaggacgtttcacgaccccctcaggcacttccctgcccccttcggcccttgccatgccccccccgtgcctcaccttgccctccccgcgcttcgtcatgcccaccaagagccctcagctgcccctcccagaccatgcagtgtcagttgccggcgttaacccatcctccccaggaggtgccctgcccaaggcagaacattccagggcctccccaagattcactgggacttccccaagacgtccccgggctaccacaaagcatacttcatcctcaggatgtggcctacttacaagacatgcctcgttctcccggggacgtaccccaaagtccatcagacgtttcaccatcccccgatgctccacaatcccccggggggatgcctcatctacccggggacgtccttcactctcccggagatatgccccattcaagtggtgacgtaactcatagccctagagatattccccatctgcccggcgaccgccctgatttcacacaaaacgacgtacagaacagagatatgccgatggacatcagcgcgttgtcttccccatcttgctctcctacctggggaacagagcaggatagtgtgaagaagaagaagaaaaaaaagcgcaaagagatccctcctaactttctcctgtttaacctttaccgcacaagggtgaagaactag

SEQ ID NO: 28106 - DNA, 1836 bp, Artificial Sequence
  Description of Artificial Sequence: Synthetic coding sequence
atggaagactttatcgtcatcagcgacgattccgggagtgaaagctctggcggagccagacccggaaggtctcgacggcctcgacgagcgctgagtcgaacgtcaggagcgctgccaagacgcactgttgatttcatagacctcactcgcgagaccagacccagaaccaaagaccggagcggactttacgtcatcgacctaactcgcgctgagggagagaatcgcccaattgccaccctggacctcaccctggagcccgtgactccttcacagaaagagcctaccagcttacagacctgtgcatccctgtcaggcaaagccgtgatggagggacatgtcgataggtcatcccagcctaccgcacgccggattatcaattctgaccccgtggacctggacctggtggaggagaatacatttgtgggacctcccccagccactagtatcagcggtggaagcgtgtaccccaccgagcctaactgtagttcagctaccttcactggtaatctttcgtttcttgctagcctgcagttgtctagcgatgtgtcatcactatcaccgacttccaataattcccgaagttcgtctagtagctcaaaccagaaagcgccactgccctgtccccagcaggatgtgagcaggccaccccaggcccttccatgtccgctcagacctctgccatgtcctcctcgggccagcccttgcccacctcgagcttcttcctgcccgcctcgagccctgtcctgcccctcgcagaccatgcagtgccagctgcccgctctgacccaccccccccaggaagtgccgtgccctcggcaaaatattccagggcctcctcaggactctctgggcctgccacaggacgtgcccggactgcctcaaagcatactgcacccacaagacgtggcctatctgcaagacatgccaagaagccctggagacgtcccacagagcccttcagatgtctctccgtcgcccgatgcaccccaatccccaggcggaatgccacaccttccaggcgatgtgctccattccccaggagacatgccacatagcagtggcgatgttactcactcgccgcgggatatcccccacctccctggagatcggcctgacttcactcagaacgatgtccaaaaccgggacatgccaatggacatcagtgcgctcagtagccctagttgttccccctctcctcaatctgagacccccctcgaaaaggtcccatggctctcagtgatggagactcccgccagaaaggaaatctcactatcggagcctgctaaacccggctctgctcatgtccagagcagaaccccccagggcgggctgtacaaccgcccatgcctacacaggctgaagtactttcttagacctcctgtgcaccatctcttctttcagaccttgatacccgacaaggatacaagggagaataagggccagaaattagagccgatccctcatcgaagactgcggatggtgaccaacacgatcgaagagaattttccgttaggtaccgtgcagttcctaatggactttgttagtccacagcactaccctccaagggaaatcgtggctcatatcattcagaaaatcttgctgagcggaagtgagactgtggacgttttgaaggaggcctacatgttactaatgaagattcaacagctgcatcctgctaacgcgaagactgtcgaatgggattggaaactgctgacatatgtgatggaagaagagccagctgagtgcctcagactgcaagcacgcgccaccacccctgattggttctggtggcgtagggggttcgctgttcttgcgggtcctgtgagttccccctag

SEQ ID NO: 28107 - DNA, 1374 bp, Artificial Sequence
  Description of Artificial Sequence: Synthetic coding sequence
atggaagattttattgtaatttccgacgatagcggttccgagtccagtgggggagccaggcctggccggtcccggagaccaaggagagccctatctagaacatccggagccttgccccgccggacagtgaataagggccagaaactggagccaatcccgcaccgcagactgcgcatggtgaccaacacgatcgaagaaaacttcccactcggcaccgtgcaatttcttatggattttgtgtccccccaacattacccgccacgggagatcgttgctcacatcattcagaagatcctcttgtccggtagtgaaaccgttgatgttctcaaagaagcgtatatgctgctgatgaaaattcagcagctgcaccctgccaatgccaagactgtagagtgggattggaaattgctcacgtatgtgatggaagaggagggtcaaacgctcccaggtcgcgttctctttctgaggtacgtggtgcagaccctggaggatgacttccagcagacgctgcggcggcaacggcaacacctgcagcaatccatcgcaaatatggtgctgtcttgcgataaacagcctcacaatgtccgtgatgtcattaaatggctagtgaaggccgttactgaagacggattaacgcagcctccaaacggcaaccaaacatcgtcgggaactgggatccttaaagcatcaagttctcacccttcatcgcagccaaacctaacaaagaatactaaccagctcattgtatgtcagctgcaacggatgctctcaatcgctgtggaggtagatagaactcccacttgctcttccaataaaatagccgaaatgatgttcggttttgtcctagacatacccgaacgaagtcagagagagatgttctttacgaccatggagagccacctcttacggtgcaaagtgctggaaatcattttcctccacagctgtgaaacacctacccgactgcctcttagcttagcccaagcactgtacttcctgaacaattcaacgtcactcctgaagtgtcagtccgacaagtcccagtggcagacatgggatgaacttgtggagcacttgcagtttctcctgtccagttatcagcacgttctgagagaacatctcaggtcctccgtgattgaccggaaggatctgatcatcaagagaatcaagcccaaaccccagcaaggagacgatatcacggtggtggacgtggagaaacagatagaggccttccggtcacgacttattcagatgctgggtgagcccttagtccctcagttgcaagacaaagtgcaccttctgaaactccttctgttctatgcggcagacctcaatccagatgcggagccttttcagaagggttggagtgggtcatag

SEQ ID NO: 28108 - DNA, 2619 bp, Artificial Sequence
  Description of Artificial Sequence: Synthetic coding sequence
atggccccagcttcggctagtggtgaggatcttcggaagcttcctacaatggctgaggtcaacggtgaacaggatttcatagacctcactcgcgaaacgcgaccccgcaccaaggatcgcagcggtctatatgtgattgaccttactagagccgagggggaaaacaggcccatcgccacactggacctaactctggaacctgtgacaccaagtcaaaaagagcccacttcacttcaaacctgtgcatctctgtctgggaaagcagtcatggaggggcatgtggaccgctcaagtcagccaacagcaaggcgaattatcaatagcgatccagtcgatctggatctggtggaggagaacacttttgtcggaccccctcctgccactagcatctcgggagggtcagtgtatcccaccgaacctaactgctctagcgcgacttttactgggaatctcagtttccttgccagcctgcagctgtcttcagacgtcagttccctatcgcccaccagtaacaattcccgcagctcatcatccagttccaaccaaaaggccccactgccatgtccccagcaagacgtatctcgcccgcctcaggcgttgccttgcccgttacgtcccctgccctgccctcctagagccagtccgtgccctcctagggcctcgagttgcccaccccgcgcactttcctgccccagccaaactatgcagtgccagctcccagcactcactcatcccccacaagaagtgccttgccctcgccagaatatcccaggtcccccccaggatagtctgggcttaccccaggatgtcccaggactgccgcagtctattctgcacccccaggacgtcgcgtatcttcaagacatgcctagatctcctggcgacgttccacagtccccgtcagacgtttctccaagcccagacgcacctcagtcacctggtggtatgccacatctaccaggtgatgtgctgcacagcccaggcgatatgcctcattcatccggggatgtaacacactcaccacgggacattccacacctgcctggagacaggccagatttcacgcaaaatgatgtgcagaatagagacatgcccatggatatatccgctctcagtagcccatcatgttcccccagtccacaatctgaaacacccttggagaaggttccctggctgtctgtcatggagaccccggcgaggaaggagatctcattaagcgagcctgccaaacctggctccgcacatgtccagtctcgcactccccagggtggtctgtataaccgcccttgccttcatcgacttaagtatttcctccggcccccggttcatcatctcttcttccagaccctcataccagataaggatacccgcgaaaataaaggccagaagctggagcccattccacacagacggcttcgcatggtgaccaatacaatagaggagaattttcccctgggtacggttcagtttctgatggacttcgtgtccccccaacactatccaccgagggaaattgttgcccacattatccagaagatcctactcagcgggagcgagacagttgacgtgctgaaggaggcttatatgttgctcatgaagatacagcagctgcaccccgccaacgctaagactgttgaatgggattggaaactcctcacctatgtgatggaggaggaaggacagaccctacctggtagggtgttgtttctgcggtacgtcgtgcagacgctggaagatgattttcagcaaacgttgaggagacaacgccagcacctgcagcagagcattgctaacatggttctatcatgtgacaaacagccccacaatgttcgtgatgtgatcaagtggcttgtcaaagctgtcactgaagatgggttaacccaacctcctaacggcaaccagactagttcaggtactggtattctcaaggcgagttcttctcatccctctagccaacctaacctgactaagaacaccaatcagctcatcgtgtgtcaacttcagcggatgctgtctattgccgtggaggtcgatcgtacccccacctgctctagcaataagattgctgaaatgatgttcggtttcgtcctggacattcccgaacggtcccagcgagagatgtttttcacgactatggaatctcatctactgcgctgcaaggtgctagagattattttcctgcattcctgcgagaccccgacacggctgcccctctcattggcccaggctctgtacttcctgaacaatagcacttcactactgaaatgtcagtctgataagtctcagtggcagacctgggacgaactagtcgagcaccttcagttcctgttaagctcctatcagcacgtgctgagagagcacttgcgttcctccgtcatcgacagaaaggatctcatcatcaagcggatcaaacccaagccacaacagggtgacgatatcacagtcgtcgacgtggaaaagcagatcgaagcatttagatccaggctgattcagatgctcggtgaacccctggtacctcagttgcaggacaaggtacacctgctgaaactactgctgttttatgctgcagacttgaaccctgacgcagagcctttccagaagggctggtctggcagctag

SEQ ID NO: 28109 - DNA, 291 bp, Artificial Sequence
  Description of Artificial Sequence: Synthetic coding sequence
atgaccccctgcctggagtccttctgtcaacgcgccaaagattgtaagcaaaatatccccctgccctttctaatccaggattggcctctcagtgagtcaaaaccccagggccaagatttctggacccctcagcccctacaagctgcagctccctcccacgagtttcagcaggtggcccttcatcccgctaggaccaggttggctagtcgacctcaagggggtcgccttatgtcttcacgggaggttgggttgagggccccccgctgtagttgcggtaagcgcaagagatag

SEQ ID NO: 28110 - DNA, 291 bp, Artificial Sequence
  Description of Artificial Sequence: Synthetic coding sequence
atgacaccctgtctggagtccttttgtcagagagctaaggattgcaaacagaacattcctctcccgttcctgattcaagactggcctttgtccgaaagcaagcctcaaggccaagacttctggacaccacagcccctccaagccgccgctcctagtcacgagtttcagcaggtagccctccaccctgcaagaacacggctcgcttcaaggccgcagggtgggcgcctgatgagcagtagggaggtcggactgagagccccaagatgttcatgtggaaaacggaagcggtag

SEQ ID NO: 28111 - DNA, 621 bp, Artificial Sequence
  Description of Artificial Sequence: Synthetic coding sequence
atggaggtggatatcaacggagagtccagaagtaccctcacgactttgccatttccaggggcagaagccaatagtcccggtaaggcagaggcagaaaagccccgctgttctagcacgccatgctctccgatgcggagaacggttagcggctatcagattctgcatatggactcgaactatttagtcggattcacgactggagaggagctgttgaagctagctcagaaatgcacaggcggcgaagagtccaaggccgaggccatgccaagcctgagatcaaagcagctggacgccgggttggctaggtcctcgagactgtataagaccagatctaggtattaccaaccttacgagatacctgcggtcaatggtcgacggagacggagaatgccgtcctctggcgataagtgcacgaagtctttgccgtatgaaccctataaagctctgcacggcccactaccactatgcctgcttaagggtaagagagctcactctaaaagtttggactatctcaacctggataagatgatcaaagagcccgccgataccgaagtcttgcagtaccagctgcagcatctcacattacggggtgatcgcgtatttgcacggaacaacacttag

SEQ ID NO: 28112 - DNA, 621 bp, Artificial Sequence
  Description of Artificial Sequence: Synthetic coding sequence
atggaggttgacattaacggggaaagccgctcaactctgactacactgccctttcctggcgccgaagcaaacagtcctggaaaagcggaagccgaaaaacctaggtgtagctcaaccccttgctccccaatgcgcagaactgtgtctggataccagattctgcatatggactctaactatctggtgggatttactaccggtgaagaactgttgaaactggcccagaagtgtactggcggggaagagagcaaagctgaggccatgccatctctcaggagtaaacagctcgatgccgggcttgctaggagcagccgcctctataagactcgcagtaggtactatcaaccctatgagattcctgctgtaaacgggcgccggaggagaagaatgccctctagtggagacaaatgcacaaaatcgttgccctacgaaccttataaggccctgcatggtcctctccccctgtgcctcttgaagggcaagcgcgcccacagtaaatcactggactacctgaatttggataaaatgattaaggagcctgcagatacagaggtcctgcaatatcagctccagcacctgacccttaggggggacagggtcttcgcaagaaataacacatag

SEQ ID NO: 28113 - DNA, 621 bp, Artificial Sequence
  Description of Artificial Sequence: Synthetic coding sequence
atggaggtcgacatcaacggggagagtaggtcgacccttacgaccctgccttttcctggggcagaggcgaattctccggggaaggccgaggccgagaagcctcggtgttcgtccactccgtgtagccctatgcgcagaacagtgtccggctaccagattttgcacatggattccaactacctcgtgggatttacaaccggtgaggaattgttgaaactggctcaaaaatgcaccggtggggaggaaagtaaagctgaggcaatgccctctctgcggtccaagcagctggatgcaggcctcgcaaggtccagtaggctttacaaaacacgatctcgatattatcagccttatgagataccggccgtgaacggaagacgacgcaggaggatgcctagctctggggataagtgcaccaagtcccttccatacgagccctacaaggctctgcacggtccattgcctctatgccttctgaagggtaagcgagcccactcaaaatcattggattacctgaacctggacaagatgatcaaagaaccagcggacactgaggtcctacagtatcaactgcagcatctaacccttcgcggcgatcgtgtattcgcccgcaataacacttag

SEQ ID NO: 28114 - DNA, 621 bp, Artificial Sequence
  Description of Artificial Sequence: Synthetic coding sequence
atggaagtggatattaatggtgaatccagatctactcttaccactctgcccttccctggggccgaagccaatagtcctggcaaggccgaggccgagaagccccggtgctcttcaaccccttgcagtcccatgaggcgtacagtgagcggctatcagatcctgcacatggattccaattacttagtgggtttcactacaggtgaagagctcctcaagctagcccagaagtgtacaggcggggaagaatccaaagccgaagcaatgcccagcctcagaagcaaacagttggatgccgggctggccagatcttccagactatacaagactagatctagatactaccagccgtacgaaattcccgctgtgaatgggcgcaggcggagacgaatgcctagcagtggagataaatgtacaaagagtctcccttatgaaccctataaagcactgcacgggccactgcccctttgcctgcttaaaggcaaacgcgcacattcaaaatctctcgattacttgaacctcgacaagatgatcaaggagccagccgataccgaagttttacagtaccagctccagcacttaacactgaggggcgacagggttttcgcccgaaacaatacgtag

SEQ ID NO: 28115 - DNA, 294 bp, Artificial Sequence
  Description of Artificial Sequence: Synthetic coding sequence
atgaaccaggagaatcccccaccatatcctgggcctggtcctaccgccccatacccaccctatccccctcagccaatggggcccggtccaatgggcggtccctatccacccccccagggctatccttaccagggctacccccagtacggatggcagggcggaccacaggagcctcctaagactaccgtgtacgtggtggaggaccaacggagagatgagttgggaccttccacttgtttgacagcctgctggactgctttatgctgttgctgtctctgggacatgttgacctag

SEQ ID NO: 28116 - DNA, 1917 bp, Artificial Sequence
  Description of Artificial Sequence: Synthetic coding sequence
atggccgcagaacttagaatgattctgtacgaagacgactcagttcaagtccagtacgttgacgggagcaccctgcagctctccccatgtggcacagagtttttattcgagaagagcccccccgtctctgctcatccactggaacaacctgagaggattaggcagcgaacccacttcgtgatatctacttacagggaacagttacagcgggccctcgatttcagaaactctagcgcaacttgtcccttcttgagtgagactatcatcccgtctgaaagaaagaagcatatatttatagatatcaccgaggtgaggtggccttcactcgacaccgatggaacaatgatttacatggagtccgggattgtgaagattacatccctggacggacacgcatacctttgcctgccacgtagtcagcacgagttcacagtgcattttttatgcaaggtttcccagaagagtgatagtagcgcagtgctgagcgaaactaacaacaaggctccaaaggacaaactagtggagaaaaccggaaagatctgtatccgtgggaaccttcccgggcagcgtctcaaaaacaaagagaacgagtttcattgccagatcatgaagtctaaggagacacttaaaaagatgtcatgcgtgaacggcacagaggggagagaagagctgccctcaccagggacaaagcacacttgcgtctatacctgggtgaaacaatgctggtctgtggctgcctgcccagaggagtggaagtaccccctgtccttagcgctgcactttcataataagatttccaacatgtctaaaattgatgctcacattacccaatcgcgattcctgacttcggacataagcgaagagcgcgggaaggtcgtcagcgtgctgccccgggctctatccctgtcttgtcctgttccccatttgcacagatggaacttttgtgattccctcctgcagaggcagagtgatgaatattcctatccagagctcgtgaagatggtctggtacaagggagtcacgtatcgcctgacccaccagaatatgaacagtattgagatctactctggagatggctccgtcttcaagtctgagggagcctatttcggaaattactttacatactattccatacaggagggatcagggaagagggaagagaaaacctactcagttaataatcttcctccagacagacctggcagccccttcaccgtggggtccttaattaagcaagcaaccagaatcctccagcactgcgttaagatgcgtctctcactcagccacaattaccgcatctgttgttggaaaatggtgccagggattaatgatagcaacatcttgcccctggtgctcaaagaatccctgatcccctcagttggccgctttctcgcctatagtgacgacaaagtccatgcaatctttcttgatggtatcaccctgaccctcaattggaattttagctcacccattgagaagagacaagtcaatcagggattaaatctggggtggtgcaagttaacattccctgatggtcaggaacagctgatccaaatcgaacatcccgagccctatgaacgatacgtaaccaccgtgacgtcttggtgccggcgtctgacacagacaagccctcgagaaatgcctacacatagtagtagctcagtgctgcaggagaattggtccgttgcgtcggagctcgaaaagattcagaaatttaacctcctgctcgaaaacagtgggatcctgaaccaaatatctaacaaaaagaatgagcagcagtcgtttgaccattacaagccgggctcctccgaaactcttcttggggaggtgaacgaaaatagggtgagcatcgccctcaaaaagacaagcgagatcctacatgacatagattgtttgttgtccaactcaaagaagtag

SEQ ID NO: 28117 - DNA, 900 bp, Artificial Sequence
  Description of Artificial Sequence: Synthetic coding sequence
atgcccgggagactcctgaggggcctttggcagcgctggaggagatataaatatcggttcgtcccttggattgccttgaatctctcccacaaccccagaactcttagatatgtacctgaggagtcaaaggataaggtgatctctgatgaagatgtcctagggaccttactgaaagtgtttcaagccctgtttttgaacgacttcaataagcagagcgagatcctgagtatgctgcccgagagcgtgaagtccaagtaccaggatttgctagcagtggagcatcagggagtcaaactgttagagaaccgtcaccagcaacagtctacatttaagccagaagagatcttgtataagacactagggttcagtgtcgcacaagctacatcatccttgatctccgctggcaaaggagtgttcgtcaccaagggcctagtgccaaaaggcgccgtcgtcagcatgtatccgggaacagtgtatcaaaaatatgaacctatattcttccaatcaattggtaaccctttcatcttcaggtgcctggatggggttctcattgatggaaatgacaagggtatcagcaaggtggtgtaccggtcctgcaatgggcgagacagattgggccccctgaagatgagcgatagtacgtggctgacttcagagattcacaacccccttgccgtgggacagtatgttaataactgcagcaatgatcgtgccgccaatgtgtgctaccaggagttcgacgtgcccgctgtattcccaatcgaactgaaacagtacctgcctaacatcgcatattcctatgacaagcagtctcccttgcgctgcgtcgtgctggtggctctgagggatattaaccagggagaggaactcttttccaactactataccattgtttcatag

SEQ ID NO: 28118 - DNA, 816 bp, Artificial Sequence
  Description of Artificial Sequence: Synthetic coding sequence
atgccgggccggttgttgagggggttatggcagaggtggagacgctacaaatacagattcgttccctggatagcgctcaacctttctcacaacccccgcactctacgctatgtccctgaggaatccaaggataaggtgatctccgacgaagatgtcttaggtactctcctgaaagtgttccaggcgttattcttgaatgacttcaataagcaaagtgaaattttatctatgttaccagagtctgtaaaaagcaagtatcaggatttgctcgcagtcgagcaccaaggtgttaagctgctcgaaaatcgccatcagcaacaaagtacattcaagcccgaggagattttatacaaaacgttgggtttttctgtggctcaagcaactagcagcttgatatccgccggaaagggtgtcttcgtgaccaaggggctggtaccaaagggagcggtcgtgtccatgtatccgggaacagtctaccagaaatacgaaccgatctttttccaatctatcggaaacccatttatcttccggtgcctcgacggagtgctgatcgacgggaatgacaagggcataagtaaggtcgtctatcgctcatgcaacggcagagatcgcctcggaccattgaagatgagcgactccacgtggctcacttctgagatacataatcccctcgccgtaggccagtacgtaaataattgttccaacgaccgcgcagcaaacgtgtgctaccaggagtttgatgtacctgcagtgttcccgattgaacttaaacagtatctgcccaatatagcctactcctacgacaagcagaggtag

SEQ ID NO: 28119 - DNA, 582 bp, Artificial Sequence
  Description of Artificial Sequence: Synthetic coding sequence
atggaacagcacttcttgggatgtgtgaagagagcatgggactctgctgaagtggctcccgagcctcagcccccacccattgtgagcagtgaagaccggggcccatggccactcccgctctacccagttcttggtgagtacagtctggattcatgtgacttgggcctgttatcgagcccatgctggcgccttcccggggtctactggcagaatggactatcccccggcgtccaatcaaccttagagcctagtactgctaaaccgaccgaattctcttggccaggtacccaaaagcagcaggaagcccccgtcgaggaagtcggtcaggccgaggagcccgaccggcttaggctacagcaattaccctggtcctcccccctgcacccatgggatcgccagcaggacaccgaggtctgcgattctggatgtctcctcgaaaggcgacatcccccagctctgcagccttggaggcaccttcccgggtttagtgattgcctcgagtggatccttagggttggctttgccgctttttctgtgctctgggcctgttgtagcagaatttgtggggcaaaacagccatag

SEQ ID NO: 28120 - DNA, 1920 bp, Artificial Sequence
  Description of Artificial Sequence: Synthetic coding sequence
atgccgcaaccatccgtgtctgggatggatcctcctttcggagatgcattcaggagccacactttttccgagcagaccctgatgtcgaccgacttactcgcgaattcttcagaccccgacttcatgtacgagctcgaccgcgaaatgaactatcaacagaatccgcgggataacttcctgagtttggaagattgtaaagacattgagaacttagaatcatttaccgacgtgctcgataatgagggcgcacttacgagcaactgggaacagtgggacacatactgcgaggatttgacaaaatataccaagcttacctcgtgcgacatttggggaaccaaggaggtcgattacctggggcttgatgattttagctccccttaccaggatgaggaggtgattagcaaaacaccgaccctggcacagctcaacagtgaggactcccaatcagtaagcgacagcttgtactatcctgatagtttattcagcgtgaagcagaacccactaccaagtagcttcccagggaagaaaatcaccagcagggccgccgccccagtatgttccagcaagacacttcaagcagaggttccgctcagcgattgtgtacagaaggcttccaaaccgacctccagtacccagataatggtcaaaactaacatgtaccataatgaaaaagtgaattttcacgtcgaatgcaaggactacgtgaaaaaagcgaaggtgaaaataaacccagtgcaacagtctagacctctcctcagtcagattcacaccgacgccgctaaggaaaacacctgttactgtggcgcggtagccaagcgccaggagaagaagggcatggagcctctgcagggccacgccactcccgccctgcccttcaaagagacccaggaattactcttgtcaccacttccgcaggagggcccaggatccctggcggctggggagagcagttctctctcggcctccacctccgtatccgactcatcacagaaaaaggaggagcacaactacagcctctttgtgtccgacaacctgggcgaacagcctaccaagtgcagccccgaagaggacgaggaagatgaggaggacgtggacgatgaggaccacgatgaggggtttggctctgagcacgaattaagtgagaacgaggaggaagaagaggaagaagaagactacgaggacgataaggacgacgacatctcagacacattttcagagcctgggtacgaaaatgacagtgtggaggacctaaaggaagtcaccagtatcagctcaagaaaacggggtaagaggaggtatttctgggagtactccgagcagctgacgccttcacaacaggagagaatgctaaggccctcagagtggaaccgggatacactgccaagcaatatgtatcagaagaacgggctccatcacggaaagtacgccgtcaaaaagtctagacgcacggatgtggaagacttaacacctaatccaaaaaagctgttgcagattggcaatgaactgcggaaactcaacaaggtcatcagtgacctgactccggtgagcgaactgccccttacagctagaccaaggtctcgaaaggagaagaataaattagcttcacgcgcctgccgtctgaaaaagaaagcccagtacgaggctaacaaggtaaagctctgggggctgaacacggagtacgacaatcttctatttgtaattaacagtattaagcaggagattgttaacagggttcagaatccacgtgacgagcgagggccaaacatgggccagaagttagagatactgattaaagataccctgggtctgcctgtggccggacagacttcggagtttgtgaatcaggtactggaaaaaaccgcggaaggcaacccaaccggggggcttgtgggccttcgcatcccaaccagcaaagtgtag

SEQ ID NO: 28121 - DNA, 1920 bp, Artificial Sequence
  Description of Artificial Sequence: Synthetic coding sequence
attcccaagccatcagtgtctggtatggatcctccctttggagacgcctttcgttcccatacgttctctgagcagactctgatgagcacagaccttctcgcgaactcatctgacccagattttatgtacgagctcgacagggagatgaactaccaacagaatccgagagataattttctgagcctagaggactgcaaagacattgagaacctggagtcatttacagacgtgcttgacaacgaaggtgccctgaccagcaactgggaacagtgggatacctactgcgaggatctgacaaagtataccaaacttacatcctgcgatatttggggcacaaaggaggtggattatctcggtctggacgatttctccagtccatatcaggacgaagaagttataagcaaaacgccgacgttagcacagctaaatagcgaggatagccagagcgtgtccgactcactttactatcccgatagccttttctcggtaaagcagaacccgttaccctccagtttccctggtaaaaaaattacttcccgggcggcggcaccggtgtgctccagcaagacactacaggccgaagtccctctaagcgactgcgtacagaaagcaagcaagcccacgtcttccacacagataatggtgaagacgaacatgtaccacaatgaaaaggtgaatttccacgtcgagtgcaaggattacgtcaaaaaagccaaagtaaaaatcaatcctgtgcagcagtcacgccccctgctgtcgcagattcatacagacgccgctaaggagaacacctgttattgcggagccgtagctaaacgccaggaaaaaaagggcatggagcccctgcagggtcacgccactcccgcgctacctttcaaggaaacacaggaactgcttctgtctcccctccctcaagaaggacccggcagcctggccgctggcgagagttcaagcctgtcagctagtacctcggtttctgactcttcccagaaaaaggaggagcacaattatagtttgttcgtgtccgataatctaggcgagcagcccaccaagtgttcgcctgaagaagacgaggaggacgaggaagacgtcgatgacgaagaccacgatgaagggttcgggagcgagcacgagctctctgaaaatgaggaggaagaagaggaagaagaggattatgaggatgacaaggacgatgacatctctgacacatttagcgaaccaggctacgaaaacgacagcgtcgaagatctcaaggaggtgacatcaatatcaagcaggaaacgtggtaagcggcggtacttctgggagtacagcgaacagctgacacccagccaacaggagagaatgcttaggccctcggagtggaatcgcgatacactgcccagcaacatgtaccagaagaatggcctgcatcacgggaagtacgccgtgaagaagagtagacgtacagatgtggaagatctaacgcctaatccgaagaagctactgcagatcggaaacgagttgcgcaagctcaacaaggtgatcagtgatcttaccccggtatccgagcttccgctaaccgctcgtcctcggtcccgaaaagagaagaataaactcgcctctcgcgcttgcaggcttaaaaaaaaagcccagtacgaagcaaataaagtgaagctgtggggactgaacaccgaatatgataacctgcttttcgtcattaatagcataaaacaagaaatcgtcaaccgtgtgcagaaccctcgggacgagcggggcccaaatatgggtcagaagctggagattttgattaaagatacactcgggttacccgtcgctggtcagacctccgaattcgtcaatcaggtcctggagaaaaccgcggaggggaaccccacaggtgggctggtgggactgcgtattcctacgagcaaggtgtag

SEQ ID NO: 28122 - DNA, 1254 bp, Artificial Sequence
  Description of Artificial Sequence: Synthetic coding sequence
atgccccaaccctcagtgtccggcatggaccctccatttggggatgccttcagatctcatacgttctctgagcagacgctgatgtctaccgacttgctcgccaactccagcgacccagacttcatgtatgagctcgatcgagagatgaactatcagcagaacccacgcgataattttctgagcttggaagattgtaaagatatcgagaacttggagtcctttacagatgtgctagataatgaaggcgcacttacctcaaattgggagcagtgggacacgtactgtgaggacctgaccaaatataccaagctgacttcttgtgacatttggggaactaaggaggtcgactatctcggtcttgacgatttctcctccccatatcaggacgaagaagtaatatctaaaactcctacacttgcacaattgaatagtgaggattcccagtccgtgagcgattctctttactatcccgattcccttttcagcgtgaaacagaaccccttgccctcttctttccccgggaaaaaaatcactagtagagcagcagcccccgtctgtagcagcaagacactgcaggctgaggtccctctgtccgactgcgtgcaaaaggcttcaaaacccaccagctcgacccagatcatggttaagacgaatatgtatcataatgagaaagttaacttccacgtagagtgtaaggactatgtgaagaaagccaaggtgaaaattaacccagtgcaacagagtcgcccactcctgagccagattcacacagacgccgcgaaagagaacacctgttattgtggagctgtcgcaaagcgccaagaaaaaaagggcatggagcctttgcagggccacgctactccagccctcccttttaaagagactcaggaactcctgctcagtccactgcctcaggagggcccaggatccttagccgccggcgagagttcctcactgtccgcatcaactagcgtgagcgattcatcacaaaaaaaggaagaacacaactacagcctattcgtgtctgacaacctgggtgagcagccaactaagtgcagcccagaagaggatgaagaggacgaggaggacgttgacgatgaggatcacgacgaaggatttggctctgaacatgagctcagcgagaacgaagaagaggaggaagaggaagaggattatgaagatgataaagatgatgacataagcgatacctttagcgaacccgggatcattatgctcgcaagcctccctgactag

SEQ ID NO: 28123 - DNA, 1254 bp, Artificial Sequence
  Description of Artificial Sequence: Synthetic coding sequence
atgccccagccctcagtgtctgggatggatcctccctttggagacgcctttcgctcccacaccttctccgaacagacactgatgagcactgatctactcgcgaacagctccgacccagattttatgtatgagctggaccgggaaatgaactaccagcaaaacccaagagataactttctttcccttgaggattgcaaagatatcgagaacctcgagagctttacggatgtgctggataacgagggagctcttacctcaaattgggagcaatgggacacatactgcgaggacctaactaaatatacaaagctgacatcatgcgacatctggggaacaaaagaggtggattacctgggactggatgacttctccagtccttaccaggacgaggaagtgatctcgaaaacccctacccttgctcagttgaacagtgaggactcccagtccgtttctgactctctgtactatcctgactctctcttttcagtgaaacagaaccctttgccttcatctttccccggaaaaaagataacaagccgagccgcggctcccgtctgctctagcaaaactttacaggctgaggtacccctctcagactgcgtgcagaaagcgtccaagccaacatcctcaactcaaataatggtgaaaactaacatgtatcacaacgagaaggttaacttccacgtggagtgcaaagactatgtgaagaaagcaaaggtgaaaataaatccggtccagcagtcccggccactgctctctcagatacacaccgatgctgctaaagagaacacatgctactgcggggccgtcgccaagcgccaagagaaaaagggtatggagcccctgcaaggacacgctacccccgctctaccgttcaaagagacccaggagcttctactctcccctctcccccaggaggggccaggatccctggccgccggcgaatcctcatctctgtctgctagtacctcagtgagcgacagtagccagaagaaggaggaacacaactactcgctctttgtcagtgataatctaggagaacagcctacgaagtgttcaccagaggaggacgaagaagacgaggaggatgtcgatgatgaggaccacgatgaggggttcggatctgaacacgagctgtctgagaatgaggaggaggaggaggaggaggaagactacgaggacgataaggacgacgatatatcagacacgtttagcgagccggggatcattatgctggcttccctacccgattag

SEQ ID NO: 28124 - DNA, 81 bp, Artificial Sequence
  Description of Artificial Sequence: Synthetic coding sequence
atgccacaaccaagtgtttctggcatggaccccccttttggggatgcctttagaagccatacattttcagagcaaacctag

SEQ ID NO: 28125 - DNA, 1962 bp, Artificial Sequence
  Description of Artificial Sequence: Synthetic coding sequence
atgccacagccttctgtgtctggaatggatcctccctttggagacgcatttaggagtcacacattcagtgagcagactttgatgtctaccgacctgctggctaatagctccgacccagacttcatgtatgaactggacagagagatgaattatcagcagaatccccgggataattttctttcgctcgaggactgtaaggacatcgagaatctggagagttttactgatgtgctggataacgagggagccctgaccagcaattgggagcaatgggacacctactgcgaggacttgacaaaatacacgaaactgacgtcctgtgacatatggggcacaaaggaagttgattatttggggttggacgattttagctccccttatcaggacgaggaggtcatatcaaagacccccactctggctcagctgaattcagaggatagtcaaagtgtgtccgattctttgtactatccagatagtctgttttctgtcaaacagaacccactaccatcaagtttcccgggcaaaaagattaccagccgagccgctgctccagtctgctccagcaagaccctgcaggccgaggtacccctgtccgactgtgtgcagaaggctagcaagcccacttcaagtacgcagatcatggtcaagaccaatatgtatcataatgaaaaggtcaactttcatgttgagtgtaaggactatgtaaaaaaggctaaggtgaaaatcaaccctgtgcaacaatctcgacccctgctgtcccagatacacacagacgcggctaaggaaaatacatgttactgtggagccgtggcaaagaggcaggaaaaaaagggcatggaaccattacagggccatgccacgcctgccctgcctttcaaggaaactcaagagttgctgctctccccccttccacaggaagggcccgggagtctggctgcaggcgagtcttcgtcattaagcgcttctacctcggtgagtgactctagccagaagaaagaagaacacaattatagcctgttcgtctccgataacctgggcgaacagccaacaaagtgtagcccggaggaagatgaagaggatgaagaggacgtggatgacgaggaccacgacgaaggctttggatccgagcatgagctatctgaaaacgaagaggaggaggaggaggaggaggattacgaagatgacaaagacgacgatatctctgatacattcagtgaaccggggtacgaaaatgatagcgtggaagacctgaaagaggtgaccagcatctcttcaaggaagcgggggaaacggcggtacttttgggaatactctgagcagctaactccgtcacaacaggagcggatgctgcgtccctcagaatggaacagggacacccttcccagtaacatgtaccaaaagaacggcctgcaccacgggaaatatgccgtgaagaaaagtcgaaggaccgacgtggaggacttaacaccaaaccccaagaaactgctccagattggaaacgagctgcggaagctgaataaagtcatctcagacctaacccctgtgagcgagctgccactaaccgcccggcccaggagtaggaaagaaaaaaataagttggcatctcgcgcgtgccgcttgaagaagaaggctcaatacgaagccaacaaggtgaaactgtgggggctgaatacggagtacgataacctcctttttgtgatcaactccattaaacaagagattgtaaacagagtgcagaatccccgcgatgagcgcgggcctaacatgggacagaagctggagatacttataaaggacaccttaggcctccccgtggcaggccagactagcgaatttgtcaaccaggtccttgagaagaccgccgaaggcaatcctaccggaggactggtcttttggggcaatagcaagacaggtaatattctttatgatgagaatcctaacgagaagaagcaagacatttag

SEQ ID NO: 28126 - DNA, 1926 bp, Artificial Sequence
  Description of Artificial Sequence: Synthetic coding sequence
atgccccagcctagcgtatcaggtatggacccaccattcggcgacgctttccggtcccacaccttcagcgaacagaccctaatgtcaacagatctgcttgccaattcctctgatccagactttatgtatgagcttgacagagaaatgaattatcaacagaatccacgggataattttctgtctttagaagattgcaaagatattgagaatctggaatctttcactgacgttctagataatgaaggcgctctcacatccaattgggagcaatgggacacttattgtgaagatctaaccaaatacactaagctaaccagttgtgacatctgggggactaaggaagtggactatctgggtctggacgacttttcttcaccctaccaggacgaggaggtcatttctaaaacaccaacactcgctcagcttaactccgaggactctcagtctgtgtctgacagcctatactacccagactccctcttctctgtgaagcaaaatcccctgccatcctccttccctggaaagaaaattaccagcagggccgccgccccagtgtgttctagtaagaccctgcaggccgaggtgcccctctcagactgtgtgcagaaggcgagtaagcctacctccagtacgcaaatcatggtgaaaacaaacatgtaccataacgagaaagtgaattttcacgttgaatgtaaagattatgtgaaaaaggccaaggttaaaattaaccccgtgcagcagtctagacctctgctttcacagattcatactgatgcagccaaggaaaatacttgctactgcggcgcagtggccaagcgacaagaaaagaaggggatggaaccgctgcaaggacatgcaactcccgccttgccttttaaggaaacacaggagttactcctcagccctttgccccaggaaggcccaggctcactggccgcgggagagagtagctctctgagtgcatctacctcggtgagtgactcctcacagaaaaaggaagagcacaattactctctgttcgtctccgataatctgggtgagcagccgactaaatgcagtccagaagaagatgaagaggatgaggaggatgtagacgatgaagaccacgatgaaggcttcggatccgagcatgaactctccgagaacgaggaggaggaagaggaagaagaagactatgaggatgataaggatgatgacatctctgatactttctcagaacctggatacgagaatgattctgtggaggatcttaaagaagttacctctatctcttctagaaaacgcggcaaacggcgctacttctgggaatacagcgagcagctgacacctagccagcaggaacgcatgctacgcccatctgaatggaacagggataccctgccaagtaatatgtaccagaagaatggcctacaccacggttccggaaaatacgccgtcaaaaaaagcaggcgcaccgatgttgaggatttgactccaaatcccaagaagctgttgcagatcggaaacgaactgcggaaactgaataaggtgatctctgacctgacccccgtgagcgaattgcctctgaccgccagaccaagatcccggaaggaaaaaaacaaactggcgtcaagggcctgtaggctgaagaagaaagctcagtacgaggccaacaaagtgaagttatggggtctaaatacagagtacgacaaccttctatttgtaatcaattctatcaaacaggaaattgtaaatagggtgcaaaatccccgtgacgagcgggggccaaacatgggtcagaaattggagattttgattaaagatacactggggctgcctgttgctggtcagacatctgaatttgtaaaccaggtgcttgagaagaccgccgaaggcaaccctactggtggcctcgtaggtcttagaataccaacaagtaaagtgtag

SEQ ID NO: 28127 - DNA, 6288 bp, Artificial Sequence
  Description of Artificial Sequence: Synthetic coding sequence
atggccgacgcagacattctcagcgagactttccaattactgatcgactcggccaaggacttttccaagcgattgtggggtctggttccgtttgggctgtatttacccgcacctcccctgtattgcccccagcccgctatcttatcagaggaggatggggacgatctcctgctgaaggccgaaaaaaacaacagacagaaagtttctggaattctgcaaagagtcttactacttttcagagcagcccagtgttcgttccccgtggcccaatggtatattctgcaactgcgatgggctaggaaggtcatgcaaaagatcagaatgaaagggtctctacctagtttatcccccttcccgcagagtctgctcaactattgcaaggggggcatcgcctttttcagaccaggggcagcaggtgaccataaattagatgaggtcagcatcagggcgatcggatgtttccgggagttatgcgccctttgttggatgctccatgtgcgggacaagctgagctactcttgtagacagtatcagaaggcccgtgagaacgtgaaaggcgagaaggatcttgaagttgaatttgactcctgtatgatagaacattgcctgagtgccgtagaatgggcctatagaatgttaccatttagcagatttttcaacatggaggagctcatacaagatataatactttccctcattggggagctgccacctatcagaaaggtggctgagatattcgttaaggccttcccatatcctgaggatgtccgggtaccactgagggataagtatcattcactgcaccagcgccttcggcattgcgtggtgaaaggcccccaaacagaagagatgatgagtgtggtaatgcactcaattcagaaagtccgagttaaggcactgaagcgcgtgcagcgtaacattggatctttcgaggtgaacatctgggagccgattgaggaagagaagcctgacgaggctccgggtgtagaccggtactctctggggacgtcactgagcaggagcacactcaccgagctaggggattccgtcgtacattctgacgccgatacatttagcgaggccttatccgtggaagaaaagagtcgtattaacatatatcagaggaacgctccgaaccacatggagctcacgtcaatccacaaacctacagacaagcgcaagatgtgtaatcagaaagaaaacccaactaagaaggaggaccatgagaagctctcccagaatactcttcccgtaatcggagtctgggaatttgaacgggacgatgacgaatacataaagttcctggacttgttcttgagctatattctagagagagatctcccctactctcgcgatgcagacattccatttctcacgtctttttccggcaagctgcgggaacacgaactgaattctctcctttttgatgtccatacaacccttaaaagacaccagagtaaaacaaagtctcagaacgtattccgggcaggttcatgctttgtcgtggctccggagtcgtatgaaagtgaaaaatcgtcttctctaaatgatgaatatggcatgcatctggagaatcagaagctaagctccagcgtccttgtcaatcaaggtattaaacctttcctccagtatccctctaatgaagtgaataaaaacgagggtatgtccggactgttcggactgaaacagcggtctatctacaagatccaggatgacacaagagaaaagtgtctgatccagcggtcatcgaatcacatcttctggacgcctaagtcaattaagacgcgaagatgtatcttcaaggcaatacagtgtaatgacattaatcctcaggaggacctgcccttggccctgaatacattcggatctatcggccgcctgttagagtggatgatccgatggtctaaccgcagactgctgtgcgactctggaatcaccgaatcaagttcagagtactcacctgttatccgtgtgaagacatctacagcagctattcttaccagcctgtggttgctagagcagccgtacttcgctacctataaggccaagaatgcaattattaagatggtggagaatcgagacaccggctgtcagattggacccaacatcgaacgggaaagtaagtcagacgctggggggagcgtggccgttgcaaccccggggggcacggaagagcgcaatggtcagaacaagtcatgccagaacattctcaagatgcctaccgaggcgaagaatcccgacattaaggagattaacgatgatattatatcaattacacacaatacgaagaaggagttcattgacatcgatgagaacttacttgaagtggaggcattcacagaggaagaaatggacatgcacatctctgactacgaggaagacattgaggagtcggtcggcgggttcaggagtccatctctcgccatttgtatgatgaccttaccacaacagctggaagaggaattcactgaagaggttcagtgccagagggaagagccgttggagacgatcatggaggaaaagagcacagaacagaaagggatgatagaggcattttcacacccaggccacacgacaccgcagtctatgcaggttgatacatcttcagaaatctcatcagcccaaatctctacatacaaagaaaagtcatctagtgtgccccttttgatctctaacggtgtgaatgtcgcaagccagccaccagctcccacgcctcagaagacgcagaggaacgagttcacagcccagctgcccgactgttcagagagcgtcaggcagatgctccaggacgaaatgtttaaactggtgcagctccagcagatcaacttcatgtcactgatgcagattgtgggatcttcatttgccaacttgccagatactcagcagctggtccagcagagccaatctgtccacctgggagagtctcaagagtcgaatctcagaggctgcggcgatgttgaagattccaataaaaacttgaaggagcggttttttatcaagcctcagagtatgggagagaatgcaagggaaccccggaaaaactcaccgcattgccacgaggggacaatcccgtctggccaaaactccactggcaatgtgcagaacgtgccccatggtagtatccccctttgccaattaaacggacaaccacggaagaagggccctatccccagttctcagaatctcccctccacttcattttatcctgcacccgcggggaacacacatctctatttgctgagtactccatccgttgtacagaaggctccgcgactgattccgcatgccaaaaccttctctcccggtgacggatttcctctgctccagtttaaatctaaacaggagttccagccactgtttctacacaccggatctatcccgcaagtgccatttcgaccattgccccagccaagagaggcctggggcttgagcgatagcttccagcctgctcttcctcaaagggctgcccagactactcccgcgtctcatcttaacgtgagtcaatacaatactgaagctagaaagaaggaagtcgagcagaagacatgggccgagacagttatcaccgaaatcccgaaccacgtgaatttagaccagtatgtcggccaggagaatctcaccccccagcaagactcatctgtcttcatcaagccagagaaactgttcgacgtcaagcccggcacacttgagatatctcctcaccacagctttggtctgcctctgttgtatctcccgttaaaacctcccaacatgttcccatcgacttcacgcgcaagcattacagtgccatcaaccccaatccaaccaatagccgaagaaagaaaatatccgaggctgtcgctgcttcactctcacctgagtcctgaaaatcggtgtaagaaaacacagctgattccactggagaacctgatcgcctttaaacaatcacagcagaaactgactcacaatctattcgaacaaggagatgctggacatttacagctcttgaaggtgaagattgaaccacccgaagtacgccaaggtaaggattccaaaaaaagacaacgccgaagggccgaaaaggagttgcaggagaaacgctgtgaaaagctgaggagaaagcccaatgtgaccttcagacccgaaaattcaattatcaataatgacgacagcgaaatcattaaaaagccaaaggagcagcaagaacattgcggaagccacccattagatgattttgatgttcctttcgaaatgttacaagatgataacacatctgctggcctgcatttcatggcaagtgtcaagaagaaagcaatcggatctcaagatgcaagtaccaataccgatcctgagcatgagcccctgaccgctcctcaactgctggtgccggacgtctacttgaatctgaaactctcctctgagatgtcggagaaaccttggtcgccatcgatcccccatacagtgacaaatctcgtgggccacacctatatcaatgtcatagacattgaggctaacgatttacttcaggaactccctgtgagagaggaaccctccaatgataatgtcatcaagcagcaatctgatcacctggcggtcccctccagcgccgaactccactacatggctgcgtcggtgacgaatgctgttcccccgcacaacttcaagagccaaggactaccaaagcccgagtttagattcaagggtcagagcacaaagagtgactcagccgaagattatctgttatggaagcgattacagggggtgagcgccgcctgtcctgctccatcaagcgcagcacatcagctcgagcacttatcggcaaaactgcaaaaaattgacgaacagcttctagctattcagaacatagccgagaatatcgaacaagacttccccaagcccgagatgctggaccttcactgtgataagatcggacccgtggaccacatagaatttagctctgggcccgagtttaaaaaaaccctagctagcaaaacaatctccatatccgaggaggtgcgcttcctgactcacatggacgaagaagatcaatccgataagaaggagacgtctgaaccggaatttagtatcacagagaattacagcgggcagaaaacatgcgtttttcctacagctgactcggcagtgtcgttaagtagtagctctgatcagaatactacatctcccggaatgaattcaagcgatgaactctgtgaaagcgtctcggttcatccactccagatgactgggctgaccgacatagctgacatcattgatgacctcatcatcaaagatggagtctctagtgaagagctcgggctgaccgaacaggctatggggacttctcggatacaacactattcaggacgccacagtcaacgcaccgataaggagcggcgagagattcaggcttggatgaaaagaaaacgaaaggagagaatggcaaagtatctgaatgagcttgcagagaagcgcgggcaggaacacgaccctttttgtcctagatcgaatcccttgtacatgactagccgggaaattagactgcgccagaaaatgaagcacgaaaaggataggctgctactgtccgaacactattcaagacgcatcagccaggcctatggactcatgaacgaactgctctctgaaagtgttcagctgcctaccctgccacagaaacccctgccaaacaagccttcaccaacccagtcaagttcttgccagcattgtccatcacccagaggcgaaaatcagcatggacactcattcttaattaaccgtcccggaaaggtaaagtatatgagtaagcccagttatattcataagcgtaaatcttttggacaaccacaagggtccccatggccccatggaacagctacttttaccatccagaagaaggctggtggcgccaaggctgccgttcgcaaggctacacaatcccccgtgactttccagaagggaagcaatgccccttgtcattctttgcagcacacaaagaagcacggaagcgctggcttggctcctcaaacgaaacaggtctgcgttgagtatgaaagggaggaaacggtagtttcaccatggacaatacccagcgagatccataaaattctgcacgagtcccacaactccctactccaggacctgagccctacagaggaggaagagcctgagcatccttttggagttggaggcgtggactctgtgtctgagagcaccggctctatcctgagtaagctcgactggaacgcaattgaagatatggtagccagtgtggaagatcagggtttatccgtccattgggcgctcgatctttag

SEQ ID NO: 28128 - DNA, 5442 bp, Artificial Sequence
  Description of Artificial Sequence: Synthetic coding sequence
atggccgatgcggatattctgagcgagactttccagctactaatcgattccgcgaaggacttttccaagcggttgtgggggctggtcccttttggcctatatctacctgcccctcctctttactgtccacaacctgccatcctgtctgaagaggatggcgatgacctattgctcaaagctgaaaagaataatagacagaaagtgtctggcatcctgcaacgcgtccttctgcttttcagagcggcacagtgttcgtttcccgtggcccagtggtatatcttgcaacttagatgggcgaggaaggtcatgcaaaagatccggatgaaggggagcttgcccagtctttcacctttcccccagagcctgctgaactactgtaagggcgggatcgcatttttccgtccaggcgcagccggggatcacaaactggacgaagtttcgattagagcaattgggtgttttagggaactctgtgccctatgttggatgttgcacgtccgggacaaactgagctattcttgccgtcagtatcagaaagctagggagaatgtgaagggcgagaaagatcttgaggtggagtttgacagctgtatgatagagcattgcctgagcgccgtggagtgggcttaccggatgctcccattctcccgatttttcaacatggaagagttgatccaagacataatcttgtctcttattggcgaactgccacccatccggaaggttgctgaaatctttgtgaaggcttttccctatcccgaggatgtgcgggtgcctctccgcgataagtatcacagcctgcaccagcgcctgcgccattgtgtcgtaaaagggcctcagaccgaggagatgatgagtgtggtgatgcactccatccaaaaggtcagggtcaaggcacttaagagagtgcagaggaatatcggcagctttgaggtaaacatctgggaaccaattgaagaagaaaagccagatgaggcgccaggggtagacagatacagcttgggaacttcactatcacggtcgactttgaccgagttaggggactctgtggttcactccgatgccgataccttctctgaggcgctgtcggttgaggaaaagtcccgcatcaacatataccagcgaaatgcccctaatcatatggagctgactagcatccacaaaccaaccgataaaagaaagatgtgtaatcagaaagaaaatccaaccaagaaagaggaccacgaaaaactgtctcaaaatacactgcccgtgatcggcgtctgggagtttgagagggacgacgacgaatacattaaatttctcgatctgttcctgtcctatattctggaaagagacttaccttacagcagggacgccgacatccctttcctgaccagcttttcagggaagcttcgcgaacatgagctgaattctttgctctttgatgtgcatacgacactgaaaagacaccagagcaaaacgaagtcccagaatgtgttccgggctggcagctgctttgtcgtggccccggagtcttacgaatccgagaaatcttcttccctgaatgacgagtacggaatgcatctggagaaccagaaactgtcttcctcagtgcttgttaaccagggtattaaacccttcctgcaatacccatccaatgaggtaaataaaaatgagggaatgtcgggcctgtttgggctcaagcaaagatctatttacaagatccaagacgatacaagagagaaatgcttgatccagaggtcctccaaccatattttttggacacccaaaagcatcaagacacgcaggtgtatttttaaagcaatacagtgcaatgacataaatccccaggaggacctgcccctggcccttaatacgtttgggagcatagggcgcctgctggaatggatgatccggtggagcaatcgccgattgctgtgcgattctggcatcaccgagagcagtagcgagtactctccagtgatcagagtcaagacctctaccgctgccatccttacatccttatggctccttgagcagccctatttcgcaacatataaagcaaagaacgcaatcattaaaatggtggagaatcgagacacagggtgccagattggaccaaacatcgaacgtgagagtaagtccgacgccgggggatcagtggccgtggctactccagggggaactgaggagcgtaatgggcaaaataagagctgtcagaacatcctcaagatgccaacagaggctaagaacccagacattaaagagatcaacgacgatatcattagtatcacccacaatactaagaaggagttcatcgatattgatgagaacctgcttgaggtggaagccttcacagaagaggagatggacatgcatatctcagactatgaggaggacatcgaggaatctgtcggaggcttcagaagtccttcactcgcgatttgcatgatgactctcccccaacagctggaagaagaattcactgaggaagttcagtgccagcgggaggaacccctcgagacaatcatggaggagaaaagtactgagcaaaaaggtatgattgaagccttctctcatcctggccacactaccccgcagtccatgcaagtcgacacatccagcgaaatatcctccgcacagatcagcacctacaaggaaaagtcctcctcagtccccctgctgatctccaacggagtgaatgtcgcctcacagccccccgctcccacaccacagaaaacgcaacgcaacgagtttaccgcccaacttccagattgttccgagagcgtcagacaaatgctccaggacgagatgttcaaattagtccagctacagcagatcaattttatgtccttgatgcaaattgtcggctcaagcttcgcgaatctgccagacacccagcagctggtgcaacagtctcagtccgtgcacttgggggaatcacaagagtcgaatttgaggggttgtggggacgtggaggacagcaacaagaatctgaaggagcgcttttttattaagccccagtcaatgggagaaaacgctcgggagcctaggaagaactcaccccactgccacgagggaactattccatccggccagaacagtaccggtaacgttcaaaatgtgccacacggcagcatccctctctgccaacttaatggccagccaagaaaaaagggccccatcccgagttcacagaacctccctagcaccagcttctacccagcaccagctgggaacacacacctgtatctcctgtccacgccatctgttgtccagaaagctccgcgactgattcctcacgccaaaacattctcaccgggcgacggcttcccactattgcaattcaaaagtaaacaggagttccagccactgttccttcatactggctcaatcccccaggtccccttccgccctctacctcagcctcgagaagcatggggcttgagcgatagtttccagccggccctgccccaacgggcggcacaaactacacccgcgtcgcacctaaatgttagccagtacaacaccgaagcaagaaagaaggaggtcgaacagaagacctgggctgagaccgtgatcaccgaaatccccaatcacgtgaacctagatcagtatgtgggacaggaaaatctgactccgcaacaagattcttcagtgttcatcaagccagagaagctgttcgatgtgaaacctggtactctggaaatctcacctcatcattcctttggcctgcccctcctctacctgccactgaagccacccaatatgttcccctcaacttcaagagcgagcattaccgtacccagcaccccaattcagcctatcgcggaggaacgaaaatacccacgactctcgcttttgcacagtcatctgagtcctgagaacaggtgcaagaagactcagctgatccctcttgaaaacttgattgccttcaaacagagccagcagaaactgacacataatcttttcgagcagggagatgccggacacttacagctgctgaaggtcaaaatcgagcctcccgaggtcagacagggcaaggattctaaaaagaggcagagacggcgcgccgaaaaggagctgcaggagaaaaggtgcgagaagctgcggcgtaagcccaacgtaacatttcgaccggagaatagtatcatcaataacgatgactcagaaataatcaagaagcctaaggagcagcaggaacattgtggttctcaccccttagatgactttgatgtcccttttgaaatgctgcaggacgataacacgtctgctggccttcattttatggccagtgtgaagaaaaaagcaattggcagtcaggacgcatccacaaacactgacccggaacacgaacctctgactgctcctcaattgcttgttcctgacgtatacctcaacctgaagctcagttctgagatgtccgaaaagccctggagccccagcattcctcacaccgtgaccaatctggtcgggcacacatatatcaatgtgatcgacattgaggctaatgaccttctgcaggaacttccagttcgggaagaacccagcaacgacaatgtgatcaagcagcagtccgatcatttagccgtcccctccagcgccgagctgcattacatggctgcctccgtaacaaacgctgtcccaccacataattttaagtcacaggaggtaactccagcctgtcttgacggaaaatcactcagagcggggatcacagaggtgaaagaaccctcggtcacctcccctaccccttcagatatccaacagaataagggcttacccaagcccgaattcaggttcaagggccaatctaccaagagtgactccgcagaagactaccttctgtggaaaagactgcaaggcgtttctgcagcatgtcccgccccttcttctgccgctcaccagctcgagcatctttcagccaagctgcaaaagatagatgagcagctgttagcgattcagaacatcgctgaaaacatagaacaagacttcccaaagcccgagatgctcgacttgcattgcgacaagataggacccgtggatcatattgagttctcctctgggcccgagtttaagaaaaccttagccagcaagaccattagtatctccgaagaggttagattcctgacacacatggacgaagaggaccagtctgacaaaaaagaaacctctgaacccgagtttagcattactgagaactattcagggcagaaaacatgtgtgttcccaaccgctgatagtgcagtgtctttgtcttccagcagcgaccagaacaccacatcacctggaatgaattcttcagacgagctgtgcgagtccgttagcgtgcacccattacagatgaccggcctcacagatatcgcggatattattgacgacttgatcatcaaagatggcgtatccagcgaagagctaggtcttacagaacaggctatgggtacctcccggtttagttag

SEQ ID NO: 28129 - DNA, 9594 bp, Artificial Sequence
  Description of Artificial Sequence: Synthetic coding sequence
atggaaatcagattagaaatcctgaccagcactggcatcaagcagaagaaaccctggccccgcgtcagctggttaggcaaggaaaaagaagccgttttcctactggatgacaagttcatcaacgagataaaccttttgtccggtaagattaaaaaaaagattccttcgctgcagcctttcctgaaggacgtcatcgtgttaacaacttcatccaatgacgcttggctggcaggagtactgaccaccggggaactgttcctgtggaataaagatcaggactgtctgaagactatccctattacagaaaaacctaaagagatgattaaggccacagtggcctcttctttacgactgtatctttatgtctcggggaacggtaaacggatagtcctaatcaccccgtctgggtgcatctttctctgggagtacctcgagctaaagaatatcctgtcctctaaatccctgtctctggcagggcggtggtctcaggttatccctgaagaggccgttctgctgccttcaactgaggataaggaagccgtggtcaatgccgtcttcattaaaaatgaactgtttggagactgctgcctgtgctcttttacgttctacagcggcgaatgtcttaaactgacattcttggcaatacgctggcatgagaacgtttttacatcagtgcggagcctgccatatcatgttcattgggcccagcaagactgccatctctgctctctgatccctaaatgtgagtcagtgaaatcccgtggagctctgatttccgcctttagtagagatgggctgaccctcgcagttactctgaatcagaaagacccgaaggccactcaggtgctgttcatcaacactctcaattttgtgacattgtgtggctcactgaaaggttgcagcaataagagtccagtagttcccgctaccctgatacgatcttactgggtgggagacataagttggacacacgacagcttattcctggcatgtatgctgaagcgtggtagtctcgtgctcctcacctgccagggagagcttctgaccctcattacattcgggtgcagcattgaattcggcccagccgagtttatccctttgcaccccctgatcacttaccggcctcagcaatttaccttccaagattcaaataactccgtggatagctccgcttcagactctgatcctatgaggcagcggttcagcatcaaggcccactctagattgccgtatctggtgataagtgatggatatatggttacgaccctccgctttctggactccctgtctccgtctgtccatatgcgtagtttgcttttagattccacgcagcgactagagaagatttaccaatccgtcatcctgagcaagcccaagggcaagggcttaaacctcaggagcctcaatagtttgcggagctctctgttagagcatcaaggaaacgaatcttcggctgatttcactgtgccaaagtttctgcaggctgaggagactattaacgagaatgctgccgatttccaggacttcgaagccgaggagacaaatgaggggcggcatttccctgacaatctttgccccttttggaacaagcgggatgatgtgttatgtagctccatgaaagagggccgcctagagtttgcaagcatgtttgatacaattcatgcaaaggatgactctgaggaaacggaccgcacgattactgagctgcacagcatccagaagagtctgctagctgcctggacgatcggcatatctaagacagtgaccgaaaagaacctaatgttaaattatattgtggtgtgcattacacattttttctatatcctgcagttcatcaaatgcccgtttcctaagctcgatctcgtactgtctaaaagcagtcgtcacaacgcttggatactttgcatttttcaactttttcatcagtgtctttccatccactactgggacataaggtacaaacaggatgttggtcacttaatcaaattgaccagtaataccgtgaagctgttgctgacacaacaacagaagggccaactctttagcgaaaagcttctggcatgtttttatcttttgaagatggtggccgacaacctcaacggagtatatatcttgcagccagaggtgatttcagccagtgcggacggatccaaaatcacagctcaggactcactcgtcgtgcccatcttccagatgttccaggactcaggtttccagaagaattggtcttggaattcattttttaaaatccacccccaggtcgtgaatccagtgcagcagccaggccaccggctcttaattttgtggaggatactctacaagaaaactctgtggtaccaggctcagctcaatcgaagggttcctgaagccgactcccagcttaccgagaaaatgacgcacgaagctagcacagtaaagtccctgctctgtcacctgcaagctaacctgcagtcaaccggagactgcctgaatcagacccttgaattgaagagcatcaacggcgaggaatgttttttactcgggtcatatgagaagtctgtgcaactgtggaaaaaagccctgcaggaaatcgaggaaaagggaggccggcggacatactttctgcagatcagatattacttatccctattgtattgtcacttgtacagctacaatctgaacgacgcacaaggcctttgtgatcagctggccagagagattctgagatggtcacagctgcccgtaaaagagaacaaagacttctctggcgccgctaagagccacttcgagtgtggaatggtgggaggggtgcatcccgaggccgcagtgcgggtggttcagtccatggcccgattcatggctgcttattttaccaaccagcagctttgtatactaccccctcaccacgtgaatgtgttgcctcctttacacattaaaactgaacagtcttttcgactgatccctctgcagcattcgaaagtggcaagcgtcgtccgggaccagaacctctccaatgtgtggaccgtggaatacgctcttgagctgctattcataggcggtcttgtcccagaagcagtctggcttgcgtataaactgggagactggaagacatccgtgtcaataggggttgcttttcagctgttttgtaagagagatagtaattttatgcggagcaaaaaaaagtccctgaatctgcccttacggatgactcctgcccagatcttccaggagaagctgcagtgcgttcttggtcagcccgcgagccttgaggcgaagaacgagatggggagcaagtataaacagttcaccgaccccatagaagaagaggatgccaacctgctttttgggtccgtgcaggaagtgcttaaagcctcggttatggcagatgctgatatcctgtccgagactttccagctactgatagacagtgctaaagatttctcaaagcggctgtgggggctggtgcctttcgggctatatctgcccgcacctcccctgtattgcccacagcccgcaattttaagcgaggaggacggagacgatctgctgctaaaggctgagaaaaacaatcggcaaaaggtgagcggaatcctgcagcgcgtactactgctgttccgggccgcacagtgcagcttcccagtggctcaatggtacattctacagctgcgctgggccagaaaagtaatgcagaagattcggatgaaggggagcctgcctagcctctcgccctttccccagtcgctgctcaactattgcaagggcgggatcgcattctttcggcctggcgccgcgggtgatcataagctggatgaagtcagtattcgggccatcggttgctttcgggaactttgtgcactatgttggatgctgcacgtacgagacaaattgtcatatagctgccggcagtatcagaaggcgcgagaaaacgtgaagggagagaaggatttggaggtggagttcgatagctgtatgatcgagcactgcttgtctgccgtggaatgggcttaccgaatgctacccttcagtaggttctttaacatggaagagctgatccaagacattatacttagcctgatcggtgagctgccccccattcgcaaggtcgcggaaattttcgttaaggcgttcccgtatcccgaagacgtgagagtgccgctgcgtgacaagtatcacagtcttcatcagcggctgaggcattgcgtggtgaaaggccctcaaacagaggaaatgatgtcagtggtaatgcactccatccaaaaagtcagagttaaagccctgaagcgagtgcaacggaatattgggtcatttgaagttaacatttgggagcccattgaggaagagaagcccgacgaagcccctggtgtggacaggtacagcctggggactagcctgtctcgaagcacactcactgaactgggtgatagcgtagtgcactccgatgccgatactttctccgaggccttgagtgttgaagagaaatcaagaatcaatatctaccaaaggaatgcacctaatcacatggagctgacgtctatacacaagccaaccgataagcgtaagatgtgtaatcagaaagagaatcccaccaagaaagaggatcacgaaaaactgtcacagaacacattacctgtaataggtgtgtgggaattcgagcgagatgatgatgagtacattaagttcctggacttattcctctcatacattttggaaagggatctgccatatagccgcgacgccgatattcccttccttaccagtttcagtggaaagctgagagaacatgaactgaactcactcctctttgacgtacacactacacttaagcgccatcagtccaaaaccaagtcccagaatgtcttccgtgccgggtcatgttttgtcgttgctcccgagagttacgagtccgaaaaatcttcctcattgaatgatgaatacgggatgcatctcgagaaccagaaactctcttcgagtgtgctcgttaaccaggggataaagccctttttgcagtacccttccaatgaagtgaataaaaacgaggggatgtcaggcctgttcggtttaaagcagaggagtatatacaaaatccaggatgataccagggaaaagtgtctaattcagagaagcagcaatcatatcttctggacacctaaatccattaagacaaggaggtgtatattcaaggctattcagtgtaacgatatcaatcctcaagaagacctgcctttggcgctgaacacttttggatccatcgggaggctgttggaatggatgatccggtggagtaaccgtcgactactttgtgactctggcattaccgaaagtagctcagagtattcacctgtcattcgcgtcaagacaagcacggccgcgatcctgacttccctgtggttattggagcaaccctattttgccacctataaggctaaaaacgccatcattaaaatggtcgaaaacagggacacggggtgtcagatcggtccgaacattgaacgggagagtaagtcggatgctgggggctccgtcgccgtggccacccctggtggcacagaggaacggaatgggcagaataagtcgtgtcagaacattttaaatcggatgccaacagaggcaaaaaatcccgatattaaagaaattaacgacgacataatatctatcacacacaacaccaaaaaggagtttatcgatatcgatgagaacctgttggaggtcgaagcctttacagaggaggaaatggacatgcatatcagtgactacgaggaagacattgaggagtccgtgggcggcttccgcagtcccagcctagccatctgtatgatgacacttccacaacagcttgaggaggaatttaccgaagaggtgcagtgccagagggaggaacccctcgaaaccatcatggaagaaaagagcacagaacagaaggggatgatagaagcatttagtcaccctggacacaccaccccccagagcatgcaggttgatacaagtagcgagatcagcagtgcacagatctccacttataaggaaaagtctagcagtgtgccactactcatcagcaacggagtcaacgtggcttcacagcctcccgcccctactcctcaaaaaacccagcgcaatgaattcactgcccagctgcccgattgttcagagtcagtacgtcagatgctgcaggacgagatgtttaagttggtacagctgcaacaaatcaattttatgtccttgatgcagattgttggtagcagcttcgctaatctgcccgacactcaacagctggtgcagcaatctcagtccgtccacctcggggagagtcaggaaagtaacctcagggggtgcggcgacgtggaagacagtaataagaatttgaaagaacgtttcttcatcaaaccccagagtatgggcgagaatgcacgcgagcctagaaagaatagtccccactgccatgaaggcacaatcccaagtggacagaattctactggaaacgtccagaacgttccccacggcagcatccccctttgccagctgaatggccagccccggaagaaggggccgattccttcctcacaaaacttacctagcacctccttctaccctgcaccagccggaaacacccatctgtacctcctttcgaccccgagcgtagtacagaaggcaccgagactgattccccacgctaagactttcagccctggcgacggctttccattactccaattcaaaagcaaacaggaattccagcccttgttcttgcacacgggctcaattccccaggtcccatttagaccactgccgcagcctagagaggcgtggggtctcagtgatagtttccagccagctctgccccagcgcgctgcccagaccactccagcaagccacctgaacgtgtcccaatataacacggaagcaaggaaaaaagaggtggagcaaaagacatgggcagaaaccgtgattaccgagatccctaaccacgtgaatctggaccaatacgttggccaggagaatttgactccccagcaagacagctccgtcttcatcaagccagaaaagctgtttgatgtgaaaccaggcacactagaaatctcccctcatcacagtttcgggttaccactcctgtacctgcccttgaagcctcctaatatgttccccagcacctccagagcttcaatcacagtcccctccaccccgattcaacccatagctgaagagagaaagtatccccgcctaagcctgcttcactcgcacctgtcaccagagaaccggtgtaagaaaacccaactgattcctctagaaaacttaatcgccttcaagcagagtcaacagaaactgacccacaatctcttcgagcagggagatgccggacacctacagctgctgaaggtgaaaatagaaccacctgaggtcagacagggaaaggactccaaaaagaggcagagacggagagccgagaaagaacttcaggagaagcgctgtgaaaagctgagaagaaagccgaatgttactttcagacccgagaacagcattatcaataacgacgacagcgaaatcatcaagaagccaaaggagcagcaagagcattgtggtagccatcccctggacgatttcgatgtgccatttgaaatgctacaggacgataatacatcagctggattacatttcatggcaagtgttaagaaaaaggcgatcggatcacaagatgcaagtacgaacacggaccctgagcacgagccactgaccgccccacaactcttggtgccagatgtatacctaaatctgaagctctcctccgagatgtctgaaaagccgtggtcacccagcataccccacactgttaccaatctggagttgccagtgagggaggagccgagcaacgacaacgttataaaacaacagtccgaccacctggcagttccttcgtcagccgaattgcactacatggccgccagcgtcacaaacgctgtccctccgcataactttaagtcgcagggactgccaaaacccgagttccggttcaaggggcaatccaccaagtcagattccgctgaagactatctattatggaaacgattgcaaggtgtgtccgccgcctgtccagcgccttccagcgccgcacaccagcttgaacacctcagcgcaaagctccagaagatcgacgaacagctgctagctatccagaatattgctgaaaatatcgaacaagattttcctaagcccgaaatgctagatctgcactgtgataagataggccccgtcgaccacatagaattctcttctggacccgagttcaaaaaaacactggccagcaagaccattagtatcagtgaagaagtccggttcctcacacatatggacgaggaggaccagagtgacaagaaagagaccagcgaaccagaattctcaatcactgagaattattctggacagaagacttgtgtttttccaacagcagatagtgctgtgagcttgagcagctccagtgatcagaacactacatcccctggcatgaattccagcgatgagttgtgtgaaagcgtttcggtgcacccgttgcagatgacaggactaacagacattgcggatatcattgatgatttgataattaaggacggcgtctcctctgaggaattgggtctgaccgaacaagctatggggaccagccggatccaacactactcagggcggcacagccagcggaccgataaagagaggcgggagattcaggcctggatgaaacgcaaacggaaagaacgtatggccaagtatttgaatgagctggctgaaaaaaggggccaggaacacgatcccttctgtccacgttctaacccattgtatatgacgtctagagagatccgattgagacagaaaatgaagcatgaaaaggaccgcctgctgctctcagagcactattcccgccgcattagtcaggcttacggacttatgaatgagttactgtccgagtctgtgcaattgcctacactcccgcagaaacccctgccaaataaaccgtcccctacacagtcttcaagttgtcagcactgtccctcacctaggggggagaatcagcacggccatagctttcttataaacagacctgggaaagtgaagtacatgtcaaagccctcttacattcataaaaggaagagcttcggccaaccccagggaagtccatggcctcacggaactgctacttttacaatccagaagaaggcaggaggggctaaagctgctgtgcggaaggctacccaaagccccgtgacatttcagaagggctctaatgccccttgtcactctctacagcacaccaagaagcatgggtctgccggccttgccccccagactaagcaagtatgcgtggagtatgagcgggaggaaactgtcgtgagcccatggaccatcccctccgaaatccacaagattctccatgagtcacataactcccttctgcaggacctctcccctactgaggaagaggagcccgaacatccttttggggtcggaggagtcgactctgtgagcgaaagtactggctctattctgtccaaacttgattggaacgccattgaagacatggtggcctccgtggaagaccagggattatcggtccactgggctctggacctctag

SEQ ID NO: 28130 - DNA, 9594 bp, Artificial Sequence
  Description of Artificial Sequence: Synthetic coding sequence
atggagatcaggttggaaattttgacttcgaccgggatcaagcagaagaagccctggccacgcgtgtcttggcttggtaaggaaaaggaggcagtgtttttactggatgacaagtttattaacgagattaacctactctcagggaaaattaagaagaaaatccctagtttgcagcctttcctgaaagacgtcattgtccttactacaagctcaaacgacgcttggctggccggagtgctcaccactggtgagctgttcctctggaacaaagatcaagattgcctgaagaccatacccatcactgagaagcccaaagaaatgatcaaagcgaccgtcgcatccagcctgaggctttacctgtatgtgtctggtaacggtaaacgtatcgtccttatcactccttctgggtgtatctttctctgggagtatctggagctgaagaacattttgtcctctaagagtttgtctttagcaggtcgctggagccaagtaatccccgaggaagccgttctgctcccttcaacagaagacaaagaagcagttgtaaatgcagtgtttatcaaaaacgaactatttggagattgttgcctgtgctctttcactttttactcaggtgaatgccttaaattgacatttctagccatccgctggcacgagaatgtgttcacaagcgtgcgttccctcccttaccacgtacattgggcacagcaggactgtcatctgtgtagcttaattcccaaatgcgaatccgtgaagtcacggggagccctgatctctgctttttctagggacgggctgactttagctgtgactctgaatcagaaggaccctaaggctacccaggttctgtttattaatacgctcaactttgttacattatgcgggagcctgaaaggctgttccaacaaatctccggtggtgccagctaccctgattaggagctattgggtcggcgatatctcgtggacccacgactcactgtttctagcttgtatgctaaagcgagggtcccttgttttactgacctgccagggggagctcctgaccctcataactttcgggtgctcgatcgagttcgggcccgctgaatttattccactgcaccccctgatcacttatagaccgcagcagttcacctttcaagactcgaacaactccgtcgattcttcagccagtgactctgatccaatgcgccagcgcttctcaataaaagctcatagtagactcccctatctagtaatatccgacggatatatggtgacaacgctgcggtttctcgattctctaagtccatctgtgcatatgcgctctctcctcctggactccactcagcggctggagaaaatttaccagtccgtcatcctatccaaacctaagggcaaaggactcaacctgcggagtctcaactcgctgaggagttccctactggaacatcagggaaatgaaagtagcgcagactttaccgttcccaagtttcttcaggcagaggagaccattaacgaaaacgccgctgatttccaggattttgaagcggaggaaaccaatgagggccgccactttcctgacaatctgtgccctttttggaacaagcgcgacgatgtcctgtgctcctccatgaaagaaggcaggctggagtttgcgagcatgtttgacaccatccacgcaaaagacgactccgaagagacggaccggacgatcacggaattgcactctatacagaaatctttactagccgcctggacaattggcatcagtaagacagtcacagaaaagaatttaatgctaaactacatcgttgtgtgtatcacccattttttttatattctgcagtttatcaaatgcccgttccccaagctggacctcgtgctgagtaaaagctcccgccataatgcttggatcttgtgcatttttcagctcttccaccagtgtcttagcatccactactgggatattcggtataaacaggacgttggccatcttataaagctaacgtctaatactgttaaattactacttacgcagcagcaaaagggtcagctgttttctgagaaattgctggcttgcttctacctgctcaagatggtggctgacaatcttaatggcgtgtacatcctgcaaccagaggttatctctgcctctgccgacgggagtaagatcacagcgcaggacagcctcgtggtgcctattttccagatgttccaagactctggctttcagaaaaactggagctggaacagcttcttcaagattcacccacaggtggttaaccccgttcagcagccgggtcacaggctgctgattctttggagaatactgtataaaaagacgttgtggtaccaggcccagctcaatcgaagagttcctgaggccgatagccagctaacagagaaaatgacccatgaagcgtccacggtcaaatccctgctgtgtcacctgcaggccaacctgcagtccacaggggattgcctcaaccaaacactcgaactgaagagcatcaacggagaagagtgtttccttcttggatcttacgaaaagagtgtgcagctttggaaaaaagccttacaggagattgaagaaaaaggggggagacggacctattttttgcaaatccgctactatctgagcttgctgtattgtcatctctacagctacaacttgaatgatgcacagggactgtgcgaccaactcgcgcgtgagattctgaggtggtcgcagcttccagtcaaagagaataaagatttttccggcgccgccaaatcacattttgagtgcgggatggttgggggtgtgcatccagaagccgccgtccgggtcgttcagtctatggctagattcatggccgcatactttacaaatcagcaactgtgcatcctccccccacaccatgtcaatgtcctacccccgctccacattaaaaccgaacagagtttcaggcttatccccttgcagcattcaaaagtggctagtgtggtcagagatcagaacttatccaatgtttggacagtggagtatgccctggagctgctattcataggcggcttggtgccagaagcagtgtggctggcttataagttaggcgattggaaaacaagcgtcagcatcggggttgctttccagctcttctgtaagcgggactcgaactttatgaggtctaagaagaaaagtttaaatctgcccctacggatgaccccagcccagattttccaggagaagcttcagtgcgtcctgggtcagcctgcctccctggaagctaagaatgagatgggatctaagtacaagcagttcacggaccctatcgaagaagaggatgcaaatctgctctttgggtcggtccaagaagtgctgaaggcctctgtcatggcagatgccgacatcttgtccgaaactttccagttactcattgactcagccaaggatttcagcaagcgtttgtggggtctcgtccctttcggtctctatttgccagccccccccctttactgcccccagcctgccattctgagtgaggaagacggcgatgatctgctcttgaaggctgaaaagaacaatcggcagaaggtgtctgggatcctgcagcgggtactgttgctctttagggccgctcaatgtagttttcccgtagcccagtggtatatcttgcagcttaggtgggccaggaaggttatgcagaagataaggatgaagggctccctcccaagtctgtcccctttccctcaatccctgttgaattattgcaaggggggaatcgcctttttccggccgggagctgcgggtgatcataagctcgatgaagtcagcatccgagcgatcggctgcttccgagagttgtgcgcactctgttggatgcttcatgtgagggataagctcagttattcctgtaggcagtaccagaaagccagggaaaacgtgaagggggagaaggaccttgaagtagagtttgacagctgcatgatcgagcattgtttgagcgctgtcgaatgggcctaccgaatgctccctttcagcagattcttcaacatggaggagttaattcaagacatcattctgtccttaatcggcgaactaccgcctattcgcaaggtggcagagatcttcgtgaaggcctttccctaccctgaagacgtccgcgtaccattgagagacaaataccactctctacaccagcggctgcgacactgcgtggtaaagggaccacaaacagaagaaatgatgtctgtcgtcatgcatagtattcaaaaagtccgggtgaaagccctgaaacgcgttcagcgaaatattggatcctttgaagtcaacatctgggaacctattgaggaggaaaaaccggacgaggccccaggagtcgatagatactccttgggaacatcgcttagcaggtcaaccctgacagagctgggtgacagtgtcgtccactctgacgccgacaccttcagcgaagccctcagtgtcgaagaaaaatctaggattaatatctaccagcggaatgccccgaaccatatggaactgacatctattcataaaccgacagacaaaagaaagatgtgcaatcagaaggagaatcccaccaagaaggaggatcatgaaaagctgtcacagaacactctcccagttattggcgtctgggagttcgaacgggacgatgacgagtatatcaaatttttggacttgttcctctcctatattctcgagcgcgatcttccttattctcgtgatgccgacatcccattcctgacgtctttctcaggaaagttgagagaacatgaactgaacagcctgctattcgacgtgcacacaaccctgaagcggcatcagtccaagacgaaaagccaaaacgtctttagagccggttcttgctttgtggttgcccctgagagctacgagtctgagaaatcctcctccctgaatgacgagtacggaatgcatcttgaaaaccagaaattgagtagcagcgttcttgtgaaccagggtataaaaccgtttttacaatatccatccaatgaagttaacaagaatgagggaatgtccggcctattcgggctcaaacagcgatctatttacaaaatacaggatgacacgagggagaaatgtctgatccagcggagctctaatcacattttttggacaccgaaaagtatcaagacccggcgctgcattttcaaggccatccaatgtaatgacataaatccacaggaggacctccctttggcactgaatacttttggtagcataggcaggcttctagaatggatgatcaggtggtccaaccggcgactcctttgcgactctggcatcaccgagtcttctagcgaatatagtccggtcattcgggttaagactagtactgcggccatcttgacatcactgtggttactcgaacagccatattttgctacttataaagccaaaaatgccatcataaagatggtggagaatcgggacacaggctgccagatagggcccaatatagaaagggaatcaaagagcgatgcgggcggcagcgtggcggtggcgaccccgggcggaaccgaagaacggaacgggcagaataaatcctgtcaaaatattcttaatcgaatgccgactgaggctaagaaccccgatattaaggagattaacgatgacattatctcaatcacccacaacacgaagaaagaatttatcgatattgacgagaacttattggaagtggaggctttcaccgaggaggagatggatatgcacatcagtgattacgaggaagacattgaggaatctgtgggggggttcagatcgcccagccttgctatctgcatgatgactctgccccaacagttggaagaagagttcacagaggaagtgcagtgccaaagggaagagccactggagactattatggaggaaaagagcactgaacagaaaggcatgattgaagctttttcgcacccaggccatactacccctcagtctatgcaggtcgataccagcagcgaaatatctagcgctcagatcagcacatataaagagaaatctagtagcgtcccactcctgatctccaatggagtgaacgtggcgagccagcctccagcacccaccccccagaaaacccagaggaatgagttcaccgcccaactgccagactgctcggagtccgtgagacagatgcttcaggatgagatgtttaaactggtgcaactgcagcaaattaatttcatgagcctgatgcagatcgtgggcagttccttcgctaaccttcctgacacccaacagttggttcaacagagccagagcgtgcatttgggggagagccaagaatctaacctgcggggctgcggggatgtggaggatagcaataaaaaccttaaagagcgattcttcatcaaaccccagtctatgggcgagaacgctagagagccccggaaaaacagccctcattgccatgagggtactattccctctggacaaaattccaccggcaatgtccagaacgtccctcacggatccatcccgctgtgccagctcaacggtcaaccacgcaagaagggtcctatccctagcagtcaaaatttaccgagcactagcttctatcctgcccctgctggcaacacccacctgtatctgttgagcactcccagtgtggtgcagaaagccccgcgactcatcccacatgccaagaccttctcccctggagacggcttcccgctgctccaatttaagtccaagcaggaatttcagcccctgttcctgcataccggttccatccctcaggtgccctttcgcccgctgccacagccgagagaggcctgggggctgagtgatagcttccagcccgcgctcccccagagagccgctcagacaacacccgccagccatctaaacgtgagtcaatataataccgaggcaagaaagaaggaagtcgaacagaaaacctgggctgagactgttataaccgagatcccaaatcatgtaaacttggatcagtatgtgggccaggagaatctgacaccgcagcaggactcctccgtgtttattaaacccgaaaagctgtttgacgtcaagcccggcacgctggagatctctccacaccacagttttggactcccccttctctatcttcctctcaagcctccgaatatgttcccttccacatccagagctagcattactgtccctagcactcccatccaacctattgccgaagagcgcaaatacccaaggctgtcacttctgcattcccacctgagtcccgaaaaccgatgtaaaaagacccagctgattccattggagaatctaatagcgtttaaacagagtcagcagaagctgacccacaacttgttcgagcagggtgatgccggacaccttcaactactcaaggtgaaaatcgaacccccggaagtgcgccaaggcaaagattcgaaaaaaagacagcgaagacgggctgagaaggagttgcaggagaaaagatgcgagaagctccgacgaaaacctaatgttacatttcgtccagaaaactcgattataaataacgacgattccgagattatcaaaaagcccaaggagcaacaggagcactgcggttcacatccactggacgatttcgatgtaccatttgaaatgttacaggatgacaacacaagtgccggtcttcattttatggcaagcgtcaagaagaaggccatcgggtcacaggatgcctcaaccaatacagacccagagcacgaaccgctcacagctcctcaacttcttgtgcctgatgtttacctcaacctcaaactgagtagtgagatgtccgagaagccctggagcccttctatcccacacacagtcacaaacctggagttgcccgtccgtgaagaaccctccaacgacaacgtgatcaagcagcagtctgatcaccttgcagtcccctcgagtgccgaactgcactatatggctgccagcgtcaccaacgcagttccaccacataactttaagtcacaagggctgccaaaaccggagtttcgatttaaggggcagtccaccaagtccgattcagccgaggactacttgctatggaaaaggctccaaggcgtcagcgcagcctgtcctgcgccctcttctgccgcacaccagctggagcacctgtcagctaagttgcagaaaatagacgaacaactcctggcaatccaaaatatcgctgaaaacatcgagcaggattttccaaaaccagagatgctggatcttcactgtgataagattggacctgtagaccatatagagtttagctctggaccagagttcaagaaaactttggcaagcaagacaatctccatcagcgaagaggtcagattcctgacccacatggacgaggaggatcagtccgataaaaaagaaaccagtgaaccggaattttctatcactgaaaattattccggccagaaaacctgcgttttccctacagccgactcggctgtgagccttagctctagctcagatcagaacactacctccccgggaatgaatagctccgatgaattgtgcgaatctgtgtctgttcaccctctccagatgacaggactaacagatatcgctgatataatcgatgacttgatcatcaaagacggagtgtcctccgaggaactgggcctgactgagcaggcaatgggcacatctcgcatacaacactatagcgggcggcattcacagaggacggataaggaaaggcgggaaattcaggcgtggatgaagcgcaagcgtaaggagaggatggctaaatacctgaatgaacttgccgagaagcgcggccaggaacacgatcctttctgccctcgttccaatcccctttacatgaccagccgggagatccggctacgccagaaaatgaagcatgaaaaggaccgcctgcttctcagcgagcactacagccgacgtataagtcaggcctacggtcttatgaacgagctcctgtctgaaagtgtgcagcttcccactctcccacagaagccactgccaaataaaccaagcccaactcagtccagctcctgccaacactgtcctagtcccaggggagagaatcagcacggccactcattcctgataaatcgacccgggaaagtgaagtacatgtctaaaccctcctacattcataaacgtaagagtttcgggcagccacaaggtagcccctggccccacggcactgcaacctttactatccagaaaaaagcaggaggtgcaaaggctgcagtgcgaaaggcaacccaaagccccgtgacatttcagaagggtagcaatgcaccttgccattccctgcagcacaccaagaaacacggttcagccggactggcgccccagaccaagcaggtgtgtgtagagtatgagagagaggagaccgtggtttccccctggactataccctccgagattcataagattcttcatgaaagtcacaactctcttcttcaggatctgagtccaacagaagaagaggagccggagcaccctttcggagtgggcggcgtggactccgtttcggagagcacagggagcattttgtccaagcttgattggaatgccattgaagacatggtcgcttcagtcgaggatcagggcctgagcgtccactgggctctggatctgtag

SEQ ID NO: 28131 - DNA, 1725 bp, Artificial Sequence
  Description of Artificial Sequence: Synthetic coding sequence
atggcgaccctagtcgtgaataagttgggggcaggcgtggactcagggagacaggggagcaggggaacagccgtggtaaaggttctagaatgtggagtctgcgaggatgtgttctccctgcagggggataaggtgccaagattgctgctttgtggccataccgtgtgccacgattgccttacccgccttcctttacatggtcgagctattagatgtcccttcgaccgtcaggtcaccgatctgggagatagtggggtttggggattaaaaaagaactttgctctgcttgaacttttagagcgacttcagaacgggccaatcgggcaatacggcgccgcagaggagtccatcgggatcagcggcgagtccatcattcgatgcgacgaggatgaagcccatctggcctccgtgtactgcactgtttgtgcaacccatctgtgtagcgagtgctctcaggtgactcactctacgaaaacactggcaaagcatcgacgcgtgccccttgctgacaaaccccacgaaaagacaatgtgtagccagcatcaagtgcacgccatcgaatttgtctgtctagaagagggatgccagacctcaccactcatgtgttgcgtgtgcaaggaatatggaaagcaccagggccataagcactccgtgcttgagcccgaggcaaatcagatacgcgccagtattctagacatggcacattgcatcagaacgtttacagaggagatcagtgattatagcagaaagctggtcggcattgtgcagcatattgagggcggcgaacagatcgttgaagacggcattggtatggcccatacagagcatgtccccggtaccgcagagaacgctcggtcctgcataagagcatacttctatgatctgcacgagaccttgtgtcgccaggaggaaatggccttatcagtcgtcgacgcacacgttagggagaaactcatttggctcagacagcagcaggaagacatgacaattctgttaagcgaggtgtcagctgcctgcctccactgtgagaaaaccctgcagcaagacgactgccgcgtggtgttagccaaacaggagatcactcgattgcttgagacattacaaaaacagcagcaacagtttaccgaagtcgcggatcatattcagctcgacgcttctattcctgtgacttttaccaaagacaatcgggtgcacatcggtcctaagatggaaatcagagtcgtgaccctcggcctggatggcgctggtaaaactaccatcttgttcaagttgaaacaagatgagtttatgcaaccaattcccaccattggttttaatgtggagacagtcgagtacaaaaacctgaaattcacgatctgggacgttggagggaaacacaagctcagacctttgtggaaacattactacctcaacactcaagcagttgtgttcgttgtggattccagccaccgagatcgcatcagtgaggcacatagtgagctggctaaactgctcacggagaaagaactgagggacgctctgctgctgatcttcgccaacaaacaggatgttgctggcgctctgtccgtggaggaaatcacagagttgttatctctccacaagctctgttgcggacgtagctggtatattcaggggtgtgacgctagatctggtatgggactgtacgagggtctagactggctctcaagacagctcgtggcagctggtgtcctggacgtggcctag

SEQ ID NO: 28132 - DNA, 1254 bp, Artificial Sequence
  Description of Artificial Sequence: Synthetic coding sequence
atggaggttaaccccccaaagcaggagcacctgttggcccttaaagtgatgcgcttgacaaagccaactttatttactaatatcccagttacatgtgaggagaaggaccttcccggcgacctgtttaaccaacttatgcgagatgacccctctactgtgaacggggccgaagtgctgatgctgggagagatgcttacactgccacaaaattttggcaacatcttcctgggcgaaaccttctctagttacattagcgttcataatgatagtaaccaggtggtaaaggacatcttggttaaggctgacctccagacctcaagccagagattaaacctgtctgcctcaaacgcggcggtggcggaactgaaaccagactgttgtattgacgatgtgatacatcacgaagttaaagagatcggtacacacatattggtgtgtgccgtaagctataccacacaggcaggagagaaaatgtatttcagaaagttttttaaatttcaggttctgaaacctcttgatgtgaaaactaaattctacaatgcggaatctgacttgagttcagttacagatgaagtatttttggaggcgcagattcagaatatgaccacctctcccatgtttatggaaaaggtgtccctcgaaccttccataatgtacaatgtaacggaactcaactccgtgagccaggccggcgaatgcgttagcaccttcgggagtcgggcctacctccaacctatggacacccgtcaatacctgtactgtctgaaaccaaaaaatgaatttgctgagaaagctggcattattaagggggtcactgtcatcgggaaattggacatcgtttggaagacaaacctaggcgaaaggggacgcctgcagacttctcagctgcagcggatggcacctggatatggagatgtaagactctctctcgaggctattcctgataccgtcaaccttgaggagccgttccatattacttgtaaaattacaaactgcagcgaacgcactatggacttggtcttggaaatgtgtaatacaaactctatccattggtgtgggatcagtgggcggcagctcggtaagctgcatcccagttcctctctgtgcctagccttgacgctgctgtcctctgtgcagggtttacagtctatttccggattgagactgacagatacattccttaagaggacttacgagtacgacgatatagcccaggtctgcgtagtgagcagcgccatcaaggtggaaagctag

SEQ ID NO: 28133 - DNA, 1239 bp, Artificial Sequence
  Description of Artificial Sequence: Synthetic coding sequence
atggaggtgaacccgccaaagcaggaacatctcctcgcactcaaagtgatgcgattgactaaacccactctgtttacgaatatcccggtaacatgtgaggaaaaagaccttcccggtgacttattcaaccagttaatgcgagacgatccatctaccgtcaatggggcggaagtgttgatgctgggcgagatgctgacactgccacagaacttcgggaatatctttttgggggaaactttttcctcttacatctcagttcacaacgatagtaatcaagtagtgaaggacatccttgtgaaggctgatctgcaaacctcgtcacaaagactcaatttgagcgccagcaatgccgcagtggctgaactgaagcccgattgttgtatcgacgatgtcattcaccacgaagtgaaagaaattgggacccacatcctggtgtgcgctgtgtcctacacaacgcaagccggcgaaaaaatgtactttcggaagtttttcaaatttcaagtcctcaagcctttggacgtcaaaactaagttctataatgccgagacggatgaggtctttctcgaggcacagattcaaaacatgactacttctcccatgtttatggaaaaggtcagtctggagccttccataatgtacaatgtgactgagctaaactccgtctcccaggctggcgagtgcgtgtctactttcggcagccgagcctacctccaaccaatggataccaggcagtacctatactgcctcaagcctaaaaatgagttcgcggaaaaggccggaatcatcaagggtgtcacggtgatcgggaagctagacatcgtgtggaagacaaatctcggagagcgcggccgcctccagacatcccagctgcaacgcatggcaccagggtatggggacgtgcggctgtctctggaagctatccctgacacggtgaacttagaagaaccctttcacattacctgcaaaatcaccaattgttccagtgaaagaaccatggacctggtcctggaaatgtgtaacaccaatagtattcactggtgtggaatcagcggcagacagctcgggaagctgcatccatcctctagcctctgtcttgctctgactctcctcagctcagtccaaggactgcaaagcatctctggcctgcgcctgacagatacatttcttaagcgtacttacgagtatgatgatatcgcccaggtctgtgtcgttagttcagccataaaggttgaaagttag

SEQ ID NO: 28134 - DNA, 1260 bp, Artificial Sequence
  Description of Artificial Sequence: Synthetic coding sequence
atggaggtgaatcctccgaagcaggagcacctactcgctcttaaggtgatgcgcctgaccaaaccaactttgttcaccaacattcctgtaacctgtgaggagaaggacctgcccggcgacctcttcaaccaactcatgcgcgacgatccttctaccgtaaacggagccgaagtgcttatgctaggtgagatgctgaccctcccacagaactttgggaatattttcctgggggagactttctcaagttatataagtgtgcataacgatagtaaccaggtcgtcaaggacattttggtgaaggctgaccttcagacctcatcccaaagattgaacctgagcgcttccaacgctgccgttgccgagctgaagccagattgttgtatcgacgatgtgattcatcatgaggtaaaggaaatcggaacacacatcctggtttgcgcggtatcctataccacccaggccggagagaaaatgtacttccggaagttttttaaatttcaggtccttaaaccactggacgtgaaaaccaagttctataatgccgaaaaacagatagccaacgtcaccaccgacgaggtgtttctggaggcccagatccagaacatgactaccagcccaatgttcatggaaaaagtctcgctggagcccagcataatgtacaacgtgaccgaactcaactcagtgtcacaagccggcgagtgtgtgagtacgtttgggagccgtgcctaccttcagcctatggacactcggcaatatttgtattgcttaaagcctaaaaacgaattcgcggaaaaggccggcattatcaagggtgtgaccgtgatcggtaaactggatatcgtgtggaaaacaaacctgggagagagggggagactacagacatcacagctccagcgaatggctccgggatacggggatgtcaggctgtcgctagaagccatcccagataccgtcaacctggaagaacctttccatatcacctgcaaaataaccaattgttcttctgagcgaaccatggacctggtgctggaaatgtgcaatactaatagcatccactggtgtggaatctctgggagacagctgggcaagctgcatccgtcttcttccctgtgcttagcactgacgctcctttcttccgtccaaggtcttcaaagcattagcggccttcgcctcacagacacttttttgaaaaggacatacgagtatgacgatatcgcccaggtgtgtgtcgtgagtagtgccattaaggtggagagctag

SEQ ID NO: 28135 - DNA, 1257 bp, Artificial Sequence
  Description of Artificial Sequence: Synthetic coding sequence
atggaggttaaccctcccaagcaagaacatctgctggcattgaaggttatgcgcttaaccaaacctacactattcacaaatatccctgttacatgtgaggagaaagatcttcccggcgacctttttaaccagctcatgcgggacgacccaagcacggttaatggggcagaagtgcttatgctcggagagatgctgaccctccctcagaatttcgggaacatcttcctgggggaaaccttttcatcatacatatccgtgcacaacgattccaaccaggtggtcaaggacatcctggtcaaggcagatcttcagacaagctcgcagcgcttgaacctgtctgcctctaacgccgctgtagccgaactgaagcccgactgctgtatcgacgacgttatccatcacgaggtaaaggaaatcggcactcacattctggtttgcgcagtcagctatacgacacaggccggcgaaaagatgtatttcaggaagtttttcaaatttcaggtgctgaagccactcgacgtcaagacaaagttttacaatgctgaatccgatctttcatctgtgaccgacgaagtctttctcgaggcgcagatccaaaacatgaccacaagccccatgttcatggagaaggtatccctggagccctccataatgtataatgtgacggagctgaactccgtgagtcaggccggggagtgcgttagtacatttgggagccgcgcctatcttcagccaatggataccaggcagtatctctactgcttgaagcctaagaacgaattcgccgaaaaagccggtatcatcaagggcgtgaccgtgatcgggaagcttgatatcgtatggaagactaatcttggggaaagaggaagactccagacaagccagctccagcgaatggcccccggctatggggatgtgcgcctgagtttggaagccattcccgacactgtaaacctggaagaaccttttcacatcacttgtaagattactaattgctcaagcgagcgcaccatggacttggtcctggaaatgtgtaataccaactcaatccactggtgcggcatatctggcaggcagctgggcaagctgcatccctcctccagtctgtgcctggctctgaccctgctgagctctgtgcaaggtctccagtccattagtgggctgcggttgaccgacaccttcctgaagcgcacctacgagtacgacgatattgcccaagtgtgtgtcgtgtcctctgccatcaaggtggagagctag

SEQ ID NO: 28136 - DNA, 1032 bp, Artificial Sequence
  Description of Artificial Sequence: Synthetic coding sequence
atggcttccctgcagcgcagtagagtacttcgctgttgtagttgtcgactgttccaggcccatcaggtgaagaaaagcgtgaagtggacttgcaaggcctgtggggagaaacagtctttcctccaggcctacggggaggggagcggggctgactgccggaggcatgtgcaaaaactgaatctgttacagggccaggtcagtgagctgcccttaaggagtctcgaggagactgtcagcgcctccgaggaagaaaacgtgggtcaccagcaggcgggcaacgtgaagcagcaggaaaagagccaaccgagcgagagccgttggcttaaatatctggagaaagattcccaagagctcgagctagaagggacaggagtttgtttcagcaagcaaccgtcgtcaaagatggaagaaccgggaccgcgattctcacaggatctgccacgaaagcgaaagtggtccagatcaaccgtgcagccgccatgctcacgcggcgtacaggacagcggagggagcgaggtcgcttgggggccgcagaagggccaggcagggctcacctggaaggtcaagcaagggtcctcaccgtgccttcaggaaaactctgccgattgcagtgcgggagaactccgcggacctggaaaagagctctggagccccatacaacaggttacagcgacgtcgtcgaaatgggcacagttcgtactgcccccacggaagagttcccatgtcgatagtgagcagcccaggagccttcagagggatcctagaccagccggccctgctcaagcgaaacagggaactccgcgagctcaggcttcccgcgagggcctgtccagaccaactgccgccgtccagctccctagggcaactcaccctgtgactagcgggtctgagaggccatgcgggaaaacttcatgggatgctaggactccttgggccgagggtggccctcttgtgctggaggcgcagaatccacgtccaacaagactgtgcgatctttttatcacgggagaagacttcgacgacgatgtgtag

SEQ ID NO: 28137 - DNA, 867 bp, Artificial Sequence
  Description of Artificial Sequence: Synthetic coding sequence
atggcgagtctccagaggtcccgggttctgagatgctgcagttgccgtctgttccaggcacatcaggtgaagaaatccgtgaaatggacctgcaaggcctgtggagaaaagcaaagtttcttgcaggagaaaagccagcccagcgagtcacggtggctgaagtacctcgagaaagactctcaggagcttgaactggaaggaacaggggtttgcttcagtaagcagcctagctctaagatggaagagcctggaccccgcttttcacaggacctccctcgcaagcgtaaatggtctcggagcaccgtccaaccaccttgctcccgtggggtgcaggactctggcggctccgaagttgcatggggccctcagaaaggccaggctggtttgacatggaaggtcaagcaaggatcaagcccgtgcctccaggagaactcggctgattgcagtgccggtgagctgcgtgggccagggaaggagttatggtctcctattcaacaggtcacagcgactagttccaaatgggcccagttcgtgttgcctcccagaaaatcgtctcacgtggacagtgaacaacctcgttcacttcagcgcgatcctcggccggcaggccctgctcaggctaagcagggtaccccgcgtgcccaggccagcagggaggggctgtccaggcccaccgcggccgtacagttaccaagagccacacacccagtcactagtggatccgaacgcccgtgcgggaagaccagctgggatgccaggacaccatgggccgaaggcgggcctcttgtcctggaggctcagaatcctcggccaactcggctctgtgacctcttcatcacgggcgaggattttgacgatgacgtgtag

SEQ ID NO: 28138 - DNA, 816 bp, Artificial Sequence
  Description of Artificial Sequence: Synthetic coding sequence
atgcaaagtgctcgggcatggctgcctggcgactgtacaagtagggacggggtcgcctcagcctttagtggcgcaacactgctgcaactccccccactgccaggagctcctggcaagaaagagtgtcaggtggatatgcagagcctctggagagaggcagtgctgtttgcggagtttcccaggcacggcgccccggctagtgaactgccagtcccttcaggatctgaaatggatggtgcagagtcaggtaaagcctacggcgaaggctctggcgccgactgccgaagacatgttcaaaagttgaatcttctgcaggggcaggtcagcgagttgcctctccgaagtctcgaggaaaccgtctccgcaagtgaagaggaaaacgttggacatcagcaggctgggaacgtgaagcagcaggaaaagtcccagccttcagagtcgcggtggttaaagtacctagagaaggactcacaggagctggagttagagggcaccggcgtttgtttctctaagcaaccctcatcgaagatggaggagcctgggcccaggttttcacaggacttgccaagaaagcgcaagtggtcaagatccactgtgcagccaccatgctcaaggggcgtccaggactccggaggctccgaggtggcctggggaccccagaagggccaggctggactcacctggaaagtgaaacaaggctcctctccgtgcctgcaagagaatagcgcagattgttcggctggcgagttaagaggacccggcaaggagttatggagtcccattcagcaagatggatataaagaaattttgttttag

SEQ ID NO: 28139 - DNA, 531 bp, Artificial Sequence
  Description of Artificial Sequence: Synthetic coding sequence
atggctgctgcagggagaggtagggaacaagattctgcaaggtttgtgtatgtcacacgatttggatctcatcaatgctctggggtgctgcagctcggcgggaggggggcccaaggtctctggggccaggggccaggggccggctgtcgccaggagaagcctagggaggccatggccgttgcaggggtgcaaggaggctcagaacttccactcggttcacaactgcgagtccctactactcctggcgtggaggccgcagccagcgcaagtagccaactgagagcttctcgggtgcagagtggcacgcggcagtccgcccgagccggcttgatccagaaagatgcagctaaaaagtatgatttccccatccccctgaacgaggcttctaagataatgaaaaaaaagaaaaaagtgctcgtgtggaacagggtctataaagtgataagtcgcatgctggaggagaatgagaaataccgacatcgccttaaatgccagcggctgtcctccgagtctagtaactatactcgctag

SEQ ID NO: 28140 - DNA, 405 bp, Artificial Sequence
  Description of Artificial Sequence: Synthetic coding sequence
atggcttccggcaaagacacatgtccaaccctaccaaagctgaccaacaactgcagtgacgagtctctgtacaagtccgccaacaaatatgaggagattcacctaccaagattctctctcaagcagggaatgattcctcgccggtacgtgatgccctggaaagagaacatgatctttcgcaacgtgaacctgaaacaagcggaggtttgtggaatccatacaggcccactggaagacagcttgttcctcaatcacagcgaaagactgtgccacggcgaggacagaaaagtcgtgtttcagaaaggacctccagagattaagatcgccgatatgcccctgcactcaccgctttcacggtaccagtctaccgtcatcagccatgggtttcgccggcgcctagtctag

SEQ ID NO: 28141 - DNA, 444 bp, Artificial Sequence
  Description of Artificial Sequence: Synthetic coding sequence
atggaagatgacgaggaagagacgacagccagcaccctccgaggcaagcctagaccgcctcccgtgtccgcacaatccgcgttttcctacatcccgccgaggagactcgatccaaaggagcactcttactattaccggcccgcccggaccggcatcatctcgctctacgattgtatttttaaaagacggctggattacgatcaaaagttacacagagatgaccgggagcacgccaaatccctcgggcttcatgtgaacgaagaagagcaggagagacctgtgggagtgttaacttctagtgtctacggcaagcggatcaaccaaccgatagagcctctgaacagggatttcgggagggcaaaccacgtgcaagccgatttctatcggaaaaatgatataccgagtttgaaagaaccgggattcggtcatatcgcccctagctag

SEQ ID NO: 28142 - DNA, 471 bp, Artificial Sequence
  Description of Artificial Sequence: Synthetic coding sequence
atggccacccagcaagtggactcacggcggcaagtcgccgcagagcaggtggctgcccagctgctcgaacgtcgaagaggctctcattgcgatgacgagaaacagaccctcttggcactgctgattttggttctctatctgagcacagaaatttgggggagcagctgggaggtgtctgagaggattagagaatgcaattattatcagaatctggctgttccccagggtctggagtatcaaaccaacgagccatctgaggagccaattaaaactattcgcaattggcttaaggagaagctccatgtattttccgagaagcttgaggaggaagtccagcaactggaacagctggcttgggacttggagctctggctggatgctctattaggagagccacaccaggaggagcactgctcaacctataagtctcacctgcatctggagcacgaggtcagcataagggatcattag

SEQ ID NO: 28143 - DNA, 885 bp, Artificial Sequence
  Description of Artificial Sequence: Synthetic coding sequence
atggctgccgcagtgtcatctgtcgtgcggcgggtggaagagttaggcgatctcgctcaggcccacattcagcagctctctgaggccgctggagaagacgatcactttcttatacgtgcatcagcggcactggaaaagctaaaattattgtgtggagaagaaaaagaatgttcaaatccctccaatctccttgagctgtacacacaagcaatcttggatatgacgtatttcgaagagaataaactggtggatgaagattttcctgaagactcaagtagccagaaggtgaaggagttgatttcttttctttcggaacctgaaatcctggtcaaggaaaataatatgcaccccaagcactgtaacctgctcggggacgagttgcttgaatgtctgagctggagacggggcgctttattgtacatgtattgtcactcgctgaccaagaggcgagaatggttgctgcgcaagtcaagtttactgaaaaagtacctccttgatgggatcagctacctgctgcagatgctgaactaccgctgcccaattcaattgaacgagggcgtgagtttccaggatttagataccgccaaattgctcagtgccggtatttttagcgatatccacctcctagccatgatgtattccggggagatgtgttactggggcagcaaatattgcgccgaccaacagccagaaaatcacgaggtcgatacctcggtctcgggcgcaggctgcaccacttacaaggagcccctggacttcagagaggtgggcgagaaaatcctcaaaaagtacgtaagcgtgtgcgaaggccctctgaaagaacaggaatggaatactaccaacgccaaacagatacttaattttttccaccaccggtgcaattag

SEQ ID NO: 28144 - DNA, 480 bp, Artificial Sequence
  Description of Artificial Sequence: Synthetic coding sequence
atgacgcagcctacacggcccagtgtaacctgcgaccaaggcagttcaacgattggcggcacggccgctcaggctacaaccagctcttcggcgacgtccggcagtaattaccagagggacagattgggaaggcgccccgaaatcggcgttgggggtcagcctcagatatgttttccacggcccaggtccgcccaacagcccgtgctgttttctcttatgaacagctcggaagcagccatgaaaaagactctgcccaaatcccatcttagtagagtcataatccatgataaccggataacccagcgcatatatgagatggaagtgtccgccctggagaaaacaaaaaaaaagatcagccactattacgaacacttaaagaaaaagttcatgaccgaacagttgagaaaactcgggaggtggagagaggagtcagtgaatagcaataggtatttgactttcgggatccctccaccggtttag

SEQ ID NO: 28145 - DNA, 1785 bp, Artificial Sequence
  Description of Artificial Sequence: Synthetic coding sequence
atgtccaagaaaagaaaatgggacgatgactacgtcagatactggtttacgtgcacgaccgaagtggatggtacacagcggcctcaatgtgtgctctgtaactccgtgtttagtaacgccgacctgagaccttccaaactcagtgaccattttaaccggcagcacgggggagtcgccggccacgatctgaattcactaaaacacatgccagcgccatccgatcagtctgagactttgaaagcctttggagtggcttctcatgaggatacgttgctccaggcttcttatcagtttgcctacctgtgcgctaaagagaagaatccccacaccgtggcagaaaaactggtcaagccatgtgcgttagaaatcgctcagattgttctgggtcctgacgcgcagaagaaactgcagcaagttccgttgtcagacgacgtgatacatagcagaatcgacgaaatgtcacaagacatattgcagcaagttctggaggacatcaaagcaagtcccctgaaggttggcattcagttggccgaaaccacagacatggatgattgttcacagttaatggcttttgtgaggtatattaaggaaagagaaattgtggaagagttcctgttttgtgaacctcttcagttgagcatgaaaggcatcgacgtcttcaacctctttcgggatttcttcctgaagcataagattgcactggatgtatgcggcagcgtgtgtactgacggagccagctctatgctcggagaaaattccgaatttgtagcctacgtgaagaaggaaatcccacacatcgtggtgacgcattgcctgctgaacccccatgcactggtgattaagacgctgcctactaagctccgtgatgccctcttcactgtggtgcgcgttattaacttcatcaaaggtagggccccaaatcacaggttgttccaggcattttttgaagagattggtatcgaatattctgttctgctgttccacaccgaaatgcgctggctgtcaaggggacagatactgacacatatctttgagatgtacgaggagattaaccagttcctgcatcataaaagctctaatctggtcgacggctttgagaacaaggaatttaagatccacctggcctacctggcggatctcttcaagcatctcaatgaactgagcgcttctatgcaacgaaccggcatgaatacagtgagcgccagagagaagctctcagcattcgtacggaaattcccattctggcagaagagaattgaaaagagaaacttcactaatttcccttttctggaggagatcatagtgagcgacaacgaagggattttcattgctgccgagatcaccttgcatctccagcagctgtctaattttttccatgggtatttctccatcggtgacctcaacgaggcttctaagtggatcctagaccccttcctcttcaacatcgactttgttgacgactcgtacctgatgaagaatgacttagccgagttacgagccagcgggcagatccttatggaattcgagacgatgaagcttgaggatttctggtgcgctcagtttaccgccttcccaaacctcgcaaagactgctctcgaaatcctgatgcccttcgccacgacatatctctgtgagctcgggttctcttctcttctgcactttaagaccaagtcacgatcctgctttaacctgtctgatgatatacgcgtcgcgatttccaaaaaggtgcccagattttcagatattattgagcagaaactccagctgcagcagaagtcactatag

SEQ ID NO: 28146 - DNA, 1785 bp, Artificial Sequence
  Description of Artificial Sequence: Synthetic coding sequence
atgtccaaaaagcggaagtgggacgatgattatgtccgatattggtttacatgtaccaccgaagtcgatgggactcagcggccacagtgtgttctgtgcaactcggtgttttcaaacgccgatcttcgcccgtctaagcttagcgaccactttaatagacagcacggcggtgtcgctggacacgacttaaactctctgaagcatatgcctgccccatccgaccagagtgaaaccttgaaagctttcggagttgcaagccacgaggacacactgctccaggcctcctatcaattcgcttacttgtgtgcaaaagagaaaaacccccacaccgtggccgaaaaattggtgaaaccctgcgcactggaaattgctcaaatcgtgctgggccccgacgctcaaaaaaagctgcaacaggtgcccctctccgacgacgttatccactctcggatagacgaaatgtcccaggatatactccagcaagtgctggaggatatcaaggcctcaccattgaaggtgggcatccagctggcagagacaactgatatggacgactgcagccagttgatggcttttgttcgctatataaaggaaagggagatcgtggaggagttccttttttgcgaaccgctacagctgtctatgaaaggaattgacgtgttcaatcttttccgggatttctttctgaaacacaagatagcattggatgtgtgcggcagtgtgtgtactgatggggcgtccagcatgctgggcgaaaatagcgagtttgtggcgtatgtgaagaaggaaatcccacacatcgtggtcacacattgcctgctgaacccacatgctctggtcatcaagacactaccaactaagttaagagatgctctcttcacagtcgtcagagtgattaactttatcaaggggcgtgcacccaatcataggctgtttcaggctttctttgaggagatcggaatagaatattccgtcctcctttttcatactgagatgcgatggctgagcaggggacagatattaacacatatctttgaaatgtatgaggaaattaatcagttcctacatcacaagtcatctaatttggtagatggattcgaaaacaaagagtttaagatccacctagcatatctggcagacctttttaagcacctgaacgagctctccgcaagcatgcaacgaaccggaatgaatactgtcagtgccagagagaaattgtccgcttttgtgagaaaatttcccttctggcaaaaacgcattgaaaagaggaactttacaaacttccccttcttggaggaaatcattgtgagcgataatgagggcatcttcatcgccgcggagattaccctgcatctgcaacaattatctaacttctttcacggctacttctctataggtgacctgaatgaggctagtaagtggattctggatcccttcttgttcaacattgactttgtcgacgacagctatttaatgaagaacgatctggccgaactcagagccagtgggcagattcttatggaattcgaaaccatgaaactcgaagacttctggtgcgcccaatttacagctttcccaaacctggccaagaccgccttggaaatcctcatgccatttgctactacatacctctgcgagttaggtttcagcagtctactccactttaaaaccaaaagccgatcctgttttaatttatccgatgatatcagggtggccatttccaagaaggttccgcggttttcggatataatcgaacagaagctgcagctgcaacagaagtccctgtag

SEQ ID NO: 28147 - DNA, 309 bp, Artificial Sequence
  Description of Artificial Sequence: Synthetic coding sequence
atgcgggaaatcgccgagatattgccggcccaggaaaaggtggaggcacgcatcgatcttaaaatgggcaagaagcgtgtgacggaccacaaactgaacgtggacaaggtgatcaaaaacatcaatactatctctagcgagttgaagaagattaaagagctgagccagcttttgctgtgcgacctaatcttacacttcaaccatccaataaaaacggaaaatctggctgaagccgagcgtaacaaccctctctttgaagagtctaaaatctccgacgtaagccttgtgtccaactcattttccatttag

SEQ ID NO: 28148 - DNA, 309 bp, Artificial Sequence
  Description of Artificial Sequence: Synthetic coding sequence
atgagagaaatcgctgaaatccttcctgcccaggagaaggtggaggctagaattgatctgaagatgggaaagaagcgtgtaacagatcataagctgaacgtcgataaggtcattaagaatattaacacaattagtagtgaacttaaaaaaatcaaggagctcagccagctcctcttgtgcgatttgatactgcacttcaaccaccccatcaaaactgagaatctggctgaagccgagagaaacaaccctctgttcgaagaatcaaagatctcagacgtttctcttgtctccaacagcttttcaatctag

SEQ ID NO: 28149 - DNA, 834 bp, Artificial Sequence
  Description of Artificial Sequence: Synthetic coding sequence
atgccaagggcacaactccctgaggacagtagtgcagtagacatggatatcctgtttcccttagattcagtcatcggcaccgagctgtgtccaagtccaattcctcaaataattcattttgtgttattcgtggtgttctctctcgtgatccttatcatcctgagactgtatattcctcgggagccatcatcagtgcccccccgagaggaagatagcgagaatgatcaggcagaagttggggagtggctacgaatcggcaataaatacatcaccctcaaagattaccggatactgctgaaggaactcgaaaacctggagatttatacctttctctctaaaaagtgtcttaagaagctgtcaagagagggctcaagccatcacctcccaaggcaagtgaggccgggaccagtttataagccggcaccagctaggaatcatcgccctaggggtggacgcggtaaggcaagtcctactagcttccacgtgagcccacgtgccccattagcgccactggcctccatgcctagctctgtcccaaaaacctccgtggagtctctcggctctccgtcatctctctcttcctcaaaacctagggagcccctttgtccgttaaagcacccttctcaccagcctcctgcctccacgctttcacctaaccctacatccagcacagaaagtctgggggagacaccgcatgccggccgttggcgccaggggtcccgcttccctcagcccggatgtgctaacgccgctggacggatccggcatcagaatccacgccactcccatggacacaggattagtgatattcacgagcaactggggattagctag

SEQ ID NO: 28150 - DNA, 348 bp, Artificial Sequence
  Description of Artificial Sequence: Synthetic coding sequence
atgctgtggttccagggcaacagtatgcagttggcgaggtccagcttcgggttgtttttgaggaattgttccgcatcgaagaccactctcccagtgctcacattattcaccaaggatccttgtccactttgtgacgaggctaaggaggtgctgaagccctatgagaacagatttattttacaggaggtgaacatcacgctaccagagaacagtgtgtggtatgagagatataagtttgacatacctgtcttccacctgaacggccaatttctgatgatgcatagggtgaatacctccaagcttgagaagcaactgctgaagcttgagcagcaaagcacaggcggatag

SEQ ID NO: 28151 - DNA, 417 bp, Artificial Sequence
  Description of Artificial Sequence: Synthetic coding sequence
atgctgtggtttcagggcaacagcatgcagctggctcggagcagcttcggcctctttctgcgaaactgctccgcgagtaagaccactctccctgtgctgaccctttttactaaggacccctgtccattgtgcgatgaagctaaagaagttctgaaaccctatgagaacagacagccctacaaggatcagaagctgcctggaacccggcgccggagaagcccttcttctcctagccatccacatatggccagtcaaagcgggaaacgctacaacctgaccttgaaccaggttttgagcttcgattatgacatgggtctggacgccccgaagacaatttcctccgactgcggagcattctactgtctgcgcatgtttaagagtcctgatatgacatgttgtttttatccaaagcagtag

SEQ ID NO: 28152 - DNA, 3048 bp, Artificial Sequence
  Description of Artificial Sequence: Synthetic coding sequence
atgctgacagcactggctccccccgctttgcctgggatccccagacaactccccaccgcccccgcgcgaaggcaggatagttctggtagctctggctcttattacacagccccaggtagcccggagccgccagatgtcggtcccgacgccaaagggcccgctaactggccgtgggttgccccaggtcgcggagcgggagcacagccccgactgtctgtttcggcccaaaattcaaggcagaggcacgggccagggagcggattcccaaggggacccgggtcaggtcctcgccccccgcagcctcagctgcgcactcttccgagtggggagatggaggtgatctttggcgtcggacctctgttcggctgctcaggagccgacgatagggaagctcaacagcagtttacagagcccgcttttattagcccgctgcctcccgggcctgcatctccagcagccgttccccgccagagccaagtgcccgacggagggtcccgctgggcaacctatttggagctgagaccacggggtccatcacctgccgccccagctcagtttgaatgtgtggaggtggctctggaagagggagccgcccccgcgagacctaggacagtgccgaagaggcagatcgagctaaggccgcgcccccaaagcccaccaagagccgccggcgcaccgagacctcgcctattgctgaggaccgggtctctcgatgagtcactaggcccgctccaggccgccgctggattcgtgcaaaccgccctggcccggaaactgagccctgaggcccctgctccctcaagtgcaaccttcgggagcaccggacggagcgagcccgagaccagggagaccgcgaggagcactcatgtggtactcgagaaagccaagtcccgccccctgcgggtgcgggacaattcagctccggccaaagctcccagaccatggccatctctgagagaacgggcgatccggagggacaagcctgcacctggcacggaaccccttggcccggtgtcctcatcaatcttccttcaatcggaggagaaaatccaggaggcccgaaagacgaggttcccgagagaggcccctgacaggactgtacagagagccaggtctcctcccttcgaatgcagaattcccagcgaggtcccttcccgggcagtccgaccgcgctcgccgagcccgcctaggcagactcctaacggagcagtgcgtgggccccgatgcccaagtccccagaacctgtcgccatgggataggacaacccgtcgcgtctcatcaccactgtttcccgaagcctcctcggagtgggaaaaccaaaatccggcagtggaagagactgtaagccggcggagcccaagcccgccaatcctgtctcagtggaaccagtgtgtggcaggggagaggagtccaagtcttgaggcaccatcgctctgggagatccctcacagtgccgttgctgatgccgtcgagccaaggtcttcaccctctcctcccgccttcttcccttgggaagctcctgatagacccatcggaacatgggggccttctcctcaagaaacttgggaccccatgggacccggtagctctattgcttttacccaggaagcccaaaatggtctaactcaggaagagctcgctcctcctacaccctccgctccaggcacaccggagcctactgagatgcagagcccttccacacgtgaaatcagcgaccttgcgtttgggggctctcagcagtctccagaggtagccgcgcccgagcccccagggagtcatccagtgggaaccctggacgcagataaatgccccgaggtccttggcccaggggaagccgctagcggaaggcctcgtatggccataccacgcccccgggatgttaggaaattggtcaagacaacctatgcacccgggtttcccgccggagcgcagggctctgggttaccagcgccaccagccgatccttgcggtgaagagggaggggaatctaaaacgcaggagcctccagcccttgggcccccggcaccagctcactataccagtgtgtttattaaggactttctgcccgttgttccacacccatatgagccgccggagccttcttttgacacagtggcacgggacgcaagccaacctaacggcgtgctccgccgcagagcagaaaactccacagccaagccatttaagcgaaccgagattcgattgcctggagccctcgcgctggggaggcgtcctgaggtcacctccagagtgcgggctcgggggcctggcggagagaatagggatgtcgaggcccagagattggttcctgatggggatggtcgaacctctcctcttggcggggccaggtcatcttcccagagatctcccgtcggccccgccggggtgcgaagcccacgcccaggcagcccccagatgcaggccagccccagtccaggcattgcaccaaaacccaaaactccacctacagccccggaacctgctgccgccgtacaggcgccactccctcgggaacctctcgccctggctggacggacagccccagcccagccaagagccgcaagcgcgccgcccactgatcggagcccccaaagcccatctcagggggcccgcagacagcctggagctgccccactaggaaaggtgctcgtcgacccggaatcggggcggtactacttcgtggaggcacccaggcaaccgaggctcagggttttgttcgaccccgagtccggtcaatatgtcgaagtgctgctcccacccagctcgcccggcccacctcatcgagtctatactcctctggctctcgggcttggactgtatcctccagcttatggacctattccgagcctttcccttccaccatcccctggtcctcaagctttgggcagcccccaattaccttgggtcagcgaagccggacctctggatgggacttactacctaccagtatctggaacccccaaccccgctccgccgttactgctgtgcgctccaccctcatctagtggccccacccaaccgggcaaaggctcacttttccctctgtag

SEQ ID NO: 28153 - DNA, 1689 bp, Artificial Sequence
  Description of Artificial Sequence: Synthetic coding sequence
atgaccgttctggaaattacacttgccgtgattcttaccctgttagggcttgctatcctggcgattctgttaacaagatgggctcgaagaaagcaatccgagatgtacatctccaggtactcctctgaacagtccgccagacttcttgactatgaagacggcagaggctcaagacatgcctattctacacagtccgacactagttacgataaccgggaacgctcaaaacgcgattataccccatcgacaaactcgcttgccctatcgagatctagcatcgcccttccacagggctcaatgtcctcaattaaatgtttgcaaactaccgaggaacctccctccagaactgctggagcaatgatgcaatttactgcgcccatcccaggggcgaccggccctattaagctgtcgcagaaaaccattgttcagaccttgggacccattgttcagtaccccggatccaatgtccggtctcacccacacaccatcacaggcccacctagtgccccaagaggacccccaatggccccaataattataagccagcgcaccgccagccagctggccgcccctattcgaatccctcaggtgcacaccatggattccagcggcaaaataactctgactcccgtagtgatactgacaggctatatggatgaggaactcgctaaaaagagttgctccaaaattcagatattgaagtgcggcggaaccgcacgctcgcaaaattccagggaagaaaataaggaggcgttgaagaacgacatcatatttaccaactccgtagaatcgctgaaaagcgcgcacatcaaggaaccagaacgcgagggaaaaggcacagacctggagaaggataaaatcggtatggaagtaaaggtggactccgatgccggcattcccaagcgccaagaaacacaactgaagatatcggaaatgagtatcccccagggtcagggcgcacagattaagaagtccgtctcggacgtaccacggggccaggaaagtcaggtcaagaaatcagaaagtggagtgcccaaaggtcaagaggctcaagttaccaaatcaggccttgttgtactaaagggccaggaagcgcaggttgaaaagagcgagatgggcgttccccgacgccaggagtcacaagtcaagaaatcacagagcggtgtatccaagggacaagaggctcaggtgaagaagcgcgagagcgtagtgcttaaaggacaggaggctcaggtggaaaaatcagaactgaaagttcccaaaggacaggagggtcaagttgagaagacagaagccgatgtgcctaaggagcaagaggtgcaggagaagaaatctgaggcaggggtgcttaaaggccctgagtcacaggtgaaaaataccgaggtttccgtgcccgaaaccctcgaatcccaggtgaaaaaatcagagtcaggcgtgctgaaaggtcaggaagcccaggaaaaaaaggagtcttttgaggacaagggaaataatgacaaggaaaaagagcgtgacgctgaaaaggaccccaataaaaaagagaagggtgacaagaataccaaaggggacaaaggaaaagacaaggtaaaaggtaagagggagagcgaaattaacggggaaaagtccaaaggtagtaaacgggcaaaagcaaacaccgggcgcaagtacaataagaaggttgaagagtag

SEQ ID NO: 28154 - DNA, 1692 bp, Artificial Sequence
  Description of Artificial Sequence: Synthetic coding sequence
atgacagtccttgagatcaccttagccgtgatcctgactcttctaggcttggccatattagccatccttcttactaggtgggcccgaaggaaacagtccgaaatgtacatttctcggtactctagcgaacagtcggcccggctgctcgattatgaggacggccgaggcagcagacacgcatactctacccagtccgatacctcttatgataacagagagcgttctaaaagagactacacccccagtacaaacagtttggtgtccatggcctctaaattttccttaggacaaaccgagctgatccttctgttgatgtgcttcatcctggccctcagtagatcttctataggaagcattaagtgtctgcaaactaccgaggagccaccgtctagaaccgccggagccatgatgcagttcacggcccctatcccaggagcgactggacctattaagctctcccaaaagaccatcgtgcagaccctcgggccaatcgttcagtacccgggctccaacgctgggcctccctccgcccctcgcgggccccctatggcacccattatcatatcacagaggaccgctcgaattcctcaggtgcacacaatggatagcagtggaaagattaccctgactccggtagtcatcctgactggatatatggatgaagaactagcgaaaaaatcgtgttccaagatccagatcctcaagtgcgggggcaccgctaggtcacagaattcccgggaggagaataaagaggcgctcaagaatgatataatattcactaactcggtcgagtccttaaaatccgctcacattaaggaaccggaaagggaaggcaaaggcacggatttagaaaaggataagataggcatggaggtgaaagtcgattccgacgccgggatcccaaaacgccaagagactcagcttaaaatctctgagatgtctattcctcagggccaaggggcccaaattaaaaagagtgtttcagacgtcccacgtggccaggagagccaagtgaagaagtctgagtcaggcgtgcctaagggacaagaagctcaggttactaagagtggcctagttgtattgaagggccaggaagcacaggtagaaaaatccgaaatgggggtccctaggagacaggagtcacaagtcaaaaagagccagtcgggggtctccaaggggcaggaggctcaggtcaagaagcgggagagtgttgtattaaagggtcaggaggcccaagtcgagaagagcgaattgaaggtgccgaaggggcaggagggacaggttgagaagaccgaggccgacgtgcctaaagaacaggaagtgcaggagaagaaatcggaagccggggtgttgaaggggcctgagtcgcaggtgaaaaataccgaggtgagtgtccccgaaacccttgagtcacaagtcaagaaaagcgaatctggcgtgctgaagggacaggaagcgcaggagaaaaaagagtccttcgaggataagggcaataatgacaaggaaaaggagcgggatgctgagaaagaccccaacaagaaggaaaaaggcgacaagaatactaagggggataagggaaaggataaggtaaagggcaaacgggagagcgagataaacggcgaaaagagtaagggatccaaacgggccaaggccaatacgggtaggaagtataacaagaaggtggaggagtag

SEQ ID NO: 28155 - DNA, 582 bp, Artificial Sequence
  Description of Artificial Sequence: Synthetic coding sequence
atgaccgtgctggagatcaccctcgctgtgattctgaccttactgggcctggcaatcctagcaatactgctgacacgttgggctagaagaaagcaatccgagatgcacataagccggtatagtagcgagcaaagtgcgcggctattggattacgaagatgggagaggtagtcggcatgcatacagtactcaaagcgacacgtcttgcgataacagggagagaagcaaacgtgattacaccccctccactaactctctggttagtatggccagcaagttctccttaggtcagactgagctgatattgttattgatgtgctttatacttgccctgagccggtcgagcatagggtcgatcaaatgtctgcagaccacagaggaactcccaagcaggacagctggagctatgatgcagtttacggcccctattccgggcgccactggaccaatcaagttgtcccaaaagaccattgtgcagacaccaggccccatcgtccaatatccaggtccaaacgccggacccccctcagcaccacggggcccccctatggcaccaatcattattagccaaagaacagcctag

SEQ ID NO: 28156 - DNA, 579 bp, Artificial Sequence
  Description of Artificial Sequence: Synthetic coding sequence
atgaccgtactcgagataacactggcggtcatactcactttgctgggtctggcaattctcgctattcttcttacaagatgggctcgcagaaaacagtccgaaatgcatatctcgcgatactccagtgagcagagtgctcgattgctagactacgaagatgggagaggaagcaggcatgcgtacagcactcaaagcgatacctcttgcgacaaccgggagcgttctaaaagggattacaccccaagcaccaatagtctggcgctcagtaggtcaagcattgcattgccccaggggtccatgtcgtcaatcaagtgtctccaaaccacagaggagctgcctagtagaacagccggcgcgatgatgcagtttacagccccgataccaggagctactggccccattaaattatcccagaaaaccattgtccagacacccggccccatcgtacagtatcctggccctaacgtgcggagccatccacacacgattacaggtcccccttcagcaccaagaggcccacctatggcccccattataatttcacaacgtacagccagccaactggccgccccaatatag

SEQ ID NO: 28157 - DNA, 579 bp, Artificial Sequence
  Description of Artificial Sequence: Synthetic coding sequence
atgaccgtgctcgagataactctggccgtcatcttgacgctcctcggactggcgattcttgccatactgctcacgcgctgggcccgtcggaaacagagcgaaatgcacatcagccgatactccagtgaacagagtgccagattgctggattatgaggacgggaggggcagtcggcatgcatactcgactcagtccgacactagttgtgataatcgggaaaggtccaaaagagattacacaccttccacaaactctttggccttatctaggagttcgattgctctgccacagggctccatgtcaagcattaagtgtctgcaaacaacagaggagctgcccagtaggacagccggggcgatgatgcaattcacagcccccattccgggcgcgactggtcccattaagctgtcgcagaaaactattgtgcagacccctggccccattgtgcagtaccctgggcctaacgtgaggagtcatccccacacaataaccggccccccatcagcaccccggggccctcccatggcacccatcattatcagccaacggactgcttcccaattagctgctcctatatag

SEQ ID NO: 28158 - DNA, 1689 bp, Artificial Sequence
  Description of Artificial Sequence: Synthetic coding sequence
atgaccgtgctagagattacattagctgtgatcctgactctcttaggcctggccattcttgcaatactgctcaccaggtgggcaaggcgcaagcagtccgaaatgtatatttcgcgttatagttctgagcaaagcgcgcggttactcgattacgaagatgggcgcggctcacgccacgcttattctacccagtccgatacaagctatgacaacagggagcgttctaaacgagattacactccatccactaattccctggccctgagcaggtcctccatagccctacctcaaggcagtatgagcagcattaagtgtctccaaactactgaagagcccccctctcgaacggccggagccatgatgcaatttacagccccgattccaggagccaccgggccgatcaaactctcgcagaaaaccatcgtgcaaaccttaggacccatcgtgcagtatcctgggtctaatgtccggagtcatcctcacaccatcaccggtcccccatcagccccacgcggaccacccatggcccctatcattatcagtcagcgtactgcgtctcagctggctgccccaattcgtattccgcaggtccacaccatggattcaagcgggaaaattacactaacacctgtcgtcatcctgactgggtacatggatgaggaactggccaagaagtcttgtagtaagatccagatcttaaagtgtggaggaactgcacgcagtcaaaactcaagggaagaaaacaaggaggcgcttaagaatgatatcatcttcacaaattccgtggagagcttaaagagtgcccacataaaagagccagagcgtgaagggaagggcacagatctcgagaaagataagataggcatggaggtgaaagtcgattctgatgcagggattccaaagcgacaggaaacacagttaaagatcagtgagatgtccgtgccgcaggggcagggggcccagatcaagaagagtgtgagcgacgtgcctaggggacaggagtctcaggtaaaaaagagcgagagtggcgtaccaaaaggtcaggaggcccaggttaccaagtctgggctcgtcgttttgaaaggacaggaggctcaggtggaaaagtcagagatgggggttccacgaagacaggaaagtcaggtgaaaaagagccagtcaggcgtttcaaagggccaagaggctcaggtcaagaagagagagagcgtcgtacttaagggacaagaggcacaggtggaaaaatctgagctgaaggtgccaaaagggcaggaggggcaggtggaaaaaaccgaggccgacgtgccgaaagagcaagaagtccaagaaaagaagtccgaagctggggtgctgaagggtccagagtcacaggtcaagaataccgaagtgtcagtacctgagacactggaatctcaggtgaagaaatcggagtcaggcgtcctgaaggggcaagaagcacaggagaaaaaagaaagttttgaagataaggggaacaacgacaaggagaaagaacgggatgcggaaaaggatcccaataagaaagagaagggggataaaaacacaaagggggacaagggcaaagataaggtgaaaggaaagagagaatccgagatcaacggtgagaagtcaaagggatcaaaacgtgccaaagctaacacagggagaaagtacaataaaaaggttgaggagtag

SEQ ID NO: 28159 - DNA, 582 bp, Artificial Sequence
  Description of Artificial Sequence: Synthetic coding sequence
atgaccgtgttggagataaccctcgcggtgatactaaccctcctgggtctggccatcctggcaatcctactgactcggtgggcccgacgcaagcaaagtgaaatgcacatttcaagatactcttcggagcagtccgcacggttactggattatgaagacggcagaggcagtcggcatgcttactccacccagagtgatactagctgtgataatagggagcgaagtaagagagactatacccccagtactaactccctagtcagcatggcatctaagttttctcttggacagaccgaacttattttgctgttgatgtgcttcatccttgccctgagccgttcttctataggtagcattaaatgtttgcaaaccactgaggagctccctagtcgtactgccggggcgatgatgcagttcactgcgccaattccaggtgcgactggcccaatcaagctctctcagaagactatagttcagacacctggccccatagtgcagtatcctggccccaatgcaggacccccctcagcaccccggggccctccaatggcccctatcataatctcccagcggacggcatag

SEQ ID NO: 28160 - DNA, 1689 bp, Artificial Sequence
  Description of Artificial Sequence: Synthetic coding sequence
atgactgttctcgagatcactctagccgtgatcctgactctcctgggactcgccatcctggccatcctgctcacaaggtgggctcgcaggaagcagtctgagatgtacatttcccggtattcatcggagcaaagtgcacgcctgttggactacgaggatggccgagggtctaggcacgcctattccacccaatccgacactagttatgacaacagagagcgcagcaaacgggactatactccgtccaccaactctctagcgttgtccaggagctctattgctttgcctcagggttctatgtcctcaattaagtgtctgcagacgacagaagagccaccatctagaacagccggcgccatgatgcaattcaccgcacccattcccggcgccactggcccattcaagctgagtcagaaaacaattgtgcagacactggggcctattgttcagtaccccggtagcaatgtgaggtcacacccccacactatcaccggcccaccatctgcacctcgaggcccccccatggcccctattatcatatcccagcgtaccgcttcccagttggctgcacccatcaggatcccccaggtccacaccatggacagtagtggcaaaattacgttaacacccgtggtaatccttacagggtacatggacgaggagctggcaaagaaatcatgcagcaagattcagatcctgaaatgtggtggaactgcgcggtcccagaacagcagggaagagaataaggaagccctcaagaacgacatcatatttactaactccgtggaaagcttaaagtccgcgcacatcaaggaacctgagagagagggaaaaggaactgacctagagaaggacaaaatcggcatggaggttaaagtggatagtgacgccggcatcccaaagaggcaggagacacaactgaagatctccgaaatgtccgtgccacaaggtcagggagctcaaattaagaagagtgttagcgacgttccacgtggacaagagtctcaagtgaaaaaaagcgaatctggggtgcctaaaggccaggaggcccaggtgaccaaaagcgggctcgtagtgctcaaggggcaggaagcccaggtggagaagagcgagatgggggtgcctcgaaggcaggaatcccaggtgaagaagagtcaaagcggcgtgtccaagggacaggaggcccaggtgaaacagcgagaatccgtcgtgttgaaaggccaggaagcccaggtggagaaaagcgaactcaaagtgcctaagggacaggagggccaagtggaaaagactgaggcggatgtccctaaagagcaggaggtccaggagaaaaagagcgaagccggagttttgaaagggcctgagagtcaggtgaaaaacacagaggtgagcgtacctgaaaccctagagtctcaggtaaaaaagagcgagagcggggtgctgaagggccaggaagctcaggagaaaaaagaatcctttgaagacaagggtaacaacgataaggagaaagagcgggatgctgagaaagatcctaataaaaaagaaaagggcgataagaacacgaaaggggataaaggtaaggataaggtaaaaggtaaaagagagtccgaaatcaacggggagaaatcaaaaggctccaagagggcgaaggcgaatactggcaggaagtacaacaagaaagttgaagagtag

SEQ ID NO: 28161 - DNA, 1692 bp, Artificial Sequence
  Description of Artificial Sequence: Synthetic coding sequence
atgactgtgctcgaaattactctggccgtcattttaaccctcttgggtctggcaatactagccatcctactcactcgttgggctaggcggaaacaatccgaaatgtacattagtagatattctagcgagcaaagcgcccgattgcttgactacgaagacgggagggggtctaggcacgcttactcaactcaaagtgacacctcgtacgacaacagagagcgatccaagcgagattacaccccctcgacaaatagtctggtgtcaatggccagtaaattttcccttgggcagacagaattgattttacttctgatgtgcttcatactggctctctcccgcagctcaatcggtagtatcaaatgtctgcagacaacagaagaacctccaagcagaacagctggcgctatgatgcagttcactgcccctattcccggagcaacggggccaatcaaactgagccagaagactatcgtgcagacactcggaccaattgtccagtaccccggttctaacgcgggaccacctagtgcgcctcgtgggcccccaatggcccctataattattagtcagcggactgcacgcatcccccaggtccacaccatggatagcagcggcaagataaccctgacccccgttgtcatcctcacagggtatatggatgaggagctggcaaagaaatcttgttcaaagatccagatcctcaaatgcggggggactgcaagatcgcagaacagcagagaagaaaataaggaggccctgaagaatgacatcattttcaccaatagcgtagagagcctaaaatcggcccacataaaagagcccgagcgggagggcaagggcacagatctggagaaagataagatcggcatggaggttaaggttgattctgatgccggcattcccaaacggcaggaaactcaacttaagatttccgagatgagcgtgccacaaggccagggggcccagatcaaaaagtctgtctccgatgtgccgaggggccaggaatcccaggttaagaagagtgaaagcggagtgcccaagggccaggaggcccaggtgactaaaagcggcctggtggtgcttaaagggcaggaagcacaggtcgagaagtcagagatgggcgttcccaggcgtcaggagagccaggtgaaaaagtctcagagcggtgtaagtaagggccaggaagcgcaggtgaaaaagagggagtcagtggtgctgaaaggccaggaagcccaggttgaaaagtccgaactgaaagtgcctaaaggccaggaaggacaagtcgaaaaaaccgaagcagatgtgccaaaggaacaggaggtgcaggagaagaagagtgaggcaggcgtactgaaaggtcccgagagccaggtgaaaaacacagaagtgtcagttcctgagaccctggaaagccaggtgaagaagtctgagtccggagtgctgaagggccaggaagcacaggaaaagaaggaaagctttgaggacaagggcaacaacgacaaagagaaggaacgagatgcggaaaaggacccaaacaagaaggagaagggcgataaaaatactaaaggagataagggcaaagacaaagtgaagggaaagcgagagtcagaaataaatggcgaaaaaagcaagggctctaagagggcgaaggccaacacaggcagaaaatacaataagaaagttgaagagtag

SEQ ID NO: 28162 - DNA, 1692 bp, Artificial Sequence
  Description of Artificial Sequence: Synthetic coding sequence
atgacagtgctggagatcacacttgcggtcattctgacgctgcttgggctggctatcctcgctatactgctgacaaggtgggcccggagaaagcagtctgaaatgtacatcagcaggtattctagtgagcaaagtgcgcgcctactggactatgaggatgggaggggatcaaggcatgcttattcgactcagtcggacacgagttacgacaacagggaaaggagcaaacgcgactatactcctagtaccaacagtctggtctcgatggcatccaaattcagcctgggacaaaccgagttaattctgctcctgatgtgttttattctggccctttccagatcttccattggctcaatcaagtgtcttcagacgactgaggagcccccctctaggaccgctggtgcgatgatgcagttcaccgcacccatcccaggcgccacggggccttttaagcttagccaaaagactatcgtccagacgctgggcccaattgtgcaatatcccggcagcaacgcaggccctcccagcgcgcctcgcggcccacccatggcaccaattatcatcagccaacgcacagcaagaatcccacaagtgcacactatggacagcagcggaaaaattacactgacgcccgtagtgattctcactggctatatggacgaggagcttgcaaaaaagtcctgctctaagatacagattctcaagtgcgggggcaccgcacggtcacagaattcacgagaggagaataaagaagccctcaagaacgacatcatctttactaactccgtcgagagtttgaaaagcgctcatattaaggagcctgagagagaagggaaggggaccgacttggaaaaagataagattgggatggaagttaaggttgatagtgatgccggaatccccaagcgacaagagacacagctcaaaatttccgaaatgagcgtgccacagggacagggagcccaaatcaaaaaaagtgtgtctgatgtaccaagaggacaggaatctcaggtgaagaagagcgaaagtggcgtccccaaggggcaggaggcgcaggttactaagtctggactggtggtcctcaaaggccaggaagcccaggtagagaagtccgagatgggggtccctcgcaggcaagagagccaggtgaaaaaaagccagtccggtgtatccaaaggccaagaggcacaggtgaaacagcgggagtcagtagtactcaaaggccaggaagcccaggtggagaagagtgaattaaaggtcccaaagggccaagagggccaggtggagaagaccgaagcagacgttcccaaagagcaggaagtacaggaaaagaagtccgaagccggcgtcctaaagggccctgagtcacaggtgaagaatactgaagtttcggttcccgagacgctggaatcccaggtaaagaaatccgagtcaggtgtgttgaaaggacaggaagctcaggagaagaaggagtcctttgaagacaaaggaaacaatgataaagaaaaagaacgggatgccgagaaggatcccaacaaaaaggagaagggagataaaaacactaagggagacaaagggaaagataaggtcaaagggaaacgtgaatcagagatcaacggcgaaaagagtaagggctcaaaacgcgctaaagcgaacaccggcagaaagtacaacaagaaagtggaggagtag

SEQ ID NO: 28163 - DNA, 1689 bp, Artificial Sequence
  Description of Artificial Sequence: Synthetic coding sequence
atgacggtgctggagatcactctcgcagtgattttgactttattgggactggccatcttagccatcctcttgacaaggtgggcacgtcgaaagcagtctgaaatgcacatctccagatattcttcggagcagagcgcgcggcttctggattatgaggacggcaggggatccagacatgcatactctacacagagtgatacgagctgcgataacagagagcgctccaaacgcgactatactccgtctaccaacagcctggccctatctcggagtagtattgcactgccccagggatccatgtcctccatcaaatgcttgcagacgacagaggagttaccctctcgcaccgctggcgctatgatgcagtttacagcacccattcccggcgccaccggaccgatcaaattaagccagaagactattgtgcaaacaccaggtcctattgtccagtaccctggcccgaatgtgaggtcacatcctcacactatcaccggaccccctagtgctccacggggacctcccatggcccccatcattattagtcagcgtactgccagccaactggcggcccccatccgtatcccccaggttcacactatggatagcagcggcaagatcaccctcacaccggtggtgatcctgactggttatatggacgaagagttggccaagaaaccgtgttctaaaatccagattctgaaatgcggcggcacagcccggagtcagaacagtagggaggaaaacaaggaggccctgaaaaatgatatcatctttaccaatagcgtggaatctctgaaatccgctcacattaaagagccggagcgtgaaggaaagggaaccgacctggagaaagataaaataggaatggaagtcaaggtggattccgatgccggtatccccaaacgccaggaaacccaactgaagatctcagagatgtccatccctcagggacagggcgcccagatcaaaaagtccgtatctgacgtgcctcgaggccaggaatcacaggtcaaaaaaagtgagagcggcgtgcctaaaggccaagaggcacaggttacaaagtctgggctggtggtcctcaaaggtcaggaggcccaggtcgagaaatctgagatgggagttccaaggaggcaggaaagtcaagtaaagaaaagccaaagtggcgtgagtaaaggccaggaggcgcaagtgaaaaagcgggaatctgtcgtgcttaagggccaggaagcacaggtggaaaaatccgagctgaaagtaccaaagggacaggaaggacaggtggaaaagaccgaagctgacgtgccaaaggagcaggaggtgcaagaaaaaaagagtgaggccggcgttctgaagggacccgagagccaggtaaaaaacacagaggtatcagtccccgaaaccctagagagccaggtgaaaaaatctgagtctggggtgctgaagggccaagaggcccaagagaagaaggagtccttcgaggataagggcaataatgacaaggagaaggagagggatgccgagaaggacccaaacaaaaaggagaaaggagataaaaacaccaagggtgacaaagggaaggataaagtcaagggtaagcgcgagagcgaaattaacggagaaaaaagcaaaggtagtaagcgcgcaaaggctaatacaggccggaaatacaataaaaaagtggaggagtag

SEQ ID NO: 28164 - DNA, 1692 bp, Artificial Sequence
  Description of Artificial Sequence: Synthetic coding sequence
atgaccgtgttggagatcacccttgctgtgatcctgaccctgcttggcttagcaatcctagcaattctccttaccaggtgggcccgcaggaagcaatcagagatgcacatttcgcgctacagctcggaacagtctgccagactgcttgattatgaagacggcaggggctcgaggcatgcctattcaactcaaagtgataccagctgcgacaatagggaaaggtccaaaagggactacaccccttcaacaaactcgctggtgtcaatggcaagtaagtttagcctgggtcagactgagctcattctgcttctcatgtgcttcattctggctttgagccgatcctccatcggaagcataaaatgcctgcagacaacagaagagctgccaagtcgcaccgccggggctatgatgcagtttaccgctcctatcccaggggcgacaggaccaatcaagctttcccagaaaaccattgtccagactcctggcccaattgtccagtatcctgggccaaatgctgggccacccagcgctcccagaggccctcctatggcccctataatcatttctcagcgtacggcgagaataccccaggttcacacaatggatagttcaggtaaaattacactgactccagtggtgatcctgacaggctatatggatgaagaactggccaagaaaccatgtagtaaaatacagattctaaaatgtggaggaacagccaggagccaaaactcccgtgaggagaataaggaagcactgaagaatgacattatatttaccaacagcgtggagagtttaaagagcgcgcacatcaaagaacccgaacgcgaggggaaaggaacagacctggagaaggataaaatcggcatggaagtgaaagtcgattctgacgccggtatccctaaacggcaagagactcagctgaagataagcgagatgagtattcctcaggggcagggggcacagatcaagaaatcagttagtgatgtcccaagaggtcaggaaagtcaggtgaaaaaaagtgaaagcggcgtacccaagggccaggaggcccaggtcacaaaatccggtctggttgtactgaaggggcaggaggcccaggttgaaaaaagcgaaatgggtgtcccccgacgccaggaatcgcaagtcaagaaatcccagagcggagtgtcgaaggggcaagaggcccaagttaaaaagcgagagtctgtggtgctgaagggccaggaagcgcaggtagagaaatctgagcttaaggtgccaaagggacaagaaggacaggtggaaaagactgaggccgacgtgccaaaagaacaggaggtgcaggagaagaaatccgaggcaggcgttctcaaaggtccggagagccaggtgaaaaatactgaggtgtctgtaccagagactctcgaatcccaagtgaagaagtccgaaagcggcgtcctcaagggccaggaggcccaggaaaagaaggagagcttcgaagacaaaggaaataacgataaagaaaaggagcgggacgccgaaaaggaccctaataaaaaagagaaaggggataaaaacacgaagggagacaagggaaaggataaggttaaagggaagcgggaaagcgagataaatggggaaaaatctaagggctctaagcgagcaaaagccaacacaggccggaaatacaataagaaggtggaggaatag

SEQ ID NO: 28165 - DNA, 1644 bp, Artificial Sequence
  Description of Artificial Sequence: Synthetic coding sequence
atgactgttctcgaaatcaccttggctgtcattcttaccctgcttgggctcgctatcctcgctatcctgctgaccaggtgggcccgcaggaaacagtcagagatgcatattagccgatatagctcagagcagagcgccagactgctggactatgaagacgggcgcggtagcaggcacgcttattcgactcagtccgagcggtctaaacgcgactacactccaagtaccaattcactggctctgtctagatcctcaattgctctcccccaaggttccatgtcttctatcaagtgtctacaaacaaccgaagaactgccaagcaggacggctggcgccatgatgcagtttacagcgcccatcccgggggccaccggaccaattaagctatcccagaaaaccatagtgcaaacgccaggccccatcgtacaatatcccggtccaaacgccggccctcccagcgctccccgggggcctcccatggcacccatcattatcagtcaacgcactgcctcacaattggcggctcccattcggatcccccaagttcacacaatggactcttccggaaagatcactttgactcccgtggttatcttaacaggctacatggacgaagagcttgccaaaaagccgtgcagtaagattcaaattctcaagtgcggagggacggcaaggtcccagaattctagagaggaaaacaaggaggcactcaagaacgacatcattttcacaaactccgtggagtcactaaagtccgcacacattaaagaacccgaacgggagggtaaaggaacggatttggagaaagacaaaatcggtatggaagtcaaagtggatagtgacgctgggatacccaagaggcaggaaacacagttgaagatatcagaaatgtctatcccccagggccaaggggcccaaattaaaaaaagcgtgtccgacgtgcctaggggccaagagagccaggtgaagaagagtgaaagcggcgtgcccaaaggccaggaagcacaagttactaaaagcgggttggtggtgctaaaaggccaggaggcacaggtcgagaagagtgaaatgggtgttccccggaggcaggaatcccaggtcaagaagagccagagcggggtgagcaaaggccaggaggcccaagtgaagaagagagagtccgtggtgctgaagggacaggaggcccaggtggaaaagtcagaattgaaggtccccaaaggacaagagggccaagttgaaaaaactgaagccgacgttcctaaggagcaagaagtacaagagaaaaaatctgaggcaggtgttctgaaaggaccggaatcacaggtcaagaataccgaggtttccgtgcccgaaacccttgagagccaagtcaaaaaaagtgagtcaggtgtcttgaaggggcaggaagcccaagagaagaaggaatcgtttgaagataaagggaacaacgacaaagagaaggagcgggacgccgagaaagatcctaacaaaaaagaaaagggcgacaagaatacaaagggggataaaggaaaagacaaggtaaaggggaaacgggagtctgagatcaatggcgagaaatctaagggatctaagcgtgctaaggccaataccggtaggaagtataataaaaaagttgaggagtag

SEQ ID NO: 28166 - DNA, 189 bp, Artificial Sequence
  Description of Artificial Sequence: Synthetic coding sequence
atgctccaggtggtgcaagagggcaatcctgcaccttttataattaatacagttaagagggggcggcgggatcgcgagcgccaacgcaccccatgggccccacatccactgggcttccagggccgccggtatatctatgagtcgccgaaccacagggggaaggattccagctttttagctcagaagtag

SEQ ID NO: 28167 - DNA, 189 bp, Artificial Sequence
  Description of Artificial Sequence: Synthetic coding sequence
atgttgcaggtcgtgcaggaagggaacccagcaccgttcattattaatacagtgaagagagggcgcagggaccgggagagacagaggacgccctgggccccccaccctctgggcttccaaggtcgaaggtacatttatgaatctccaaaccatagaggcaaggattccagttttttggcgcagaagtag

SEQ ID NO: 28168 - DNA, 189 bp, Artificial Sequence
  Description of Artificial Sequence: Synthetic coding sequence
atgctgcaggttgttcaagaaggaaaccctgcccccttcatcattaatactgttaaacggggcagacgagatagggaaaggcagcggaccccatgggctccccacccattgggattccagggtcggagatatatctacgagtcccctaaccatcgcggtaaggatagctcctttctggcccagaagtag

SEQ ID NO: 28169 - DNA, 189 bp, Artificial Sequence
  Description of Artificial Sequence: Synthetic coding sequence
atgttgcaggtcgtgcaggaggggaaccccgctcctttcatcattaacaccgtgaagcgaggtaggcgagatcgagagcggcaaaggaccccctgggcacctcatccactcggattccaggaaaggagatatatttatgagtccccgaatcaccgaggcaaagattcttctttcctagcacagaagtag

SEQ ID NO: 28170 - DNA, 189 bp, Artificial Sequence
  Description of Artificial Sequence: Synthetic coding sequence
atgttacaggtggtgcaggaaggcaaccctgcccccttcattattaacaccgtcaagagggggcggagagatagggagcgtcagcgcaccccgtgggctcctcacccactgggatttcaagaacgacgctatatctatgaatctccgaatcacaggggaaaggacagtagcttcctagcccagaaatag

SEQ ID NO: 28171 - DNA, 189 bp, Artificial Sequence
  Description of Artificial Sequence: Synthetic coding sequence
atgttgcaggttgtgcaggagggcaatcccgcaccctttattattaataccgtaaagcggggccgtagagaccgggagaggcagcggacgccatgggcaccccacccattaggattccaggaaagacgatacatatatgagagccctaaccaccgcggtaaggactcctccttcttggcccagaaatag

SEQ ID NO: 28172 - DNA, 708 bp, Artificial Sequence
  Description of Artificial Sequence: Synthetic coding sequence
atgcacgagcacgccactcctgtgacatccgcctacggcgaaagacatgaagagctcatcaatcttggttcacccgacagtcacacaatctcagagggccagaagtctagcgtgacctctaagaccacaagaaaaggcaaggagaagtcttcagagaaggagaaaacagcgaaagaaaaacaagcccctaggtttgaaccgcagatctccacagtccatcctcagcaggaggaccccaataaaccgtactggatacttcgactggttactgaacataacgaaagcgagcttttcgaagttaagaaggataccgagcgagctgacgagattagggctatgaagcaagcctgggaaaccacggagcccggccgcgccatcaaagcctcccaggccaggctgcactacctgtctggcttcatcaaaaagacaagcgacgcagaaagtccccctatctcagagtcgcagaccaaacctaaagaggaagttgagacagctgcacgcggcgttaaggagccaaacagtaaaaactccgcaggcagcgaatccaaagagatgacccagactggctcggggtctgccgtgtggaagaagtggcagctgacaaaaggattaagagacgtcgccaagtccacctcaagtgaatctggaggcgtcagttctccaggtaaagaagagagagagcagtcgacccggaaggagaatatctag

SEQ ID NO: 28173 - DNA, 2142 bp, Artificial Sequence
  Description of Artificial Sequence: Synthetic coding sequence
actgacgagcagaccgattttggcttgggggatgcccatcagagcgatggactcaacctggagcgagagatcgtaagtcaaaccacggctacacaggaaaaaagccaggaggaactccctactaccaacaattccgtatctaaggagatctggctggattttgaggacttttgtgtatgctttcagaatatatacatttttcacaagccatcctcttactgtctgaactttcaaaaatccgaattcaagttttctgaagagcgggtttcctattatttgtttgtcgactccctgaagccgatcgaactgctggtgtgtttttcggccctggtgcggtggggagaatacggtgcgctgacgaaagactcaccacctatcgagcctggcctcctgaccgcagaaaccttctcatggaagtccttaaagccaggtagtctggtcctaaagattcacacgtacgctaccaaggcaacagttgtccgcctgcctgttggacgccacatgctcctgtttaacgcctattctcccgtaggccactctatccatatatgttccatggttagctttgtgattggggacgaacatgtcgtcttacccaattttgaaccagaaagctgcagatttactgagcaatcacttctgataatgaaagctatcggcaacgttatcgccaacttcaaagacaagggaaaactgagtgccgctttaaaggatctgcaaacagcccactaccctgtcccttttcatgataaggaactcacagcccagcatttcagggtgttccaccttagcctgtggaggctaatgaaaaaagtacagatcaccaaaccacctccaaattttaaatttgcgttcagagcaatggtcctcgatctggagttacttaacagcagcttagaggaggtatctcttgtcgaatggctggatgtgaaatactgcatgcccacctcagataaggaatactcagcggaggaggtggcagctgccatcaaaattcaggccatgtggcggggcacgtacgtacgcctgctgatgaaagctcgaatcccagataccaaagaaaatatctctgtcgccgatacgctgcagaaggtctgggctgtgctggaaatgaatctcgaacaatatgctgtctcactgctgagactcatgttcaagagcaagtgcaaaagtctggaaagttatccttgttatcaggacgaagagactaagatcgcgttcgctgattacactgtaacgtaccaggaacaacctcccaactcttggtttatcgtgttccgcgagacattcctggtccaccaggatatgatcctagtgcctaaagtgtacacgaccctgccgatatgcatccttcacattgtgaataacgacaccatggaacaggtgcccaaggtattccaaaaggtggttccatacctctacacaaaaaacaaaaagggatatacttttgtggccgaggcctttactggcgacacctacgtggccgccagcaggtggaagctcagactgatcggatcaagcgccccgctaccatgtttaagcagagactcaccatgtaatagtttcgcaatcaaagaaataagagattactacatcccgaatgataagaaaatcctcttcaggtactctgtgaaggttttgacaccacagcctgctacaattcaggtgagaacaagcaagccagatgccttcattaagttacaggttcttgagaacgaggagaccatggtgagtagtacggggaaaggccaggccattataccagcctttcacttcctgaaatcagagaaggggctttccagtcaaagctatggagagcgtcatgaggagctcattaacctgggatcgcccgattctcacaccatcagtgaggggcaaaagtcctcagttacctccaagaccacacggaagggcaaggagaagtctagcgagaaggaaaagactgcaaaagagaagcaggcgcccagatttgaaccccagatctctacagtccatcctcagcaggaggaccctaacaaaccctattggatcctaaggctccttcgcctggtttgtataaccttagccggtagcctcagaaaacatctgatgctgcgagtgcgattgtatctgaaagccaagctgaaccagaaaaaaaagtag

SEQ ID NO: 28174 - DNA, 5004 bp, Artificial Sequence
  Description of Artificial Sequence: Synthetic coding sequence
atggcaagcaagcaaaccaagaaaaaggaggtgcacaggatcaattcagcacatggctccgataagagtaaagatttctacccctttggcagtaatgtccagtcggggagcaccgaacagaagaaaggcaagtttcccctgtggccagagtggagtgaggctgacattaactccgaaaagtgggacgccggtaagggtgcaaaggagaaagataaaacaggtaaatctcctgtatttcacttttttgaggatcctgagggcaaaatcgaactgcccccgtcccttaaaatctactcttggaagcgaccacaggatattctcttttctcagacaccagtggtggtgaaaaacgagatcaccttcgacttattctctgctaatgaacacttactgtgttctgagctcatgcgctggattatctcagagatctacgccgtgtggaaaatctttaacggcggaatactgtccaactacttcaagggcacgtcaggagaacctcccctcttaccgtggaagccctgggaacacatctacagcctgtgcaaagcggtaaagggacacatgcctttgttcaattcctatggtaagtatgtcgttaaattgtattggatgggatgttggcggaaaatcactattgacgacttcttgcccttcgatgaggacaataacctgctgcttcccgcaacgacatacgagtttgagctctggccaatgctcttgtcgaaagccatcatcaagctggctaatatagatatccacgtggcagaccgccgtgaacttggggaattcaccgtgatccatgccttgactggttggcttcctgaagtgatcagtttgcatccggggtacatggacaaagtatgggaacttctcaaggagattctgcccgaatttaagcttagtgatgaggcctctagcgaaagcaaaatcgcggtgcttgactccaaattgaaggagcccggtaaggaggggaaagagggtaaggagattaaagacggcaaggaagtgaaagatgtcaaagagtttaaaccggaatcatccctgactactctgaaagctccagagaagtctgataaagtgcctaaggagaaagccgacgcccgagatatcggcaagaagaggtctaaggacggtgagaaggagaaattcaaatttagcctccatggttcccgcccctcctcagaggtgcagtactcagttcagtcattgtctgactgtagttccgccatccagaccagtcatatggtggtgtacgctacctttacacccctctacttgtttgagaacaagatttttagcttggagaagatggccgattcagcagagaagctcagggaatatgggctgtcacatatatgctcccaccccgtgctggtaacacgaagtcgaagctgtccactggtggcacctcccaagccaccaccactgcccccatggaaacttatacggcaaaaaaaagaaactgtgattactgatgaggcgcaggaattgatcgtgaaaaaaccggagcgctttttagagatttcttccccattccttaattaccggatgacacccttcacgattcccacggagatgcatttcgtgcggtctttaatcaagaagggaatccccccgggatccgacctgccatcagtgtcagaaaccgatgagacagctacacactcccaaaccgacctgtcacagattacaaaagctacgagccaggggaatacggcatctcaggtcattctgggcaagggtaccgacgagcagacagactttgggctgggggatgcccatcagtcagacgggctgaatcttgagcgagagattgttagtcagactacggccacccaagagaagtctcaggaggaattacctacaaccaacaacagtgtctccaaggaaatatggctagatttcgaggacttttgtgtgtgttttcagaacatatacatctttcataaacccagcagctactgtttgaactttcagaagagtgagtttaagttcagtgaagagcgcgtctcatattatctcttcgtggacagtctgaaaccaatcgagctgctggtatgtttctcagctttagtgcggtggggagaatacggggctttaacaaaggactctccacctattgaaccgggactgctgaccgctgagacattcagttggaagagtctgaagcccggaagcttggtcctcaaaatccacacctatgctacaaaggcaacagttgttagactccccgtggggcgccatatgttgctgtttaacgcttattccccagtcggccacagtatccacatctgttcgatggtttccttcgttatcggggatgaacacgtagtgctgcctaattttgagcccgagtcttgccgctttactgagcagtcactcctgatcatgaaggccattggcaatgtaattgcaaatttcaaggataagggaaaactgagtgccgctctcaaggacctgcagacagcccattatcctgtgcccttccatgacaaagagctcactgcccagcatttccgtgtgttccacttatcactgtggaggctgatgaagaaggtccaaataacaaaaccaccgcccaatttcaaatttgcctttcgcgctatggtgctggacctcgagttgcttaatagtagcctcgaggaggtctccctggtggaatggcttgatgtgaaatactgcatgcctacatcagataaggaatacagcgcagaagaagtcgccgcggccattaagattcaggccatgtggagaggaacgtacgttaggctgttgatgaaggcccggatacccgatactaaggagaatatcagcgtagccgacacactgcagaaggtctgggctgtgctcgagatgaacctggaacaatacgctgtctctctgttgcggttgatgttcaagagtaaatgcaaatctctggagtcatatccttgttaccaggacgaagagactaagatcgcatttgctgactacacagttacctatcaagaacagccccctaacagttggttcatcgtgttcagggagactttccttgtgcatcaggacatgattctggttcccaaggtgtatacgacgctgcctatatgtattctgcacattgtaaacaatgatacgatggagcaagtcccgaaggtcttccagaaagtcgtgccttacctatataccaagaataaaaaggggtacacctttgtggctgaggctttcactggtgacacgtacgtcgcagcgtcccggtggaagttaagactaatcggttctagtgcccctctcccctgtctgtctcgcgattccccctgcaactcattcgcgataaaggaaataagagattattatattcccaacgacaaaaagattttgtttaggtactctgttaaggtgctcacacctcaacccgccaccattcaagtgcgtacgagtaaacctgacgcctttatcaaactgcaggtattagaaaatgaagaaaccatggtgtcgtccaccggcaagggtcaggccatcatccctgcatttcacttcctgaaatcagagaaaggactctcatcacagagctctaaacacatcctatcattccatagtgcaagcaaaaaagagcaggaagtttatgtaaaaaaaaaggcggcacagggcatacagaagagcccaaagggaagagccgtgagtgccattcaggatattggcttacccctggtggaagaggaaactacttcaacacctacgagagaagacagctctagcactcctctgcaaaactacaaatacattattcagtgtagcgtgctttacaactcctggcctctgaccgaatcacagctgactttcgtgcaagccctgaaggacctaaagaagagcaacactaaagcttacggagaaaggcatgaggagctaatcaatctgggcagtcccgacagccatacaatcagtgaggggcagaagagctcagtcacctctaagactacacggaaaggcaaggagaaaagttctgaaaaagaaaaaacagcaaaggagaagcaagccccccgctttgagccacaaatttctactgtccatccccaacaagaggatcctaataaaccttactggattttgcggctggtcaccgagcacaacgagtcggagctctttgaagtgaaaaaggacaccgaacgcgctgacgagattcgcgcgatgaagcaggcgtgggaaacaactgaaccaggaagggccatcaaagcttctcaagcgcgcctccactacttatcagggtttatcaaaaagactagcgacgcagaatcccccccaatctctgagtcacagactaaaccaaaggaagaagtggagacggctgctcgcggcgtgaaagagcccaacagcaagaacagtgctggctcagaaagcaaagagatgacccagacaggaagcggctctgccgtatggaaaaaatggcaactgactaaggggctcagagatgttgccaagagcaccagctcagagagcggtggggtgagctcccctgggaaggaggaacgtgagcaatccacaaggaaggagaatatacagacaggacctcggacccgttcccccactatcctagaaacgtctccccgacttatcagaaaagctctcgagtttatggatctttcccaatatgtgcgcaagactgacacagatccgctgttacagactgatgaactaaaccaacagcaagctatgcagaaggctgaagaaattcaccagttcaggcagcacaggactcgggtgctgtctatccgcaacatcgatcaggaagaaagattgaaactgaaggacgaggtactggacatgtacaaggagatgcaggattctctggacgaggccagacaaaaaatattcgacattagggaggagtaccgaaacaaactgctggaggcagaacacctaaagctagaaactctggctgctcaggaggcagccatgaaactcgaaaccgagaagatgaccccagctcctgacacccagaagaaaaaaaagggcaaaaaaaaatag

SEQ ID NO: 28175 - DNA, 153 bp, Artificial Sequence
  Description of Artificial Sequence: Synthetic coding sequence
atgctccgaagtacgttcaccgtccactggaccaccatccttggtatatgtaggccgatcaagccgatctataagtcacaggcctgtccactttcagagaaacgcaatgcggataaccacctggtgagcgaggacaatacatttaaagtctag

SEQ ID NO: 28176 - DNA, 297 bp, Artificial Sequence
  Description of Artificial Sequence: Synthetic coding sequence
atgctgcgatcgacctttacagtgcactggactactattctgggtatctgccggcctatcaaacccatctataaatcccaagcgtgtccactgagcgagaagcgtaatgctgacaatcatctggtgagcgaagacaacacattcaaagagccggagagatacatatccagtagctgcgtactgacaagcatcctctatttgggcgagaagacgttcagcttcaggacactgatttctcctagaggaatgaagctggttgaaatactccagcagccttccctgaccatggttgcctag

SEQ ID NO: 28177 - DNA, 246 bp, Artificial Sequence
  Description of Artificial Sequence: Synthetic coding sequence
atgaatgtcgatcacgaggtcaatcttctagtggaagagatccaccgcctgggatccaaaaacgccgacggaaagctctctgtgaagttcggggtgctgttccgcgacgacaaatgcgccaatttattcgaggcgttggtggggacactcaaggccgctaaaagaaggaaaattgttacctaccctggcgagttgctgctgcagggagtgcacgatgatgtggacattatcctattacaggactag

SEQ ID NO: 28178 - DNA, 204 bp, Artificial Sequence
  Description of Artificial Sequence: Synthetic coding sequence
atgaatgtggaccatgaagtcaaccttcttgttgaggaaatccataggctcggcagcaagagcaagtacctgactgaaatcgaatacttctcctggctctacctgggaactggggagacggggatgttggaaaagcctatgaagggctcaccccgagcttccggccaccgaagcggcagctctgcccactctccacggctgtag

SEQ ID NO: 28179 - DNA, 1374 bp, Artificial Sequence
  Description of Artificial Sequence: Synthetic coding sequence
atggaccgcagcctgaggaacgtgctcgtggtctcattcggcttcttgctgttgtttaccgcgtacggcgggctccaaagcctgcagtcaagtctctacagtgaagagggcctcggcgtgaccgccctgtctacactatatgggggcatgcttctgtcatctatgtttttaccccccctattgatcgagaggcttggctgtaaagggaccattattctctctatgtgtggttatgtggccttctctgtcggtaacttttttgcttcatggtacacattgattccaacatccatcctgctgggccttggggcagcccctctttggtccgctcagtgcacgtacttgacaattacggggaatacccacgccgagaaggccggcaagcgcgggaaggacatggttaatcaatacttcggcattttcttcctgatatttcagtctagcggtgtatggggaaacttgatcagttctttggtgttcggacagactcccagccaggagactcttcccgaggagcagctgacttcctgcggtgctagcgactgcctgatggccacaactactactaactccacccagaggccttctcaacagcttgtgtacactctgctgggcatttatacagggtccggggtactggccgtgcttatgattgccgcatttcttcaaccaatacgggacgtccaacgcgagagcgagggcgaaaaaaagtccgtacccttttggtcaacactgctgagtacctttaaactgtacagggacaagagactctgcctcctcatccttttgcccctgtactcaggcctccagcagggtttcctcagcagtgaatacacaagaagttacgtgacctgcaccctgggcattcagttcgttgggtacgtaatgatttgcttttccgctacggacgctttgtgctccgtcctgtatggcaaggtgagccagtacacaggacgagctgtcctgtacgttctcggcgccgtgactcatgtatcgtgcatgatagccctgctcctatggcgccctcgcgctgatcacctcgctgtgtttttcgtgttttccggactttggggggtggccgacgcagtgtggcagacacagaacaacgccctgtatggcgtcctatttgagaagtcgaaggaggctgcctttgccaactatcgattgtgggaggcactaggatttgtcatcgcttttgggtactccatgttcttatgcgtgcatgttaagttatacattttactcggcgtactgagcctgacaatggtggcttacggcctggtagaatgtgtggagtcgaagaatcctatccggccacacgcacccgggcaagtgaatcaagccgaagacgaggaaatacagacgaagatgtag

SEQ ID NO: 28180 - DNA, 912 bp, Artificial Sequence
  Description of Artificial Sequence: Synthetic coding sequence
atgaaggaagcccttgcccacttcaccatccataccgccctcgtcccctccgaggcccaagataccccgctttttaggtatctaaatccccaggcctctctgtcccacactagcgaggaggatttcctccctgtagaagccgtgcgggaaggcaaggaagagaagaaaggcgggcctccaggcagaggtccgcctggatggagacgaagagaagaactgagactgcctgacttgaaagtgctgtgttatcaggaagccggctccagagggacacgagaccgtcatcattatgtctcaagttacctcgctggcgctacatccgcagaccgctataggatgttcctgagattccagaaggaggtgctagccaagcaagaccttctcaaaaatgattttacaggaagtaaagccgcagccggacacgagcggaaactgcaacaggaattacaaaagatctgtacctgtagcccacagcagttcaacagactgcacgtctttgggaaggtgttcgaggatatatgcaacagctccctgatttttggggatcttctgaaaaaagtcaaggacgagtatgagctttacatggccaccttactcgagtcccaacccgccgcccaatacgaagctttattagcacagctgaaagctctggggcagaggccggtgaagaccgcagatatggatcttgcccgagaagagctgagaatgcttgtgacggccactaaggccgccctggaacaaaacgataggctgcgatcagagctggagatggaagtggccttgctgcagtcagccaaggagaggagcggccggtgcctgtgtgatgtcttaccctatgggtgctttgccgtcacgttcattatttcagctgctgcggtgtggctgcccgtctgtcagctgggtcggtgttag

SEQ ID NO: 28181 - DNA, 174 bp, Artificial Sequence
  Description of Artificial Sequence: Synthetic coding sequence
atgggcaccgccgtggggccccaccattcccctgccccccatgacagtgcccttcccgcccggctcctcacaagtgatttcccctacggccggagctgtcagattgagcaggtgaaatatagcgtacctgataccggcttgttccagcactgggaggggtccataccaacctag

SEQ ID NO: 28182 - DNA, 174 bp, Artificial Sequence
  Description of Artificial Sequence: Synthetic coding sequence
atgggcaccgcagtcggtcctcaccacagtcccgccccacacgactcagccctgcccgccagattgttgacctctgactttccttatggacgtagttgccagatcgaacaggtgaaatatagcgtcccggatactggcctgtttcagcactgggaggggagtatccctacctag

SEQ ID NO: 28183 - DNA, 462 bp, Artificial Sequence
  Description of Artificial Sequence: Synthetic coding sequence
atggccgctgcattggcacttgtagccggcgtgcttagcggggctgtactgcccctctggtctgctcttcctcagtacaagaaaaagatcaccgatcgctgtttccatcacagtgagtgttactcaggttgctgtctgatggatctagattcagggggagcgttctgtgcacctagggcaagaatcactatgatatgtctgccacaatggcttgagcttttcaagggcagagaccggataatctttatatacgaggcacccacgccttcccttgtgtcagcccataatcaaggctcatatcagcaccacctcccattgcctgacggcctcgatgtgcacatacagggactggatgtctttccaccagtcccttacgacctcgaagaagacgccggatggtccctccttccatggggccatcgaccatggcttcctccgacctgttcgaagagtagcagctag

SEQ ID NO: 28184 - DNA, 546 bp, Artificial Sequence
  Description of Artificial Sequence: Synthetic coding sequence
atgtatcaaccatctagaggagctgcccgcaggctcggtccttgtcttcgagcataccaggcccggcctcagctccccaaactgtttctacaatcccacgattactctttatatagtcttgatgttgagtttattaacgaaatcctaaatatcagaaccaaggggcggacctggtatattttgtccctgaccctgtgcaggtttctggcttggaattatttcgcacatctgcggctggaagttctccagctgaccaggcaccccgagaactggactctgcaggcgcggtggcgccttgtcggtctgcctgtgcacctcctatttctgcgattttacaagagggataaggacgaacactaccggacatacgacgcatactccactttttatctcaactcatctggcctaatttgtagacataggctggataagcttatgccttctcattccccgcccacaccagtgaagaaactcctggtgggcgccttggttgctctgggcctcagtgaacctgaacctgacttaaatctctgttctaaaccgtag

SEQ ID NO: 28185 - DNA, 948 bp, Artificial Sequence
  Description of Artificial Sequence: Synthetic coding sequence
atgtaccagccgtcccggggagccgccaggcgacttgggccctgtttgagggcatatcaagcgaggccccaggaccagctgtaccccggcaccctgccatttcccccactctggcctcactctacaactacaacctccccttcctcccctctgttttggtccccgttaccacctagactgcccacccaaaggttaccacaggtgccccccctgccactgccacagatccaggctctgtccagtgcatgggtagtacttcccccaggaaagggagaggagggacctggccctgagctacactctgggtgcctggatggtctgcggtctttgttcgagggtcccccatgcccttaccccggagcctggattcctttccaagttccagggaccgctcacccaagtcccgccacccccagtggcgatccttctatggaagagcacttgagcgttatgtacgagaggcttaggcaggagttgcctaaactgttccttcagagccatgattatagcttatattctctcgatgttgaatttatcaacgagattctgaatatccgaacaaaaggaaggacctggtacatcctaagcctcaccctctgcaggtttctggcatggaattacttcgctcatttgagactcgaggtgctacaactgacacggcatccggagaactggactctgcaggcccgctggcgcctggtcggtttgcccgtgcacctgctctttctcagattctacaagcgtgacaaggacgagcactatcgcacctatgacgcatatagcactttctacctcaattccagcggcctaatctgcagacaccgacttgataagctcatgccttcgcactcaccgcccactcccgtgaaaaaattgctagtcggtgccctcgtagccctgggcctgtcagaaccggaacccgacctgaacctgtgctccaaaccctag

SEQ ID NO: 28186 - DNA, 1302 bp, Artificial Sequence
  Description of Artificial Sequence: Synthetic coding sequence
ttgcccacttgcgccctgcaaagagtggaccgactgggcgttgccggcgctggcgggagacgctgtagggcctgtcgcgctcgtacctccgtcttgcctggtttgagagcagtaagaagaggtcaggggcaggcagccggacgcgtgtgtgtggcgccagacagccctagattacccgtccctcggggggatttaaagggaaggggccgggaaattcggtcacccgctgccgccccttcacgtagcagcccagcccagacgcgccctgccggccggccccaacaacctgctcgactagctctgggagagcggagttggcaggagggccgtcctgtgtgtaccaggttcgggcccctcagacccgggtggcaagacgggcacgcaccctcacgcgatggcgccagtaggactccctccgggaccgaggaccaactgtaccccggcactctaccgttcccgcccttatggcctcatagcactacaaccacttcccccagctctcctttattctggtcccctctgccgccacggctcccgacccagaggctgccccaggtgccaccccttccactcccccagatccaggcgctttcctctgcctgggtagtcctgccccccggaaagggcgaggaagggccggggcctgagttgcattctggttgcctcgatggccttcggtctctgtttgaaggacctccttgcccctatccgggcgcgtggatccctttccaggtccctgggactgcacacccttctccggctacaccctcaggagatccctcaatggaggaacaccttagcgtaatgtacgagagactgagacaggagttgccaaaactcttcctgcagtcccacgattacagcctatatagcctcgatgtcgagttcatcaacgaaatccttaatatcaggactaagggcagaacatggtacattttatcacttactttatgtaggttcctagcttggaattacttcgctcacctgaggctggaagtgctccagctcacgcgccacccggagaattggacccttcaggctcgctggaggctggtgggactcccagtacacctgctgtttttgagattctacaaacgcgacaaagacgagcactatagaacttacgacgcctattctaccttttatctgaactcttctgggcttatatgtagacacagactcgacaagctcatgccttcccactctccgcccactcctgtcaagaagctcctcgtgggggcactggtcgctctcggcctgtccgagcctgagcccgacctgaatctctgtagcaagccttag

SEQ ID NO: 28187 - DNA, 546 bp, Artificial Sequence
  Description of Artificial Sequence: Synthetic coding sequence
atgtaccagccttcacgaggagcggcccgaaggcttgggccttgtttgcgagcctaccaggctagacctcagctgcccaagctttttctgcagagccacgattactcactgtattccctggacgtggagtttatcaacgagattctaaacatccggactaaagggcgcacgtggtatattttaagcctcaccctatgcagatttttagcttggaactatttcgcccatttgagactcgaagtgctacagctgacgcgtcaccctgaaaattggactctgcaagccagatggcgacttgtaggtctacctgtacatttactgtttttacgattttacaaaagggataaggatgaacactacaggacttacgatgcttattcaacattctaccttaattcatccgggctgatatgtaggcaccggctggacaagctgatgccgtcgcacagtccaccgacacctgtgaagaagctgctggtcggcgcactggtggcacttggcctgtccgaacctgagcccgaccttaatctatgtagtaaaccttag

SEQ ID NO: 28188 - DNA, 546 bp, Artificial Sequence
  Description of Artificial Sequence: Synthetic coding sequence
atgtatcagccgagccgaggcgccgcgagacggcttggaccttgtttaagagcttaccaggccaggcctcagctccctaagctgttccttcagtcacatgattactccctttactcacttgacgtcgaattcatcaacgaaatcctgaatatccgcaccaaagggagaacttggtacatcctttccctcaccctgtgccggttcttggcttggaactacttcgcccatcttagactggaagtgctgcagttaacccggcatccagaaaactggactctgcaggccagatggagactcgtgggcttacccgtccatctgctgttcttgcgattctacaagagagataaggatgaacattatagaacttacgacgcttattcgaccttttatctgaatagctcagggttaatctgccggcatcgtctggacaaactcatgccctctcattcgccacctacgcccgtgaaaaagttactggtgggcgccttggtggcactgggtttgtctgaacccgagccagatctaaacctttgttccaagccctag

SEQ ID NO: 28189 - DNA, 546 bp, Artificial Sequence
  Description of Artificial Sequence: Synthetic coding sequence
atgtatcaaccatcacggggggctgcccgacggctgggaccatgtttgcgcgcatatcaggcccggcctcagcttccaaagctgtttctacagagccatgattatagcctatactcactggatgtggaattcataaatgagatcctgaatattaggacaaaggggagaacctggtatatcctgagtttaaccctttgccgttttctcgcctggaactactttgctcacctccgcctggaagtgcttcagttgaccaggcatcccgaaaactggacgctgcaggcccggtggaggctggtgggcctaccagttcacctactctttttgcgcttctacaagcgcgataaggacgaacactatagaacgtacgacgcctactccacattttatctaaattcaagcggactgatctgccggcatagactggataaattgatgccctcccattcacccccaacccctgtgaaaaagctgctggttggtgctctcgtcgctctcgggcttagcgagccagagcccgatctgaatttatgctccaagccctag

SEQ ID NO: 28190 - DNA, 948 bp, Artificial Sequence
  Description of Artificial Sequence: Synthetic coding sequence
atgtaccagcccagcaggggtgccgctcgcagattgggcccatgtctgcgcgcatatcaggccagacctcaggaccagctctatccgggaactctgccatttccacctctgtggccccatagcacaacaaccacatcccccagctcacccctcttttggagtccccttcctcctcgcctgcctactcagaggctcccccaagtccctcctctgcctttgcctcaaatccaagctctttcatctgcatgggtcgtgctccccccggggaaaggtgaagaggggcccggcccagaactgcactccggctgtctggacggtcttagatcactgttcgagggtcctccttgcccttatcctggggcctggatcccatttcaggttcccgggactgcacatccatcccctgccaccccctccggggaccccagcatggaggagcatctgtccgtaatgtatgagcgattaaggcaggaacttcccaagctatttttgcagtcccacgactacagtctttacagtctagacgtcgaattcatcaatgagatccttaatatccggaccaagggtagaacctggtatatattgagtctaactctatgccggtttttggcctggaattacttcgctcacctgagattagaagtcttacagttgacaagacaccccgagaactggacgctccaagccaggtggcgacttgtagggcttccggtgcacctcctctttctgaggttttataaacgcgataaggacgaacactatcgcacctacgacgcgtactccaccttctacctcaacagcagcgggttgatttgtaggcacaggttggacaaacttatgccatcacattcccccccgacccctgttaagaaactcttggttggggcactggtggcgctgggcctgtctgagcctgagcctgatctgaatctgtgttctaagccttag

SEQ ID NO: 28191 - DNA, 948 bp, Artificial Sequence
  Description of Artificial Sequence: Synthetic coding sequence
atgtaccagccctcccggggggccgcacggaggcttggcccctgcctacgcgcctaccaggctcgtccccaggaccagctgtatcccggcactttgcccttccccccactgtggccccactccaccaccactacctctccctcttcccccctgttctggtccccgcttcctccccggcttccaacacagcgcctgccacaggtgcctccattgcccttgccccagattcaggccctgagtagcgcctgggtggtcctgcctccaggcaaaggcgaggagggccctgggccagaacttcattccggctgtttggacggtctgcgatccctgttcgaggggcctccttgcccataccctggagcatggatccctttccaagtgcctggcacagcccacccttcccctgccactccaagcggggacccttcaatggaagagcatctgtctgtaatgtacgaacgactgcggcaagagttgccaaaactctttcttcagtctcatgactatagtctgtattcgctggatgttgagtttattaacgagatccttaatattcggacaaaggggcgcacctggtatattctgtcgttaaccctctgtcgatttctggcttggaattacttcgcccatctgagactcgaggtactccagctgacaaggcacccagagaattggacactacaggctcggtggaggctggtggggctcccagtgcacctcctttttctaagattttacaaaagagacaaggacgagcactatcgaacttacgatgcatatagtactttttatcttaactcttctgggctcatctgtcgacaccggctggacaagctgatgccttctcactctccgcctacaccagtcaagaagctcctggttggcgctctagtggctcttggcctaagcgagcccgagcctgaccttaacttatgttctaagccctag

SEQ ID NO: 28192 - DNA, 1302 bp, Artificial Sequence
  Description of Artificial Sequence: Synthetic coding sequence
cttcccacgtgtgcacttcagcgggtggataggctgggcgtggctggagcaggtggcaggaggtgtcgggcttgccgcgccaggacatctgtactgccaggtctcagagctgtgcggcggggtcagggccaggccgcggggagggtgtgtgtcgccccagactcgccaagactgccagtgccaagaggcgatctcaaaggccgcggacgagagattcggagccccgccgcagcgcccagtcggagttcgcctgcccagactagacccgctggccgaccgcaacaacctgcacgcctcgcactgggagagaggtcatggcaggaaggccgcccagtgtgtactaggttcggcccccttcgccctggatggcaggacggccatgccccatcacgcgacggagcttcgagaaccccctccggaactgaagatcagctgtaccccggaacacttccctttccaccgctttggccccactctaccacaacaacatcaccctccagtcccctgttttggagccccttacctcccagacttcccactcagaggctccctcaggtgcctcctctccctctgccccagatccaagccctgagctccgcctgggtggtcttacctccaggcaagggagaggagggccccgggcctgaactgcactctgggtgcctcgacgggttacgttccctttttgagggcccaccgtgtccttacccaggcgcctggatcccgtttcaggtacccggcacagcccatccctctcctgccaccccatcgggagaccctagcatggaagagcacctgagcgtgatgtacgagcgactgaggcaggagctgcccaaactgttccttcagagtcacgattattccctttattctctggacgtggagttcattaacgaaatcctgaacatcagaaccaaaggaaggacctggtatattctgtcactcaccctttgcagattcctggcatggaattatttcgctcacctcagactagaggtcctccagctgacacggcacccagagaattggaccctgcaggcccggtggcggctagtgggcttaccagtgcacctgcttttccttcgcttctacaagcgtgacaaggacgagcactacagaacatacgacgcatacagcactttttatctaaactcatcaggattgatttgtcgacaccgcttggataagcttatgccttctcattcaccccccacgccggtaaagaagctgcttgtcggagcattagttgccctaggtttgagcgaacccgagccagatcttaacctgtgtagcaagccatag

SEQ ID NO: 28193 - DNA, 948 bp, Artificial Sequence
  Description of Artificial Sequence: Synthetic coding sequence
atgtaccagcctagtcgcggtgccgctaggcgccttggtccctgcctccgggcataccaagcaagaccccaggaccagttgtaccccggcacactgcccttcccccctctctggcctcacagcaccactactactagtccatcatctcctctcttctggtctcccctgccaccccgcctaccgactcagagactgccccaagtgcccccgctccccctgccacagattcaggctctcagttctgcatgggtggtgctgcctcctggaaagggagaggagggccctgggccagagctgcacagtggctgtctcgatggactccgatccttatttgaagggccgccctgcccttaccctggagcttggattccttttcaggtcccgggaactgcacatcctagtcctgcaacaccaagtggtgacccatcgatggaggaacacctcagcgttatgtacgagcggctgagacaggaactgccaaaacttttcctgcagtctcatgactactctctgtattcacttgatgtcgagtttatcaacgagatactaaacattcgaactaaagggcgcacttggtatatactttctcttactttatgtcgctttctggcgtggaattatttcgcgcacctgcgcttggaggtgttacagctgacccgccaccctgagaactggaccctgcaggccaggtggagactggtcgggcttccagtccatctcctcttcctaaggttctacaaacgagacaaggatgagcattatcgcacatatgatgcatactccactttctacctgaactcctctggccttatctgtaggcacaggcttgataagttaatgccttctcatagccctcccacgccagtgaaaaaactcctagtaggtgctcttgtggcactgggcctttcagagccagaacccgacctgaatctgtgctctaagccttag

SEQ ID NO: 28194 - DNA, 948 bp, Artificial Sequence
  Description of Artificial Sequence: Synthetic coding sequence
atgtaccaaccctcgcggggcgcagcacgtagacttggaccctgtttgagggcataccaggcgcggccacaagatcaactgtatcctggcacgcttccctttccccccctctggccacacagtactactactacatccccaagcagtcctctgttctggtcacccctgcccccacgcctgcctactcagcgccttccgcaggtcccgcctttgcctcttccgcaaattcaggcactgtcaagtgcttgggtcgtcctgccccccggcaaaggggaggagggaccagggcctgagctgcactcaggatgcctcgacggcctccgatctctgtttgagggcccaccgtgtccctatccaggtgcctggatcccttttcaggtgcctgggactgcccacccctctcccgcaacccccagcggagatcctagcatggaagaacatctctcagtcatgtatgagaggttgcgtcaagaactgccgaagctgttcctacaaagtcatgactacagtctgtattcgctggacgtcgagtttataaatgaaatcctaaatataaggactaaggggcgcacctggtatatccttagtcttacgctgtgcagattcctcgcctggaattattttgcacacttgcgcctggaggttcttcagttaacgcgtcaccctgaaaattggacactccaggcaagatggcgactggtgggcctgcctgtccatctgctcttcctgcgattctacaagagagacaaggatgaacactatcgcacctacgacgcgtactccaccttctacctgaactcgtcggggttgatctgtcggcaccgcctggacaaactgatgccttcacattcacccccaactcccgtaaaaaagcttttagtgggtgccttagtcgcgctggggttgagcgagccggagcccgacttaaacctgtgtagtaagccttag

SEQ ID NO: 28195 - DNA, 1302 bp, Artificial Sequence
  Description of Artificial Sequence: Synthetic coding sequence
ctgcccacgtgcgcacttcagagagtggaccgtctgggagttgccggggcaggcggtagacgatgtagggcctgtcgagcccggacctccgtcctaccaggcttgcgagccgtcaggaggggccagggccaggctgctgggagagtatgtgtagcacctgacagtcctcggttgcccgtgccccgtggagacctcaagggtcgtgggagagagatcagatcacccgccgctgcccccagtagatcctctcccgcccagacaagacccgctgggagacctcagcaaccagcccggctggctctgggggaaaggtcctggcaggaaggaagaccagtctgtactagatttggtccactgcggcctggctggcaggatgggcatgcaccctcacgggacggcgcttcgcggactccatcaggaacagaggatcagctgtatcccggaacccttccttttccccctctctggccgcattcaactacgactacatcccccagctctcctttgttttggtctccgcttccccctcggttgcccacccaacgactgccacaggtgcctccactgcccttgccccagatccaggccctgtcttccgcgtgggtggttctgcccccaggtaagggtgaagagggtccaggaccagaactgcattctggatgtttggacggacttagatctctgttcgaagggccaccctgtccttaccccggtgcctggattcctttccaggttccaggcacagcacaccccagccctgcgactcccagcggagaccccagtatggaggaacacctgtccgtaatgtacgagcgccttcgccaagagcttccaaagctatttctgcagtcccacgattatagtctgtactccctcgacgttgaattcattaatgaaatactcaatatccgaactaagggaagaacatggtatattctttctctcactctctgccgatttctggcgtggaattacttcgcgcacttgagattggaagtcctgcagctgacaaggcatccagagaattggactctacaggctagatggagactggttggccttcccgtgcatcttctgtttcttcgcttttacaaacgagataaagacgagcactatcgcacatacgatgcgtactcaaccttttaccttaattccagcggcttgatttgtaggcaccgcctcgacaagctaatgccctcccattctccccctaccccagtgaaaaagctgctggtcggagccctcgtagctttgggcctgtctgagccagaacccgatctgaacctctgttcgaaaccctag

SEQ ID NO: 28196 - DNA, 1302 bp, Artificial Sequence
  Description of Artificial Sequence: Synthetic coding sequence
ttgccgacatgtgccctgcagagagttgaccgcctgggcgtcgccggtgccggcggcaggcggtgccgggcctgtcgcgctcgaacctccgtactgcctggtctgcgcgcagtgcgtcgcgggcagggtcaggccgcgggcagggtgtgcgttgcgccagactccccccggctgccagtaccaaggggggatcttaaaggtcgcggtagggagattcgatccccggcggcagcacccagccgtagctctcctgcccaaacccgtcctgcgggacggccacaacagccagcccgcttggcgttgggagagagatcctggcaggagggaaggcccgtttgtacacgcttcggcccgctaaggcccgggtggcaggatggacacgctccttcgcgcgacggggcgagcaggacccctagcggcacagaagaccagctgtatcccggaaccttacccttccctccactctggccacacagcaccacgaccacctctccctcttccccactgttctggtccccactccccccaagactgccaacccagaggctgccccaggttcctccacttcctctgccacagatccaggctctgagttctgcctgggtggttttacctcctggcaaaggggaagaaggcccaggacctgagctccatagcggttgtctggatgggcttcgaagcctctttgagggacctccctgtccgtatcctggagcttggattcctttccaggtccccgggacagcccatcctagtccggcaaccccctccggtgacccgtctatggaggaacatttgagtgtcatgtatgaacgccttcggcaggaactccctaagctgtttctccaatcccacgactactccctgtattcactggatgtcgagttcatcaacgagatattgaatattaggaccaagggaagaacatggtacattctcagtttaactctttgtagattcctagcttggaattatttcgcccacctgaggctggaggttctgcagctgacaaggcaccctgaaaattggacgctccaggctaggtggcggcttgtgggacttcctgtccatctgctgttcctaagattctataagcgagacaaggacgaacactatcggacatatgacgcatactctacgttctaccttaactcaagtggtttaatctgcagacaccgcctagacaagcttatgccatcacacagccctcccactccagttaagaagctgttggtgggcgcactggttgcccttggtctgagtgaaccggagccagatctgaatctgtgctctaagccctag

SEQ ID NO: 28197 - DNA, 948 bp, Artificial Sequence
  Description of Artificial Sequence: Synthetic coding sequence
atgtatcagcccagtcgcggcgctgccagacgtttgggcccttgtctccgggcgtatcaggcccggcctcaagaccagttatatccaggaacactgccgttccccccgctatggccacatagcaccacaactacgagcccgagtagtccactcttctggtcacccctgccacccagacttccaacccaacggctgccccaggtgccgccactcccattaccacagatccaggccctctctagcgcctgggtagttctccctcccggaaaaggtgaagagggtccgggacccgagctgcactccggctgtctggacggactccgctctctgttcgaggggcccccatgcccatacccaggcgcctggatcccatttcaggtccccggtaccgcccatcccagtccagctacacctagcggcgatccgtctatggaagaacacctctcagtgatgtatgaacgactccgtcaagaactacccaaacttttcttgcagagccatgactattcactatattctctggatgtggagttcatcaacgaaatactgaatatcagaaccaaaggtcgtacctggtacatcctgtctttaaccctctgcaggttcttggcatggaattattttgcacatctccgattagaggtcctccagctgacacggcaccccgaaaattggaccctccaggccaggtggaggctggtgggactccctgtccacctcctgttcttaaggttctacaagcgggataaggacgagcactaccggacttacgacgcctatagcaccttctatctgaattccagtggtctgatatgccggcatcgcctggacaaactgatgccctctcactcccctcctactccagtgaaaaagttgctggtgggcgccctcgtagccctaggtttgtccgaaccggaacctgacctgaatctttgctccaaaccatag

SEQ ID NO: 28198 - DNA, 1302 bp, Artificial Sequence
  Description of Artificial Sequence: Synthetic coding sequence
ctgccaacttgtgccctccagagggtggataggctcggagtggccgaggccggtggtagaagatgccgagcttgtcgcgccagaacttcagttctgcccggactgcgagcagtgagaaggggccagggccaggccgcgggcagagtttgtgtggctccagattccccccgccttcctgtgcctagaggtgacctgaagggtaggggacgcgagatacgcagtcccgctgctgcaccgtccaggtctagcccggcccagacacggcccgctggtcgaccacagcaacccgctaggttagcactgggcgagcgctcgtggcaagaggggcgcccagtgtgcactaggtttggacccctacgccctggatggcaggacggccatgccccatctcgagacggtgcctctcggactccaagcgggacagaagaccagctgtatccaggtacactccccttcccccccctgtggccccattctacaaccacgactagccccagttcacccctgttctggagcccattaccaccccgcttacccacacaacggctcccgcaagttcctccgctgccgctccctcaaatccaggcgctgagtagcgcctgggtcgtgcttcctcccgggaaaggggaggaaggccctggccctgagctccactcagggtgtttggacggactcaggtcactgttcgaggggccaccttgtccctaccctggtgcttggattccctttcaggtgcctggaaccgcccacccaagcccagctacaccatcaggcgaccctagcatggaagaacatctaagtgtaatgtacgagaggctccggcaggaactcccaaaactcttccttcaaagccacgattacagtctctacagtctggacgtggaatttattaatgagatactgaatatcaggaccaaaggccgtacctggtatatactctctctgaccctctgtagatttctggcatggaactacttcgcccatcttaggctggaggtgctacaactgactaggcatccagagaactggactctgcaggctagatggcgcctggtcggacttccggtgcacctgttgtttctcaggttttataaacgcgacaaggacgagcactacaggacctacgacgcctactcgacattttatttaaattcttctggcctcatctgtagacaccggctggataagctaatgccaagtcatagtcccccgacacccgtcaagaaattgctagtgggggctctggttgccctcggattgtcagagcccgagccagacttaaatctctgctcaaaaccttag

SEQ ID NO: 28199 - DNA, 1302 bp, Artificial Sequence
  Description of Artificial Sequence: Synthetic coding sequence
cttccaacctgtgccctccagcgcgttgatagacttggcgtggctggggctggtggacgccggtgcagggcctgccgagcaagaacctctgtgttgcccgggttgagggccgtgcgaagaggccaggggcaagcagccggacgagtgtgtgtggcccctgacagtcctcgccttcctgtgccccgaggggacctcaagggacgcgggcgcgagatccgctcccccgcagctgccccctcgagaagttctcccgcacagacccgccctgccgggagaccacaacagcccgccagattagctctcggcgagcgtagctggcaagaggggcggcccgtgtgcacaaggtttgggccattgcgtcccggctggcaagatggtcatgctccgtctagagacggggctagtaggacgccctccggaaccgaagaccagctttaccctgggactttgcctttcccaccactgtggccccactccacaaccaccacatccccgtcctcgcctctgttctggtcacctctgcccccccgtctacctactcagagattacctcaggtaccacccctaccactgcctcagatccaggccctgagctccgcctgggtcgtcctgccccctgggaagggggaggaaggacccggcccagaactccacagtgggtgtcttgatggtctcagaagcttgtttgagggacccccttgcccctatccaggtgcgtggatccctttccaggtgcctggtactgcccatccttcccccgctacgccttctggcgatccgtctatggaggagcacttgagtgtgatgtatgaaagactgcgccaggagctgcctaagcttttcctgcagtcccatgactactcactgtactccctggatgtagagtttatcaatgagatcctgaatattaggacaaaagggagaacatggtacattctttctctgacattgtgtagattcctagcctggaattactttgcacacctgcgcctggaagtcctgcagctgactcggcacccagaaaactggactctgcaagcgaggtggcggttggtcggcctccctgtgcatcttctctttttacgcttctataagagagataaagacgaacactaccgcacatatgatgcctactccaccttttacctgaactcaagcggcctgatctgccggcacaggctggacaagctaatgccttctcactctcctcctaccccggtgaaaaagctcctggtaggtgcgctggtggctctagggctgagcgaaccagagcccgaccttaacctgtgcagcaaaccctag

SEQ ID NO: 28200 - DNA, 546 bp, Artificial Sequence
  Description of Artificial Sequence: Synthetic coding sequence
atgtatcagccttcacggggagccgcacggcggcttggtccctgtctgagagcctatcaagcaagaccccagctgcctaagctcttccttcaaagccacgactacagcttgtacagcctggacgtcgagtttattaacgaaattctaaatattcgaacaaagggtcggacgtggtacattttgagtttgaccctctgcagatttttggcttggaattatttcgcccacctgcgcctggaggttctgcagctgacccgacacccggagaactggaccctgcaggcacggtggcggctggtggggctacccgtccatctcttgtttctcagattttataagagggataaagatgaacattaccgcacctatgacgcctactccactttttatcttaattcctcaggcctgatatgtagacatcgcttagataagctgatgccctcccactccccacccactcctgtcaagaaactgttagtaggagcacttgtggccctggggctctccgaacccgaacctgatctcaacctctgtagtaagccctag

SEQ ID NO: 28201 - DNA, 546 bp, Artificial Sequence
  Description of Artificial Sequence: Synthetic coding sequence
atgtaccaacctagcaggggcgcggcacggcgtcttggcccatgtctgcgggcctaccaagctcgcccacagctacctaaactgttcctgcagtcacacgattacagtctgtacagcctggatgttgaatttataaacgagattcttaatatacgcacgaaggggcgcacctggtatatcctaagcctgaccttatgccggttcctggcttggaattactttgctcacctgcgtttggaagtcttgcagctgaccagacacccggagaattggacactccaggcacggtggaggcttgtgggtttgccagtccacctgttattcctgaggttctacaaaagagataaggatgagcattacaggacgtatgacgcatacagcaccttttacttaaactcgtcgggtctgatatgccggcatcggcttgataaactgatgcccagccactctccccctacacccgtgaagaaactccttgtgggcgcgctcgtcgccctgggcctgtcggagcctgagcctgacttaaacctctgctccaaaccatag

SEQ ID NO: 28202 - DNA, 1491 bp, Artificial Sequence
  Description of Artificial Sequence: Synthetic coding sequence
atgtatcagccaagcaggggcgcggccagaaggcttggtccttgccttcgggcataccaggcgagacctcaggtctccggtggggaggaggggggaaggcggggtggaggagagcgacctagctcgaaaccagtgcgcggcgcggaacgggccctgggctcagctcaagctcagaggcatccgccgcctttgcctacatgcgcactccagcgagtggaccgactgggcgtcgccggagcgggcggacggagatgcagggcctgccgggcacggacctctgtactgcccggtctgcgggctgtgaggagggggcagggccaggcggcgggtagagtgtgcgtggctcctgacagtccaagacttcccgtgcccaggggtgatctgaaaggaaggggtcgagagattagatcccccgccgccgctccgagccgaagtagcccagcccaaacaagacctgccgggcgaccccagcagcctgctaggctggctctgggcgaacggagttggcaggagggacgccctgtttgtacaaggttcggccccttgcggccaggatggcaagatggccacgcaccaagcagggatggggctagtcgtacaccttccgggactgaagaccagttgtaccctggcaccttaccgtttccccctctttggccacatagtactaccacaacaagcccgtcaagcccactgttctggtcacctctcccccctaggctcccaacgcagaggctgccccaggtgccccccctcccattgccgcagattcaagctctatcttccgcgtgggtggttctgcccccaggcaaaggggaagaaggaccagggccagaactccatagcgggtgcctggatggcctccggtccctgttcgagggccctccctgcccataccccggggcctggatcccatttcaagttcccggcactgcgcacccttccccagctacacccagcggggatccctccatggaagagcaccttagtgtgatgtacgagcgactccgccaggagctccccaagctcttcctgcagtcccatgattacagtctgtactctctcgacgtggaattcattaatgaaatcctgaacatccgtacgaagggcaggacatggtacattttaagtctgacattgtgcaggtttctggcttggaattatttcgcgcaccttagattggaagtgttacaactaactcgtcaccctgaaaattggacgctacaggctaggtggcggctggtgggcctgcctgtccatcttctgttcctgagattctacaaacgcgacaaggacgaacattaccgaacatacgacgcatatagcactttctatttaaactcctccgggctcatctgtcgacaccgattggacaaactgatgccaagtcactcaccaccaacacccgtcaagaaacttctggtgggggccctggtggctttaggactcagcgaaccagagcctgatctgaacctgtgttccaagccatag

SEQ ID NO: 28203 - DNA, 1491 bp, Artificial Sequence
  Description of Artificial Sequence: Synthetic coding sequence
atgtaccagccatccaggggcgccgctcgtcgcttgggcccctgcctccgggcatatcaggcccgtcctcaggtttcagggggggaggaaggcggacgcagaggcggtggagagagacccagcagcaaaccagtgcgcggggccgagcgcgcactcggcagcgcacaggcccagcgtcatcctccaccactgccaacctgcgcactccaaagagtggatcgactgggggtggctggtgctggaggacggagatgcagagcctgcagggccagaacttctgtgctgcctggacttcgtgcggtcaggcggggccagggacaggccgcaggaagggtatgtgtcgcccctgacagcccccgcttgccggttcctaggggggacctcaaagggcgagggcgtgaaattaggagtcctgccgcagctccaagccggtcgagccctgcacagaccagacctgctgggcgcccacagcaacccgcccgcttagccctgggggaaagatcatggcaagagggtcgccctgtctgcacaaggtttggacctttgaggccaggttggcaggacggacacgccccaagtcgggatggggcctcaagaaccccatcgggcacagaggaccagctgtatcccgggacattgccatttcctcctctctggcctcattccactaccaccacctcaccctcctcgcctttgttctggagcccacttcccccgcggctgcctacccagcgactgccccaggttccaccacttccattgcctcagattcaggccctttcctcagcctgggtagttcttccccctgggaaaggagaggaaggccccggtcctgagctgcactcaggctgtcttgacggccttagatctctgtttgagggccccccgtgcccatacccgggcgcttggatccctttccaagtccccggcactgctcacccaagtcccgctactcccagtggagatcctagcatggaggagcacttgagcgtgatgtatgagcggttacgacaggagttgccaaaactgtttctccagtcccatgattattctctgtatagcctcgacgtcgaatttattaacgaaattctgaatatccgtactaaaggccgcacgtggtacatactctctcttacattatgccggttcctggcttggaattatttcgcccacctgaggctcgaagtgctccagctgactcgtcaccctgaaaactggacacttcaggcgaggtggcgcctggtgggactgcccgtccacctcctgtttctccgattctataaacgcgacaaggacgagcactataggacttatgacgcctacagcacgttttatctcaactcatcaggcttgatatgcagacaccggctggacaagctgatgccctcacactcgcctcccacacccgtaaagaagctgttagtaggagccctagtggctcttggcctcagcgagcctgaaccagatttgaatctgtgttctaagccttag

SEQ ID NO: 28204 - DNA, 1491 bp, Artificial Sequence
  Description of Artificial Sequence: Synthetic coding sequence
atgtatcagcccagcagaggcgccgctagacggttggggccatgcctgagggcctatcaggctcggccacaggtaagtggaggcgaagaaggcggcagacgcgggggaggcgagcgtcccagctctaagcccgtgcgtggtgcagaaagagccctggggtccgcccaagcacaaaggcaccccccccctttgcctacatgcgcccttcaacgcgtcgataggctgggggtggcaggcgccggaggtcgcagatgccgagcctgcagagcgcgtacatctgtcctgccaggtctgagagccgtgagacgcgggcaagggcaggccgcagggcgtgtgtgcgttgctcctgattctccacgtttaccggtgccacgcggagacttaaagggacgaggaagggagattagatcacctgcggccgctccttcacggagttcccctgcacaaactcggcccgccgggagaccccagcagccagctagactggcccttggtgaaagaagctggcaggaggggaggccagtgtgcaccagatttgggcctctgcggcctggatggcaggacggccatgccccaagtagagacggtgcatcccggacccctagcggtaccgaagaccagctctatccgggaaccctcccatttcctcctctgtggccccactcgacaaccaccacctctccttcgagccctctcttttggtctcccctgcctccccggctgcctacacagcggctcccgcaagtcccccccctgccactgccccagatacaggctctctcttctgcttgggtggtcctcccccctggaaagggggaagagggcccgggaccggagctgcatagcggctgtctagacggcttgagaagcctcttcgaaggccctccgtgcccttatcctggagcctggatccccttccaggtgccaggcaccgcccatccgtctcctgccaccccttctggggatccttctatggaagagcacctttctgtaatgtatgagcgcctgcgacaggagctgcctaagctgttcctccagagccacgattatagcctttattcattggacgtagaatttataaatgaaatccttaatatcaggacgaaaggaaggacttggtacatacttagcctgacactttgcagatttttggcgtggaattactttgcccacctgcggttagaagtgttacagctgacaaggcaccccgagaattggaccctgcaggcaaggtggagactggtgggtctcccagtccacttgctcttcctgaggttctataaacgggacaaggacgagcactaccgaacatacgatgcatactcgactttttacctgaactcatccggccttatctgtcggcatcgactggacaagcttatgcctagccattctccaccaacccctgtcaaaaaactgctggtaggggccctggtcgccctgggattatctgagcctgagccggatttgaatctgtgttctaaaccttag

SEQ ID NO: 28205 - DNA, 1491 bp, Artificial Sequence
  Description of Artificial Sequence: Synthetic coding sequence
atgtatcagccatccagaggagccgcacgccgactgggaccttgcctacgcgcgtaccaggcccgcccacaggtttctggaggagaagaaggcggcaggagaggaggtggtgagaggccaagttctaaacctgtacgcggagctgaacgagcacttgggtccgcccaggcacaaagacacccccctccgctgcccacctgtgctctccaacgagttgatcgcctgggggtggccggtgccggcggaagacgctgccgggcgtgccgtgctcgcaccagcgtccttcctggacttagggctgttagacggggacagggtcaggctgcagggcgggtgtgtgttgccccagattctccaagactgccggtaccgagaggggacttaaagggtagggggagggaaattcgttccccagcagccgccccttcccgtagctctcccgcacagacgaggcctgccggccgaccccaacaacctgcgagattggctttgggcgagcgatcttggcaagaaggacgccctgtctgtacacggtttggccctctgagacctggatggcaggacggacatgctccttcgcgagacggggcctctcggacaccatccggaactgaggaccaactatatccaggaactcttccttttcctccactgtggccgcactccactacaacaacaagcccttcaagcccccttttctggagccctcttcccccaagactcccaactcagcgccttccacaggtgcctcctctgcccctgcctcagatccaagctttgtcttcggcttgggttgtgctgccccccggcaaaggtgaagagggccccggtccggaactgcatagtgggtgcctggacgggctccggtctctgttcgagggccccccttgtccttaccctggcgcctggattcccttccaggtccctgggactgctcatccttcgcctgccactccgtccggggaccctagcatggaagaacatctgagcgttatgtacgaacggttgaggcaggaactgcctaagctcttcctccagtcacacgattatagtctgtactccctagatgtcgaattcatcaacgaaatcctcaatattcggactaaaggccggacctggtatatcctatcattaactttatgccgcttcctggcctggaactattttgcccatctcagactcgaggtcctccaactaacaaggcaccccgaaaactggaccctgcaggcccgttggcggctggtgggactaccagtacatttactgttcctgagattctataaaagagataaggacgagcattatcggacatatgacgcctactctacattctaccttaattcaagtggcttgatctgccggcacagattggataaactgatgccttcacactctccaccaacacctgttaaaaaattactggttggcgcgctggtggctctcggccttagcgaaccggagcccgatctgaacctgtgcagcaagccttag

SEQ ID NO: 28206 - DNA, 1491 bp, Artificial Sequence
  Description of Artificial Sequence: Synthetic coding sequence
atgtaccagccctcaagaggtgccgctcggcggcttggtccctgtctgagggcttaccaggcgcgtccgcaggtctcagggggagaggagggcggacgcagaggagggggcgagcgccctagttctaaaccggttcgcggagcggagagagccttgggaagcgcccaggctcagaggcaccccccgccattgccgacatgcgcactgcagagggtggatagactcggggtcgccgaggcaggaggtaggagatgccgagcttgtcgggcacgcacctcagtgcttcctggtctacgtgccgtccgacgggggcaggggcaggccgccgggcgcgtttgcgtggccccggacagcccacggcttcccgtaccccggggagatctgaagggtagaggtcgcgaaattcggagcccagcagctgccccctcccggtcttcccccgcgcagacacggcccgccggaagaccccaacagccggctcggctggccctgggcgaacgttcttggcaagagggaagaccagtctgtacccgctttggccctctgaggccaggatggcaggacggacatgccccctccagggacggagccagtcgaaccccctccggcactgaggaccagttgtatcccggtacgctgcctttcccgccattgtggcctcatagtaccacgactacatccccgagctcgcccttgttttggagccctctgcctcccaggctgcctacccagaggcttccccaggttccgccgctgcccctaccacagattcaggccttgagttctgcttgggtggtcctccctcccgggaagggggaagaagggcccggacctgagctgcattccggctgcttagacggtctcaggtccctgttcgaaggacccccttgcccgtatcccggagcctggattcccttccaggtcccaggtactgcacaccccagtccagcaacaccaagcggcgatcctagtatggaggaacacctcagtgtgatgtatgaacggcttagacaggagctaccaaaactgtttctccagtctcacgactactcactttatagccttgatgttgaattcatcaacgagatcctgaacattaggacaaaagggagaacttggtacatcttgtccctgaccctatgtcgtttcttggcctggaactattttgcccacctacggctggaagtcctacagctgacacgccaccccgaaaattggacacttcaggcacggtggcgattggtgggcctgcctgttcacttgctttttctacggttttataaacgtgacaaggatgagcactatagaacatatgacgcttattccaccttctacttgaactcgtcgggcctgatttgcagacaccggctggacaaactgatgcccagtcactcccccccaactccagtgaaaaaattgttggtgggagctctcgttgctctcgggctctccgaaccagaacccgacctcaatctgtgctccaagccctag

SEQ ID NO: 28207 - DNA, 1491 bp, Artificial Sequence
  Description of Artificial Sequence: Synthetic coding sequence
atgtaccaacctagccgtggcgccgccagacgacttggtccatgtctgcgggcctaccaagccagaccacaggtgagcggaggggaagaagggggaaggaggggtggcggggagcgcccgtcctcgaagccagtaaggggagccgagagggccctcggctcagctcaagcacagcgacaccctcctccactacctacctgcgctttgcagcgggtggatcggctgggcgtggccggagccggaggaaggcgctgcagagcctgtagagcccggacgagtgtcctaccgggactgcgggcggttaggcgcggacagggtcaggccgctggtagggtgtgcgtggcccccgactcaccccggttgccagtgccgcggggcgacctcaagggtaggggacgggaaataagatcgcccgctgcagccccaagccgtagctcccccgcccagacaagacccgctgggcggcctcaacagccagcacgcctcgccctgggggaaaggtcctggcaagaggggcgcccggtatgtactcgattcggaccccttaggcccgggtggcaggatggacatgcgccgagccgggatggtgcgtctaggactcctagcggaaccgaggaccagctctacccgggtacgctgccattccctcctctgtggccgcactcaacaacaacaacatccccatcctcacctttgttctggtctccgctgccccctagactacctacacagcgcttaccccaggtgccgccactgccgctcccccaaatccaagcactgtcatctgcctgggttgtactgcccccgggcaagggggaggaggggcctggcccagagctccactctggctgcttagacggcctgaggagcctgttcgagggccctccttgcccctaccccggagcttggatcccttttcaggttccaggaacagcacaccccagcccagcaacacctagcggtgacccatctatggaagagcacctttctgtaatgtacgagaggctacgccaggagttgcccaaacttttcctccaatcacatgactactctctctactccctggatgtagaattcattaacgagattctgaatataaggactaagggtcgtacctggtacattctaagtctgaccctgtgccgcttcctggcctggaattacttcgcccacctgcgcctggaggtgttgcagcttacacgccaccctgaaaattggactctgcaggccaggtggcgattggtggggctgccagtgcacttactgtttctgcggttttacaagagagataaggacgagcattatcgcacctatgacgcttactcaaccttttatctcaactcatcgggtctcatctgccgccaccgactcgataagctgatgccgtcacactctcctcccaccccagtgaagaaactattggttggggccctggttgcccttggactgtccgaacctgagcctgatctcaatctgtgctcgaaaccttag

SEQ ID NO: 28208 - DNA, 735 bp, Artificial Sequence
  Description of Artificial Sequence: Synthetic coding sequence
atgaatgacccgttcgctcgaatggagactcgagggcctcagggggccgccaacccgatggatagtagtcgaagcctaggcgacctcggcccatttcccagggaggtcggcaggggcgctcccctggcacctggtgcgcgtaatcctgcaacagccggagcaagtcgcagccagggcggagggcacgaggataggaccgccgaccgcgcactcggaccaagggccggagaggagcttgacagagagagctgggtcagggagaaggtgctcttcctcctccatccggagcgctggctgggaactagaggggatccggccagggaagaagtagctggggctgaggatttgcctcatgcggggggagaggatcatggcgaagaaccgaactacccgagcgtgtttcagcggcagaagcgaattagcgggcggagagtggccccccccagagacgcagccgatccacccaagtacgttctggtgcgagtggaggattatcaggttacacaggaagtgctgcaaacctcatgggccaagggaagaatgacaactcggaccgaggagcattttgtgaccgctctgacatttagatccagcagggagggtcagcccggagaacggtgggggccagccgaatcacgcgccctgcaggcccgcacaggagcgagtcgcgtgcacgcggccggccgccgcgtgtccccttcaccaggcacttggctggaggaaatcaagctgtag

SEQ ID NO: 28209 - DNA, 1527 bp, Artificial Sequence
  Description of Artificial Sequence: Synthetic coding sequence
atgggtcggcggaacgaaaactgcgccaactcgctgagagtgtccaacatctcccaggaaaatctctcacattggaatctggacagcgaagtgcctgtctcagaaaacaagaacctgccagctggcagggacggcgctgccggggggaagattaataagaactacctggaaattcccgtggaacagttaatgctggaaccaaacctaagcgtgcactctcagaagagtactcagaacagcaagcaaggcatctttcagctgtggaattgccccctgaacgagggctctaccatcgaaaagcgggagtttaaaaaatcaagcgtggagaccggttttaatgttatcaatcatcccattcgggtcttcaccttaaaccatccgctgaccatcgcctctgtggacaagcaggtggggccttaccccgggcttccaatgcccctgggtctttgttggccctacgccgacggagacttctttaagaacagaaatgagattcacgtgtcaagttgctctacaattgagaacaatgatggggaaacactgcctgcgcctaactggaacctgaagcatggaaattcttccgtcgaggagaacttcactgacgaaagcgacttgtctgagaacgagaagacaaatgatactttattgtcttacttcaagaaggtagaccttaacctgaagccagaaaccatcaaaaatgtcgaggagccctttacagaagaaccaaacgaggtttttccctacccagattttctgcctcccccattcagtgcccttgacctgcataacttggctctctctaagtcagataactggaaggttaccgtggatcccgctgagactagcgtggagcacctgattacacggttgctggagttggaaaggctacagcacatgacaattcagaaggagcggccacgtctgcagaccactttttgtactcccgccgtgacagagcgtccttcatcttccaaggccacaccaaaagtgaggcaacccaaactgtgcgactctctctcactgcagattccatgcgtagacaagtcgcaggagaaatcaaaaaacaatagcgggtcctgcaagttagagcagaacgccttgaagcggaattggtctaacgcaggaaaatatcgctggaattctcggcctctttcactcaaaagctcaagcacccccaagcagctaatcgagacatacgacaaaaaccccaagagtagtatccttagcccttgtcaggaattatctttcaagcccaccatcggccatacgaatcagtctatggtcaaaatggttagcacgcggtgcctcccgtggcggagcccaatgcccgtgtctccaattccactgacttttcccgagaaccagaaagaagagataaaggcacctaagaggaatttcgggaccaagaaaaagttgtatcggcaaaatatcgtccttaatcgacccttctccatacagaaactgaactgtttatcaccctctctgatcgcaaaggacaagtgttgttcacctatcgagcagaagtag

SEQ ID NO: 28210 - DNA, 1068 bp, Artificial Sequence
  Description of Artificial Sequence: Synthetic coding sequence
atgctaatggaattctttaagaacaggaacgaaattcacgtgagctcatgtagtaccatagagaataatgatggcgaaactctccctgctccaaactggaatctgaaacacggcaattcctctgtggaagaaaactttacagacgaaagcgatctctctgaaaatgagaagacgaatgatacgctgctctcttatttcaagaaagtggatctcaacttgaaacccgaaactattaagaacgtcgaggaacccttcactgaggagccgaacgaagtgtttccctacccagatttcctacctccccctttctccgctctcgatttacataacctcgcactcagtaagtcggacaactggaaggtgaccgttgatcccgcagagacctcagtcgagcatcttattaccaggcttctcgaactggagagattgcaacatatgaccattcagaaagagcgacctcgcttacaaaccacattttgcacacccgccgttacggagcggccatcgagcagcaaggctactccgaaggtccgacagccaaagctgtgcgattccctgagcttacagatcccatgtgtagataagagtcaggagaaaagtaaaaacaatagtggatcttgtaagcttgaacagaatgcccttaagcggaattggtcgaatgctggaaaatacagatggaacagtaggcctctttcactgaaaagttccagcacaccaaagcagctcatcgagacttacgataaaaatccaaagagtagcattctgagcccttgccaggagctgagcttcaagccaaccatcgggcacaccaaccagtcgatggtcaagatggtgtccacacggtgtctgccctggagatctccgatgcctgttagtcccattcctcttaccttccctgaaaatcaaaaggaggagatcaaggctccgaaaagaaatttcggaacaaagaagaagctgtaccgccagaatatcgtcctaaatagaccttttagtatacagaagcttaactgtctttctccctcactgattgcaaaggacaagtgctgcagtcccatcgaacagaagtag

SEQ ID NO: 28211 - DNA, 978 bp, Artificial Sequence
  Description of Artificial Sequence: Synthetic coding sequence
atgcagggcagggtcgctggcagctgtgcccccctggggctgctgcttgtctgtctacatttaccgggattgtttgcgaggtctattggtgtggtcgaggagaaggtgtcccagaactttgggacagatcttccgcagctcggccagccctccagtaccggcccatcaaatagtgagcaccctcagcctgcccttgatcccagatccaatgatctcgcaagagtgccgctcaagctgtctgtacctcccagcgatgggttccccccagccgggggtagtgctgttcagcggtggcccccctcctgggggttgccagccatggactcatggcccccagaggacccttggcaaatgatggccgccgctgcagaggaccgtttgggcgaggccctgccagaggaattgtcctaccttagttcagctgctgcattagcaccgggatctggccctctgccgggtgagagttcgccagacgctaccgggctgagtccggaggccagcctgctgcaccaggactcagaatcccgcaggctgccacgatctaactccctcggagctgggggaaaaatcttgtcccagcgcccgccatggagcctgattcatcgagtccttccggaccatccatggggtaccctaaatccaagcgtctcttggggcggcggaggccctgggacaggttgggggacgcggccgatgccacaccctgaggggatctggggaattaataatcaaccacctggcactagctgggggaatatcaatcggtatccggggggctcttgggggaacatcaaccgatatcccggcgggtcctggggcaacatcaaccgatatccaggaggatcatggggtaatatccatttgtatcctggcataaataacccttttccccctggtgttcttcggccccccgggagttcgtggaacatccccgctggttttccgaatcccccctcacctaggctgcagtggggttag

SEQ ID NO: 28212 - DNA, 978 bp, Artificial Sequence
  Description of Artificial Sequence: Synthetic coding sequence
atgcagggtagagtggcgggctcttgtgccccattgggcctgctgctcgtgtgcctgcatttgccaggcctgtttgcccgtagtatcggagtagtcgaagagaaggtttcgcagaattttgggactaatctcccacagttaggtcaaccatctagcacaggaccctctaactccgagcacccccagcctgcactggacccgcgaagtaatgacttggcgagagtgccgttaaaactgtcagtccctcccagcgatgggttcccccctgctggaggatcagccgttcagcggtggccaccttcatggggactgcctgcaatggattcttggccccccgaggacccgtggcagatgatggccgccgcggcagaggatagactgggcgaggcactccccgaagaactgagctaccttagttccgccgccgccctggcacctggatcaggcccgctgcccggggagagctctccagacgctacaggcctatccccggaggcctcgctcctacaccaggacagtgagtcccgaaggttacctagatctaattcactgggggccggggggaaaattctttcccagagacctccctggtcactcattcacagagtgcttcctgatcatccttggggcacattaaacccatctgtttcatggggtggcggcggacccgggaccggatggggcacacggcctatgccacatccagagggaatctggggcatcaacaatcagccccccgggacttcatggggcaacatcaatcggtatcctggaggatcctggggaaacattaacaggtatcctggaggtagttggggtaacataaaccgctatccaggtggtagttggggcaatatccacctttaccccggcatcaataacccgttcccaccgggtgtgctgcgtcccccaggaagttcttggaacatccccgccggcttccctaacccccctagccctagactacaatgggggtag

SEQ ID NO: 28213 - DNA, 612 bp, Artificial Sequence
  Description of Artificial Sequence: Synthetic coding sequence
atgtaccagaatatggatgatgagatgaagagggagcaccttgccgctgagcagcgcatggtacacaggattcagcggatcatgatggagtgccaccgtgaaaaagtggaggctgtcgagaaagcaagggcggaggaacgccatatagcccaggaggccatacaagcccagaaatctaaggctgtggaggaaattgtgaatacaggggtaaccgtgattaaagatgaaaaaacaagcgtggctcgcctgatgcgcgaaaaagagcatgagatgagcatcctgtatggcatagcccagaggcaaaggcaggaagaggtgcaggaggtgctccaggaagcggaaaagacccaccaagccacgctcggcaacatgatggacaaactggcaaatacccagggtgagctactgtccattgccaaacaactcggaatcatgacaaattggaaagacttcttggaggaagagttacaggagacccgcatggctttccagaaatacattaattacacgtttcctaagctaagtcccggacatgctgacttcattttgcctgagcgcaagaaaacaccttccaacctggttatcaaagagaataaaacaactctagactag

SEQ ID NO: 28214 - DNA, 990 bp, Artificial Sequence
  Description of Artificial Sequence: Synthetic coding sequence
atgatcaggaactctgactacaagaactttgtgtgttgcgcggtttgtaacaagatcatcccacccgcaccctttggaaaaacgttcaaacggatccacgagtataagccacttaaaacgcgattttacactcacaaagacatccttgatattggcgcaaacattctaaaaaaggaggaacagttccaggaggacattctaagggaacacattgcaaaagccgaggcagaagtttgggcgcaggctaatgagcgacagaagcaggccgtggagaaggcactcgaggaagctaatgatagacacaaaatcgaaattcaaattctcaaagaggagcatcagaaagacctgcaagaggttaccgcgaagaccaagaccgagatgtaccagaatatggatgacgagatgaagcgggagcatctcgcagccgaacagagaatggtacacaggatccagaggattatgatggagtgccatagggagaaggtggaagccgtggagaaggcccgggctgaagagcggcacatcgcccaggaggccattcaggctcaaaaatccaaggcagtggaggagatcgttaacacaggcgtgacagtgattaaagacgagaagacttctgtggcccggttgatgagggagaaggagcacgagatgagtatactctatggcatcgcccaaaggcagcggcaggaggaggttcaggaggttctgcaagaagcggaaaagactcaccaggccacactcggaaacatgatggacaagctagctaacacccagggtgaactactgtcaatcgctaaacagctaggcatcatgacgaattggaaagattttctggaagaagagctacaggaaactcgtatggcctttcagaagtacataaactatacattccccaaactctcccctggacacgccgactttattctgccggagcgcaagaagacccccagcaatctagtaatcaaagagaacaaaactaccctagactag

SEQ ID NO: 28215 - DNA, 231 bp, Artificial Sequence
  Description of Artificial Sequence: Synthetic coding sequence
atgtcacatttaccggcagttagcccggtgttcttccagctacccgcccctcatccacctaccgttctcagacctcagctgggcctgcatcctaatccggagtgcgacagagagaagatgagcgttcgggatcatgacccagaagttctcactagaaactccgcctgtaaaccccgcggacagttatcagggcacttgctcaaaccacgggctcccttggaagccgcctag

SEQ ID NO: 28216 - DNA, 180 bp, Artificial Sequence
  Description of Artificial Sequence: Synthetic coding sequence
atgagccacctgcctgcagtttctcccgtcttcttccagctccccgcaccgcacccgccaaccgtgctacggccacaacttggcctccacccaaacccagagtgtgacagagagaagatgtcggtgcgcgaccacgatcctgaggtactgactagaaactccggcagccttcaggcctag

SEQ ID NO: 28217 - DNA, 1869 bp, Artificial Sequence
  Description of Artificial Sequence: Synthetic coding sequence
atgcctcccacccaagccgagtcagtgatccgcagcatcataagggaaattgggcaggagtgtgcagcacacggtgagatagtctcagagaccttaatcgccttcatggtcaaagctgtggttttagatccctccaatgggtttaacatggaccggacactcatgaaaagcgacgtccagaatctggtgaagctttgtatgacccgactcctcgatacgaagaaccctagccttgatactatcaaaatgcaggtgtactttgacatgaattacacaaacagggttgaattcctcgaagaacaccaccgggtgctggaaagtcgactcggcagcgtcacccgcgaaatcactgataaccgggcctgcgccaaagaagaactggaatctctttatcggaagatcatatcttacgttctgctgaggagcggtctaggaagccccacagacatcaaaactgtgagagaggttacagcagcattgcaatccgtgttcccgcaggctgaactgggcacattcctgacactatcaaagaaggacaaggaacgccaactgaaggaactaactatgatcgtcaccggaattaggctgttcaatcgggattgtggcaaaggcggtgaaggcatagatgacttaccagcagtactgcacgtcgccatccctgctaccatgcaacatattgattaccagctggaaaccgccagatcacaggtttatcggtacaccgccatccttgaaaaggcggcaaatgatccattaatgcgggccgagttgcagccctacatgctgaaagaagctttatataatatcagacagtatgaagtattcttacagatcatattgagtgatattatcactggggctcaggaggtggaaatgatgacaaaacaactcggcgctcatctggagcagctaaagatgactataaaatctaaaatagcggtccccacaagccaagtctttcctatattcatagcactttccacactgtggacaagcctgcaggacgagactatcgtggttggggtacttagcaacctgtttacacacatccagcctttcttgggggctcatgaactctactttccagagcgcgttatgcagtgccatttaaatggagcaacagtcaagactgacgtctgtcgaatgaaagagcacatggaggaccgggtaaatgttgccgacttccggaagctggagtggctgtttccagagaccactgccaatttcgacaaactgctcatccagtatcgcgggttctgcgcctacacctttgctgcaactgatggactgttgctcccgggcaatccagcaattggtatcctcaaatacaaagaaaaatattatactttcaactccaaggatgcagcatacagtttcgccgagaatccagagcactacatcgatatcgtaagagagaaggccaaaaagaatactgagctgatacagcttttagagctgcatcagcaattcgaaaccttcattccatactcccaaatgagggacgcggataaacactatattaagcctatcactaagtgcgaatcaagcacccagacgaacacgcatatcctgcctccgaccatcgtgagaagctacgaatggaatgaatgggaactaaggcgcaaggccatcaaacttgccaatctcagacagaaagtcacccacagcgtccagaccgacctatcacacttgcgcagagaaaattgttcacaggtgtacccccctaaggatactagcacccagtcgatgagagaagacagcactggagtccctaggccacagatctacctggccggactccgcggagggaaatccgaaatcactgacgaggtgaaggttaatttgacccgggatgtagatgagacctag

SEQ ID NO: 28218 - DNA, 759 bp, Artificial Sequence
  Description of Artificial Sequence: Synthetic coding sequence
atgccacctacgcaggccgagtctgtgataagatctattatccgggaaatcgggcaggaatgcgctgcccacggagaaattgtttctgagaccctgattgcatttatggtaaaggcagttgttctggatccttccaatggctttaatatggatcggaccctcatgaaaagtgacgtgcagaatctggtcaagttgtgcatgacaaggcttctggacactaagaatccctcacttgacactataaagatgcaggtgtatttcgatatgaattacacaaatagggtcgaatttctcgaagaacatcaccgagtgctggaatctcgacttgggtccgtgactcgcgagattaccgataaccgtgcttgtgcaaaagaagagctggagtctctgtatcggaagataatatcctacgtcctgctgcgctcaggtttggggagccccacagatatcaaaactgtcagagaagtgaccgcagccctccagtcagttttcccacaggccgaacttgggacattcctaacgctgagcaaaaaggataaggagcgccagctgaaagagttgaccatgatcgttaccgggattcgcctgtttaatcgagattgcgggaaagggggagaagggatcgatgacctgcctgccgtgctgcatgtggccattcctgccactatgcagcacatcgactaccagctcgaaacagccaggtcccaagtctatcgatataccgccattttggagaaggccgctaacgaccctctgtag

SEQ ID NO: 28219 - DNA, 1230 bp, Artificial Sequence
  Description of Artificial Sequence: Synthetic coding sequence
atgcactggggtgtcggctttgcgtcctctaggccttgtgttgtggatctaagttggaaccagagtatatccttctttgggtggtgggctggctccgaggagccctttagcttctatggagatatcatcgcctttccactacaggattacggggggatcatggccggtctcggcagcgatccctggtggaagaaaactctatatttaacagggggcgccctgctggcggctgctgcttatcttttacatgaacttctcgtcattcgtaaacagcaggagatagatagcaaggacgcaataatcctgcatcagttcgcccgtcccaataacggggtgccctctctgagccctttttgcctcaaaatggagacctacctgcgcatggcggatctcccgtaccagaactacttcggcgggaagttatcagctcagggaaaaatgccttggatcgagtacaaccacgagaaagtctccggaactgagtttataatcgattttcttgaggagaagcttggtgtcaacctgaataaaaatctgggaccacatgagagagctatttctagagctgtaaccaagatggtggaggaacacttctactggaccttagcttactgccagtgggttgacaatcttaacgaaacccgcaagatgctaagcctgagcggggggggtccattttccaatctgctgcgctgggtcgtctgtcatattacaaagggaatcgtgaagcgagagatgcacggacacggtattggacgctttagcgaggaggagatctacatgctgatggagaaggatatgcgaagcctggccggtttacttggcgataaaaagtatatcatgggccccaagctgagcacactggatgcaactgtctttggtcacctggcgcaggccatgtggacactccctggcactcgaccagaacggctgatcaaaggggagctgatcaacctggccatgtactgcgaaagaatccggcgcaaattttggcccgagtggcaccatgatgatgataacaccatctatgagtccgaggagagctccgagggatccaaaacgcatactcccctgttggactttagcttctacagcagaacggaaacctttgaagatgaaggcgcagaaaactctttcagtagaactcctgataccgatttcactggtcactcactcttcgacagcgatgtagacatggacgattatactgatcacgagcaatgcaagtag

SEQ ID NO: 28220 - DNA, 390 bp, Artificial Sequence
  Description of Artificial Sequence: Synthetic coding sequence
atgggtcccaagctgagcacactagatgcgaccgtgttcgggcacctggctcaggccatgtggaccctgcccgggacaagacccgaaaggctcattaaaggtgagttaattaatctggccatgtactgcgagagaattaggcggaaattttggcccgagtggcaccacgacgatgacaataccatttacgagtcggaggaaagctcagaaggctccaaaactcacacaccactgttggactttagcttctactcccggactgaaacatttgaggacgagggcgcagagaactcttttagccggacccccgacactgatttcacaggacattcactttttgactctgatgtcgatatggacgactatacagaccatgaacagtgcaagtag

SEQ ID NO: 28221 - DNA, 384 bp, Artificial Sequence
  Description of Artificial Sequence: Synthetic coding sequence
atgatctatccgttagacctgttccggaacatcccctggaaacaggggaagtgtttcgcatctctctctcctgaaggggagcgtgccttcgacggaatggagcccctgtgccagccgggagctaggccagcgctccgcgggctgcagcacgcctccgactgctacaggctgttgagtcctccaggcagtggccttgtgggtactaatccatccgtcccggccccttccccacactgcggatgctgtcaggcatggtcaatttcttctttcaccttcaccggacctacgccatttaagataaattcagaccaagctacgccctgtcatctgagatctccagagactatatttcggcagcgggagatctcgaatgaagccttttag

SEQ ID NO: 28222 - DNA, 432 bp, Artificial Sequence
  Description of Artificial Sequence: Synthetic coding sequence
atggccagtggcccactgggaccaggcgcaaggcccactaggcttcatcccccctttcctccaccagcccacatcaagcccggcgccccgccgggagaaaatcccgaactttctggcctcgaacggatcctggcccgccatcagctccctaaagaaattaacctgactcccaaaccaaaccggatgcccccttggaagagaaagattatcaataacgtgacagacgggtggaaaaaatgccatctcctcaagaggaatacaaaggagccgccgatgagcacaattgtggtcagaaagctgattcagaagaatgtacctcgtagacattccttgcgcaacacttcaagaaagctgcggaacctgcccacgaccgctaagggcacacaaaccgggaagtcccagtgcttgctgggcatcagtgaacctacctag

SEQ ID NO: 28223 - DNA, 387 bp, Artificial Sequence
  Description of Artificial Sequence: Synthetic coding sequence
atgctttcaaatttacatgaattattgcctaaccatctcatggaaactctgtactcacgtaagagcgaagaggacaaaaaaaagtgtgaaaaccctgaactctccggcttggagcggatactcgcccgacatcagttgccaaaggaaatcaaccttacgcccaaacccaacagaatgcctccttggaaacgcaagatcatcaataatgtaaccgacggatggaagaaatgccacttgctcaaaaggaacaccaaagagcctccaatgtctacaattgtcgtgagaaagttgattcagaaaaatgttccccgcaggcactctctcaggaatacaagcagaaagctgagaaacctgccaacgaccgcaaaggggacccaaaccgaatag

SEQ ID NO: 28224 - DNA, 591 bp, Artificial Sequence
  Description of Artificial Sequence: Synthetic coding sequence
atgctgtccaacctgcatgagctgctgcccaaccatctcatggagacactctactccagaaagtctgaagaggacaagaaaaaatgcgaaaaccccgaactgtcagggcttgagagaattctcgcgaggcaccagttacctaaagagatcaacctgacccctaaacccaatagaatgcctccatggaagcgcaaaatcatcaataacgtgactgacggctggaaaaagtgtcatctgctcaaacgtaatacaaaggagccccccatgtcaactatcgtagtgcgctggcttaaaaagaacatgcaacctactgaggacctcaaatccgtgatctgtcgactgtccgcctttggaccaatccagtccgccacagtctgcgggaggcaaagcgcaatcgtcgctttcaaagacatgacttctgcatgcaacgctgtctctgcgttccagagccggaccccagggaccatgttccagtgcagttggcagcagagatttatgtctaaagataagacatattccaaaaaatgcacccagaaaacgcagcctaaggagtacaagcaggaaacagagaaaccagctaacaactcctag

SEQ ID NO: 28225 - DNA, 423 bp, Artificial Sequence
  Description of Artificial Sequence: Synthetic coding sequence
atgctctccaacctgcatgaactcctgcctaaccatttgatggaaaccctgtactctagaaagtctgaggaagataaaaagaagtgcgagaacccagaactatctggcctggaaaggatcctcgctagacaccagctgcccaaggaaattaacttaacccccaaacccaatcgcatgcctccctggaaaagaaaaatcatcaataacgtgaccgacggctggaagaaatgtcacttactgaaaagaaatactaaagaaccccccatgagcaccatcgtggttagaaaacttatccagaaaaatgtccccaggcggcatagtctccggaacactagcaggaaactcagaaatctgcctacaacggctaaagggactcagaccgggaagtcgcagtgtctccttgggattagcgagccaacatag

SEQ ID NO: 28226 - DNA, 1326 bp, Artificial Sequence
  Description of Artificial Sequence: Synthetic coding sequence
atggccgtggtgcccgcaagtctgagcggccaggatgttggaagcttcgcttacctgaccattaaagacagaatcccacagatcttgacaaaagttatcgataccctccaccgtcataaaagcgagtttttcgagaaacacggtgaagagggcgtagaagctgaaaaaaaagcaatctcattgctttctaagcttcgaaatgagttgcagactgacaaaccctttatcccgctggtcgaaaagttcgtggatacagacatatggaaccagtacctcgagtatcaacagtcacttctgaacgaaagcgatggaaagtccaggtggttctactctccttggctcctggttgaatgttacatgtaccgcagaatccatgaagcgattattcagagcccgccgatagattactttgacgtgtttaaagagagcaaagagcaaaacttctacggaagtcaggagtccataatagctctttgcacacacttgcagcagctcattaggaccatagaggaccttgatgagaaccagctcaaggatgagttcttcaagctactgcaaatttccctatggggcaacaagtgtgacttgagccttagtgggggggaatcttctagccagaatacaaacgtgctcaattcactggaagacctgaagcccttcattctgttgaatgacatggaacatttgtggtctctgctgagcaattgcaaaaagactcgagagaaagcaagcgccacccgtgtttacattgtcctggataattctggcttcgaactggttaccgacctgatcttagccgactttctgctatctagtgagctggcaacggaagttcacttctacgggaaaactatcccatggttcgtgtcagataccacaatacacgattttaattggctaatcgaacaggttaaacattccaatcacaaatggatgagcaaatgcggcgcagattgggaggagtacatcaaaatgggaaagtgggtataccataaccacatcttttggacccttccacatgaatactgcgctatgccacaagttgctcccgatctatacgccgaactccaaaaggctcatctcattctgtttaaaggcgacttgaattatcggaaactgacaggagacaggaagtgggaattctcggttcctttccaccaggccttgaatggcttccatcctgcgcctttatgtacgatccggaccctgaaagcggagatccaggtaggacttcaacccggccagggcgagcagttgctggcctccgagccatcctggtggaccacagggaagtacgggattttccagtatgacggtccactatag

SEQ ID NO: 28227 - DNA, 969 bp, Artificial Sequence
  Description of Artificial Sequence: Synthetic coding sequence
atgtatcggcgcattcatgaagcaataatacagtcccccccaatcgactacttcgacgtatttaaagaatccaaagagcagaatttctatggcagccaggaatccattatcgccttgtgtacccacctccaacagctgataagaacaatcgaggacctggatgaaaaccagctcaaggacgaattcttcaagctgctgcagataagtttgtggggcaataaatgcgatttatcactttcagggggagaatcatctagccagaacacgaacgtgctaaactccttggaggacttgaagccctttatattgctgaatgacatggagcacctgtggtcactgctgagcaattgtaagaagacaagagagaaggccagcgccaccagggtgtatatcgtcctggataatagtggattcgaactcgtaaccgatctcattctggcagatttcctgctctcttcggagcttgctaccgaggtgcatttctatgggaaaacaattccatggttcgtctcagacacgacaatccacgatttcaactggctgatcgaacaggtgaaacattcaaaccataagtggatgtctaaatgcggagcagattgggaggagtacataaaaatggggaaatgggtctaccataaccacattttctggacgctcccccatgagtactgcgcaatgccccaggtagctcctgacctctatgctgaattgcagaaagcccaccttattctgtttaaaggggatctgaattacaggaagctaacaggggatagaaaatgggaattttccgttccatttcatcaggccctgaatggctttcatcctgcccctctttgcactatccggaccctcaaagcggaaatccaggttggcctgcaaccaggccagggagagcaattactagcctctgagcctagttggtggaccactggcaagtatggcatttttcagtatgacggcccactgtag

SEQ ID NO: 28228 - DNA, 1959 bp, Artificial Sequence
  Description of Artificial Sequence: Synthetic coding sequence
atggaaaatccaaggtgcccaaggcgcccattagcagagaagaaagcccggagtctggatcggccgcaggctcctggcaaaggctccgagtcctgggactgtcattggctcagcttgcccacggcaccctcaaggaaggccctccactggaccacttctgattgggcccgacattcagatagcccagctcccagcgcagaggcccattgtactaccgccgcagcccccacgcctgaagagacaggcgactttcttccgtccgagcagagacctagccaggacacgaagaaaggctggcttaagacgatgctcaacttttttgtgaggacggggccagaagagcctagagagaaagcctcgagaaggccgcgcgggaaggagggaattagccaacatcccgaacccctcgaagccgccggagagccagcactgcggaagaaggcgcaccacgataagaagccctccagaaaaaagcagggtcataagaaacacgcagcagaagtgacaaaagcagcccaggaccaagaagcccggggccgcgaggagggcttgtcaaaagctgccgcagctctgcgatccggtgaggccgacctgggtccagctcggcgcgggggcgaagattcagaccaccaatccttcctgataaaggtcgacggaactggggcccttgatgtgtctccccacgcgaccggccaccagcaagaagaagaactgaaaaagccagatcaagacgctatcattcagatgatcgttgaactgctgaagagggtgggcgatcagtgggaagaggagcagtctctggcatcacaactaggcgtcgcgctgcccaaccctgcaccagccgtcagaaagaagtcacaagagaagaaaactagcctgaaacgaacctctaagacaaatcctaagaaacatggttcagaggaggccaagagaggcgccgcggacgtgagtagccctgaggcttggccccctaaaaaatcttcgttcctccccctctgtgtgagcgggcataggccaagcatcagcagcagttacggcctcgaagaaccaaaggtgcaggaagcaccctctacagaggccggagctcccggcccgtctgtgctgcccaccccatccgaatcgcaagaaccaggggaggagctcccactggaccgagcgtctgaatataaagaattcatacaaaaaatcatcagcatgttgcaggacgctgaagagcagcagggcgaggagcaaccccaggtgcagcaggaggaagtcggagtggagaatcccgctcctcactgtcggcgaaagtcacaggagaagagatcctcatttcggagagcgttttatcacaaaaagcacacctctaaagagcctaggcgggccggggcggcaggtgccgccagccccgaagctagacggccgaaaagaccaagctttctccctctgtgtgtgggcgggcacaggccatcaacaagctcatcattagaccctgaggacctcgaatgccgagaaccactgcccgcggagggcgagccggttgtcatttccgaggccccctcccaggcccgtggtcacacccccgagggtgccccccagttatcaggggcttgtgaaagtaaagagatcattatccagaagctcgttgcattactgcaggaggtggacggccaactgggacaacagatccggcggcatccatccttcaagagatttttctacgaatttagcgacagttctctgagtaagctggtggctacactccggtctcaggtcgcgcacagctctaagctggaccgtaatagggcaaggcggctttaccagtttgatgtgtctctcgccaataaatttgctggcagcaattctcacgctatgtgtatcctcatgggcttgcgagaccactataattgtactcaattcccttatcgtgaggaccagcccaacattacatcacccaaagtagaatctcctgactag

SEQ ID NO: 28229 - DNA, 729 bp, Artificial Sequence
  Description of Artificial Sequence: Synthetic coding sequence
atgatgcctctcgccgaagcaggcgctctggcccagggcgggggcccaagcgccacagaatgggcttgtatcctaagaagaaagaccccgagacataagcagccgaccctcctcatggtgcgggctagtcgtcggtctggtaaaacctcggcagtgctgaaagccggcaggcagtcagtgtccggacgaaagaatagtacttccaaggacctagtgaccctgggcgcctcttcactgagagaggagcgaggacaccctctgcatcctcgtcatagaaaggctgtccacctgcgaacacgcggtcggacccgtgggtgggtgcagacccttgcccggatgtctcgtagaactagaggacctgtggaaagggcagctgctgcagccgcagccgccgctggaggggatgctggacacgctccattcccccccccacctgccgcagatggagccagagcccccaggtcacctgggcaagtgaccccgcgcggccttagactgcgcctccctaggagggagtcgcttcttcggggcctctgtcgtcctctaaggccactactggggtttcgtgagagcgacagcgcaaaacctgcttcgctgcggctcctccaacatactccctccgccaggagaaactacagaatagcaggagcccgactgatgcggtcaaattaccccccaccattgtctagtgcagcactaaggggcgccggccccactagaagaaattag

SEQ ID NO: 28230 - DNA, 318 bp, Artificial Sequence
  Description of Artificial Sequence: Synthetic coding sequence
atgatgcctttggcagaagccggggccctggctcagggaggcggcccaagcgccaccgaatgggcctgtattctgagaaggctgctcaggaaagagggcgtggatggagggctgttttccccagaagatcctcaggcgcaggcagcacacctgaccgacggacaatctatccagaaaaagtggcaggatttttcttgtccgcagagcaggaagacagagtgcttttggcaaaaggaacagcacaaacaacgatccggaaacccacgctgcctgcagtttgaaggtggcgagcgcacaccaccccccccacaaacatag

SEQ ID NO: 28231 - DNA, 243 bp, Artificial Sequence
  Description of Artificial Sequence: Synthetic coding sequence
atgcctttccagttcggaacacagccaagaagattccccgtcgaaggcggtgattcgagcatcgagctggaaccagggctctcaagtagcgccgcatgtaacggaaaagagatgtcccctacccggcagcttcgccggtgccccggatcccactgcctcactatcacagatgtccccgtcaccgtctacgcaactacgagaaaaccaccagctcaatcatctaaagagatgcatcctaagtag

SEQ ID NO: 28232 - DNA, 306 bp, Artificial Sequence
  Description of Artificial Sequence: Synthetic coding sequence
atggagcgtccccggagtccgcagtgtagtgcccctgcatccgcatctgcaagcgtcaccctcgctcagctgctccagctggtccagcaggggcaggaactccctggactggagaagcgacacatagccgccatacacggggaaccgaccgcctcaaggctcccccggcgacctaagccgtgggaggctgcagctttggcggaatcactgccgccccctactcttaggataggcaccgcgcctgctgagcccggactggtagaggcggcaaccgcaccttcctcttggcacactgtgggaccttag

SEQ ID NO: 28233 - DNA, 276 bp, Artificial Sequence
  Description of Artificial Sequence: Synthetic coding sequence
atgtggcacagcgtgggcctcacgcttttggtttttgtggcgactcttctgatcgtgttgcttctgatggtgtgcgggtggtactttgtctggcacctgttcctcagcaaatttaagttcttacgtgagctggtcggcgatacaggaagccaggaaggggaccacgagccctcgggcagcgagactgaagaagatacttctagctctccacatcggattcggtccgcccgacagagacgggcgcccgcagatgagggacaccgtcccctgacttag

SEQ ID NO: 28234 - DNA, 582 bp, Artificial Sequence
  Description of Artificial Sequence: Synthetic coding sequence
atggcagttttccttcagctgctgccactgctgttaagtcgggcccaaggcaatccgggagcatcattagatgggcgaccaggcgaccgggtcaatctgagctgcggcggggtttcccacccaatccgttgggtttgggctccgtcatttcctgcctgtaaaggactcagtaagggacgacggcccatcctctgggccagtagctccgggacaccaacggtgcccccccttcagccctttgtaggaaggttacgctcacttgattcagggatcaggagactggagttactcctgtcagcaggcgatagcggcactttcttttgcaaggggcgccatgaagacgaatcaagaactgtgcttcacgtgctgggggataggacctattgcaaggcccccggccccacccatgccctgagtccaccccactcaagtacgtgcgagaatcgtgccccagaagcaagcaaaggtggaagagctcaggatagtagggggcctgggccgggtaccgagcccgcactgtgcgggtccggcccatcaagtcctcagcaagcccccccggctgtgcactccgggccatgctag

SEQ ID NO: 28235 - DNA, 594 bp, Artificial Sequence
  Description of Artificial Sequence: Synthetic coding sequence
atggccgtttttctgcaactcctgccactcttgctttcacgtgcacagggtaaccctggggcttccctggatggtcgcccgggtgatcgggtgaacctctcgtgtggcggtgttagtcatccaatccggtgggtctgggcccccagtttcccggcttgtaaagggttatccaaaggtcgacgccccatcctttgggcctcgtcttccggaactcccacagttcccccactccaaccatttgtaggccgcttgcgttctttagactcaggcatacgccgcttagaactgctgctgagtgcgggagacagtggtacatttttctgtaagggccggcacgaagacgagtcaaggacggtgctgcacgtcttgggcgatcggacatattgcaaagcgccaggtccaacccacgccccccttgtgaaaactgagccacagagacctgtaaaggaggaagagcccaaaatccccggcgacctggatcaagaaccttctctattatacgctgacctggaccatttagccctatcccgtcccaggcgcttgtctaccgctgatccagcagacgcatccacgatctacgccgtcgtggtctag

SEQ ID NO: 28236 - DNA, 714 bp, Artificial Sequence
  Description of Artificial Sequence: Synthetic coding sequence
atggcagtcttcctccagctgcttcccctgcttctgtccagggcacagggtaatccaggagcgtcactggacggcaggccaggtgatcgggtgaatttgtcctgcggcggcgtttcacatcctatcagatgggtctgggcgccctctttccctgcctgtaaagggctgagcaagggccgccgccccatattgtgggcgtctagctccgggacgcctacagttcctccccttcagcctttcgttggacggttgcggagcctggacagcggcatcagaaggctggagctgctcttgtcggccggcgatagcggcacctttttttgtaaaggtcggcatgaggacgaaagcagaaccgtccttcatgtcttgggagaccgcacgtactgtaaggctcctgggcccacacacggctcagtctacccccagttgctgatccccctactgggcgccggtttagtcctcggcctgggcgctctcgggctggtgtggtggctgcacagaagactgccgccgcagccgattggacccctgccccggtttgcattgtcaccccctcacagcagcacctgtgagaatagggcacccgaggcatctaagggcggacgcgctcaagactcacgcggacctggcccggggaccgaacctgccctttgtggaagcggcccaagcagcccccagcaggcccctcctgcagtacattctggaccgtgttag

SEQ ID NO: 28237 - DNA, 726 bp, Artificial Sequence
  Description of Artificial Sequence: Synthetic coding sequence
atggctgtgttccttcagttgctccccctgctgttaagccgcgcccagggtaatccaggcgccagcctcgatggccgacccggcgatcgggtgaatctgagctgtggaggagtcagccatcccatcagatgggtctgggcaccatcatttcctgcctgcaaaggcttatccaaaggacggaggccaatactgtgggcaagctcaagcggaactcccaccgtgccgccgctgcagcctttcgtgggtaggctgagaagcctcgacagcggtatccgcagactggagctgctgctgagtgcaggcgacagcgggacattcttttgtaagggtcgccatgaggatgaatcccgcaccgtactacatgtgctgggcgacaggacatactgcaaggccccaggccccactcacggctctgtgtacccccagctactgatccctctcctgggggccggccttgtgctcgggctgggggccctcggcctggtgtggtggttgcacagaagactgccgcctcagcccatcggaccccttccccggtttgcccccttggtgaagactgagccccagcggccggtgaaggaagaggagcccaaaattcccggcgacttggatcaagaaccatctttactttacgccgatttggaccatctggctttgagtcgccccagacgcctctcgacggccgatcctgctgacgccagtaccatttacgcggtggtggtgtag

SEQ ID NO: 28238 - DNA, 654 bp, Artificial Sequence
  Description of Artificial Sequence: Synthetic coding sequence
atggcggttttcctccagctgctgcccctgctcctgagccgcgcacagggaaacccaggggcttcactggatggccggccaggggatagggtgaacctgagctgcgggggtgtgtcacaccctattagatgggtctgggctccaagttttcctgcttgtaagggactgagtaaagggcgcagacccattttatgggcatcctcgagcggtacacctactgttcccccattacagcctttcgtgggtagactccgatctctcgacagtggaatcaggagactggagctgctcctgagcgccggggactccggtacattcttttgtaaagggagacacgaagatgagtctagaaccgtgctccatgtactaggcgatagaacctactgcaaggcccccgggcccacccacggagcctgtccaaggaacaggttggaccattcactggatttgctctgccccccacatatcgcccctctggtgaaaactgagcctcaaagacccgtgaaagaagaggagccaaaaatccccggcgacttggatcaggagcccagcctgctgtatgcggacctagatcacctggcactgtcacgtcctcgtcgcctttcgacggctgatcctgctgatgcttccacaatctatgctgtcgtcgtgtag

SEQ ID NO: 28239 - DNA, 885 bp, Artificial Sequence
  Description of Artificial Sequence: Synthetic coding sequence
atgtttctgcgccggcttggcggctggcttcctcgcccttggggacgccgaaaaccaatgaggccggaccctccctatccagaacccagaagagtagatagcagcagcgagaattcaggaagtgattgggatagtgctcccgaaacaatggaggatgtcgggcaccccaagactaaggacagcggagcccttcgggtatctagggcggcttccgagccgagtaaagaagagccacaggtcgagcagctggggtcaaaacgcatggactctttaaagtgggaccagccaatctcttccacccaggagagcggcaggctggaggctgggggtgcgtcccctaaactcagatgggaccacgttgattctggaggcactagaaggccaggagtcagccccgaggggggccttagcgtcccaggaccgggcgctccccttgagaaacctggacgccgcgagaaactgctgggctggctgaggggcgagccaggcgcaccttccaggtatctggggggccccgaggaatgtttacagataagcactaacttgacactccacttattggaactgctagcctctgccctgttggccctgtgtagcaggccgctccgtgcggccctcgacaccttaggcctgagaggcccccttgggctgtggctgcatggacttctaagcttcctggccgctcttcatgggcttcacgccgtgcttagcctgcttacggcccacccactccacttcgcctgcttgtttggacttctgcaggccctggtgcttgcagttagcctgcgggaaccaaacggtgacgaggccgccactgattgggaaagcgagggactggagagggagggcgaagagcaaagaggggatccaggaaagggactgtag

SEQ ID NO: 28240 - DNA, 885 bp, Artificial Sequence
  Description of Artificial Sequence: Synthetic coding sequence
atgttcctgcggcgcttaggcgggtggctgcccaggccttgggggagacggaaaccaatgcggcccgacccgccctacccagagccacgacgggtagatagttcatccgagaacagcggcagtgactgggacagcgctcccgaaaccatggaggacgtgggacacccaaagacaaaagattcaggtgccctaagagtgtcacgcgccgcgtctgagccaagtaaggaagagcctcaggtcgagcagctagggtctaagcgaatggattctttaaagtgggaccagccaatctcatctacccaggaatccggacgactggaggctggaggggcttctccaaagctgcgatgggatcatgtcgattcggggggcacacgcagacccggggtgtctcccgagggaggtctctccgttcctggccctggcgcgcctctagaaaaacccggccgtcgagagaagctgttggggtggctgcgtggggaacccggggcgccttcccgctacttgggcggacccgaggagtgtctacagatttctacaaatttaacactccacttactcgaactactggcctctgcgctgctggcgctgtgtagccgacctcttcgcgccgccctggatacactgggtctccggggacctttggggctttggctacatggcctgctctccttcttggctgcacttcacggcttgcacgctgtgctgagtttgctgacggcccatccgttgcacttcgcctgcctgtttgggctcctgcaggcactggtcctcgctgtttccttgcgcgaacccaatggcgatgaggccgcaacagactgggaatccgagggcttagagcgggagggagaagagcagcgcggcgacccgggcaagggcctctag

SEQ ID NO: 28241 - DNA, 885 bp, Artificial Sequence
  Description of Artificial Sequence: Synthetic coding sequence
atgtttcttcgacgtctcggaggttggttgccaaggccctgggggcgccgcaagccgatgcggcccgatccaccctatcccgagcctcgccgcgtggactcctcctccgagaatagcggcagcgactgggattcagcccctgagacaatggaggatgtggggcacccgaagacaaaggacagtggagctcttagagtatccggagccgcctccgagccatccaaagaggaacctcaggttgaacagctcggaagcaagaggatggattcattgaagtgggaccagcccatcagctctacccaggaatcaggccgactagaagccgggggggcatcacccaagctgcggtgggaccacgtggactctggcggaacgcgccgccccggcgtaagtccagagggcggtctaagcgttccaggacctggagctcctttggagaagcccggaagacgggagaagttgctcggatggctgagaggagaacctggagctcctagcaggtatctgggcggtccagaggaatgcctccagatcagcactaatctcacgctgcatctgttagagctgctggcctccgctcttctagccctgtgttctagacctctgcgagccgcactggatacactcggcctccgaggaccgttaggactgtggttgcacggcttgctgtccttcctggccgcccttcacggtttgcacgctgtcttgtctctgctgacagcccatcctctgcatttcgcctgcctgttcgggctgcttcaagcactggtattggcagtaagcctgcgggaaccaaacggcgacgaagcggccaccgactgggagtctgaggggctcgaaagagaaggtgaggaacagcgcggagatcccgggaaggggctctag

SEQ ID NO: 28242 - DNA, 885 bp, Artificial Sequence
  Description of Artificial Sequence: Synthetic coding sequence
atgttcctgcgccgcctgggagggtggttaccccgaccatggggacgacggaaacccatgcggccagatccaccgtaccctgaaccacgccgagttgacagctcaagcgaaaactctggatcagattgggactctgcgcctgaaacaatggaggatgtgggacatcccaagacaaaagactcaggagccctgcgagtgtcccgggctgcgagtgaaccaagcaaagaggaaccccaagtcgaacagcttggctcaaaaaggatggattcgctgaaatgggaccaaccaatctcttccacacaggagtccgggcgccttgaggccgggggggcctcaccaaagctacgctgggaccatgtcgactccggaggtacccgcagacctggcgtttcacctgaggggggactgtccgtgccaggtccgggtgctccacttgaaaaaccaggccgccgggagaagctgctgggatggcttaggggcgaacccggggctcccagcagatacctaggagggccagaggaatgtctccaaataagtacaaatctcactcttcaccttctggaactgctagcctcagctctcttggccctgtgcagcagacccctcagagccgcactggacacactgggactccggggcccactagggctgtggctccatggcctgctctcgttcttggccgccctacatggtcttcacgcggtattgagcctcctgacagcccacccccttcatttcgcttgtttatttgggctgctgcaggccctggtgctcgcagtttcacttcgtgagccgaacggcgacgaggctgctacagactgggaatccgagggattggagcgcgaaggtgaagagcagagaggagaccccggtaagggtctgtag

SEQ ID NO: 28243 - DNA, 885 bp, Artificial Sequence
  Description of Artificial Sequence: Synthetic coding sequence
atgtttctgaggcgcttagggggatggctcccacgcccgtggggccgcagaaagcccatgcgtccggaccccccataccccgaacctaggagagtagattcatccagcgagaatagtggctccgactgggactcagcacccgagactatggaagacgtgggacatccgaaaactaaggactcgggggccctgagagtctcaagagcagccagcgagccctctaaggaagaacctcaggtggaacagttgggcagcaagcggatggactccctgaaatgggatcaacctatttctagcacgcaggagagcggcagactcgaagctggcggtgctagtcctaaattgcgttgggaccacgtagattccgggggaacgagacgccctggggtgtctcctgaagggggtttgtccgttcccggaccaggggcacccctggagaagcctggaagaagggagaagctattggggtggctgaggggcgaaccaggcgcaccaagcaggtatctgggtggacctgaagagtgccttcaaatctccaccaacctgactctgcatctcctggaactcttggcaagcgccctccttgctctctgctctcgcccattgagagctgccctcgacacactcggcctccgggggcctctgggcttgtggctccacggcttgttaagcttcctcgctgccctccacgggttgcacgcagtgttatccctgctgactgctcaccccctgcacttcgcctgtctgtttggacttctccaagctctagttttggcggtgtctctgagagaacctaacggggacgaagctgctacggactgggagtcagaagggcttgagagggaaggggaagagcagcggggagaccccggaaaggggctttag

SEQ ID NO: 28244 - DNA, 885 bp, Artificial Sequence
  Description of Artificial Sequence: Synthetic coding sequence
atgtttctcagaaggctgggagggtggcttccaagaccgtggggacggagaaaacctatgagaccggacccaccgtaccccgagccccgccgggtagacagcagtagtgagaactctgggtctgactgggacagcgcgccggagaccatggaggacgtgggacatccaaaaaccaaggacagcggagccctgagagtatcaagggcagcctccgagccttctaaggaagagccccaggtggaacagctgggttcaaaaaggatggactcactgaagtgggaccaaccaatcagctctacccaggagtcaggcagactagaagcagggggggcatcaccaaagttgagatgggatcacgtggacagcgggggcacacggaggcccggggtgtcaccggagggcggtctttccgtgcccggacccggagcgccactggaaaagccaggacgacgagaaaagctcctcgggtggttgcgaggtgagccaggagctccctctagatatctcgggggacccgaggaatgcctgcagatcagtacaaaccttactttacacctactcgagctgcttgccagcgctctattagccttatgtagccgccctctacgagccgcccttgacaccttaggtttgcggggccctttgggactgtggctccacggcctgctgtccttcctggccgccttgcatggactacacgccgttctgtcgcttttgacagctcaccctttgcacttcgcttgccttttcggacttctccaggctctggtactggctgtatccctgagggaaccaaacggcgatgaagctgcaacagactgggaaagcgaaggacttgaaagagaaggcgaggaacagcgtggggaccccgggaagggtttgtag

SEQ ID NO: 28245 - DNA, 885 bp, Artificial Sequence
  Description of Artificial Sequence: Synthetic coding sequence
atgttcttgaggcgtttgggcggttggctccccaggccttggggccggaggaagcccatgaggccggacccgccataccctgaacccaggagagtagattcctcatcagagaactccggctccgactgggacagtgctccggagaccatggaggatgtgggacaccctaagactaaagattcaggagccctccgtgtgtcaggggcagctagcgagccatcaaaggaggagccccaggttgaacagctgggctcaaaaaggatggattccttaaaatgggaccagccaatatcctccacccaggagagcggacgcctggaggccgggggagccagtccaaagttgcggtgggaccacgtcgacagtgggggaactcgtagacctggcgtatctccggaaggaggtttaagcgtaccgggacccggggcgccgctggagaaacccgggagacgggaaaagctgctgggatggctgcgtggagagcccggcgcacccagccggtatttgggagggcctgaggaatgtctgcaaatatcaactaacttaacacttcacctgctggagttgcttgcaagcgctcttctggctctctgtagccggcctctgcgagcagctctggatacccttgggttgcgaggacccttaggactgtggctgcatgggctactcagcttcctggccgctctgcacggactgcacgctgtgctctcactgttgacagcccatcctctccactttgcttgtttgttcgggctgctgcaggccttggttctagccgtctccctgcgagagcccaatggggatgaagctgccaccgattgggaaagcgagggtctggaacgggagggcgaggagcagcggggagacccaggtaaggggctctag

SEQ ID NO: 28246 - DNA, 936 bp, Artificial Sequence
  Description of Artificial Sequence: Synthetic coding sequence
atgttccttcgtagactgggtggatggctcccgaggccctggggccgaagaaaaccaatgcgaccggatcccccttaccctgagccaaggcgggtcgatagtagcagcgaaaactcagggtccgactgggacagcgccccggaaacaatggaggacgttggccaccctaaaaccaaggatagcggcgcactgagagtctctggtgctgcatctgaaccctccaaggaagaaccgcaggtcgaacagctggggtcgaagagaatggatagtctcaagtgggatcagccaatcagttccacccaggaatccggaagactggaggccggtggagccagcccaaagctgagatgggaccatgtagattcggggggtaccaggcgcccgggagtgtcacctgaaggagggctgtctgtgcctggacctggcgccccattggagaagcccggtcgtagagagaaattgctgggttggctacgaggggagcccggagcaccctcgcgatacttgggaggcccagaggagtgcctgcaaatttcaacgaacctgaccctgcatctactggagctgttagctagtgccctattggccctctgctcacgaccacttagggccgcactcgataccctgggcctcagagggccattaggcctgtggctgcacggattgttaagttttctcgcggctcttcatggacttcacgcagtccttagtctgctgaccgcgcacccactgcacttcgcatgcttgttcgggttgctgcaggcacttgtgttagcagtgtcagggtcaccaatgggcatgcgaagacctcttaccggaagggtccggggctggagaggcaaagtgaggtcgcgcggagagacaagagagcggggttgtgatcgcggagtgggggccaaaggagaggagtcagtgggattccggagaaaagtctag

SEQ ID NO: 28247 - DNA, 228 bp, Artificial Sequence
  Description of Artificial Sequence: Synthetic coding sequence
atggagcggagcttcgtttggctgagctgtctggattctgacagctgcaatctcacattcagactcggggaggtggaatctcatgcctgctctccctcactattgtggaaccttttaacacagtatctgccccccggtgccggccacattctacgtacctacaacttcccggtgttgtcctgtgtgagctcctgtcacctcattggaggtaaaatgcctgaaaattag

SEQ ID NO: 28248 - DNA, 228 bp, Artificial Sequence
  Description of Artificial Sequence: Synthetic coding sequence
atggagcgaagtttcgtctggttgtcctgcctggattctgactcatgtaatctcacgtttcgtctgggcgaagtcgagagtcacgcatgtagccccagcttgctttggaacctgctgacacagtacctgccgcctggcgccggccacatcctccgcacatataatttcccggtccttagctgtgtgtctagttgccatctgatcggtggtaaaatgcccgaaaactag

SEQ ID NO: 28249 - DNA, 378 bp, Artificial Sequence
  Description of Artificial Sequence: Synthetic coding sequence
atgagagtggtgatggcaagattgctgagcgaaggcgagcaggggattccaacggcctgtgccgctttcgctcagcagcctgctggtccacgaagaggccttgcgggcgtgggagagggaggtccccagtgttcctgggtgaactataggtgcaccctagaattcctcgttagcttactgggtacagatctcgcgagagggcgcggaaacagcgcatctgggccaaccgctcccgcagattccaaacagcttatgaattccggaagtccagccagagacaacgcaccaagccagaggttttgcacgaatttgtccgaggggctgaggtttggcattagcccctcctggagggaagccctatatgggtgccacgcatag

SEQ ID NO: 28250 - DNA, 228 bp, Artificial Sequence
  Description of Artificial Sequence: Synthetic coding sequence
atggagaggtcttttgtgtggttgtcctgtcttgactcggatagttgtaatctgaccttccgactgggagaagtcgaatctcacgcatgcagtcctagcctgctatggaatttgttaacccagtacttacctccaggggccggacacattctgaggacttacaatttccctgtgctttcctgtgtgagctcttgtcacctgatcggcggaaaaatgccagaaaattag

SEQ ID NO: 28251 - DNA, 228 bp, Artificial Sequence
  Description of Artificial Sequence: Synthetic coding sequence
atggaacggtcgttcgtgtggctttcttgcttggatagcgatagctgtaatctcactttccggctgggtgaagtggagagccatgcatgttcgccgagcctgctgtggaacctgctgacacagtatcttccccccggcgctggccacattctccgaacatacaatttcccagtgctgagctgtgtatcatcatgccatctcattgggggaaaaatgccagagaactag

SEQ ID NO: 28252 - DNA, 228 bp, Artificial Sequence
  Description of Artificial Sequence: Synthetic coding sequence
atggagcggagcttcgtctggctgtcctgcctggactccgactcttgcaatctaactttccgcctgggcgaggttgagagtcatgcatgtagcccttctctgctctggaatctgcttacacaatatctgccacctggcgccggccacatacttcgtacatacaactttcccgtgctatcttgtgtgagcagttgtcatctgattggcggcaaaatgccagaaaactag

SEQ ID NO: 28253 - DNA, 228 bp, Artificial Sequence
  Description of Artificial Sequence: Synthetic coding sequence
atggagagatcatttgtgtggctgtcctgcctggattctgacagttgtaacctgacattcaggctgggggaggtcgagtcccatgcctgttccccttcgctgttgtggaacctactgacacagtatctgccaccgggggctggacatattttacggacctacaacttccctgtgctgagttgcgtgtcttcttgccatctgatcggaggtaagatgcctgaaaattag

SEQ ID NO: 28254 - DNA, 228 bp, Artificial Sequence
  Description of Artificial Sequence: Synthetic coding sequence
atggagcggagctttgtgtggctttcctgtctcgattcagattcatgtaatctgacgttcagactgggcgaagtagagagtcatgcttgttccccaagtttactgtggaatctccttacacaatatctacctccaggcgcgggtcacattctccgcacatacaatttccccgttctgagctgcgtttcttcttgccacctcatcggaggcaagatgcctgagaattag

SEQ ID NO: 28255 - DNA, 228 bp, Artificial Sequence
  Description of Artificial Sequence: Synthetic coding sequence
atggagcggagcttcgtctggttgtcctgccttgatagtgatagttgtaacctcacttttcgactgggggaggttgaatcacacgcctgcagccctagtctgttatggaacttgttaactcagtacctgcctcccggcgcaggccacatcctgagaacctacaatttcccagttctgtcctgcgtgagcagctgtcatttaataggcggtaagatgccagaaaattag

SEQ ID NO: 28256 - DNA, 228 bp, Artificial Sequence
  Description of Artificial Sequence: Synthetic coding sequence
atggagcgatcattcgtgtggctgtcctgcctggactcagattcatgtaacttgacatttaggctgggggaagttgagtcacatgcctgttcgccttcactcctctggaacctactcacacagtacctcccgcctggggccgggcacatactgcgcacttacaattttccggtgctatcctgcgtctcttcctgccacttgataggcggtaaaatgcctgagaactag

SEQ ID NO: 28257 - DNA, 228 bp, Artificial Sequence
  Description of Artificial Sequence: Synthetic coding sequence
atggagcggagctttgtgtggttgtcctgcctcgatagcgattcttgcaatctgacatttagactcggtgaagtggagtcccatgcttgctcaccctcactgctttggaacttgttgacacagtatctcccgccaggcgctggccacatcctgaggacttacaacttccctgttctaagctgcgtgtcaagctgccatctgattggaggaaaaatgccagagaattag

SEQ ID NO: 28258 - DNA, 228 bp, Artificial Sequence
  Description of Artificial Sequence: Synthetic coding sequence
atggaaaggtctttcgtatggttgtcttgcttggacagtgattcttgcaatttgactttccggctaggcgaagtggagtcacacgcttgtagcccctccctgctgtggaacctcctgacccagtacttgcccccgggggccgggcacatactgcgcacatataacttccctgtgctctcctgtgtgtcaagctgccatctcatcggcggaaagatgccagaaaactag

SEQ ID NO: 28259 - DNA, 228 bp, Artificial Sequence
  Description of Artificial Sequence: Synthetic coding sequence
atggaacggagttttgtgtggctgagctgtctggattcagatagctgcaacttaaccttccgcctcggcgaggtggagtcacacgcctgcagcccatctttactgtggaacctgctgacccagtacttacctccaggggccggacatatccttcgaacctacaatttccctgtcctctcatgcgtgagcagctgccacctcatcgggggaaaaatgcccgaaaactag

SEQ ID NO: 28260 - DNA, 228 bp, Artificial Sequence
  Description of Artificial Sequence: Synthetic coding sequence
atggagcggtcttttgtatggctgtcctgcctggattcggattcttgtaacctaacctttagactcggcgaagttgagagccatgcctgttccccctctttgctttggaatctgctgacccagtacttgcctccaggcgccggacatatcctcaggacctacaacttcccagttctctcatgtgtttcttcttgtcatctcattggtggtaaaatgcccgaaaattag

SEQ ID NO: 28261 - DNA, 228 bp, Artificial Sequence
  Description of Artificial Sequence: Synthetic coding sequence
atggaacgcagtttcgtatggctgagctgtttggattccgattcttgcaatctgacctttcggctgggcgaagtggagtcacatgcatgttcccctagtcttttatggaacctgttaacccaatatttgccaccaggtgcgggccacatcctgcggacatacaactttcctgttctgtcctgtgtgtcaagttgccacctaataggcggaaaaatgcccgagaactag

SEQ ID NO: 28262 - DNA, 228 bp, Artificial Sequence
  Description of Artificial Sequence: Synthetic coding sequence
atggagaggtcatttgtttggctgtcctgcctcgatagtgactcatgtaacttaacattccggctgggagaagttgagtctcatgcctgctcaccttctctcctgtggaatctcctgacgcaatacttgcccccaggtgccgggcatatcctccggacctataactttccggttttaagctgtgtgagctcttgtcatttgatcggaggcaagatgcccgaaaactag

SEQ ID NO: 28263 - DNA, 228 bp, Artificial Sequence
  Description of Artificial Sequence: Synthetic coding sequence
atggaacgcagcttcgtatggttaagctgtctggattccgacagctgcaacctcacctttcgcttgggggaggtggagtcacatgcatgcagcccatctctcctgtggaatctgttgacccagtaccttcctcctggagcggggcacatcctcaggacctacaactttcctgtgttatcatgcgtctcctcatgccacttgattggagggaagatgccagagaactag

SEQ ID NO: 28264 - DNA, 228 bp, Artificial Sequence
  Description of Artificial Sequence: Synthetic coding sequence
atggagaggagcttcgtttggctgtcctgcttggactccgatagttgtaatcttacattccgcctgggggaggttgagtcacacgcctgtagtcctagcctcctgtggaatctgctgactcagtatctgccacctggcgcaggccacatcctgaggacatacaactttcccgttctgagctgcgtttcttcctgccatctcattgggggaaagatgcccgagaattag

SEQ ID NO: 28265 - DNA, 228 bp, Artificial Sequence
  Description of Artificial Sequence: Synthetic coding sequence
atggagcgctctttcgtctggctgtcatgcctcgactctgattcttgtaacctgacctttcgcttaggcgaggttgaatctcatgcgtgttctccaagcctgttatggaacctccttacccagtacctcccgccaggagccgggcatatcctccgtacctacaatttcccagtgctctcttgcgtgtcgtcttgtcacttgattggaggtaagatgcccgaaaactag

SEQ ID NO: 28266 - DNA, 228 bp, Artificial Sequence
  Description of Artificial Sequence: Synthetic coding sequence
atggagagaagtttcgtctggctctcttgcttggattcagacagctgcaatctcacctttagactaggcgaggttgaaagccacgcctgttctccctccctgctctggaatctactaacccagtatctgccaccgggagccggacacattttgcggacctataattttcccgtactctcgtgcgtatctagttgtcacctcatcgggggcaagatgccagagaattag

SEQ ID NO: 28267 - DNA, 228 bp, Artificial Sequence
  Description of Artificial Sequence: Synthetic coding sequence
atggagagatcctttgtatggctatcttgcctcgactctgacagctgtaatttaaccttcaggctaggtgaggtggaatcacacgcctgcagtccaagcctgctatggaacttgctgactcagtacctgcctcccggagccgggcacatcttacgaacatacaattttcccgtgttgtcctgtgtgagcagctgtcatttgatcggtggcaaaatgcctgagaactag

SEQ ID NO: 28268 - DNA, 228 bp, Artificial Sequence
  Description of Artificial Sequence: Synthetic coding sequence
atggagcgctcttttgtgtggttatcatgcttggactctgacagctgtaacctgacttttagattgggcgaggtagagtcccatgcgtgttctccttctctgctttggaacttacttacgcaatacttgcccccgggcgccgggcacatcttgcggacgtacaactttcctgtcctaagctgtgtctcttcatgccaccttattggtgggaagatgcccgagaactag

SEQ ID NO: 28269 - DNA, 228 bp, Artificial Sequence
  Description of Artificial Sequence: Synthetic coding sequence
atggagcgttcttttgtgtggctgtcgtgtctagactccgacagctgtaacctcacttttagacttggagaagtcgagagccacgcttgttctcccagcttgctatggaatctgttaactcaatacttacccccaggagcggggcacatcctgaggacctacaattttcctgtcctaagctgcgtgtcaagttgtcacctcataggcgggaaaatgcctgaaaactag

SEQ ID NO: 28270 - DNA, 228 bp, Artificial Sequence
  Description of Artificial Sequence: Synthetic coding sequence
atggagcgcagctttgtttggctcagttgtctagactcagactcctgtaatctgacttttcggttgggcgaggtcgagagtcatgcatgtagtccgtccctgttgtggaacctcctgactcaatacctaccgcccggagccgggcatatactgagaacatacaacttccccgtgttgtcctgcgtgtcctcatgccacctcattggtggaaagatgcccgagaattag

SEQ ID NO: 28271 - DNA, 228 bp, Artificial Sequence
  Description of Artificial Sequence: Synthetic coding sequence
atggagcgcagctttgtttggttgtcatgtttggattctgactcttgcaacttaactttcaggcttggagaagtcgagtctcacgcttgctcgcctagtctattgtggaatctgttgacacaatacctcccacctggggcgggacatatcctcagaacatataattttcccgtgctgagctgcgtctcctcttgtcacctgatcgggggcaagatgcctgaaaactag

SEQ ID NO: 28272 - DNA, 228 bp, Artificial Sequence
  Description of Artificial Sequence: Synthetic coding sequence
atggagcgttcgttcgtgtggttatcatgccttgactctgattcctgcaacttgacgttccggctcggagaggtggaatcccacgcctgctctccaagcctgctgtggaacttactcacacaataccttcccccaggcgccgggcacatcctcaggacctataacttccccgttttatcctgtgtcagtagctgccacctcattgggggcaagatgcctgagaattag

SEQ ID NO: 28273 - DNA, 228 bp, Artificial Sequence
  Description of Artificial Sequence: Synthetic coding sequence
atggagcgctcattcgtgtggctgagctgcctggactcagattcctgtaacctgacctttaggttgggtgaggtcgaaagtcatgcatgcagcccctcactgctgtggaatctcctgactcaatacttaccccccggtgctggccacattctgagaacttataattttcccgtgctgtcctgcgttagctcttgtcatctgattggaggaaagatgccggaaaattag

SEQ ID NO: 28274 - DNA, 228 bp, Artificial Sequence
  Description of Artificial Sequence: Synthetic coding sequence
atggaaaggtctttcgtgtggttgtcctgcctcgactcagacagctgtaatctcacgttccggcttggcgaggtcgaatcccacgcatgcagcccctcccttttgtggaatctcttaactcagtatctcccaccgggcgctggccatattctgagaacatataacttccctgttctgtcttgcgtttcatcatgtcatctgattgggggcaagatgcccgagaattag

SEQ ID NO: 28275 - DNA, 228 bp, Artificial Sequence
  Description of Artificial Sequence: Synthetic coding sequence
atggagcggtctttcgtttggctgagctgtctagatagcgatagctgtaatctgacgttccgtctgggtgaagtggagtcccacgcgtgtagcccaagtttattgtggaatttacttacacagtacctgcccccaggtgcaggccatatattgagaacttacaattttcctgtactgagttgtgtgtcaagctgccacctgataggcggcaagatgcccgagaactag

SEQ ID NO: 28276 - DNA, 228 bp, Artificial Sequence
  Description of Artificial Sequence: Synthetic coding sequence
atggagagaagtttcgtttggttgagctgtctcgacagcgattcatgcaatctgacttttcgtcttggagaggtcgaatcacatgcgtgctccccgtcattgttgtggaacctgctgacacaatatcttcccccaggagcaggtcatatcctgagaacttacaacttccccgtgctctcctgtgtcagtagctgccacctaatcggaggtaagatgcccgagaactag

SEQ ID NO: 28277 - DNA, 228 bp, Artificial Sequence
  Description of Artificial Sequence: Synthetic coding sequence
atggaacggtccttcgtgtggctgtcctgtctggacagtgatagctgcaacttgaccttcagactgggagaggtggaatctcatgcatgtagcccttctttgttgtggaacctcttgactcagtacctgcctcccggtgcgggacacatcctcaggacatataattttcccgttctgtcatgtgtttcttcctgccatctaattggcgggaaaatgccagagaactag

SEQ ID NO: 28278 - DNA, 228 bp, Artificial Sequence
  Description of Artificial Sequence: Synthetic coding sequence
atggaaaggagcttcgtttggctatcttgcctcgattctgattcctgtaatttaacgttccgcctgggcgaggttgagtctcacgcatgcagtccatcactgctgtggaatcttctgacccagtatcttccaccaggtgccggacatattctgcgaacttacaatttccccgtgctgagctgtgtttcgagctgtcaccttattggtggtaagatgccagagaactag

SEQ ID NO: 28279 - DNA, 228 bp, Artificial Sequence
  Description of Artificial Sequence: Synthetic coding sequence
atggagcgaagctttgtgtggctcagctgcctcgatagcgactcatgcaatctgacgtttaggctgggagaggttgagtcacacgcatgcagtccttccctcctgtggaaccttttgacacagtacttaccacccggggccggacacatcctgaggacctataacttcccggttctctcatgcgtgtcatcgtgccacctgatcggcggcaaaatgcccgaaaattag

SEQ ID NO: 28280 - DNA, 228 bp, Artificial Sequence
  Description of Artificial Sequence: Synthetic coding sequence
atggaacgatccttcgtgtggctctcgtgcttggatagtgatagctgtaaccttacattccgactgggcgaggtggaaagtcacgcgtgcagccccagtctactttggaacttactgacccagtacctgcccccgggggctggccacatactgcggacctacaatttccctgtcctgagctgtgtttcttcctgccacttaattgggggaaagatgcccgaaaactag

SEQ ID NO: 28281 - DNA, 228 bp, Artificial Sequence
  Description of Artificial Sequence: Synthetic coding sequence
atggaacgttcatttgtgtggctgagctgccttgactccgatagttgcaacctgacttttaggctgggggaggtggagtcacacgcttgttccccctccctgctgtggaacctgttgacgcaatacctcccaccgggtgctggacacattctcagaacttataattttccagttctgagttgtgtgtcctcatgtcatctaattggcggaaaaatgcccgagaattag

SEQ ID NO: 28282 - DNA, 228 bp, Artificial Sequence
  Description of Artificial Sequence: Synthetic coding sequence
atggaacggtccttcgtctggctcagctgtcttgactctgattcctgtaacctgacgtttagattgggggaagtggagagtcacgcctgttcaccatccctcctatggaacctactcacccagtatctgccaccaggggccggtcatatcctgcgaacatacaattttccagttttatcatgtgtgagcagctgccatctgattgggggaaagatgccagaaaactag

SEQ ID NO: 28283 - DNA, 228 bp, Artificial Sequence
  Description of Artificial Sequence: Synthetic coding sequence
atggagcggagctttgtctggctctcatgcctagacagtgactcctgtaacctgacgttccgattgggcgaggttgagtcccacgcttgtagccccagtctgctctggaacctcttgacccaatatctcccacccggcgctggtcacattctcaggacctataatttccccgtgctctcttgcgtaagtagctgccacctaatcgggggaaagatgcccgagaattag

SEQ ID NO: 28284 - DNA, 228 bp, Artificial Sequence
  Description of Artificial Sequence: Synthetic coding sequence
atggaaagatccttcgtatggctgtcctgccttgattccgattcctgcaatctgaccttccgccttggcgaagtggagtcacacgcgtgctctccaagtttgctgtggaaccttcttactcagtacttgccccctggcgcgggtcacatcttgcgcacatataactttcccgtgctgagctgtgtttcatcttgccacctgatcggagggaaaatgcccgagaattag

SEQ ID NO: 28285 - DNA, 228 bp, Artificial Sequence
  Description of Artificial Sequence: Synthetic coding sequence
atggaaaggagcttcgtttggttatcctgcctcgactctgactcatgtaatttgacctttaggctaggagaagtcgaaagtcacgcttgcagcccatctcttctgtggaatctattgacccagtaccttcctcctggggcaggccatatcctgagaacatataactttcctgtgctgtcatgtgtctcgtcatgtcacctgatcggcggaaagatgcctgagaactag

SEQ ID NO: 28286 - DNA, 228 bp, Artificial Sequence
  Description of Artificial Sequence: Synthetic coding sequence
atggagcgaagctttgtgtggctgagctgcctcgattctgatagctgcaatcttacattcaggctgggagaagtagagtctcacgcatgttcaccatctctgctgtggaatctgctaacccagtatttgccaccaggcgccggccatatcttgcggacttacaactttcccgtcctgagttgcgtttcaagctgccatctcatagggggtaagatgcccgaaaattag

SEQ ID NO: 28287 - DNA, 228 bp, Artificial Sequence
  Description of Artificial Sequence: Synthetic coding sequence
atggagcggagcttcgtttggctaagctgtttggatagcgatagctgtaacctcaccttcagacttggtgaggtcgagagtcatgcatgctcaccctctttactgtggaaccttcttacacaatacctccctcccggggcgggccacatcctaagaacatacaatttcccagtcctctcctgtgtgtcatcctgccacctaattgggggaaaaatgcctgaaaactag

SEQ ID NO: 28288 - DNA, 228 bp, Artificial Sequence
  Description of Artificial Sequence: Synthetic coding sequence
atggaaagaagtttcgtatggcttagctgcctcgatagcgactcttgcaatctcacttttcgactgggtgaggtggagtcacatgcctgctcaccgagtttgctgtggaacttgcttacacagtacctgcctcctggcgcagggcacattttgaggacatataattttcctgtcctaagctgcgtctctagttgtcacctgattggcggaaagatgcccgagaactag

SEQ ID NO: 28289 - DNA, 228 bp, Artificial Sequence
  Description of Artificial Sequence: Synthetic coding sequence
atggagaggtccttcgtgtggctctcctgcctggacagtgactcctgcaatctgactttccgcctgggcgaagttgaaagccacgcctgcagcccctcgctcctgtggaacctgcttactcagtacttgccccctggggcagggcatatcctgcggacttataatttccctgtgctctcctgcgtcagttcatgtcatctaatcggaggcaaaatgcctgagaattag

SEQ ID NO: 28290 - DNA, 228 bp, Artificial Sequence
  Description of Artificial Sequence: Synthetic coding sequence
atggagcggagttttgtgtggctctcctgcctcgacagtgacagttgtaatcttacatttaggttgggggaagtcgagagccacgcctgcagcccatccctgctctggaatctcctcacacagtacctccccccgggcgcggggcatattctccgaacatacaattttcctgtcctatcatgcgtttcgtcctgtcacctaattgggggtaagatgccagagaactag

SEQ ID NO: 28291 - DNA, 228 bp, Artificial Sequence
  Description of Artificial Sequence: Synthetic coding sequence
atggagagatcgtttgtgtggctgtcgtgtctagacagcgacagttgtaacttgacgttcagactgggtgaggtcgaatcccatgcctgctccccatcactcctttggaacctccttacccagtacttgcctccaggcgctgggcacatcctgaggacttataatttcccagttttgtcctgcgtgtccagctgccacctgatcggcggcaagatgccggaaaactag

SEQ ID NO: 28292 - DNA, 228 bp, Artificial Sequence
  Description of Artificial Sequence: Synthetic coding sequence
atggagaggagctttgtgtggctgagctgccttgactctgattcgtgcaatcttaccttcaggctgggtgaggtcgagtcacatgcttgttcccccagcttgctttggaatctcctgacgcagtacctgccccctggggcaggacatatcctgcggacctataactttccagtgctcagctgtgtcagtagctgccatctcattgggggtaagatgccggaaaattag

SEQ ID NO: 28293 - DNA, 297 bp, Artificial Sequence
  Description of Artificial Sequence: Synthetic coding sequence
atgcgagtggtcatggcaaggttgttaagcgagggcgagcagggcatccccaccgcctgcgccgcattcgctcaacagcctgcaggacccagacgtggactggccggtgttggtgagggaggtccccagtgctcctgggtcaattatcggtgcactctggaatttctagtaagcttattgggtactgacctcgctagagggaggggcaattctgcgtccggaccaaccgcccccgccgatagtaagcagcttagttgtaaaacatttatcgccgttttgagcctatctaaagagtag

SEQ ID NO: 28294 - DNA, 378 bp, Artificial Sequence
  Description of Artificial Sequence: Synthetic coding sequence
atgcgagtagtgatggctcggctgcttagcgaaggggaacaagggataccaacagcttgcgcggctttcgcccagcagccagcgggcccgcggagaggtctcgcgggagtgggggaaggaggcccacagtgttcttgggtgaactacaggtgtacgttagagtttctggtgagcctgctgggaacagatctggccagagggcgcggaaattcagcttccgggcccaccgctcccgctgactccaaacagctgatgaactccggatccccagccagagataacgcgcctagccaacgattttgcaccaatctgtctgagggtctccgatttgggatttctccgtcttggagagaagccctgtatgggtgccacgcgtag

SEQ ID NO: 28295 - DNA, 297 bp, Artificial Sequence
  Description of Artificial Sequence: Synthetic coding sequence
atgagggtcgtcatggcccgcttgctcagcgagggagaacagggtatccccaccgcatgtgctgccttcgcacagcagcccgctgggccaagaagggggcttgccggcgttggcgaaggcgggccacaatgttcatgggttaactataggtgtaccctggagttcttagtgagtctgctcggaactgacttagccaggggcagagggaatagcgcaagtgggccaactgctcccgcagacagcaaacagctgagttgtaagacatttatcgccgttctgtcactgtcaaaggagtag

SEQ ID NO: 28296 - DNA, 378 bp, Artificial Sequence
  Description of Artificial Sequence: Synthetic coding sequence
atgagggtagttatggcgcgtctcttatcagaaggagaacagggcatccccaccgcctgtgccgcatttgcccagcagccagcgggccctaggcggggactggcgggagtgggtgaaggagggccccaatgttcttgggtaaattaccgctgtaccctggaattcctggtaagcctgctcggaaccgacctggcccgcgggcgcggcaactccgcatcaggcccaacagcccctgccgacagcaaacaactgatgaactctggaagcccagcccgggacaacgccccgtcacagcgattctgcacaaatttatctgagggcctgaggtttggaatctctccatcctggagagaggcgctttacgggtgccacgcctag

SEQ ID NO: 28297 - DNA, 297 bp, Artificial Sequence
  Description of Artificial Sequence: Synthetic coding sequence
atgagggtggtcatggcgcggctgctgtctgagggcgagcaaggcattcccacggcttgcgctgcattcgcccagcaaccagccggccccagacggggtctagccggcgtgggggaaggcgggcctcagtgtagttgggtcaactataggtgcaccctggagttcctggtctctctgttagggaccgatttagcacgagggcggggtaatagcgcctcagggccaaccgctcctgccgacagtaaacagctgtcatgcaaaacttttatcgctgtgctgtccctcagcaaggaatag

SEQ ID NO: 28298 - DNA, 297 bp, Artificial Sequence
  Description of Artificial Sequence: Synthetic coding sequence
atgcgagtagtgatggcaaggctcctgtctgagggcgagcaggggatccctactgcttgtgccgccttcgcacagcagcctgctgggccacgcagggggctggctggggtgggagagggcggcccccaatgcagttgggtgaattacagatgcacactcgagtttctggtttccctcctcggcacagatctcgcccggggaagaggcaattccgcgagcggcccaactgctcctgccgacagcaaacaactaagctgcaaaacattcatcgccgttctctctttatctaaagagtag

SEQ ID NO: 28299 - DNA, 378 bp, Artificial Sequence
  Description of Artificial Sequence: Synthetic coding sequence
atgcgcgttgtgatggccaggctactgtccgagggggaacagggaattcccactgcttgcgccgctttcgctcagcagcccgcaggtcctcgccgcggccttgccggcgtcggagagggcggaccgcaatgcagctgggtgaactatcggtgtaccctcgaatttctcgtgtctctgctgggcacggatctcgcccggggacgagggaactctgctagcggacctacagcgccggccgatagtaagcaactcatgaatagtggctctcccgctcgcgacaacgccccttcccaacggttttgtacgaacttgtcagaaggcctccgctttggtatctcgccatcttggagagaagccctctacgggtgtcacgcatag

SEQ ID NO: 28300 - DNA, 378 bp, Artificial Sequence
  Description of Artificial Sequence: Synthetic coding sequence
atgcgagttgtgatggcgagactgctttcagagggtgagcagggaattcccacagcctgcgctgccttcgcgcagcagccggcggggccaaggaggggcctcgctggcgtcggagaaggtggaccccagtgctcctgggtgaattatcgatgtaccttagagtttctggtgtctctgctggggactgatctcgcccgcggcagggggaattcggcaagcggcccgactgcccctgccgattccaagcagcttatgaattctggctctcccgcccgggacaacgccccctcccaacgtttttgtacaaacttgtcagaaggcctccgatttggcataagtccatcctggcgcgaagccctgtacgggtgtcatgcctag

SEQ ID NO: 28301 - DNA, 297 bp, Artificial Sequence
  Description of Artificial Sequence: Synthetic coding sequence
atgagggttgtgatggctcgcctgctaagcgaaggagagcagggcatccccaccgcatgtgccgcctttgctcagcagccagccggacctagacgaggccttgcaggcgttggcgagggagggcctcaatgcagctgggttaactaccgatgtaccctggaatttttagtctccctgctgggcacggacttggctcggggacggggcaattccgcatcaggccctaccgccccagcagattcaaagcagctctcatgcaagacctttatagccgtgctgtcactgtcaaaagaatag

SEQ ID NO: 28302 - DNA, 459 bp, Artificial Sequence
  Description of Artificial Sequence: Synthetic coding sequence
atggcgcagccggagagctccgccgactttggcatagcacaacagaacaattactactgttactggcaaagtctcccctccgctatccgcgtgaagcaagagttccagccaagccagagctatagatatggcaactggtacgcccgacagcacggcagttacctgctgtccggctacagttacggctgcgccgtagacggaaatggcaaggactgtttctctgcacacgagacaccagagcatacagctggcacccttgtcatgccaaaagaaactacccccttggctgagaatcaggacgaggatcccctggaggaccctcatttgcacctgaatatagaggagtcaaaccaggaattcatggtcaagtcggaagagttatacgattccctgatgaactgtcactggcagccgctcgacaccgtacacagcgagatccctgacgaaaccccaaagtag

SEQ ID NO: 28303 - DNA, 198 bp, Artificial Sequence
  Description of Artificial Sequence: Synthetic coding sequence
atgccaaaagagacgacacccctggcggagaaccaggacgaagatcctttggaggacccccacctgcacctgaacatcgaggaatctaaccaggaatttatggttaagtctgaagagctgtatgattcattaatgaactgccactggcaacctctagatacagtgcatagcgaaattccagatgaaactcctaaatag

SEQ ID NO: 28304 - DNA, 603 bp, Artificial Sequence
  Description of Artificial Sequence: Synthetic coding sequence
atgtctgaaaatctgtccgaccccgtgagcccggttgttcgtaagaagaaaagtgcactgtttgaggtaagtgaagtgatcccagtgatgacaaacaattatgaagagaatattcttaagggcgtaagggatagctcttactcattggagagttccctggaactgttacaaaaagatgtggttcaacttcatgcccccagatatcaatctatgagaagagatgtgatcggctgtacacaggaaatggactttatcctatggcctcgcaatgatattgaaaagatcgtgtgtcttttgttctccaggtggaaggagagtgatgaaccttttcgcccagtgcaggcaaagttcgagtttcaccacggtgactatgaaaagcagtttttgcacgtactctccaggaaggataagacaggaatagtcgtgaataatccaaatcagtcagtatttctgtttattgaccgacagcatctccagacccccaagaataaggctactatattcaagctgtgctctatttgcctgtacctcccacaggagcagctcacacattgggcagtggggacaatcgaggatcacttgaggccctatatgcctgaatag

SEQ ID NO: 28305 - DNA, 690 bp, Artificial Sequence
  Description of Artificial Sequence: Synthetic coding sequence
atgggcgaccctaacagtaggaagaaacaagccctgaacaggttgcgtgctcagctccgcaagaagaaagagtcacttgccgaccagtttgactttaagatgtatatcgcctttgtctttaaggagaaaaaaaagaagtccgccctgttcgaagtgagcgaggtcatccccgtgatgaccaacaattatgaggaaaatattcttaaaggtgtgcgggacagcagctactctctggaatccagtctggaacttctccagaaagacgtcgttcagctgcatgcccctcgctatcaaagcatgaggcgtgacgtcatcggctgtactcaggagatggatttcatcttatggcctcgcaacgacattgaaaagatcgtttgtcttctgttcagcagatggaaggagtcggacgagccctttcgacccgtgcaagccaaattcgagtttcaccacggagattatgagaaacaatttttgcatgtgctgtcccgcaaggataagacagggattgtggttaataaccccaaccagtccgtatttctatttattgacagacagcacctgcagactccaaaaaacaaagccacgatatttaagctgtgtagcatttgtctgtacctgcctcaagaacaactgactcattgggcagtggggactattgaagaccatctgcgaccatacatgcccgaatag

SEQ ID NO: 28306 - DNA, 516 bp, Artificial Sequence
  Description of Artificial Sequence: Synthetic coding sequence
atgacaaacaactacgaagagaacattctgaagggggttagggactcctcctactctctagagtcgtctctcgagcttctgcagaaggatgtcgtccagttgcacgcccctcggtaccagtccatgcgacgcgatgtgatcggatgcacacaggaaatggatttcatcctatggccaagaaatgatattgagaagattgtgtgcctgctgttcagtaggtggaaagagtctgacgaacccttccgccccgttcaggccaaatttgagtttcaccatggggactatgagaagcagttcctgcatgtcttgagccgaaaagacaaaaccgggatcgtggtgaacaatcctaatcagtcagtcttcctattcattgatagacagcatttacagacgcctaagaataaggctactatttttaaactatgtagcatctgtctgtacctgccccaggaacagctcacacactgggccgtgggcactattgaagaccatctgaggccgtatatgcctgagtag

SEQ ID NO: 28307 - DNA, 669 bp, Artificial Sequence
  Description of Artificial Sequence: Synthetic coding sequence
atggccggcgctgagccattcttagcagatggcaaccaggagctttttccttgtgaggtgtgtggaaggcggttcgcggccgatgtgctggagcgacacggacctatctgtaagaaactgttcaaccgaaaacgcaaacctttctcgtcacttaaacagcggcttcagggcactgacattcctaccgtcaagaaaactccacagagcaaatcccctccagtgagaaagtctaattggcgccagcaacacgaagacttcattaatgcaatcaggtccgctaaacagtgtatgctggcaattaaagaggggagaccactcccaccccctcccccccccagcttaaatcccgactatatccagaggccttattgtatgcgaaggttcaacgaatccgccgccgagagacataccaacttttgtaaagaccagtcatctcgtcgcgtgttcaatccagcccagaccgctgcaaaacttgctagccgtgcacaagggagggcccagatgggcccgaagaaggagcccacggtcacctctgcggtaggtgcactcctgcagaatcgagtcctggtcgcgaccaatgaggtgccaactaagtcggggctggcaatggaccctgcgtcgggagctaagttaaggcaaggcttctcgaagtccagcaaaaaggactag

SEQ ID NO: 28308 - DNA, 465 bp, Artificial Sequence
  Description of Artificial Sequence: Synthetic coding sequence
tgaggaaaccaggagctattcccttgcgaggtgtgtggcaggcgctttgcagccgacgtgctggaacgacacggaccaatttgtaagaaattgttcaaccgaaagcggaaacccttttctagtctcaagcaacggctgcagggcactgacattcctaccgtgaagaagaccccccaatcaaagtcccctccggtgagaaaatccaattggagacaacaacatgaggactttattaacgcaattagatcggccaagcagtgcatgttggctatcaaggaaggccgtccgcttcccccaccgcctccacccagtctcaatccagattatattcagcggccatattgtatgaggagattcaacgagtcagccgccgagcgacacactaacttctgcaaggaccaatcttcacggagggtcttcaatcctgcccagacggccgccaagcttgcctcccgggctcagtag

SEQ ID NO: 28309 - DNA, 348 bp, Artificial Sequence
  Description of Artificial Sequence: Synthetic coding sequence
cctcctccaccccccagcctgaacccagactatattcagcgtccctattgtatgcggcgcttcaatgaatctgcagcggagagacacactaacttctgtaaggaccaaagctccagacgtgtctttaatcctgcccagactgccgccaaactagcttcacgggcccagggaagagcccagatggggccaaagaaggagcccaccgtgaccagcgccgttggtgcgctccttcagaaccgcgtgctggtcgccacaaacgaagtccccacaaagtccggactggccatggacccagcttccggggccaagctgcggcaaggatttagcaagtcgagtaagaaggactag

SEQ ID NO: 28310 - DNA, 381 bp, Artificial Sequence
  Description of Artificial Sequence: Synthetic coding sequence
atgctagccatcaaggagggtcggcctctacccccgcctccacctcctagcttgaacccagattatatccagaggccatactgcatgcgccgctttaacgagtcggcagcagagcgccacacaaatttttgcaaagatcagagttcacgtcgtgtatttaaccctgcacagactgccgctaagctcgcgagccgcgcccagggccgagcccagatggggccgaagaaagagcctactgtcacttcagcagttggcgccctgctccagaatcgcgtgctggtggcgaccaatgaagtccctactaagtccggcctagccatggaccctgccagcggtgccaaactacggcaaggattttccaagagtagtaagaaggattag

SEQ ID NO: 28311 - DNA, 2148 bp, Artificial Sequence
  Description of Artificial Sequence: Synthetic coding sequence
atgtccttggactgtacttcacacattgcactaggggccgctagtcctgcccctgaggaaacgtatgaccatctatccgaagtgccagttacccgggagcagttaaatcactacaggaacgtggctcagaatgcccgctccgaactagccgctactctggtgaagttcgagtgtgctcagtcagagctccaggatcttcggtcaaaaatgctgtcaaaagaggtctcctgccaggaattgaaggcagaaatggagagttacaaagaaaacaatgcgcgcaaatcgtcactgctgacctctttgcgcgaccgagtgcaggagctggaggaggagtccgccgcgttgagcacttcaaaaattcgcaccgagatcacggcacatgcagcgataaaagaaaaccaggaactgaagaaaaaggtcgttgaactgaatgaaaagttgcagaaatgtagcaaggagaacgaagaaaataaaaaacaggtttcaaagaactgccgtaagcacgaggaattcctgacgcagctaagagactgtctcgatccagacgaaagaaacgataaagctagtgatgaggatctcatcctcaagctgcgggatctccgcaaagaaaacgagtttgtaaaaggtcagatagttatcctcgaggagacaatcaatgtccacgagatggaggccaaggcatcacgcgaaacgataatgaggctcgcttctgaggtgaatcgggaacagaagaaggcagcctcttgtacggaggagaaagagaagctcaatcaggatctattaagcgctgtcgaagcaaaagaggctctggaacgcgaagtgaaaatatttcaagagagactactggccggtcagcaggtctgggatgcgagtaagcaggaggtgtctctgctaaagaaaagctccagcgagctagaaaagtctctcaaagcgtcccaagacgctgtgaccacctctcaaagtcagtacttttcatttcgtgaaaaaatagccgccttgcttcgcgggcggttatctatgacagggagcacagaagatactatactggagaaaatccgcgagatggactctagggaggagtctcgggaccgcatggtttctcaactggaagcacaaatctccgagctggtggagcagctgggtaaagaaagtggctttcaccagaaggcccttcagcgggctcagaaggcagagaatatgcttgagacgttacagggtcagcttacgcatctggaggccgaattagtgagcggaggtgtactgcgcgacaacctcaatttcgagaagcaaaagtacctgaaatttttggatcaactgtctcagaagatgaaacttgaccagatggccgccgagctgggctttgatatgcggttggacgtcgtgctggccagaacggagcagctggttcgacttgaatctaatgctgttatcgaaaacaaaactatcgcgcacaatctgcagcgcaagctaaagacgcaaaaggaaagactagagagtaaagagctgcacatgagcctgttacggcagaaaatcgcgcagttagaagaggagaagcaggctcgcaccgcccttgttgtggaaagggataacgcccacctcactatacggaatctacaaaaaaaagtggagcggctccaaaaggaactgaatacatgtcgagacctgcacaccgaattgaaagccaagttggcagacacaaatgagctgaaaattaaaactctggagcaaacaaaagctattgaggatctaaataagagcagggatcaactcgaaaagatgaaggaaaaggctgagaaaaaactgatgtccgtgaagtcagaactcgatactacagaacacgaggccaaagaaaataaggagcgagctcgtaatatgattgaggtcgtgacttccgagatgaagacgctgaagaagtctctcgaagaggcggagaagagagagaaacagttagctgacttccgtgaagtggtgagccagatgctaggtctgaatgttacatctctggctcttcctgattatgaaatcatcaaatgtctggaaagactggtccacagccaccagcatcactttgtgacttgtgcatgtctgaaggatgttaccacaggccaggaacggcatcctcagggacatctgcagcttctccattag

SEQ ID NO: 28312 - DNA, 2169 bp, Artificial Sequence
  Description of Artificial Sequence: Synthetic coding sequence
atgtccctcgattgcacttctcacatcgcactcggagcagcctcacctgctccagaagagacatacgatcacttgagcgaggttcccgtgaccagagagcaactgaaccattacaggaatgttgctcagaatgctcggtcagaactcgccgctactttggtaaagtttgagtgtgcccagtccgagctgcaggatctgcgctcaaagatgctgagtaaagaggtttcttgtcaggagttgaaggctgaaatggagtcttacaaagagaataacgcccgcaagagcagtttactgacttcactgcgcgaccgggtccaagagttggaggaagaaagtgccgccctgtccacctcaaagatccgtactgaaatcaccgcccatgctgcaatcaaagagaaccaagagttaaagaaaaaggtggtggagctgaacgagaagcttcagaagtgtagtaaggagaatgaagagaacaaaaaacaggtctccaaaaactgtcgtaaacatgaggaatttctaacgcagcttcgcgattgcctagatcccgatgagcggaacgacaaagcaagtgatgaggatttgatactaaaactgcgcgatctgcggaaagagaatgagtttgtgaagggccagatcgtgatcttggaggagaccatcaatgtccacgagatggaagctaaggccagccgagagaccatcatgagactggcctcggaagtaaatcgcgaacagaagaaggccgcctcttgcacggaggaaaaggaaaaacttaatcaggatcttctcagcgcggttgaggctaaagaggcactggaaagggaggtgaagattttccaggagagactgcttgccggacaacaggtgtgggacgcttccaaacaagaagtctcattactgaagaaatccagctccgagttggagaagagcttaaaggccagtcaagacgccgtcaccactagtcagtctcaatacttttcttttcgagagaaaatcgctgcgttgttgaggggccgtctgtctatgactgggtccaccgaggataccatcctagaaaagattcgcgaaatggacagtcgagaggaaagccgagaccgcatggtgtcccagctcgaggctcagattagtgagttagtggagcagctgggcaaggaatctgggtttcaccagaaggcccttcagcgtgcacagaaggccgaaaacatgttagagaccctgcaaggtcagctgacacatctcgaggctgagctggtcagtgggggcgtgctgagagataacctgaactttgagaaacaaaagtatcttaaatttctggaccaactctcccagaagatgaagctggaccagatggcagctgaactagggttcgacatgcgtctggatgtggtcctcgctaggaccgagcagctggttcggttagagagcaacgccgtgatagaaaataagactatcgctcacaacctgcagaggaaattaaagacacaaaaggaacgtctcgaatcaaaagaactccatatgtctctgttgagacagaagattgctcagctggaggaagagaagcaggctaggaccgcactggtcgtcgagagggataacgcacacctgacaatcagaaatcttcagaagaaagtggaaagactgcaaaaggaacttaacacatgccgcgacctacacactgagctcaaggcgaaattggccgataccaacgaactcaaggcatccgcgtggctccatttcatcaagaccctcgaacagactaaagctatcgaggatttaaataaaagccgcgatcaactggaaaagatgaaggaaaaggccgagaaaaagctcatgagtgtgaagagtgagctggacacaacagagcatgaagccaaggaaaacaaggagcgcgcaagaaatatgattgaggtggtaacatcggagatgaaaaccctaaagaaatcattagaggaggcggagaagagggagaaacagttagcagacttcagggaggtagtgtcccaaatgctcgggctcaatgtgacgagcctggctctcccagattatgagattatcaaatgtctggaaagacttgtccatagccatcaacatcatttcgttacatgcgcctgtctgaaggacgtgaccacagggcaggagcgacacccgcagggccatttgcagctgcttcattag

SEQ ID NO: 28313 - DNA, 378 bp, Artificial Sequence
  Description of Artificial Sequence: Synthetic coding sequence
atgaaaaacgaagagcactgtcccgggtcatttttcttgtgcaagatacgtgaatgcgttctgaactaccgctttcagctgcagcacccaggattccaacattatctgcagagctcaggtcgtagagaccgaggccgctcggaggacaaaaagcctttggaagccggagtgtggtgctgggaccggggtggatgggatggctcctctagggcagtccatctactgttccgaggggtcgcccacccatctctatacctcttccctcgggaggacccaccccgcctcctcttccctaggctgagcttgcttgtctgcgaacagttttggtgttatagcgctacactccttctcgcacccttgcctgcctcaacgtgttag

SEQ ID NO: 28314 - DNA, 609 bp, Artificial Sequence
  Description of Artificial Sequence: Synthetic coding sequence
atgaacgcagctgtccccccagagcaagcccatagctgtgggtggggaaccgaaggatgtccctgccttcgatcaaccgccattaggcagacttttttcccaggaggtgaccagttccaaagagacggagggctggctatgctgcctatcctggtctcgaagttcttggcctcttctgacccccccgtgtccgtgcccgaaatgctaggcctccagaaccgttggcgcggtatgaagaacgaggagcactgccccggaagtttcttcttgtgcaagattcgggaatgcgtccttaactacaggttccaattgcagcacccagggtttcagcactatctgcagtcttctgggcggcgggaccgtggccgttcagaggacaagaaacctttggaggctggcgtttggtgttgggaccgaggcggctgggacggatcatcacgcgccgtccacctgctatttcgtggagtggctcacccaagcctatacctattcccccgagaagatcccccccgccttttgtttccacgactgtctctcctggtgtgcgaacagttctggtgctactctgcaactctcctgttggccccgttacccgcttccacatgttag

SEQ ID NO: 28315 - DNA, 1266 bp, Artificial Sequence
  Description of Artificial Sequence: Synthetic coding sequence
atgagcgcacattccatgctttgcgaacgaattgctatagctaaagagctcataaaaagagctgaatcactcagccgtagtcgaaagggaggcatagaggggggcgccaaactatgtagcaaattaaaggctgagctaaagtttctgcagaaagtcgaggctggcaaggtcgccatcaaggagtctcatctacaatccactaacctcacacacctgagagcaattgtagaaagcgccgaaaacctcgaggaagttgttagcgtcctgcacgtgttcggatacacagacacactgggcgagaaacagactcttgtggtggatgtcgtcgcaaacggtggccatacctgggtgaaagctattggacggaaggcagaagcattgcataacatctggctgggcaggggccagtacggagacaagtctattatcgagcaggctgaggattttctgcaggcttctcatcagcaacctgtccagtacagcaacccacatattatcttcgctttctataacagcgtctcgtctcccatggcggaaaagctgaaagagatggggatttctgtgagaggcgacattgtcgctgtcaacgccctgctggaccatccagaggagctgcaaccctcggagagtgagtcggacgacgagggccctgaactcctgcaggtgacccgggtggatcgcgaaaacatactcgcaagcgtggccttcccgactgaaatcaaggtcgacgtctgtaaaagggtcaatttggacatcactaccctgatcacctatgtgagcgcactgagctacggggggtgtcacttcatatttaaggagaaagtcctgacagaacaagccgagcaggagaggaaggaacaggtgttgccccagctggaagcatttatgaaggataaagagctcttcgcgtgcgagagcgccgtcaaagatttccagagcatcctggacaccctgggaggccccggcgagcgggagcgcgctaccgtcctaatcaaaagaatcaacgtggttccagaccagcctagtgaacgagctctgcgtctggtcgcttcttcaaagataaactccaggagtctgacaatctttggtacaggagatacattaaaggcaattactatgaccgcaaacagtggatttgtgcgggcagcaaataaccagggtgtgaagttctctgtgttcatccaccaacctcgtgcgctcacggagagcaaagaagccctcgctaccccacttcccaaagactatacaaccgattccgagcattag

SEQ ID NO: 28316 - DNA, 537 bp, Artificial Sequence
  Description of Artificial Sequence: Synthetic coding sequence
atgtctgcccatagcatgttatgcgagaggatcgctatcgctaaagagttgatcaagcgtgccgagagtctgagccgaagccgtaagggcgggattgagggcggggccaagctttgtagtaaattaaaggctgagctcaagtttctgcagaaggttgaggccgggaaggtggctattaaagaaagccacctgcagagcactaacctgactcacctccgcgcaatcgtcgagtccgctgagaatctggaggaggttgtttccgtcctgcacgtgttcggctacaccgacactctcggtgagaagcagacacttgtggtggacgtggtcgctaacggcggccacacatgggtcaaggcaatagggaggaaagctgaagcacttcacaatatctggctgggccgaggccagtatggggataagtccattattgagcaggccgaggattttcttcaagcaagccatcaacagcctgtccaatattctaacccccacataattttcgccttttataacagtgtgagttcccccatggcgtag

SEQ ID NO: 28317 - DNA, 1440 bp, Artificial Sequence
  Description of Artificial Sequence: Synthetic coding sequence
atgcaggaggtcccagaggccgcagggctggctagagtcgaaccacccaggagaagctcaggggtgggagctgcccgactacggtttcccggggggtcacggccattgagagcccgggcgtgcgtgctggcactagctgtcctggcactgcctgagcgtaacaacgctgactctatgtctgcacatagcatgctgtgtgagcgcatcgcaatcgctaaggagctgattaaacgggcagagtccctaagcaggtcgaggaagggcggcatcgaaggcggtgctaaactgtgctcaaaactcaaggccgaactcaagttcctgcaaaaggtggaggcagggaaagttgccataaaggaatcccacctgcagagcacgaatctgactcatctgcgtgccatcgtggagagcgccgagaatctggaagaggtcgtaagcgtcctgcacgtgtttggctatacagatactctaggcgagaagcagacccttgttgtagatgttgtagccaacggggggcacacttgggtgaaggcgatcggtagaaaggcggaggcactgcataatatttggttgggcagagggcaatatggagataagtctattatcgaacaggctgaagatttcctccaggcctctcatcaacaacctgttcagtactcaaatccgcatattatctttgcattttacaattctgttagcagcccgatggctgagaaactgaaggaaatgggtatttccgtgcgaggtgacattgtggccgttaatgcgctactcgaccatcccgaagagctccagccaagcgaatccgagtctgatgacgagggaccagagctgcttcaagtgacaagggtggaccgggagaatattctggcgtccgttgcgtttccaaccgagatcaaagtagacgtctgtaaacgcgtgaatctagacattaccaccctaatcacatacgtgtccgctcttagttatggtggatgccacttcatctttaaggaaaaggtgttgaccgaacaggcagaacaagaaaggaaggagcaggttcttccccagctggaggctttcatgaaagataaggagctctttgcttgcgagagtgccgtgaaagattttcagtctatactggacaccctgggcggaccgggtgagcgcgaaagggctacggtccttattaagagaataaatgtggtcccagaccagccatccgagagggccttgcgacttgtagcttcaagcaaaataaatagccggagtctaactattttcggcacaggtgacaccctcaaggcaattacaatgaccgccaactcagggtttgttcgtgccgccaataatcagggagtaaaattcagcgtgttcatccatcaaccaagagccctgacagaatccaaagaggccctggccactcccctgccaaaggattacacgacggactcagagcattag

SEQ ID NO: 28318 - DNA, 258 bp, Artificial Sequence
  Description of Artificial Sequence: Synthetic coding sequence
atgagcgcccacagcatgctgtgcgaaagaattgccattgccaaggaactgattaagagggccgaatccctctcccggtcccgtaaaggcgggatcgagggcggcgctaagctatgtagcaagctgaaagctgagcttaagtttctccagaaagttgaggccggcaaagtggccatcaaagagtctcacctgcagagcactaatctgacccatttgagagctatcgtcgaaagcgcagagaatctggaggaagtttag

SEQ ID NO: 28319 - DNA, 1266 bp, Artificial Sequence
  Description of Artificial Sequence: Synthetic coding sequence
atgtctgctcattccatgctctgcgaaaggatagccatcgccaaagagcttatcaagagagctgagtccctatcacggtccagaaaaggcggaattgaaggtggcgccaagctttgctctaagctgaaggccgagcttaagttcctccagaaggttgaggcgggcaaggtagccatcaaagagtcacacttgcagtcaactaacctgacccacctgcgcgctattgttgaaagcgcagaaaatcttgaggaagtggtatcggtccttcacgtgttcggatacacggataccctgggagagaagcagaccttggttgtagacgtggtcgcaaacggcggccatacatgggttaaagccattggccgcaaagccgaagcgttacataacatttggttaggcagagggcagtatggagataaatccattatcgaacaggcggaagacttcctccaggcaagtcaccaacaaccagtgcagtatagcaacccgcacatcatttttgctttctataattcagtctcctctccaatggccgaaaagctgaaagagatggggattagcgtacgtggagacatagttgctgtcaacgccctgctcgatcaccccgaagagctgcagccctccgagtcagagtcggacgatgagggaccagaactgctgcaggtcactagggtggaccgagagaatatcctcgcttcagtggcctttcccacagagattaaagtggatgtgtgcaagagggtaaacctcgacattaccaccttaattacatatgtaagcgccttgagttacggcggatgtcatttcatcttcaaggagaaggttctaaccgagcaggctgagcaggagcggaaggaacaagtcctgcctcagttggaagccttcatgaaggataaggaactcttcgcttgcgagtcagctgtgaaggatttccagtctatactggatacactgggaggccccggcgagagggagagagctaccgtgctgatcaaaagaattaacgtggtcccagatcagcccagcgagcgagcattgaggctggtggcgtcatcaaagattaattccaggagcctgacaatctttggaactggcgacaccctgaaagccatcaccatgaccgccaatagcggtttcgtacgggcggccaacaaccaaggcgtgaaattttccgtgtttatacatcagcctcgcgcgctgacagaaagtaaagaggccttggctactccactgcctaaggattacacaaccgatagcgagcactag

SEQ ID NO: 28320 - DNA, 1266 bp, Artificial Sequence
  Description of Artificial Sequence: Synthetic coding sequence
atgtcagcccattcaatgttatgcgagcgcattgcaatcgccaaggaacttattaaaagggctgaaagcctgagcaggtctaggaaaggtgggattgaaggaggagcgaagttatgcagtaagctcaaggccgaactaaagtttctgcaaaaggttgaagcaggtaaggtggcaatcaaagagtcccacttgcagagcactaatctcactcatcttagagcaatcgtcgagagcgccgagaatctggaggaagtggtctccgtgctgcacgtgttcggatataccgacacactcggagagaagcaaaccttggtagttgacgtggtggctaacggcggccatacctgggtgaaggccatcggacgcaaggctgaggccctgcacaatatttggcttgggagagggcaatacggagataagagtatcattgagcaagcagaagacttcctccaagcgtcacaccagcagccagtgcagtactcaaaccctcacatcatctttgctttttacaactctgtcagctcgccaatggcggagaagcttaaggagatgggtattagcgtgagaggcgacatcgtggccgtgaatgctctcctggatcatcccgaggagctccagccttcggagagcgagtccgatgatgagggccctgaattactgcaggtcacaagagtggatcgggagaacatactggcgtcagtggcctttcctaccgagatcaaggttgacgtgtgtaagcgagtgaacctggatattacaaccctcatcacatatgtgtctgctttgtcatacggcggatgtcacttcatctttaaggagaaagtgttaacagaacaggccgaacaggaaagaaaagaacaggtgcttccacagctggaagcattcatgaaagataaagaactcttcgcttgcgaatccgcagtgaaggatttccagtctatactggatacacttggcggacccggcgagagagaacgcgcaacggtgctgataaagagaatcaatgtggtgcccgaccagccttcagagagagctctgagactggttgcgtcatcgaagatcaattctagaagcctcaccatcttcggcaccggggatacgctcaaggctattactatgaccgccaacagcgggtttgttagagccgcaaacaaccagggtgttaaatttagcgtgtttatccaccagccacgagccctcacagagtcaaaggaagctttggccaccccgctcccaaaagattataccacagactctgagcactag

SEQ ID NO: 28321 - DNA, 1350 bp, Artificial Sequence
  Description of Artificial Sequence: Synthetic coding sequence
atgtccgacatacgccactcacttttacgcagggacgctctcagtgccgcaaaggaagttttgtaccacttggatatctacttttcttcccagctgcagtcagcacctttacccatcgtggataaagggccagtggaactgctggaggagttcgttttccaagtaccgaaggaacgatcagcccagcccaagagactcaacagtctccaggagctgcagctgctggagatcatgtgtaactactttcaagagcagacaaaggactcagtgcgacagatcattttctcctctctcttctcaccccaaggcaacaaggccgacgactcacggatgtctctcttggggaaactggtgagcatggccgtggcagtttgtcggattcccgtcttagaatgtgccgcttcctggctccaacgaacccctgtcgtctattgtgtgcgactggctaaggccctcgttgacgactactgctgtctcgtgccaggcagcattcaaacgcttaagcagattttctccgcttcaccacgcttttgctgtcagttcatcacatctgtgacagccttatacgacctgtcttctgacgacttaattcccccgatggacctgctcgagatgattgtgacatggatcttcgaggaccctcggttgattctgatcacgtttctgaatactccaattgccgccaatcttcccatcggattccttgaactcacaccactcgttggccttatcaggtggtgtgtgaaggctcctctggcatacaagaggaagaaaaaacctcctctctcaaacggacatgtgagcaacaaagtcacgaaggacccgggggttggtatggatagagactcccacttgctgtattctaagctgcatctttccgtcctgcaagtcctcatgaccctgcaactccacttgacggagaagaacttgtacggacgcctgggcctgatactcttcgaccatatggtcccactggtggaggagatcaaccgactggccgacgagctgaacccgctgaatgccagccaagagattgagctctccctagacaggctggcccaggctttgcaggtcgctatggcatcgggggcactcctgtgcacacgagacgatttaagaacactctgttcccgtctaccccacaataatctattgcagctagttatttctgggcctgtgcagcagtctccacacgccgctcttccacctggcttttacccacatatacacactccgcccctgggctacggtgctgtgcccgctcatcccgctgctcaccctgccctccctacccaccccgggcacacatttatctccggtgtgacgttcccctttcgcccaataagatag

SEQ ID NO: 28322 - DNA, 1059 bp, Artificial Sequence
  Description of Artificial Sequence: Synthetic coding sequence
atgtcagatatcagacactccctgctaaggcgggacgccctgagtgcggctaaggaagtactgtaccaccttgatatatacttcagttctcaactgcaatctgctcccctgcctatcgtggacaagggacccgttgaattactcgaggaattcgtctttcaagtccctaaagagcgctctgcacagcctaaggagcagaccaaagactccgtgaggcagatcatcttctcctccttgtttagcccgcagggaaataaagcggacgactctcgtatgtcccttctcggcaaactggtctcgatggccgtggcagtttgccgtattcccgtgcttgagtgcgcggctagctggctgcagcggactcccgtggtctactgtgtcaggctggccaaggccctcgtcgatgattactgttgcctggtaccgggatctatacagaccctcaaacagatcttttctgcaagcccgcgtttctgttgtcagttcattacaagtgtcactgccctctatgatctttccagtgacgatctgattccaccaatggatctcctggagatgattgtgacttggatctttgaagatccgagtgtactacaggttctgatgaccctccaactgcacttaactgagaagaatctgtatggacgactgggcctgattttgtttgatcacatggtccctctcgtcgaagagattaataggcttgccgacgagctgaaccccctgaacgctagccaggagatcgagttatccctcgaccggttagcgcaggctttgcaggtggctatggcaagcggagcactgctctgtacacgagatgacttgaggacactctgctctcggttacctcataacaatctgctgcaactggttatatccggaccggtccagcagagtcctcacgcggcccttcctccagggttctacccgcacatccacactccacccctgggctacggggccgtgcctgcacacccagctgctcaccctgctctgcccacgcatcccgggcacaccttcatcagtggagtgacattccctttccgaccaattagatag

SEQ ID NO: 28323 - DNA, 711 bp, Artificial Sequence
  Description of Artificial Sequence: Synthetic coding sequence
atggtggttcgcgaggcttcagccgctcaggcatccttgagccaagtgctcccacagttacgatatttgcacatcttcttagagcaggtgcatactcactttcaagaacagtcggtaggcgagcgtggtgctgccatccaactggcggagggcctggcccgccagctgtgcactgattgtcagcttaataagctgttttaccgggaggagttcgtcctggcaacgctcctggatccttgcttcaagggcaagattgaggccatcctgccgtggggccccactgatatcgaccattggaagcaagtgctcgtatataaagtgaaggagatacgcgtcagcgagtactcactgaactctcctagcccattgcagtctcccagaggcctatgtgtggatcctacaagagtggccaaatcctccggagtggaaggacgctcccagggagaacctcttcagtctagtagtcattccggcgctttcttgctggcccagagggaaaagggcctgttggagagcatgggacttctggctagtgagagatcggggggctctctgagcacaaagtcacactgggccagtattatcgtgaagaaatacttatgggagaacgagactgtaggcgcccaggacgaccctctggcctactgggaaaagaagagagaagcttggcctccttccatctgtctcacacctcataggtccttgctgtag

SEQ ID NO: 28324 - DNA, 1773 bp, Artificial Sequence
  Description of Artificial Sequence: Synthetic coding sequence
atggaagtgattcatggcagaccatactgctgtagagaactggagggcgccgacatactttctaatacattctacagcaacgaattgcacaatcctctgcaaacagttacccggcctaccgccagcgaagatcggtaccaagagctgcgggaatctcttcagcagtgtcgcctcccctggggagcagagcgggaatacgggggtattattcccattagcctccctgaggatcacaggccgaagtacgagccaccacgtgtcatgggcaaaggtcatcaacactatggcttcgggggggaaacatggccgagaaaactgccagttgaacaattttactatctcactcaaaataagaaatctgacgtatacgggaacgactccctcataccaaagccaccaaatagcaccgtcggggagatttgtttgccgtatcctatcgagcacccgtaccacacccacatctgccggggtgccatgttccccacattcacctctccagaggacctctacactggcattaaggctaggacccagcaaccattcccccctaccgttcctaccaaggcctacgacagcacagtgttaaagacccggggaaatccttatcgctacgagttaattgatatacccatggacagcaaaaaaaaagccctgacatggccaggccagggtgtctattacgacttcccgcgaggggtggagaaaaataaaccagtgttctatcccaaaccacccaagaccttcgccccaaatacatcactgaactcgtgggacccgatttgcagcgctaaggaagcaaacatacagcgaaatctcgaacggagtcattggctgacctcgtacacacatgacttcacgggcctgggtcctatggaccccttggagttagacgactatcacgaaaagatggtcgccgagttaacccgcaagattgggttcgaccctgagccccaggaaaagttccacccagtgtttaaaccaccaagacccctggaaggcaggatagcacgactcatccagaatagacggtcactggaggccattgttcagcagcggcccagatcttgccctgattgcacacctagagtgctgtgcaatttccatactttcgtcccctcctctaaggaaatggtggcactgagtgacaacatccccgcaggagttacacacaagaatcaagatatcgaagaaaagattattgaggaacagtctttactcagtacatatgagctgccttcttgctaccccactaaagacctcacctcaatatacgacatcaaacctttcccgaagattaccgacaccaagaagacagaagacctgtattggcggcagcagtcactgaagacgcagcctaccccgtactgcaagcccgaccattggattcactatgagaatctcaagagcccccttcgggatcagtataacatgtgccccgatcctgttagcctgtccaagccctcggtactgcagaataaacaggacactgaagccttcacacttgaacatttcctctcaaaacccgaggaagaactgttcctaaacatggagaacaatgaggaaacccggccagtgctcgggtggatcccacgcgcaggggtaaccaagcctcagaccaacttgctggaactgaagaactcctttagcaagacaggggcccagaagcggttccataaatcaattttggaagaccacaaagatctgcgagacaacgagcatagtgggatgaagcaccaattctacggccataattcctattacttctacaattag

SEQ ID NO: 28325 - DNA, 1773 bp, Artificial Sequence
  Description of Artificial Sequence: Synthetic coding sequence
atggaggtcattcacggacgtccatactgctgtagagagctggaaggggctgacatcctatccaacaccttttactcaaacgagctacataatcctctgcagacagtcacgcgtcccactgcctccgaagaccggtaccaggaactcagagaaagtcttcagcaatgccgcttaccctggggagcagagcgtgaatacggaggcatcattcccatcagtctgccggaggatcaccgtcctaagtacgagccaccccgcgtcatggggaaaggtcaccaacattacggctttgggggagagacttggcctcgtaagcttccggtcgaacagttctactacctcacgcaaaataaaaaaagcgacgtgtacggcaatgattcactgattcctaagccaccgaactccaccgttggcgaaatttgcctgccctatcccatagaacatccataccacacacacatctgtcgaggggcaatgtttcccacgttcacctcaccagaagacctgtacacaggaatcaaggcacgaacacagcagcctttcccacctacagtgcccactaaggcatacgactcaactgttctgaagactaggggaaacccgtacagatacgagttgatcgacatccccatggactctaaaaaaaaggcgcttacctggccaggccagggagtgtactacgacttccccaggggagtggaaaagaataagcccgtcttctacccgaagccccccaaaacctttgcccctaacaccagcctcaacagctgggacccaatctgttccgcaaaagaagcgaacatacaacgtaatctggaacgcagccactggctaacctcgtacacccacgatttcaccggtctaggacctatggatcccttggagcttgatgattatcacgagaagatggtggctgaattaactaggaaaatcggcttcgaccccgagcctcaggagaagttccaccctgtgttcaaaccaccccggcctctcgaaggaagaatcgcccgacttatccaaaataggcgtagtctggaggctatcgttcaacaacgacccaggagctgtccagattgtacgcccagagtgctgtgtaactttcacacgttcgtgccttcctctaaggagatggtggctctttctgataatatccctgccggagtgacacacaaaaatcaggatattgaggaaaaaattatagaggagcagagcctcctcagtacttacgaactgcctagttgctaccccacaaaggacctaacgagcatctatgatatcaagccattccccaagataacagatacgaagaagacagaggatctatactggcggcagcagagccttaagactcagccaaccccgtattgcaagccagatcattggatccactacgagaatctgaagagtcctctgcgtgatcaatacaatatgtgccctgatcctgtcagcctctctaagcctagcgtgctacagaacaagcaggataccgaagcctttacgctggagcattttctcagcaagccagaggaagagctcttcctcaacatggaaaacaacgaggaaactagaccggttctgggttggattccaagagccggcgtaacaaagcctcagacaaatctattagaactcaagaactctttttccaaaacaggggcccaaaagcggttccacaaaagtattctagaggatcacaaggacctgcgagacaacgagcactccggcatgaagcatcaattttatgggcacaacagctattatttctacaactag

SEQ ID NO: 28326 - DNA, 348 bp, Artificial Sequence
  Description of Artificial Sequence: Synthetic coding sequence
atggaagtgattcatggcaggccgtattgttgtagggaactcgagggcgccgatatcttgtccaacacgttctattctaacgagctgcacaatcctctccagactgtgacaaggccaaccgcctcagaggaccgttaccaggaattaagagaatcgctgcagcaatgccggctcccctggggcgcggagcgagaatacgggggcataatccctatttcactcccagaggatcatcgccctaaatacgaaccccctagagtgatgggcaaaggccaccagcattacggcttcgggggcgagacctggcctcgcaagctccctgtggagcagttctactacttgacatag

SEQ ID NO: 28327 - DNA, 462 bp, Artificial Sequence
  Description of Artificial Sequence: Synthetic coding sequence
atggaagttattcacggcaggccctattgctgtcgtgaattggagggagctgacatattgagcaacacgttttactccaacgagctgcacaacccgttgcagactgtcacacggccaacagcgagcgaagatcgatatcaggagctgagggaatctttacagcaatgccgcctaccgtggggggccgaacgcgagtacggtgggataatcccaattagtctccccgaggaccatcgccctaagtatgagccaccccgtgtaatgggaaagggacatcaacactatggattcggcggagagacttggccgaggaagctccccgtggagcagttctattacttaactcaaaataaaaagtccgacgtctacgggaatgacagcctgatcccaaagcctcctaactctaccgtaggggagatttgtctcccatacccaatagaacatccctaccacactcactag

SEQ ID NO: 28328 - DNA, 279 bp, Artificial Sequence
  Description of Artificial Sequence: Synthetic coding sequence
atggaggtcattcacggacgcccatattgctgtagagagctagaaggtgctgacatactgtcaaacacgttctacagcaacgaactccataaccctctgcaaactgtgacgcggcctaccgcatccgaggaccggtaccaagaactgcgtgaaagcctgcaacagtgtaggctcccgtggggggccgaaagagaatacgggggcatcattcctatttccttgcctgaagatcacagacctaagtacgagccgcctagagtcatgggcaaaggacactag

SEQ ID NO: 28329 - DNA, 534 bp, Artificial Sequence
  Description of Artificial Sequence: Synthetic coding sequence
atgcaagttgaggtgcaatcgttgtcactggaagagtgtccttggcgcctgcctggtcctcagtgtgagtgtgaggccttgctgccttccggcgcacgcagacggatagacttacggctgtctggccgagcggtggctgtctgggtacacgtccgaggtgggccaggccagtttaatctcagctatgcaacaggccgccacaagaaacccaatccccatcaaaatatgaacagaggaatggagttcatagcccccgtgtcagcacccacgaagtcaggagctccctggcacttcctgtctcagggccccactgatgcccagagggctgtccgcatcagacccggcactcggatgggcctgagtagcgatccagtcgtgggcacacttagttccagttacctggacctgttgacgctctcctacaagccgggtagaacagtgacatcaagttatctaaacgtgcgcggccatgaggtcaggaagttgcaaaattcagtggaggccacccggatttcgcggacagacagttcatag

SEQ ID NO: 28330 - DNA, 396 bp, Artificial Sequence
  Description of Artificial Sequence: Synthetic coding sequence
atggatttccagcagctggccgatgtagctgaaaagtggtgttccaatacccccttcgagctaatcgcaacggaggagacagagagaaggatggatttctacgcagatccaggtgtcagtttttatgtactgtgtccagataatggctgcggagataatttccatgtgtggtcggaatcggaagattgtctgccttttctccagctagcccaagactatatttcgtcctgtggtaagaagacactgcacgaggttctcgaaaaggtcttcaagtccttccggccgcttctaggtctcccagatgccgacgacgatgccttcgaagaatatagcgccgacgtcgaggaagaggagcccgaggcagaccatccccaaatgggagtcagtcagcagtag

SEQ ID NO: 28331 - DNA, 297 bp, Artificial Sequence
  Description of Artificial Sequence: Synthetic coding sequence
atggccacccactgtccactgtattgcgttggggccgacctgatgatgaacagagcaggggagcatgtctggagcgaatccgaggattgcctgccctttttacaattagcccaagactatattagctcgtgcggtaaaaagaccttacatgaagtgctcgaaaaagtttttaaatcattccgccccctgcttgggctgccggacgccgatgatgacgcattcgaggagtatagcgcagatgtggaagaggaggaaccggaagctgatcaccctcagatgggcgtgtcccaacagtag

SEQ ID NO: 28332 - DNA, 396 bp, Artificial Sequence
  Description of Artificial Sequence: Synthetic coding sequence
atggatttccagcagctggccgacgtagctgaaaagtggtgcagcaatactccattcgaactgattgcaactgaggaaacagaacggcgaatggacttctacgctgaccctggggtcagcttctacgtcctgtgcccagataatggttgcggagacaactttcatgtgtggtccgaatctgaggattgcctcccattcctgcaactggctcaggattacatatctagctgtgggaagaaaactctccatgaggtgttagagaaggtctttaagtctttccgcccccttctcggcctgccagatgccgacgacgacgcatttgaggagtatagcgctgacgtggaggaggaagagcccgaggcagatcaccctcagatgggcgtgtcccagcagtag

SEQ ID NO: 28333 - DNA, 297 bp, Artificial Sequence
  Description of Artificial Sequence: Synthetic coding sequence
atggcgacacactgcccgctatactgtgttggggcagacctaatgatgaaccgggccggagaacacgtctggtctgaaagtgaagattgtctcccattcctgcagcttgcccaggattatatctcatcatgcggcaaaaaaacgctgcatgaagttctcgaaaaagtgttcaaatcttttaggccactcctgggcttgccagacgctgacgacgacgctttcgaggagtatagcgcagatgttgaagaagaggaacccgaagccgatcaccctcagatgggtgtgagccaacagtag

SEQ ID NO: 28334 - DNA, 600 bp, Artificial Sequence
  Description of Artificial Sequence: Synthetic coding sequence
atgcataaaaagtccggcttcgaaaaccagatgcggttatgttggcgacgtccctgcggaaacgaggagcgatgcagtgtgtgctggtcccttttcctccctcctgggaagcagctttgcgaagaggagcgtagagccatgcaggccgccctggacagtgtggtctgtcatacaccgttgaataacctcggattctcaagaaaagggtctgcccttacgttctccgtggcgttccaggctctacggactgggctgtttgagcatatgaagctcaagctgcagttcacagcctctgttagccacccccctcctgaggcgcgacctttgagtaggaaatctagtccctcatcccctgcagttagagatctcgtggagaggcaccaggcatctctgggcaggagccaatcattttcccatcagcagcctagccggagccacctgatgcggagcggatccgtcatggagaggcgcgcaatcacgccgcctgtggcaagtccagttggccggcctttgtacctcccccccgataaagctgtgttatccctggacaaaatcgctaagagagagtgcaaggtgctggtggtcgaacccgttaagtag

SEQ ID NO: 28335 - DNA, 1743 bp, Artificial Sequence
  Description of Artificial Sequence: Synthetic coding sequence
atggagagtcagtgtgattacagtatgtactttcccgcagtgcctctcccccccagggccgagctggccggggatccagggagatatcgcgcacttcctcgtcgaaaccacctctatctgggagaaacagtgagattcctgctggttctccggtgtcgggggggcgccggatcaggcaccggcggaggtcctggactaggtagccgcggggcatgggcggaactggcaaccgctcttgcagcactggccagcgtctcagccggcggcggcatgccgggtggcgggggagccggcgaccaagattccgagccccccggtggcggggaccctgggggaggggggctgttccgcggctgttccccgctgttgacacacggtcccgggcccgccacttctggtggcgctaccacactgccggtggaagagcctatcgttagtaccgacgaggtgatttttcccctcactgtgtctctcgacaggcttccgccaggcaccccaaaggcaaagattgtcgtaaccgtgtggaaacgggagatagaggcccctgaggttcgggaccagggctatctcaggttgttgcagacccgctccccaggtgagaccttcagaggggaacagagcgcattcaaagcacaggtctcaaccctcctcaccctgctccccccccccgtgctaaggtgccgccagttcaccgtagccgggaagcatctgaccgtgctgaaggtgcttaacagcagttcccaggaagaaatttcaatttgggacattcgcattctgcctaattttaatgcctcttatctccctgtcatgcctgacggatcagtactccttgtggacaatgtgtgccatcaatctggagaggtgtccatgggatcattttgccggctccctggtaccagcggctgttttccttgtcctttgaacgccctagaagagcacaacttcttgtttcagctgcgcggcggagagcaaccacccccaggagccaaggagggcctggaggtaccactgattgctgtggtgcagtggtctaccccaaagttgccgttcacacaaagcatttacacacactatcggcttccttccgtccgactggacagaccttgttttgtgatgaccgccagctgtaagtctccagttagaacttatgagaggttcaccgtcacctacactctgctcaacaaccttcaggactttttggccgtaaggctggtgtggacacccgagcacgcacaagccggcaaacagttgtgtgaggaagaaagaagagctatgcaggccgctctggacagcgttgtgtgtcacaccccattgaataacctaggattttccaggaaaggaagcgctctcactttttccgtggcttttcaggctctgcgcacaggactatttgagctgtcacagcacatgaaacttaaactgcaattcacggccagtgtgagtcatccacctccagaagctaggcctttgtcacgcaaatcgtcacccagttcccccgctgtgagagatttggtggagaggcaccaggcctctctaggcagatcgcagagcttcagtcaccagcagcccagtcgctctcatctgatgcgctcagggagcgtgatggaacgcagggcaatcacacctccggtggccagccctgtgggaagacctctgtacctgccgcccgataaagcggtcttaagcctcgacaagatcgccaaacgcgaatgtaaggtgctggtcgtggaaccagtcaagtag

SEQ ID NO: 28336 - DNA, 897 bp, Artificial Sequence
  Description of Artificial Sequence: Synthetic coding sequence
atggaaagactgacactgccacttggtggagccgccgccgttgacgaatacttagagtacaggagaattgtgggcgaggacgatggaggcaagctgtttacaccagaggaatatgaggagtataagcgcaaggtcctgccactgcggctccaaaatcggctgtttgtcagctggcgatcccctacagggatggattgcaagctcgttggtcccgaaactttgtgtttttgtacacatcgttacaagcagcacaagaccgacctggaggctattccacagcagtgccctattgacctaccctgtcaggtgaccggttgccagtgccgtgcctacttgtacgtgcctctgaacggctcccaaccaattcgctgccgatgcaagcattttgctgatcagcattctgctgcacctgggttcacgtgcaatacctgctctaagtgcagcgggtttcactcttgttttacgtgtgcgtgtggacagccagcctacgcccacgataccgtagtagagaccaaacaggagcgtctcgcccaggaaaagcccgtcgggcaggatatcccttacgctgctatgggaggactcactggtttctcttcactggccgagggatacatgcgcctggatgactccggtataggagtgccctctgttgagttcctggagtcacccatcaccgcggtggattctccattcctgaaggccttccaggcctcttcatcaagctccccagagaccctgaccgacgtgggaacctcatcccaggttagctctctgcggcggcccgaagaggatgacatggcttttttcgaacggcggtaccaagagcgaatgaagatggaaaaagcagccaagtggaagggtaaggccccactgccctctgcaacgaagccttcttag

SEQ ID NO: 28337 - DNA, 789 bp, Artificial Sequence
  Description of Artificial Sequence: Synthetic coding sequence
atggaacgcctcactctgcccttgggaggcgcggctgctgtggacgagtacttagagtatcgcaggattgttggtgaagatgacggggggaaactgttcacccccgaggaatacgaagagtacaagcgcaaggtgcttcctctccggctgcagaaccgcttatttgtgtcttggcggagtcccactggcatggattgcaaactggtcgggcccgaaacactatgtttttgtactcaccgctacaaacagcacaagactgacctcgaggcgattccccagcagtgccctattgacctcccctgccaggttacgggctgccaatgtagagcctatttgtatgtgcctcttaacggttctcagccaatccgctgtagatgcaaacacttcgcagaccagcactctgccgcccctggattcacctgcaatacatgttcgaaatgtagtgggttccacagctgttttacgtgtgcctgtggccagcccgcttatgcccacgatactgtcgtagaaaccaagcaagagagactggcgcaggagaagccagtgggtcaggatatcccatatgcggccatggggggactgaccgggtttagttcgttagcagagggctacatgcggctggatgatagcggaattgtcggaacaagcagtcaggtgtccagtttacgcaggcccgaagaagacgatatggccttcttcgagcgccggtatcaggagcggatgaagatggaaaaggctgcgaagtggaaggggaaagcgcctctgcccagcgcgacgaagccctcctag

SEQ ID NO: 28338 - DNA, 615 bp, Artificial Sequence
  Description of Artificial Sequence: Synthetic coding sequence
atggagcggctgactctccccctaggcggggccgccgctgtggacgagtacctggaataccgtcggtacaaacaacacaagaccgacttggaagccataccccagcaatgtcctattgaccttccatgtcaggtgaccggatgtcagtgcagggcatatttgtacgttcccttaaatggctcccagcctattcgctgccggtgtaaacattttgccgatcagcatagcgccgcaccgggctttacttgcaacacatgttctaagtgttccgggtttcattcttgcttcacatgcgcgtgcggtcaaccagcatacgctcacgataccgtcgtcgaaacaaagcaggagaggttggcccaggagaaaccggtcggtcaagacatcccatacgcggcaatgggcggcctgacaggtttctcatccctggcagaggggtatatgagattggatgacagcggtatcgtaggcaccagtagtcaagtcagctcactccggcgcccagaggaagatgacatggcattttttgaacgccgttaccaagaacgcatgaagatggagaaggctgctaaatggaagggcaaggcgccccttccaagtgcaaccaaaccctcatag

SEQ ID NO: 28339 - DNA, 585 bp, Artificial Sequence
  Description of Artificial Sequence: Synthetic coding sequence
atggcgaaacagaaacgcaaggtgccggaagtgacggaaaagaaaaacaagaagcttaagaaagcttcggctgagggtcccctccttggccctgaagcggcccctagtggcgaaggcgctggcagtaaaggggaggctgtactgcgacctggcctggatgccgagccagagctgtctcctgaagagcaacgagtgcttgagaggaaattgaagaaggaacgtaaaaaggaagagcgccaacgcttgcgggaagctgggttggtggcccaacacccccccgcgcgccgaagtggcgctgaacttgcactggattatctctgccgctgggctcaaaaacataaaaattggcggttccagaagacgcgccagacgtggctcttgctccatatgtatgattcggacaaggtgcctgacgagcattttagtacactgttggcctacctggaaggtctacaaggtcgcgccagggagctcacagtgcaaaaagcagaagctcttatgcgtgaactggatgaagaaggttcagatccacccttacctgggcgcgcccagcggatacgacaggtgctgcagctgctgtcttag

SEQ ID NO: 28340 - DNA, 585 bp, Artificial Sequence
  Description of Artificial Sequence: Synthetic coding sequence
atggctaaacagaagcggaaggtgccagaggtgacagagaagaaaaataagaagctgaaaaaagctagtgccgagggtcctctgctggggcctgaggcagccccttcaggtgagggtgccgggtctaagggcgaggctgtgctgcggccaggattggatgctgagccagagttaagtcccgaagaacaaagggtcctcgagcggaagctgaaaaaggaaagaaagaaagaggagcgacaaagactgagagaggcaggcctggtcgctcagcaccctcccgccaggcggtccggcgcggaactggccctggactacctgtgccgctgggcacagaaacataaaaattggaggttccagaaaactagacagacatggttgcttctacacatgtacgattcagataaagtgcctgatgagcacttcagcaccctgctggcgtatctggagggactacaaggacgggcgagagaactaacagtccagaaggcagaagctctaatgcgggaactggatgaggagggctccgatccaccccttccaggcagagcacagcggatccggcaggtgctgcagcttttgagctag

SEQ ID NO: 28341 - DNA, 585 bp, Artificial Sequence
  Description of Artificial Sequence: Synthetic coding sequence
atggccaagcagaaacgaaaagtcccggaagttaccgaaaagaagaataaaaaactcaagaaggcttccgccgaaggacccctgctcggacctgaagccgcaccgagtggcgagggggctggcagcaagggggaagctgtgctgcggccagggctggacgcggaacccgagctttctcctgaggagcagagagtactggaaaggaagctcaagaaggaaaggaagaaggaggaaagacagcgattgcgcgaagctgggctggtggcccagcacccaccggcaagaagatccggagctgaattggcactagactacttgtgtaggtgggcccagaagcacaagaattggagatttcagaagacaagacagacgtggcttctcttacacatgtatgattcggacaaagtcccagatgagcacttttcaactctcctggcatatttagagggccttcagggccgggccagggaactgaccgtgcagaaggcagaagcactgatgagagagctggacgaggaggggtctgaccccccgctccctggcagggcccagcgcatccgccaggtgctacagctgctcagctag

SEQ ID NO: 28342 - DNA, 579 bp, Artificial Sequence
  Description of Artificial Sequence: Synthetic coding sequence
atggcaaagcagaagcggaaggtgccggaagttaccgagaaaaagaacaagaaactcaaaaaagcctctgccgagggccccctgctgggccccgaggccgccccatctggagaaggtgccggttcaaagggcgaagccgtcctgcgtcctggcctggacgctgaacctgaactgagtccagaggaacagcgggtgctcgaaaggaaactgaaaaaggagaggaagaaggaagaacggcagagactgagggaggcaggactcgtcgcccagcacccaccagcccgtcgctctggcgccgagttggccctggattacctatgccgttgggcacagaagcacaagaactggcgctttcagaagaccagacagacgtggctcttgctgcacatgtatgactcggataaggtccccgacgaacatttttctactctgcttgcctacctggagggcctgcagggaagagcgcgtgaactgactgtgcaaaaggcggaggccttaatgcgcgagctggacgaggaaggatccgatccccccctgcctggcagagcgcagcgcattcgccaggtcctacagctgtag

SEQ ID NO: 28343 - DNA, 888 bp, Artificial Sequence
  Description of Artificial Sequence: Synthetic coding sequence
atgcgaaatacaagcaaggaattacagggggccacgcacagatatgccccttgcgactggtactaccacgttcctgtgaaacggagtgaaaaggctgtggatgccccccctgcctctcaaattcccggcttatctaatctgggggattcccacagcgagaatctgcccggcaccaggcggtactggattaaggaaacggactcagaatatgtcaaactggcaaagcagggaggaagacctgacttactcaaacactttgcacctggtactcgaaaagggagcccggttgcatatagcctaccagattggtatatccaccattcaaagcctcccaccgcctcacagcaagaagtcagggctgtttccatgccagactatatggtccacgaggagttcaacccggatcaggcaaatggatcttatgccagtcggaggggacccttcgactttgacatgaagaccgtgtggcagagggaagccgaggagctcgagaaggagaaaaagaagctgagactgcctgcaatcgactccaaatatctctctaaggccggaaccccactcggccccaaaaatccggcagggtcccgactgtcattccctccggtgcccggccagaaaaattctagcccgacaaacttcagcaagttaatcagtaatggctataaggacgaatggctccagcaacagcagcgggctgactctgataaacgtaccccaaaaacgtcccgcgcctccgtgctctcacaaagtccacgggacctggaaggcccgcaagacgccgcacgactccaagatgcggaggcaagtgagggacctgaggacacaccagagagctcacagagtcctgaagagagcgtgagtgcgagcacaccggccgagttaaagtag

SEQ ID NO: 28344 - DNA, 888 bp, Artificial Sequence
  Description of Artificial Sequence: Synthetic coding sequence
atgaggaatacatccaaagaactgcagggggccacacatagatacgctccctgtgactggtattatcatgtgcctgtgaagagatctgagaaagccgtggatgcgcctccagcgtcccagatcccagggctgtctaacctgggagactcccattccgagaacctacctgggacgagaaggtactggatcaaggaaaccgacagcgaatacgtgaagcttgcgaagcagggggggcgacctgacttgctcaaacatttcgcccctggcacacggaaagggagccctgtggcgtactcccttcccgactggtatatacatcactctaagccaccgacagcatctcagcaagaagtgcgcgccgtttctatgccagattacatggtgcatgaggagttcaatcctgatcaggcgaatggctcttacgcctctaggcggggacccttcgatttcgacatgaaaaccgtttggcagcgcgaggcggaagagttggagaaggaaaagaagaaactccgcctgcccgccattgattcaaagtacctctcaaaagccggaacgcccctcggtccaaagaatcccgcaggatcaaggctgagtttcccaccggttccgggccagaaaaactcaagcccaacaaatttctccaaactgatctccaacggttacaaagacgaatggcttcagcaacagcagagggcagattccgataaacgcaccccgaaaactagccgcgccagcgttctgtcccagagccctcgagacttagagggccctcaggacgcagccagactccaggatgccgaagcatccgaagggccagaggatacgccagaatctaacacgtgccctgaagaatctgtaagcgctagcacacccgccgagttgaagtag

SEQ ID NO: 28345 - DNA, 462 bp, Artificial Sequence
  Description of Artificial Sequence: Synthetic coding sequence
atgccagactacatggttcatgaagagttcaatcctgaccaggcaaatggctcatatgcgagtcgcaggggtccattcgattttgatatgaaaacagtctggcaaagagaggcagaggaactcgagaaagagaagaagaagctcaggctccccgctatagattcgaaatatttgagcaaagccggcacaccactcgggcctaagaatcccgccggcagtagattgtctttcccaccggttaatgggtataaggacgagtggctgcagcagcagcagcgcgctgacagtgacaaaagaacccctaagaccagccgcgcctccgttttgtcacagtctccacgcgacctggaagggccacaggacgcagccaggctccaggacgccgaggcaagtgaggggcccgaggacacaccaggccccgaggagagcgtttccgcttccacaccagcagagctcaagtag

SEQ ID NO: 28346 - DNA, 300 bp, Artificial Sequence
  Description of Artificial Sequence: Synthetic coding sequence
atgacgtctgccctgacccaagggctggaaaggattccagaccagctgggatacctggttctgagtgagggagccgtattggcatcatccggtgaccttgagaacgatgaacaggcagcatccgcgatctccgagctcgtcagtacagcttgcggttttcgactgcaccgtgggatgaacgtgccatttaagcgcctgtccgtggtttttggagagcatacccttctagtgaccgtgagtggccagagggtctttgtcgttaagagacaaaacagaggaagagaacctattgatgtgtag

SEQ ID NO: 28347 - DNA, 1218 bp, Artificial Sequence
  Description of Artificial Sequence: Synthetic coding sequence
atggagcccggggccggcggtagaaacacggcgcgagcccagcgggctgggtctcctaacacccccccaccaagggagcaggagcgaaagctagagcaggaaaagctgtccggagtcgttaagtccgtgcaccgaagactgaggaaaaagtatcgcgaagttggggacttcgacaaaatctggcgcgagcattgcgaagacgaggagaccctgtgtgagtacgccgtcgccatgaaaaatcttgccgataatcactgggccaagacctgtgagggtgagggtcggatcgagtggtgctgcagcgtctgtcgggaatacttccagaatgggggcaagagaaaggctttagagaaggacgaaaaaagagcagtccttgccaccaagacaactcccgcgctgaatatgcatgagtcttcccaactggaaggccacctgacaaacttgtcctttaccaacccagaatttatcacagagctcctccaggcgagcggcaagatccgcctgcttgacgtggggtcctgttttaacccgttccttaagttcgaggaattcctgacagtagggatcgatatcgtgccagcagtggagagtgtgtacaagtgcgatttcttaaacctgcaactgcagcaacctctgcagctggctcaggacgcaatcgacgccttcctgaagcagctgaagaatccaatcgacagtttacccggagaacttttccatgtcgtcgtgttcagtctgctcctgtcgtattttccaagcccgtaccagcgctggatttgttgtaagaaagcccacgagttgctcgtactaaacgggctgttgttgattatcacacctgactcctctcaccagaaccggcacgccatgatgatgaaaagctggaaaatcgccattgagagcctaggcttcaagcgttttaagtactccaagttttctcacatgcaccttatggcattccgcaaaattagcctaaagactacctccgacctagtgtcgcgcaattatcccggcatgttgtacattcctcaggactttaatagcatagaggacgaagaatacagcaatccatcctgctatgttcggagcgacatcgaagatgaacagctggcgtatgggtttaccgagttaccagacgccccttacgacagcgattcgggagaatcacaggcctcatcaattcctttctatgagctggaggaccccattctcttgctgtcgtag

SEQ ID NO: 28348 - DNA, 1059 bp, Artificial Sequence
  Description of Artificial Sequence: Synthetic coding sequence
atgggtgacttcgacaaaatctggcgggagcattgtgaggacgaggaaacactgtgcgagtacgctgtggctatgaagaatctggcagacaatcattgggcaaaaacctgcgaaggtgaaggtagaattgagtggtgttgtagcgtctgtagagaatattttcagaatggcgggaagcggaaagccttggagaaagatgagaagcgcgccgtgctcgcaacgaagacgacacccgccctcaacatgcatgagtccagtcagctggaaggacatttaaccaacctcagtttcaccaatcccgaattcattactgaacttttacaggcatcaggaaagatacgtttactggacgtggggtcctgcttcaatccgttcctgaagtttgaggagtttctcacagtgggtatcgacattgttcccgctgtggagtcagtgtacaaatgtgatttcctaaatctacaacttcagcaacccctgcagctggcccaagatgctatcgacgctttcttaaagcagctaaagaatcctatcgactcacttccgggagagctcttccatgtggtggtgttttctctcctcctgtcctactttcctagtccctatcagcggtggatttgctgcaagaaagctcacgagttgctagtgctaaatgggttgctgcttatcatcacccctgattcctcgcaccaaaacaggcatgccatgatgatgaaaagttggaagatcgcaattgaatccctgggctttaaaagattcaaatatagtaagttctcccacatgcacctgatggccttccgaaaaatatccttgaagactacctcagaccttgtgtctcgaaattacccaggcatgctctacattcctcaggatttcaactccattgaagacgaggagtactctaacccttcctgctatgtgagaagtgatatcgaagacgaacagttggcctatggcttcactgaactgccagacgctccttacgatagcgacagcggggagagccaggccagtagcatacccttttatgagctggaagaccctatcctgctcttgtcctag

SEQ ID NO: 28349 - DNA, 621 bp, Artificial Sequence
  Description of Artificial Sequence: Synthetic coding sequence
atggtggtagtgatgaagttctttaggtgggttaggcgggcatggcagcgtattatcagctgggtctttttctggcgccagaaaatcaagccaacaatttccggccaccccgactccaagaagcatagcttgaagaagatggagaagacactgcaggtcgtcgaaaccctgaggctggtggagttgcccaaggaggcaaagccgaaactaggggaatctccagagctggccgacccttgcgtgttggcaaaaactactgaggaaacagaggttgaactgggccagcagggccaaagtctgctacagctgccaagaacagctgtgaagagcgtgagtaccctaatggtatccgcccttcagtccggctggcagatgtgcagttggaaaagtagcgtctcgtccgcttcagtgtcatcccaggtgcgcacccagtccccactgaaaacgccagaggcggagctgttgtgggaggtctatctcgtactgtgggccgtacgtaagcacttgcggcggctgtataggagacaggaaagacataggaggcatcatgtgagatgtcacgccgccccaagaccaaaccccgcccagtcgctgaaactggatgcacaaagtccactctag

SEQ ID NO: 28350 - DNA, 762 bp, Artificial Sequence
  Description of Artificial Sequence: Synthetic coding sequence
atgtcgttttcggttcacaaccagaaagggtccaagcgtcccctgcctctggagcccctcttatttctgcaggtaccacggagcaattacctccactttcaggaggaaaaacagagactgcacttaaagaaatttttactggacaggatgttcttagtggcgaagatccaagccaatgtggagagaaaggatgtcgccgactactatgagcaaatgttccagtctgtattaaaacatcacttgggcgaagcagtgactggtctgcttctgatctatcctacatcaatcttgcatatcttagagtcctcttcggacaccctgtataaagtactgttagactatatcgggcacgtgaaagacgagacagtcttctttatacagcagatgaaaatcatagttatttctcacaacataccaatgaggcttttcatgcagtggcacgtatcagtcatcaaggtcccagtaatgtacctggacgatgtgacacagagccagtcactgaaagaggtgattaccgatttcctgacccagacccacaagctttccttatatctatgtcaaactatgaaagtgggcacaaagggcccaggggacaacctgcatcaggtcgcgccagatctgctgctgccagagcagatcataaagtatctgtgtaagtccgaggaatttatggatccagccaccttcatcaatatgtacaaccgcccaattcacattaccctcgactcagaggtagtttggccagcaccaagcagattctag

SEQ ID NO: 28351 - DNA, 2688 bp, Artificial Sequence
  Description of Artificial Sequence: Synthetic coding sequence
atgtggacagaggaggcaggcgccacagccgaggctcaagagagtggcatcaggaacaagtcctcctctagctcccagattcctgtcgtgggcgtcgtaaccgaggatgatgaagcacaggatgttttcaagcccatggacttaaatcgcgttatcaaactgttggaggagacggataaagacgggctggaagagaaacaactgaaattcgtgaagaaactcgttcagtgctaccagaacggactacccctgcgcgatctggcacagatctttaagatcctgaatctgtgtagcggaaagattaaaaatcaaccgagattcatagagtccgcatacgacatcatcaagttgtgtggtctgccgttccttaaaaaaaaagtcagcgatgagattacctacgccgaggacaccgccaattctatagccctcctgggagatctgatgaaaattccaagctctgagctgcgaattcagatttgcaagtgcattgtggatttttatcacgctgagccgcctaagaaacacatccctggctatcaacaggcttctagtagctataagattcagatggccgaagttggcggtttagcaaagactatggtccaatctatgacattactcgaaaaccagctggtagagaaactctgggtgctgaaagtgctgcagcatctgtcgacatccgaggtcaattgcactatcatgatgaaggcccaggcagcctctgggatatgcacccacttgaacgaccccgacccatcaggtcaattactgtttagatcctcagagatcctgtggaatctccttgaaaagagctccaaagaggaggtgattcaacagctaagcaacttggaatgtctgctggccctcaaagaagtttttaaaaatctctttatgcgtggattttcccactatgaccgtcagctgaggaacgacatccttgtcattaccactattatcgcccagaaccctgaagcccctatgattgagtgcggcttcaccaaggatttgatcttgttcgcaacattcaatgaggtgaagagtcagaacctgctggtgaaaggcttaaagctgtccaattcttatgaagactttgagctgaagaagttactctttaacgtgatcgtgatactctgcaaagatctgcctacggtgcagctgctcattgacgggaaggtgatcttggctctgtttacgtacgtcaagaagccagagaaacaaaagatcattgattggagtgctgcacaacatgaagagttgcaacttcacgctatagccacattatcaagcgtggccccattacttatcgaggagtatatgagctgccagggaaacgcaagggtgcttgcttttctggaatggtgcgagtctgaagatccttttttctctcatggcaactcttttcacggtaccggcggccgagggaacaaattcgcccagatgcggtactcactgcgactgctaagggccgtagtttacctggaagatgagacggtgaacaaagacttatgtgaaaaggggacaattcaacagatgattggaatatttaaaaatatcatatctaaacccaatgagaaggaggaggctatagtcctggagattcagtcagacattctgttaatattgtccggtctttgcgagaatcatatacagcgcaaggagatatttggcactgagggtgtggatatcgtgcttcacgtgatgaagacagaccctagaaaactccagagtgggctgggatacaatgttcttctgttttcaacccttgactccatttggtgttgtatcctcggttgttacccttctgaggactattttttggagaaggaaggcatattcctgctcctcgacctgttggcactgaaccagaaaaagttctgcaatttaatcctcggtatcatggttgagttttgcgataatccgaagaccgctgctcatgtcaacgcatggcaggggaagaaagatcagactgcagccagcctgttaattaaactatggcggaaggaggagaaggagctcggcgttaaaagggacaaaaatggtaagattatagactttgagaatctgcctggcctgtccgctgaagacttcgtcacattgtgtattattcaccgctatctggacttcaagattggcgagatctggaacgagatctatgaagaaatcaagctggaaaagctgaggccagtgaccaccgacaaaaaagcgctggaggcaatcacaacggccagtgagaacatcggcaaaatggtggcctcgctccagagtgacatcatcgagtcacaggcttgtcaggatatgcaaaacgaacagaaagtgtatgctaaaatccaggctacgcataagcagagagaattagcaaataaatcctgggaggacttcttggccaggacttcaaatgcaaaaacgctgaaaaaagccaaaagcctacaggaaaaggctattgaggcctcccgctaccacaagagaccacagaacgccatcttccaccagactcatattaagggactgaacactacagtaccttcaggaggcgttgtgacggttgaaagtacacctgccaggctggttgggggccctctcgtggataccgacatcgccttaaaaaaactccctattcgagggggagctctacagagggtaaaagccgtcaagatcgtcgacgctccgaaaaagtccatcccaacctag

SEQ ID NO: 28352 - DNA, 2826 bp, Artificial Sequence
  Description of Artificial Sequence: Synthetic coding sequence
atgtggaccgaggaggctggtgccaccgctgaggctcaagagtcagggatccggaacaaatcttcatcctccagtcagatacctgtggtaggtgtggtgaccgaagacgatgaggcgcaagacgtattcaaacccatggatctcaatcgcgtcattaagctgcttgaagaaacagataaagacggtctggaggaaaaacagttaaagtttgttaagaaacttgtgcaatgttaccagaatggtctgccgctccgtgatttagcacagatcttcaagattttgaacctctgctccgggaagattaaaaatcagcccagatttattgagtctgcgtacgatattataaaactgtgtgggctgcccttcctgaagaagaaggtcagtgacgagatcacctatgcagaggacaccgctaacagcattgccctgctgggtgatctgatgaagattcctagctctgagctccgcattcagatttgcaaatgcattgtggacttctatcacgccgagcctcccaaaaagcatattccgggctaccagcaggcctcaagcagctataagattcaaatggctgaggtcggcgggttagccaagactatggtgcagtcaatgactttgttagagaaccaacttgttgagaagttatgggtgctgaaagtattacagcacctgagcacatcagaggtgaattgcacaattatgatgaaggcccaggctgccagcggcatctgtacccatttaaatgacccagacccttccgggcagctcctgtttagatcctcagagatcttgtggaacctgctggagaaatcatccaaggaagaggtgatacagcagctctcaaatctggaatgcctactggcccttaaggaggtctttaagaaccttttcatgagggggttcagccattatgaccgccagctgcggaatgatatcctagttatcacgaccattattgctcaaaaccccgaagcccctatgattgagtgcggattcacaaaggatctcattctgttcgcaacctttaatgaggtcaaatcacaaaacctgcttgtgaagggcttgaagttgtccaacagctacgaagactttgaactgaagaaactactcttcaatgtaatcgtcattctgtgcaaggacctgcccaccgtccagctgctcatcgatggaaaggtcattcttgcattatttacatatgtgaaaaaaccagagaagcaaaaaataattgattggagcgctgcccagcatgaggaattacagctgcacgccatcgctactttgtcaagtgtcgcccccctcctgattgaagaatacatgagctgccagggaaatgcacgggtgcttgccttcctagaatggtgtgaaagcgaagaccctttcttctctcatggcaattcatttcacggtacggggggcagaggtaacaagttcgcccagatgagatattcactccgcttactccgcgccgtcgtatatctcgaggacgaaaccgttaacaaagacctctgcgaaaagggcacaatccaacagatgatcggtatattcaaaaacatcattagtaaaccaaatgagaaggaggaagccatcgtcttagagatacagagcgatatcctgctgatccttagtggactttgcgaaaatcatattcagcgcaaggaaatctttggaaccgagggagtggatatcgttctgcatgttatgaagacagacccgcggaagctgcagtccggactggggtacaatgtcctgctgttcagcacattagatagtatctggtgttgcattctgggctgctacccttccgaggattacttcctggaaaaggagggcatttttctgttactggacctgctggccctgaatcagaagaagttttgcaatctaatcctcggtatcatggtcgaattctgtgataatccgaaaacggccgcacacgttaatgcttggcagggtaagaaagatcaaacagcagccagcctgcttatcaagctgtggaggaaggaagaaaaagaacttggcgtgaagcgagacaaaaatggaaagataatcgacactaagaagccactctttacgagcttccaagaagaacaaaagattatccctttacctgccaactgtccttccattgctgtaatggatgtgagcgagaacattcgggcaaagatatacgccattcttggtaaactagactttgagaacctgcctggtttatctgcagaagactttgtaaccctctgtatcatccaccgttacctcgactttaaaattggtgagatttggaatgaaatctatgaagaaattaaactcgagaagctcaggccagtgaccaccgacaaaaaggctctagaagccattaccacggcctcagagaacatcgggaagatggtggcatctctgcagtccgacatcatagagagccaggcatgccaagatatgcagaacgagcaaaaagtctatgctaagattcaggcgacccacaagcagcgagaacttgctaataaatcgtgggaagacttccttgctaggactagcaacgccaagaccctgaagaaagccaaaagcctgcaggaaaaggcaatcgaagcatcacggtatcataaacgcccacaaaacgcaatttttcaccaaacccatatcaagggcctgaatactacagtcccatccggcggcgtcgttacagtcgagagcacccccgccagattagttggaggccctctcgtagataccgatatcgccctgaaaaagctgcccatacgtggtggagccctacagagagtaaaggcagtgaaaatcgtggacgcccctaaaaagagtattccaacttag

SEQ ID NO: 28353 - DNA, 1437 bp, Artificial Sequence
  Description of Artificial Sequence: Synthetic coding sequence
gaactgcagttgcacgctatagcaacactatccagtgtggcccccctcctgattgaagagtacatgtcttgtcagggaaacgcccgtgtgttagccttcttggagtggtgcgagagtgaggatccgtttttttctcacgggaactccttccatgggacaggcggtagggggaataaattcgctcagatgcgttattctctcagattactgcgggcagtggtgtacttagaggatgagacggtaaacaaggatttgtgcgagaagggcacaatacagcagatgatcggaatcttcaaaaatatcatttctaagccgaacgagaaggaggaggctatcgtgttagagattcagtctgatatactgttgatactgagcggtttgtgtgagaatcacattcaacgcaaagagatctttgggacagaaggggtggacattgtgctccacgtgatgaagactgacccacggaagttgcagtcaggtctgggctacaacgtgctgctcttctctactttggactcaatctggtgctgcattctcgggtgctatccttcagaagactatttcttagaaaaggaaggtatctttctgctccttgatcttctggctctcaatcagaagaaattttgtaatctgattctgggtattatggtggagttctgcgacaatcccaagactgctgctcacgtgaacgcctggcagggcaaaaaagaccagacggccgcctcgttactaatcaaactatggcgcaaagaagaaaaagagctgggagtgaaaagagacaagaacgggaagatcatagatttcgaaaatctcccgggactgtccgcagaggatttcgtgactttgtgtatcattcaccgctatctggattttaagatcggcgagatttggaatgaaatctatgaggagatcaagctcgagaaacttagacctgttaccacagacaaaaaggctctggaagccatcactaccgcgtctgaaaatatcggcaagatggttgctagtttacagtccgacattatcgaatcccaggcctgtcaggatatgcagaacgaacagaaagtgtatgccaagatccaggctacccacaaacagcgcgagctcgcaaacaaatcttgggaagacttcttagcccgtacaagtaatgcaaagacattaaaaaaggctaagtccttgcaagagaaagcgattgaagcctcccgctaccacaaaagaccacagaatgcaatcttccatcagacccatatcaaagggctgaacacaacagtcccctccggaggtgttgttacggtggaaagcacgcctgctaggcttgttggcgggcctctagtggataccgacatcgcgttaaagaagcttccaatcagaggcggcgctctgcaacgggtaaaagcagtcaagattgtggacgctcccaaaaagtctattcctacatag

SEQ ID NO: 28354 - DNA, 2772 bp, Artificial Sequence
  Description of Artificial Sequence: Synthetic coding sequence
atgtggacagaagaggccggtgcaacagccgaggcccaagaatccggcatcagaaacaagtcatcctcgagttcccagattcctgtggtgggcgttgttactgaggacgatgaggcccaggacgtattcaaaccaatggacctgaacagagtcattaaactgcttgaagagaccgacaaggatgggctcgaggagaaacagctaaagtttgtcaaaaagcttgtgcaatgttatcagaatggactgccacttagagacttggctcagatatttaagatcctcaatctatgctccggcaagattaagaatcagcccaggtttatcgagtcggcttatgacattattaagctgtgcggcctcccatttctcaagaagaaggtgagtgacgagatcacttatgccgaagacacagcaaattccatcgctctactaggtgacttgatgaaaatcccctcatccgaactgcgaatccaaatttgctatcagcaagcctcaagcagctacaaaattcagatggctgaagtcggcggtctggcgaaaactatggtccagagcatgacacttctggagaaccagttggtggagaaactgtgggtcctcaaggttttacagcatttgtccacaagcgaggtgaattgcacaatcatgatgaaagcccaggctgcaagcggcatctgtactcacctgaatgaccccgatccaagtgggcagctcctgttccggagctcggagattctctggaatttattagagaaaagttcaaaagaagaagtgatccagcagctgagcaacctagagtgcctgctcgctctgaaggaagtgttcaaaaacctcttcatgcgcggattcagtcactatgacagacaactgcggaatgatatcctggttattacaactatcatcgcccaaaatccggaagcccccatgatagaatgtggattcacaaaggatctgatactgttcgctacgtttaatgaggtcaaatctcagaacctattggttaagggattgaagctgtccaatagctatgaagacttcgagcttaaaaaactgctttttaatgtcatcgtgatactctgcaaggatctcccaaccgtgcagttattgattgatggaaaggtcatactggctctgttcacttacgttaagaaacctgagaaacagaagatcatcgattggagcgcggctcagcacgaagagctgcagctgcatgcaatcgctaccctcagctctgtggctccactgctgattgaggagtacatgtcttgtcagggcaatgcgagagttcttgccttcctggagtggtgtgaatcagaggacccctttttcagccatggaaacagtttccacgggacgggtgggaggggcaacaagttcgcccaaatgaggtacagtctgaggctactgagggccgttgtctatctcgaggacgaaaccgtaaacaaagatctgtgcgagaaggggacgattcaacagatgatcggcatttttaaaaacatcatctcaaaaccgaacgaaaaagaggaggccatcgtactggagattcagagcgatatcttgttgatactgagtggcttgtgcgaaaatcacattcagaggaaggagatcttcggcacagaaggcgtagatattgtgctccatgtcatgaagacggatcccaggaagctccagagtggcctcggatataacgttctcctgttctccaccctcgattctatctggtgctgtatcctgggatgctacccctctgaggactatttcctggaaaaagaagggatcttcctcttactcgacctcttggcactcaaccaaaagaagttctgtaatctgatcctaggaattatggtggaattctgcgacaatcctaagaccgctgctcacgtaaatgcgtggcaggggaagaaagatcaaacagcggcatccttgttgattaaactctggcgaaaagaggaaaaagagctgggggttaagcgtgacaaaaatggaaagatcattgacactaaaaaaccactcttcacgtcctttcaagaggagcagaagatcattcctctcccggccaattgtcccagtatagcagttatggatgtcagcgagaacatccgagctaaaatttacgctatactgggcaagctggattttgagaatctgccaggcctgtctgccgaagacttcgtgactctgtgtataatccacagatacctggacttcaaaatcggggagatttggaatgaaatttacgaggagattaaactcgaaaagttgaggcccgttactactgataagaaggctttagaagcaataacaaccgcttctgaaaacatcggtaagatggtcgcctcgttgcagtctgacattatcgagtcccaggcctgccaagacatgcagaacgagcagaaggtgtacgccaagattcaggctacccacaaacagagagaattggctaataagagctgggaggatttccttgcccggacttccaatgcgaagacactcaagaaagccaaaagcctgcaggaaaaagcaatagaagcgtctcggtaccataagcggccccagaacgccatcttccaccaaacccacattaagggactcaataccaccgtcccgtcaggcggcgtagtcaccgtggaatctaccccagctagactcgtgggagggccactcgtagacaccgacatcgccctgaaaaagctccccataaggggtggcgctctgcaaagggtgaaggccgtgaaaatagttgacgcgcccaagaagagtatccctacctag

SEQ ID NO: 28355 - DNA, 456 bp, Artificial Sequence
  Description of Artificial Sequence: Synthetic coding sequence
atgcggatggcgcctacagagtctactgaagggagacgcctgtggcccggaccacgcgagggagggtcaggaaaagagaccacctcagagaaattatccaatctcccccggcctcacagctactccccaaaacgcgcggatgctgaaagctttcgaggggtgcccgcagcttttaaaaaatgcagggaagtctttagggcatgttgggggtctagagagttactgttcctgttcaaagcgatcagtgaggcaggacccgctcagaatagctgcggaattactctggagaaagcggggggcctagaggacactggctcgcattggctgtcttgggctcggtgtaaggtcctgtacatcaatggctttaccgacccttggaaggatgcccaagcatggatattgatcgtctcttgtaagaaagggaagggtacacctgagagggagggaagaaactag

SEQ ID NO: 28356 - DNA, 510 bp, Artificial Sequence
  Description of Artificial Sequence: Synthetic coding sequence
atggggtcgtgcggatgggcgctgacacaaagtgattggtgtccctttaagaagcggaaaagacatcagaggtgcgctcactccgagacgcggcacatgcgaacccaacggcagggcgggtatctccaggctcgggaacggggtctgggagaggccaatcctgcttacgcgttgattctggactttcagccacctgagctgcagaacttgagcgagatggggataaatcatgagttaggctacagcagtatcatccccatgatgaagagagccttttctgcgtgcggcactcttggtctgattatgagtggcatttttgacaatcctggacctataaaaaatacccttaaaaaagctttcaccatgctctggagttttactgtttatacgaggctggagtccctcagagttgccctaagcaacgaagagatggtgcccttcatctttcatctaaaaactcagaccgccaatatgctcagtggccccatctcaactccaatgttgctatag

SEQ ID NO: 28357 - DNA, 1317 bp, Artificial Sequence
  Description of Artificial Sequence: Synthetic coding sequence
atggacgtagagatacaagacacgccaggcaaaatcagcataagcaagaggtctatactgtctggcacagtggagaatatagactacccccactattgtgatttgttgcggaaaatgaatatgcccttcgtgaagggtctggaaaaccgccacaactatggccgcttcgagaagaagtgtaaccccgctttcttgaagttccacccttaccccccttcagtcctccccgattaccacctgcatgacccctaccccccaccatacggcccccactatccattgttcccacttcgcgatgatgtgaccttgggagactcctgctctggattcatgagccctggtggcgacgctgatctgaacccaggcataggccggactattcccaccctcgttgatttcagcgatgttaaaccacagcatagagtgccaagacctgacacgggttttcaaactactatcaagcgacaaaagatccttagcgaagagctgcagcaaaacagaagatggaactccagagaagtgcccgacatctctatccgcgcccggttgggaggttggacatcaccattgaaggtgactccgctccagccacaccacgagggacgaagtctgagccacatattcaccttcgacgaggaggccacttgtaccgatgagggagagcccttggttcagacgaacaaaaagtgcaacgccaaagactccttttacaaatctagcacgcagaaagcatacgaagatgtgccctgggacaagatgctaccgcctaaactagtacccgaagagactaccctagaaaaaaccgccgatcctatctcccagtgtttcacgctgaagcgctataaaggagtgcccgctatcacacagatggtaggcgagctttgggaccgcttccagacaaggtcattcctggcaccagtcaagccgataaacttcgtgtctagttcctcccgatctaagtacataccactctacactggacatgtccaatccactaatgctgacgatgtcgacaatcccttgggcgatattgcctccctagctaaacagcggtactctaagcccctctacacaaatacttcgcgcgccgccaatatccctggctacacgggcaaggtgcacttcacagcaacacatccagccaactcaaatattccctccacgaccccatcgcctgacagcgaactgcatcgtgtttttcaaaaagagatggcagtggacttgttccggcaccaagcaccactatcacggcttgttacaaccgtgagaccgtataacccctttaataaaaaggataaggaaacgatcgactactag

SEQ ID NO: 28358 - DNA, 144 bp, Artificial Sequence
  Description of Artificial Sequence: Synthetic coding sequence
atgctgcaattcctattgggcttcaccctggggaatgttgttgggatgtacttggcccagaattatgatatccccaacctggcgaagaaactggaagagataaagaaagatctcgatgcaaaaaagaagccaccgtcagcttag

SEQ ID NO: 28359 - DNA, 315 bp, Artificial Sequence
  Description of Artificial Sequence: Synthetic coding sequence
atgggccggtcaccttgtttttttaaaagtttcaaggggaaacttcataaggataggtcaccagacccctcgaccctggcgagcccccatcccagtaccgaggcccgccgtccagtggaagccgggtctgctgagtggacatgggggtggatgaagcgactgccgccagcctccctctctcccgggatcgctatgagttgttactcaggcgactcaatgctgcagaagtataaagttaagaacgcttatcggctacactggcagggacgcgaggagcctggagcttcaacttttgcatcactggtttttcagtag

SEQ ID NO: 28360 - DNA, 315 bp, Artificial Sequence
  Description of Artificial Sequence: Synthetic coding sequence
atgggcagaagcccttgtttctttaaatccttcaaggggaagctgcacaaggaccgtagccccgacccctctacactcgccagccctcacccctctacagaagccagacgccccgtagaagcagggtcagccgagtggacctgggggtggatgaagcggttgccccccgcctctttgagccccggcatcgctatgtcttgctattctggcgactctatgcttcaaaaatacaaggtgaaaaacgcctaccggctgcactggcagggtagagaggaacccggtgcatccacctttgccagtctcgtctttcagtag

SEQ ID NO: 28361 - DNA, 255 bp, Artificial Sequence
  Description of Artificial Sequence: Synthetic coding sequence
atggcctccgttccatccatcgggtgcttgcttgctcgaaaccagtattatcgtaagtcatccgtctcctccgtgagcagccttacctcaagcgacagcgtgaacttcatcgatgacgataaaccacagcaaggattgccggaggtagctgagtctacctggtggtttaaatccttcttccatagcgagcccgtgctgtccaatgtcaggatcaaagacctaagcgccaccgggagcctttcaggccggagctag

SEQ ID NO: 28362 - DNA, 246 bp, Artificial Sequence
  Description of Artificial Sequence: Synthetic coding sequence
atggctagcgtgccaagcattggctgcttattagcccgcaatcagtactacaggaaatcttctgtgtcatccgtctccagtttaacgagcagcgactccgtaaactttatcgacgatgacaaacctcagcagggcctgcctgaggtggctgagtccacctggtggtttaaatccttcttccactcagagccagtcctcagcaatgtgaggattaaggacttaagtgctaccggaatgaattcttag

SEQ ID NO: 28363 - DNA, 399 bp, Artificial Sequence
  Description of Artificial Sequence: Synthetic coding sequence
atggccgagaaaccgcaccagaacagttgcaatagtgttaggcagctttttaaaacaaagcagctggtaacccaccgtgacaggggcagctgtactcatagggcccaaggactgctcgcggctagaaccacagccctgcagaggagcccgctgcagcaggagatttgggaatccactacggcactgaatttaccttctgctctggccccacagggcctgacagcgaaagacgcgcatttcctcggtgatactgacccgattcaggaaggagcaagagaccacgcagcaggtggccctttccaggacagacaggcctcagtggccgcccagacccttagttgggaacgcggacaaggatttagtcgccaccatggaaatcacctgctgtactctcactag

SEQ ID NO: 28364 - DNA, 690 bp, Artificial Sequence
  Description of Artificial Sequence: Synthetic coding sequence
atggccgctctgggccatcttgccggcgaagcggcggctgctcccgggccaggcaccccatgtgcttctaggggggcccgactccccgggcccgtcagctccgcacggaacccatctaccgtgtgcctctgcccagaacagccaacttgttctaatgccgacagcagggcgcatccactcggcgatgaggggggaacagcaagcaagaagcagaagaacaagaagaagacccgaaaccgcgcatcggttgctaatggcggtgagaaagcttccgagaaacttgctcccgaagaggtgccattgtcagcagaggcacaggcacaacagctggcccaggagctcgcatggtgtgttgagcagctggagctgggcctgaaacggcagaagcccacacctaagcaaaaggagcaagccatcggagccattaggacactgcgaagtaaaagaacgcccctcccacgcaaacggcagctcatgcactctctcttcggagactatagagctcagatggaggctgaatggcgcgaggcactgcgggctctcagagccgctgcctatagtgcccaggtacagccagtcgacggagctactcggaaaaagagccagcgcgtgtgtcgtcctcgcagcatttggagagccaaggctaccctagacatgccagacgaggaatttcgtttcaatttcttctag

SEQ ID NO: 28365 - DNA, 606 bp, Artificial Sequence
  Description of Artificial Sequence: Synthetic coding sequence
atggagaacggcttcactatgtgtcagaccggacgccagcatcccgtcgcatgtggtctacacttgtccggaggaaaggaggacctaaacgatctgcgcatggaaggagtgaccacactggttcctagcggaagcaagtttaatcaagggcggccgacatatcccgctgagccccaagcaaaggtcaccttgaacatatgttctaggtgcgcccggctccagggagacaacctggaagagcggacggaggaatcgcttccaattctgcacagcccagatgagaaaatcccagattccttcgactcactgccgggaacggaagaggctctgatggaagaaggtgatgagtttgagaaggcctcaaagctgacggggcccggtgaggctagcagcggggtcggacacagtctaaaaaactacatggaggaggacgagtccctcaagcagctgcaggtggtgcatcagccatggatcctcccatcagacaccgagtctgaaggcgtggaggccgagcaggagaaacatctgttgaatcaaaatttatgtggttgggatagcgaattctgcatattccatactcttgcttccttcttaatctataaatag

SEQ ID NO: 28366 - DNA, 1284 bp, Artificial Sequence
  Description of Artificial Sequence: Synthetic coding sequence
atgaccaaactaattactgagactcctgatcagccaatcccatttctgatcgaccacctacaaagtaaacaggggaatcgcggccagcttcagcgtaccttgagcggatctgctgcgctctgggctgagagcgagaagagcgagtccaaggggacaaggcgtgacttcagaagctacgacaaaccgtggcaactcaacgccaagaagcccaagaaaagtaagtccgacctcgctgtgagtaatatctctccccccagtcccgatagcaagagcttacctcgttctgtcgagcaccctaaatggaattggagaaccaagccacagtctcgtgatttcgacgagctaaatcacatcttgcaagaaagtaaaaagctgggcaaggccttggaaaacctgagccggtccatcgcaatctcagatgagctggataaagagacagtgacatttaactcatctctgctgagaccgagagtcatcggggagtggatcggtcgcgaagagaacgatgccgaccctcttgccgccgagatgctgcagcctcctatccccaggagtaaaaacgatcaatgggagagcgaagactctggttcttcccctgcagggagtctgaagatggagcccaaaaataaggggctcaaacagcaacagcagcagcacaagaagctccttgctgctatgttgtctcaggactctttcgagtctatacattcccccaccccctctgtaacggaagaggacattgacaatgaagacgatgcaatggagctcctcgaagaccttaatgatctccgtatggagggtgtcacaaccttagtgccctccggttcaaagtttaatcaggggaggccaacgtatcctgctgaaccacaggccaaggtgaccctgaacatctgttcacgatgcgctaggcttcagggagacaacctcgaggaaagaaccgaagagtccctgccgattttacatagccccgatgaaaaaattccagattcatttgatagcctgccaggaacagaagaagcattgatggaagagggggatgagttcgaaaaagcttccaagctcactggacccggcgaggcctccagtggcgtggggcattctttgaaaaattacatggaagaagatgaaagtctgaagcagcttcaagtagtgcaccagccgtggattctacccagcgacacagagtccgagggcgtagaggccgaacaggagaagcgaagcgcagatctgctcctctgtgtgccttgctcctcctgccctaccctggtgtactctggcctttag

SEQ ID NO: 28367 - DNA, 864 bp, Artificial Sequence
  Description of Artificial Sequence: Synthetic coding sequence
atggccagtcatccccagaccagaatccaggcctacctggagaaaaataaaattggtccgctgtttgaggaactaatgaccaagttaattacagagacgcccgaccagccaattcctttcctcatcgaccacctccagagtaagcaagggaaccggggacagcttcagcgcaccttgagtgggagcgcggcgctctgggctgaaagcgagaaaagcgaatcgaagggaactcggagagactttcggagttacgacaaaccgtggcaactgaacgcgaaaaaaccaaagaaaagtaagagcgacttggcagtatcgaacatttctcccccttcccctgactctaaatccctcccaaggagcgtggagcacccaaaatggaactggcgcacgaaaccgcagagtcgcgactttgatgaactaaaccacattctgcaggagtctaagaaactggggaaagcactggagaacctgagccggtcaattgctatttctgacgaactcgataaagagacagtaacattcaatagctcacttttgaggcctagggttatcggcgagtggatcggccgcgaagagaatgatgctgacccactcgccgccgaaatgttgcagccaccgattccccgtagcaagaatgaccagtgggaaagtgaggactccggtagtagtcctgcgggatctctaaagatggagcctaagaacaagggtctcaaacagcagcagcaacagcacaagaaactgctggccgctatgctgagccaggatagctttgaatcaatccactctcccacccccagcgtaacagaggaagacattgacaacgaggatgatgccatggagttgctaggcaatttcaaaaattag

SEQ ID NO: 28368 - DNA, 1617 bp, Artificial Sequence
  Description of Artificial Sequence: Synthetic coding sequence
atgtcctcaccactggctagcgagctgtccgagctcgccgcacttaggcccgggtttagactgagtgcaccacatgccagagtggccccgcgggctgccacgcacgcaaggggccgcggtcgtgctagccacgccgggcagccaagacttagaagtagctgtcccgggccgagtcccggcaaacgtcgcgttgtgccgtcaggtggtgcccagcctcgcgtactgcccgcgctaagctcccgtagccatctcttcccaatggcaagccacccgcagactcggattcaagcatacctcgagaaaaataagatcgggcccctatttgaggagctgatgacgaagctcataactgaaacccctgatcaacccataccatttcttatagatcacctccaatccaagcaagggaaccgcggccaattgcagcgtacgctatcaggatcagctgctctgtgggccgaaagcgaaaagtccgagtcaaaaggcacacggagggatttccgctcttacgataagccatggcagcttaacgcaaagaagcccaaaaaatcaaaatctgatctggccgtgtccaatataagccctccatcgccagacagcaagtcccttcctaggtccgttgagcatccgaagtggaactggagaactaaaccccagtcgagggactttgatgagcttaatcatatcctacaggagagtaaaaaactggggaaggccctcgaaaatctgtctagaagcatagccatcagcgatgagctggataaggaaaccgtgactttcaattctagccttctccgtccaagagtcattggggagtggattgggagagaggagaatgatgccgacccactggcagctgaaatgcttcagcccccaatccctcgctccaaaaacgaccaatgggagagcgaggactccggatcttccccagccggaagcctgaagatggagccaaaaaataagggcctcaaacagcagcagcagcaacataagaagcttctggcagcgatgctttcacaggatagtttcgagagcattcactccccaaccccgtcagtcacagaagaggacatagataacgaggacgacgcaatggagttactggaggacctgaacgacctccgtatggagggggtgacgaccttggtgccttcaggatccaagttcaaccaaggtcgaccaacctatcctgccgaaccccaggctaaggtaacgctgaatatttgctctcggtgcgcacgattgcagggagataacctggaggagagaaccgaagaaagcctgccaatccttcattcgcccgacgaaaagatccctgactccttcgactctcttccagggaccgaagaggcattgatggaggagggcgatgagtttgaaaaggcttctaagctgacaggtccaggcgaagcttctagtggcgttggacactctctgaagaattatatggaggaagacgaatctttgaagcagttacaggtggttcaccagccctggatccttcctagcgacacagagagtgaaggggtcgaagccgaacaggaaaagcgctcggccgatctattgctgtgcgtcccttgctcgagttgccccacactggtctactcaggattgtag

SEQ ID NO: 28369 - DNA, 390 bp, Artificial Sequence
  Description of Artificial Sequence: Synthetic coding sequence
atggcctctcaccctcagacccgcatccaagcatatctggaaaagaacaaaatcggccccctgttcgaggagctcatgacaaaattaatcactgaaacaccagatcaaccaatcccgttcctgatcgatcatctccagtccaagcagggcaaccggggacagctacaacggaccctgagtggctcggcagccttatgggcagagagtgagaagtccgagtcgaagggaacaaggagagattttaggtcttatgacaagccgtggcagctaaatgccaagaagcctaaaaagtccaagtccgatctcgcggtgtcaaatatttccccgccttcccccgactctaaatcgtgcaaggaagtttcttatagcaatgctattcagagtatgtag

SEQ ID NO: 28370 - DNA, 1359 bp, Artificial Sequence
  Description of Artificial Sequence: Synthetic coding sequence
atggcgtcccaccctcagacacgcatccaggcatacttggagaagaacaaaatagggcctctctttgaggaactgatgacgaagctcattactgagacacctgatcagccaattccttttctgatcgaccaccttcaaagtaagcagggcaaccggggccagctacagagaaccctttctggatcagcagccctgtgggcagagagtgagaagagcgaatccaagggaacccggcgagactttaggagttatgataaaccttggcagctgaacgccaagaagcccaaaaagagcaagtctgacctggctgtgtcaaacatctcccccccttctccagattcaaagagtttgcctaggtctgtagagcatccaaaatggaactggcggaccaagccacaatctcgtgattttgacgaacttaatcacattctgcaagagagtaaaaagctgggaaaggcactagaaaacttatcccgttcaatcgctatctcagacgagctggataaggagaccgtcacctttaatagttctctcctgcgcccccgagtgatcggtgaatggatcggcagggaagaaaatgatgccgacccattggcagcagaaatgctccagcctccgataccgaggtccaaaaacgaccagtgggagtccgaggatagtggaagcagccctgccggttctctgaagatggaacccaagaacaagggtttaaaacagcagcagcagcagcataagaagctgttggccgccatgttgtctcaagattcttttgagagcatccactcacctactcccagcgttacggaagaggatattgataacgaggacgatgcaatggaacttttagaagatctcaacgacctgcggatggaaggcgtgacaaccctggttccttctggctcaaaattcaatcaggggcggcccacttaccctgcagaacctcaagccaaggtgactctgaatatttgtagcaggtgcgcccgcctgcagggcgataatctcgaagagcggacagaagagagcctgcccattctgcattcacctgacgaaaaaatccccgactcctttgattcactgccaggaacagaggaagcgctcatggaagagggtgacgagtttgaaaaagcatcaaagttgacagggcccggagaagcttcgagtggggtaggccactccctgaaaaactacatggaggaagacgagtcgttgaagcagttacaagtggtgcatcagccgtggatcctgccttcagataccgagtctgaaggcgttgaagcagaacaggagaagcggtctgccgatctgttgctctgtgtaccctgttcatcctgtcctactctggtttactctggactatag

SEQ ID NO: 28371 - DNA, 624 bp, Artificial Sequence
  Description of Artificial Sequence: Synthetic coding sequence
atggccgaagatctggatgaattattagacgaagtggaatccaaattctgtaccccggatttgttgaggcgaggaatggtcgaacaacccaagggctgcggtggcgggactcatagttccgacagaaaccaggcgaaggcgaaagagactttgcgctctacggaaaccttcaagaaggaagatgacttggacagtctgataaacgagatcctggaagagcctaaccttgacaaaaagccttccaaattgaaaagtaagagcagcgggaacacttccgtgcgggcttcaattgagggtctggggaaaagttgctcccccgtgtacttgggcggcagtagcattccatgtgggatcggcacgaatatctcttggagagcgtgtgatcatctccggtgtattgcctgtgacttcctcgtggtgagttacgatgactatatgtgggacaagtcttgtgactacttattcttccggaacaatatgcccgaatttcataagttaaaggccaagctcattaagaaaaaaggtactagggcctatgcgtgccagtgttcatggcgaacaattgaagaagtgactgatttgcagactgaccaccagttacgctgggtgtgtggaaagcattag

SEQ ID NO: 28372 - DNA, 309 bp, Artificial Sequence
  Description of Artificial Sequence: Synthetic coding sequence
atggctcaggatttcagtcagcatcctcagactggtataattcggcggcacagattctacagcccaaagcctttgtctacaacccccagaggccagagttttcttctgtccaggcaagcaaaagtggccacctgggaccccatgcttagtcctgatttccagccaaagtctgccttcaagttgacatggacagcccagccgccatgtctgagcgttacaccttcgcagggtcagacattccatccgaacagccctgagggagaacttccacctgacctcacggaaaatacgtgccctagtcaagcatag

SEQ ID NO: 28373 - DNA, 558 bp, Artificial Sequence
  Description of Artificial Sequence: Synthetic coding sequence
atgtggaagttaggtagaggtcgtgtcctattggacgaacctccggaggaggaagatgggcttcgcggcggacctccccccgctgctgctgcggccgcacaggcgcaagttcaaggtgcgagcttccgaggctggaaggaggttacctctctgtttaacaaggacgacgaacagcacctccttgagcgttgcaagtcacccaaaagtaaagggaccaacctgagacttaaggaagagttgaaggccgagaagaagtcaggattttgggacaatctagttttgaaacagaacatacagtcaaaaaaaccagacgagatcgagggctgggagcctccgaagcttgctctcgaagacatcagtgcagatcccgaggacacagtgggcggccaccctagctggtccggttgggaagacgatgccaaaggatctaccaagtatacgtccttggcctcatccgccaattccagccgttggagtcttagagccgccgggcgactggtctctatccgtagacaaagcaaggggcacttgactgatagccctgaggaggcagagtag

SEQ ID NO: 28374 - DNA, 597 bp, Artificial Sequence
  Description of Artificial Sequence: Synthetic coding sequence
atgtggaaactgggaagaggccgggttctgttggacgagccacctgaagaggaggatggtctgagggggggcccacccccagcagcagctgcggctgcgcaggcccaggtccagggagccagttttcgaggatggaaagaggtgacttcgctgttcaacaaagacgatgagcaacacttattggaaaggtgtaagtcgcccaaaagcaaaggaacgaatctgcggctgaaagaggaactgaaggctgagaagaagtctggcttttgggacaacctggtcctcaaacagaacatccaaagtaagaagccagatgaaatagagggctgggaaccccctaagctcgcactcgaagacataagtgctgaccccgaggacacagttgggggacacccctcatggagtgggtgggaggatgatgcaaagggctctactaagtacacttcattggcgagctcggccaacagttcccgatggtccctgcgggccgctggtcgcctgatcaaggaagtatggataaacttttcacagctgattattagctttcgcaaacactgcctcgcacactatcgagagttaagattgtgtatcaaatattag

SEQ ID NO: 28375 - DNA, 597 bp, Artificial Sequence
  Description of Artificial Sequence: Synthetic coding sequence
atgtggaagctgggaagaggtcgagtgctgctcgatgagccccctgaggaagaggatgggctgcgtgggggtccaccgcctgccgccgccgcagcggcacaggcccaggttcaaggggcatcgtttcgcggttggaaggaggttacatcactgtttaacaaagatgatgaacagcacttactcgagcggtgtaagagtccaaagtccaagggcacaaaccttcgcctcaaagaggaactgaaagctgagaagaaaagcggcttctgggataacctggtgctgaaacagaacatacagtcaaaaaaaccagacgagatagaaggctgggagccccctaagttggccctggaggatatcagtgctgacccagaggatacggttgggggacacccatcctggtcgggctgggaagatgacgcgaagggcagcacaaaatacacctctctagctagcagcgcaaattcttcccggtggtctctgcgagcagccgggcgtttaattaaggaagtatggattaatttcagtcagctgattatctcgttccggaaacactgtctcgctcattaccgtgagttacgactttgcattaagtactag

SEQ ID NO: 28376 - DNA, 480 bp, Artificial Sequence
  Description of Artificial Sequence: Synthetic coding sequence
atgcgaaagaatgagagttatctgaatcaacctgctcctccaattcccatccctaccttatccctaatggggggatgtcgcgagcattttgagaatcactggaaagggagggctcggtggcttatgccggtgattcccgcgctttgggaggcgaaggcggggcgttccccagaggtgcgatcgagtaaacctgcttggcccacatggcggaaccccatttttacgaaaaacactaagatctcacaggttctagagctgtttctgaactatcagtcactgatttgcgccctggagaagcagaagcggcaaaaggggagcctggctatattttgctggtcttttcaggggggttgcgtttcaaaacgccctgacgtgcccagtctcaaatcccaaaaaccaaagagaaaacggattaccggaaggaaacgcctgtccaagggcttttggagcctgctgttcagcaacctggggaggttctag

SEQ ID NO: 28377 - DNA, 480 bp, Artificial Sequence
  Description of Artificial Sequence: Synthetic coding sequence
atgagaaagaacgaaagctatcttaaccagcccgctccccctataccaatacccaccctgagcctgatgggcggctgccgtgagcactttgagaatcattggaaagggcgggcgaggtggttgatgccagtcatcccagcgctgtgggaggctaaggctggccgtagtcccgaggtgcggagtagtaagcccgcatggcctacttggaggaatccaatcttcaccaagaacacgaaaatcagtcaggtgttggaactgttcctgaactatcagagcctaatctgtgccctggagaagcagaagcggcaaaaaggaagccttgccattttttgctggtccttccagggcgggtgtgtatcaaagcgccctgatgtccccagtttgaagtcacagaagccaaagagaaaaagaatcacaggtaggaagaggttgtctaaaggcttctggtcacttctcttctccaaccttggacggttctag

SEQ ID NO: 28378 - DNA, 1899 bp, Artificial Sequence
  Description of Artificial Sequence: Synthetic coding sequence
atgtcaaatttgaagatgaaagaggctgccctcatctaccttgaccggtctggtggactgcagaaattcatcgatgactgcaagtattataatgactctaagcagagttacgctgtgtatcggtttaagatcttgattaacccatctgatgtcgtcgaacttgatgctgagctcggaaaccatattctccaccaacctcttaaagcggccgaagtgtttcagtctgtctgcttcatcgcagtcaagaccctgtcactgattgggcagttacagactgaaacacagatcaatatcgtgctcaaattgacacatcttcctccccttccaagttacggcctggatctgtgcgaatttcccctagattatacttcccagaggttctatatgatgcagggtattgtgatagctatgaccactatcactaagtatacccagggcgcccgctttctgtgtagcgatgaggcctgtcctctaagtaaaggattccagtatatcagagtccatgtgccaggtgcgaccgaatccgctaccattagaaatgactttctctgcaacttgtgcgctagctctctgcaggaggaccggaagttcagggtgctgggagacaaacaaatagtggaaattatcgctacaaaggctctgagagctttccaaggctatagcaataaccagcccttccgcttccagtcactcaccatctttcttagggatgagagcgtaaacaagatgaacatcggaaatgagtataaaataatcggcatacccacctgcgtgaagacaagtcagactgctgtgtgcattgaagccaattctattacgttttgcaactcaaaagtaccctccggtataagcgacaatttccgctgcctcctgtcactcacttcctctagctgttggaagttcactgcgatcttggccaacatctttgcatcccaaatcacgcccccaggcacctataatttgctcaaactgtgtcttctcatgagcctggtgcagaccaccgacaggaataaagagctcgaggattgccttgacatcctaattattacaagtgacaccctgttgatcgaccgactgctcaacttcagtattaacttagtcccaaggggtattagacatttagtgagtacagaaatttttcctacactgtctcggaacaagtacgggaccggcgccgttagcattcaggcgggctcagccctgttggctaagggcgggatttgctttatcggggacctagcctctcacaagaaggataagctcgaacagttgcagacagtactggagtcacgaagcataaccgtttatattccgggaaaaaaatttggagaggatatcgatcaacagatgaccttccctgtgcagtgcagcttttggtcctttgtcgacgtggatagttccagtagacgaaacgcccagaagatcaatacactgatcggccaaatggattgctccttaatacccgcaaacctggtagaagccttcggacttctgatcaattgtaatgagtccagtccgtgtcacccattcttacctactgtgcagcacactctgaacaaagccataaaccccgaaggtttattctacgcagcctctagacagtttactacggaagattttgagaaactactcgccttcgcaaagaacctgaatgttgagttctcactagaggctgaacgcatgacccacgggtattatttggccagtcgacggatcagaaccggatccgtttgtggcagcaaattgtccgcctccgcgctcaaatatctggtgtttctgagtgaagctcacgcgcgtttgaacttacgcaataaggtcctgaaggaggacgtcttgatcgcagccctgctgttcgagaccagcctgacactgaagtacgggaatgagcttaactattag

SEQ ID NO: 28379 - DNA, 1002 bp, Artificial Sequence
  Description of Artificial Sequence: Synthetic coding sequence
atgatgcagggcatagtgattgcgatgacaactataacgaaatacacccagggggcacgatttctgtgttccgacgaggcgtgcccactgtccaagggttttcagtacatccgcgtacatgtccccggagccacggagagtgccacaattcgcaatgacttcctttgtaacttatgtgctagtagcctgcaggaggaccgcaagttccgggttctgggagataaacaaattgtcgagataattgcaaccaaggctctgagagcattccagggttacagcaataatcagcctttccgcttccagtccctgacaattttcttgagggatgagtctgttaacaagatgaacataggcaacgaatacaagattataggcatcccgacttgcgtaaaaacatctcagactgccgtgtgtatcgaagcgaattctatcacgttttgcaatagtaaggtgccaagcggcattagtgataattttaggtgcctgctgtcacttaccagctctagttgctggaaattcaccgctattctcgctaatatcttcgcctcacagatcacacctccggggacgtataatctgctcaaactgtgtttgctgatgtccctcgtgcagaccacagatagaaataaagaactggaagactgtcttgatatactaattatcacaagcgacaccctcctgatcgaccggttattgaatttttcaatcaatctggttcccagagggattcgccatctagtgagcacagagatttttcccaccctcagccggaacaaatatggaacaggcgctgtgagtattcaggccggttcggctctgctcgccaaaggaggcatctgtttcatcggtgacctcgctagccataagaaagacaagctggaacagcttcagacggttctcgaatctcggtccattaccgtgtacattccaggcaagaagttcggcgaagacatagaccagcagatgactttccccagtgtgcaatttttagtgttctgttag

SEQ ID NO: 28380 - DNA, 1773 bp, Artificial Sequence
  Description of Artificial Sequence: Synthetic coding sequence
atgtcaaacctaaagatgaaggaagccgccctgatttatcttgatcggagtggcgggctacagaagttcattgacgactgcaagtactataatgacagcaagcagagctacgccgtgtatagatttaaaatactcatcaatccctccgatgtcgtcgagctcgacgcagaactgggtaatcacatattgcatcagccattaaaagccgctgaagtgttccagtctgtgtgctttattgcagtaaagactctgtccttgattggacagctgcagacagagacccagatcaatatcgttctgaaactgacccatttaccaccgttgcccagttacggacttgacctttgtgaatttcctctggattacaccagccagagattctatatgatgcagggcatcgtaatcgccatgacaaccatcactaagtacacacaaggggcccgctttctgtgttctgatgaggcctgcccactatctaaggggttccagtatattcgcgtgcatgtgccgggagccactgagtccgctaccattaggaatgactttctctgtaatctgtgcgcctcttcattacaggaggatcggaaatttcgggtgcttggagacaagcagatcgttgaaattatagcaaccaaagctcttcgggctttccaggggtacagcaataaccagccatttcgtttccaaagcctcaccatctttttgcgcgatgagagtgtgaataagatgaacatcggcaatgaatataaaatcatcgggatcccaacctgcgtcaagacatctcagaccgcagtctgcatagaggctaactccatcactttctgcaatagcaaagttccctctggtatttcggataatttccggtgcctgttaagcttgacaagctccagctgttggaagtttacggccatccttgcaaacatctttgcatcgcagatcactcccccaggcacctataacctgttgaagctttgcctgctgatgtcactggttcagaccaccgacaggaataaggagttggaggattgtttagatatcctcatcatcacaagcgataccctgctgatagataggctgcttaatttttctatcaatctggtacctagagggatccgccacttagtgtccaccgagatcttcccaaccttgagtcgaaacaagtacgggacaggggccgtcagcattcaagctggctccgcactcttagccaagggcgggatctgtttcattggggatctggcctcccataaaaaggataagctcgaacagcttcaaacggtgctagagtctcggagtattaccgtgtatatccccggaaagaaattcggagaggatattgaccagcagatgacttttccagtccagtgttctttttggtcctttgtggatgtggactcttcttcccggaggaatgcccagaagataaacactcttataggccagatggattgctctctgataccagccaacttggtcgaggcgttcggactgctgattaactgcaatgaatcaagcccctgccatccatttctgccaactgtccagcatactttgaacaaagctatcaatcctgaaggcctcttctatgccgcttctcgacaatttactacagaggactttgaaaaacttctggcttttgctaagaatctaaacgttgagttttctctcgaagcagaaaggatgactcacggctactatctggcctctaggagaatcagaaccggctccgtctgtgggtctaaattatctgcatctgctctgaaatatctctag

SEQ ID NO: 28381 - DNA, 2046 bp, Artificial Sequence
  Description of Artificial Sequence: Synthetic coding sequence
atgagcaacctcaagatgaaggaggctgctttgatttatcttgataggtctggcggccttcagaaattcatcgatgactgtaagtattataacgatagcaagcaaagctatgccgtctacagattcaaaatcctcatcaatcctagcgatgtggtggagctcgacgccgagttgggaaatcacatactccatcagcccttaaaagcagcagaagtatttcagtccgtctgcttcatcgctgtgaagaccctttctctcatagggcagcttcagactgaaactcagatcaacatcgtgttaaagctgacacatctaccccctttgcctagctatgggctggacctttgcgaatttccactggactatactagtcagcggttctacatgatgcagggtattgtgattgccatgaccaccatcaccaagtacactcagggagcacggttcctgtgctctgatgaggcctgccccctgtctaaagggttccaatatatcagggtgcatgtgcccggggctacagaaagcgctacaatccgcaatgatttcctgtgtaacctgtgtgcgagtagcctgcaggaagatcgaaaatttagggtgcttggagacaagcagattgttgaaataatcgccactaaggctttaagggcctttcagggctattctaacaaccagcccttccgattccagagcttgactattttcctgagagatgaaagcgttaataaaatgaatattggtaacgaatacaagatcatcggaatacccacatgtgttaagacttcacagaccgctgtttgtatcgaggctaacagtatcacattttgtaacagcaaggttcctagcggcatttccgacaacttccgctgcctactctcactgacatctagctcctgctggaaattcaccgccattctcgctaacatcttcgcaagtcagatcactcctcccggcacttacaacctcctaaaactttgcctgcttatgtcgcttgtgcagactaccgatagaaataaggagctcgaggactgcctggatatactcatcattacaagcgacactcttctaattgatagactgctgaacttttccatcaaccttgtccctcgcggaattagacatctcgtgagcactgagatctttccaaccctttcaaggaacaagtacggcactggcgccgtgagcattcaagcagggagcgctctgttggcaaaaggcggcatttgttttataggcgacctggcatctcacaaaaaggataagttggaacagcttcagaccgtgcttgagagccgttctatcacagtgtacatcccaggtaaaaagtttggcgaagacatcgatcagcagatgacatttcctgttcagtgttcattctggagcttcgtggatgtagacagctccagtagacggaacgcccagaaaatcaacaccttaattggacagatggactgtagcctgatacccgccaacttggtggaggcgttcggacttctgatcaattgcaacgagtcgagcccctgccacccatttctaccaactgtacagcatactttgaataaggcaattaacccggagggcctcttttatgctgctagccgccagttcaccactgaggattttgagaagttgctagcattcgcgaagaacctgaatgttgagttctcgctggaggcagaacggatgactcatggttattatctggcctcccgtaggattcgcaccggctcagtttgtggctctaaactgtccgcttcagccctgaagtaccttgttttcctgagcgaggcccacgcgcgcttgaatctgagaaataaggtgctcaaagaagacgtgctgatcgctgccctcctttttgagacctccctgacgctgaaatatggggctacagtgttctgtgttgcaccaaatgctgtgtttccgttcgaactctacaacgaggagtatctggaacagcgagacctgtatctaacacagtgtcagcagcaactagagcagttcatcgccacctatggcccaggcacgacaatcttttcctcagacgaatag

SEQ ID NO: 28382 - DNA, 1857 bp, Artificial Sequence
  Description of Artificial Sequence: Synthetic coding sequence
atgattgcaagcaccacgatggtccggtccgcaaaagtgtgctttattgctgtgaaaacccttagcctgatcggccagctccagaccgaaacacagataaacattgttctcaagctaacgcatcttccccctctcccatcttacgggcttgacctttgcgagttccctcttgactataccagtcagcgcttctatatgatgcaggggatagtgatagcaatgaccacaatcaccaaatatacccagggtgcacggtttctatgttcagatgaggcctgcccactgtcaaagggatttcagtacattcgcgtgcatgtccccggggctacagagtcagctaccataaggaatgattttctttgtaatctttgcgccagctctctgcaggaggaccgcaagttccgggtcctcggcgataagcaaatagttgagataatagctaccaaagccctcagggcttttcagggctatagtaataaccagcctttccgttttcaatccctcactatcttcctgcgagatgagagtgtcaataagatgaacatcggcaatgagtataagattatcggaataccgacctgtgtgaagacatctcagaccgctgtatgtattgaggctaacagcatcaccttctgcaacagcaaggtgccttcaggtatctctgataattttcgttgtctcctttcacttactagctccagttgctggaaattcactgcaattctggctaatatattcgcctcccaaattaccccccccggtacctacaatttgttaaagctgtgcctgctgatgagtctggtgcaaacaactgaccggaataaagaacttgaagactgcctggacatcctaatcattacttccgacacattgctgatagaccgactccttaattttagcatcaaccttgtgccccgcggcattaggcatcttgtgagcacagagattttcccaaccctctcacggaacaagtatggcactggcgctgtttccatacaggcggggagcgccttgcttgccaagggtggaatatgctttattggagatttggcctcccacaaaaaagacaaactcgagcagttacaaactgtactcgaatcacgatccatcactgtgtatatccccggtaaaaagttcggagaggatattgaccagcagatgacatttccagtccagtgctccttctggtccttcgttgacgttgacagtagcagcagaaggaatgctcagaagattaacaccctgattggccaaatggactgctccctaatacccgctaaccttgtggaggcatttgggttgctgataaactgcaatgaaagctccccttgtcatcctttcctccccacagtgcaacacactctcaacaaggctattaacccagaagggctcttttacgccgcctctagacaattcaccaccgaagactttgaaaaattgcttgctttcgcaaaaaacctgaacgtcgagtttagcctcgaggcagaaagaatgacacatggatactacctggcgagccgcagaattcggacaggctccgtctgcggatctaagctgtccgcttctgccctcaagtatttagtcttcctttccgaggcacacgctagactgaatctccggaacaaggtcctcaaagaggatgttctgatcgctgccctcctgttcgagacctcactgacccttaaatatggtgctacagtgttttgcgtggccccgaacgctgtgtttccctttgaactctataatgaagagtacctagagcagagagatctgtaccttacacagtgtcagcagcagctggagcagttcattgcaacttatggtcctggaaccacaattttcagctctgatgaatag

SEQ ID NO: 28383 - DNA, 624 bp, Artificial Sequence
  Description of Artificial Sequence: Synthetic coding sequence
atgatgcaccagatctactcctgcagcgatgaaaacatagaggtattcacaacggtgatcccttctaaagtgtcctcccccgcccggagaagggccaagtcaagccagcatctcctgacaaagaatgtggtaatagaatccgacctctatacccaccagcccctggaattgctgccgcacagaggagacaggcgcgacccgggggaccgcaggcggtttggccgcctgcagaccgcaagacccccgaccgcgcatccagcgaaagcctccgccaggccagttgggatttctgagcccaagacatctaatctgtgtggaaaccgcgcgtacggtaaatcactgatcccgcctgttccacggatcagcgtgaagacatccgcaagcgccagcttggaagcaacagctatgggaaccgaaaaaggagcagttttgatgaggggcagcagacacctgaaaaagatgaccgaagaatatcctgctcttccacaaggggcagaagcatccttacccctcacagggtctgcctcctgcggtgtccccggtattctgagaaagatgtggacacgtcacaagaaaaagagtgaatatgtgggtgctaccaacagcgcctttgaagcagattag

SEQ ID NO: 28384 - DNA, 1125 bp, Artificial Sequence
  Description of Artificial Sequence: Synthetic coding sequence
atgggatgtagctcttcagcactgaacaaggctggcgatagctcccgcttccctagcgtgacctctaacgagcacttttccacagccgaggagagcgaaagctgcttcgcccagcctaagcctcatgccctcggtagggagagtaccgtggatggcaacgttcagagggaatcgaggccccccctacaaaagctgaaagtgtcagccgaacctactgccaatggcgtcaaaccactgcaggagcagccacttgccaaggacgtcgctccaggacgggatgcgacggaccaatctgggtctacagagaagacccagccaggggagggcctggaggagagtggccctccgcagccaggggggaaagaagacgctccagcagcagaaggcaaaaagaaggatgctggagccggcacagaagccgagtccctaaaaggaaatgcagaggcgcagcccctgggaccggaggccaaaggtcaacccctgcaggctgccgtggaaaaggacagcctcagagctgtcgaagtaaccgagaaccctcagactgccgctgagatgaaacctctgggcacaaccgagaacgtccttaccctccaaattgctggcgaactgcagccacagggaactgtgggaaaagatgagcaagctcctttgctggagaccatcagcaaggagaatgaatctcccgaaatcctcgagggatcccagttcgtcgagacagctgaggagcaacagctacaagccaccttagggaaagaagaacagccgcagctgctagaacggatccctaaggagaatgtgacaccggaggtgctggacagatcccagcttgtcgagaagcctgtcatgaacgaccccttccataaaactcctgagggccctgggaatatggaacaaatacaacccgaggggattgtgggctctatggaacaccccgctcgcaacgtggaagccggtgcttacgtggagatgatccgaaacattcacacaaacgaagaggaccagaggattgagggggaaaccggagaaaaagttgaaaccgatatggagaatgagaaagtctccgagggagcagaaactaaggaggaagagacgggagaggttgtcgacctgtctgctgccacttag

SEQ ID NO: 28385 - DNA, 171 bp, Artificial Sequence
  Description of Artificial Sequence: Synthetic coding sequence
atgggttgttcaagcagcgccttgaataaggccggtgattcctcaagatttcctagcggagaaactggcgagaaggttgagactgatatggagaacgagaaggttagtgagggggccgaaactaaagaggaggagaccggggaggttgtggatttgtcagcagccacttag

SEQ ID NO: 28386 - DNA, 960 bp, Artificial Sequence
  Description of Artificial Sequence: Synthetic coding sequence
atggccatctgtccagaactagcccaaacggacaagagcgccctagcgaacctgagcgatgagactgagaccctaaaaaattctacagacgaagtccagaccagctcctcgttttcctccagcggaggacggcagtcatcaccactcacttctgggagcaagctcgaaagagaaaagcagacaccctccttggaacagggtgacacccagagcgaattgcttgattataaaaactacgagaagaaactgagcaagaagtggattaattacctcaagcttaaagactctaactttgagcgccaccagcccgacactaagcttccaactgagattacgcgcgtgagcgacgaggagcttaatgctctgcaatcatactgtaccatgaaaattaacctcattcaccggcggggtgattccaagaaaaagacgagtagtcgacacaagaaactccatttgggcctggatgtggaagcatctgaacgggacgcattcagctgcactgttcctgacgagttgttgaacaggatctacttcaaaaacatgagaacgacccccaagcaggaagcagccgccaaacagcatatctcataccagtgcccatactgtaaccgcaagagggctgagctggcgttgtccgcattcctcaaacaaaaaaagacactgctagagagtttcctgctccaggaacgcatcgacgagcacctccacactaaagattttctgaccaggatcggggaagcccatcaggacttccctcgactatcagacgacccccggataatctggaaacggctgacagaaaagtcacacatcaggtattccggttttgagcggagcgagaccgagcagaagttgcagcgggacggcaattcagcctgtcacctacctttctccctgccttttctgaagcgtttaaccctaattaagccagagttggtcatcgtaaacgacaacgtgtag

SEQ ID NO: 28387 - DNA, 693 bp, Artificial Sequence
  Description of Artificial Sequence: Synthetic coding sequence
atggagaaaccccgattatatcagaaatataaaatttccagggtatggtggcggctgccagttatacctgcgactggggaggccgaagataacaggctgaaccccgaggggcgggggtgcggtgagcctaggtcacgtcactgtactccagcgtggacaaccactgccaagctccatctgaaaacaatcatttctctccagcctcttaacatgtaccaaatggagccaggcgtgggctctattcggacatccccagcccttcaatcacctccagctctgacccgcggcccgagcgcctgggatacagcaatccgcaaagccctaagcttcggcgtgggtctgggagtcctcgtgctcgtctgcctgttttatcacttcgtgacactggcgcctatcctgcagtttgcttcattgccctgcctgctggaagcaggcgctcagatgagcaggcaccccgttacgacgcaggtttgtgtgatgccggctcggctgtccttaggatcgggtatatctcgaaatctgctcagactgagcgtctgtcacttcaccctacttcttcctttcagatctctgcgcccttgtcccctaagctcacgtgacatggtcctgagctatgagctctggttgctgtgcgacttttacatcgcaccccccgatagtagtgggtcaggcatctgtaaaaaggcaatctag

SEQ ID NO: 28388 - DNA, 318 bp, Artificial Sequence
  Description of Artificial Sequence: Synthetic coding sequence
atgagcctgaaatcctggcacccacagtccaagacaaaaagagtgggtgcgtctgaaggtaacccccaatgggggagcggttcaatggaagcgccgttgctcagcagtttcctccctccactcgcctctgaggcggagctgactggcaacacttggtttctgcatcgatgctcatgtattcttaatctggaagagtcaatggactccgattggggagcctggtggggtgtaagtctgcctaggagagccccattcctcatttatgggtccgatggaccctggtgtacccaggctggcttcccgggctggggccactag

SEQ ID NO: 28389 - DNA, 318 bp, Artificial Sequence
  Description of Artificial Sequence: Synthetic coding sequence
atgtccctaaagtcctggcaccctcagagtaaaaccaaaagagtcggcgctagtgaggggaatcctcagtggggttcagggtctatggaggctcccttgctgtcgtctttccttcccccactggccagtgaggccgagttgaccggcaatacatggttcctccatcgctgctcgtgcatattaaatctcgaggaaagcatggatagcgactggggtgcttggtggggtgtatccctccctcggcgggctccattcttgatttatgggtccgatgggccctggtgtacccaggccggctttcccggatggggtcactag

SEQ ID NO: 28390 - DNA, 1098 bp, Artificial Sequence
  Description of Artificial Sequence: Synthetic coding sequence
atgatgggtcgccggcgagctttcgccgttgacggacgtgatggggctggtgaaggcctggcacgtggatgcatcgtgcctggagtgactagtacctatcgaaggattcccgacgcagcacacggatgcagttcatgggaaaggggggacaagtttcgaggcgtcgggagagaagccctatttcttaagttggcaagtcgcgactctggcgtggagatggcagtcggtgatagtccattggcggcactgcccggattgagccaagacagtttagacttcgagtcgtcaggaagctctgaaccaccagcccaggttggccggctgctcgcctcccagaagttgggggaggttttggagcgatcacggcgactcccaacagcgcccacgagtctgagcggtcagcatcgcagtttgcgcttggctagcaaaccagaacgagaagttcccctgggtgcagggcagcaggagtctatggaagccgacacagatctcgaggccgggctggaggaagaggcagtggggggcctggggcccggggcctgggcttgcctgccgggccagggccttcgctatctggagcacctctgcctggtgctggagcaaatggctcgactccagcagctctatctccaactccgcatccagaggcccccaggtgacccaggagaagaggaaagcacgcgggcccctctacctagcccgctgcatactcccgggaaccggggtcagggaccatgggagctacttagccagactgaacatacaggagcgaaagctgccagcccacctaaagtcgaagtgcccagtgccaaccccccccggctcccagaaacccccgtggagcccacctaccatctaccaagcagtcagggccacaaaagagacatctctcactgggataaagttaaggttctattgaaccgaatctgtcgccgctctcatcaccatcctgaaccaccggcacctcctgacggatccgacccccgcatcgaaagcagggatctaccggaaagaccacagtgccggcctcacaggaaaacatttatgccctcattagtcgtgaagaaacagcgagccaagaacctttctgtgggttag

SEQ ID NO: 28391 - DNA, 987 bp, Artificial Sequence
  Description of Artificial Sequence: Synthetic coding sequence
atggctgtcggagattcccctctcgccgccctccccggcctgagccaagattccctcgatttcgagagttccgggagcagcgaacccccagctcaggttggccggctgcttgcttcacagaagctcggagaggtcctagaacgttcccgccgccttcctacggcccccacctctctgagtgggcagcacaggtctttgcgcttagcgtctaaaccggagcgagaggtgccactgggtgccggccagcaagaaagcatggaggcggatacagacctcgaggcaggcctcgaggaagaggcagtcggtggactcgggcccggcgcctgggcctgcctgcctggacagggactgcggtatctggagcacctgtgcctggtactggagcaaatggcgcggctgcagcagctgtacctccagctaagaatccagcgcccacccggcgatccgggtgaagaggagtcaacaagagcccccctgccatctccactgcacacccccggaaaccgtgggcaggggccctgggagttgctctcacaaactgaacatacaggtgccaaagctgcttctccacccaaagttgaggttccatctgctaaccctccacggttgcctgagactccggtggaaccaacatatcatctgccatcctctcagggtcataagcgcgacatttctcactgggataaggtaaaggtgctgctaaatcgcatttgcagacgatcccatcaccatcctgagccacccgcacccccggacgggtccgacccccgaatagagtctcgagacctgcctgaaaggccccaatgtaggccgcatcggaaaacctttatgcccagtctagtagtcaaaaagcagaggaagaaacccttctgccgactgcgccccttgggggccccgggcgacccagggtggcgaggattggctgtgaagtcctcaagcccctccgccctattgctccttttacatatcgcccgcaaaagctgctag

SEQ ID NO: 28392 - DNA, 1074 bp, Artificial Sequence
  Description of Artificial Sequence: Synthetic coding sequence
atgatgggtcgccgtcgagcttttgctgtcgatgggagagacggagctggcgaaggcctggccaggggttgtatcgtccctggcgtgacctctacataccggagaattcccgatgctgcccacgggtgttcgtcttgggagaggggtgataaatttagaggcgttggacgcgaggccctgttcctcaagttggcctcccgcgactccggagtcgaaatggctgtgggggacagcccattggccgccctacctggcctgtcacaggattctctcgattttgagtcttccggtagctcagaacctcctgcacaggtggggcgcctactggccagccagaagcttggggaggtccttgagagatccagaagactacccaccgccccgacttctttatcaggtcagcacagatcactgcgactggccagtaaacccgagcgggaggtgccacttggggccggacagcaggaaagcatggaagcagatacagacctggaggccggcttggaagaggaggctgttggaggccttgggcctggtgcatgggcgtgtctgcctggacagggacttaggtacctggagcatctgtgcctggtcctggagcagatggctcggttacagcagctgtatctacaactccgtattcagcgtccccccggcgaccctggggaggaggagtcgacacgggcacctctccctagtcctctacacactccaggtaaccgcggtcaaggtccatgggaactgctgagtcagactgaacacacaggtgccaaagctgcctctccacccaaagtggaggtaccttctgcaaaccccccaagactcccggaaacccccgtggaaccaacatatcacctcccttcaagtcagggtcataaggtcaaggtgctgttgaatagaatttgccgtcgcagtcaccaccaccccgaacccccagctccgcccgatggctccgacccacggatcgagtcccgggatttacctgaacgccctcagtgcaggccacatcggaagacctttatgccatcactcgtcgtcaagaagcagagagctaagaatttgtctgtaggatag

SEQ ID NO: 28393 - DNA, 132 bp, Artificial Sequence
  Description of Artificial Sequence: Synthetic coding sequence
atggccaaaaataaactcagaggcccaaagagcaggaatgtttttcatatagcatctcagaagaattttaaggccaagaacaaggcgaagccagtcaccacgaacctcaagaaggttctccacttctcatag

SEQ ID NO: 28394 - DNA, 297 bp, Artificial Sequence
  Description of Artificial Sequence: Synthetic coding sequence
atggctaagaacaagctaagagggccgaagtcccgtaacgtgtttcatatcgcctctcagaagaatttcaaggccaagaacaaggccaagcccgtgaccacaaacctcaaaaaaattaacatcatgaacgaggagaaagtcaatcgagtcaataaggcgtttgtgaatgtgcagaaagagttggctcacttcgctaaatcaatctcattagagcctctccagaaagaactgattccgcagcagagacatgagtcaaagccagtggacgaggccacgcgactcatggctctgctgtag

SEQ ID NO: 28395 - DNA, 297 bp, Artificial Sequence
  Description of Artificial Sequence: Synthetic coding sequence
atggccaaaaacaagctcagaggaccaaagtcccgcaatgtgttccacatcgcttcacagaagaactttaaggcaaagaataaagccaagccggtcacaacaaacctgaagaagattaacatcatgaatgaggaaaaggtgaatagggtaaataaggcctttgtgaatgttcagaaggagcttgcccacttcgccaaatccatttctctagagccacttcaaaaagagctcatacctcagcaaagacatgagagcaaaccggttgacgaggctactagacttatggccctgctgtag

SEQ ID NO: 28396 - DNA, 297 bp, Artificial Sequence
  Description of Artificial Sequence: Synthetic coding sequence
atggccaagaataaactacggggtcctaaatcaaggaacgtgttccatattgcctcccaaaagaacttcaaggccaagaacaaagcgaagcctgtcacgaccaatctcaagaaaatcaacatcatgaacgaggagaaagtgaaccgcgttaataaggccttcgtgaacgtgcagaaggaactcgcccattttgccaaatcaattagcctggaaccccttcagaaagaactgattcctcaacagagacatgagtcaaagccagtggacgaagctactagactcatggcacttctttag

SEQ ID NO: 28397 - DNA, 297 bp, Artificial Sequence
  Description of Artificial Sequence: Synthetic coding sequence
atggccaagaacaagctgcgagggcctaaatctcgaaacgtcttccatatcgccagccaaaaaaacttcaaggctaagaataaagcgaaacccgtgacgacaaatctgaaaaaaattaatattatgaacgaggagaaggtgaatagagtgaacaaagctttcgtcaacgtgcagaaggaactggcacattttgccaaatccatctctctggagcccctacagaaggagctgattcctcagcagcgacacgaaagtaagccggtggatgaggccaccagactgatggctcttctgtag

SEQ ID NO: 28398 - DNA, 138 bp, Artificial Sequence
  Description of Artificial Sequence: Synthetic coding sequence
atggcgaagaataagttaaggggccctaaatcacgaaatgtgttccacattgcttctcagaaaaactttaaggccaagaacaaagcgaagcccgtcacaaccaatttgaagaagatcaatatcatgaatgaagaatag

SEQ ID NO: 28399 - DNA, 297 bp, Artificial Sequence
  Description of Artificial Sequence: Synthetic coding sequence
atggccaagaataaactgcggggtccaaagagccgtaacgtcttccacatcgcaagccagaagaactttaaagccaaaaacaaagcaaagcctgtcaccactaatctgaaaaagattaatattatgaatgaagagaaggtgaatcgcgtcaataaggccttcgtgaacgtgcagaaggagctggctcattttgcaaaatccattagtttggaacctttgcagaaagaacttattccacagcagcggcatgaaagcaagcctgtggatgaggctactagactgatggctttgctttag

SEQ ID NO: 28400 - DNA, 132 bp, Artificial Sequence
  Description of Artificial Sequence: Synthetic coding sequence
atggccaagaacaagctcagaggccccaaatctcgaaatgtctttcatatcgccagccaaaagaacttcaaagccaagaacaaggctaaacccgttaccacaaatttgaaaaaggtgctccacttctcttag

SEQ ID NO: 28401 - DNA, 2160 bp, Artificial Sequence
  Description of Artificial Sequence: Synthetic coding sequence
atggccggaggggtttggggaaggagcagggctcgggaggcccccgtaggcgcgctgactctcaccgcactcacagaggggattagggcaaggcagggacaaccacaaggacccccttcggctggcccccaaccaaagagctgggaagtcaagcctgaagccgaaccacaaacccaagcccttactgctcctagcgaagcagaaccaggccggggagctaccgtcccggaagccggctcagaaccgtgctccctgaatagcgcgctggagcctgccccagagggtccccaccaagttccacagagtagctgggaagaaggggttctcgccgacctcgccctgtacacagccgcttgtctggaagaagcggggttcgcaggaacgcaggcaacagttcttactctctctagtgctctggaggctcgcggagagaggctggaagaccaggtacacgctctggtgcgggggctcctcgcacaggtgccatcactggcggaaggtaggccctggagggccgccttgagggtattgtcagccctggccctggaacacgccagggatgtcgtctgcgccctcttgccaaggtcgttgcctgcggatcgcgttgctgcagagctgtggcgctccctgagtagaaatcagcgagtgaatggccaggttctcgtgcaactgctgtgggcgctgaagggcgccagtggtcctgaaccccaggctctggccgccacccgggccctgggcgagatgctcgcagtaagcggttgtgtcggcgccacccgaggcttttacccgcacctgttgttggccttggtcacccagctccataagctggctcgcagcccatgtagccccgatatgcccaagatctgggttcttagtcatcggggaccgcctcattcacatgcttcctgtgcggtggaagccctcaaggctctactgactggtgatggaggtagaatggtggtgacatgcatggaacaggctggaggctggagacgcttagtgggtgcccacacccacctcgaaggcgtactgctgctggcatctgccatggtcgctcacgcggaccaccatttaaggggactgttcgccgacctgttgccccgattgcggagtgcggatgacccccaaaggctgacggccatggctttttttacaggtctgcttcaatcgcggcctaccgcccgcttattgagagaggaagtgatactcgaacggctgttgacctggcagggcgaccccgagcctacagtgaggtggcttgggctgttaggcttggggcatcttgccttgaatagaagaaaagttcgccacgtgtccacgctgctgcccgctcttctgggtgccttaggggaaggagatgcgcggctggtcggcgcagctctgggagctctgcggcggctgcttctcagacccagggcccctgttaggctattgagcgctgagctgggcccacgactccctccactgctagatgataccagggatagtattagagcaagcgctgttggactcttggggacactggtgcggaggggtcgcgggggcttacgacttggcctgcgcgggccactgagaaagctggttttacagtccctggttcccttgttattgcggctccatgaccccagcagagacgccgccgaatcctctgaatggacgctggccaggtgcgatcacgccttttgttggggcctgctggaagaactcgtgacagtggcacactatgactcaccagaggctctgtcacatctctgttgtcggcttgtacaacgctatccaggtcacgtcccaaacttcctgagtcagacacagggatacctgcgcagccctcaagaccctttgcgcagagccgccgcagtactaatcggatttctggtgcaccacgcttctcctggttgcgttaaccaggacctgctggattccctttttcaggatcttggaaggctgcagagcgatcctaagccggctgtcgccgcagctgcacatgtttcagcgcaacaggtggccatgctggcaagggctcgcggatgcccaagaggtcctcgattgctacgcatcgccccgagacctgcccgccctcctcctgtgttcgcggacagcccgttccagcgaaggtcagtggctgggcggtgggggtgcagcgggcctaggcgagcgtag

SEQ ID NO: 28402 - DNA, 885 bp, Artificial Sequence
  Description of Artificial Sequence: Synthetic coding sequence
atggctttgctgactccccagggagtgaaagaggtcttccaacttcagcgtcctcaggggagagagcgcctacgccgtctactcaactgggaagagtttgacgaacagcgggactcccgtcggtctattctgcttgacaccctgtatgagtctattatcttcgcagtggggaaaggattcccatgggtcgaagtggcccaagtcgtgaaatttaccgaagaacttctgcgggagactaaggggtgctcgataaccgaagcagtgaccattctcggaaataaactcagagactatcgcggtcatttcaataccacacacctgcttgctctgtgcgattacttccatcacactttcatcagacattataagctttaccaatatgtgctgggccaagaccagcaggtagacctcaccgtggcacacctggaagtgtgcatgcctcctcaccccctaccactggcagaggggatggacagggatctctggatccacgaacaacaggtcgctactctcacagaagcggaagctcaaaaaagagcagatgtgctgctgctgaaggaggctctaaggttagaacgggagaatagcctccagaaagcctttgcagctgctgcacccgctcaacctggccaggtgctcgagcggcaggagctagagtcgctgatctgccaagcggttcacacacagatggagctccttcaggaactgttgcagagacaaattcagaatacttttgctattctggaccttaagctccaaaagaaaaccttgaaccttaacgctcccacacccatccctccgcccatcacgtcacacgcaggacaggaagaggctcttaaaccacaaagagcctccaaaggaaagaaggccaaagcacggaaatag

SEQ ID NO: 28403 - DNA, 1143 bp, Artificial Sequence
  Description of Artificial Sequence: Synthetic coding sequence
atggattctgggtgttggttgttcggcggtgagttcgaagactcagtgtttgaggagagaccagagcggcgctcaggtcctcccgcaagttactgcgccaagctgtgtgaaccacagtggttctacgaagaaactgagtcttcagatgacgtcgaggtgcttactctaaagaagttcaagggggatctggcatacaggcggcaggagtatcagaaagcactccaggagtactcatccattagcgaaaagctgtcctcaaccaacttcgctatgaaacgcgatgtacaagaaggtcaggcacggtgtctggctcatttgggcagacatatggaggcgctggaaatcgcagctaaccttgaaaataaggccactaacaccgaccacttgactactgtgctgtacttacagcttgcgatctgctcttctcttcagaacctcgagaagaccatattttgtttacagaagctcatctcattgcatccatttaatccgtggaattgggggaagttagctgaagcctaccttaacctggggccagcactttcagctgcgctggcctcatcacaaaagcaacactcttttacctctagcgacaaaacgataaagagcttcttcccccattccgggaaagattgtctcctgtgttttccagaaacattgccagagtcctcgcttttcagcgtggaggcaaacagcagcaactcccaaaagaacgaaaaagccctgactaatatccagaattgcatggccgagaaacgggaaactgtactcatcgagacacagctgaaggcctgcgccagtttcattcgaacccggctcctgttgcagtttacacagccacagcagacatctttcgccctggaaaggaatctcagaacccagcaggaaatagaagataagatgaaaggcttcagcttcaaggaggatacactgctcctgattgccgaagtgatgggtgaggacatccccgagaagattaaagatgaggtccacccagaggtgaagtgtgtaggttcagtagcccttactgccttggtaacggtcagctccgaagaatttgaggacaaatggtttcgcaagatcaaagaccatttctgtcccttcgaaaaccagttccatacagagattcaaatcctggcctag

SEQ ID NO: 28404 - DNA, 636 bp, Artificial Sequence
  Description of Artificial Sequence: Synthetic coding sequence
atgttgcgacagtcctgttcgtttcccgtcacaagtctgcctgccctcgggggtgtttgtggccgcgagggagccggcgccgaggttccccctgcagcgtgcggctgcgaggggagagatcctgatacagaaagaagttgtggtaggagctccactggggggtgttctccgtgtagcggcccaggtccatcgagccctaggacatccagaggtgccctatctccgtctttaggccgcttgttcccacacctgcaggttgttataaaactgcgtatccagttagcccccgccgtccatctggccctgcctacatgctcactgctgacgtcctcccctccgctggagggctgttgccaccgtctaaacgaggaggccgaggtccaacgtgggttccgacctatcgccgtggagctcgaattcgagaaccagcccctcggcgcagagaccaggttgaggaatgggaggagggccggcgtgaagcgttctgaagggagggggcaggtgcgtcctgggcaagtgcgctccaccggcccggagggggggctcaccagaatggagaggaaggccgcaagactgcagtgggatagcggcagcattaagatgtctgagaatgagcagctgtgggaagaaccttag

SEQ ID NO: 28405 - DNA, 261 bp, Artificial Sequence
  Description of Artificial Sequence: Synthetic coding sequence
atgtggccgccctgcgggactctccggacacttgcactggccaggtcccgaggcgctcgtgcttgttccggcgatgggggggtgtcctacacccaggggcaatcacccgagcccagaacccgcgagtatttttactatgtcgatcaccagggacagctgtttctggatgacagtaaaatgaagaactttatcacctgtttcaaaggcaatgctgtgcccccatctccagccccctctttcagcctaccaggctcaccttag

SEQ ID NO: 28406 - DNA, 468 bp, Artificial Sequence
  Description of Artificial Sequence: Synthetic coding sequence
atgggccccggcgacttccggaggtgtagagagaggatctcccaaggattgcagggtctaccgggccgagccgaactgtggtttcctccaaggcctgcctgcgacttcttcggcgacggtagatccaccgatatccaagaagaagcactggctgcatcaccattactcgaagacttgcgacgcagactcaccagagccttccagtgggctgtccaaagagccatcagtaggcgtgttcaggaagccgcagccgccgcagcagctagagaggaacaaagttggacgggagtggaagccacactggctcgcctgcgtgctgaactggttgaaatgcactttcaaaatcaccagctggccagaacactgctcgatctgaacatgaaagttcagcagcttaagaaggagtatgagttagagattacctccgactcccaatccccaaaagacgatgctgccaatccagagtag

SEQ ID NO: 28407 - DNA, 672 bp, Artificial Sequence
  Description of Artificial Sequence: Synthetic coding sequence
atgcgacccctaggaaagggcttactgcctgccgaagagcttatccggagcaacctaggagtgggtaggagtctgcgcgattgcctctcccagtctggcaaactcgcggaggagttgggctctaaacgcctcaaaccggccaaattcgggacagaagggaaggagcgggtggaacaaaggacggagaggcagcggactggatcttctaaagaacccaggatgcagatcatatgtcgaaggaggtggcgagagcccccaccccgcctactctgggggtgcttaatgcccagggcacaaccgctgctgcatgtcaccgcttacgagaacacaggacactgggagcgacttgcatcagtggtgagtagcaaaactcagcagccaaccgtgatcagccactctagcatctctatcacattcagtcactatccccccgcgacactcgacagcttcctggtcctggagccaatcaaactcttcccagtctcatctctgcggagccccctttgcctgaattgcggaagctgccgcgaatctatacgcatttccggtgagctgatcggcaacgcccattctcctgcccccccgagaactcctgagctggagaccctcgggtgggacaaacaggcggtactcagcggggctcaggtgatcttggtctgcgccgaggtgtag

SEQ ID NO: 28408 - DNA, 306 bp, Artificial Sequence
  Description of Artificial Sequence: Synthetic coding sequence
atgcgaacacctaaaagaacacggagtcccaagactaaagtgtctttacgcggcgagacactgacacttcagctgactacagtgtccctggacacccgccatatggtgaaacgctgcgacgaacgccacgggcggcccctgcctcatagccaggaaagtcaacatggatcagccacaagcaagaaggccgtcagaggaaccgccgacaccgcccctctagagcgcatttccgctgctaggggttgggctttacctatggaagctactgtctctgtctttcgagcccatcagtggcagtggaattag

SEQ ID NO: 28409 - DNA, 561 bp, Artificial Sequence
  Description of Artificial Sequence: Synthetic coding sequence
atggaactttcttgtcccgggagcagatgtcccgtgcaggaacaacgggcacgttgggaacgcaagagagcctgcacagcacgcgaattactcgaaacggagaggcggtatcaggaacagctgggactggtcgcaacatactttttgggaatattgaaggccaaggggactctgagaccccctgagcgtcaggccctgttcgggtcttgggaactgatctacggagcctcacaggaattactgccttacctcgagggtgggtgttggggacagggactggaagggttttgccggcacttggagctgtacaatcagtttgcagcaaatagcgagaggtcgcagaccaccctgcaggaacaactgaagaaaaataaaggattccggaggttcgtccgcctccaggaagggaggcccgagtttggcggcttgcaactacaagatctgctgcccctgccactccagaggttgcagcagtacgagaacctcgtcgttgccctcgctgaaaataccggacccaatagtcctgaccatcagcaactgacccccgtgctgccatcatag

SEQ ID NO: 28410 - DNA, 1008 bp, Artificial Sequence
  Description of Artificial Sequence: Synthetic coding sequence
atggaactaagctgccccggatcgcgctgtccagtgcaggagcagagagccagatgggaacggaagagggcatgcactgccagggagctgctagagaccgagcgtcgctatcaagagcagttgggcttggtcgccacttactttctcggaattttaaaagccaagggcaccttacgtccaccagaacgtcaggcattgttcggctcgtgggagctcatctatggcgccagtcaggagttactgccttatcttgaaggaggctgctggggacagggactggagggattttgcagacatctggaactgtacaatcagttcgctgctaacagtgagcgcagtcagacaaccttacaggagcagctgaaaaaaaataagggcttcaggagatttgtgagactgcaggaaggcaggcctgagttcggcggcttgcagcttcaggacttgctacctctgcccctgcaacgtctgcagcaatacgagaatctggtggtggcacttgctgagaacactgggcctaacagtcctgatcaccagcagctgactcgggcggccagattaatttccgagaccgcacagcgggtccacacaatcgggcagaagcagaagaatgaccagcacttgcggcgcgtccaggccctattgtcaggaaggcaggccaagggtctgacctctggccggtggtttttgcgacaggggtggttgcttgttgtccctccacacggggagccacgacccaggatgtttttcttattcaccgacgttttgcttatggctaagccccggcctccgctgcacctgctccgttcaggcacctttgcctgcaaggcgctgtatcccatggctcagtgtcacttgagccgcgttttcggacacagtggcggaccctgcggcggcctcctgtccctgagtttcccccacgagaagctactgctgatgtccaccgaccaggaggagctgtcacggtggtatcactcccttacttgggccatctcatcccagaagaactag

SEQ ID NO: 28411 - DNA, 900 bp, Artificial Sequence
  Description of Artificial Sequence: Synthetic coding sequence
atgcttggtgtgtgtcagacactcaagcagtattttctcggtatcctgaaagcaaaagggacactgcgcccgccagagcggcaggcactattcgggtcttgggaactgatttacggggcgtcccaggaattgctgccatatttggaaggcggatgttggggacagggtcttgaggggttttgtaggcatctggagctctacaatcagtttgcagccaactccgaaagatctcagacgaccctgcaggagcagctgaagaaaaacaaggggttccggcgctttgtgaggctccaggaaggacgccccgagtttggtggactgcaactacaggacctgctcccactcccacttcagcgtctgcagcagtatgagaatctcgtcgttgccctggccgaaaataccgggccgaattctcccgatcaccaacaactgacccgcgctgccaggctaatctcagaaaccgctcagagagtccacacaatcggacagaagcaaaagaacgaccaacatctgaggcgggtacaggccctgctgtcaggccggcaggcaaagggtctaaccagcggacgctggtttctgcggcagggttggctcctcgttgtaccacctcatggggaacccaggccgcgaatgtttttcttattcaccgacgtgctgctgatggccaaacctcgaccgcctctccatttgttgcgctctggaacattcgcatgtaaggccttatatccaatggcgcagtgtcatctttctcgtgtatttggccacagcgggggaccctgcggtggactactctctctgtctttccctcatgaaaagctgctgctgatgtccacagaccaagaggaactgagtcggtggtaccatagcctcacctgggcaatctcctcgcagaaaaactag

SEQ ID NO: 28412 - DNA, 171 bp, Artificial Sequence
  Description of Artificial Sequence: Synthetic coding sequence
atgcggaggccatgggagaagaaggaggctacgcgaaacccgatagccgaggtactcgctagaaagaagagaactgaggagctgatctccttgcaagagcacggctcgaggaaacagaagattaaggaagctagcatttcctgggccgaaacttcccgccagattggatag

SEQ ID NO: 28413 - DNA, 222 bp, Artificial Sequence
  Description of Artificial Sequence: Synthetic coding sequence
atgcagttcgcagactggttgcatccctccgggtggactatcgagatcctgaatgcttatggcatgggagatagaaagcggacaaactctatgtcgaaggaggcctttaccccagaacagctgcatctggaaaaagaactgggagagatgaggcttaggccgacggtgctccactctcaaaccgaccatcagggctttaggccaattcccatgatgcagtag

SEQ ID NO: 28414 - DNA, 1131 bp, Artificial Sequence
  Description of Artificial Sequence: Synthetic coding sequence
atggccgagagaggccgtaagaggccctgcgggccaggggagcatggacaacggattgaatggcggaaatggaagcagcagaaaaaagaagagaagaagaagtggaaggacttaaaactgatgaagaaactagagcggcagagggcgcaagaggaacaggccaaaagactggaggaagaggaagcagctgccgagaaagaagatcgcggacgcccatacacgttgtccgtcgcgctacccggcagcattctggataacgcacaaagtcctgagctgcgcacttacttggcaggtcagattgcccgggcatgcgcaatattttgcgtggacgaaatcgttgtcttcgacgaggagggccaagacgctaagacagttgagggagagttcaccggggtcggcaaaaaagggcaggcatgtgtccagctggcaagaatcctgcaatacctcgagtgcccacaatatctgcgcaaggcatttttccccaaacatcaagacctccaatttgcagggctcctgaaccccctggacagcccccaccatatgcggcaggacgaagaatccgagttccgggaggggatcgtagtggaccggcctacgagaccagggcacgggagcttcgtgaactgtggcatgaagaaggaggtcaaaatcgacaaaaatctggaaccgggactgcgggtcacagtgaggttgaatcagcaacagcatccggattgcaaaacttatcacggaaaggtggtgagttcgcaggacccccggaccaaggctggcctatattgggggtacactgtgagactggcttcctgcttatccgcggtgtttgccgaggccccttttcaggatggatatgacctgacaattggaactagcgaacgaggcagcgatgttgcgagcgcccagctccctaattttcgccacgcgctggtcgtctttgggggtttgcagggtcttgaagcaggcgcagacgcagaccccaatctggaggttgcagagcccagcgtgctgttcgatctgtacgtcaacacctgtcccggtcagggatcccgcactatccggaccgaggaagcaatcctcatctcattggcagccctccagcccgggctgatccaggctggtgccagacacacctag

SEQ ID NO: 28415 - DNA, 1167 bp, Artificial Sequence
  Description of Artificial Sequence: Synthetic coding sequence
atggcggagaggggtaggaaaaggccctgtgggcctggcgaacacgggcagagaatagaatggagaaagtggaaacagcagaagaaagaagagaagaagaaatggaaggacttgaagcttatgaaaaaattagagaggcagcgcgcccaagaggagcaggcaaagagactggaggaagaggaagccgccgccgaaaaagaggatagaggccgtccgtacacactgtccgttgccctccccggttccattctgactatgctcagcaggcgctcttttgcacctacctggccagttaggctccccgagcctgtcccaagcagcgtttggatgcgatcatggtgtttgatgcgccgcgcgaggatgccccgactgtggcgcgggaacagtcaggagcttgaagagggcgcgggcgtgcgcaccgctggccccgacccggcggtcccggagtgcccccaatatcttcggaaggcatttttcccgaagcatcaggatctccaattcgcaggactcctaaacccattggactcgccccatcacatgcgccaggacgaggaatccgagttccgggagggaatcgtggtagaccgtcctaccaggcctgggcatggcagctttgtaaactgcggtatgaagaaggaagtgaagattgacaagaatctggagcccggattgagggtgactgtgcgtctgaaccagcagcaacaccctgattgtaaaacctatcatggaaaagttgtgagcagccaggatccacgaactaaggcgggcctctactggggctacacggtgcgacttgccagttgcctgagcgcagtgttcgctgaggctccttttcaggacggctatgacctcactatcggaacatctgaaaggggctcggatgttgccagtgcctcctttcctacttccggaatgctgctgtggtgctctggtgcatcacgggtgtggaagctcgagcgaatgctcacaccaacctggaggtggctcaaccccgtgagtagcctcacctgcaccagtatacccgtgcttgcgcgggtcgccgtaccctcagcaagacgcaaaccaagctcttccccctggcctccctgctccctggcgtctagcaggcgcgtccccggcaccccggaatcttcgaaagggcctaggacctctgttaaacaacagtag

SEQ ID NO: 28416 - DNA, 279 bp, Artificial Sequence
  Description of Artificial Sequence: Synthetic coding sequence
atggccgaagagtgcccgcgcgcttgcgctgaacccgtagctcccaaagctactgccccacccgagcgaaccagtgattactatagggtgagtgccgacctgccaggtagattcaataatccaggatggttccgaggctatagaacccagaaagcagtttcggtatatagaacctcaaaccaggcatacgggtcgagggcacccaccgtgcacgaaatgccaagggttgagtgctctggcacgatcctgagcatgttcacatggagaaaggccagttag

SEQ ID NO: 28417 - DNA, 279 bp, Artificial Sequence
  Description of Artificial Sequence: Synthetic coding sequence
atggctgaagagtgccccagagcttgtgccgaaccagtagctcctaaagctactgctccacctgagcggacaagcgactattatagagtgagtgccgatctgcccggacgattcaataatccaggatggttccgtggctatcggactcagaaggctgtgagtgtgtaccggacctccaatcaggcctacggcagtcgggcacctactgtacacgaaatgcctagggtggaatgtagtggcacgatactttcaatgttcacttggaggaaagcctcttag

SEQ ID NO: 28418 - DNA, 411 bp, Artificial Sequence
  Description of Artificial Sequence: Synthetic coding sequence
atggccgaagagtgccctcgcgcctgtgcggaaccagttgcgcccaaagcaaccgcccctccggaaaggaccagcgactactatagggtgagcgccgatctccctgggcggttcaataaccctggctggttcagaggttatagaactcagaaagcagtaagtgtttatcgaacatcaaaccaggcttacggaagcagggctcctactgtgcatgagatgcctaaagtcttctatccgaactctaataagtttagccagcagctcgctgccggcggcatgttccgaaataacaccctgaatgtttacctggagaagagtattgtaacgggccctgacaattgtataacttcgtgtgaccggcttaattttcatccttcctacaacatcaatcgacctagcatctgtgactag

SEQ ID NO: 28419 - DNA, 381 bp, Artificial Sequence
  Description of Artificial Sequence: Synthetic coding sequence
atgggaactgaggtgggaatttcttggacacgtgtgggcacaggagccactgttgggctgctgcccccgcacccgcaccagcaaatgcaccgggacgaagaggattccgacgtggacgtgacattccagccgtggcacaaagagatgctgcagcagcttctcgtgatgctgtccagcacagtggctacccggcctcagaaggccgcctgcccgcaccaggagtctcagagtcacggacctcccaaggaatcagtgccctgggcccctacacagcgttcggggaatgccgagcagcgttgcagcggggagggagcaaggcggaggggtcccgagacccggcctctgcggaccccggaggggtgggctggccgtgctccctag

SEQ ID NO: 28420 - DNA, 1563 bp, Artificial Sequence
  Description of Artificial Sequence: Synthetic coding sequence
atggcacccaagaagtccgtgtccaaggccggaaaggagttggaggtgaagaagaagggcggtaagaaagaacctgttgtggctgtagaaccaccattggcaaaggagatgaaagagttctaccatattcagatccgagatctagaggaccggctcgctagataccaaaggaagtgggatgaactggccgtgcaagagaaaatgtttagacaggagttcgagcaactggctaataataagaaggaaatcgttgctttcctcaaacggaccctgaaccagcaggtcgacgagattacggacctcaacgagcagctgcagaacctgcagctggccaaggagatggaaaaggatgcctttgaagcgcagttagcacaggtccgtcatgaattccaggagacaaaggatcagcttaccacagaaaacattattctgggcggaaagctggcggcccttgaggagtttcggctgcaaaaagaggaggtgaccgacaaattcactcttctagaggagcaagtacgcaaacaggaaaacgaattcagggactatgcttacaatctggagaagaaatctgtcctagataaagaccgcttgcgaaaggagataattcagcgcgtgaaccttgtggccaacgaattccataaggtcaccaccaaccggatgtgggagactacgaaacgcgcaataaaggaaaacaatggtattacacttcagatggctagggtgtcgcagcagggcatgaaattgttgcaggaaaacgaacagctgaagggcagacagaacaatctatgtaagcagctggaacttttggagaatacacaaaaagtgatggcccggcataagagaggccatcagaagattatccttatgctgaccaagaaatgccaagaacagcagcaggacacgaaagaggccgaggaactgcgcctgctgctgagccagctggaacagcgatcattgcagctccaggtcgataatcaagccctcaagtctcagcgggatcagctgtccctccaactcgagcaacagcaagttgacctgcaaaggctccagcaggagctggcaaacgaacaaaaggtacgggcatctttggaggccgccttggttcaggctacctcgtttctccagaatatcctgcaaatgcatagagatgaggaggactcagatgtggacgttacatttcagccttggcacaaggagatgcttcagcaactgctcgtgatgttaagctcaactgttgccactcgtccccagaaggctgcctgcccccaccaggaaagtcagtcacatggcccgccaaaagaatcaagaccatccatccagcttccaagaactggatctctgttaccccagctttcagacattacaccatatcagcctggcgaccttgggctagtacctcgacaggtgcatattccccctaacccccaggacctgaggttgttgagttatataacccgcgttggcactttccgggcccattcatctccggagatgcgcgcccccggctctctaaagaggctggagaagttctcactgcccgaagtgccattaagaccgaagtag

SEQ ID NO: 28421 - DNA, 210 bp, Artificial Sequence
  Description of Artificial Sequence: Synthetic coding sequence
atgtgctatgtagtacccggatgttttatttacatttgcggctgcactcggatcaagagcacccattttaatggaaaaagtcagatggtcgatttgaagtcacaaagctgggacctggaaaggctggagaataagccccctccagccgtatacgatctcgccgctactaccagccagttgggggaatgggcaaaatccaggatctggtag

SEQ ID NO: 28422 - DNA, 906 bp, Artificial Sequence
  Description of Artificial Sequence: Synthetic coding sequence
atggaggcacacgagatcatcgaagagccccatatcaccatggatgctgaaaagcaccctccttctaaagatccttctgcagaagacctccaagagaatcacattagtgagtcttttctcaaaccctcaacgtcggaaactcctctggaaccacacacctcggaatcaccactcgtacccagccccagccagattccactggaagcccacagtcctgaaacccaccaagagccctccataagcgaaaccccatccgagacccctacatatgaagcaagtctggactctcccattagcgtggtgcctgaaaaacaccttacgttaccccctcaatctagggattacgtttgcttaagtagttctgacacactcaaggaggatctcagttccgaatccagttcaaatgaggtcccctggacacggcgttccacccacctatctgagagcgagtctctgccagagcactgcctcagcggacccagcagccaggtgcaggtggacacaacagagaaacaggaagaggaagcaggagaagtcgagaaaggagtcgatgcctccgactcaactgcgcataccgctcagccagggcaccagctcggcaacacggctaggccagtgttcccggcacgccagactgaactagttgaagttgctaaggcaatgcacagggaggagttcggtgcccaggtgaacaaccttttccagtgggaaaaggacgcagccctcaacgccattcagactggactgtacattggctggcggtgcccacattatctttgggactgtttccgaattggcgacgaatcgaggtgcttttgcggacacctgctacgcgagcacagaatcatttcagatataagcgtcccatgtaaggtatcgcagtgcagatgtttcatgttttgctag

SEQ ID NO: 28423 - DNA, 1209 bp, Artificial Sequence
  Description of Artificial Sequence: Synthetic coding sequence
atggaggcccacgagattatcgaggagccccacatcacaatggacgcagaaaagcacccccccagcaaagacccctctgcagaggacctgcaggagaatcatatttcagagagctttcttaagcccagtaccagcgagactcccttagaaccgcacacttccgagtctcccttagtcccctccccaagccagattccactcgaagcacacagcccagaaacccatcaagagccaagtatttcagagactcccagcgaaacaccaacctacgaggcttcacttgactcccccattagtgttgtcccagagaagcacctgactctcccccctcagtccagagactacgtgtgcttgtcctctagtgacacccttaaggaagatctgtcctccgagtcctccagtaacgaagtgccttggacccggcgctccacccacctcagcgagtcggaaagtctgcccgagcactgcctcagtgggccgagctctcaagtccaggtggacactaccgaaaagcaggaagaagaagcgggcgaggtggaaaagggggtcgatgctagcgacagcaccgcacacaccgcgcagcccggccatcaactcggaaatactgctcgccccgtatttccagcccggcagacggagctagtggaggtagctaaagccatgcatcgggaggagtttggtgcccaggtcaacaacttgttccaatgggagaaggacgcagccttaaacgccatccagacagggctgtacattggctggagatgtcctcactacttatgggactgctttcgaatcggggatgaatcgcgctgcttctgtgggcatttacttcgcgagcatcggataatttctgatattagcgtgccttgcaaggtctctcagtgtcgatgttttatgttttgcttcattccatcccggcccgaggaggtgggcgaattctggttgaaacggcgtgccacctttgaccccaaggcgtggcgcgcccagtgcaggtgtaaacacagccacgaggaacacgcagccaccggcccccatccctgccgccatcacgggtgttgttgcggctgtttcgaatctaacttcctgtgtgctgcatgtgaccggaggtgggaagagcacgagacttttttcgacacacagaaaacccgtcaacgggggggaagaccaagaggcacagatacagtgtccaactggcaccgtccgctgtag

SEQ ID NO: 28424 - DNA, 273 bp, Artificial Sequence
  Description of Artificial Sequence: Synthetic coding sequence
atggaagcacacgaaatcatcgaggagcctcatattactatggacgccgaaaagcaccctccatcaaaggatccaagcgctgaagatttgcaggagaaccacatctcagaatcattcctcaagccgtcaactagcgaaacccccctggagccgcacacgtccgaatccccattggttccatctcccagtcagatcccactggaagcacacagcccagaaacgcaccaagagcctagtatctctgagactcctagcgagaccccaacatattag

SEQ ID NO: 28425 - DNA, 591 bp, Artificial Sequence
  Description of Artificial Sequence: Synthetic coding sequence
atgccaggaatggtgccgcctcacgttccccctcagatgcttaatattccccagacaagtctacaggctaagccagtggccccacaagtgccctctcctggtggagcccccggtcagggaccttacccttacagcctgtccgagcctgcccctctgaccctagacacttcaggtaagaatctcaccgaacagaatagctattcgaacatccctcacgaaggaaagcacacacctctatatgaacggtccctgccaattaatccagctcagagcggaagtcctaaccatgtagacagcgcctactttcccgggtcaagcacaagctcctctagcgataatgatgaaggctctgggggggccactaaatatacaatatattggggctttagggccaccgaccatcatgtgcaaggcagagacagccaggcccgtggtacggcggcgcactggcatggtggacatgtttgttctcccaacgtcttctggcggatctctcacggccccgctcagcagctcacatttcccaccgagcaggccgccccgcctgtgtgccccgcacctgcaagccgtcgcctgtctgccccaggatag

SEQ ID NO: 28426 - DNA, 3240 bp, Artificial Sequence
  Description of Artificial Sequence: Synthetic coding sequence
atggaatggctgttagaagatcttctgggcgccaaaggtgatatgggactgttatggggacagctgacccatgccctggcctgtcgtcactgcggatctagctgcttccagtcgcctggcaatctggtgacattatttctcttcgtggtgtggcagatccagcgctggtggcagctgggcagattgcgacagctccacccctggtgtagcggcaatatggttcaggggaaggaactcccactgctgcaccgcgtggccttcctggatcacctgtgcaagcaaaaatctgaggtcgaagaggagggcgaagaggaagaggaaggggaggacgaagccagcttagatccacttaaaccatgtagtcctacaaaggaagctccgaccggagagcaggctactcccgcgcccccgcagccatcatgtgggtctgaaggcctgctgaaggccattgggatccctgagcaaactgtcatgcagccagtgtcccccagcagaagctttccaatcttccaaattctcacaagctttcccgtcaggcataaaattgcaagtggaaaccgacagcagcagcggaagtcccagctcttctggggcctcccttccctacatagcgaaagtctcgaagccatattcctctcttctggcggcccatctccactgaagtggtctgtctgctcttctgtgttctttaacaaacttgccttcttaccaagatctaatcttttacttcctcaatatcattcctcggctcaattcagtacacatggagcacacactatggaagatctggagggcatggcgccggacccccagctccttccgcccccttctagtcctagcgtcagtagtttactcctccacttgagaccattccctgtcgatcacaagggcgtgcttagcggcgcggaggctccgacccagtcacccgggactagtccgctcgaggtcttaccaggctatgaaacccatctggaaactaccggacacaaaaaaatgcctcaggctttcgagcccccgatgccaccaccttgtcagtcaccagcctcactgtctgaaccccggaaggtttctccagagggtggcttggctatctctaaagacttttggggcactgtgggctaccgtgagaagccacaggcttccgagtctagtatgcccgtaccgtgtcctcctcttgattccctccctgagctacagcgcgagagttcactggaagacccctcacgctacaaacctcagtgggaatgccgtgaaaacagtggcaatttgtgggcattcgagtctcccgtattggatctaaatccagaactcagcggaacgtccccagaatgcgtgcccccggcctccgaaacaccttggaaggggatgcagagtagggagaacatatgggtccctgctgacccggtgagtccaccttccctgccctcagtaccattgctcgagagcttggtcatggggccacagggtgtgttaagcgaaagcaaggctctttgggagactatggggcagaaggagaatctgtgggcaagtgactctcctgatcccgtgcactcaacgcctcccaccactctgatggaacctcaccgcatcaatcccggcgagtgcctggcaacctctgaagccacttggaaggacaccgaacactctaggaatagctcagcttctagaagtccaagccttgccctgtctccaccacctgctcttgctcccgaattgctgcgtgtgcgatccatgggggtgctgagtgacagcgaagcccgttgcggcgacattcagaaaacaaaaaactcctgggcctcaaagcatccagcttgcaacttgccccaggatctacacggagcctccccactaggggttcttagcgatagccagtctatcgtaggtgaaatggagcagaaagagaattgtgtccccgtatttcccggcagagggtcaagcccttccagtaacagcgtctctaagtcccatgtgagcgaacccatcgccgatcagtccaactataagcccgatggcgaggcagtagagcaaaggaagaaccactgggccacagaactgccagcaccttcttctctgtctaccccccttcccgaaccgcatatcgatctagagttagtgtggcggaacgtgcaacagcgcgaagtgccacaaggacccagcccgcttgcggtggatccccttcacccagtgccgcagccccctactttagccgaagctgtgaaaatcgagagaacacatccaggcctcccaaagggcgtgacctgtccgggggttaaagcggaggctcctttgagtcagaggtggacggtgcctgaattacttactcaccccggaatacacgcttggcagtggtcacgggaattgaaactccgattgaaaaaactacgccagagccccgcctcccgggccccaggaccttcccagagtttttgctcctcccccatactgtcaagcacaatccccgatttttggggactgccttcctgcccgccccagcagatttatcccccgaatccatgcccccatagctcctcatgccatccgcaggaagtgcagagaaccgttccacaacccgttcagtcttcacactgccatcacttccagtcttcaagccagctgcagccgcaggagtccggacgggccgagcagggctctcagagaggagagaagatgaagggaaagatggtgagccaagttccctctcagggaccgtgcgttcacatggaagccggggtggactacctgtcaccagggccaggcgagccatccaactcaaaagtccttgtgtccggaaaacgaaaggacaaggcgagtgcatcctcctcagcgaagaaacgagaacatccaagaaagccaaaggccggcgatcaccgaagaggcacagcacggttgggtctgtctacagtaaccggaaagaatcaccctgcccaggcgaggtccctggtggaagcccccgtttccacttttccgcagcgtagccagcacagggggcagtcctcgcaacatactgcactgcctcagctgctcctgcccaaggctagcggcccacaggatcagcctgaagcagggaggagggcctcggacattcttacccctcggcactgtaagcactgtccatgggcccacatggaaaagtacctaagctttcctactctaaaggctagcctcacacgcggcttgcagaaggtgctggcaaagtgtctagataatcatcgcccactcccaactaaatcctcgcagtag

SEQ ID NO: 28427 - DNA, 3021 bp, Artificial Sequence
  Description of Artificial Sequence: Synthetic coding sequence
atgttgaggaaagaattacccctactacaccgcgtggctttcctggaccatctctgtaagcaaaagtccgaggttgaagaggaaggcgaggaagaggaggagggagaggacgaagcttctctggaccccctgaagccatgtagtcccaccaaggaagctcctacaggggaacaggccacacctgctcctccacagccaagctgtggatccgagggcctcctgaaagcaatcggcatccccgagcagacggtaatgcagcccgtgtctcccagtcggagtttccctattttccagatactgacatcttttccagtaagacataagattgcaagcggcaatcgacaacagcagaggaaaagtcaattgttttggggactccctagtctccactcggagagcttagaggctatctttctgtctagtggcggacctagtccactcaagtggagtgtttgttcaagtgtttttttcaataagttagccttccttccaagaagtaatctgttgcttcctcaatatcactcctcggcgcagttttccacccacggggcacacactatggaggatctggaaggcatggcccctgatccgcagctgctcccacccccatcttcaccttccgtctcctccctgctgctacaccttcgaccctttcctgtcgatcacaagggtgtgctgtcaggcgcggaggcccctacccagtcccccggaaccagccctctggaagtattgccaggttatgaaacccacctggaaacaacaggacacaagaaaatgcctcaggcctttgagccacctatgccacccccttgccaaagtccagcttcgctgagcgaacctcgaaaagtgtctcccgagggcggtttggctatctccaaagacttctgggggacagtaggctacagggagaagcctcaggcttcagagagttcaatgcctgtgccttgccctcctctcgattctcttcctgagctgcagcgtgagtcgtccctcgaagatcccagccgatataagccacaatgggagtgtagagagaattcagggaatctttgggcattcgaaagcccggtgctcgatctgaatcccgaactctctgggacttcccccgagtgcgtgccccccgcatcggaaacgccttggaagggcatgcagagccgggagaacatttgggtgcctgctgatccggtatctccgccttcactcccctccgtgccacttctggaaagcttggtgatgggacctcagggagtgctttctgagtctaaggccctttgggagacaatggggcagaaggaaaatctttgggccagcgattctcccgaccctgtccattccacaccaccaactacgctgatggagccccaccgtatcaaccccggggaatgcttggcaacctctgaggccacttggaaggacaccgagcatagcaggaacagcagtgcatcacggagcccgagcttggccctgagcccacctcctgccctggctcctgaattactgagggtgcgctccatgggcgtgctgtctgacagcgaggctcggtgtggtgacatccagaagacgaaaaatagttgggccagcaagcacccggcctgcaatctaccacaggacctccatggtgcgtcccctctgggggtgctttccgatagccagagcatcgtgggagagatggagcagaaagaaaattgcgtcccagtgttccctggcaggggttcatctccatcttctaactcagtaagcaagtcacatgtgagcgagcccatcgcggatcagagtaattataagccagacggtgaagccgtcgagcagcggaaaaatcactgggcaacggaactccccgccccttcgtccctgtcaaccccacttcccgaaccacatatcgacctggagcttgtgtggcgaaatgttcagcaacgggaagtgccacaaggaccttccccgttagcagttgaccctctgcaccctgttccacagcctccaacacttgccgaggcagtgaaaatagagcggacccatcccgggctgccgaagggagtaacatgccccggtgttaaggcagaggcccccctgtctcagcgttggaccgttccagagttgttaacgcaccctggaatccatgcctggcagtggtccagggaattgaagctgcgccttaagaaactcaggcagtcacccgcaagtcgagcacccggtccatcccagtctttttgtagcagtcctatcctgtcaagtacaattccagacttctgggggctacctagctgtcccccacagcagatctacccgcccaatccttgtccacattcttccagttgccacccacaagaagtgcagaggacggtcccccagccagtccaatcgtcccattgtcatcactttcaatcctcttcccaactccagccacaggaaagtggtcgcgccgagcagggttcccagaggggcgagaagatgaaaggcaaaatggtcagccaggtgccctctcagggcccatgcgttcatatggaagcgggggttgactatctgtcccccggacccggcgaacctagcaatagcaaggtactggtgtcaggcaaaagaaaggataaagcatccgctagcagctcagccaaaaagcgcgaacatcccaggaaacctaaggcaggagaccatagaaggggcacggcacgcctcgggctctctaccgtgacaggcaagaaccaccccgcccaagcaaggagtctggtggaggctccagtgagcacgtttccccagaggtcacagcatagggggcagtcttcccaacatacggccctgccgcaactgctcttaccaaaagcctcgggccctcaggatcaacccgaggccggtcgccgagcctccgacattttgacgccccgacattgtaaacattgtccctgggcccacatggagaagtacttgtcatttcccacattaaaggctagcctgacacgtggtctacagaaggtgctcgcaaaatgcttggataatcaccgcccgcttcccaccaaatcctctcaatag

SEQ ID NO: 28428 - DNA, 3096 bp, Artificial Sequence
  Description of Artificial Sequence: Synthetic coding sequence
atgcttcgcaaaatccagcgctggtggcaactcgggcggctccgccagctgcacccctggtgttccggcaatatggttcaagggaaagagcttccactgttgcacagggtcgccttcttggatcatctgtgcaaacagaaaagcgaggtggaggaggaaggcgaagaggaggaggaaggcgaggacgaggcgagcttagaccctctgaaaccttgttcacctactaaggaagctccaacaggggagcaagccacacccgcccctcctcagccaagctgtgggtctgagggcctcttgaaggccatagggatccctgagcagacggttatgcagcccgtttcaccttcaaggtcctttcccatattccagatcctcacctcgttcccagtgaggcataaaattgccagtgggaataggcaacagcagcgaaagtcccagcttttctggggattgcccagcttgcactcggaaagcctcgaggctatctttttgtctagcggaggtccatcgccactcaagtggtccgtatgttcaagtgtgttctttaacaagcttgcttttttacctaggagtaacctcctgctcccccagtaccactccagtgcacagttctctacgcacggagcccacaccatggaggatctggaagggatggcgccagacccccaactcctcccgcccccaagctcaccttcagtttccagcttactgttacatctgcgtcccttcccagtcgatcataagggcgttctgagcggagccgaggcgcctacacagagtccagggacatcccccctggaggtgctgccgggttacgagactcacttggaaactacggggcataaaaagatgcctcaagccttcgaacctccgatgcctcctccgtgtcagtcccccgccagcctgtcagagccgcgaaaggtgtctcctgaggggggactggccatttctaaagacttctgggggactgtaggctacagggaaaagccccaggctagcgagtcaagcatgccagttccttgcccccccctagattctttgcccgaactgcagagggaaagtagtctcgaggatcccagtaggtacaaaccccaatgggaatgcagggagaactccggcaatctatgggcctttgaatcccctgtactggatttaaaccccgagctgagtggaaccagtccggagtgcgtgcctcctgcgagtgagaccccttggaaaggcatgcagagcagagagaacatttgggtgccagccgacccggtgagcccaccctcactgccttcagtccccctgctagaaagtctggtgatgggtccacaaggagtcctgagcgaatctaaagctctgtgggagaccatggggcagaaagaaaacctctgggcgtctgactccccagatccagtccactcgaccccacctaccactctgatggagccacacagaattaaccccggcgagtgcctggctacctccgaggcaacttggaaggacaccgaacactctaggaattcttctgctagccgatcaccctctctagcactcagccctccacctgcattggcccccgaactgctgcgggtgcgaagtatgggagtgctctccgattcagaggccagatgtggtgacatccagaagacaaagaacagctgggcaagtaaacatcccgcgtgcaacctcccgcaagacctgcacggggcctcccctttaggcgtgctgtctgatagccagtctatcgtgggcgagatggagcagaaggaaaactgtgtgccagtctttcccggacggggatcttctccaagctccaacagcgtgtctaaaagccacgtgagcgaacccattgctgaccaatccaactacaaaccagacggtgaagccgttgaacagagaaaaaatcactgggccacagaactgcccgcccctagttctctgtcaacccctctacccgaacctcatatagatctggagctggtctggagaaacgtccagcagagggaagtccctcaggggcccagtcccctcgctgtggacccacttcacccagtgccccagcctcccacccttgctgaagctgttaagatcgagcgcacacatcccggtctgcccaaaggtgttacctgccctggggtgaaggcggaggcccctctgagccagcggtggacagtgccagaattgctgacacatcctggcattcacgcctggcagtggtcgagggaactgaaactgaggctcaagaaactacgccaatcacccgcctcccgggcaccgggccctagtcaatcattctgcagctcacccatcctctcttctactatcccagacttctggggcctgccgagttgtccaccccagcagatctacccccccaatccctgtccacactcaagttcctgccacccccaagaggtgcagaggaccgttccccagcccgtccagagcagtcattgccaccactttcagtctagcagtcagctccagccacaggagtccggtagggcagaacagggctcacaacgaggcgaaaagatgaaggggaagatggtgtctcaggtgccctcccaggggccatgcgtgcatatggaggccggagtggactatctttcacctggccctggggagccttccaactctaaggtgctcgtttccggcaagaggaaagataaagcttccgcatcatcctcggccaagaaaagagaacatccccgcaaacccaaagccggagatcatcgacggggcactgcgagattaggcctctccactgtcactggcaagaatcaccctgctcaagcgcgcagtctggtcgaggcccccgtttcaaccttcccacagcggtcacagcatcggggacagagctcccaacacacagctctgcctcagctgctgctgccgaaggccagcggaccacaggatcagccagaggccggacggcgagcctcggatattctgactccaagacactgtaagcactgtccctgggcccatatggaaaagtacctatcattccccacgctgaaagctagcctcacaaggggcctgcagaaggttctggctaagtgcttggataaccaccgccctttacctactaagagcagtcaatag

SEQ ID NO: 28429 - DNA, 1665 bp, Artificial Sequence
  Description of Artificial Sequence: Synthetic coding sequence
atggtccagggcaaagaactgcccctcctccaccgtgtggcttttctggatcacctctgcaagcagaagtcggaagtggaggaggaaggcgaagaagaggaggagggagaagatgaagccagcctggaccctccggagctgttgagggtcaggtcaatgggggttctttccgacagcgaagctcgttgtggagatattcagaagaccaaaaacagctgggcttccaaacatcccgcctgcaatctgccacaggatctgcatggtgcctctccgctgggggtcttgtctgatagccagagcatcgttggagagatggagcaaaaggagaactgtgttcccgtgttccctggaaggggaagcagcccttcatccaactctgtctctaaaagccacgttagtgagcccatcgctgaccaatctaattataagcctgacggagaggctgtggaacagcggaaaaaccactgggccaccgagctgcctgcccctagttccctgtctactcccttaccagaacctcacatagaccttgagctcgtttggcgaaatgtgcaacagcgggaagtcccccagggacctagccccctagccgtggaccctctgcaccctgtgcctcagccgccaactctggcagaggctgtcaaaattgagagaacacaccctggtctgcccaagggggtgacctgcccgggcgtgaaagcagaagccccgctctcccagagatggactgtgccagagttgctaacccaccccggtattcacgcctggcagtggagcagagagctgaagctgaggcttaaaaagctgaggcagtcccccgcctccagagctcccgggcccagccagtcattctgttctagtccaatactcagctccacaatccccgatttttggggcttgccgtcctgtcccccacaacagatctatccacccaatccctgcccccactcatcatcttgccatcctcaggaggttcagcgaaccgtcccacaaccagtgcaatcttcccactgtcatcacttccaatctagcagtcaactccagccgcaggaaagcggtcgagccgaacagggctcccagcggggagaaaaaatgaaaggcaagatggtatcccaagttccctctcagggaccttgtgtccatatggaggcaggggtagattacttatctcccgggcccggggagccatctaacagcaaagtgctggtgagcggtaagcggaaagataaggcctcagcgtccagttcagctaagaaacgtgaacatccgcgaaagcctaaagctggagaccaccgacgcggcactgcccgactggggctcagcaccgtgacaggcaagaatcatccagcccaggccaggagcctcgttgaggctccagtgtctacatttcctcaaaggtcccagcaccgcgggcaatctagccagcacacggccctcccgcagctgctacttcccaaagcatccggcccccaggaccagcccgaggctgggaggcgcgcctccgacatacttacaccgagacactgtaagcattgcccatgggcccacatggagaagtatctaagcttcccaacattgaaggcgtctttgacgaggggtctgcagaaggtgttagcaaaatgtctcgacaaccaccggcccctgcctaccaagtctagtcagtag

SEQ ID NO: 28430 - DNA, 573 bp, Artificial Sequence
  Description of Artificial Sequence: Synthetic coding sequence
atggcactcagaggccaccctgaaccacagcccaccaacacaccgttatcagccacagtgggcggaccaatctcactctttacccagccgcgttgccattctgcagcgagggatctcgtgtggtcgcaggcctggcccgaccctgacgtgctggagatatctatgcagacgcctggtggcagtagctgtaggaaggaagccgttctccctcgattgagggttactagacccctggtgcccgagccggccattctacctgtttgcgcggccagattggccggctccctggcaacagacctgagcaggagtcacagcttgctccccccgtgggttgatcttaaagaaccaccacctccaagcgctccgagcctcctgctcgaggatccaggacagggcggctgtcatggagcccaatcatgcgtcggtacctgtgagctcgctaatggcgctagaggattttgcccagagatgggacagaacgaaagtcttagcgaggagaggaagggccacgaaagcaagcggaagtctgggggtagggggtccccctcctcccaccccacacaagcctcatag

SEQ ID NO: 28431 - DNA, 693 bp, Artificial Sequence
  Description of Artificial Sequence: Synthetic coding sequence
atgctcgggacccagtggaccctcgctagatgcctgctgccaagtcacccagacccaggtctagcgggaagcctgcgtggcgactcatctgaagacggccggcgcggtcaactgctccctcaatccccggccccgtgtagccctgtatggtcccccgggactcccgttggcggcccacatccagccggagatgggccagccaccgcaccagggcctcccgaaggaccagaactggcattcccacaggacctatctccagcatggcctcagaagggcgccggaacgcatccagcaaatgcggggcccggccctctgagcagacgcagtagtcagctccgtaccccgctggaggcagggcgtaagtggggttggaagatgacacgatggcggcttaggcgcgatcaggcccctggtgaaggcactcaggctaagcttctgggggaggctctttcaacggccgggcggggtcatgcagggcctccagagggatgggcgggagagggaggggttagtccaggcctcacccccctgcttggcaccggccaggggaaagaactggatctggacttgcgggaaaaatttatcagattcgatcagatactgggaatctctctggatcacatccctttcctccctcagaccggacccgggagaccttggggttgtggcgttggcaaacagcggccacactag

SEQ ID NO: 28432 - DNA, 615 bp, Artificial Sequence
  Description of Artificial Sequence: Synthetic coding sequence
atggacccactgagcccaccactttgcaccctaccaccaggccctgagccaccccgattcgtatgttattgcgaaggagaggaaagcggagagggggataggggggggtttaacctatatgtcactgatgccgcagagctgtggtctacatgctttacgcctgactcattagccgcgctgaaggctaggttcggactctcagcagcagaggatataacgccaaggttccgggccgcatgtgaacaacaggccgtggcgctcacgcttcaggaggaccgcgcctcgctgacactgtcaggaggccccagtgcactggcttttgacctgagtaaggtccctggccctgaagccgcgcccagacttagagctttgactttgggccttgcaaaacgggtatggtctctggagcgccgcctggcggctgctgaagagactgcggttagccctagaaaaagcccccgcccagccggtccccagctcttcctgcctgaccctgacccccaaaggggggggccagggccaggggtccgtaggcggtgcccaggtgaatccctgatcaacccaggctttaagtctaagaagcccgctggcggagtggacttcgatgaaacctag

SEQ ID NO: 28433 - DNA, 177 bp, Artificial Sequence
  Description of Artificial Sequence: Synthetic coding sequence
atgccaaatcgccacaagactaaagaccagactcttctgcctgcgcagcagtatatttggctcctgaacagtcatacccagatgactgctcccgtgcctcagttcaaactttctgagactgcctccctgctttgcaagcggaagatctccacggctatgagttcaacgtgcctctag

SEQ ID NO: 28434 - DNA, 459 bp, Artificial Sequence
  Description of Artificial Sequence: Synthetic coding sequence
tgagggaggccacctcataagggcgcccccagattgggaagaggcgtgggagctttggtgccagctcctagggctggcagccaccctccagcaggtgtctgcgcaagtgtccataggaacgctgtcggagccggggggccagcaagggccggccaaccgggtttggacggcactggcaggcgtggggccagggccggtggtgaaaggccagaggggagggctccgaaggtctggaatcctcctagtcctctgtggagtgaggaggtgtattccacagccccatattataccagctgggcgagaggaccccgctgcccacccgagctttgtgctcctccattaaagcgcaaagaacagactgagcccactcccagcgtgaggcaccctaccatgatgcgctatctcgtcgagcaaaccaactccgccactgaaaacgatgaaagctgtctgaagaaatag

SEQ ID NO: 28435 - DNA, 687 bp, Artificial Sequence
  Description of Artificial Sequence: Synthetic coding sequence
atggaggatagcccactgccagacctgcgggatatcgagttaaaactcgggcgcaaagttccagagtcactggttcgctcactgaggggtgaggagcctgtgcccagagaaagagaccgagacccatgtggcgggagtggaggcggaggcggtggcggcggaggatgcagtagctcttcctcttactgttcattcccgccttcactgagtagcagctcgagctcatctcctacaagcggctcccctaggggatcacacagcagcgcactcgagcgtctggaaaccaagcttcatcttctccgacaggagatggtcaacttaagagctactgacgttcgcttgatgcgccaactgctggttataaatgaaagcattgaaagcattaagtggatgatagaagaaaaggcaactattacgagccgaggcagctctctgtcaggctccctgtgctccttgctggaatcacaatccacctcactcaggggatcgtacaactcactccacgacggaagcgacggtttggacggcattagcgtgggaagctatttagacactctcgccgacgacgtacccggacaccaaacccccagtgatctggaccagttttcagacagctctctcattgaggatagtcaggctctgcataagaggcccaagttagattccgagtattactgcttcgggtag

SEQ ID NO: 28436 - DNA, 720 bp, Artificial Sequence
  Description of Artificial Sequence: Synthetic coding sequence
atggagggccttccatgtccttgccctgctctgcctcacttctggcagctgcgcagtcatttgatggccgagggatctagaacacaggcccctggcaagggcccgcccctgagcatccagttcttgcgggctcagtacgagggcctgaaaaggcaacagcgcacacaggcacatcttctagtattgcctaagggaggcaataccccagccccggcagagtcaatggttaacgctgtatggattaataaagagcgaaggagttcgctgtcattggaggaagccgacagcgaagttgagggacgattggaggaagccgcccagggctgcctgcaggccccaaagagtccttggcatactcacctggaaatgcactgcctagtacaaacctctccccaagataccagccaccaggtgcatcataggggcaagctggtcggctctgatcagcgactgcctccagaaggagacacccacctctttgaaaccaatcagatgacacagcaggggactggaatccccgaagccgctcagctgccgtgtcaggttggaaatacgcagaccaaagccgtggagagcgggctgaaattctcaactcaatgcccattgtctatcaagaatcctcaccgcagcggcaagcctgcatactatccttttcctcagcgcaagaccccacggatctcacaggcagccagaaatctgggactgtatggcagtgcctag

SEQ ID NO: 28437 - DNA, 288 bp, Artificial Sequence
  Description of Artificial Sequence: Synthetic coding sequence
atgttcctaactggtgatacaagtcctgcggaagataatcgagaagccaccctgcctcagtgcagcctgccagagctctatgcatgtatcgagaactttaacaaagaatctaaaaaaagcaacctgctgaagatgcatggtatcagccttaatgaggctcaggaggttttggcacgaaacctcaacgtgatgagttttacacggggcgctgacgtccggggggacctgcagccagttatccgcaaaacgatccatgagtctaaggggtccggtatggagatcttctag

SEQ ID NO: 28438 - DNA, 306 bp, Artificial Sequence
  Description of Artificial Sequence: Synthetic coding sequence
atgttcctcaccggagatacaagcccggctgaagataatagggaagctaccctcccgcagtgctctctgcctgagctctacgcctgtatcgagaatttcaacaaagaatctaagaaaagcaatctcctcaagatgcatgggataagcctcaatgaggctcaggaggtgctcgctaggaatctcaacgtgatgtcttttaccagaggcgccgacgtgcgaggggatttacagcccgtgatatctgtaaacaaaatgaataagccagggaagcacagaaagaccccttctccaaaaatcaacaagtag

SEQ ID NO: 28439 - DNA, 558 bp, Artificial Sequence
  Description of Artificial Sequence: Synthetic coding sequence
atgtcctggagtcagcccgtgttgcgcggattacccgcgtctcgggatgaggatagtaagcaggtcacaacccttccatggggcaaacgcagtagcagggggggagcaatttacttgtctggtattgacatgatacacggtacccccgtgctggacattaagccttatatagccgagtacgacagccctcaaaatgtaatggaacccctggcagacttcaatctgcaaaacaaccagcatacccctaatacagtgagccaaagtgactctaaaacagacagctgtgatcagcgtcagttgtccggctgcgatgagcctcagccccaccatagtacaaagcgaaagccaaagtgtccagaggacagaactagcgaggagaattatctgacccactctgacacagcgcgcatacaacaggccttcccaatgcatcgcgagattgccgtcgactttggactggagtcacggcgggatcaaagttcctcagtggcagaagagcaaatcgggccatactgtcccgaaaagtccttcagtgagaaagggaccgacagatcttag

SEQ ID NO: 28440 - DNA, 480 bp, Artificial Sequence
  Description of Artificial Sequence: Synthetic coding sequence
agaggtctggaggaaagcggccctagacccactgctacaccctgtgggtgcgtgaagcccgcgcttgaaacagggaatctgctcaccgagcccgtaggctacttagaaagttgcttctctgctaaaaacgggacccctcggcagcccagtatttgtagttactcccgggcctgcctgcgcattcggaaaagaatcttcaacaatccagaacacagtctcatgggcttagagcagttctcccatgtctggattctgttcgtatttcacaagaatgggcacctaagctgtaaagccaaagtgcagcctccacggctcaacggggccaaaaccggcgtgtttagcaccaggtcgcctcacaggcctaacgctatcggtctaaccttggccaagctcgaaaaggtcgaagcgcttggcaaatggacagacatcatggcagccgtgttgatgagtactgttctgtgcggtcgtagcctgggatag

SEQ ID NO: 28441 - DNA, 888 bp, Artificial Sequence
  Description of Artificial Sequence: Synthetic coding sequence
atgattcatggaacacccgtgctggacatcaagccatacatcgccgagtacgactctccacagaatgttatggaaccactggccgatttcaatttgcaaaacaatcagcacacacccaatacagtgtctcaaagcgattctaagacagacagttgtgaccagcgccagctatccggatgtgacgagccacaaccccatcactcgaccaaacgcaagcctaagtgccctgaggatcggaccagtgaagaaaactacctcactcactccgataccgcccggatccagcaggctttccctatgcacagggaaattgcggtggattttgggctggagtctagacgcgatcaatcctcctcggtagccgaagagcaaatcggtccatactgcccagagaagtccttctcggagaaagggacagataaaaagctggaaagggtcgagggcgccgccgtcttgcaggggagtagagccgagactcagcctatggctccccactgccccgccggccgggcagacggcgctcctcggtccgttgtaccggcatgggtgacggaagcaccggtcgcgactctggaggtgcgcttcacccctcatgccgaaatggacctgggacagctgtcctcacaggatgtgggacaggcctcattcaaatattttcaatcggccgaggaagccaaacgagcgatagaggccgttctgtctgcagacccgcgctctgtgtaccggagaaagttgtgccaggacagactcttttattttaccgtggacatcgcccacgtaacatgctggtttggggacggcttcgccgaggttctccggatcaagcccgcaagcgagcccgtgcatatgactggacctgttgggagtctcgtaagtcttggatcttag

SEQ ID NO: 28442 - DNA, 1326 bp, Artificial Sequence
  Description of Artificial Sequence: Synthetic coding sequence
atgcgggggctcgaagagagcggccctcgtcccacagctacaccatgtggatgtgttaagccagccctcgagaccggtaacctcttaacagagcctgtgggctatcttgagagttgcttctctgcgaagaatgggacacctcgtcagccttcaatatgttcttactctcgcgcttgcctcagaattcgcaaacgcatattcaataaccccgagcactctctcatgggactcgagcagtttagccacgtctggattcttttcgttttccataagaacggccacctctcatgcaaggcgaaggttcagccgccaaggcttaatggtgcaaagactggggtgttctctaccaggagcccgcatcgtcccaacgccattggtctcactctcgcaaagcttgaaaaagtggaaggtggggctatctacctgtctggaatcgacatgattcatggtactccggtgctagatataaaaccgtatatcgccgaatacgattcacctcagaacgtcatggagcccctcgctgacttcaacctgcaaaacaatcagcacactcctaacaccgtgtcccaaagtgacagtaaaactgactcatgcgaccagcgacagctgtcggggtgtgatgagcctcagcctcaccatagcactaagcggaaacctaaatgtcccgaagatcggacctcagaggaaaactacctgacacactccgacacagcaaggatccagcaggcattccctatgcatcgggaaattgccgtagatttcgggctagagagtagacgggatcaaagctcttccgttgccgaggaacagatagggccctactgtccagagaaaagttttagtgaaaagggcacagacaaaaaactagagagggttgagggagcggcggtgctccagggcagccgcgctgaaacccagcccatggcaccacattgcccggctggacgggctgacggagccccgcgcagcgttgtccctgcctgggtgacggaggcgcccgtggcaacactcgaagtacgctttactcctcatgcagagatggacttagggcaattgtcctctcaagacgtcgggcaagcctcttttaaatacttccagagcgctgaggaggctaaacgcgctattgaagctgtgctctctgccgatcccaggagtgtgtacaggcgcaaactgtgccaggatcgacttttttattttaccgtggacatcgcccatgttacgtgttggtttggagacggattcgccgaggtgctgagaattaaacctgccagtgaaccggtccatatgaccggtcccgtgggcagtctggtcagtctcggcagctag

SEQ ID NO: 28443 - DNA, 519 bp, Artificial Sequence
  Description of Artificial Sequence: Synthetic coding sequence
ggactggaggaaagcgggccacggccaactgctaccccatgtggatgcgtcaaaccggccctggagaccggaaacctgctgacagagcccgttgggtacctcgagtcctgcttcagcgcaaagaatggcacaccccgccagccaagtatctgttcatactcccgggcctgcctgaggataagaaagaggatcttcaataatccggaacactcacttatgggactggagcaattttctcatgtttggattctgttcgtgttccataaaaacggccatctttcttgtaaggctaaggtgcagcctccgcgacttaacggagccaagacaggggtgttttccacgagatcgcctcatcggccgaacgcaattggccttacgcttgctaaattagaaaaagtggaggggaacccctttcacttttacttttacctctttcctcacccaaagaagccatacaagatcaactccatccaccactggctcttcattcagacaagtaccaacgacgtgaatagctag

SEQ ID NO: 28444 - DNA, 252 bp, Artificial Sequence
  Description of Artificial Sequence: Synthetic coding sequence
atgtccggccccaacggggaccttggaatgcccgtcgaagcgggggcagagggcgaagaagatggattcggcgaggctgagtacgccgccatcaacagcatgctggaccaaatcaatagttgcttggatcacttggaggagaagaacgaccatctgcacgctcggctgcaggaactgctggaatccaataggcagacacgtctggagtttcagcagcagctcggggaggccccctccgacgcctccccttag

SEQ ID NO: 28445 - DNA, 612 bp, Artificial Sequence
  Description of Artificial Sequence: Synthetic coding sequence
atgcctgggccattgacctgtacccccgcctggcagggacagggccgggcagccgctttcttgtgttgttcgtttcagcgcgctggcgctgttgtgggggtccccgctagatggcataggggtcgcctcagtagccagcagagactcaggagttctctgggaggatcacacccttgtccccagctgggacgtcggcttgtgcgggaaggagtcatctcggttcctcgacagcaaggccgaaggagatgcagagaatctttttcccccgcagacgttgcccctggccccatctgttctgccaacatttgtctcagcggtgtcagatttctgacgtgccttaacagggtccgcgaacatgtggtgggtccttctccttctcctgccgcacctatctgcttctttcccgtggtcgaagcactttgcactctgcggggccgcagatgccattgcttgcccttcccaaagcgaggcatgcagcgttggatgctgccacttcgcagaggcgctaggctgttacctctcgcctcctcgaagaaccccagggcaaggtctccgggactggatcccctggggtcctctgagacactgtggtctcacagaggcggccattag

SEQ ID NO: 28446 - DNA, 435 bp, Artificial Sequence
  Description of Artificial Sequence: Synthetic coding sequence
atggatccacaggagatggtcgtcaagaacccatacgcccacatctctataccaagggcacaccttcgaccagacctggggcaacagctggaagtggcttctacctgctcctctagctccgagatgcaaccactccccgtgggtccttgtgcgcccgaaccaacccatctgttacaacctactgaggtgcccggccctaagggcgcaaaaggcaaccaaggtgctgcgcctatacaaaatcagcaagcgtggcagcagcccggcaacccctatagtagttcccagcgccaagccggtctgacctacgccggacccccacccgctggaaggggcgacgacatagcacatcactgttgttgctgcccatgttgccactgctgtcactgtcctcctttttgccgctgccacagctgttgttgttgcgtcatcagttag

SEQ ID NO: 28447 - DNA, 366 bp, Artificial Sequence
  Description of Artificial Sequence: Synthetic coding sequence
atgtggtctcgccgcgggctgggcgtgagtcgcgctccactccatcttcttctgggtgtatggggcccgtccggacggaccggtgggcagaggaaaggcgccagcttagctcgccctggtaggggaggcctagcgtcttgttctgtcggcgcaaacggcaagagagatgtgctgtttttgcggaagactctaactaataccgtagaggacattcagatcgacaatttccgcagaaagtcagacttgggagtcgggtcccccgattggaagaacctcttaattgacgtgaccagggaagatcacgagaatagccagaataattccaagcgcaggtgtaaagtcaattgtgaaacggaccagagatag

SEQ ID NO: 28448 - DNA, 963 bp, Artificial Sequence
  Description of Artificial Sequence: Synthetic coding sequence
atgccggaggccaggagtagcggacctgacctgactcggtggaggaagcagcagcaacccgtgcgccgcacagtaagccaggtctgccctcccccccgccgcccactgacagtggccgacatacgctcaggtatggagaacgagcgcctcggggtggtccgtgacagcatgttccagaacccgctgattgtcaaggcagccgggccggctagcgtggggacatcgtatagcgtttacgatagcagcgcggttcaaaaagtcatacccagtctggcaggccaccacatcaaggggggcccccaggcagagctgggaaaacctcgggaaagaagttatagcctgccgggcatcaatttcaattatggtctctacatcagaggacttgatgggggagtccccgaagccattggtcggtggaacgtgtttaagcagcagccgacttgtccccatgaactgaccagaaattacatcgccatgaatagaggagctgtgaaagcaggactggtgacggcgagagagaacctcctctataggcagctcaatgatatccgcatatcggatcaggacgaccggcggatgaagaaggagcctccccctctgcctcccaacatgaccttcgggatccgtgctcgcccatctacaccgttttttgacctcctccagcataggtatctgcagctctgggttcaggagcaaaaagcaacccagaaggccatcaagctggaaaagaaacagaaggtggtgctcggaaagctctatgagactcgctctagccagctcagaaaatacaaaccacctgttaaactcgacaccctgtggcatatgccgcactttcagaaagtgggtagacacctagacacttttcccacagaggctgacagacagcgcgccctgaaggcgcacagggaggaatgcgcagtccggcaaggaaccctgcgcatgggcaactacactcacccttag

SEQ ID NO: 28449 - DNA, 855 bp, Artificial Sequence
  Description of Artificial Sequence: Synthetic coding sequence
atgcctgaggctaggtccagcgggcccgacctgacaaggtggcgaaagcagcaacagcccgtcaggagaacagtttcccaagtatgtcccccgccccgccgccccctgaccgtggccgacattcggtcaggcatggagaacgaaagactgggcgtcgttcgggatagtatgtttcaaaaccctctgattgtgaaagccgagctgggaaagcctagggaacggtcgtatagcttgcctggaatcaatttcaattatggactgtacatccgtggccttgatgggggggttcctgaggccatagggaggtggaatgtttttaaacagcagcccacatgtccgcatgaactgacccgcaattacatcgctatgaaccgtggggccgtgaaagctggcctggtgacagctcgtgagaatttgctctacaggcagcttaatgatatccgcatctccgaccaagacgatcgtcgcatgaaaaaggaacctccccctctgccccctaatatgaccttcgggattagagcccggccgtctaccccctttttcgatctgctgcagcatcgatacctgcagttgtgggtacaggagcagaaagcaacccaaaaggccatcaagctcgagaagaagcagaaggtcgtgctgggaaagctatatgagacgcggtcatcgcagctaagaaaatacaagcctccagttaaactcgataccctatggcacatgccacactttcagaaagtcggccgtcatttggatacattccctactgaagcagaccgacagagagcgctgaaggcgcacagagaagaatgcgccgtgaggcagggcactctgcgcatggggaattacacacatccctag

SEQ ID NO: 28450 - DNA, 2931 bp, Artificial Sequence
  Description of Artificial Sequence: Synthetic coding sequence
atgaccagaaccgatcccccagatctgctggtctccacagtgtatcaggatattaaggtcgccaccccaggtccggcttcaaaatgcagcccctgcgaacgtagcgtggcccgccccgccgaaccagctccattcaacaaacgacactgtcgttccttcgacttcctggaggctttggatggccccgccatggagacccttcccgagccacccccccccgagtccgccgtcccccgcgcccgcacccgagaggccgagccacgtaggcgggctcgaagtaagagcgcccccagggccccccctggtttgaccccagccccggcgtcaccgccagttctcccgaggagaggaagggaggcccaacgggccgcccgtgctgaagctagtcctagacgcgagcctgcctatcctgcactccgggctctggccaacgagctgcaccccataaagctgcaacctcagagggggggccctggaagggtcgcacccctctgcgccgccgccggacggtgcgcccctccggagcctccggctggacccgcaccacatgttaggtgccgtctggatatcaaacccgatgatgcagtacttcagcacgcaacgagggggagccggtcatgtggccctaccgaagccgcccattgggctagacctgcgcctcaatttcatggtctgaccgtgccagggcccaggcacatggcgttgtccagaaccccgaccccttctgatagctactgtgctgacccccgagccttctactgtgacggccctttgccaggcccaagggactatgctgagaggcgctcactccccttcacaactccacctggacccacccagtttttttatacagaggagcctcagggattcagaggttcattcgctgccagccctggtccaacctttgacgcgtattatccacgcccatacccttccgaggagctgagcggcccgtctccacgcagaatgggcggctactacgccggcgaagtacggaccttcccaatccaggagccccccagccggagctactatggcgaagcaccgcgggcttatggtttgccatatggtccccggtatgtgccagaggaacctcgcgctcactccactgccagacccttttacactgaggactttggcaggtaccgtgagagggacgtactggcccgaacctatccgcatccacgatcttcacccgcgtgggctgactggggcccgagaccataccgcacattgcaagtggtgccaccgtctgatccagatcctctgctggccagttggcacggaggcacgggaacctcacctccgaggttggcaactgatagtagacactatagccgatcttgggataacattcttgctcctggaccacgcagagaagacccactcggaaggggcaggagttacgagaacctgctcggcagagaggtgagagaaccgcgcggggtgagtccagaggggcggcgcccgcccgtggtagtgaacctgtcaactagccccagacgctacgctgcattgagtctctctgagacgtctctgactgagaaggggagagccggggaaggacttgggcgcaattggtatgtgacaccagaaataacaatcactgacaatgatttgagggccacggagaggccttcggcccgcgcatgggagctacctgggggacggacaaggcctccaccgcacgcggctcccgacgggccaacctcgggcaggcaacgatccctggagcagttggacgaattgatcactgacctcgtgatcgattcgcgtcccaccgcaggacaggccagtgaacctgctgctgactgtctcggaccgcaactccgccggttactggactctaggcccgctggttccggcgctcctgccctggcccctcccagatctccccccgcaagtgccggcagcgccgaagaaccggccgcacctggagaagcagccgacgcaagccctgagccgagcgccgatgaagatgaccttatgacatgctctaacgcccgctgtcgccggactgagactatgttcaatgcctgcctgtactttaagtcctgccattcttgctatacatattattgttctcgtttatgccggagggaagactgggacgctcacaaagccaggtgcgtgtatgggcgcgtcggttctgtgtgcagacacgttctccagttctgcagggacagcggccccgtgcacagagctttctctcgcatagcccgagtcgggttcctgagtcgcggccggggtgtgctctttctcgggttcccatctccaggcagtgcggataactttcttcggttcggcctggaaggtctgctcctgtcgcccacttacctgtccctccgagagctggccactcacgccgcacccctcgggagctatgcccgggagcttgccgccgccgggcgactgtatgaacccgcagagtgtttcctgttaagcgtgagcgtggcagtggggccaggcaccgctcccccaggtacaccagcactgccggctccggcacccagatcccatggcccaactgtcagaaagttcgccaaggtcgctctggctgccggcagtccagctcgaccaccccctgccaggtcacgggagcctgatatggagaccctgattctgactcctccaccaggcaccgctggactggatcaggacggagaggctgggcgacgcgcacgcgaggttgccttcatacacattcagagggagcttaggctgcggggtgtcttcctaagacatgagttccccagggtctatgagcaattgtgtgaattcgtcgaagctaaccgaaggttcacaccgacaacaatatatcccacggacaggaggacggggagacccttcatgtgtatgataatggctgcgtccgaacctcgggcgcttgactgggtggcctctgctaacctcctcgatgatataatgtag

SEQ ID NO: 28451 - DNA, 1161 bp, Artificial Sequence
  Description of Artificial Sequence: Synthetic coding sequence
atgatgaatagcgatcagaaagctgtaaaattcctagcaaacttctacatcaacggcgggaagcactggacccatgggcaccttagacagacccagcccgagccgacgcagcctaaagctagcgtgctgctcttagggcctgagccaggtatggcctgggatgagacacagccaccaaaaatgaaggagatacctgtggggctccgcctgcagactggcacaccccaagagtcgctcccgacctatacgcagactctcagggagttgctactcgagcagcggccccttattacagctgacctggaagttcctagtcccacccggtatcaggtgccctctccgtctgtacgagagagctcccctcacccccattatagcatcgggtgtaagcaccagggccgagaaggaggtgggcgacgcgcttggcagacattgtggtttcagtctgagtcccctttcactcagaaagctgatttcgatcaggagcagaagtggccatcgccagcacactaccaactgctttctcgccccgcgtttcctgcattcagctttagaggatgccactctgcttcgaaaacacctgaaggccacacccacctaggactcccgggggctcgtggcctggggctccgtgtccagcctcagtcattactgcaggcctcactgcaagccccagggaagcggtgccctgggcccaacacttacaatatcctgcccggatccagactccagtctcctagatcgcccgctttttctatgagtaggagccctgcctttacctcatggttgtcaacaagtttcagcttcggcagccctaacccttggccttctcggctccccaggggtggactccagttgacacttcctttcggcgcgtggagaggacaccctggctgcactcagactcaagctcctcgccaccgccccctgctccacgcccttgaaccagctgggcataacctacttgggccagctacagagtggaaccatggtcttccccgtggctttcctcggcctcctctagggctcggagcgccagcttggccctcagatcctttggggacgcctatgcatcccagcggctggccaactctactgtgggctgtggacaaagcagggcccgcttggatcccccacctgccaattagtccactgcactag

SEQ ID NO: 28452 - DNA, 927 bp, Artificial Sequence
  Description of Artificial Sequence: Synthetic coding sequence
atgatgaacagtgaccagaaggctgttaagtttctggccaacttttacatcaacggcgggaaacattggacgcacggtcatctgcgccagacccagcctgagccaactcagccaaaggcttctgttctgctcctcggcccagagccaggcatggcttgggatgagactcaacctccaaaaatgaaggaaattccagtggggcttcgcctccagacagggacaccccaagaatccttaccaacttacactcagaccttacgcgaactgcttctcgaacagagacccttaattacagctgatctggaggtgccttctcccacacggtatcaggtgccatcaccatcagtgcgggaatcatcacctcatccccattactctatcggctgcaaacaccaggggcgcgaaggaggcggcagacgagcctggcagacattgtggtttcagagcgagtccccattcactcaaaaagcggacttcgatcaagaacagaagtggccctctcctgcccactatcagctcctgagtaggcccgcctttccagctttttcttttcgggggtgccacagcgcaagcaagacgcccgagggacatacacatctagggctgccaggagctagagggctcggcttgagggttcaaccacagtctctactgcaggcatctctccaagcaccaggcaagagatgtcccggacctaatacatacaacatcctgccgggaagccggctccaaagtccacggtcacccgctttctccatgtcacggtcacccgccttcacttcttggctcagcacatctaggacccccggcccagcagcctaccacgtggaggattgcaacagtcggttcccatccgctcccggagtagtaatccagggagtccgcaggccgaagaggcacgataccggccccttttgtacattgtag

SEQ ID NO: 28453 - DNA, 549 bp, Artificial Sequence
  Description of Artificial Sequence: Synthetic coding sequence
atggcagcccccgctcctgtcacacggcaggtatcaggggcagccgctcttgtgcctgctccaagcggccccgacagtggccagcccttggctgcagccgtggccgaactgcccgtgctagacgccaggggacagagggtaccttttggggcgctgttccgcgagcgtcgagccgtcgtagtgtttgtgagacacttcctgtgctacatctgcaaggagtatgttgaagacctcgcaaagattccccgcagttttttacaagaggctaatgtaacattgattgtgattggccagtccagctaccaccatatcgagcctttttgtaagttaacagggtacagccatgaaatctatgtggacccggaaagagagatctacaagcgtctaggtatgaaaaggggtgaagagatcgcgtcatctggaaataatatccactttatacaccgagaccggaataggctggatcacaaacccattaactcggtcctacagttagttggagttcagcacgtgaacttcactaaccgacccagtgtgattcatgtctag

SEQ ID NO: 28454 - DNA, 681 bp, Artificial Sequence
  Description of Artificial Sequence: Synthetic coding sequence
atggccgccccagccccagtgacacgtcaggtgtccggtgccgctgccctggtgcctgctccatcaggacccgacagtggtcagcctctcgccgccgccgtcgccgaactgccagtccttgatgcacgcggtcaacgtgtgccctttggtgctttgtttagagagaggcgggcagtcgttgtattcgtaaggcatttcttatgttacatctgcaaagagtacgttgaagatctggcgaaaatcccgcggtcattcctgcaggaagccaacgtaacactcattgttatcggacagtcatcctatcatcacattgagccgttttgtaagctcaccgggtactctcacgagatttatgtggaccctgaacgggagatctataaacgccttggcatgaagcggggcgaagagattgcctcttcgggacaatctccacacattaagtcaaacctactgagtggctctctgcagagtctctggcgcgcagtgacgggcccgctgtttgacttccagggagacccagctcagcaaggaggcaccctgatattaggtccgggcaacaacatacacttcatacaccgtgacagaaatcgtttggaccacaaacctataaacagcgtcctgcagctagtaggcgtccagcacgtgaactttactaatcgtcccagcgtcattcacgtgtag

SEQ ID NO: 28455 - DNA, 333 bp, Artificial Sequence
  Description of Artificial Sequence: Synthetic coding sequence
tgatacgtggaggatctggccaagatcccgagatcattccttcaggaggccaatgtgacactgattgtaatcggacagagctcgtatcatcatatcgagcctttttgcaaactcaccggatactcccacgaaatctatgtggaccccgaacgagagatctataaacgcctgggaatgaaaaggggagaagaaatcgcgagcagtggaaacaatatccatttcatccaccgcgatagaaacagactcgaccataagccaatcaatagtgtcctccagcttgtcggcgttcaacatgtgaacttcaccaacaggccttccgtgatccacgtttag

SEQ ID NO: 28456 - DNA, 543 bp, Artificial Sequence
  Description of Artificial Sequence: Synthetic coding sequence
tgaggcccacgccccccaagggtgatggccgctcccgccccggtcactaggcagcactttttgtgttacatttgtaaggagtacgtcgaagatcttgcgaaaatccctagaagttttctgcaggaggccaatgtgacactcattgtgatcggccagtctagttaccaccatatagaaccgttctgcaagcttactggatacagccacgagatatatgttgatcctgaaagagagatttacaagaggttgggtatgaaacgcggcgaagagattgcttcatcaggtcagtctccccacattaagagcaatctgctgtccggaagtctgcagtccctctggcgggcggtgaccggccccttgttcgatttccagggagaccccgctcagcaggggggaactctgatcctgggacccggaaataatattcatttcatccatcgtgatcgcaaccgcctggaccacaaacccattaactctgtcctccagctggttggcgtgcagcacgtcaactttaccaacagaccttcagtgatccacgtatag

SEQ ID NO: 28457 - DNA, 492 bp, Artificial Sequence
  Description of Artificial Sequence: Synthetic coding sequence
atggaacactaccggaaggcaggaagcgtcgagctgcccgctccgtctccaatgcctcagctcccccccgataccttagaaatgcgtgtgcgcgacggtagtaagattaggaatctcctcggactcgccctagggcggctcgaggggggttcagctaggcatgtggtgttcagcggctccgggcgtgccgcaggtaaggccgtcagctgcgctgagattgtcaagcgccgcgtgcccggattacaccaactcactaagctccgattcctgcagactgaggactcctgggtaccagccagtccggacactggtctagatccactaacagtgcgaagacatgttcccgccgtttgggtgctgctgtcaagggacccattagacccaaatgagtgtgggtaccagcctcctggcgctccccccgggctcggttccatgccttcctccagctgcgggcctcggagcaggagacgagcacgggatacccgatcctag

SEQ ID NO: 28458 - DNA, 492 bp, Artificial Sequence
  Description of Artificial Sequence: Synthetic coding sequence
atggaacactaccggaaagctggaagcgtggagctgcccgcaccgtctccaatgcctcagttgccccctgataccctggagatgcgcgttagagatgggagcaagatccgcaacctcctggggttagccctgggcaggctggagggcggaagtgcccggcatgtagtgttttcgggaagtggtcgcgcggccgggaaggcggtgtcatgtgccgaaattgtgaaaaggcgtgtaccgggcctgcatcagctcacaaagctgcgatttttgcaaactgaggatagttgggtgccagcaagcccagatacagggcttgatccactgaccgtgaggcgacatgtgcccgccgtgtgggtgttgttgagtcgcgatcctctggaccccaatgagtgcgggtaccagccacccggtgcacctccgggtttgggctcaatgccctcgtcatcgtgcggaccgcgctctcggcgccgcgctcgcgacacccgcagctag

SEQ ID NO: 28459 - DNA, 495 bp, Artificial Sequence
  Description of Artificial Sequence: Synthetic coding sequence
atggaaacagcagtgagaggcatgcccttggaatgtcccccccgtcccgagaggctcaacgcttatgagagagaggtcatggtcaatatgcttaactccctgtcacggaatcagcagcttcctcgaattaccccgcgttgcggctgtgttgaccccctgcccggccggctcccatttcatggttacgaatccgcctgctccggccgccactattgcctgagagggatggattactacgcttccggggcaccttgtaccgatcggcggctccgaccctggtgtcgcgagcagccaaccgttcggtgtgtaccgccatatgaacatcgaccgggaatgcagtgcgctgttacaaccccacctcctagctactatccttacccgaacctgagatgggacacctcccattttaagaaatccggtgggccccaacgcaacaattacgtgattcacccagagtttgtgtctgagacttaccctgactaccgctgttggtag

SEQ ID NO: 28460 - DNA, 336 bp, Artificial Sequence
  Description of Artificial Sequence: Synthetic coding sequence
atggaaactgcggtccgcggtatgcccttggaatgtcccccccgacccgagcggctcaatgcctacgagcgtgaagtaatggtgaacatgttgaactctctatcaagaaaccaacagctcccacggattactcccaggtgcggatgtgtacctccttacgaacaccgccccggtatgcagtgtgcagtaacaaccccacctccatcctactatccttaccctaatctacgctgggatacatcacacttcaagaagtcaggcgggccccagcgcaacaactacgtgatacacccagagtttgtaagtgaaacataccctgattatcgctgttggtag

SEQ ID NO: 28461 - DNA, 495 bp, Artificial Sequence
  Description of Artificial Sequence: Synthetic coding sequence
atggaaacggcagttcgcgggatgccactcgagtgtcccccgcgtccagaaaggctcaatgcatacgaacgggaggttatggtgaatatgctgaattccctctctcgaaatcaacaattgccccgcatcacacctcgatgcggatgtgtggacccgctccccggacggcttccgtttcatggatacgagtccgcgtgctccggccgccattattgcctaagagggatggattactatgctagcggagccccgtgcaccgacagaaggctgagaccttggtgcagagagcagcccaccgtaaggtgtgtgcccccctatgaacataggccagggatgcagtgcgctgtgactaccccaccacccagttactacccatatcccaacctgcgctgggacacatcccactttaagaagtccggcgggccacagcggaataactacgtgattcaccccgaattcgtctctgaaacctaccccgactatcgctgctggtag

SEQ ID NO: 28462 - DNA, 384 bp, Artificial Sequence
  Description of Artificial Sequence: Synthetic coding sequence
atggaaacggccgtcaggggcatgcccctcgaatgccctccacgtcccgaaaggctgaacgcctacgagcgagaggtaatggtgaatatgttgaacagcctgtcccggaatcagcaactccctcgcataactcctaggtgcggttgtgtcgatcccctgcccggccgccttcccttccatggatacgaatcggcgtgctcagggcggcactattgcctccggggtatggactactacgcaagtggtgcaccatgtaccgatcgccggctcagaccttggtgtagagaacagcctacaatgtgtacaagcttgcgcgccccagctcggaacgcagtttgctgctacaattccccagccgtcatccttcccatatcagaaccttag

SEQ ID NO: 28463 - DNA, 381 bp, Artificial Sequence
  Description of Artificial Sequence: Synthetic coding sequence
taagcttgggaagctaataagtttctgacccctggccttacccataccatggagaggcacgtggatccggaagccctgcagaagatggctaagtgcgccgttcaggactatacctataggggaagcatatccggtcatccatacctgcccgaaaaatactggttaagccaggaggaggctgataagtgtagtcccaattacctcgggagcgactggtacaacacttggaggatggagccgtacaactcctcttgctgtaacaaatatacaacttaccttccccggctccccaaagtctcggttgccccttcaaccgacgtttggggcctgggccacgcatatccaaccaccagccaaaccaccgtcacggacatctcttag

SEQ ID NO: 28464 - DNA, 507 bp, Artificial Sequence
  Description of Artificial Sequence: Synthetic coding sequence
atgatggaagagatagacagattccaggttccaactgcacacagcgaaatgcaaccactggaccctgctgcagccagtatatccgacggcgattgcgatgctcgtgaagagaaacaacgagaactggctcgcaaagggtctcttaagaacggcagtatgggtagtcccgtcaatcagcagcccaaaaaaaacaatgtgatggccagaacacgccttgttgtcccaaataagggctactcctctcttgaccagagtcctgatgagaaaccactggtcgccttagacaccgactccgacgatgacttcgacatgtcccggtacagctcctctggatacagtagtgcagagcagataaaccaggacttgaatatccagctcctgaaagacggttaccgccttgatgaaatccccgacgatgaggacctagacctgatccctccaaaatccgtaaatcccacatgtatgtgctgtcaggccacctcgtctaccgcctgccacattcaatag

SEQ ID NO: 28465 - DNA, 471 bp, Artificial Sequence
  Description of Artificial Sequence: Synthetic coding sequence
atggaagaaattgaccgtttccaggtacccacagcacatagcgaaatgcagcccttggatcctgccgcagcgagcatctcggacggtgactgtgatgcgcgtgagggagagtcagtcgctatgaactacaagccgtctccgcttcaagtgaaattagagaaacagagggagctagcccgtaaaggttccctaaaaaacggcagcatgggctctcccgttaaccagcagccgaagaaaaacaacgtgatggcaagaacacgattggtggttccaaataaaggatactcctcactcgatcagtcaccagacgagaagccacttgtggccctggataccgaccggtgcgtctggggcctcggcggatcctgggctgctcagaggaatctgtattcaacctcaggcctgtataggcctcatcttctatattgtcagaattgggatatcctgcagccagagagcctccagggctag

SEQ ID NO: 28466 - DNA, 519 bp, Artificial Sequence
  Description of Artificial Sequence: Synthetic coding sequence
atggaggaaatcgatcggtttcaagatcctgccgccgctagtatcagcgacggagattgtgacgcgagggagggcgagtccgttgctatgaattacaagcctagcccgctgcaggtaaaattagaaaagcagagggaactcgctcgtaaaggctcacttaaaaatggttccatgggaagtcccgttaaccagcagccaaagaagaacaacgtcatggccaggacaaggctcgtcgtgcctaataagggttattcatcgctcgaccaaagcccagatgaaaagccattagtcgccctcgataccgacagcgacgatgactttgatatgtcacggtattcatcgtccggctattcatcagccgagattaatcaggatcttaacattcagctgctgaaggatgggtaccgcctggacgaaatccccgatgacgaggacctggatttgatcccaccaaaatccgttaatccaacttgcatgtgttgtcaggccaccagctcaaccgcctgccatatccagtag

SEQ ID NO: 28467 - DNA, 471 bp, Artificial Sequence
  Description of Artificial Sequence: Synthetic coding sequence
atggaagagatcgatcgctttcaggaccccgccgccgcgtcaatatctgatggcgattgcgacgcaagggaggagaaacaacgagagttggccaggaagggtagcctgaagaacggatctatgggcagccccgtcaaccaacagcccaaaaagaataatgttatggcgcgaacacgacttgtcgttcctaataagggctattctagccttgaccagtcccctgacgaaaagcctctcgtggctcttgataccgatagcgatgatgatttcgacatgtcgcgctacagttcctccggttactcctctgccgagcagattaaccaagacttgaatatccagctactgaaggatgggtaccgacttgacgaaattcccgatgacgaagatctggatctgattcccccaaaatctgtgaatcctacatgcatgtgttgccaagcaacgtctagtaccgcctgtcatatccaatag

SEQ ID NO: 28468 - DNA, 495 bp, Artificial Sequence
  Description of Artificial Sequence: Synthetic coding sequence
atggaggaaatcgacaggtttcaagtgccaacagctcattccgaaatgcagccactggatcctgctgccgcgagtataagcgacggtgactgcgacgcccgggaagagaagcagcgagaactggctagaaaaggttcgctgaagaacgggtctatgggcagtccagtaaaccagcagcctaaaaaaaacaatgtcatggcacgcactcgccttgtggtgccaaataaaggttattccagtcttgatcaaagtcccgatgagaagcctctggtcgccttagacacagacagtgatgacgactttgacatgtcgcgttactcctcttctggttactcgtctgctgagcaaatcaatcaggaccttaatattcagctgcttaaagacgggtatcggttggacgagatccccgacgatgaggatcttgaccttatccccccaaaccaggtgtccccctgttccttgatttatttccaggagggcgtctggaaaacttag

SEQ ID NO: 28469 - DNA, 501 bp, Artificial Sequence
  Description of Artificial Sequence: Synthetic coding sequence
atggaagagatcgatcgtttccaggtgcctaccgcccacagcgagatgcagcctcttgacccggctgctgctagtattagtgacggcgattgtgacgcccgtgaggagaagcagcgcgagctggcccgaaaaggcagtttaaaaaacggcagcatgggatcaccagtcaaccagcagcctaagaaaaataatgtgatggctcggacgaggctagtggttcccaataaaggttacagctcccttgaccagtcgcccgacgagaagcccttagtcgcattggataccgattctgacgatgacttcgacatgtcccggtactcctcgagtggatattcgagcgcagagataaatcaagatctgaatatccaattactgaaagacggctacaggctggacgaaatccccgatgatgaagacctcgatcttatcccgcccaagagcgtgaatccgacatgcatgtgctgccaagccaccagcagtaccgcttgccacatccaatag

SEQ ID NO: 28470 - DNA, 552 bp, Artificial Sequence
  Description of Artificial Sequence: Synthetic coding sequence
atggaagagatagaccggtttcaggtgcccactgcccattccgaaatgcagcccttggatcctgccgcagcgtcaatttccgatggagactgcgacgcccgggaaggagaatcagtggctatgaactataagcccagtccactacaggtgaagctcgaaaagcagcgcgaactggcccggaagggatcgctgaagaacgggtctatgggaagccccgtgaatcagcagcctaagaagaacaatgttatggcccgcacgaggctggtggtgccgaacaaaggatactcttcactggatcagtccccagacgagaagcccctcgttgccttggatacagactctgatgacgactttgacatgtctcgctattcctcatccggttactccagcgccgaaatcaatcaagacctaaatatccagttgttaaaagacggctataggcttgacgagatccccgatgatgaggacctagacctgattccacctaagagcgttaatcctacatgtatgtgctgtcaagctaccagtagcacagcctgccatatccagtag

SEQ ID NO: 28471 - DNA, 510 bp, Artificial Sequence
  Description of Artificial Sequence: Synthetic coding sequence
atggaggagattgacaggttccaggtgcccaccgcacactcagagatgcagcccctggatcccgcggcggcaagcatatccgatggcgattgcgatgccagggaaggcgaaagcgtggccatgaactataaaccgagccctctgcaggtcaaactggagaaacagcgcgaactcgcacgcaaaggctccttgaagaatggcagcatgggatcgccggtcaatcagcagcctaagaagaacaatgtcatggctagaacccggctagtggttcctaacaagggatacagttctttagatcagagtcctgacgaaaagccactcgttgccctggacactgactcagatgacgacttcgatatgagtaggtattcatcgagtggctattctagcgccgaacagatcaaccaggatctcaacattcaattactgaaagacggctatagactggatgagatccccgacgatgaggacttagacttgattccccctaagagcgttaaccctacctag

SEQ ID NO: 28472 - DNA, 558 bp, Artificial Sequence
  Description of Artificial Sequence: Synthetic coding sequence
atgatggaagagatcgatcggttccaggttccaactgcccactcagaaatgcagccattggatccggcagctgcctcaatatctgacggggactgcgatgcccgggagggcgagtccgtggcaatgaactataaacccagccccctgcaggtgaagctagagaaacagcgcgagctagcccgcaagggctcactgaaaaacggttctatgggctcccctgtcaatcagcagcccaaaaagaacaatgtaatggctcgcacgcgactcgtggttccgaacaaaggctactcatccctcgaccaaagtcctgatgagaagccgctggtcgctcttgacactgactcagatgatgatttcgacatgagcagatatagctccagcggatacagttccgctgagcagattaatcaggacctgaatatccaactactgaaggatggctataggctagatgaaatccccgatgatgaagatcttgacctgattcctcccaagtcagttaacccgacttgtatgtgttgccaagcaaccagctcgacagcctgtcatattcagtag

SEQ ID NO: 28473 - DNA, 153 bp, Artificial Sequence
  Description of Artificial Sequence: Synthetic coding sequence
atgaaactgttgtcagagcagcaggaactaaggacggtctcaatgacggcctggaagccgcgcatgaatagaaagtcaaggagccgaatgagccccatagatccccgacactctgggacccctaatagtaacaggatcggcctgagcacctag

SEQ ID NO: 28474 - DNA, 153 bp, Artificial Sequence
  Description of Artificial Sequence: Synthetic coding sequence
atgaaactgctgagtgaacagcaggaactacgcacggtgtccatgaccgcttggaagcctcgaatgaatagaaagtctaggagcagaatgagtcctatcgatcccagacatagcgggacacccaactcaaatcgaatcggtctatctacttag

SEQ ID NO: 28475 - DNA, 360 bp, Artificial Sequence
  Description of Artificial Sequence: Synthetic coding sequence
atgaaccgaaatatactcgaggagatgctgcagtatctgctgatcgattggatcgtgggcgaccagttcgaaatccagttaaaccaacaactctggtccttgataccaaataacgatgtgcgtcgcctggtgagccacgtgatcaggacgctgaagaccgactgtacagagactcatcttcagctggcgtgtgcaaaacttataagccgcacaggacttcttatgaaattgctgagcgaacagcaggagttgaggactgtgagcatgacagcatggaagccaagaatgaatcgaaagtcccggagcagaatgagtatcccatctggacctgatatggaggaaactacggacgtcagctag

SEQ ID NO: 28476 - DNA, 297 bp, Artificial Sequence
  Description of Artificial Sequence: Synthetic coding sequence
atgcttcagtacctgctgattgactggattgtgggggatcaatttgaaatccagttaaatcagcagctgtggagtcttatacccaacaacgacgtgcgtcggctggtctcacacgttatacgcaccttgaagactgactgcacagagacccatctgcagcttgcatgtgcaaagttgatcagccgcactgggctgttaatgaagctactgtctgaacaacaggaactgcgaaccgttagtatgactgcttggaaacctagaatgaatagaaagtctcggagtaggatgaggtcttag

SEQ ID NO: 28477 - DNA, 2163 bp, Artificial Sequence
  Description of Artificial Sequence: Synthetic coding sequence
atggacattcagctggatcccgctcgagacgatctgcccttaatggccaatacgagccacatcctcgtcaagcattatgttctagatctggatgtcgacttcgagtctcaagtgattgaagggactatcgtgctcttcctggaagacggcaaccgatttaaaaagcagaactctagtattgaagaggcatgtcaatcggaatccaacaaagcttgcaagttcggcatgcccgaaccctgccatatccctgtgaccaacgcccgcaccttttcaagtgagatggagtataatgactttgccatctgttctaagggcgagaaagacaccagcgacaaggacggcaatcacgataaccaggaacatgcctcaggtatatccagctctaagtattgttgtgatacagggaatcatggctcagaggactttcttctggtcctggactgctgcgatctgagtgtattgaaggtggaggaggtggacgtggccgccgtgccaggcttggaaaagttcacgagaagcccagaactaacagtggtgtcagaggagttcagaaaccagatcgtcagggagctcgtgaccctgcccgcaaacagatggagagagcagttggactattatgcccgatgctcccaagctcccggctgcggcgagctactgttcgacactgatacatggtctctccaaattaggaagacaggggctcagacagcgaccgacttccctcatgccatcaggatctggtataaaaccaagccagaagggcgatcagtgacctggacttccgaccagagcggtaggccctgcgtctataccgtgggcagtccaataaacaatcgagccctattcccgtgtcaagaaccaccagtcgcaatgtccacctggcaagccaccgtgagagcggccgcaagctttgtcgtgttgatgtccggggagaacagcgccaaacctacacagctatgggaggagtgctccagctggtactactatgtgactatgcccatgcctgccagcaccttcaccatcgccgtgggatgttggactgagatgaagatggagacctggagctctaatgatcttgccactgaacgccccttctcgccatcggaggccaactttcgacacgtcggcgtgtgctcacatatggaatacccatgtcgcttccaaaatgcgtccgccaccactcaggagatcattcctcaccgagtatttgcacccgtctgtctcacaggagcttgccaggagaccctgctgaggttaatccccccatgtttatcagctgcccactctgtgctcggggctcatcccttttcccggctcgatgttctgattgttcctgctaatttccccagtctcgggatggcgagaccttccaaagataaaaccggtcacacatccgacagcggcgcctcagtcattaagcatgggctcaatcccgaaaagatcttcatgcaagtgcattacctaaaagggtatttccttctgagatttctggctaagcgcttgggcgacgaaacgtatttttcatttctccgcaagtttgtgcacacattccatggacaactgatcctgagccaagactttctgcagatgctgttggagaatatcccagaggaaaagaggcttgagttgtccgtcgaaaacatctatcaggactggctggagagttccggaatccccaagcccctgcaaagggaaagacgagctggagccgaatgcggtctggcccggcaggtgcgagccgaggtgaccaaatggataggggtcaatagacgtccacgtaaaaggaagcgtcgcgagaaggaagaggtattcgagaaactgttgcccgatcagctcgttctccttctggagcacctgctggagcagaagacactaagcccgaggacgctgcagtccctacagcgaacttaccacttacaggaccaggacgcggaggtgagacaccgctggtgtgagctgattgtgaaacataaatttaccaaagcttacaagtctgtggaacgctttctgcaggaggaccaggccatgggagtctacttgtacggagaattgatggtttcggaggacgcccgtcagcagcagttggctagacgatgtttcgagcggactaaggagcagatggaccgctcttccgcacaggttgtggccgagatgcttttttag

SEQ ID NO: 28478 - DNA, 552 bp, Artificial Sequence
  Description of Artificial Sequence: Synthetic coding sequence
gccgacccaggccgggctcaaggcgccggttctggggctgccgccgcttcttcccccgccgccggcgaacccctgcagagagaaagaagggccggcgctgaatgtggtctcgccaggcaggtcagggcagaagtcacaaagtggattggtgtgaatcgcagacctcgaaaacgcaagagacgcgaaaaggaagaggtgttcgaaaaactactccctgatcagctagtgttgctacttgagcacctgctggaacagaaaacgttgagccctcgcaccttgcaatccctgcagagaacataccacctgcaagatcaggatgctgaggtccggcatagatggtgcgagctcatcgtgaaacataagtttacaaaagcctacaagtcagtggaaagattcctccaggaggaccaggcaatgggagtgtacctctatggcgaactcatggtaagtgaggatgcccgccagcagcaactagctagaaggtgttttgaacgcacaaaggaacagatggaccggtcatctgcacaagtggtcgctgaaatgctgttttag

SEQ ID NO: 28479 - DNA, 2460 bp, Artificial Sequence
  Description of Artificial Sequence: Synthetic coding sequence
atggacatccaacttgatcctgccagagacgacctacctctcatggcaaatacaagccatatccttgtgaaacactatgtattggatctggatgttgactttgagagccaagtcatcgagggcaccatcgtcctatttctcgaggacggaaatagatttaaaaagcagaactccagcattgaggaggcttgccaatcagaaagcaacaaggcttgcaaatttgggatgcctgaaccatgtcacattccggttacaaacgcacggacctttagtagcgagatggaatataacgacttcgctatttgcagcaaaggtgaaaaggatacttctgacaaagacggcaaccacgataatcaagaacatgcatccggaatcagctccagtaaatattgctgcgatacaggcaaccatggcagcgaggactttctgctcgtactggactgctgtgacttatcagtactcaaagtggaagaggtggacgttgccgccgtccctggtctggagaagttcacacgcagccctgaactcaccgtggtgtctgaggaatttcggaatcagattgtgcgggaactggtgacattgccagcgaatcgatggcgggagcagctcgactactatgccagatgctcccaggcgcccggttgtggagaactactgttcgacacagacacatggtctctccagattcgaaagacaggggctcagactgctaccgatttcccccacgctataagaatctggtacaagaccaagcctgagggtagatctgtcacgtggacatccgaccagtccggtcgcccctgtgtctatacggtgggcagccccattaacaatagggctttgttcccttgccaggaaccccctgttgccatgagcacctggcaggccaccgtccgggcggctgcttctttcgttgtgctgatgagcggggagaacagtgccaaaccgactcagctgtgggaggagtgctcaagctggtattactatgtgacaatgccaatgccagcctccacctttacaatcgctgtaggatgttggaccgagatgaagatggaaacatggagttcaaacgatctggccactgaaagacctttctctccctcagaggccaattttcggcacgtgggagtctgtagccacatggagtatccgtgtcggttccagaacgccagcgctaccacacaggaaattatccctcaccgcgtgttcgccccagtctgcctcactggggcctgtcaagagacactgctccggctgatcccgccctgtctgtctgcagctcactctgtcctcggtgcccaccctttctccagactagatgtgttaattgtgccagctaacttccctagtctgggtatggcctcccctcacatcatgtttctgtcgcagtcgattctcacggggggcaaccatttgtgcggaactcgactctgtcacgaaattgcacacgcgtggttcggcctggcaataggcgctagagactggactgaggagtggttatctgagggctttgctacccatctggaagatgtattctgggccacagcccagcaactggctccttatgaagcgagggagcagcaggagctgcgcgcctgcctacgctggcgtcggctgcaggatgagatgcaatgtagccctgaggaaatgcaggttctgaggccctcaaaggacaaaacaggacacacttccgacagtggagccagtgtcattaagcacggtctcaatccagagaagatttttatgcaggtccattatctgaagggctacttcctgcttagatttttggcaaaacggctgggcgacgagacctacttttccttcttgcgaaagtttgtacacacattccatggccagttgatacttagccaggacttcctccagatgttgctagaaaacattcccgaagaaaaacgattggagctgagcgtcgagaatatctatcaggactggctggaatccagcggtatacctaagcccctgcagcgggagagacgagccggggcggaatgcgggctggctcggcaagtgagagccgaggtgactaagtggatcggagtgaaccgtcggcccaggaagcgcaagcggagggagaaggaagaagtgttcgaaaaactgttgcctgaccagctggttctccttctggaacatttactcgagcagaaaacactgtcccctaggacactgcaaagtctacagcggacataccatctacaggaccaagacgcagaggtcagacatagatggtgtgagctcatcgtgaaacataagttcacaaaggcctataaatcagtcgagcgcttccttcaagaagatcaggcaatgggcgtgtatttatacggtgaattaatggtaagcgaggacgctcggcagcagcagctggctcgcagatgctttgagaggactaaagagcagatggatcggtcgagcgctcaggttgtcgcagagatgctgttctag

SEQ ID NO: 28480 - DNA, 495 bp, Artificial Sequence
  Description of Artificial Sequence: Synthetic coding sequence
atgcaggttcattatctgaaggggtatttcctgttgcgtttcctagccaaacgcctgggggacgaaacctactttagtttcctgcggaaattcgtccacacgttccacggccagctgatcctgagtcaggatttcttacagatgctgttggaaaatatcccagaagagaaaagattagaactgtccgtggaaaatatatatcaggactggctcgaaagtagcgggatccccaaaccactgcagagggagagacgcgcaggcgcggagtgtgggttggcacgccaggttcgggccgaggtcaccaagtggatcggcgtgaataggcggcccaggaaacgcaaacgaagggagaaggaggaggtgttcgaaaagacacttaactggtcccatttgcggaatcgagaacggagaaggaagaaatggattacatttaagactctcggcggaatcctgtttaccgtcaagcaaatgcgtaacctcttcgctcaggtgtag

SEQ ID NO: 28481 - DNA, 561 bp, Artificial Sequence
  Description of Artificial Sequence: Synthetic coding sequence
atggagtatccttgcaggtttcagaacgcctctgctacaacccaagagataattccacatagagttttcgcccccgtctgcctgactggggcctgtcaggaaactctgttaagactgatacctccctgcttaagcgccgcgcactcagtgctgggcgcgcacccattctcacgactggatgtcctgattgtccccgcaaattttccatctttgggaatggctagcccccatataatgtttctcagccagtcaatcctgacaggcggcaaccacctatgcggtacgcgcctctgccacgaaatcgcccacgcgtggttcggcctcgccattggcgcacgcgactggactgaagaatggctttccgaggggttcgccacccacctggaagacgttttttgggccacagcccagcagctggcgccttatgaagccagagagcaacaggaactcagggcttgcctacggtggagacgcctgcaggatgagatgcagtgctcccctgaggagatgcaggttttgcgattcccacatgttgggggctgttccggctccttttcctag

SEQ ID NO: 28482 - DNA, 1527 bp, Artificial Sequence
  Description of Artificial Sequence: Synthetic coding sequence
gtcgtgtcagaggagtttaggaatcagatagtccgtgagctcgtcactctgcctgccaatcggtggagagaacagcttgactactatgccagatgttctcaggcgcccggatgcggggagcttctatttgacacagacacatggagcctccagatcaggaaaacgggcgcccagactgcaaccgactttccccacgctatacggatctggtataagactaaaccggagggacgctcagtaacctggacatctgaccagtctggaagaccctgtgtgtatacagtagggtcgcctataaataatcgcgctctctttccatgtcaggaaccacccgttgcaatgagcacctggcaggccacagttagagccgccgcctcgtttgttgtgctgatgagtggagagaattccgcaaagcccacacagttatgggaagaatgcagctcctggtattactatgtgactatgcccatgccagccagcacttttacaattgctgtgggctgctggacggagatgaagatggagacctggtcttccaacgatttagctactgagcggcccttcagtccctcagaggcaaactttaggcatgtgggcgtctgttcccacatggagtatccttgtcggttccaaaacgccagcgccacaacgcaggaaatcatcccccatcgggtgttcgcccctgtgtgcctcacaggcgcatgtcaggagacattgctaaggctgattccaccgtgcctcagtgccgcccatagcgtcctcggtgctcatcctttctctaggcttgatgttctcatcgtgccggcgaactttccctcacttggcatggcccgtcccagcaaggataagactgggcatacgagcgactccggcgccagcgtgattaagcacggcctgaatcccgaaaagatctttatgcaggtgcattatctgaaaggttactttcttctcaggtttctggccaagagactgggtgacgaaacttatttctcttttctgaggaagttcgttcatacgtttcatggccagttgatattatcgcaggacttcctgcaaatgctccttgagaatatccctgaggaaaagaggctggagctcagcgtagagaacatctaccaggattggctggagtccagtggaatccctaagccactgcagagagagagacgcgccggagctgaatgcggtcttgctcgccaagtgcgtgctgaggtgacaaaatggatcggcgtcaatagaagacctcggaagagaaaaaggcgagagaaggaagaggttttcgagaagctcttacctgatcagctagtacttttgcttgaacatctgctggagcagaagactctgtcgcccaggactctgcaatccctgcagcgaacctatcacttgcaggatcaagatgctgaggtcaggcaccggtggtgcgagctcatcgtgaagcacaaatttacaaaagcttataaatctgtcgaacgctttctgcaagaagaccaagtgggagttatttttcagcagatggggatactatag

SEQ ID NO: 28483 - DNA, 546 bp, Artificial Sequence
  Description of Artificial Sequence: Synthetic coding sequence
atgaggatgcggcggcctctggccggaggaggtaaatcttgggggattgctcacttctacaagcctctgcagcgggagaggcgggctggcgccgagtgcggactcgctcggcaagtccgggccgaggttacaaagtggataggagtgaacaggagaccaaggaagagaaaacgtcgcgaaaaagaagaagtttttgagaaactgctccctgatcaactggtgcttcttctggaacatctgctcgagcaaaaaaccctcagtcctaggactcttcagtccctccagaggacataccacttacaggatcaggatgccgaggttcggcacagatggtgcgagctaattgttaagcacaaattcactaaagcgtacaaatctgttgaacgcttcctccaggaggatcaagcgatgggggtttacttgtatggtgagctcatggttagtgaagatgcgagacagcagcagctcgcgcgccgatgcttcgaaagaacgaaggaacagatggatcgaagctcggctcaggttgtagctgagatgttgttctag

SEQ ID NO: 28484 - DNA, 423 bp, Artificial Sequence
  Description of Artificial Sequence: Synthetic coding sequence
tcctccaagtattgttgtgacactgggaatcacggcagtgaggacttcctgttggttttagattgttgtgatctgagtgtcctcaaggttgaagaggtggatgtggcggccgttccaggattagaaaaattcacacgcagccctgaattaacggtagtgtctgaggaatttcggaatcaaattgtgcgcgaactggtcacgttacccgcaaatcggtggcgtgagcaactggattactacgcaaggtgtagccaggctcccggttgcggagaacttttattcgacacagatacttggagcttgcagatccgcaagactggagctcagaccgctacagattttccgcacgcaattcgaatttggtataagacaaaacccgaggggcgctccgtgacttggacttccgaccagagcgggagatag

SEQ ID NO: 28485 - DNA, 1806 bp, Artificial Sequence
  Description of Artificial Sequence: Synthetic coding sequence
ctcttcgatacagacacatggtcactgcagatcagaaagactggagcacaaacagctacggatttccctcacgccattagaatctggtataagactaaaccggagggcagatccgtgacttggacatcagatcaatcggggcgaccctgcgtgtatacagtagggtctccgattaacaatcgcgctctgtttccatgtcaggaaccgccagtggcaatgtccacctggcaggccacggtgcgggccgccgccagttttgtagtcctaatgtccggagaaaattcagcaaagccaacacagctgtgggaagaatgcagctcatggtactactatgtgaccatgccaatgccagcgtcaacctttaccatcgcagttggctgctggacagagatgaagatggaaacatggtccagcaatgacttagccaccgagaggcccttctctcccagtgaagcgaactttagacatgttggagtctgctctcacatggagtatccttgccggtttcagaacgcctcagcaacgacacaggagattattccacatagagtgtttgcccctgtgtgtctcaccggggcctgtcaggaaacactgttacgcttgattcccccctgtttgtcagccgcacactcagtgctcggtgcacatccattttcccgacttgacgtactcattgtgcccgcaaattttcctagccttggaatggccagcccccacattatgttcctctcccaaagtattttaaccgggggcaaccacctgtgtggaactagactctgccacgagatcgctcacgcatggtttggactggcaatcggagccagggactggacggaggaatggctttccgagggctttgccacacacctggaagatgtattctgggcgacagctcagcaattggcaccctacgaagcacgagaacaacaggaacttagggcctgccttaggtggagaaggttgcaggacgagatgcagtgtagcccagaggagatgcaggtgctgaggcccagtaaggacaagacgggtcacacgtcggactccggtgcctctgttataaaacacggactaaacccagagaaaatattcatgcaggtccactacctgaaagggtacttcctcttaagatttctcgcgaaaaggctgggtgacgaaacttatttctcttttttgcggaaatttgtgcacacatttcacgggcagctcatccttagccaggattttcttcagatgttgttggagaacataccagaagagaagaggctggaattatctgtcgagaatatctatcaggactggttggaaagtagcggaattcccaaacctctgcagcgggagcgtcgggccggagctgagtgcgggttagctagacaagttcgcgccgaggtaaccaaatggatcggcgtaaatcggaggccccgcaagcgcaaaagacgggagaaggaggaggtatttgaaaagctgctccccgatcagctcgtgcttctgttggagcacctcttagagcagaaaactctcagcccacgaacactgcagtccttacagagaacctaccacctgcaggaccaggatgccgaggtgcggcatcggtggtgcgagctcattgtcaagcacaaatttacaaaagcttataaaagtgtagagaggtttctacaggaggaccaggccatgggagtctatctgtatggggaactgatggtgtccgaagatgcccggcagcaacagttagctagacgttgctttgaacgtaccaaggagcagatggacagaagctcggctcaggttgtcgccgaaatgcttttttag

SEQ ID NO: 28486 - DNA, 483 bp, Artificial Sequence
  Description of Artificial Sequence: Synthetic coding sequence
atgaggatgcgcaggccactcgccggcggggggaagtcgtggggaattgcccatttttataaggtaacgaagtggattggagtgaaccgacgtccacgaaaacgcaagaggcgggagaaggaggaagtgttcgaaaaactgttaccggatcagctcgtgctgcttctggagcacctgctggagcagaaaactctgtcccccaggacgctccagagcctccaacggacctaccatttgcaggaccaggatgccgaggtgagacacagatggtgtgagctgatcgttaagcacaagttcaccaaggcttacaagagtgttgaaaggttcttacaggaagaccaggctatgggcgtgtatctttacggcgaattaatggtcagtgaagatgctaggcagcaacaactggcacgccgctgctttgagagaacgaaagaacagatggacaggagtagtgcccaggtcgtggccgagatgctgttttag

SEQ ID NO: 28487 - DNA, 555 bp, Artificial Sequence
  Description of Artificial Sequence: Synthetic coding sequence
taggccgatccagggcgagcgcagggcgcagggtctggggccgctgcagcgtctagtccagctgccggtgagccactgcaacgggaacgccgcgcaggggccgagtgcggattagcgagacaggtaagagccgaggtgaccaaatggatcggtgttaataggaggccaaggaagagaaaacgccgcgaaaaggaagaggtgtttgaaaagctgctgcctgaccagttggtgctgctgctggagcatctcttggaacaaaagacattatctccccggacactgcagagtttgcagcgcacgtaccacctgcaggaccaggacgccgaggtgagacatcggtggtgcgagttgatcgtgaaacataagtttacaaaggcatataagagcgtggagcgctttctgcaggaggaccaagccatgggtgtctatttgtatggagagctgatggtttcggaggacgccagacagcaacagctggctaggcgttgttttgagcgaaccaaagaacagatggatcgatccagcgcccaggtggtcgctgagatgttattttag

SEQ ID NO: 28488 - DNA, 438 bp, Artificial Sequence
  Description of Artificial Sequence: Synthetic coding sequence
tgagatgagacatacttctcttttctccgaaaattcgtgcacacatttcatggccaactgatactgagccaagacttcctgcaaatgctgctggagaatatcccggaggagaagaggctggagctgagcgttgaaaacatctatcaggactggctggaatctagcggcatccctaaacccctacagagggagcggcgagccggtgcggaatgtgggctggctcggcaagtgcgcgcggaggtcactaaatggattggcgttaatcggagaccacgaaagaggaagcggagggaaaaggaggaagtgtttgaaaaaaccctcaactggtctcacctgaggaatcgtgagcggcggcggaagaaatggataacctttaaaaccctgggcggcatactgtttacggtcaaacagatgcggaacctgtttgctcaggtgtag

SEQ ID NO: 28489 - DNA, 546 bp, Artificial Sequence
  Description of Artificial Sequence: Synthetic coding sequence
atgcaaaacaacgaaatcattaagccagctaagtacttcagcgagctggaaaagtcgatcttgctagcgctggtggaaaagtataaatacgttctggagtgcaagaaatccgatgccagaactatcgcccttaagcagcgcacatggcaagcccttgctcatgagtataatagtcaacccagtgtaagcctgagggactttaagcagctgaaaaagtgttgggagaatataaaagcccggaccaagaaaattatggcccatgagcgtagggagaaggtcaaacggtccgtgagccctttgcttagcactcacgtgctgggaaaagagaagatcgccagcatgttgcccgaacagctatacttcctgcagtccccaccagaagaagagccagaataccatcccgatgccagtgctcaggaaagcttcgcagtgtctaatagagaactttgcgacgatgagaaggagtttatccattttccagtgtgcgaagggacatcacagcccgagccatcctgtagtgccgttcgcatcacagcgaataaatag

SEQ ID NO: 28490 - DNA, 828 bp, Artificial Sequence
  Description of Artificial Sequence: Synthetic coding sequence
atgcagaataacgagatcatcaaacctgcaaagtacttttcagaactggaaaaatctatcctgctggcattagtcgaaaaatacaagtacgtgctcgaatgcaagaaatcagatgctaggactattgccttaaaacagagaacctggcaggcactcgcccacgaatataacagccaaccttccgtttccctgagggattttaaacagctgaagaaatgttgggagaacatcaaggcgagaaccaaaaagataatggcgcatgaaaggcgggagaaagtgaaacgcagcgtctcacccctcctaagcacgcacgtgctgggaaaagagaagattgctagcatgctacccgaacagctctactttctgcagtcgccccctgaagaagaaccggagtatcaccctgacgctagtgcccaggaatccttcgccgtatcaaacagagaactgtgcgacgacgagaaagaattcattcatttccccgtgtgtgagggaaccagtcagccagagcccagctgttccgccgtgcgcataacagcgaataagaactacaggtctaaaacctcgcaggagggcgctctcaagaagatgcatgaagaagagcatcaccagcagatgagtattttacagttgcagttaatccagatgaacgaagtgcacgtggccaagatccagcaaattgaacgggaatgcgagatggctgaagaggaacaccgcatcaagatggaggtcctgaacaagaagaaaatgtactgggagcggaaactgcagacgtttactaaagaatggcccgtgagctcattcaatcgcccgtttcctaatagcccttag

SEQ ID NO: 28491 - DNA, 405 bp, Artificial Sequence
  Description of Artificial Sequence: Synthetic coding sequence
atgcagaataatgaaattataaaacctgcgaagtatttcagcgagctggagaagtctatattgctggcgcttgtcgaaaaatacaaatacgtcctggagtgcaagaaatccgatgcaagaacaattgccctcaagcagagaacttggcaggcactcgcccatgaatacaattcccagccctctgtctctctacgagacttcaaacaactgaaaaaatgctgggagaacatcaaggccagaaccaagaagatcatggcacatgaacggcgagaaaaagttaagcgatcagtctctcctttactgtccacccatgtccttggcaaagagaagatagccagcatgctgcctgagcagctttacttcttgcaatcgccaccagaggaggaaccagagtaccacccttag

SEQ ID NO: 28492 - DNA, 492 bp, Artificial Sequence
  Description of Artificial Sequence: Synthetic coding sequence
atgactcatcccctcccgcacgacagtcacacctctggagctccgcccttggtgaacaaaagtcgcgaccttgccaatggcccccccttcttcagcccgcttcagtccttgtgggaagaattccttcaccttctcttcatggggaccctgcttttttataggattgcaacaaaagcattgcgaggcaaggctaccctacttaaaagtcactctaagcagcctgcgcagcctggctgggagcccggcatacgggcccccagccctgtgccggcatccagccttcaggatcactcgcggctgacatcactgagtcggactggcaaggaacagcggcgtacactgtcgctgatcaggaagacatctggcacacccactgagtctacggtggcaacggccgctgcctcaaccaccgaagtgccctcccgtttgccttgggccgctcgcgcaggtttcaaaaggacaaccggggtctgcattgccttgccgacatag

SEQ ID NO: 28493 - DNA, 435 bp, Artificial Sequence
  Description of Artificial Sequence: Synthetic coding sequence
atgccctcttcggcccacgcccacgcgattcttaaggacgcccaagattcgccaggtgttgtcctgggccagggagtcatacgggccgggaagggttgggaaaacgggcccgagagccatagggtcagatataggggcaaaaaaaacactgactggcataccagaagcccggccctcacttttaccgtgctttggcctagctgccccttagtgcctatagtgttgggcctcaaccctgggttttgtccgtgtgcaagatcttctggggagtgcaatcactctggccacatcatcgagggtacaaggtgggaccagggtcagttgtgcctcctgtttactctgtcacgtgccgatatcagagcatgttggcgggtgggagaacagcagtacgtgagtttgtttactcacgttcaaatgcagcacccatcgctctag

SEQ ID NO: 28494 - DNA, 531 bp, Artificial Sequence
  Description of Artificial Sequence: Synthetic coding sequence
atggagttccactacgtcgctcaggccgacttagagctccttacctcatccaaccctccagcttccgcttctcagtcaaccggcatcacaggaggctcccatagagcacgccctggtcccgtgcattttattgataaggtcactgataagccatcgcatagtcacccttttgccctcaaagagaattggaacctgaaccctgagccttcgagtccaccttcacctctgtttcttgaggccccaagccggcaggcttctcagcaccatggagcttcccccggggccggaacctctgccggatgcccgtttgagaaatgctgttcaactgagccttgtctcagtgggcttggggatgttggacgcggcgaggcagcctcactcagagctagacccggctcaggagctagcaggggccaaggtcccggcagcagggtgagctgccgcagggatctggggaagcccctccatgctccagccgggttttcagccggtgaggttcacacaacccccctgggtaatctcggcgcctag

SEQ ID NO: 28495 - DNA, 357 bp, Artificial Sequence
  Description of Artificial Sequence: Synthetic coding sequence
atgcccagcaagacagcagagaacgctaccttttattacatatcatctcttcttagcagccgcagtcccgtctttaatcagagccccaaagtgaaagcggggcacatgttggaggctagtcaaatatccgcaaagaactccgcggatttctttcaccctaccccgtcgtgtagtgagttagatttcaccctacaccccgagttagccgacagcctcggcgctaagcacaattataaagctacctgtctgatgcggtttctgccattgcagaggcacactcgttcttggtttagtttgatcctgtggtgtattcaaagagacgattacctcattgggctattctcttgtttcagttag

SEQ ID NO: 28496 - DNA, 462 bp, Artificial Sequence
  Description of Artificial Sequence: Synthetic coding sequence
atgcagcgcaggagacggccaccaccccccactagcagactgcccgaaggttgtggcgggggcggcggcggaagcgaagaggtggaagtgcaattttccgctgggcgctgggggagcgccgctgccgtgagcgctgcggccgccgccgctacccgctctaccgaggaagaggaagagaggttggagcgcgaacacttctggaaaatcattaatgctttccgttattacggaacgtcaatgcatgagcgggtgaaccgcactgagagacagttcaggtcactgcccgctaaccagcagaagctgttaccccagttccttcttcacctagacaaaattcggaaatgcatcgaccataatcaggagatcttgctgaccattgtcaacgactgcatccacatgttcgaaaataaggagtacggcgaagacgtgtgcgaatccctcttctatttttgcctcttttag

SEQ ID NO: 28497 - DNA, 1230 bp, Artificial Sequence
  Description of Artificial Sequence: Synthetic coding sequence
atgcagaggagacggcggcctcctccacccaccagccgcctaccagaggggtgcgggggcggaggggggggatctgaggaggtagaagtgcagttctcggctggaagatggggcagtgccgccgccgtaagtgccgccgcagctgccgccacccggtcaaccgaggaagaagaagagcgtctggagagagagcacttttggaaaatcatcaacgcttttaggtactacggtacttcgatgcacgaacgcgttaatcggacagaaaggcagtttcggtcgctgccggccaaccaacagaagctcctgccgcagtttctcctgcatctcgataagatacgcaaatgcattgaccataatcaagagatccttcttactatcgtgaacgactgtatccatatgtttgagaacaaggaatacggcgaggacggcaacggaaagatcatgccggcatcaacatttgacatggacaagctcaaatctaccctaaagcagttcgttagagactggagtgagacaggcaaggcagagcgcgacgcctgctaccagcccataataaaggagatcctgaagaattttcccaaggagcgctgggatccgtccaaggtgaatattttggtccccggagccggtctcggtagactcgcctgggaaatcgccatgttgggatacgcctgtcaggggaatgagtggagtttttttatgctcttctcttccaactttgtactgaatcgctgcagcgaaataaataaatacaagctgtacccctggatacatcagtttagtaataaccggaggtcagctgaccagattcgtcctattttctttccagatgttgatccccacagccttcctcccgggagcaacttcagcatgactgcaggggattttcaggaaatctactctgaatgtaacacttgggattgcattgcaacatgtttttttatcgacaccgcccacaatgtaatagactatatcgatacaatctggaaaatcttgaagccgggaggaatctggatcaacctcgggccacttttgtatcatttcgaaaacctggctaacgagctaagcatcgaactgagttatgaggatatcaagaatgtcgtccttcagtacgggtttaaggtggaggtggagaaggagtcagtcttgtctacttacactgttaatgatctgtctatgatgaagtactattacgagtgcgtgctatttgttgtgcgaaagccacaatag

SEQ ID NO: 28498 - DNA, 591 bp, Artificial Sequence
  Description of Artificial Sequence: Synthetic coding sequence
atgcagcgccgacggcgtccgcccccacccacatcgcggctgcccgaggggtgtggagggggggggggagggtcagaggaggtggaggtgcagttcagtgcaggcaggtggggttcagccgctgccgtttctgcagccgcagctgcggccacgaggtccaccgaggaggaggaggagagactcgagcgagaacacttttggaagataattaacgccttccggtactacggcacaagtatgcacgagagagtcaacaggacagagaggcagtttcgttcactcccagcaaatcagcaaaagctgctgccacaattcttgttgcacctggacaagatccgtaaatgtattgaccataaccaggagatcctgcttacaatcgtgaatgactgcattcatatgttcgaaaacaaagaatatggggaggatgggaacgggaagataatgcctgccagcactttcgacatggacaagctcaagtcaaccttaaagcagtttgttcgcgattggtcagaaaccgggaaggctgaaagggatgcatgttatcaaccaattataaaggaaatcctcaaaaattttccgaaagagcgatag

SEQ ID NO: 28499 - DNA, 717 bp, Artificial Sequence
  Description of Artificial Sequence: Synthetic coding sequence
gtgctgaggctgcaactggaatcagataggcacgatttacttcgttcaactagcatgcacgagagagtcaacaggacagaaagacagttcagaagcctgcctgctaatcagcagaagttgcttccccagtttctgttgcaccttgacaagatccgcaagtgtattgaccacaaccaggaaatcctgctcactattgtgaatgattgtattcacatgttcgaaaataaggaatatggcgaggacggtaatgggaagatcatgcccgcatcaacttttgatatggataagctgaagtccaccctgaaacagttcgtaagggattggtcagagactgggaaggctgagcgggatgcgtgctatcaaccaattattaaagagatcctgaaaaacttccctaaggagcgctgggatccttcaaaagtcaacatccttgtcccaggagccggattaggcagattagcttgggagattgccatgttgggatacgcatgtcagggcaacgaatggagcttttttatgcttttcagctctaatttcgtcttgaatcggtgttcggagatcaacaagtacaagctgtatccctggatccaccagttcagcaataacaggcgatccgcagatcaaattcggccaatcttctttcccgatgtggacccacacagtcttccacccgggtccaacttctccatgaccgccggggactttcaagaaatttag

SEQ ID NO: 28500 - DNA, 1386 bp, Artificial Sequence
  Description of Artificial Sequence: Synthetic coding sequence
atggacctgcctgatgagtcgcagtgggacgagacgacttgcggattagcagtctgtcaacacccccagtgctgggctaccattcggaggatagaaagggggcaccctcgtatactgggctcaagttgtaagacgccgttggacgcggaggacaagctacccgtgctcactgtggtggacatcctcgactctgggtttgctgcccaccacctgcccgagtgtaccttcaccaaggctcatagccttctctctcagtctagcaagttctactcaaaattccatggtcgtccccccaaaggactgcccgacaagtctctgattaactgcacaaatcggttacctaagttcccagtcctcaatttgaatgagacacaactgccatgccccgaagacgtgcgaaacatggtggttctgtggatacctgaggagactgagatccacgtgtcgcagcacggcaaaaagaagagaaagaactcagcagtgaaaagcaagtctttcctcggtctgtccggaaaccagtcagccggaaccagggtgggcacgccaggaatgatcgtccctccacctaccccagtgcagctgtctgagcagttttctagcgacttcctcccactttgggcacagagcgaggcactaccccaggacctccttaaggagctgctccctgggggcaaacagacgatgctatgccctgagatgaaaattaagctggctatgatgaagaagaatctgcctctggaaaagaatagaccagactccgtcatcagtagcaaaatgttcttgagcatccacaggctcactctcgagaggcctgcacttcgctacccagaacgactgaagaagctgcacaacctcaaaactgaaggataccgtaaacagcaacagcggcagcagcagcagcaacagcagcagaagaaggtcaagacccccataaaaaagcaagaagctaagaagaaggctaagtcagatcctggcatccagtccacatctcacaagcatcccgtcacaacagtgcacgacagactgtatggataccgtactctgccaggtcagaattcggacatgaaacagcagcagcagatggagaagggcaccacaagtaaacaggacagcactgagaggcctaaaatgaattactacgatcacgctgatttccaccatagcgtaaagagccctgaactctatgagactgaacctaccaacaaggatatctcagccccagttgatgccgttcctgaggctcaggccgctcgacagaaaaagatctcttttaatttctcagaaattatggccagtaccgggtggaattccgaattgaagttgctgcgcattctgcaagatacggatgacgaggacgaggaagaccagagtagtggtgccgagtag

SEQ ID NO: 28501 - DNA, 1386 bp, Artificial Sequence
  Description of Artificial Sequence: Synthetic coding sequence
atggatctgcctgatgagtcgcagtgggatgaaacaacttgtggactggctgtttgccagcatccgcagtgctgggccacaatccggcgtatcgagcggggccaccccaggattctcggatcttcctgcaagaccccgcttgacgcagaagataagctgccggtcctaacagtcgtcgatattctggatagcggattcgccgcacaccacctcccagagtgcactttcaccaaagcccactctctgctgtctcagtcttcaaaattctattctaaatttcacggcaggcccccaaaaggactgccagataaatcactcataaactgtacgaaccgcctaccaaagttccctgtgctcaatctgaacgagacccagttgccttgcccagaagatgttcgaaacatggtagtactatggataccagaggaaacagagatccatgtgagccagcacggcaaaaagaaaaggaaaaactcagccgtgaaaagtaaatctttcttaggcctctcaggaaaccagtctgcaggaacccgcgtgggaacaccaggtatgatcgtgcctcctcccacccctgttcaactgagcgaacagttctcatcagattttctccccctttgggcgcaatccgaggcactgccacaagacctccttaaggagctgttgcccggaggaaagcagactatgctgtgcccggagatgaagatcaagttagcgatgatgaaaaaaaacctgcccctggaaaaaaatcgccctgacagcgtaatttcttctaagatgttcctgtcaatacaccggctcacactggagcgccctgctttacggtatccggagcggttgaagaaactgcacaacctgaagactgaggggtaccgaaagcaacaacaacgccaacagcagcagcagcagcagcaaaagaaagtcaagacaccaatcaaaaagcaagaggcaaaaaagaaggccaagtccgaccctgggatccagagcacctcccataagcacccggtgacaactgtacatgaccgcctttatgggtaccggacattgcccggacaaaactcagacatgaagcagcagcaacagatggagaaagggactaccagcaagcaagacagtacagaaaggcctaaaatgaactattatgatcacgccgatttccaccactccgtcaaatcaccagagctttacgagacagagccgacaaacaaagatattagcgcacccgtggatgccgtgccagaggctcaggcggcccgccagaaaaagatttctttcaacttctccgagattatggcgtctactgggtggaatagcgagcttaagttacttcgtattttgcaggataccgacgatgaggatgaagaggatcagtccagtggcgctgagtag

SEQ ID NO: 28502 - DNA, 1386 bp, Artificial Sequence
  Description of Artificial Sequence: Synthetic coding sequence
atgtcacgcattaataagaatgtggtgctggcactattgacactgactagcagcgcatttctgttattccaactgtactactataaacactatctgtctacaaaaaacggagcaggcttaagcaaaagcaaaggcagcagaataggcttcgattccacccagtggcgagctgtgaaaaaattcatcatgcttacaagcaatcagaacgttcccgtcttcttgattgaccctctcattctcgaactgatcaataaaaactttgagcaggtaaaaaacacatctcatggctctacctctcagtgtaagttcttttgtgtgcctcgggatttcactgctttcgcactgcagtaccacctctggaagaatgaagagggatggttcagaatcgccgagaacatgggtttccagtgcctgaagatcgagagcaaagatcctaggctcgatgggatcgactcattatctgggacagagatccctcttcactatatatgcaagttggctacccacgcgatccaccttgtcgttttccatgagcggtcaggtaattacctgtggcacggtcatctgagactgaaggaacacattgatcgcaagtttgttcccttccgtaaactccagttcggccgatatcccggtgccttcgatcggccggagctacaacaggtgacggtagacggcctggaggtgctgataccaaaggatcccatgcacttcgtggaggaagtgccgcactctcgatttatcgaatgtagatacaaagaggcgcgggctttttttcagcagtatctggacgacaacacggtggaagcggtcgccttcaggaagagcgcaaaggaactgctgcagcttgcagctaagacgctcaacaagctgggtgtgccattctggctcagctccggtacatgccttggttggtaccggcagtgtaacattataccttactctaaggatgtggaccttggtatatttatccaggattacaaaagtgatatcattctcgcattccaagatgcggggctcccactcaagcacaagtttgggaaagtggaggattcactggagttgtcgtttcagggcaaagacgatgtgaaactcgatgtattctttttttacgaagaaacagatcatatgtggaacggcggcacacaggcaaaaactggcaaaaagtttaagtatctcttcccaaaattcacactgtgctggacagagttcgtggacatgaaagttcacgtaccatgtgagaccctcgaatatatagaagcaaattatgggaagacttggaaaatacctgtcaaaacttgggattggaaacggtcaccacctaatgtccagcctaacggaatctggcccatctctgaatgggacgaggtcatccagttgtattag

SEQ ID NO: 28503 - DNA, 2640 bp, Artificial Sequence
  Description of Artificial Sequence: Synthetic coding sequence
atggctgatggtggaggaccaaaagacgcccctagtctccgaagttctcctggaccagctcccagggtgccaagggccgtcggaccgtctgggggaggcggtgaaaccccaagaactgccgcgcttgccctacgctttgataagccgataaagcaggcattctataacaccggtgctgtcctctttgtgtgtctgtgttgcggcgcggccgtactggtgtacttcattctggaggccttcttgcgtcctctgctgtgggccgtcctctgtggcacattccttcacccctttaagtcctctctgacacgcctgggacggcactggctgcaaagactccaccgcgcgcacacccctattgtgctggcggccctcctgttacccctgtgctttgtggattacggcgtcgaggcactgggggaacaagctctgcggaggcgtcggctgcttctcctcctcggcgccggggggcctctgctgtacgggctatattgcctgggcagctatctcggtgtacaagttctcttggtgcatgcggctaccctaatatgcagaggccttgactatttctcctctttgtggatttggacccttgttgtcgggtatgtcctcacagtatccttcaaatggaacgccagcacagagcgatatctgcgggctgtgagtataccggtgtggattatcctcttattccacctcgccagtctggctggttcttggaggattcccgtgtttttagtcatcgtttttctgatgagcgtgggtacgctttatgaaaaacaaaatggaaaggagtcttccggagctgagctgcctggccaagtcatatccatggccgcttcaaccttagccaacctcgctatctctatcactggttacgaatccagttccgaggatcaaccatccacccagccagcagaagccgtggaccggggagagtccgcccctacccttagtactagcccaagcccctcgtcaccatccccgactagtcctagccctacactgggcaggcggcggccggagattgggacttttttgcggaagaagaaaacttccgacatttattttgtcagtctcgtttgggccatagtagttatgcaaatttggctgaatctgtggatcgtacagctccttccggtgccgatcgcagtgtggatccttaagaagctggtgattcacttcggggtggttgatttcctggagaagaggtaccacgtttggtggggaattatcgaatcgtttctgaaggagcgacagggggcccttgcgccttggcctatcgtggggctcggcaaatttttgctgaaagttgattcaaaactttggcactggctgaacaaaaagatgatcatctggttagaaaagatgttggataaaattatctccatttttataatttttctcttggttattggcactctgcttctagcgcttctgctgaccgctaaggtccaccaggagtcggttcatatgattgaggtcacctccaatctgataaatgagacacttgcaaatcaccctgagtgggccaactggctgccagaggctcaggttgtccagcgagccctgaatagcgctgcaaacaatgtctaccagtatggtcgcgagtggatcacccataaactgcataagattctgggagacaaggtcaacaatacggccgtcattgaaaagcaggtgctggaactgtgggacaggctgtatcactcttggtttgttaagaatgtgacccattcagggagacacaagggacagaagttacatgtttcacgccagaattcatggctgggggatattctggattggcaggacatcgttagtttcgtgcatgaaaacatcgagacatttctgtctatcctggagtctctatggatagtaatgtctaggaacgtgagcctcttgtttacaaccgtcacaaccctgctgactatacttttctattcaggcactgctcttctgaactttgtgctctccctgattatattcctgaccaccttattttatctcctctcctctagtgacgagtactacaagcccgttaagtgggttatatctctgacacccctgtctcagcctggtcccagctcaaacattatcgggcagagcgttgaagaagcgattcgcggcgtgtttgacgcctctctcaaaatggcgggcttctatggtctgtacacatggctgacacacacaatgttcggtattaacattgttttcatcccatcagccctcgcagctatcctgggagccgtgccattcttgggcacctattgggcggccgtgccagccgttctggacctgtggctcactcaagggctcgggtgtaaggctatccttctgctcatcttccatctgcttcctacctacttcgtggataccgccatctactcagacatttccggcggaggacacccttatctgactggcctcgcagtggccggtggggcgtactacttgggcctcgaaggtgccattattggacccatattactgtgcatcctggtcgtggcctctaatatttactccgcaatgttagtgtcccccaccaactccgtcccaacaccaaaccaaaccccctggcccgcccagccacaaaggacatttagagatatctctgaggacctcaaatcaagtgtgggctag

SEQ ID NO: 28504 - DNA, 1509 bp, Artificial Sequence
  Description of Artificial Sequence: Synthetic coding sequence
atggccgacggaggaggccccaaggacgccccttctctcagatcttcccccgggcctgcaccaagggttccccgggcggtgggcccaagtggcgggggcggggaaactccccggacagctgcactggcgctgcggtttgacaagccgatcaaacaggccttttacaacactggagctgtgttatttgtgtgcctctgttgtggcgccgccgttctggtctattttattctcgaggctttccttcggccccttctgtgggctgtactgtgtgggacttttctacatccttttaagtcgagcttaacaaggctggggcgccactggctgcagagattgcaccgggcgcatactccaatcgtgctcgccgcactgctcctgcccctctgcttcgtggattatggggtggaggcactcggcgaacaagcactcagaaggcggaggctgctgctgctgctgggcgccgggggacccctcctctatggcctttactgcctaggaagctatctgggcgttcaggtccttctagttcacgccgccaccctgatttgccgaggcttggattacttcagctccctgtggatttggaccctggtcgtgggctatgtgctgactgtatcattcaaatggaacgctagcaccgagcgctacttacgcgccgtttcaatccccgtatggatcattctgttgttccatctcgccagcctggccggttcctggcgcattcccgtctttcttgtgatcgtgttcttaatgtctgtggggacgctgtatgagaaacagaacggcaaagagagtagtggcgccgaactccccgggcaagtgatcagtatggccgcttctactctcgctaacctagcaatttcaatcacaggatacgagtcaagtagtgaggaccagcctagcacacagcctgctgaagctgtagaccgcggagagagcgccccaaccctgtccacaagccccagtcccagttcccctagtcccacttcaccttcacctacactggggcgacgccgccctgagatcggaaccttcctcagaaagaagaaaacctctgacatatacttcgtgagtctggtctgggcaatcgtcgtcatgcagatctggctgaacttgtggattgtacagttactccccgtgcctattgcggtttggatacttaagaagctcgtcatccatttcggagttgtggattttctggaaaagcgctatcacgtatggtgggggataatcgaatcctttttgaaagagaggcagggagctctggccccctggccaatagttgggcttgggaaatttctcctgaaggtggactctaagatgattatctggctggagaaaatgctcgacaagattattagcatatttatcatctttctactcgtgataggaacattactcttagcactcctccttactgctaaagttcaccaggagtccgtgcatatgatcgaggtgacgtctaatttgatcaacgaaaccttggccaatcacccagaatgggcctag

SEQ ID NO: 28505 - DNA, 1296 bp, Artificial Sequence
  Description of Artificial Sequence: Synthetic coding sequence
atgttttggagaagactgagaccgggggctcaagatttagcccccaaagggctacctggggacggagacttcagacgtagctctgacccacgacttcctaagctgacccctcctgcgctgcgcgccgctcttggagcacgaggttccggtgactggaggattccaggcggtggggccgcatggtggcctgagggtgacgccaagccaggggtcggcgtggggaggcttcccccacgcctgcccgcactgctgacagcaacaaggagggctgtgaggaagagagggctcttgcggagcctcttgcctccaccactcttgtcagccggcgcatcccgggagagtgcccccagacagccaggacccggggaaagagaaaggccgcggcggcgtgtcgcccgcgaggatccagactttttaggtgcctttctgggagagctgcttcccagtagattccgggaattccttcaccagctgcaggagaagtgcgccgaggaacctgagccactcacgagtcccgctccacagcatcagcgaggagtgctggagcactgccccggatctcctaggtgtcctaattgtagttttttgcccgacttgtggggccagagttcacatctccaggattccttgacgaagatttctctgcagcagactcccatcctgggccccctaaagggggaccatagccagtttaccaccgtgcgtaaagcaaatcacaggccgcacggagcgcaagtgcctaggctgaaggccgcactgacccacaacccgtctggcgaagggagtagaccatgccgtcagcgttgccctttccgagtcaggtttgcagatgagactttgcaggacaccacccttaggtattgggaaaggaggaggagcgtgcaacagtccgtcatagtgaatcaaaaagccgccctccccgttgcctccgaacgtgtcttcgggtcagtgggaaaacggttagagtcacttcccaaggcactataccccggcgcaaaggaagagacgctcgcaagttcttcgtgctgggactgtgctggactgtctacccaaaaaactcagggatatctctcagaggacactagcatgaattcgagtctacccttttgcagctggaagaaagcagccgcccaacgacctagatcttccctgcgggctttcctcgacccccatagaaatctggagcaggagtctctgcttccaaatcgagtgctgcagagcgtcttgaagcaggggtgccccaagggataccatctgctgctggcaagcgctaccttacagcccgataagcggtag

SEQ ID NO: 28506 - DNA, 816 bp, Artificial Sequence
  Description of Artificial Sequence: Synthetic coding sequence
atgcgtgaccggcggggcccattagggacatgtctggcccaggtgcagtgggccggcggcggcgactccgataaactgagttactccctcaagaagcggatgccgacggagggcccgtggcctgccgacgcgcccagctggatgaacaaacctgctgttgacggtaactcacagagtgaagccctgtcgcttgaaatggccggactgtccctgccctctggcgggcctgtcctgccatatgtgaaggagtctgcccggcgtaatccagcttctgccgcgacccctagtgccgcagtgggcctgtttccagccccaactgagtacttcgcccgtgtgtcttgttccggcgtagaggccctgggtagagactggctgggcggtggcccccgcgcaactcacggacaccgtggccaatgtccaaaaggagagccacgcgtgtctagactgacccgccatcaaaaacttccagagatgggctctttttgggatgatccaccctcggcctttcctagcgggctcgggtctgagctcgaaccttcttgtctacactccatactctcagcaactctgcatgcatgcccggaggtcctactgaaggacgagaccaagaggattttcctagacctcttgaacccaatgttttcaaagcagaccattgagtttaaaaaaatgttcaaatctacaagcgacggcctgcagatcacactcgggctgcttgctctacagcactttgaacttgccaactctctatgccatagcctgaagtacaaacagaataatgcctctagacttatactcagagtcgttctggagtag

SEQ ID NO: 28507 - DNA, 240 bp, Artificial Sequence
  Description of Artificial Sequence: Synthetic coding sequence
atgcggcagcgtggtcaggagcatctacccacttctgtaaaaagcgaacccagggcgtgcaataatcccaccgtggccgaaaacaggagagtgcctagcggtctggccgccgtaattcgaaatctcacggccctgtggaatccctccctcggagtatcagagaggagaggcggcgactgggagccttccagaatcccacggctgtgggcccgtgtcgggtggatccagctacctggatag

SEQ ID NO: 28508 - DNA, 459 bp, Artificial Sequence
  Description of Artificial Sequence: Synthetic coding sequence
atgggcctcagccccggacagactagcgtgtccttcctctggccgctcctggaagtgagggatcataatactggccgcgggctggtccccgctaccgtgctgacccccggcagtccagaaacgctactcgagctcaggcaggctttccttggcagtcggcaggccagacacggtcacgacgccgctccaagcagtggccagcagggctgcagtgtggacaggaccgcaggcagacccgttttgggttggcgcttgcgaaacagcctcacgggacaggaggggaggcagcatcttcacctgtcaggcatacggacaagcagaaaagccaaggaatataaaccagtgttcttcggggcaaccgaaatctcagtgctgatggcagtggctgagtctctgcgagaacctccaccgccccagtggggatggtttctgagtagcctgtttttgaaaatcttctag

SEQ ID NO: 28509 - DNA, 603 bp, Artificial Sequence
  Description of Artificial Sequence: Synthetic coding sequence
atgccactcgtcgaggaaagacaccggatcttaaatgagactgggaagattctgctggagaaatttggggggagcttcctcaattgtgtccgagagagcgagaactccgcacagaaactaatgcacttggttgtcgagtccttcccaagttaccgggacgtcaccctcttcgagggcaaacgggtcagcttttataagagagcccaaatactggtggccgacacctggagtgtgttagagggtaagggcgacggctgctttaaagacatctcctcgatcactatgtttgcagattatcggctcccccaggttctggcccacctgggcgccctgaaatactctgatgatcttctcaaaaagttactgaagggagaaatgctatcttatggcgaccggcaggaggtggaaatccgtggatgcagtttatggtgtgtggaacttatccgcgactgcctgctcgagctcattgagcagaaaggcgagaagccaaacggcgagattaattccatactactggattattatctatgggattatgcccatgaccatcgagaggatatgaaagggatcccgtttcaccggatccgttgcatttactactag

SEQ ID NO: 28510 - DNA, 183 bp, Artificial Sequence
  Description of Artificial Sequence: Synthetic coding sequence
atgcccttggtcgaggagcgacataggatacttaacgaaacaggcaagattctgctcgaaaaattcgggggctcttttttgaattgtgttcgggagagtgagaattccgcccagaagctaatgcatctagtggttgagtcctttccctcctacagagacgtaactctgttcgagtgcacgtag

SEQ ID NO: 28511 - DNA, 1026 bp, Artificial Sequence
  Description of Artificial Sequence: Synthetic coding sequence
atggatggactactaaacccccgggaatcttctaaattcatagcagagaactcacgagatgtgttcatagattctggaggagtccggcgcgtggctgagctgctgctggctaaggcggcagggcccgagctgagagtggaaggctggaaagctctgcacgaactgaatcccagagccgcagacgaagctgctgtgaattgggtgttcgtcactgataccttaaatttctctttctggtccgaacaagacgagcataagtgtgtggtccgttacagaggaaaaacttattccggctattggtccctgtgtgctgcagtgaatagggccctggatgaaggcatacctattacaagcgcatcctactacgctacagtcacgctcgaccaggttagaaacatactgcgttccgacacagatgtcagcatgcctctagtggaggagcggcacaggatcttgaacgagaccgggaagatcctcctcgaaaaatttggaggatccttcttgaattgcgtgagagaaagtgagaatagcgcccaaaaactcatgcatctggtggtggagagctttcccagttacagggatgtcaccttgttcgagggtaagagggtgtccttttataaaagagcccagattctggtcgccgacacatggagtgtccttgaagggaaaggcgatgggtgcttcaaggacatctccagcataacgatgtttgctgactaccggttaccacaggtgctagcacatcttggggcccttaagtacagcgacgacctcttaaagaagctcctgaagggtgaaatgctgagctacggcgaccggcaggaggtggaaatccgcggttgtagtctctggtgcgtggaattaatcagagattgtttgctggaactcattgaacaaaagggagaaaagcccaatggggagattaacagcatactgctggactattatttgtgggactacgcccatgaccaccgcgaagatatgaagggaattcccttccaccgcatacgatgtatttactattag

SEQ ID NO: 28512 - DNA, 888 bp, Artificial Sequence
  Description of Artificial Sequence: Synthetic coding sequence
atgagacactctgtggctcggcccacacgattacccaggagactgtcaccattctgggatcccgctacttgcaagaacctggaggggggtgctggtgaggtcgtacggggccgggatccgcggaggctgaggacgtcccgtagcacggagatcttgggagaagacctggcaggtccctctgccggagccgccgccaggcctgccgctccccccccacaaccaagagaacccggcgccccagggctcagacgggctccaccaaggacacgcatggactcctctggcctggggccatgttctgaggcaccgctacacaccagcgctggcctatccgggcgcaatctgagggccgcaggtggggtgcttcccgtggacctggagagggaaagagctgcgctgtgcgcaaggcagtcaggacatggccccccagccgtgagatggctgctcggatcccgtggagctgaatccgggggcctggcaagaaggagggtggctgccgagcacgcacagccgtccgccaatttggtctgcaggagtgctctggagactagtgctttccctccaagcaagcctaaaagtccccggggtcgggttcgcgctagatcaagcgacggcaggctcagacaccccgcttggagggccggctcaggcgggagaggaggcagaggtccgtccgccgagctcgcgtcccgctattggggcagaagaagagccttgcccggggccgccgatttgagacctaagggtgcccgcgctgatgaccgacgtcctcttagggctggtcgtaaattgcaccttccagaggcggcgagacttcctggaaacgtgggcaagagcggtgagccacacaaggctggggaggtgggaaatcacccccgcgattcctag

SEQ ID NO: 28513 - DNA, 810 bp, Artificial Sequence
  Description of Artificial Sequence: Synthetic coding sequence
atgggacctaggcctcttgagaagggctgcttccccggctgcttttttcgtaacagcaaggaggagagacacgagtctcggcgtccattgtctacctcccacgaacctattttccccctgaataccattaagatgaaattgaaggaaaataacctcaacaggctccctaagggcatgcaagcacgcgctccctctcaatatagcactcgccattttttccaggatcagccggctcagctgaacctgggcaataattttaagatctccggcggttcaaagcccccatttgtagtgcggcacgttgacagcgccaaaccttttggagagaacatcagtgaacaccatctaagacgctcaaggcggaaatcaaagttcagcgatttcccattccccacccggcgtgcgtcatccttagatagcctggccgccaatgtcaaggtcataaaagagccagatgaacggattgtgctgaggagcgatagcagttcgtgtctggatagttcccagtttggaaaatcctcatcttcaaagcagggcgacgctgattttcacggcaaagcaagcttcgccacataccagcacagcacctcgcctggtccactcgaccaacctctgctgcgcgagaggttccacccaggctctcaaagcacctggaagaatatacatgagcgcgtctgttccttactgacctcccatagggcccagttgcaccagaacaaagaggactcgacatcagaggtgaactacatcatagagcggccaagctacccattgaaaaagtattctcttcacgagcaacgttacttctag

SEQ ID NO: 28514 - DNA, 1179 bp, Artificial Sequence
  Description of Artificial Sequence: Synthetic coding sequence
atgccattggaggtggtcgtggagctacaaatacgggcaataagctgccctggagtcttccttccaggaaagcaggatgtctatctgggggtttatctcatgaatcagtacctggaaacaaattccttccctagtgcctttccaatcatgatacaggagtccatgagattcgagaaggttttcgaatccgccgttgacccaggagccgtcgtcgacctactggagatgtgggatgaactggcatactacgaggagaacaccagggatttcctgttcccggagcctaagcttacccccagtcacccgaggcggtgcagagaagtgctcatgaaaacagcactgggcttccctggaattgcccctaaaatcgagttttccacgagaacggctattagagaatgcgtttttctgcaccgaaatcgtttcctcgaagaacgacacgagtcgcggaggcccctgtccaccagtcacgaacccatttttcccctcaatacaataaaaatgaaactgaaagaaaataatctcaataggttgcctaaggggatgcaggctagagctccctcacagtattcaacccgccacttcttccaggatcaaccagcccagctcaacttaggcaacaacttcaagatttccggcggatcaaaaccaccctttgttgttcgacatgtggacagtgcaaaacccttcggagaaaatatttctgagcaccacttgagacggagccggagaaaaagcaaattctcggatttcccattcccgacccgacgggcctcttcactggatagcttggcggccaacgttaaggtcattaaggagccggacgaacgcatagtgctccgctcagattcgagtagctgtttggactcctctcagtttggtaaatcaagttcatcaaaacagggagatgctgacttccatgggaaagcctcttttgccacctaccagcatagtaccagtcctggtcccctggatcagcccttgctgcgcgagcggtttcaccccggatcgcaatctacgtggaagaacatccacgagcgagtttgcagccttctgacatcacaccgggctcagctgcatcagaataaagaggattccacctccgaagtcaattacataatcgaaagaccatcttatcccctgaaaaagtactccctacacgagcaacggtacttttag

SEQ ID NO: 28515 - DNA, 408 bp, Artificial Sequence
  Description of Artificial Sequence: Synthetic coding sequence
atgaccccaactccaacagccgcctggacacctccaccacccttaagaccatcagctgctgctgctggcgcccaatgccggtcctgcccctttcggggtggatgtgccccgtccacggcgcgcacacccccggcatgcatgcggcctgcaggcccctgtgccccgcctacatggcccgcaccgagcacaactacatctacctgtacctcgcgtcgtgccgggtgtaccgccagctccgcctcctattccactttggcagccgcatgttcactccgaaggtctggggtgagatggcccccaagcagtgcttactccacatgggcttttgctagctgttgtgcctctagcgcttcttgcagatgctgctgttgctgttgggctgctggcgcgtggacaagtgcgtggtag

SEQ ID NO: 28516 - DNA, 870 bp, Artificial Sequence
  Description of Artificial Sequence: Synthetic coding sequence
atgccagtcgtccgcaaaatcttccgacgccgccgtggtgacagcgagtctgaagaggatgaacaagattcggaggaagtgaggttgaaattagaagaaacacgcgaggtgcagaacttgcgcaaacgtcccaacggagtgtccgctgtggccttgctggtgggggagaaggtccaggaagagactacactggtagatgaccctttccagatgaaaaccggaggcatggtggacatgaaaaaactgaaagagcgcggcaaagacaaaataagtgaggaggaggacctgcatcttgggacatcatttagtgccgagactaacagaagagatgaagacgccgacatgatgaaatacattgagacagaattaaagaaaaggaaaggaattgtcgaacacgaagaacaaaaggtgaaaccaaaaaatgccgaagattgcctgtacgagctccccgagaacatcagagtgtcctctgccaagaaaacagaggagatgctgtctaatcagatgctttcgggtattcccgaggtcgatctcggaatcgatgcaaagattaaaaatataatcagtactgaagatgcaaaggcccgcctgctggccgaacaacaaaataagaaaaaggactctgaaacctcgtttgtgccgacaaacatggcggtgaactatgtacagcataataggttttaccatgaggaattgaacgcccccatccgtcgtaataaagaggagccgaaggcaaggccgcttcgcgtgggtgacacagaaaagcccgagcctgagcgctcaccccctaaccggaaaaggccggcaaatgaaaaggccacagatgactaccactatgagaagttcaagaagatgaatcggaggtattag

SEQ ID NO: 28517 - DNA, 528 bp, Artificial Sequence
  Description of Artificial Sequence: Synthetic coding sequence
atggttgacatgaaaaagctcaaagagaggggcaaggacaagatatccgaagaggaagacctccacctgggcacctccttttctgccgagactaaccggagggatgaggacgctgatatgatgaagtatatagaaacagagttaaaaaaacgaaaaggcatcgtagaacacgaggagcagaaggtgaagcccaaaaatgctgaagactgcctgtacgagctccctgaaaatatccgcgtgtctagtgcaaaaaagaccgaggaaatgctgagcaaccaaatgctctccggcatccctgaggtggacctcgggattgacgctaaaatcaagaatatcatcagtacggaggatgccaaggcccgtctgcttgccgagcagcagaataagaaaaaggattctgaaactagcttcgtgcctactaatatggctgtgaattacgtgcagcacaacaggttttatcacgaggaactgaatgctcataccgaaaagcagcgcagagctcagggccccgccttggaatctcgatag

SEQ ID NO: 28518 - DNA, 1086 bp, Artificial Sequence
  Description of Artificial Sequence: Synthetic coding sequence
atgaccggcaagaagtcaagtcgcgagaagcgtagaaagagatcttcccaggaagccgctgcagcactcgctgcccccgacattgtaccggctttggcatcagggagtagcggctccaccagcgggtgtggttctgccggagggtgcgggagcgtgtcatgctgcggaaatgctaatttcagcggcagcgttacagggggcggatcgggcgggtcttgctgggggggtagctcagtggaaaggagcgaacgcagaaaacggaggtccaccgattcttcctccgtcagcggctcactacaacaggagaccaaatatatattgccgactctggagaaagaattattcctggccgaacattcggacctcgaggaaggggggcttgatctcaccgtgagtctaaagcccgtcagtttctatatctccgacaagaaagagatgttgcaacagtgcttctgtatcattggggagaaaaagctccaaaagatgcttcccgacgttctaaagaactgtagcattgaagaaatcaagaaattgtgccaagaacagctggagctgttatcagagaaaaaaatcctcaaaatcctggagggtgataatgggatggattcggatatggaggaggaagcagatgatggatcaaaaatgggttctgaccttgtgagtcaacaagatatatgcattgattccgcttcttccgtcagagagaataaacagcccgaaggacttgaactgaaacaggggaagggtgaggattccgacgtgctgtcgatcaacgctgacgcatatgattctgacattgagggcccttgtaatgaggaagccgccgcccccgaagcgcccgaaaacactgtgcagtcagaggctggacagattgatgatctggaaaaagacattgagaagagcgtaaatgagattctggggctggctgagtccagtccgaacgaacctaaagcagcaactctggctgttccaccacccgaagacgtgcagccctccgctcagcagctcgagcttcttgagttagagatgcgtgccagggctatcaaggccttgatgaaagccggggacatcaagaagcctgcatag

SEQ ID NO: 28519 - DNA, 651 bp, Artificial Sequence
  Description of Artificial Sequence: Synthetic coding sequence
atgctccagcaatgtttttgcataataggcgagaagaaactccagaaaatgctcccagacgtacttaaaaactgctcaattgaggagatcaaaaagttatgccaggaacagctggaacttctgtctgagaagaagatcctgaagatattggaaggcgacaacggaatggatagcgacatggaggaagaggcagatgacggctcaaagatgggcagcgaccttgtctcccagcaggacatttgcatcgacagcgcttccagcgtgagagagaacaagcagcctgaaggcctggaactcaagcagggcaagggcgaagattctgatgtgctgtcaatcaatgctgatgcttacgacagcgacatcgaaggtccttgcaacgaggaggccgccgccccagaggcacctgagaacactgttcagagcgaggccggccagatcgacgatttggagaaggacatagagaagtccgtaaacgagatcctggggctggccgaatccagccctaatgaaccaaaagctgccaccctggccgtcccacccccggaggatgttcaaccatccgctcagcaacttgagctgcttgagctggagatgcgagcacgcgcaatcaaagcactgatgaaagccggagacattaaaaagcctgcatag

SEQ ID NO: 28520 - DNA, 4335 bp, Artificial Sequence
  Description of Artificial Sequence: Synthetic coding sequence
atgacagacaccagtgtgcttgaccaatggaaagccagtttctttgtggaggactttttagagaagaaaaccataacacgaatggtgacacaaatcaattgcgaattcgaagaagtggtcccaagcagtaaccctgactcccagatcgaagtggaagaggtctcactatacacccacatggattacaacgaggtgtttaccccagtgtcttgtctggagaaatgctctgcgcttcaaaatcagaaccaggatctgtttattgatgacaaaggaatcctctttgttagcagtcggaagcatttgccaacactcccaacccttctgtctcgcctcaaactgttccttgtgaaagacccgctactagatttcaagggacaaatttttaccgaggcaaacttctccagggagtgcttcagccttcaagagacactggaggccttcgtgaaggaggacttttgcatggacaaggtgaatttctgtcaggagaagctagaggatacaatctgcttgaatgaaccctccagcttcttgattgaatacgagtttctcattcctccttctctgaagccagagattgacatcccctctctttctgagctgaaagagcttttgaacccggttccggaaattatcaattatgtggatgagaaggagaaactgttcgagcgggacctcactaacaaacatgggattgaagatatcggcgacatcaaattctcttctactgagatcctgacaattcaatcccaatccgagcctgaggaatgttccaagccgggggagctcgagatgccactgacccccttatttttgacctgccaacattcttctgtaaattcactgaggaccgaactgcagacctttccgctttcaccagtctgcaaaattaacctgcttacagcagaggagtccgctaacgaatattatatgatgtggcaacttgagcggtgcaggagccccctgaaccccttcctcctcaccgtgcccagaattcaggaacctcatagccagtactccgtgaccgacctcaagaagatcttcagcgtgaaagaggagtccttagtgatcaacttggaaaaagcagagtggtggaaacaggccggtttgaacctcaagatgatggagaccctggaacaccttaatacatatctttgtcatgataacctgtcttccaatgacactaaaatagaaatctttctgcccacaaaggtgctccaactggagtcgtgtctggaacacaagtcacattcaagtcctattgcccttatcgacgagaagtctactaatgcacatctgagcctgcctcaaaaatctccaagtctggcgaaggaagtaccagacctgtgcttctcagatgattacttcagcgataaaggagccgctaaagaggagaaacctaaaaacgatcaagaacctgtgaataggattattcagaaaaaggaaaacaacgaccatttcgagttggattgtacaggcccctcaattaagtccccaagtagctctattattaagaaggcatcattcgagcacggcaagaaacaagaaaacgatttggatctgctctctgattttatcatgctgcgcaacaaatataagacatgtacgagcaagaccgaggtgaccaactccgatgagaaacatgataaggaagcttgtagtttgactctgcaagaagaaagtcctattgttcacatcaataaaactctcgaagagattaaccaggagagaggcacggactccgtgatcgagatccaagcatcagactcccaatgtcaagccttttgtttgttggaggccgctgcatcccccatcctcaaaaacctggtgtctctgtgtacgcttccgaccgccaactggaagtttgctactgtaatcttcgaccagacacgatttctgctcaaagaacaagaaaaggttgtcagtgatgctgtccgtcaaggaacaatcgatgaacgggagatgaccttcaagcatgccgcactgctccatttactggtgaccattagggatgttttactaacttgctcactggacacagccttgggatatttgagcaaagccaaggacatctataatagtattttgggaccctaccttggcgacatttggcgccagctggagatagttcagtttattagggggaagaaacccgagaccaattataaaatacaggagttgcagtgtcagattctctcctggatgcaaagccagcagcagatcaaggtgttgatcatcatacgtatggactcggatggagaaaagcacttcctgattaaaattttgaacaagatcgagggcctcacactcacggtgttacacagcaatgagcggaaggacttcctggaatccgagggagtactacgaggcacatcatcatgtgtcgtggtccacaaccaatatatcggagcagactttccatggagtaatttctcctttgtagtcgagtacaattatgtagaggactcgtgctggacgaagcactgcaaagaacttaacataccctacatggcattcaaagtaattctgccagacaccgtattggagagatcaacattgctcgacaggttcggcggcttcctgctggagattcagatcccctacgtcttttttgcttctgaggggctgctgaatactcctgatatcctccagttactggagtcaaactacaatatttcactcgtagagagggggtgcagtgagtcccttaagctgttcggatcgtctgagtgttatgtggtggtgaccattgacgaacacactgcaatcatcctgcaggacctggaggagctcaactatgaaaaggcttctgacaacattatcatgagacttatggcactgtcgcttcaatacaggtattgctggatcattctgtataccaaggagaccttgaactcggaatacctgctaacagagaagacgctgcaccacctcgcactcatttacgccgcgttagtgagttttggtctgaacagcgaggaactcgacgtcaagctgataatcgccccaggggtagaagccactgcccttataatccggcagatcgccgaccattctctaatgacatcaaaacgggatcctcacgagtggctcgacaagtcctggctgaaggtgtcccctagtgaagaagagatgtatttgcttgattttccgtgcattaaccccctggtcgcccagctgatgttgaataaaggaccttcccttcactggatcctgctggcaactctctgccagctacaggagctgctgcccgaggtgccagaaaaggtcttaaaacacttctgttctattactagcttgtttaagatcggaagttctagcattaccaaatctccccagatcagcagtccccaagaaaacaggaaccagatttccacgctctcaagccagagctccgcgagtgacttagactccgtgattcaggaacataacgagtactaccaatacctcggtcttggagagacagtacaagaagataaaaccactatattgaacgacaactcatccattatggagctgaaagagatatcctcatttttgccgccagtgacgagctataatcaaacctcctactggaaggacagctcatgtaaatccaatatcggccagaatactcccttcctgattaatatcgagagtcgaaggcccgcctacaactcctttctaaatcattcagattcagagagtgacgtattctcccttggcctgactcagatgaactgtgaaacaatcaagtccccgactgatacacagaagcgtgtttcagttgtgcctagatttattaacagccagaaacgtcgcactcatgaagctaagggtttcatcaataaagacgtctctgacccaattttttccctggagggaactcagagcccgcttcattggaacttcaagaagaacatctgggagcaggagaatcacccttttaacctgcaatatggagcacaacagaccgcctgtaataagctatactctcaaaaaggcaatctgtttacggatcagcagaagtgcctgtccgatgagtccgaagggctgacatgtgagagcagtaaggatgagacgttctggagggagctcccatccgtgcctagtttggaccttttccgtgcatccgatagcaatgccaaccaaaaagagtttaacagtctgtacttctatcagcgggccggcaaaagcctgggacagaagcggcaccacgagtcttcttttaactcaggcgataaggaaagtctcaccggatttatgtgctcacagctcccgcagtttaagaagcgccgcctggcctacgagaaggtacctggccgggtggacgggcagacaagactcagattcttctag

SEQ ID NO: 28521 - DNA, 1467 bp, Artificial Sequence
  Description of Artificial Sequence: Synthetic coding sequence
atgttctccgccttaaaataccatgcgatagattatctgtacgagaatgtggtgcgcaagaagttctacagggatgccctgctcctgagaatcccgtcctgtttataccaggacgaatcctaccacgttgctgtgactgataacaaattccgcaggccatggactagagtttctgccgtgagcgttcctgggatgacagatacttcagtgttagaccaatggaaggcgagttttttcgtcgaggactttttggagaaaaaaactataaccaggatggtaactcagattaattgcgagttcgaagaggtagtcccatctagcaatcccgactcccaaatcgaagtggaggaagtcagcctgtacacccacatggattacaatgaagtatttacaccagtctcctgcctggagaagtgcagtgctctgcagaaccagaaccaggatctcttcattgatgacaagggtatactctttgtgagcagccgtaagcatttgccaactttacctacgctgttgagcagacttaagcttttcctggtaaaagaccccctgttagatttcaaaggccagatcttcactgaagcaaatttctccagggagtgttttagcctgcaagaaaccctggaagctttcgtaaaagaagacttttgcatggataaggtgaacttttgtcaggaaaaactggaagataccatctgtttgaacgagcctagctcattcttaattgaatacgaatttctgattccccccagtctgaagcccgagattgacataccaagtctctccgaactgaaggaactgcttaaccctgtccccgagatcatcaactatgtggacgagaaagaaaagcttttcgaacgcgacctgactaacaagcatggcattgaggatattggggacattaagttctcgagcacagaaatcctcactatccaaagtcagagcgaaccagaggagtgctccaaaccaggcgagttagaaatgcctctgacaccgcttttcttgacttgtcagcatagttcagtgaatagcctgagaacggaactacaaacattcccactctctccggtgtgcaaaatcaacctgctgaccgcggaggaatccgcaaatgagtattatatgatgtggcaactcgaacgttgtagaagccctctgaacccctttctgctgaccgtacctagaatccaggagcctcacagccagtattcagtgacagacctaaaaaagattttctcagtcaaggaggaatcgttggtaattaatctggagaaggccgaatggtggaagcaggcaggtcttaacctgaagatgatggagacactcgagcacctcaatacttacctttgccatgacaatttgtctagtaacgacacaaaaattgagatcttccttcctaccaaagtgttgcagctggagtgtaagtatataaccgttaatatctcttacgtgaatatctttagaatgtag

SEQ ID NO: 28522 - DNA, 4335 bp, Artificial Sequence
  Description of Artificial Sequence: Synthetic coding sequence
atgacggatacgagtgtgttggaccagtggaaggcgtccttttttgtggaagacttcttagagaaaaaaacgattacccggatggtgacccagattaattgcgagtttgaagaggtcgtacccagctctaacccagattctcagatcgaggtggaggaggtgtccctatatacacacatggactacaacgaggtttttacgcccgtcagttgcctggagaagtgtagcgcccttcaaaaccagaaccaggatctatttattgacgacaagggcattttattcgtctctagccgaaaacacctcccaacgctgcccactctactgtcacggctgaagttatttctggttaaggacccgttgctggattttaaggggcagattttcaccgaggctaatttttctagagagtgttttagcttacaggagacactggaagctttcgttaaggaggatttctgcatggataaagttaacttttgtcaagagaagcttgaggataccatctgtctgaatgaaccatccagctttctgatcgagtacgagtttctaatcccccccagtctgaagcctgagatagacatacctagcctttccgagctgaaagaactgctgaaccccgtccccgaaatcattaactacgttgacgagaaggaaaagcttttcgagcgggatctaactaataaacacggcatcgaagacattggcgacattaaatttagctccaccgaaattctgaccatccaatctcaaagtgagccagaagagtgcagtaaacctggcgaactcgagatgcctctgacccctctattcttaacctgccaacacagtagcgtgaacagccttagaacagaactgcagacattccccctgtctcccgtttgcaagatcaatctgctgacagccgaagaaagtgccaatgagtattacatgatgtggcagctggagagatgtaggtcccccttgaatccctttctgctgacagtccctaggatccaagaacctcacagccagtacagtgttactgacttgaagaaaatattctctgttaaggaggaaagtcttgtgattaacctcgagaaagctgagtggtggaagcaggcaggccttaatctcaagatgatggagaccctcgaacacctgaacacatacctctgtcacgataatctgtcctctaatgatacaaaaatcgagatctttctgcccaccaaggttctgcaactggaatcctgcctggagcataaaagccactccagcccgatcgcactcatcgacgagaaatcaaccaatgctcatttaagcctgccacagaagagccccagtttggccaaggaggtgccagacttatgtttcagtgacgactatttctctgataaaggagcagcaaaagaggagaaaccgaaaaatgaccaggaacctgtaaacaggatcatacaaaagaaagagaacaacgaccatttcgaactcgactgtactgggcccagcatcaaatcaccatcctcctctatcatcaaaaaggcttcatttgaacatggcaaaaagcaagagaacgacctcgatctgctgtccgactttatcatgcttaggaacaagtacaagacatgcacttctaaaacggaggtgaccaattccgatgaaaagcatgataaagaggcttgcagcctgaccctgcaggaggaaagtccaatagtgcatatcaataagacacttgaagagattaaccaggagaggggcactgactcagtaatagaaatccaggcgtcagattctcagtgtcaggctttttgcctactggaagccgctgctagtccaattttgaaaaacctggtgagcctctgtactttacctactgctaactggaaatttgccaccgtgatttttgatcagacccggttcctcctcaaggaacaagaaaaagtggtctccgatgctgtgaggcaaggaacaatagacgagcgcgaaatgacatttaagcatgctgccctgctgcacctgctggtgacaattcgtgacgtcctccttacatgttcactggacactgccttagggtatttatcaaaagcgaaagacatctacaactcaatccttggcccctatctgggggatatctggcgccagttagagattgtgcagttcattagagggaagaaacccgagactaattataagatacaggagctgcagtgccaaattctgtcatggatgcaaagccaacagcagatcaaggtgcttatcatcatcagaatggacagtgacggcgagaaacactttcttatcaagatattgaataaaattgaaggcctgacacttactgtgttacattccaatgagcgcaaggattttctcgagtcagagggagtcctcaggggtacttcaagctgtgtcgtggtccacaaccagtatattggcgcagatttcccctggagtaatttttccttcgttgttgaatacaattacgtcgaggactcttgctggacaaaacattgcaaagaattgaatattccttatatggccttcaaggttatattacccgatacggtgctggaacggtctaccctgcttgacaggtttggcggcttccttctggaaattcagatcccatacgtattcttcgcatcagagggccttttaaatactccggacatcctccagcttctggagtcaaattacaatatctctcttgttgagcgggggtgcagcgagtccttaaaactctttggatcaagtgagtgctatgtggtggtgacaatcgacgaacacaccgccatcatcctgcaggaccttgaggagctgaattatgagaaagccagtgacaacatcattatgagactgatggccctgtctttgcagtacaggtactgttggattattctatacacaaaggaaacactgaacagtgagtatcttctcaccgaaaagacactgcatcacctagccttaatctatgctgccctggtttctttcgggttgaattctgaggaacttgacgtgaagctcatcatcgctcccggcgtggaggctaccgctttgattattagacaaatagcagatcactctttaatgacttcaaaaagggacccccacgagtggctagacaagtcctggcttaaggtatcgccctccgaggaagaaatgtacctgcttgatttcccctgcatcaacccactcgttgcacagctaatgcttaacaagggtccctctctacattggattttgctggccaccctatgccagttgcaagaactgttaccggaggttccggaaaaggtcctcaagcatttctgtagcatcacaagtctgttcaagattgggtcttcatccatcaccaagagtccccagatctccagcccacaggagaacaggaaccagatatcgacgctttcttcccagagctctgctagcgacctggattcagtgatccaggagcacaacgagtactaccagtatctaggactaggagagacggttcaagaggacaaaacgacgatccttaatgacaactcatccatcatggaactgaaagaaatcagcagctttcttcccccagtcacttcttacaatcagacctcctactggaaggattcatcatgcaagagtaatattggccagaacaccccctttctgataaatatagaaagcaggcggccagcttataacagtttcctgaaccactcagactctgagagcgatgtattttcgctcggtctgacccagatgaactgcgagacaatcaagagtcctacagacactcagaagagagtctctgttgtgccacggttcataaacagtcaaaagagacgaacacatgaggcaaagggtttcattaataaggacgtcagtgatcctatcttcagtcttgaaggcacccagtcaccgttgcactggaatttcaaaaaaaatatttgggaacaagagaatcatcctttcaacttgcagtacggcgcccagcaaaccgcttgcaataagctgtactctcagaaggggaacctgttcaccgatcagcagaaatgtttgtccgacgagtcagagggactcacctgtgaatcttcgaaggatgagacattttggcgcgaacttccttccgtacccagcctggatctgttccgtgcgtccgacagcaacgccaaccaaaaggaatttaacagcttgtatttttatcagagagccggaaaatcactcggtcaaaaaaggcaccatgaaagtagctttaactcaggggataaggaatcactcaccggtttcatgtgctcccaactgccacagttcaagaagcggaggttagcctacgagaaagttcctggcagagtggacgggcagacacgtcttcgtttcttctag

SEQ ID NO: 28523 - DNA, 3177 bp, Artificial Sequence
  Description of Artificial Sequence: Synthetic coding sequence
atgattatttgcttgttgatgacactcaagctgagatatttacccacaaaagtactgcagttggagagttgccttgagcataaatcacacagctcacccattgccctgattgacgagaaaagtacaaacgcacatcttagcctgccgcagaagtcaccgagcctggcgaaagaggtgcctgatctgtgcttctcagacgattatttcagcgataagggagccgcaaaggaagaaaagcccaaaaacgatcaggagcctgtcaacaggatcatccagaaaaaagaaaacaatgaccactttgagctagattgcaccggaccctcaatcaaaagcccctcatcgtccatcatcaaaaaggccagttttgagcacggaaagaaacaggagaatgacctagacctgctctcagacttcatcatgttgcgcaacaagtacaaaacgtgtacctctaagacagaggtaactaactctgacgaaaagcacgacaaagaagcatgcagcttaacgctccaagaggagtctccaattgttcacatcaataagacactagaggaaatcaatcaggagcgcgggaccgattccgtcattgagattcaggccagcgatagtcagtgtcaggctttttgcctgctggaagccgctgccagtcctattctgaaaaacctagtctctctgtgcacattgcccaccgccaactggaaattcgccactgttattttcgaccaaaccagattcctcctgaaagaacaggagaaggttgtgtccgatgctgtccgacagggcaccattgacgagcgggagatgacatttaagcacgccgcacttttgcacctgctggtgactatcagagacgtgttgctgacctgctccctggacacagccttgggttatctatctaaagcaaaggacatctataactcgatcctgggaccatatctaggggatatctggaggcagctggaaatcgtgcagttcattaggggcaagaaacctgagacaaattacaaaatccaggaactgcagtgtcagattctgtcctggatgcaatctcaacagcagattaaagttctaattataatccgcatggacagcgacggtgaaaaacacttcttgatcaaaattctgaataagatcgaggggctgaccttaaccgtactgcacagtaatgagaggaaagacttcctcgagtctgagggggtccttcgtggaacatcttcgtgcgtcgtggttcacaaccagtacatcggggccgatttcccgtggagcaacttctcctttgttgttgagtataattatgtagaagactcgtgttggacaaagcattgcaaagaacttaatatcccctacatggcgttcaaggtgattctaccggataccgttctggagaggagcactctgctcgaccgttttgggggcttcctcctcgagatccagataccttacgtgtttttcgcatctgaaggcctgttgaacaccccagacattctgcaactccttgagagcaactacaatatatcattggtggaaagaggatgtagcgaaagtctgaagctgttcgggtcaagcgagtgttatgtggttgtcaccatcgacgagcacactgctatcatcctgcaggacttggaggagcttaactatgagaaagcttctgataatataatcatgcgattaatggctctcagtctgcaatacaggtattgttggatcatcttatacactaaagagacgctgaactccgagtacctgttaaccgagaagaccctgcatcatctggccttaatttacgctgctttggtgtcatttggcttaaattcggaagaactggatgtgaaactgattattgcgccgggcgtcgaagccacagcgctgattattcgccagatcgctgaccacagtttgatgacaagtaagcgggatccccacgaatggctagacaaaagctggctgaaagtgagtccctctgaggaagagatgtacctcttggactttccatgtatcaaccccctcgtggcccaactaatgctcaataaaggcccctctttgcactggattcttttggcgacgctatgccagctgcaggaacttctgcccgaggtgcccgagaaggtcctcaaacatttttgttcaatcacaagtctgtttaagatcggaagttctagtatcaccaaatctccacagatttccagcccgcaagagaacagaaatcaaatctccactcttagcagccagtcctcagccagcgatttggattcagtcattcaggaacacaacgaatactaccagtatctggggttgggagagacagtgcaagaagacaagacaacaatactgaatgacaattcaagcattatggaactgaaagaaattagctctttcctcccacctgtcacctcttacaaccagaccagctattggaaggatagctcctgtaaatctaatatcggccagaacaccccttttctcatcaacatcgagtcaagacgtcccgcatacaatagcttcctgaaccacagcgattcggagtccgatgtgtttagcctgggcctgacccaaatgaattgtgagaccattaaatcaccgaccgacacacagaagagggtgagcgtcgtacctcgcttcatcaacagccagaaacgtcgcacccacgaagcgaagggtttcattaacaaggacgtttcagatcccatattttcgttggagggaacgcagagtccgctccactggaatttcaagaagaacatatgggaacaggaaaaccatccttttaacttacagtatggggctcaacagacggcctgcaacaagttgtattctcagaaagggaacctgtttacagaccaacagaaatgtctaagcgatgagagtgaaggtttgacatgtgagtctagcaaggatgaaacattctggcgggaactaccgtccgtcccatccttggacttgtttcgagcttcagatagcaacgccaatcagaaagaatttaatagcctctacttttaccaacgggctggaaagagcctgggccagaaacgacaccacgaatcaagctttaacagcggagacaaggagtccctcaccggcttcatgtgctcccagctgcctcaattcaagaaacgcagacttgcttacgaaaaagttccgggaagagtcgacggacagaccaggctgcggtttttttag

SEQ ID NO: 28524 - DNA, 4218 bp, Artificial Sequence
  Description of Artificial Sequence: Synthetic coding sequence
atgtccgaaactttaggagacgagcttgagattctgcgagggaaaatgatgcagcgtaggcctcgatccgccgaggtgaaatatttctatttcttcaagatcctactgcgcctgaggctcgccattctgaagtatcttttcattgatgataagggaatcctcttcgtctcatctagaaaacatctgcccacacttccgacactgctgtcccgcctgaaattgtttctggtgaaagacccacttctggacttcaaaggacaaatttttactgaggccaacttctctagggaatgtttctctcttcaagaaaccttggaagcatttgttaaagaggacttttgtatggacaaggtaaacttctgtcaagaaaagctagaggatactatttgcctgaacgaacccagcagctttcttatcgaatatgagttcctaatcccccccagtctcaaacctgaaatcgatatcccctcactgtcagagctcaaggagctgctaaatcctgttcccgagataataaattacgtcgatgaaaaggagaagctttttgaacgtgacttgacaaacaagcacggtatcgaagatatcggcgacatcaagttcagctcgactgagatactgaccatacaaagccaatccgagcccgaggagtgtagtaagcccggtgagctagagatgcctctcaccccgctttttcttacctgccaacattcctctgtaaacagtctgcgcactgagctgcagacctttcctctcagccccgtctgcaagataaacctactgacagccgaggagagcgctaatgagtactacatgatgtggcaactcgaacgctgccgctcgccgctcaatcccttcttgctcaccgtccccagaattcaggagccgcactcccagtacagtgttacagatctcaagaagattttctccgtcaaggaggagagcctggttatcaatctcgaaaaggctgagtggtggaaacaggccgggttaaacctcaaaatgatggaaactctcgaacatctgaatacatatctgtgtcatgataacctgtcatcgaatgatacgaagatcgaaattttccttcccacgaaggtgctgcagttggagagttgcctggagcacaaatcccattccagcccaattgcactgatcgatgagaagtcaacaaatgcccatctcagcttgccacagaagtcaccatctctggcgaaagaggtcccagatctctgcttttccgacgactatttttctgataagggtgccgccaaggaggagaaacccaaaaacgaccaagagcccgtcaaccgaattattcagaagaaagaaaacaacgaccacttcgaactggactgtaccggaccttcaataaagtcgccctcaagctcaatcataaaaaaagcttcatttgagcacggtaaaaaacaggaaaatgacctggatttgctcagcgatttcataatgcttcgcaataaatacaaaacatgcacgtccaagacggaagtgactaactcagatgagaaacatgataaggaagcctgcagcctcaccctgcaggaagagagccctatagtccatatcaacaaaactttagaagagattaaccaggaaagggggactgacagcgtgattgagatccaagcctcagacagccagtgccaggctttctgcctcctggaggccgcggctagccctattttaaaaaatcttgtgtcgctgtgtaccctgcctacggcgaattggaagttcgcaactgtcatctttgatcagaccaggttcctgctgaaggaacaggagaaggttgtatctgacgccgttcggcagggcaccattgatgagcgcgaaatgaccttcaagcacgctgcgctcctgcatcttctggtgactatccgggacgttctcctgacctgttccctcgatactgcccttggctacctgagtaaagctaaagatatttataactccattctaggcccctatctgggagacatctggcggcagctcgaaatcgtgcaattcatcaggggcaaaaaaccagagaccaattataaaatccaagaactacagtgccagattttgagttggatgcagagtcagcagcaaatcaaggttctgatcataatcagaatggactccgatggcgaaaagcacttcttgataaagatcctgaataagatagaaggcctgacattgaccgtgctgcacagtaatgaaagaaaggatttcctggagtctgaaggagtgttgcgggggacctctagctgtgtggtcgtgcacaaccagtatatcggagccgacttcccctggtccaacttttcattcgtggtggagtacaactacgtggaagactcatgttggaccaaacactgcaaagaactgaatatcccatacatggcctttaaggtaattctgccggatacagtgttagaacgcagtacgctgcttgaccgatttggtggctttcttctcgagatacagatcccctacgtcttcttcgcctctgaggggctgttaaataccccagatattctgcaactactggaaagtaactacaatatctcacttgtcgaaagagggtgcagcgagtccctcaagctgtttgggtcttccgaatgttatgtggtagttacaatcgatgaacacactgctatcatccttcaggatttggaagagctgaattacgaaaaggcctctgataacattattatgcgcctaatggccctgagcctgcagtacaggtattgttggattatcctctatactaaggagaccctaaacagtgaatatctgctcactgagaagacccttcatcatctagccctcatttacgcagcccttgtgtctttcggcctgaattcagaggaactcgatgtgaagctgattatcgcacccggggtcgaggcgacagctctgatcattagacaaattgccgatcatagtttgatgaccagcaagcgtgacccgcacgagtggctggacaaatcgtggctgaaggtgtccccaagtgaggaagagatgtacttgcttgactttccgtgtatcaatccgctggttgctcagcttatgctcaacaagggcccctccctgcattggatcctgctggccaccctttgccagctgcaggagcttctccccgaagtgcccgagaaggtcctcaagcatttttgttccatcaccagtcttttcaagatcgggagttctagcatcacaaagtcccctcagattagcagccctcaggaaaataggaatcagataagcaccctgtctagccagagctcagcctcagacctggatagcgtgatccaggaacacaatgagtactaccaatacctgggattgggggagacagtgcaagaggacaaaaccacaattctgaatgataatagttctattatggaattgaaggaaatctcttcctttctaccacctgtgaccagttataaccagacatcctattggaaagacagctcctgtaagagcaatatagggcaaaacacaccctttctcattaatattgaaagtcggcggccagcttacaactcctttctgaaccatagcgactctgaatctgatgtcttctccctgggacttactcagatgaattgcgaaacgatcaagtctccgacagacactcagaagagagtctccgtggtaccacgcttcattaacagtcagaagaggcggacgcacgaggccaagggctttataaacaaggacgtgtctgatcccattttcagtctcgagggaacacagtctcccctgcattggaacttcaagaaaaatatttgggagcaggaaaatcatcccttcaaccttcagtacggagcacaacagacagcgtgtaacaagctgtacagccagaagggcaacctgttcactgaccaacagaaatgtctctctgacgaatcggaaggcctgacatgtgagagctcgaaggacgaaactttctggcgggaattgcccagtgtgccgagcttagatttattccgggcttctgactccaatgccaaccagaaagagttcaatagcctttacttttatcagagggccggtaaaagtctcggtcagaagcggcaccacgagagctcctttaattccggcgataaggagtccctcacgggattcatgtgttctcagctgccccaattcaagaaacgacgattagcgtatgaaaaggttcctggcagagttgatgggcagacccgactgaggttcttctag

SEQ ID NO: 28525 - DNA, 474 bp, Artificial Sequence
  Description of Artificial Sequence: Synthetic coding sequence
atgtcaagtcagaaaggcaatgtggcacgctcaagaccccagaagcatcagaacaccttttcctttaagaacgacaagttcgataaatccgtgcagacaaagaagataaatgccaagttgcacgatggcgtctgccagagatgcaaggaagttctggagtggagggtgaagtactccaaatacaagcccctgtcaaaacccaagaagtgcgtgaaatgtcttcagaagacagttaaagattcatatcacattatgtgccgcccttgtgcttgtgagctggaagtgtgtgccaaatgtggaaagaaagaagacattgtcataccactgaacaaggaaactgaaaaaattgagcatactgagaacaacctcagttcaaatcaccgccgcagctgtcgccgcaatgaggagtcagacgatgatttagactttgatatcgacttagaagacactggtggggaccaccaaatgaattag

SEQ ID NO: 28526 - DNA, 108 bp, Artificial Sequence
  Description of Artificial Sequence: Synthetic coding sequence
atgtcaagccagaagggcaacgtggctagaagccggccacagaagcaccagaacaccttcagcttcaaaaatgataagttcgacaagtctgtacagactaaatgttag

SEQ ID NO: 28527 - DNA, 540 bp, Artificial Sequence
  Description of Artificial Sequence: Synthetic coding sequence
atgtcctcacagaaaggcaacgtcgccagatcacggccgcagaagcatcagaacacattttctttcaagaacgacaagtttgacaagagcgttcagactaaaaagattaacgctaaattacatgatggcgtttgtcagcggtgtaaggaggttcttgaatggagggtgaagtacagcaaatacaagccgttgagcaagcctaagaagtgcgttaagtgcctgcaaaaaacggtgaaggatagctatcatatcatgtgtagaccttgcgcgtgtgaattagaagtctgcgctaagtgtgggaaaaaggaggacattgtcattccttggagtttgccactgctgccaagattggaatgctcgggccgcattttggcacaccacaatctaaggctcccctgtagttccgactctcccgcttccgcatctagggtggcaggcaccacgggagcccaccatcacgcccaactgatcttcgtgtttctggtcgagatggggttccactatgtggggcaggccggacttgagctgctgacaagttag

SEQ ID NO: 28528 - DNA, 507 bp, Artificial Sequence
  Description of Artificial Sequence: Synthetic coding sequence
atgaacgaggttaaagagagtctgagatctatcgagcaaaagtacaaacttttccagcagcagcagcttacctttactgcagccctggaacactgccgtgaaaatgctcatgataagattagacctatcagtagcatcggtcaggtacagtcatatatggaacactactgtaattcttcaacggacagacgcgtcctccttatgtttctggacatctgtagtgagttaaacaaactgtgccagcatttcgaagctgtgcacagtgggacacctgtgacaaataacctgctggaaaagtgcaaaacactcgtcagccaatctaacgatctgagctccctccgggccaaatatccccatgacgtggtcaaccatctctcatgcgacgaggccagaaatcactatggaggtgttgtgagcctcatacctcttatattggatctcatgaaggagtggatagcccacagtgagaaattgcccagaaaggtgctacagcacggaacaacctag

SEQ ID NO: 28529 - DNA, 669 bp, Artificial Sequence
  Description of Artificial Sequence: Synthetic coding sequence
atgaacgaagttaaggaaagtctcagatctattgagcagaaatataagttgttccaacagcagcagcttacctttaccgcagcgctcgagcactgcagagaaaacgcacacgataagatccggcccatcagctcaatcgggcaggttcagtcatacatggaacattattgtaacagtagcactgacaggcgcgtcctgctgatgtttctagatatctgttccgagctgaataagctgtgccagcactttgaggcggttcactcaggcacaccagtcacaaacaatcttcttgagaagtgtaagaccctagtctcccagagtaatgacctgagctccctgagggccaagtatcctcacgacgttgtgaaccacctgagctgcgatgaggctcgcaatcattatggaggcgtcgtgtcactgatcccattaatcctagacctcatgaaagaatggatcgcacacagcgagaaactgccaaggaaggtcctccagcacgtctccgaaccacaggcacatcaagagtccacccgcggcgccgctaggcccgcacaggccatcggcacccagccccgcgcgaccaaacacaagtgccgccaactaaccaaagccagtctaaaacctcgtgggtgttctaaacctccttggcggcctcctggaggaaaattgtag

SEQ ID NO: 28530 - DNA, 669 bp, Artificial Sequence
  Description of Artificial Sequence: Synthetic coding sequence
atgaatgaagtgaaggagagcttacgctccattgaacagaagtataagctttttcaacagcagcagctgactttcaccgccgcactggaacactgcagggaaaatgcccacgataagatcagacctatcagttccattggccaggttcagtcctacatggagcattactgtaacagctctacagacagacgcgtgcttctgatgtttctagacatttgtagtgagttgaacaagctctgccagcacttcgaggctgtccactccggcactcctgtcaccaataatctgctggagaaatgcaagacccttgtgtcccagtcgaatgacctgtcttctctgagggctaaatacccccacgacgtggtcaaccatctcagctgtgacgaagcgcggaatcactatggaggcgttgtgtctctgataccactgatcctggatctgatgaaagagtggatcgcccactccgaaaagctccccaggaaggtccttcagcacgtttctgaaccacaagcacaccaagaatctaccaggggtgccgccaggcccgctcaggccatcggcactcagcctcgggccacgaagcataagtgtcggcagctgactaaagcctcactgaagccgcgcggctgttcaaaacctccatggcgtccaccgggggggaaactgtag

SEQ ID NO: 28531 - DNA, 234 bp, Artificial Sequence
  Description of Artificial Sequence: Synthetic coding sequence
atggcgagatttcaacggactaaggagcgggaagaagaccgctgtagcttaaatatctattatgttagaaatacgactcagggcaccgccccagcctgtgtgggcaaaagaatgcagccttccccaaccgggaaaggagggaagtgctgtactgtgcatggcctaacacgcaaaatccacaatgtccagccaaatttgcagagcccaatactatcagcagcctgcgtggactag

SEQ ID NO: 28532 - DNA, 327 bp, Artificial Sequence
  Description of Artificial Sequence: Synthetic coding sequence
atggaactcaacactaacataaagtctaagaagggcctgggccggcggaacctgaaacctatgaatggcgcctggccccccgcccggagggagatggcccggtttcagcgtaccaaggaacgggaggaagataggtgctctcttaatatctactacgtgcgcaacactacacagggcaccgcgccagcctgtgtcggtaagagaatgcagcctagtcccaccgggaagggcggcaagtgctgtacagtgcacggactgacacggaagatccacaacgtgcagcctaacctgcagagtcctatcctgtccgcagcctgtgttgattag

SEQ ID NO: 28533 - DNA, 234 bp, Artificial Sequence
  Description of Artificial Sequence: Synthetic coding sequence
atggccaggtttcaacgaaccaaggagcgcgaggaagaccgttgtagcctgaacatctactacgtacggaacactacacagggcactgcgccagcatgcgtaggcaagaggatgcagccatctccaaccggcaagggcggtaaatgctgtacggtgcacggcctaacacgtaaaatccacaatgtgcaacccaatctccagagccctatcctgtcagcagcctgcgtagattag

SEQ ID NO: 28534 - DNA, 225 bp, Artificial Sequence
  Description of Artificial Sequence: Synthetic coding sequence
taaaatggtgcctggccaccagcgaggagggagatggcccgattccaaaggactaaggagcgcgaggaggacagatgctctctcaacatttattatgtaagaaatacgacccagggaacagctcccgcttgcagtcaggggcgatatatcatgtactcccggatttacagcctgctgttctgccagctgctcgtgctcattaaaacctctattaagatactttag

SEQ ID NO: 28535 - DNA, 3690 bp, Artificial Sequence
  Description of Artificial Sequence: Synthetic coding sequence
atgaatctaaatacatctagcaacacaggtgacacacagagactaaaaatcgcctctctagacgtcaagcagatcctgaagaatgagaccgagctggacattacagataacttgcgcaaaaaactacattgggctaaaaaggagaaactggaaattaccacaaaacataacgccgagctggcttcatatgagagccagattgctaagctgcggtcagaagtggagaaaggggaagccttacgccagagcttggaatacgacctggccgtagcaaggaaggaagcgggtctcgggcgtagagcagctgaggagagactcgccgaagcccacagaatccaggaaaaactgtgcgctcagaactctgagctgcaggccaagaccaatgagaccgagaaggccttccaaacaagccagcagaagtggaaagaagaatgcagacggtttgaacacgacctggaagaacgagataacatgatccagaattgcaatagggaatacgatttactgatgaaagagaagagtaggctggaaaagacactgcaggaggccttagagaaacaccaacgtgagaagaatgagatggaatcgcacattcgtgaaaccgcacttgaagaatttcggctgcaggaagaacagtgggaggcggagaggcgagaactgcagttcattgtccaagagcaggatacggctgtccagaatatgcataaaaaagttgaaaagctggaaactgagcatatggactgttcagatttgctgagacggcaaacatccgaactggaattttccacacagcgcgaggaacgactccgaaaagaatttgaagctacaactctgcgcgttagaaaactcgaagagaacatcgaagccgaaagggccgcacacttggagtctaaatttaattccgaaatcattcaactaagaatcagagacttagaaggagccctccaggttgagaaggcctcgcaggcagaagctgtggcagacctggaaatcataaagaatgaatttaaggaggtagaaagtgcatacgaacgggaaaagcataatgcacaggagtcctttgcaaaactgaaccttcttgaaaaggagtacttcagcaaaaacaagaaactcaatgaggatattgaagagcagaaaaaggttatcatcgatctttctaagagattacaatacaatgagaagtcatgcagcgagttgcaagaagagcttgtcatggcaaaaaagcatcaggcctttttagtggagacatgcgaaaataacgtcaaagaactggaaagcatcttggattcctttaccgtgtcggggcaatggacgtccggcatacacaaggacaaggacaagcccccatccttcagcgtagtactagagagactgaggaggacactgacagattatcaaaacaaacttgaggatgccagcaacgaagagaaagcatgcaatgaactggacagcacaaagcagaaaatagattctcataccaagaatataaaggagctgcaggataagttagcagatgtgaacaaggagctgagccacctccatactaagtgcgccgacagagaagccctgatatctacgctgaaagtggagttgcagaatgtactgcattgctgggaaaaggaaaaagcccaggccgcccagagcgagtcagagttacaaaagctctcccaggccttccataaggacgccgaggagaagctgactttcctgcacactctgtatcagcatctcgtggctgggtgtgtgcttataaagcagccagaaggtatgctggataagtttagctggagtgagttgtgcgctgtgcttcaggaaaacgtagatgccttaatcgctgatctcaatcgggcaaacgagaagattcggcatctcgaatacatttgtaagaacaaatccgatacaatgcgagaactccagcaaacacaggaagacacctttaccaaggtggccgaacagatcaaggcgcaagaatcatgttggcataggcaaaagaaagagctggagctccagtattcggaactgtttctggaagtgcaaaagcgggcccaaaagttccaggaaatcgctgagaagaacatggaaaagctcaaccacatagaaaagagccatgagcagctcgtgctcgaaaactcccacttcaaaaagctcctgtcccagactcagagggagcagatgagcctgcttgcggcctgcgccttaatggcaggcgctttgtatcccctgtatagcagatcatgcgccctgtccacacaacgagatttcctgcaggagcaggtgaacacattcgaactgtttaagttggaaatcaggactctcgctcaagccctctctacggtagaagagaaaaagcaggaagaggctaagatgaagaagaagacttttaagggcctcattcgcatttttcgaaaaggcgttatagctgtcctcgcagcaaaccgcttgaagattcttggtcaaagttgcgcctccctgttcacatggatggagtctttcaaggagggcatcggcatgttagtttgtaccggcgagccacaagacaaacacaagttcccaaagcaccaaaaggagcagctgagatgtctgcaggctctttcatggctaacctcatcagatttattggctgcaattatctcttccatggctgaactccaggacgtgatcgggaaagctgatccaaacagcagaatttgtggacacctcttgatcggtgccgcaaaaaatagctttgctaaactgatggacaaaattagccttgttatggaatgtatcccccttcactccagccgctccatcacatacgtcgagaaagactctctggtccagcgtctggcacacgggcttcacaaggtgaataccctggcgctgaagtatgggctgagaggacacgttcccattactaagtctactgcatctcttcagaaacagatactcggatttactcagcggctgcacgcagccgaggtcgagcgacgatcacttaggctggaagtcaccgaattcaaaaggagtgttaacgagatgaaaaaggagttggacaaagcccaaggcctgcagatgcagctgaacgaattcaagcagagcaaactgatcacgcatgagaaattcgagtccgcctgcgaggaactcaataacgctttactgagggaggagcaagcacagatgctcttaaatgagcaggcacagcagctacaagagctaaactataagcttgagcttcacagctccgaggaagccgataaaaaccagactctaggagaggcagtgaagtcgctgagcgaggccaagatggaactgagaaggaaggatcagtcccttcgtcaactgaatcgacaccttacacagctggagcaggataagcgccgcctggaggagaacatacatgatgccgaatccgccctccggatggcagcaaaggataaagagtgtgtggccaaccatatgcgagcagtcgaaaacactttgcacaaagtgcgggatcagatttctctcagctggtctgccgcctccaggaatgacttcaccctccagttgcccaagctgcacctggagaccttcgcaatggaaggacttaagggagggccagaagtagtggcctgtcaagtgcgtgttcagtggtgcgatcactccagccttcaatcccagatgccaggactcaaacaaagctcctgcctctctcttctgtctacctag

SEQ ID NO: 28536 - DNA, 411 bp, Artificial Sequence
  Description of Artificial Sequence: Synthetic coding sequence
atgcgcgctgtggagaacactctccacaaggtgagggaccagatatccttgtcttggtctgcagccagtcgaaacgattttactctccaacttcccaaactccatctcgaaacattcgctatggaaggcttgaaagggggtcctgaagttgtggcatgccaagcgatgatcaagtcattcatggacgtgtaccagctcgcatccacacggattatgaccctcgagaaggagatgacctcgcataggagtcacatcgctgctctcaagtctgagctgcacaccgcgtgtctgcgggaaaacgcgtcgttgcagtccgatacttttatcatctcttttcggcgagatgggagcccatgctctgatagctccagcattgaatgcgagacctttccccaggtaatactaatgtag

SEQ ID NO: 28537 - DNA, 1497 bp, Artificial Sequence
  Description of Artificial Sequence: Synthetic coding sequence
atggctggagccctgtatccgctctactctcgctcgtgtgctttgtccacacagagagacttcctgcaggaacaggttaatactttcgaactctttaaactagagatccggacccttgcacaggcgctttcaacggttgaagaaaaaaagcaggaagaggctaagatgaaaaagaaaacattcaaggggctcattagaatatttagaaaaggcgtgatcgccgtgttagccgccaacaggctaaaaattctaggacagtcctgcgcctctctgtttacctggatggagtcctttaaggagggcatcggcatgcttgtatgcaccggagaaccacaagataagcacaaatttcctaagcatcaaaaagagcagctgaggtgtctccaggctctgtcctggctgacctctagcgacctcttggccgcaatcatatcttctatggccgagctccaagacgttatcggcaaggcagatcccaatagccggatctgcggtcatctcctgatcggtgcagccaagaacagcttcgccaaactaatggataaaatttccctggtcatggaatgcattccactgcactcttccagatctatcacctatgtggaaaaggattccttggtccagagactagcgcacggcctgcacaaggtgaacaccctcgcactgaagtatgggttgcggggacatgttccaatcacgaagtccacggcgagcctccaaaaacagattctgggatttacacagcgcctgcacgctgccgaggtcgagagacgatctctgcgcctcgaagtgacagaattcaaaaggtcagtgaacgaaatgaagaaggagctggacaaggcacaggggctgcagatgcaactgaatgagttcaaacagtcgaagctgataacacatgagaagtttgagtcagcatgtgaggagctcaacaatgccctactccgagaggagcaggctcagatgcttttaaatgagcaagcccaacagcttcaagaactcaactataaactagagctccatagttctgaagaagctgataagaatcagaccttaggagaagctgtcaagtccctgtctgaggccaaaatggaactgcgtcgcaaggaccagtcattgcgacagcttaacagacaccttactcagctggaacaggataaaaggcgcctggaggaaaatatacatgacgccgaaagcgccctgaggatggcagcaaaggacaaggaatgtgttgccaatcacatgcgcgcagtcgagaatactctgcataaggtgagggatcagatttccctgtcctggagcgccgcatcacgcaatgactttactctgcaattgccgaagctgcacctcgaaacatttgcaatggaggggttgaagggaggaccggaagtagttgcgtgccaggtcagggtgagggtgcagtggtgcgatcacagttcactccagtcgcaaatgcctgggttaaaacagtcatcctgtttgtcactcctgagcacatag

SEQ ID NO: 28538 - DNA, 3981 bp, Artificial Sequence
  Description of Artificial Sequence: Synthetic coding sequence
atgaacttgaatacaagttcaaatacgggcgacacccaaagactgaagattgcctcccttgacgtgaagcagatcttgaagaatgagaccgaattagatataacggacaaccttcgaaaaaagctgcactgggctaagaaagaaaagctggagattaccacaaaacataacgcggaattagcgagctatgagtcccagatcgccaagttaagatccgaggtcgaaaagggagaggccttgagacaaagcctcgaatatgacctggcagttgctcggaaggaagctggactcgggcggagggcagcggaggaaagactggccgaggcacatcgaattcaggaaaaactgtgtgcccagaactcggaactgcaggccaagaccaacgaaaccgagaaagcatttcagactagccaacagaaatggaaggaagaatgtcggaggtttgaacacgatctcgaggagagagataatatgatccaaaattgtaacagagaatacgacctgctgatgaaggaaaaatcacgtctggaaaagacactccaggaagccctggaaaagcatcagcgcgaaaaaaatgagatggagtctcacatcagggagaccgccctggaagaattccgtctccaagaggaacagtgggaagctgaacgacgcgaactccagttcattgtacaggagcaggacaccgcagtgcagaacatgcacaagaaggtagaaaaattggaaacggaacacatggactgtagcgacctgctgagaagacagactagcgagctggaattctccacccagagagaagaacggttacgaaaagaatttgaggccacaaccttacgcgtgaggaaattagaagagaacatcgaagctgagagggctgctcatctggagtccaagttcaattccgaaattatccagctccggattcgtgacctggagggggcactgcaggtcgagaaagcttcccaagccgaggcggttgcggatctggaaataattaagaacgagtttaaggaagtagagagcgcttatgaacgcgagaaacacaatgcccaggaatcgttcgcaaagctaaatttgctcgaaaaagaatacttctccaagaacaagaagcttaacgaagatatcgaagaacaaaaaaaggtaataatcgatcttagcaaaaggctccagtataacgagaagtcatgctccgagctgcaggaagaactcgttatggcaaaaaagcaccaggcatttctggtggagacttgcgaaaacaacgtgaaggaactggaaagtatattagactccttcaccgtgagtggacagtggacatcagggattcataaggataaggacaaaccaccaagcttctccgtggtgctagagaggctgagacggactctgaccgactatcaaaataagctggaggacgccagtaacgaagagaaggcttgtaacgagctggattcaacaaagcaaaaaatcgactcccacactaagaatattaaggagcttcaggacaaacttgctgatgtcaacaaggaactttcccacctgcataccaaatgtgccgaccgggaggcgctgatttcgactttaaaagtcgagctccagaatgtgctgcattgctgggagaaggaaaaagctcaggctgcacagtccgagtccgagctgcaaaaactctcccaggcctttcataaggatgccgaggagaagctgacgttcctgcacacactgtatcagcaccttgtggctggatgtgtgcttataaaacagccagaggggatgttggacaagtttagctggtcagagctgtgtgccgtactccaagaaaatgtagatgctctcatcgccgacttgaatcgggccaacgaaaaaattaggcacctggaatacatatgcaagaataagtcagatacaatgagagaactccagcagacgcaggaggatactttcaccaaagtggcagaacagatcaaagcccaggaatcatgttggcataggcaaaagaaggagctcgaactacaatattctgagctcttcctggaggttcagaaacgggcgcagaagttccaagagatagccgagaaaaatatggagaagctcaatcatatcgagaaaagccatgagcaactggtcctggaaaattcccactttaagaaactcctgagtcagacccagagagagcaaatgagtctgctcgccgcgtgtgctctcatggccggagccctgtaccccctatactccaggagttgcgcactaagtacacagagagattttctccaagagcaggtgaacaccttcgagttgttcaagttagagataaggaccctagcccaagctctcagcaccgtggaggaaaaaaagcaggaagaagcgaagatgaagaagaaaactttcaaaggcctgattaggattttccgcaaaggggtcatcgctgttctcgctgcaaaccggctgaaaatattggggcaatcgtgcgcctcattatttacctggatggagtcctttaaagaaggaatcgggatgttggtgtgcaccggggaaccacaagacaaacacaaattccctaagcatcagaaagagcagctgaggtgtttacaggccctgtcatggctcacttcatcggacctgctggcagctatcattagttccatggcagaacttcaggacgtaatcggaaaggcggacccgaactcaagaatatgcggtcatctgctcatcggagccgcaaaaaattcatttgctaaactgatggacaagatttcactggtgatggagtgtattcctctgcacagttcacgcagcatcacttacgtcgagaaggatagtctggtccagcgacttgctcacggcttgcacaaggtaaatactctcgcgctaaagtacggcctgcggggccacgtgcctattaccaagagtaccgcgtccctgcagaagcaaatcctgggattcacacagagacttcacgcggccgaggtcgagagacggagcttacgattggaggtgacagagttcaaacggagcgtcaatgaaatgaaaaaagagctggataaggctcaaggtctgcagatgcaattgaacgaatttaagcagagcaaactgataactcacgagaaatttgagtctgcctgtgaggagctaaataacgccctgttgcgtgaggagcaggctcaaatgttgctgaatgagcaggcgcagcaactccaagagcttaactacaagctcgaactgcattcttccgaggaagccgataaaaatcagactctaggagaagccgtcaaatcactcagcgaggccaaaatggaactgagaagaaaagaccagagtctgaggcaactaaatagacatctcactcagctcgagcaggacaaaagaaggctggaggagaacattcacgacgctgaatctgcactcagaatggcagctaaggacaaggaatgtgttgcgaaccacatgcgcgctgtcgagaacacgctccacaaggttagggatcagatttctcttagttggtccgcggcctcacggaatgactttacattgcagcttccgaagctgcacctggaaacattcgcaatggagggccttaaaggtggccccgaggtggttgcttgccaggcaatgatcaagtcctttatggacgtctaccaactggctagcacgcggatcatgaccctcgaaaaggagatgaccagccacaggtctcatattgcagcactaaagtctgagctccatactgcttgcctaagggagaacgccagtctgcagagcatcggaagcagagaccactccaatctgagtatcccctcccgcgccccacttccagccgatactacgggtatcggtgattttctacccctcaaggcagaactcgacactacttacacgtttttaaaagagacctttatcaatactgtcccacacgcgttgacttccagccattcaagtcctgtgaccatgtccgctaatgccaaccggccaacacaaatcggactgtag

SEQ ID NO: 28539 - DNA, 774 bp, Artificial Sequence
  Description of Artificial Sequence: Synthetic coding sequence
tgacacaaagtcaatacattggcactgaagtacgggttgaggggacacgttcccattactaagtctactgctagcctgcagaaacagatcttgggctttacccagcggctgcacgcagccgaggtggagcgccgctctctgcggctggaagtgaccgaatttaagcggtcagtgaacgagatgaagaaagagttagataaggctcaaggactgcaaatgcagcttaacgagtttaagcagagcaagctcatcacgcatgaaaagttcgagtccgcatgcgaggaattaaacaacgcgcttctgcgtgaagaacaggctcaaatgctccttaacgagcaagctcagcagctgcaggagttaaactacaagttagagttacattcatctgaggaggccgacaagaaccagacactgggagaagccgtaaaatctctgagtgaagcgaagatggagctacggcggaaggatcagagcctacggcaactcaaccgccatttgactcagctcgagcaagataagaggagactagaggagaacatccacgacgctgaatccgcgctgcgcatggctgctaaagataaggaatgtgtggccaatcacatgagagcggtagagaatacgctgcataaagtgcgggatcagatctccctatcatggagtgctgcttctcgaaatgatttcactttacaattacccaaattacatctggaaacatttgctatggaggggcttaagggcggccctgaagtggtggcttgccaggtacgtgtgtag

SEQ ID NO: 28540 - DNA, 1416 bp, Artificial Sequence
  Description of Artificial Sequence: Synthetic coding sequence
tgatttgagttatttaagctagaaattcgcactcttgcccaggccctgtcgactgtggaggagaagaaacaggaagaggcaaaaatgaagaaaaagacctttaagggtttgatacggatcttccggaaaggcgtcatcgcggtgctggccgcaaaccggctgaagatcctcggtcagtcctgcgccagtctgtttacctggatggaatcttttaaggagggcattggcatgttggtttgtacgggagagccacaggataagcataaattccctaagcatcagaaagagcagctgcgttgtcttcaagctctaagctggctgacatcaagcgacctgcttgccgctatcataagctccatggctgaacttcaggacgtcataggaaaggcagaccccaacagccggatttgtggccacctccttatcggcgccgctaagaactccttcgccaaactcatggacaagatcagcctcgtcatggaatgcataccactacattcttcccgatctattacttacgtcgagaaggacagcctggttcaacgtttggcacatggactgcataaagtgaatacacttgctctgaaatacggactgcgagggcacgtgcccattacaaaatctacagcatccttacagaagcagatccttggcttcacgcagagactgcatgctgccgaagttgagcgaagaagtttaaggttggaggtgaccgagttcaagaggtcggtgaatgagatgaaaaaagagctggacaaggctcagggattacagatgcagctgaatgaattcaagcagtctaaacttatcacccatgaaaagttcgaatcagcctgcgaggagctgaataatgccctcctccgcgaggagcaggctcagatgctcctgaatgaacaggcccaacaactacaggagctgaattataaactggagcttcattctagcgaagaggccgataaaaaccagacccttggtgaggctgttaagtctctgtctgaagcgaaaatggagctccggcgtaaggaccagtctctgcgacagctgaatagacacttgacccagctggagcaggacaagagacgattggaggagaacatccatgatgcagaaagcgcacttcggatggccgccaaagacaaagaatgtgttgccaatcacatgagggctgtggaaaacactttacacaaggtgagagaccagattagcctgtcttggtctgccgcctctcgaaacgactttactctccagttgccgaaattgcacctagaaacatttgcaatggaggggcttaaggggggccctgaggtcgttgcttgtcaggtccgggtccgcgttcagtggtgcgaccattcctcattacagtctcaaatgcccggattgaagcagtcttcgtgcttaagcctcctgtccacatag

SEQ ID NO: 28541 - DNA, 954 bp, Artificial Sequence
  Description of Artificial Sequence: Synthetic coding sequence
atgaatttaaacaccagcagtaataccggagatactcaacgactgaagattgcttctctggatgtgaagcagattctgaagaatgaaaccgaactggacatcaccgacaacctccgtaaaaagctgcattgggccaagaaagagaagctggagataaccactaagcacaacgctgaattggcctcgtacgagagccagatagctaagcttagaagcgaagtcgaaaaaggcgaggccctgcggcagagcctggaatatgacttggcagtcgccaggaaggaggctgggctgggccgtcgagccgccgaagaacggctggcagaggcccacaggatacaggaaaagctctgcgcgcaaaattccgagctccaagccaaaaccaacgaaaccgaaaaagcatttcagaccagccagcagaaatggaaggaagagtgtaggcgctttgagcacgacctggaggagcgagataacatgatccaaaactgcaaccgggagtacgacctccttatgaaagagaagtctcgtttggagaagaccctccaagaagctttagagaaacatcagcgggaaaaaaacgagatggagtctcacatcagagagacagccctggaagagtttcggttgcaggaggagcagtgggaagcagaacgccgggaactccaattcatcgtacaggaacaggacacagccgttcagaacatgcataagaaagtcgagaaattagagacggagcatatggattgttctgatcttttgcggcggcagacgagtgagcttgagttctcaacccagagagaggagaggttacgtaaggaatttgaggccacaaccctaagggtacggaaactggaggaaaacatagaagccgagcgcgcagcccaccttgagagtaaattcaactccgagattatccaagtcaagtgcaagcagatattctggcctgcctttagttag

SEQ ID NO: 28542 - DNA, 600 bp, Artificial Sequence
  Description of Artificial Sequence: Synthetic coding sequence
atgaagacgttcatcataggaatcagtggagttactaatagcggcaagaccacccttgctaagaaccttcagaaacacctgccaaattgctcagtgatcagccaggacgatttctttaaacccgaatcagagatagaaaccgataaaaacggatttttgcagtacgacgttctggaggcgttgaacatggaaaaaatgatgagtgcaatctcatgctggatggagagcgctagacactccgtggtgtctaccgatcaggagtccgcagaagaaatcccaatacttattattgagggatttctcctgtttaattacaaacccttggatactatctggaatcgctcttatttcctgaccattccctacgaggaatgcaagcgacgacggagcactcgcgtgtaccagccccccgactcaccgggctacttcgacggccatgtatggcctatgtatctcaaataccgacaggagatgcaagacattacatgggaagtcgtatacctagacggcactaaatcagaggaagacctctttctgcaagtctacgaggacctgatacaggagctcgctaagcaaaagtgtctacaagtgacggcctag

SEQ ID NO: 28543 - DNA, 558 bp, Artificial Sequence
  Description of Artificial Sequence: Synthetic coding sequence
atgggcaaaaggaggcatcgccgggggaatgtgattagttgtgtcaccaatagcggcaaaactactctggccaaaaacttacaaaaacacttgcccaattgttcagtgatttcccaggacgatttcttcaaacctgaatccgagattgagactgacaagaatggctttttgcagtatgacgtattggaggcccttaatatggagaaaatgatgtccgctattagctgctggatggagagcgcccggcattctgtggtgtccacagaccaggaaagcgctgaagagattcccatcctgattattgaaggatttctgttatttaactataagcctcttgatactatctggaacaggtcctatttcttgaccataccttacgaagaatgcaaaagacggcgcagcacccgggtatatcagccacccgactcgccaggatactttgacggtcacgtgtggcccatgtatttaaaatacagacaggaaatgcaagatattacatgggaggtggtgtacctggacggaactaagagtgaagaggatttgttccttcaagtgtag

SEQ ID NO: 28544 - DNA, 528 bp, Artificial Sequence
  Description of Artificial Sequence: Synthetic coding sequence
atgaaaaccttcatcattggcatctctggtgtgactaactctgggaagactacactggcaaaaaacctgcaaaaacatctgcctaactgctccgtcataagtcaagatgatttctttaaacctgaatccgagattgaaacagataaaaatgggttcctgcagtacgatgtgctagaagctctgaatatggagaagatgatgtctgccatctcatgctggatggagtccgcaagacattctgtggtgagcaccgaccaagagtctgcagaggaaatacctatacttatcatcgaggggtttctactgtttaactataataccagagtttaccaaccccccgactcaccagggtacttcgacggccacgtgtggcctatgtacctgaagtatcgccaggagatgcaagatattacctgggaggttgtgtatctggatggtaccaagagtgaggaagatctatttctgcaggtgtatgaggatctgatacaggagcttgctaaacaaaaatgtctgcaggtaaccgcgtag

SEQ ID NO: 28545 - DNA, 612 bp, Artificial Sequence
  Description of Artificial Sequence: Synthetic coding sequence
atgggcaaacgccgccatagaagggggaatgtcatttcatgtgtgaccaatagtgggaagactacattggctaagaacctgcaaaagcacctgcctaattgcagtgtgataagccaggacgactttttcaagcccgagagcgagattgagaccgacaaaaacggcttcttgcagtatgacgtcctggaggcactcaacatggagaaaatgatgagcgccatatcatgttggatggaatctgctcgccatagcgtggtttcaacagatcaagaaagcgccgaggagatccctatcttgatcatcgaaggcttcctgttgttcaactataagcccctcgacacaatctggaacagatcatattttctcactataccctatgaggagtgcaaaaggcggcgctctacacgcgtgtatcagcccccggacagtccagggtacttcgatggccacgtctggccaatgtacctgaagtaccgccaagagatgcaagatattacctgggaggtggtctatcttgacggcaccaaaagtgaggaagacctgtttttacaggtatatgaggacctgatacaagagctggccaaacaaaaatgcttgcaggtgaccgcatag

SEQ ID NO: 28546 - DNA, 642 bp, Artificial Sequence
  Description of Artificial Sequence: Synthetic coding sequence
atggagttacatgaccgggtcctggatgtgcaactctgcgcttgtagcctgctgcttcacctcttaggccagggtatcattgtcaataaagcccccctggagaaagtgccagacctcatctcccaagtgttggctacatacccagctgacggggagatggccgaggcatcctgcggggtgttctggctgctcagcttactcggctgcattaaggaacaacaatttgagcaggtggtggccctcctactgcagtctatccggttatgccaggaccgggccctgcttgtgaacaacgcataccgcgggctcgcctcgctggtgaaggtcagtgagctcgccgctttcaaggtcgttgtccaagaagagggtggcagtgggctatccctaattaaagaaacctaccagctccatcgcgatgaccctgaagtcgtagagaacgtcggaatgttgttggtccacctagccagttatgaggaaatcctgcctgaactcgtgtcctcatcaatgaaagcgctgcttcaggagatcaaggaacgcttcaccagctctttggtaagcgactcatctgcattctccaaacctggtttacctcctggggggagccctcagctcggttgcactacatccggtggtctggagtag

SEQ ID NO: 28547 - DNA, 2043 bp, Artificial Sequence
  Description of Artificial Sequence: Synthetic coding sequence
atgcttgggccaggcagcaatcggaggcggcccacccagggcgagcgcggacccgggtcgcccggagaaccaatggagaagtatcaggtgctctatcagctgaatccaggggcactgggggtgaatttggtagtggaggaaatggagaccaaagtaaagcacgtgatcaaacaagtagaatgcatggatgatcattatgcctcccaggcattagaggaattaatgccgctcctgaagttgcgccatgcacacatttcggtctaccaggagctatttatcacttggaacggggagatctcaagtttgtacctttgcctggtgatggaattcaacgagctgtccttccaggaagtgatagaagacaaacgcaaagctaaaaagattatcgattcagagtggatgcagaacgtcctgggccaggtcctggatgccctcgagtatctccatcacctggatattatccacaggaacctcaagccgtccaacattattcttattagctccgatcactgtaagttgcaggacctgtccagtaacgtactcatgaccgataaggcaaagtggaatatccgggccgaggaggacccgtttcgcaaatcttggatggcacccgaggccctcaacttttcgtttagtcaaaagagtgatatatggtcattgggctgtatcatcctggacatgacaagttgtagcttcatggatggcaccgaagcaatgcacctcagaaaatccctgagacagtcccctggctcactcaaggcggtcctgaagaccatggaagagaaacagatcccagatgtcgagacatttcggaatctactgcctctcatgctccagatagacccgtccgaccgcatcacgattaaggatgttgtgcacataacctttttgagaggcagctttaaatcttcgtgtgtcagcctgacccttcataggcagatggtaccggcctctatcacagatatgctgcttgaagggaatgtggctagcatcctggaggtgatgcagaagttcagtggttggcccgaagtgcagctgcgcgctatgaagcgcttgcttaagatgcccgctgaccagcttggactgccctggccccccgagctggtggaggtggtagtgaccacgatggagttacacgatcgcgtgctcgatgtgcagctgtgtgcctgctcactgttattacatttgctaggtcaggctctggtgcaccatccagaggcaaaagcgccatgtaatcaagcaatcacgagcacgctgcttagcgcccttcagagtcacccggaagaggagcccctgctggtgatggtgtattcactcttggcaattaccactacacaggagtctgaatccctctctgaagagctgcagaacgcagggctactagaacatatcttagagcatctaaacagtagtctgaaaagccgggatgtatgcgccagtggcctaggattgctctgggcactgctgctggatggaattatcgtgaacaaggcacctctggagaaggtgcctgacttgatctcccaggtgcttgccacctacccagcggacggcgaaatggctgaggcttcttgcggtgtgttctggttgctaagtctgttaggctgtatcaaggagcaacaattcgagcaagtcgtggctctgctcctccagtcgatcagactctgtcaagatagggccttactggtcaacaatgcttacagagggttggccagcctggtcaaggtgtctgagctagcagctttcaaagtggtagtgcaggaagagggaggtagtggcttgagtcttattaaagagacataccagctgcatagggacgacccagaggtcgtcgaaaacgtcgggatgctactagtgcatttagcttcttacgaggagatccttccggagttggtctcatcctccatgaaagcccttctgcaggaaattaaggaaagatttactagttcattggtttccgattcgtcggctttctccaaacccggtttgccccctggaggatcccctcaactgggatgtacaaccagtgggggtctcgaatag

SEQ ID NO: 28548 - DNA, 486 bp, Artificial Sequence
  Description of Artificial Sequence: Synthetic coding sequence
atgctcggacccggtagcaatcgcagacggccgacacaaggcgagagaggccccgggtcccccggcgagcctatggagaagtaccaggtgctttaccagctgaaccccggggcactgggggtgaatctcgtagtcgaggagatggagaccaaggtcaaacacgtgatcaaacaggtggaatgcatggatgatcattatgcctcacaggctttggaggagttaatgcccctcctgaagctccgacatgcccatatcagtgtttatcaagagctcttcatcacttggaacggcgaaatctcttctctgtacctctgtttggttatggagttcaatgagttgtccttccaggaagtgatcgaggataaaaggaaggccaagaaaatcatcgatagcgagattaaaactgaaggggtacctaacacgcggagattccccgtgggcgaccacgactcgagattgttttgcagaagcctgaaattcctgtag

SEQ ID NO: 28549 - DNA, 906 bp, Artificial Sequence
  Description of Artificial Sequence: Synthetic coding sequence
atgctgtctgaaggatatctgagtggtctggagtactggaacgacatacattggagctgcgcctcatataatgaacaagttgctggagagaaggaggaggagacaaattcagtggccactttgtcttatagttcagtggacgagactcaggtccgcagcttgtatgtgtcatgtaagagctcgggaaagtttatatcttcagtgcactctcgtgagtcacagcacagccgcagccagcgtgtcacggtgctccaaacaaaccccaaccccgtctttgaaagtccaaacttagccgccgtagaaatctgccgcgacgctagccgggaaacctatctggtcccatcctcatgtaaaagcatttgcaagaactataacgacctccagatagccggcgggcaagttatggctattaacagcgtaactacagattttccatcggaaagctcattcgaatatggccctctacttaaatcttcggagatcccgctcccaatggaagattccataagcacccagcctagcgactttccccagaaacctatccaaagatattctagttattggcgcattacttcaatcaaagagaagagctccctccagatgcaaaacccaatcagcaatgccgtgctgaatgagtatctggagcagaaagtggttgaactttacaagcagtatatcatggataccgtatttcatgattcttcaccaactcaaatattggccagcgagctcattatgacctccgttgatcaaatctccttgcaggtaagccgcgagaagaacctggagacctccaaggcccgcgatatcgtattttctagactgctgcaactgatgtccacggaaataaccgaaatttctaccccgtcgctgcacatcagccagtactccaatgttaatccttag

SEQ ID NO: 28550 - DNA, 2931 bp, Artificial Sequence
  Description of Artificial Sequence: Synthetic coding sequence
atgaatacccagaagggctcccttacaatcaacgttcacagaggctcgctggccatgtccatccagcgcggatcactcgtgccccgagacatggacagtagtggacgagatatgcagctccgcgtgatccccgctgaagtcaaattcctggatacaatggcagggagagtttatagacttcctattacggttcataacatctgcagatggaatcagaaaatcagattcaaggagcctgtgaaaccccagtttaaattgatgcttacctcgctggacaaggaacttgcgtctggattgcagatgactgctatggttgagtaccatccagacaaggatgaagacacatttgatcggctccttatttctattgagaataaaaccaccgaaatcccattaatcgggctgattccttcctgccagctggagatcgagtctgtcgtcaacttcggtaccctggtcgctaattcaaaagtgtatagtaaagagataaccattactaatcatgggaaggccccaggaatctttaaagcggagtatcacgggcagttgcctatcttaatctttcccacatctgggatcgtggacgccaaatcctcaatggttattaaagtcgacttttgtgctgaccagcctcggattgtggacgaagaggccattgtaatcttacaagggcagccagagatgctgctgagtatcaaagcccacgttgtggaacagatcattgagttgctgagtatgtctagcgatcggaggttagagtgcatccattttgggcccgtcttttttggcagctctaagataaagcatgcgcgcgtctataacaactcacccgagcccattaattgggtagctattatccaggatgacgcggtcggcgaggaactgggtacagacattcaacagcgtaccgatattgccctgaacaacctgacatacataagaaagatcaaaaacatcgataccaccatcattatctcttgtcttccaaacgagggaaccctccagccctaccagaagacggtgatcaccttctgcttcacaccaaagcttatggccgtcggtaagaaggatattggacccagctacagacaagactacgccctcttcctgcggttcgagtccgtgggttctaaggacggatttctgcgcgatgatgattacaaaactattaaatcagagcgcttccaaaaagttgagctcgccctgacaggaacagggctgcccgtgttgctccagtttgatccaggccctgtgttgaactttaagccctgttttatgggagaaaggtccgagatccagtgtattattaagaaccagtgcgaactgttgccagttacctatcattttaagaagaccgcaaacttcgagatcgacccagaaaaggggaagataactggaggaggcatggtagacgtcatgtgtagttttgtaccccatcagctcggagtgttcaaggtaaagcagatgatagaaataatcggactggtggccgaggaggatctccaatccctgagtgtgaagagctttcaccacgtgtatctcgctttcaactcaatctgtaaagcctccacaaaaaaagtggttatgaaatttgatcctggcatcttgcctagcatccgcaatccaacaggaaaatttgtggtgaaagacctcgccaaacggaagaactatgctcctgttgcgatgttgcaaagcgcaatgaccaggacacataatcaccgttcatgcgaggagcccgtgaaagatatgctactagcattccccaatgatcgggccgccacgataaggtctaaggaccatcacaaacatttccgcccaatttttactaaagttccgcgtttcaattacgtcaatcacgattttgcttacactacatttgagaaacagcagaagaaacttcacgaaaattactatgctatgtacctgaagtatctgcggtccgtgaggctccaaaagaaacaggctgagagagaaaggatgtactcttacgacgataccgacatcggcctagagcctggttctggcctgaagagcccatctctgtctgaagcggaaatcgaggaagaactgtctagtgcagcaaattccatccgcgccaaccgcttgctcaccacccgcggcatagcctctcaagaggaagagtctgtgaggcgaaaggtgcttaaagggctcaagtctgaaccaagcactcctcaggaaaagcatgactgctcccttatgctgacccccaaacaaatacaccaggtgatcgtgggaccctcagtgctcaacttcggcaatatttgcgtcaactcacctaatacacacctcttgcatgtgattaacatgctgcccatgcatgttcttttacagttggatactgatctggaggaactccagaagaccaatcaatttagctacgtcattctcccgacaagctctacatacatcagtatggtattcgactcacccaccattggaaagttctggaagagtttcacattcactgtgaataacgttcccagtggccatatcttagtcgtagcggtggtccagcctgtgacattggagctgtccagcaatgaactggtgctacggcctcgaggtttctttatgaaaacctgcttccgcggcacggtgcggttatataaccgccagaactgctgtgcacagttccagtggcagcccgtcaatacaggccggggaatcgcattctcaatctgtcccgcgaaaggaacggtcgaagcatactccagtctggaatgcgaagttacttggcagcaaggcttttcttcaccagaggagggcgagttcatcttacacgtattccagggaaacgcactgaagctcaagtgcgtggcacacgtgatcatttttctggaacatggattttgcttcgaaggatacgagttcgttggctataccctggtgtatatcgtgacttacatttag

SEQ ID NO: 28551 - DNA, 705 bp, Artificial Sequence
  Description of Artificial Sequence: Synthetic coding sequence
tgaagtcaaaaactacctgacgtgaaaccatcaccaatcaatctgagaaaaaaaagtctgaccgtgaaagtagatgtcaagaagaccgtggatacttttcgagttgctagctcctattctactgaacgacagatgtcacatgacctggtggcggtgggtcgcaagagtgagaattttcaccctgtgtttgaacacctcgactcaacccagaacaccgagaataagcctaccggcgagtttgcccaggagatcatcactattatccatcaagtcaaggcaaattactttccctctcccggcatcactctccatgagaggttttcaaccatgcaggacatccataaagcggacgtgaatgaaatccccctaaactccgaccccgaaatacatcgtcggatcgacatgagtctggcggagctacagagtaaacaggccgtcatctatgagtccgaacaaaccctcattaagataatcgatccaaatgatctgaggcatgacatcgagcgtaggcggaaggaaaggctccaaaacgaggatgagcatatcttccatattgcgagcgctgctgagcgtgatgaccagaacagctccttttcaaaaggactggctttgtctccacggctcgaatgcggcgtcaccatcacagcctactgcagtctgtacctgcaggatagctcatatctccccccgcaacctcccgagtag

SEQ ID NO: 28552 - DNA, 1878 bp, Artificial Sequence
  Description of Artificial Sequence: Synthetic coding sequence
atggcaagaagccgctctaggtccccgcggtggaagcatagaagcctcagcccggtgccccgaaacgccgaacattataaacagcggcactcacatggccattacgggtgcgaatataggaaggatcccaaacggccagttgcgtggcggatggattctgagaagcacgggcaatctaagcctcggatcccttcccgggggaacatctattaccagagttacgagcaccgaagtccttccccaaacattaggaacagtctagagaacgtttatatgtacaagcctcataggggttactcgccaggtcggggcgactctaacaggcgagcccagtacatgcccaagtattcagaggggattccatacaaggagcacgagcgaaatagctacccacagaaagtgcagggcggccacagtccagacgaccaccgggtgcgcgggagtgggaagggcggcaagccaccacagaggtccatcgcagacagcttcaggtttgaggggaaatggcacgaggacgagctgaggcaccaaaggatccaggaagagaagtatagccaatccactaggaggggctcagaagattttgaaacccgatccagcttccagaagagataccccgaagatagagacttccgcaagtacggacatacgagcaagaggccaaaggacgtcgaacgctacgagtctcgcgagccggctaggaaccccaaatggaagccagaacacagcctgccaccatatcaggaagacaccgatcagtggaacctgggaccacaaacgtataggcatgcagaacgcgagcaccccgagacgagttccgctacaaaggtatcctacgactaccgccataagaggccgaaattgttggatggggaccaggacttttccgatggacggacccaaaaatattgtaaggaagaggaccggaagtactcatttcagaaaggcccactcaatagagaactggactgttttaatacaggtcgtggcagggaaacccaggatgggcaggtgaaagagccctttaagccgagcaagaaggattcaattgcctgcacgtatagcaataaaaacgacgtggatctcaggtctagcaacgacaagtggaaagagaagatcaagaaagaaggcgattgtcggaaagagagcaactcctcttccaatcagcttgacaagtcccaaaagttgcctgatgtaaaaccatcccccatcaatctccggaagaagtcactgaccgtgaaggtcgacgttaaaaagactgtagatactttcagggtggcctcttcatactccacagaaaggcagatgtctcacgatttagtggccgtgggaagaaaaagcgaaaacttccatcccgtgttcgagcatctcgactccacccaaaatacagagaataagccaaccggggagttcgctcaagaaatcataactatcatccaccaggttaaggcaaattactttccatcaccaggcatcactctgcatgagcgttttagcacaatgcaggacatacataaggcggatgtgaatgagatacccctcaatagcgacccagagattcatcggcgcatcgacatgtctctggccgaactgcagtccaagcaggctgttatctatgagtctgaacaaactctgatcaaaatcattgaccccaatgacctgcgacacgatatagagaggcgcagaaaggagagactccaaaacgaagatgaacatattttccatatcgcgtctgccgcagaaagagatgaccagaactcaagtttcagtaagggtctggcactgagtccacgactcgaatgtggggtcaccattaccgcttattgttccctgtacctgcaagatagctcttatctaccacctcagcctccggaatag

SEQ ID NO: 28553 - DNA, 2049 bp, Artificial Sequence
  Description of Artificial Sequence: Synthetic coding sequence
atggctaggtctaggagtagaagtccccgatggaagcaccgatctctgagccctgtcccgaggaatgctgagcattataaacagagacactctcatggtcattatggctgcgagtacagaaaagacccaaaacggcccgtagcttggcgtatggatagcgagaagcatggccaatccaaaccacgaatcccttccagaggcaatatatattaccaatcgtatgaacatagatcacccagcccaaacatccgcaactcgttggagaatgtttacatgtacaagcctcaccgtggctacagcccaggacggggagattccaaccgccgagctcagtacatgcccaagtattccgaggggattccctacaaggagcacgaacggaattcatacccccagaaagtgcagggaggacactcacccgacgaccacagagtcagggggagcggtaaaggcggcaaacccccccagagatccattgccgacagcttcagattcgaaggtaaatggcacgaggatgagctgcgccatcagcggatacaggaggagaaatatagtcagtcaacccggcggggttccgaggacttcgaaacccgcagtagtttccaaaagcgctatccagaggaccgggatttccgcaagtacggtcatacctccaagagaccaaaagacgtcgagcgatacgaatccagagagcctgcacgaaaccctaagtggaagccagaacattcactgcccccctatcaggaggatacagatcagtggaacctgggtccacagacctatcggcatgctgaacgagaacaccccgaaacctcttctgcaaccaaggtgtcttacgattatagacacaaaaggccgaagctcctcgacggcgatcaggatttcagtgatggcagaacccaaaagtactgcaaggaggaagatcgcaagtactcgtttcagaagggacctctgaatcgggagcttgattgtttcaataccggaagagggcgggagacacaggatgggcaggtgaaagagccatttaaaccttcaaaaaaagactccatcgcctgtacctacagtaacaagaatgatgtcgatttgagatcttccaacgataagtggaaggaaaaaatcaagaaggagggcgactgtagaaaagaatcaaatagctccagcaatcagttagacaagtctcaaaagctccctgacgtaaagcctagtcctattaatctaaggaaaaagtccctgactgttaaagtggacgttaaaaaaactgttgacacatttagagtcgctagctcttactccacagaaaggcagatgtcacatgacctcgtagctgtaggaaggaagtccgaaaacttccacccagtcttcgagcacttagattcgacgcaaaacacggagaacaagccaacgggtgagttcgcgcaggaaataattacaataatccaccaggttaaagcaaattatttcccaagtcctgggataactctacacgagcgttttagcacgatgcaggatattcacaaggccgacgtgaatgaaattcctcttaacagtgatcccgagatccaccggcgtatcgatatgtccctagccgagctccagagtaagcaagccgtgatttatgagagcgagcagaccctgatcaaaattatcgacccaaacgatctgcggcacgacattgagcgaagaagaaaggagagactgcagaatgaagacgagcacatatttcacatagcgtccgctgccgagcgggatgaccagaatagctctttttccaaaaactacaccacccagcgcaaggatattatcacccataagcctttcgaggtagaaggcaaccatcgcaacacccgcgtccgaccttttaagagcaacttccgtggaggtagatgccagccaaactataagagcggcttggtccagaagagtttatacatccaagccaagtaccaaaggctgcggttcaccggacctagaggattcatcacgcacaaatttagagagcgcttgatgcgcaaaaaaaaagaatatacggatgtcgccacaggcatttag

SEQ ID NO: 28554 - DNA, 1467 bp, Artificial Sequence
  Description of Artificial Sequence: Synthetic coding sequence
atgccaaagtattctgaaggcatcccttataaagagcacgagcgaaatagctatccacaaaaggtacagggcggacacagccctgatgaccaccgcgtgcgcggctctggaaaagggggaaagcccccacaacggagcatagccgatagttttcggtttgaaggaaagtggcatgaagatgaactgaggcatcaaagaattcaggaagagaaatactctcagtcaacccggcgtggctccgaggacttcgagaccaggagctcgtttcagaaaagatatcccgaggatcgggacttcaggaagtatgggcacacaagcaaaagacccaaagacgtagaaaggtacgagagccgggagcctgcccgtaaccctaaatggaagcctgaacatagccttcccccttaccaggaagacaccgatcagtggaatcttggcccacaaacatacagacacgcagaaagagaacatcctgaaactagttcggctacgaaggtcagttacgactacaggcacaagcgtcccaaactcctggacggagaccaggatttctcagacggccggacacagaaatattgtaaggaggaggacagaaagtatagcttccaaaaaggaccactgaacagagagctggactgcttcaacacaggcagaggtagagaaacacaggatggtcaggtgaaagaaccatttaaacctagtaagaaagactcaattgcttgtacctactccaacaaaaatgacgtagacttgcggtccagcaatgacaaatggaaggaaaagataaaaaaggaaggggactgcaggaaggagagcaattcttcctccaatcaactcgataagtctcagaagctcccagatgttaagccctcccctattaatctgagaaaaaagagcttgactgtgaaagttgacgtaaagaaaaccgtggatacgttcagagttgctagttcatatagtaccgagcggcagatgtctcacgatttggtggctgtgggacgcaaaagtgagaactttcacccggttttcgaacaccttgattccacccagaatactgaaaataaaccaactggagagttcgcacaggagatcattacaatcatacatcaagtcaaagctaactactttccaagtcctggcataactctgcacgagcgcttctctacgatgcaggatattcataaggctgatgtgaatgaaatccctctgaactccgaccctgagatccacaggaggatagatatgtcattggccgagcttcagagcaagcaagccgtcatttatgagtctgaacaaacgctgataaagattatcgaccctaatgacttgcgccatgacatcgaaaggcggaggaaagagcggctgcagaacgaagacgaacacatatttcacatcgcatccgccgctgagcgggacgatcaaaacagttctttcagtaaggtgaacaccagcaaatgcgctggcatctag

SEQ ID NO: 28555 - DNA, 285 bp, Artificial Sequence
  Description of Artificial Sequence: Synthetic coding sequence
atgggagcactgtttaggctcttgcttcaggaacgcggaaaggctgcagagttctattcccgcggccggaagcagcgcaggcctagcgcttcatgtaccttcggcggcatctggtcttccggggtggacatgcttccaaacggagccgttggaagtctcacccagctaggaccaagcaggcctgtccttggtattgactactccaagaaggaatttagggggactgctgaaaacgtcaccggactgaatacaatcctccacttccggaagcgcactaggtcgtag

SEQ ID NO: 28556 - DNA, 699 bp, Artificial Sequence
  Description of Artificial Sequence: Synthetic coding sequence
atggctgcgacttcaggaaccgatgagccagtaagcggggaactcgtctctgtcgcccacgccttgtctttgccggccgagagctatgggaatgatccagatatcgagatggcctgggccatgagagctatgcagcacgcggaggtctactacaagctgatctcctcagtggacccacaatttctaaagctgaccaaagtagatgaccagatctacagtgaatttagaaaaaacttcgagacactgcggatagatgtgcttgatccagaggaactcaagtctgagtcggcgaaggaacccccagggtacaattctctgccgctaaagctgcttgggactgggaaggcaattactaaactctttattagcgtgtttcgaacgaagaaagagcgcaaagagtctacaatggaggagaagaaggaactgactgttgagaaaaagcgtactccccggatggaggaacgcaaagaactcatcgtggaaaagaaaaaaaggaaagaatccacagaaaagacaaagctcactaaagaagaaaaaaaaggaaaaaagctgaccaagaagtccaccaaggtggtgaaaaagctatgcaaggtgtatcgagagcagcactcaaggtcgtatgactccatcgaaaccacctcgactaccgtgctgctggcccaaacccctctagtaaaatgcaaattcctctacaactag

SEQ ID NO: 28557 - DNA, 702 bp, Artificial Sequence
  Description of Artificial Sequence: Synthetic coding sequence
atggccgccaccagcgggaccgacgagcctgtctccggggagctcgtctccgtggcacatgctctgtcgctgcccgctgaaagctatggaaacgaccccgacattgagatggcctgggccatgagagctatgcaacatgccgaggtctactataaattgattagcagcgtggatccccaattccttaaactgaccaaggtggatgatcagatctactctgaattcagaaagaattttgagacactgcgcattgatgtactggatcccgaagagctaaagtcagaatccgctaaggagaagtggcgacccttttgccttaagtttaatgggatcgtggaagattttaactacggaaccctgctgaggctggactgctcccagggttataccgaggaaaacaccatttttgcccctcgtatccagtttttcgcgattgagatcgcccgtaacagggagggttataacaaggccgtgtacatttccgtccaggacaaggagggggagaagggtgtgaataatggtggagagaagagagcagattcaggtgaagaagagaatacgaaaaacgggggtgagaagggagcggattccggggaggaaaaagaggaagggatcaaccgcgaagataagacagataagggaggtgaaaaaggcaaagaagccgacaaagagatcaacaaatctggggagaaagccatgtag

SEQ ID NO: 28558 - DNA, 354 bp, Artificial Sequence
  Description of Artificial Sequence: Synthetic coding sequence
atgtccgaaaagaaaaactgtaagaattccagcaccaacaataaccagacccaagacccttcaaggaacgaacttcaggtgccccgatcctttgtagatcgtgtagtgcaagatgagagggatgttcagtcccaatcgtctagtacaattaacacattgttaaccttattggattgcctggccgattatattatggagcgcgtaggtcttgaagcaagtaacaatggcagcatgcgaaatacaagccaggatcgggagagggaagtcgacaacaatcgagagccacactcagccgaaagcgacgtgactcgtttcctgtttgatgagatgccaaaatctcggaagaacgactag

SEQ ID NO: 28559 - DNA, 270 bp, Artificial Sequence
  Description of Artificial Sequence: Synthetic coding sequence
atgggggagttagccgcctctgccaaccacgggcattcgccctgctaccctgagcgtaagggaacaccaggagacctcagtaagagaaaaatgctggtccacttctacccccgcaggcactcccatcccagagcaacacagcaatggatcctgaagaacaagacacaggaagggtctcatttacaaactaagcgcagagtgctcagtaggccatggatctgttggcaccccgatcttgggctcccagccagccggactatgcgtaactag

SEQ ID NO: 28560 - DNA, 189 bp, Artificial Sequence
  Description of Artificial Sequence: Synthetic coding sequence
atgggagaactcgccgctagcgccaaccacggtcacagcccctgctacccggagcgtaaaggtactcccggtgatctgagtaagcgcaaaatgctggtccatttttatccccgcaggcacagccacccccgtgcgactcaacagtggatcttgaaaaacaagaccctgtgcaggaggattaaagagtag

SEQ ID NO: 28561 - DNA, 2757 bp, Artificial Sequence
  Description of Artificial Sequence: Synthetic coding sequence
atcctaatagcctccgatggctccgtgcccctgccgctgcagttcttgccccttcagagtggtagatatccctgcaaaatccttctgaaatcccggtatgacgtgcgtgcctactatgtcgagggcatcgtcaatgaggagcaacccgaagccaaatttgaatttgaaactcctgccttcgaggcgttgacacagaatatacccataaagaatcagactaatgataagtggactttccaagtgactattgagggggaatggttttatggcccagtggatctccacgttggtcccgatgagattgtcgaatatcccctgacttttaaaccgatcttcgagtgcgtgattactggaaagctgattttgcagaatgaagtggacggacgggagcatatcttcgacataaagggtgtggggaaaaaaccatcagcacttgaacatataaccgttgagtgccaggtgggaaatgttacccagaaacacatcacccttccacattttactaacactgccctgactttcaaggtgacagccgacctccccatcgtgtggggcaatcctcaaataaccgtatatccgtataaagagattctgtacctgattcacgtgaggccctggaaacgcggcatccttaaagggacaattactttttccaccacacgacgctgtaccacgcgccgcaaacacgacgattatgaggaagacaccgaccaagaccaggccctctcatgcctcgactcgatcaccgagcagtcttctattctcgatgatgccgatacctacgggaactttaacaaccttcggttctggtacaacctcgaaattcacagtacccccggtccgcccatcgaaatcatggagatgacatgcattgcacttgacagcacgtgcattgaaatcccactcagtaaccccaaggatcggggactccatctcgaggtacaacttacaagcgcggccctaaatggcgacaacgaaatcatcctttctcccctgcagtgcaccaagtacattgtgtggtactctcctgccaccaccggctattcagacgagtctatcatttttcagccggagatggccgaagagttctggtacctactgaagcttacgattgaactcccgaagccaacgacaatgcccgaaatacagtgcgatcttgggaagcacgtaacacaaatcattcccctggttaactgcacacacgagacccttaaactccaagtcacaaatagcaacccagaaaactttgttctggacattaaccgtaagtctcaactgatcatatctcctcactctactacagagctgcctgttcttttctacccttcagctttagggcgtgccgatcatcaagcatgcattaatttctactgcacgcagttcaccgagtggaagttctatctatcaggggttggcctgttcccccaacccctcgataccgagagaatcaccacacgcataggcctgcagtcaaccatagtcattcccttcaaaaacccaaccatggaggatgtcctgattgatattatactgactagtgtcgagcatccaagaaacctcgtgatggaccattgctgggattctttcatctacgaatctagtgcttttaggttctccagtcccagcgaaatccagggcattgcgctccccccaaagggtaacattgatatctctctgctgtttatccctcagatcatgaaattgcacaagacgatggtaattatcgaaatgactaaggctaatggcaagtactggcctatagataactttgacgaattggacattaagtttaagtccattgtcggtatcgattctgaagagatccaggccatacactggatataccccatcgtaggactgcctcaggcgccaccgcccaaatcgcctcccgtggtgattcagtgccaaagcaggaaaagggcagaggaaaaggttgaaattatcctcaacgcggggtttttcgggtttagccttacgcccgatctgacagaggtcctggtgatccctaagagaaattcacataatttttgcgaggatccgaacgagattccaaagatccacgaattcgaatatgaaattcagtttgagtccgaggcaatgaagagcaagctggaaagctgtgttgccctctacatgatagagaaaagctacgacattatggcaaagaggatcaccttcatcttcaacttagtgttcacccctaagaaacccctgcgttcccacattacactcaaaatcgaatgtgtcactgagggaatttggaagtttcctatcatgctcattgccactgagcccgatacagacgccgtgattgatatcgagggggtgggcctctttaaagaatcggtgtttgaactgaggctgaagagccagacacggaatccagagccctttacggcacactttcttcccggatctgatctggagttttttgtgaaaccccaggccggagagctgctcccttttaataccaacggcactctcattactgtaggtttcaagcccaaaatgtactgcaggaagtataaggccacgctggttatccaaaccgaagagatgtactggaagtacgagataaacggactgacgccaactaccgtacccccgaagaatgctaaagcaaaaatcgatgccacccacaaaacacacgataacatgcctgtgcgcccccacaacttcgttagagaaaatacaaagttaattagaaccggcgttagctctactatcaaaggcgcaccattggtgaaaaaccagtag

SEQ ID NO: 28562 - DNA, 1902 bp, Artificial Sequence
  Description of Artificial Sequence: Synthetic coding sequence
atggagatgacctgcattgccctggattccacatgcatagaaatccccctttccaaccctaaggacagaggactccacctcgaggtgcaactgacctctgcagctcttaacggagacaacgagattatactatcccctttacagtgcactaagtacattgtgtggtactctcccgcaactacgggatactctgatgaaagtataatattccaaccggagatggccgaggagttctggtacctgctgaaactcactatcgagttgcctaaacccacgactatgccagaaatccagtgcgatttagggaaacatgtcacacaaattatccccctcgtgaattgcacccacgagacccttaaattacaggtgacaaattccaatccagaaaatttcgtccttgacattaatcgcaaaagccaactgattatctctccccactccacaaccgaactgccagtgctgttctaccctagcgctctcgggagggcagatcatcaggcctgcatcaacttttattgtacccagttcactgagtggaagttttatttatccggcgtggggctgttcccccaacccttggatacagaaaggattaccacacgcattggcctgcagtcgaccatcgtgatacccttcaaaaacccaacgatggaggacgtcttgatcgatattattctgaccagcgtggaacacccccgaaatctggtaatggaccactgctgggattccttcatctacgagtcgtcagcatttaggttcagtagcccttcagaaattcaaggaattgcactgccccccaagggcaacattgatattagtctgctgttcatacctcaaataatgaaacttcacaaaacaatggtgattattgaaatgacgaaggcaaatggaaaatactggcctattgataatttcgacgagctggatatcaaattcaaatccatcgtcgggattgattccgaagaaatacaggcgatacactggatctatcctatcgtgggccttccccaggcgcccccgcctaaaagtcctcccgtggtaattcagtgccagtcccggaagcgtgccgaggaaaaagtggaaattattctgaacgcaggatttttcggtttcagcctgacacccgacctaacagaagtcttggtgattcccaagaggaacagccacaacttctgcgaggatcctaatgaaatcccaaaaatccatgaattcgaatacgagattcagttcgagtctgaggcaatgaagagcaagctggagagctgcgttgccctgtacatgatagaaaaatcttacgatatcatggctaaacgcataacctttatttttaaccttgtctttactccgaagaaacctctgcgtagccatattacactcaaaatcgagtgcgtgaccgaagggatctggaagtttcctattatgctcatcgcaacggagcctgacacagacgcagtgattgatattgagggcgtgggcctcttcaaggagtccgtatttgagttgagactcaagtcccagactcggaatcctgagccctttactgctcactttctgcccggcagtgacctggaattttttgtaaagccacaagccggcgagttacttccattcaataccaacgggaccttaatcacagtaggattcaagcctaaaatgtattgcaggaaatacaaagctactctcgtcattcagaccgaagaaatgtattggaaatatgaaatcaacggactgacaccaactacagtccctccaaaaaatgctaaggctaagatagacgccacccacaagacacacgacaacatgcccgttagaccccacaactttgttcgtgagaataccaagctgatcaggacgggcgtgagttccacaatcaaaggtgcccctcttgtgaaaaatcaatag

SEQ ID NO: 28563 - DNA, 543 bp, Artificial Sequence
  Description of Artificial Sequence: Synthetic coding sequence
ctggaaatcccgaagatccatgaatttgagtacgagattcagtttgaatcagaagccatgaaatctaaactggagtcctgcgttgccctgtacatgatagagaaatcatacgacataatggcgaaaaggatcactttcatttttaatctcgttttcacacctaagaagcctctccggtcccatataacgttaaaaatagagtgcgtcactgagggtatttggaagttccctatcatgttgatagctacagaacctgacacggatgcagttattgacatcgagggggttggcctgttcaaggaaagtgtatttgagctgagactgaagagccagacgcggaaccctgaacctttcaccgcgcacttcttgcccgggtcagatctagagttcttcgtgaagccacaagcaggggagctgctgccctttaacacgaatgggacactgatcactgtgggctttaagccaaaaatgtattgtcggaagtataaggccacattagtgattcaggtgtccagcattcgggccatcgccaaagatgtctag

SEQ ID NO: 28564 - DNA, 240 bp, Artificial Sequence
  Description of Artificial Sequence: Synthetic coding sequence
atgtaccgtatgaaacgctcccaggttaggacccccatccggagactgatcagaaatgtgaatctggattgggaggactcaatggccctaggatgtactactgttattgagagaggaaccctgagaagacttaagcgtgctacccttaataccttccttgactcccccgtccacgtcctgctcgtgatgcctaaactgatccccgagcactgggaaaaatgggaggacgtcaaacgctag

SEQ ID NO: 28565 - DNA, 960 bp, Artificial Sequence
  Description of Artificial Sequence: Synthetic coding sequence
atggtgctgtctgaattggccgcccggttgaactgtgcagaatataagaattgggtgaaggctggccattgccttctcctgttaagatcctgtctgcagggttttgtgggcagggaggtgctgtctttccaccgagggctgctcgccgcagcacctgggctggggccgagggctgtttgtaggggaggctcgcgttgcagtcctcgggctcggcagttccagcctcagtgccaagtgtgcgctgagtggaaaagggaaattctacgacaccatgttaataggaacggtgacgtgcactggggtaactgccggccggggaggtggcccgtggacgcttgggaggtggccaaggcattcatgcctcgcggtctggccgacaaacagggcccagaagagtgcgatgctgtggcacttctgtcactcattaatagctgtgaccactttgtggtagaccggaagaaagtcaccgaggtcataaaatgcaggaacgaaatcatgcatagttccgagatgaaagtatcctctacctggctcagagactttcagatgaagatccagaattttttgaatgagttcaagaatattcctgagatcgtggccgtttattcaaggatcgagcagctcctgaccagcgactgggcagtgcacatcccagaggaggaccaacgagatggttgtgagtgtgagatgggaacctaccttagcgagtcccaggtgaacgaaatagagatgcaactcctgaaggagaagttacaggagatatacctccaggccgaagaacaggaagtgctgcctgaggaactgtccaatcggctcgaagtggtaaaggagtttctgaggaacaacgaggaccttcgcaacggtctgacggaggatatgcaaaagttagattctctatgtctacatcagaagctggacagtcaggagccaggtaggcagactcccgaccggaaagcatag

SEQ ID NO: 28566 - DNA, 468 bp, Artificial Sequence
  Description of Artificial Sequence: Synthetic coding sequence
atggtactcagcgaattggcagcaagattgaactgcgccgagtacaagaactgggtgaaagcagggcactgtcttcttctgctccggagctgcctgcaaggattcgtgggccgcgaagtcctcagtttccatagggggctgctggccgccgctcccggtctgggtccgagagcagtgtgccgcggtggttcccgttgcagcccgcgcgctcgccagttccagccacaatgccaggtgtgcgccgaatggaagcgcgagattctcaggcatcacgtgaatcgaaatggagatgtccattgggggaactgtcgcccaggccgttggcctgtcgatgcttgggaggtggccaaaggcctcgatttactctcccgcctagagtgctccggggagtccgaactgatcgcaaccttaaactcctgggcccaggctattctgttaccccaacctctggagtaccttgggctgtag

SEQ ID NO: 28567 - DNA, 603 bp, Artificial Sequence
  Description of Artificial Sequence: Synthetic coding sequence
atgcctagaggtctggcagataaacagggccctgaggagtgtgatgctgtggccctgttgtctctaatcaactcttgtgatcattttgtcgtggatcgcaagaaggtcaccgaggtgatcaaatgccggaatgagattatgcacagttcagaaatgaaggtctcaagtacgtggctccgggatttccaaatgaaaatccaaaattttttaaacgagttcaaaaatattcccgaaatcgttgctgtttactctcgtattgaacagctcttgacttcagactgggcagtacacattcctgaggaagaccagcgagacgggtgtgaatgcgagatgggcacctacttgagcgaatctcaggttaatgaaatcgagatgcagctgctgaaggaaaaattgcaggagatttacttgcaggccgaggagcaggaggtactgcccgaggaactatcgaatcgcttggaagtagtgaaggaatttctcagaaacaatgaagatctgaggaacggtttgaccgaggacatgcaaaagctcgactctctctgtttgcatcagaaactcgactctcaggaacctggacgccaaacccccgatagaaaggcttag

SEQ ID NO: 28568 - DNA, 603 bp, Artificial Sequence
  Description of Artificial Sequence: Synthetic coding sequence
atgccaagaggactggctgataaacaagggccggaagagtgtgatgcggttgcacttctttctctgataaactcatgcgaccacttcgtggtggacagaaaaaaggtcactgaagttatcaagtgccgcaacgagataatgcacagcagcgagatgaaagtctcttctacctggctgagagactttcagatgaagatccagaatttcctgaatgagttcaagaacatccccgagattgtagctgtatatagccggatcgaacagctgctcacaagcgattgggcagtgcatatcccagaggaggaccagagagacgggtgtgaatgcgagatgggaacttatctatctgagtctcaggtcaacgagatcgagatgcagcttctgaaggagaaactccaggaaatttatctccaggctgaagaacaagaagtgctgcctgaagaactctccaataggctcgaggtcgtgaaggagtttctgagaaacaatgaagacttgagaaacggcctgactgaagacatgcagaaactagattcactgtgccttcaccaaaagttagactcacaggagccaggcagacagactcctgacagaaaagcctag

SEQ ID NO: 28569 - DNA, 705 bp, Artificial Sequence
  Description of Artificial Sequence: Synthetic coding sequence
atggtcctttcagaactggccgcccggctcaattgtgccgagtataagaactgggtgaaagctggacactgtcttctgctcctgcgcagttgtctgcaggggtttgtcggcagggaagttttaagcttccatagaggtctgttagccgccgcccctggattaggtccacgggctgtgtgccgcggagggtcacgatgttcccccagagcacggcaggtgatcaaatgtaggaacgaaattatgcacagttccgagatgaaggtgagctctacatggcttagagatttccaaatgaaaattcagaacttcttgaatgagttcaagaacattccagagatcgtagccgtctacagtagaatcgagcagctgcttaccagcgattgggccgtccatattccagaagaggaccaacgagacggatgcgagtgtgagatgggcacgtaccttagcgaatcacaagttaacgaaattgagatgcaactattaaaagaaaaactgcaggagatctatcttcaggctgaggagcaggaggtgttgcctgaggaacttagtaacagactagaggttgttaaggagttcctgcgcaataatgaagacctgcggaatggcctgactgaagacatgcagaagctcgactctctgtgtctgcatcaaaaacttgactcacaggaacccggcaggcagacccccgataggaaggcctag

SEQ ID NO: 28570 - DNA, 477 bp, Artificial Sequence
  Description of Artificial Sequence: Synthetic coding sequence
atgaaattcgggtgcctaagctttaggcagccctacgctgggttcgtcttgaacggtattaaaacagtggaaacccggtggaggcccctcctctcttctcagcgaaactgcaccatcgcggtccacatcgcgcaccgcgattgggaaggggacgcctggcgcgagctgctggttgaacgcctggggatgactcccgcgcagattcagaccctattgaggaagggcgagaagttcggtagaggcgttatcgcaggactcgtcgatatcggtgagactctgcaatgcccggaggacctgacacctgatgaagtggtcgagttggagaatcaagccgtgcttaccaacttgaagcaaaaatacctaactgttatttccaaccctaggtggctgctcgaaccgattcctaggaagggtggcaaggacgtattccaggtggacattccggaacatctgatccctctcggacatgaagtttag

SEQ ID NO: 28571 - DNA, 477 bp, Artificial Sequence
  Description of Artificial Sequence: Synthetic coding sequence
atgaagtttggctgtctgagttttcggcaaccctacgccggatttgtcctcaacggaataaagaccgttgaaacccggtggcgtccactcctgtcatcccaaaggaattgtactatcgccgtgcacattgcccatagggattgggaaggcgatgcctggcgagaactgcttgttgagcgacttggcatgactcccgcccagattcagactcttttgcggaaaggggaaaagttcggacgtggcgtcattgctggattggttgacattggcgaaacattacagtgcccagaagatttgaccccggacgaggttgttgagctcgaaaaccaggccgtgttaacaaacctgaaacagaaatacctgaccgtcatttctaacccgcggtggcttctggagcccatcccacgtaaaggcggcaaagacgtgttccaggtggatatcccagagcacctcattcccctcggccacgaggtctag

SEQ ID NO: 28572 - DNA, 477 bp, Artificial Sequence
  Description of Artificial Sequence: Synthetic coding sequence
atgaagtttggctgtctctcatttcgacagccatacgcgggttttgtgctgaatggcattaagactgtggagacaagatggagaccactgctgtcctcacaaaggaattgtactatcgcggttcacatcgcacaccgggattgggaaggagatgcctggagggagctcctggtcgaaaggctaggtatgacacccgcccagattcagacgctgctccgcaaaggcgaaaagttcggacgtggcgtgattgcagggctggtagatatcggagagactctgcagtgcccagaagacctaacgcctgacgaggtcgtcgagctggagaatcaggctgtcctgacaaacctaaaacagaagtatctgactgtcatatcaaatcctagatggctccttgagcctatacctagaaagggtggaaaagatgtgttccaggtcgacattccggaacatttaatccctttgggccatgaggtttag

SEQ ID NO: 28573 - DNA, 477 bp, Artificial Sequence
  Description of Artificial Sequence: Synthetic coding sequence
atgaaattcggctgtctgagctttcgacagccctacgcaggtttcgtgctcaatggcatcaagaccgtggagaccagatggagacctctgctctctagccagcggaactgtacgattgcagtccatattgcccaccgtgattgggaaggagatgcctggcgggagctactagtggaaaggctgggcatgactcccgctcagatccagacactgttaaggaagggggaaaagtttggtaggggcgtgatcgcaggcctcgtggacatcggcgagacacttcagtgtcctgaggacctgactccagatgaagttgtggagttggagaatcaggcagtactgaccaacctgaaacagaaatacctgaccgtcatttccaatccaaggtggcttctggaacctattcccaggaagggtggtaaggacgtgttccaggtggacataccagaacacctgatcccactggggcatgaggtatag

SEQ ID NO: 28574 - DNA, 93 bp, Artificial Sequence
  Description of Artificial Sequence: Synthetic coding sequence
atgaagttcggatgcttgagctttcgccagccttatgccggcttcgtcctgaatggcataaaaacggtggaaactagatggaggcccctgtag

SEQ ID NO: 28575 - DNA, 477 bp, Artificial Sequence
  Description of Artificial Sequence: Synthetic coding sequence
atgaaattcggttgtctctcatttcgacagccgtacgcagggttcgtactgaatggaatcaaaaccgtggagaccaggtggcggccactgcttagcagccagagaaactgcaccattgccgtccacatcgcgcatcgggactgggaaggggatgcatggagagaactgttagttgagagactcggaatgacacccgcccagattcagactcttctaaggaagggcgaaaagtttggaagaggggtcatcgccgggttagtcgacataggggagaccctgcagtgtccggaggacttgactccagatgaggtcgtcgagctcgagaatcaggcagtcctgactaacctaaaacagaagtacttgactgtcataagcaaccccagatggctcctggagcctatccctcgcaagggaggtaaagatgtgtttcaggtggatatacccgaacacctgatccccctcgggcacgaggtgtag

SEQ ID NO: 28576 - DNA, 477 bp, Artificial Sequence
  Description of Artificial Sequence: Synthetic coding sequence
atgaaatttggctgtttgtcattcagacagccatacgctggtttcgtcttaaatggaataaagaccgtcgagactaggtggcgccccctgctcagtagccagagaaactgtaccatcgctgtgcacattgcccacagggactgggagggcgatgcctggcgggaactccttgtggagaggctgggcatgactcccgcccagattcaaacgcttctgcgcaagggcgagaaatttggtcggggagtcattgcaggtctggtggatatcggagagaccctacagtgtcccgaggatttgactccggatgaggttgttgagctggagaatcaagccgtcctgaccaacctgaagcagaaatacctgaccgttatctccaatccacgctggcttcttgaacccatcccgagaaaggggggcaaagacgtttttcaggtcgacattcccgaacaccttatccctctagggcacgaagtctag

SEQ ID NO: 28577 - DNA, 441 bp, Artificial Sequence
  Description of Artificial Sequence: Synthetic coding sequence
atgaaattcgggtgtctctcattccgccaaccttatgctggattcgtcctgaatggcataaagacggtcgaaactcgctggcggcctcttctcagcagtcaacgcaactgcactatcgccgtccacattgctcatcgcgactgggagggggatgcttggcgcgaactgttggtggagcggttaggcatgactcctgctcagatccagactctgctgcgtaagggggaaaaatttggcagaggggtgattgccgggttagtagatattggcgagacgcttcagtgcccagaagacctcactcctgacgaagtggttgaactggagaatcaggctgtgctgactaatctcaaacagaagtatctcaccgtaatatccaatcctcggtggctcctcgagcccattccccgcaaaggtggcaaagacgtgtttcagaacccgtag

SEQ ID NO: 28578 - DNA, 477 bp, Artificial Sequence
  Description of Artificial Sequence: Synthetic coding sequence
atgaaatttggttgccttagctttcgacagccatacgccggattcgtgctgaatggcattaagacagtggagacaaggtggcgaccgttgctttccagtcagcgtaattgtacgattgctgtgcacattgcccatagggactgggagggggacgcatggcgagagttgcttgtagagagactgggcatgacacctgcgcagatccaggctcttcttagaaagggcgagaagttcggtcgtggggtaattgctggattggtcgatattggagaaaccttacaatgcccagaggacttaaccccagacgaagtggtggaattggaaaaccaggctgtactgactaacttaaaacagaagtatttaactgttatttcaaatcctcgatggctgctggagcccattccgaggaagggcggcaaggatgtgttccaagtggacatcccagaacaccttattccgcttgggcatgaggtctag

SEQ ID NO: 28579 - DNA, 477 bp, Artificial Sequence
  Description of Artificial Sequence: Synthetic coding sequence
atgaaattcggatgtctctcgttcagacagccatacgccggctttgttctcaacggaatcaaaaccgtcgagactaggtggcggccgctcctgtcctctcagagaaattgcaccatagccgtgcatatagcccaccgcgattgggaaggggatgcttggagggagttattggtcgagcgtttgggcatgaccccagcacagatacaggccctcctgagaaaaggcgagaagttcggccgcggcgtcatcgctgggcttgtggatataggtgaaacactgcagtgtcctgaggatttgactccagatgaagtggtggagctggagaaccaagcggtacttactaacctgaagcaaaaatatttaactgtgatctcgaacccacggtggttgctcgaaccaattcctcgcaagggcggaaaggatgtgtttcaggtggacattccggaacaccttatccctttgggccacgaagtctag

SEQ ID NO: 28580 - DNA, 477 bp, Artificial Sequence
  Description of Artificial Sequence: Synthetic coding sequence
atgaagttcggttgcctgtcttttcggcagccatatgccggatttgtgctcaatggcatcaaaactgtggagacacgttggagacccctcctgagctctcagcggaattgcacgatcgccgtccacattgcccatagggactgggagggtgacgcctgtagggagctcctcgtggagcggctgggtatgacccctgcccagattcaggcactccttcgcaagggtgaaaagttcggacgaggcgtaattgctgggctggtcgacataggggaaaccctccagtgcccggaagatctgaccccggatgaggtggtcgagctcgagaatcaggccgccttgacgaatctaaagcagaagtatctaacggtgatctccaacccacggtggcttttagagccaataccgcggaaaggaggtaaagacgtgttccaggtggatattcctgagcacctgatccctctgggccacgaggtgtag

SEQ ID NO: 28581 - DNA, 477 bp, Artificial Sequence
  Description of Artificial Sequence: Synthetic coding sequence
atgaagttcggctgtttatccttccgccaaccctacgccgggtttgtgcttaacggcatcaagacagtggaaacccgctggcgccccctactgtctagccagaggaactgcacaatcgctgtgcacattgctcaccgcgactgggagggggacgcatgtcgagagctccttgtggaacgtctgggtatgacgccagcccaaattcaggccctgctgagaaaaggggaaaaatttggacggggcgttattgccgggctggtcgatataggggagaccctgcagtgtccagaagatctgacacccgatgaagttgtggagctcgagaatcaggcggcgctgacgaacctgaagcagaagtacctgactgtgattagcaatccacgctggttgttggagcccataccacgtaaaggcgggaaggatgtgttccaggtggacattccggagcatctgattcctctcggacacgaggtctag

SEQ ID NO: 28582 - DNA, 477 bp, Artificial Sequence
  Description of Artificial Sequence: Synthetic coding sequence
atgaagtttgggtgcttgagtttccgccagccttatgctggctttgtgctcaacggaattaaaaccgttgaaaccagatggcggcccttgttaagctctcagcgcaattgcactatcgccgtgcacatcgcacatcgtgactgggaaggagacgcttgccgcgagcttctcgttgagcggctcggcatgacacctgcccaaattcaggcactcctccgaaagggggaaaagttcggccggggggtaattgctggcctagtggatataggcgagaccctccagtgccctgaggacttaacacccgatgaagtggtggagttggagaaccaggctgctctgactaacctcaaacaaaaatatctcacagtgatcagcaatcctcgatggctgcttgagcctatcccaagaaaaggaggcaaggacgtcttccaggttgacattccagaacatttgattccgctgggacacgaagtgtag

SEQ ID NO: 28583 - DNA, 441 bp, Artificial Sequence
  Description of Artificial Sequence: Synthetic coding sequence
atgaagtttggatgtttgtccttccggcagccttatgctggcttcgttctaaatgggattaaaacagttgagacccggtggcgccctctgctgtcatctcagaggaactgtaccattgcggtgcacattgcacatcgtgattgggagggtgacgcatgtcgcgagctactggtggagagactaggcatgacccccgctcagatccaggccctgctcaggaagggtgaaaagtttgggagaggcgtgatcgcaggcctggtcgatatcggtgagaccttgcagtgtcctgaggatctcaccccggatgaggttgtcgaattggagaatcaggcagcgctcaccaatttaaagcagaaatatctgacagtgatttctaatccaaggtggctgctagaacccatcccccggaagggcggcaaggacgtgtttcagaacccctag

SEQ ID NO: 28584 - DNA, 477 bp, Artificial Sequence
  Description of Artificial Sequence: Synthetic coding sequence
atgaaatttgggtgcttgagctttcgccagccctacgctggcttcgtcctcaatggaataaagacagtggagacccgttggcgtccactgctttcatcccagcggaactgcactatcgccgtccacatcgcacaccgtgactgggaaggggacgcctgccgggaattgctggtggaaagactggggatgactccagcccaaatccaagctctgttgcggaagggtgagaagtttggaaggggcgttatcgcgggactggttgatataggcgagactctgcagtgtccggaagatctaactccggacgaagtagtcgaactcgagaaccaggccgccttaacaaacctgaagcagaaatatctcacagtgatcagcaatccacgttggctcctcgaacccattccaagaaagggtggtaaagacgtcttccaagtggacatcccggagcacctaatacccctgggacatgaggtgtag

SEQ ID NO: 28585 - DNA, 645 bp, Artificial Sequence
  Description of Artificial Sequence: Synthetic coding sequence
atggagtcagaaaacatggacagcgaaaatatgaaaactgagaacatggagtctcaaaatgtagactttgaatccgtgagctctgtcaccgcactcgaggctctgagcaagctcctgaaccccgaggaggaagacgactccgattatggacagactaatgggcttagcactatcggagccatgggtcctggaaatatcgggccaccgcaaatagaggaactgaaggtgatccccgaaacatccgaagagaacaatgaggacatctggaacagtgaggaaattcccgaaggggccgagtatgacgatatgtgggacgttcgcgaaattcccgaatatgagataatcttcaggcagcaggtagggaccgaggacatcttcttggggctgagtaaaaaggattctagcacaggctgctgctcggaactcgtcgccaaaatcaaactgcctaataccaaccccagcgacatacaaatcgatatccaggaaaccatcctcgatctcagaacaccacagaaaaaattgttaataacactcccagagctagtagagtgcacaagcgctaaggcattctacatacctgaaacggaaaccctggagatcactatgactatgaagagggagctggatattgcgaattttttctag

SEQ ID NO: 28586 - DNA, 645 bp, Artificial Sequence
  Description of Artificial Sequence: Synthetic coding sequence
atggagtcagaaaacatggatagcgagaatatgaagacagagaatatggaaagtcagaatgtcgatttcgaatcggtgtcctctgtcaccgcactggaagccctcagcaagttgctaaacccagaagaggaggacgacagcgactacggccagaccaatggattgagcactattggcgcgatgggaccagggaacatcgggccaccccagattgaagagcttaaggtgataccagaaacctctgaagaaaacaacgaagatatatggaattccgaggagatccccgaaggggcagaatatgacgatatgtgggacgtgcgggaaatcccagaatacgaaatcatctttcggcagcaggtgggcacggaagatatttttttgggcctcagcaaaaaagactcctcaaccggctgctgctctgagcttgtcgctaaaatcaagctccccaacaccaacccatctgacatccagatagatattcaggaaactatactcgacctgcgcaccccgcagaagaagctactgatcactctccccgagctcgtggaatgcacctcagccaaagccttttacatcccggaaacagaaactctcgaaattacgatgaccatgaaacgggagttagatatagctaacttcttctag

SEQ ID NO: 28587 - DNA, 645 bp, Artificial Sequence
  Description of Artificial Sequence: Synthetic coding sequence
atggaatctgagaacatggattcagaaaatatgaagacggaaaacatggaaagccagaatgtcgatttcgaatcagtttcctcagtgacagccctggaagctctatctaagttactcaatcctgaggaggaggatgactctgactacggacagaccaacggcctgagcacgatcggcgccatgggacctggtaacatcgggccgccacaaatcgaggaactaaaagtaatccccgagaccagcgaggaaaataacgaagatatatggaactccgaggaaattccagagggagccgaatacgacgacatgtgggacgtgcgcgagatccctgagtacgagattatcttcagacagcaggtcggcaccgaggatatctttctgggattgtccaagaaggactcgagcacgggttgctgcagtgaactcgtcgccaagattaaactgcctaacaccaacccctcagacatacagatcgacatacaggaaactatactggacctacgcacaccccagaaaaagttgctgattaccttacctgagcttgttgagtgcacaagcgccaaagccttctatatccctgaaactgagaccttggagattactatgaccatgaagcgggagctggacatcgctaatttcttttag

SEQ ID NO: 28588 - DNA, 795 bp, Artificial Sequence
  Description of Artificial Sequence: Synthetic coding sequence
atgctccggttgctaagattagccttggctttttacggacggacagccgacccggccgagcgccaaggaccccagcagcagggattaccacagggtgatacccagctgactaccgtgcagggcgtagtgacaagtttttgtggggactatggtatgatcgatgaaagcatttacttcagttccgatgtcgtgactggtaacgtacccttaaaggtgggccagaaggtgaacgtcgtcgtggaagaggataagccccattacggactaagagctattaaggtggatgttgtgccccggcatctgtatggagcgggtccttcagactccggcacaagggtgctcatcgggtgtgtgaccagcattaacgaagataacatctacatttctaacagtatttactttagcatcgctattgtgtctgaggactttgtgccctacaagggcgatctgttggaggttgaatactctacagagcccggaatttccaacatcaaagccacctccgtcaaacccattcgatgtatccataccgaggaggtttgcatcacatccgtgcacggacggaatggtgttatagattacactatcttcttcacgctggacagcgtgaagcttcctgatggttatgtccctcaagttgatgatattgtgaatgtggtaatggtcgagtcaatacaattctgcttcatttggcgagccatctccattacgcctgtgcacaagtcctctagcggattccaggatgatggaggtcttggcaggcccaagcgggagcgcaggtcgcagtccatctag

SEQ ID NO: 28589 - DNA, 729 bp, Artificial Sequence
  Description of Artificial Sequence: Synthetic coding sequence
atgctccggctgcttcggctggccctggcgttctatggccgcacggcagaccccgctgagagacagggtccacaacaacaaggtctgcctcagggggacactcagttaacaactgttcagggtgtagttacatcattctgcggcgattacggtatgatagacgagtctatttacttcagtagcgatgttgtgacaggcaacgttcccctcaaggtcgggcagaaggttaatgtcgtcgtggaagaggataagccccactatggactcagagcaattaaggtggacgtcgtgcctagacacttgtatggtgcaggccccagcgactcaggtacccgtgtgttaataggctgcgtgacttccatcaacgaagataacatctatatatcgaactctatctacttttctattgccatcgtttctgaggatttcgtgccatacaagggggatctcctggaggtcgagtattctaccgaacctgggatctccaacataaaggccacctccgttaagcctatccgctgtatccacaccgaggaagtctgtatcactagcgttcacggaagaaatggtgttattgactacacaattttcttcaccctagatagcgtgaagctccccgacggatacgtcccacaagtagacgatattgtcaatgtggtgatggtagagtccatccagttttgtttcatctggcgggccattagcatcacaccagttcacaagagctag

SEQ ID NO: 28590 - DNA, 522 bp, Artificial Sequence
  Description of Artificial Sequence: Synthetic coding sequence
atgcgtccacgggaccggtccagagttattgacgcggccaagcatgcccacaaattttgtaacactgaggacgaagaaactatgtacctcagaaggccagaaggcatcgagagacagtatagaaagaaatgcgccaagtgtggcctacctctgttttaccaatcccaaccaaaaaacgcgccagtgacgtttatcgtagacggggctgtagtgaaatttgggcaggggtttggtaagactaatatttacacgcagaagcaggaacctcccaaaaaggtcatgatgaccaaacgtaccaaggacatgggaaagttcagctctgtgacagtgtcaaccatcgacgaggaggaggaggaaatcgaggcccgggaggtagctgacagctatgcacagaatgcaaaggtgatcgaaaagcagctggagcgcaaaggaatgagcaaacggcgcctgcaggagcttgctgaactggaagccaaaaaggcaaaaatgaaagggaccctcatcgataatcaatttaagtag

SEQ ID NO: 28591 - DNA, 669 bp, Artificial Sequence
  Description of Artificial Sequence: Synthetic coding sequence
atgcccaaagtcgtgtctcgcagcgtggtgtgtagcgataccagggacagggaggaatatgatgatggcgagaaaccactgcacgtatactactgtctgtgtggccagatggtactggtgctggattgccagctcgagaagctccctatgagaccccgggacaggtccagggtgatagatgcggccaaacatgctcataagttctgcaacacggaggacgaagaaaccatgtacttgagacgaccggaagggatagaacggcagtatagaaagaagtgcgcgaagtgcggattacctctgttttaccagtcacagccaaagaacgcaccagtgacctttatcgtggacggtgccgttgtgaagttcggccagggcttcgggaagacaaacatttatacacagaaacaggaacccccaaagaaagttatgatgacgaaacgcacaaaggatatgggaaagttttctagtgttaccgtttctaccatcgacgaggaggaggaggagatagaggccagggaggtagctgactcatatgctcagaacgccaaagtgatcgagaagcaactcgagcggaaaggaatgtccaaaaggagacttcaggagctggctgagcttgaggccaaaaaggccaaaatgaagggcacgttgattgacaatcagtttaagtag

SEQ ID NO: 28592 - DNA, 669 bp, Artificial Sequence
  Description of Artificial Sequence: Synthetic coding sequence
atgccaaaagtggtcagccgttcagttgtgtgttccgatactcgggatagggaggagtatgatgatggggagaagccgttgcacgtttactattgcctatgtggccaaatggtgctggtgctagattgccagcttgaaaaactgcctatgcgtccaagagatagaagccgtgtgattgatgctgccaagcatgcacacaaattctgtaatactgaagacgaagaaaccatgtacctgagacgaccagaaggcatcgaacgtcaatatcgtaaaaagtgcgctaagtgcggcctgccccttttctaccagtcacaaccaaaaaatgcacccgtaaccttcatagtagatggcgcagtagtgaagtttgggcaagggttcggtaaaactaacatttatacgcagaaacaggagccaccaaagaaggtgatgatgacaaaaagaacaaaagacatgggtaagttctcgtctgtgacagtgtccaccatcgacgaagaggaggaggagatagaggcgagggaggtggccgacagttacgcccagaacgccaaagtaattgagaaacaactagagcgaaaaggtatgtccaagcggcgacttcaagagctggccgagctcgaagcaaagaaggcaaaaatgaagggcaccttgattgataaccaattcaaatag

SEQ ID NO: 28593 - DNA, 669 bp, Artificial Sequence
  Description of Artificial Sequence: Synthetic coding sequence
atgccaaaggttgtgagtaggtcagtagtgtgtagcgatacgcgggatagagaagagtatgatgacggagaaaagccattgcatgtgtactattgcctctgtggacagatggttctagtattagactgtcaactggaaaaacttccgatgcggccacgggatcgcagccgggtcattgacgctgccaagcacgcacacaagttctgtaatacagaggacgaggaaacaatgtacctgcgaagacccgaaggaatcgaacgccagtacagaaaaaagtgtgctaaatgcggtcttcctctcttttaccaaagccagccgaagaatgcgcccgtgacattcatcgtcgatggggctgtagtgaagttcggccaggggtttgggaagactaacatctacactcagaaacaagagccacccaaaaaggtgatgatgacgaaacggacaaaagacatgggcaagttcagcagtgtgacagtgtctacgatcgacgaggaggaggaggaaatagaagcacgcgaggtcgccgattcctacgcccagaatgcaaaggtgatagagaaacagctggagcggaaaggcatgtcaaagagacgcctacaagagctggctgaactggaggccaaaaaggctaaaatgaaaggcacactcatcgacaaccagttcaagtag

SEQ ID NO: 28594 - DNA, 627 bp, Artificial Sequence
  Description of Artificial Sequence: Synthetic coding sequence
atgcctaaggttgtgtcaagatcagtggtttgtagcgatacacgcgatcgcgaagaatatgacgacggcgaaaagcccctccacgtatattactgtctgtgtggccagatggtgcttgtgttagattgtcagcttgagaagctccctatgcgtccccgcgataggagtcgggtgatagatgctgctaaacacgcccacaaattctgtaacacagaggacgaagaaacaatgtacctgcgtaggtgtgggctcccactcttttatcagagtcagccaaagaatgcccccgtaacgtttattgttgacggtgcagttgtgaaattcggacagggctttggcaagactaacatctacacgcagaagcaggagcctccgaagaaggtcatgatgacgaaaagaacaaaagacatgggtaagttctcaagcgtaacagtttcgacaatagacgaagaggaagaggagatcgaggcccgcgaggtggcagactcctatgcccagaatgctaaggttattgagaagcagctcgagcggaaagggatgtcaaagcgaagacttcaggagttagcagaactcgaagcaaagaaggctaagatgaaaggtacattaattgacaatcaattcaagtag

SEQ ID NO: 28595 - DNA, 2277 bp, Artificial Sequence
  Description of Artificial Sequence: Synthetic coding sequence
atgagcggggagtcaggccagccagaggctggaccgtcccacgcaggtctggattggccaaaccccgaacgaaaccgggcaggggtaccaggcggcgtcatcagaagggctggctcccaaggcccacgcagctggattcaaaaagttttagagcaaattatggacagtcctcgtcagtgtgtgaccccctccgaggtagtaccggtgacagtgctggctgtgcagcgctatctgttggaggatgagccgcgtgacaccgtcccaaagccaccactttactgttacgacgtgacaattagtgatggcgtgtaccaggaaaagtgctacctggaccctagcctgaatagcctcgtgtatcagaacattctcaaagttggtattcagatgagaatatcccgggtgagctgcttatacaatgaaaagaggattggtcagggcatcctgtgcatcgacaatgtccattgtggagagaccagtgacagtatctctctggagacccccttcaggaaccgcgcacaccaggaaaagcccgagagaccactcaggggagggaaaagccactacctggccttgtggaataatgaggatccctatggtgatatctggctcacagataagcagccggaggaacacaacttctcagataccaaaatcatctctctctcccacctggagatgacctggaccaatagacgcaactttccagctttgcttgtccgcatcctgcacaagagtaagctccgttactatggtaaaccggataaaaagatgatcgagccgtaccagacatttcttgaggttgccgactctagtggtaccgtgtctgtcataatgtggaatgctctctgtccggagtggtacaaaagcctaagagtaggtttggttctcctgttacaggactacagcgtaaagaaaagctacccgtttcggattcagcccgtccccgtcgacccacagatcaagttgatctctacgatggaaatatgcctcaatctgagagacccaccaaccaacataattattatcccggagaaacaggtgaagccggagtggagactgcctaaactgaaccacagattcaccacacggagtgaactagacgacatgccagagaattgtatatgcgatgtgataggtcttctggtgtttgtggggagagtacagagatcaaagaagaaggaaaatcgtgaggacttctggtcctatcgctggatccatatagccgacggaacctcggagcagccctttatagtggaactgttttctacttcacagccggagatcttcgagaacatatatccaatggcatatttcgtctgcacccaactgaaggtggttcgcaatgataaccaggtccctaagctgttgtatctgacgactacaaacgagtcgggggtcttcatcactggacacaggggacagccttacacatatgatgcaaagaatgctaataggccttcaacatctcaggccgctcgagtcgaaatacaggaaaggaacggcaaacgtcaccaggacgacgaacccgttaatagtcagtactttcagactactagtaccaacctgtcgctgtctaacaagatccgcatcttacagggcccccacgccaaccccgtggccgtgccgcagcctggggcatccgtccaaactaaggggattaaaccgggcatgccttctattttcaaccggagggccaacatcaatgccaacctccagggaaaggctagaaaaaccatatcagaccggtgggagtcacaactctggcgagagaagaaattcggactcatagaccacctccactattcacgcgtctatcccgagtccataccacggaagtttatgtttgaacaccggaaattcttgtcagatcagtacaattcccaaccagcaaaatacgtgcctcctgaaggtagaccccccaaattggacgatttcaagtctgcgaggagtctcggccattttgaagttacgatcttgggactcaaccatgaaatcgcaattgacgtcgccttccttcccatgtactgccccgaagatataaggacaagccaaatagacaccctgttaacttcaatgaattatagctgcgcctaccctcaggatactacaggaaacgaccggctgccaggtcccagggcggtggccggcgacattatcaaggccgcaaccgaacttgaccgagtgcatattgtgggcatattagacatctgcaacctcggtaacaataaggtcgaggtgtatttgcataagatctactcccccgaaaacacctcctag

SEQ ID NO: 28596 - DNA, 2568 bp, Artificial Sequence
  Description of Artificial Sequence: Synthetic coding sequence
atgagtggcgaaagtggacagcctgaagccggcccatcccatgctggcctggactggccgaatccagagagaaatagggccggggtgcccggaggagtgattagaagggcaggctctcagggacctcgcagttggatacagaaggtcctggaacaaattatggacagccctcgtcagtgtgtcacaccgagcgaagtggtgcctgtcaccgtgctcgccgtgcagagatatctgctggaggacgaaccgcgtgataccgtgcccaagccacctctgtattgctatgatgtgaccattagcgatggagtgtatcaggagaaatgctatcttgatccgtctctgaatagcttggtgtatcagaacattctcaaagtgggtatccagatgagaatctctcgggtgtcatgcctgtacaacgagaagcgaattggccagggtatactgtgtatcgacaacgtccactgcggggagacttcagattccatctcgcttgagacgccctttagaaaccgggctcatcaagaaaaacccgaaaggcctctgaggggaggcaagtcccattacctggcactgtggaacaatgaagacccatatggagacatctggctgaccgacaaacagcccgaggaacataacttcagtgatactaaaatcatcagcctatcgcatttagaaatgacctggacaaataggagaaatttcccagccttgctggtcagaatcctgcataaatcaaagctgcgttactatggcaagcctgataagaaaatgattgagccgtaccagactttcctcgaggtggctgatagttccgggactgtgtctgtgattatgtggaatgcgctgtgccccgaatggtataagtccttgcgggttggacttgtcctgttgcttcaggactactccgtcaagaagtcatatccattcaggattcagcccgtccctgtggatccccagatcaagcttatctcaacaatggagatatgcctcaacttacgagatccacccactaacataattattatacccgaaaaacaagttaagcccgagtggcggttgcctaagttgaatcatagattcacaacaaggtcggagctggacgatatgccggagaattgcatatgtgatgtcattggacttctcgtgttcgtcggacgagttcagcggtccaaaaagaaagaaaaccgagaggacttttggtcttaccgctggatccacattgcggatggaacctctgaacagccattcattgtggagctgttttccacaagtcagcctgaaatctttgagaatatataccctatggcttatttcgtctgtacccagcttaaagtcgtgagaaatgacaaccaggtcccaaaactgttatatctgactaccacaaatgaatcaggcgtgtttatcaccgggcatcgcggccagccttatacatacgacgcaaaagtcaagaattttatccagtggatccgcactaagtctgacagtggcgagcagaagaacatggtgataggaggatactatccttacccacccgttcctgaaacttttagcaaatactcttcgagcattaaagttgagagtctgctaacggcaatttctgaagtgaggaaggaaattgaggatctacagtatcgcgagcagaaacgaatcgctatccaaggcattatcacggctattaagtacatcccccactcaagcgccaccgaatctgcatctgcctccgagaccttacggaacgccaaccgaccatctacgagccaggcggcccgcgttgaaattcaagagcgcaacggaaaaaggcaccaggatgacgaacctgtaaactcccagtactttcagacaacaagtactaacctgagtttgtctaataaaatacgaattctacagggccctcatgcaaatcctgtggcagttccacaaccaggggcgagcgtccagacaaagggtatcaagccagggatgccaagcattttcaatcgcagggcgaacataaatgccaatcttcaaggaaaagctcgaaagactatatcggacagatgggagtctcagttgtggcgggagaagaaattcgggctgatagaccacctacactacagtcgcgtctaccccgaaagtatcccacgcaagttcatgttcgagcaccggaaattcctgtctgaccagtacaactcacaacccgccaagtatgtgcccccagaaggccgtccgcccaaattggacgactttaaatcggctaggtcattgggccacttcgaggtcaccattctgggactgaaccatgagatagccatcgacgttgcctttttgcccatgtactgcccagaggacattcgaacttcacaaatagacaccttgctcacttcgatgaactactcgtgtgcctatccccaagataccaccggaaatgacagattacccggaccacgagctgttgcgggcgacattattaaagccgccactgaacttgaccgcgttcacatagttggaattcttgacatctgtaacctcggaaataacaaggtggaggtatacttgcataagatctattcaccagagaatacatcgtag

SEQ ID NO: 28597 - DNA, 1701 bp, Artificial Sequence
  Description of Artificial Sequence: Synthetic coding sequence
aacaacgaagatccttatggtgatatatggctcactgataagcagcctgaggaacacaacttctccgacacaaagatcatttccctaagccatttggagatgacctggacgaataggaggaatttccctgccttgctcgtacgaatccttcacaaatccaaacttcggtattacggaaaacctgacaagaaaatgatagaaccttatcagacgttcctggaggtggctgactcctccggtacagtgtcagtaatcatgtggaacgctctctgccccgagtggtacaagtccttgagagtggggctcgttctcctattgcaggactactccgtgaaaaaaagctaccccttcagaattcagccggtcccggtcgacccccagattaaattgatctccacaatggagatttgcttgaatttgcgcgacccgccaaccaacataattattatacctgagaagcaggtgaagccagagtggcgcttaccaaaattaaaccaccgatttaccacaagatctgagctagacgacatgccagagaactgtatttgcgacgtgattgggctgctggtcttcgttgggcgcgttcagcgaagcaaaaagaaggaaaaccgcgaggatttttggtcataccgatggatccacatagcggacgggacctccgaacagccttttatagtggaattattctctacatctcagcctgaaatttttgagaatatctatccaatggcttattttgtttgcactcaactcaaggtcgtcagaaacgataaccaagtgcccaagttgctgtaccttacaaccacgaacgagtctggggtgtttattactggtcataggggccaaccctacacatacgacgctaaaaacgctaatcgaccctcaaccagccaggctgcaagagtcgagattcaggaacgcaacggaaaaaggcaccaagacgacgaaccagtgaacagccagtatttccagaccacttccaccaacctgagcttgtccaataaaattcgcattctccagggcccacacgcgaaccctgtggccgttccgcagcccggcgcttccgtgcaaactaaaggcatcaaacccggtatgccatccatctttaacaggagagctaacattaacgccaatctgcagggcaaggctagaaagactatttctgacagatgggagagccaactctggagagagaagaaatttgggctgatagaccacctgcactatagccgcgtgtatcccgagtctatacctagaaaattcatgtttgaacacagaaagttcttgtcagaccagtacaattcccagcccgccaagtacgttcctccagagggccgacccccaaaactggatgattttaaatcggccaggagtcttggacattttgaggtgacaattctcggccttaatcacgagatcgctatcgatgttgccttcttgcccatgtattgtcctgaggatattaggacctcacagatcgatactctgctcacttctatgaattattcttgtgcttatcctcaagataccaccggaaatgacaggctccctggccctcgcgcggtggcaggcgatatcataaaggctgcaactgaacttgatcgtgtgcacattgtcggtattctggacatctgtaatctcggtaataacaaagtagaggtctacctgcataaaatctactcccccgaaaacaccagttag

SEQ ID NO: 28598 - DNA, 999 bp, Artificial Sequence
  Description of Artificial Sequence: Synthetic coding sequence
atgaaccggtcctcaaatgtgccccgtaaagggatactgaagagtggcacacggtctctccaaaaggtgaggagggtgcactttgctaatgcccgcaacgctagatccctgctgagtatgctgaaggacatcagtgcccagatcattcaacgcgcctggctgagccatacaaataaaatgattttccgtctccttaagcatgcaatctgcgccgccgagttttatgtgacgcatgaaattctgaaaaaggtcgcaccgttggaggcaaagctgatcaaggatccaaccatgcagtgcaagatccgcttcagatttaggggggagacctttccgccatttatagtgttcaaaatttttctgcacactgacggccacggttataaatatttctctggaaaaaatgttcttatgccttcctcgaaggccgtggatgatgcctgtaagctgatgggggagcgcaaatttcatagaattatcatggaagacgagcgtattttccctaagtccaaggtgactgacatcatggatgtggtgactatgcaggactatgtgcagtaccggtcattctttgatgaagctccagcattttctggcggcaggaataatagctggagaaagctcaatttggaaaatataccccggacgatgttgatgtatgatatagtccactactccgagagcggagtgatcagcaacaggctgcggaacgaaatgaaatttctactgcagaggcccgtcactcaagaaatacataaacaccagctgcgaatcgtctctgagatacgcgggccctatctcacagtacaacctctgtaccgaccatacaagcaacagaaccaggtgaagtttctgggtagaagatctaagcaggctcagatgaaggtggagaagatgcgaaaagtgtatctggcaaaggaaaagaatacatccgaggtcaccgaacccaagacaggcccttctggcacgaaggataactaccatttgcattctattttctag

SEQ ID NO: 28599 - DNA, 381 bp, Artificial Sequence
  Description of Artificial Sequence: Synthetic coding sequence
taattcgccaacgcgagaaacgctagatcactactgtcgatgctgaaggatattagcgctcagattattcagagggcctggctgagccacactaacaaaatgatatttagactcctgaagcatgccatatgtgcagctgagttctacgtaacccatgaaatcttgaagaaagtggcaccactggaagctaagttgatcaaggatcctacaatgcagtgtaaaatcaggttccgttttaggggagaaactttcccaccattcatcgtgttcaaaatttttctgcatacagatggtcacggatacaagtacttttcgggcaaaaacgtgctgatgccctcttcgaaggttacctttcacgatgtccattttatgctgacttag

SEQ ID NO: 28600 - DNA, 897 bp, Artificial Sequence
  Description of Artificial Sequence: Synthetic coding sequence
atggcatgtatcgaaaacgtactgggaggccatgcaccttccccattagtggtgtccgtggacaaaaatggtaatcaggagctgcaccatgatatgcctctgcagtgtctgagtagcaagcctgaagatgacgctgagccctggggacagccccaggttcctctgcgtccatcagtcaatgttcttaccgacctggatagcaaacagctcgaatggccatctgaacggaccggatcctgtatcccacttcactccctccgggcacatcgccatccatatggcccgccgccggcagtggctgaagagtccctcgcaaccgcggaggtgaattcctcagatgcgctcgccggatggcgacaagaaggtcaggatgctattaacgtttcctgggaagtcagcggaggaccccccgctctgattgtcggaggtactaaggtgaataacggcggtacagagcggggatctaacaacgcacggctccacgtggctctgcctcaggggaagggtttcttccccccacgcggcccacaggtgagggggccatcgcacataccgactctgagatctggtatagttatggaagtgcccccagggaacaccaggattgcttgtagaggcaaactcgctcatgtctcttttcccctgcgcggaccttgccaccccatgcacaattggcctcggcctatccccttgagctcttccacacctggactgccttcctgttccacagtccattgctttattccgccccgtcccccgatttttaacccattcctgacaatgcccctcccattcgctccccccccgatcttcgggccccctttgccatcctattttgcacattttcactccggcggaatgcccgcccctgctagcccgaatagggagcattcctag

SEQ ID NO: 28601 - DNA, 552 bp, Artificial Sequence
  Description of Artificial Sequence: Synthetic coding sequence
atgttcatctttatcaagcacggtgataatcagcagttcctggtgaacacaaattgtgccgtggtcgtgctcctgtattatatcagatcgaaagtcaaactgccaaaaaccaatactattgacctctgcgaacagacaggcaagatgaagatgcttttcttgatgaaacccaaccacgcggagtacgcctctaaatatcttaccgccagaagcacatactacgtatgcaaggtggagcgcggccctcctgggactcgactcgaaaacgcatatagagccttcgtcccactactgaaaaacccagagccttggctgctcgtggccctcagaatccagtgcgatgccctggagagacggcgtatacagatgctcaagatgaaagaggctaagaaggttgtaatcatcgagcctccagcctccgtgccatcaaaacagtccgggagaagcgacaagaagaaatctacccggaaaagcccaacgttccgcaatagaccagactttcgaaagaataaggggagacaattgaataaaacaaccaaacaaaagaagtag

SEQ ID NO: 28602 - DNA, 612 bp, Artificial Sequence
  Description of Artificial Sequence: Synthetic coding sequence
atgttcatcttcatcaaacatggagataaccagcagttccttgtgaatactaattgtgctgttgtggttcttttatattatataagatctaaagtgaagcttccaaagaccaatacgatcgatttatgcgagcagaccggcaagatgaagatgctgtttctgatgaagccaaaccatgccgagtacgccagcaaatatctgaccgcccgcagcacctattacgtatgtaaggtcgaaagagggccgcctgggacaagacttgagaacgcgtaccgtgccttcgtcccgctgctgaagaacccagagccatggctgttggtggccctgagaatccaatgcgacgcccttgagcgtaggagaatccaaatgctcaagatgaaagaggctaaaaaggtggtgataatcgaaccgcccgcttcggtaccagtgcgtctggcaaagtgcgatctgcctcaacacccacccttgccgacctcacggctgaattctaaacagagcggccggtcggataaaaaaaagtccacacggaagagtcccaccttcagaaatcggcctgactttaggaagaacaagggtcgtcagctaaacaaaaccaccaagcaaaagaaatag

SEQ ID NO: 28603 - DNA, 1512 bp, Artificial Sequence
  Description of Artificial Sequence: Synthetic coding sequence
atggccacccagtccgatatggagaaagagcaaaaacatcagcaagatgaaggacaaggcggtctcaacaacgaaacggcccttgcatctggcgatgcatgtggcactggaaaccaggacccagccgcaagcgttacaactgtgagctcacaagcctcgccttcgggcggcgcagctttgagcagttcaaccgccggctcaagcgccgcagctgcaacaagtgccgccatctttattaccgatgaggccagcggccttcccatcatcgcagcagttcttaccgagcgacattccgataggcaagactgccggtccccacatgaagtgtttggatgcgtcgtccccgaaggcggctcacaagctgcagtcgggccacagaaggccacaggtcacgccgacgagcatctggctcagaccaagtctcctggaaattctagaagacgtaaacagccttgccggaaccaggccgctcccgcccaaaagcccccaggcaggcgtctgtttccggagcctcttccccctagcagtcccggcttccgaccatcgagttatccctgttcaggagcctctacttcgagtcaagcaacacagccaggtcctgcattgctctctcatgcctccgaggcccgtccagcgacccgaagccgcatcaccctggttgctagcgccctgcgaagacgcgcttcgggtcctggtcccgtcatccggggctgcaccgcccagccaggaccggccttcccacatagagcgactcatctggatcccgcccgtctatcacctgaaagtgctccaggcccagctaggaggggacgcgccagcgtgccagggcccgctcgacgaggctgtgactcagctcctggaccagcccgcaggggccgtgattccgctccagtttcagctccccgcggtagagactctgcaccgggctctgcacggagaggacgggattcggctcccggacctgcgctcagggttcgaacagcccgttcagacgcaggccaccggtctactagcacaacccccggcacaggattgcgtagccggtccacccaacagcggagcgctctgttgtctaggagatctctgtctggctctgcagatgagaatccgtcttgtggcaccggatcggaacggttggcctttcagtcaaggtcaggctcacccgatccagaggtcccctctagggcttccccaccagtgtggcacgctgtccgcatgagggcttcttccccttctccaccaggccggttcttcctgccaatccctcagcagtgggacgaaagcagctcaagtagctatgcctctaattcaagttcaccttctagatcccctgggctgagcccatcgagtccatccccagaattcctgggcttgcgaagtatttcgactccaagtcctgaaagcctcagatatgctcttatgcccgaattctacgcactgtcccccgtgcctccggaagagcaagcggaaattgagagcacggctcaccctgctaccccccccgagccctag

SEQ ID NO: 28604 - DNA, 252 bp, Artificial Sequence
  Description of Artificial Sequence: Synthetic coding sequence
atggaggccctgggatctggacactatgtaggaggtagtataagaagcatggccgccgctgccctaagcggactcgccgtgagactttccaggccccaaggaacacgcgggtcttacggcgccttctgtaaaactttgacacgcaccttactgactttcttcgacctggcctggcggctacgtaaaaattttttttatttttatatactggctagcgtgatactgaacgtgcatctccaggtatatatctag

SEQ ID NO: 28605 - DNA, 549 bp, Artificial Sequence
  Description of Artificial Sequence: Synthetic coding sequence
atgatgcgtaggtccccttcgggattaaagtccccacgggtcagccaggggcggaagccaagagatccggaaagccttttattcctcagatgctgtttgggatcagaaccgcacaatcttagttcccttctgtcgccagaggctggtcaggagccactaccaaaactgctgccccagccactcgccggccatgccgcatggggaattcacggggttcctacttccttgctgctggctggagagtgttgggggcagggcatggcagtccctgccgacccaccgcctgcttcaccttatcgcacgtctcctcgacccccgcctggcccactcccgagatacagacctcagcaacatttgctcttacccctcggacggctgcacgccctctgtcccggttgtcctctgcagcagagtttgcaattcgagcggggcaccctttctgctcctcggttatggagctggatgaagctggagacaatcattctgagcaaactctcccaaggacagaagactaagcatcgcatgtttagcctgatctccgaatcctag

SEQ ID NO: 28606 - DNA, 549 bp, Artificial Sequence
  Description of Artificial Sequence: Synthetic coding sequence
atgatgaggcgcagcccatcaggtctgaagtccccccgcgtctctcaggggaggaagcccagagaccccgagtccctgttgttcctgcgatgttgtctgggttctgagcctcacaatttgtcatctttgttaagccccgaagctgggcaggagccactccctaagctactgccccagcccttggccggacacgcagcttggggaatacacggcgtgcccacaagcttgcttcttgccggagaatgctgggggcaggggatggcagtgccagcggatccccctcccgcctccccctacagaacaagccctcggcccccccccggacctctcccgaggtaccgtcctcaacagcacctgctattgcctttgggccggcttcacgcgctgtgtcctgggtgtcctcttcaacaaagccttcaatttgagcggggcacactctccgctccacgcctgtggtcatggatgaagctggaaacaatcatactgtcaaaattatcacaggggcagaaaaccaagcacagaatgttctctctgatatctgagagctag

SEQ ID NO: 28607 - DNA, 306 bp, Artificial Sequence
  Description of Artificial Sequence: Synthetic coding sequence
atgaataagttgggccacaatgaacttaaggaatgtttaaagaccgcgaccgactcacttcagaccgttcagccctccatcagtcagacatgtacaagctatggacccgcgttaggtgccccactaccaggtaggaacgaggtagccctgttgacttcactgcccccaaactacgagatatctgaaggaaagccaagggcaatctccgcgtatgttcgagccggcaaagggaacgtcacaagacgcaggaagaaaacacatctaggaaatgacgatggcaaaaaggaagcccaagagaaaatgtag

SEQ ID NO: 28608 - DNA, 306 bp, Artificial Sequence
  Description of Artificial Sequence: Synthetic coding sequence
atgaacaaactcgggcacaacgagctaaaagaatgcctgaaaacagctaccgacagccttcagaccgtgcaaccttccattagtcaaacctgtactagctatgggcctgcactcggggccccactcccaggccgcaatgaagtagcactgctcacatccctgcccccaaattatgagataagcgaaggcaaaccgcgcgctattagcgcgtacgttcgggctgggaaggggaacgtgactaggaggaggaaaaagacacatcttggtaacgatgacgggaagaaggaggcccaggaaaagatgtag

SEQ ID NO: 28609 - DNA, 1416 bp, Artificial Sequence
  Description of Artificial Sequence: Synthetic coding sequence
atgtgcggcgactgtgtggaaaaagaataccctaaccgtggcaacacgtgcttagaaaatggtagctttttgctgaatttcaccggttgtgccgtgtgtagtaaaagggatttcatgctgatcaccaataaaagtctcaaggaagaggacggtgaagagatcgttacatatgatcacctctgtaagaattgccatcatgttattgctagacatgaatatacgtttagcatcatggacgagttccaagcgaaggttgaagagaagattcaggaagtcttttcgtcttataagttcaatcacctagtgcccaggcttgtgctccagcgcgaaaaacattttcactacctaaagagaggactaaggcagctgacagacgcctacgagtgtctggacgcttctaggccatggctgtgttattggattttacattctctagaattactcgacgagcctattccgcaaattgttgccactgatgtgtgccaatttctcgagttgtgccagtcaccggagggcggcttcggtgggggaccaggccagtatccacatcttgcccccacctacgccgccgtgaatgccttatgcattatcggcactgaagaggcctatgacattatcaatagggagaaactactccagtacctctattccttgaagcagcccgatggatcctttcttatgcacgttggaggcgaggtggacgtgcgatccgcttattgcgcggcaagtgtagccagcctgacaaacatcatcacgcctgacttgtttgaagggaccgctgagtggatcgcccgatgtcagaattgggaaggaggtatcggcggggtgccaggcatggaagcccacggtggctacacattttgcggcctcgcagcgttggttattctgaagagggagaggtctctcaaccttaaaagtcttcttcagtgggtgacctctaggcagatgaggttcgagggcggattccagggtagatgcaacaagctagtcgacggatgctactccttttggcaagccggtctgctgccactcctgcatcgcgcactgcacgcacagggggatcctgccctgagcatgtctcattggatgtttcaccagcaggctcttcaggaatacattctcatgtgttgccaatgccccgcaggcggtctgctggacaagcccggaaagagtcgggacttctaccacacttgctattgccttagtggcttgtccattgcccagcacttcggaagtggcgccatgctgcatgacgtggtgctgggtgtgccggaaaacgctctgcagcccacacatccagtgtacaatatcgggccagacaaggtgattcaagccactacctactttctccaaaaacccgttccaggatttgaggagctgaaagacgaaacatccgcagaaccagcaaccgactag

SEQ ID NO: 28610 - DNA, 582 bp, Artificial Sequence
  Description of Artificial Sequence: Synthetic coding sequence
atggaagcccatggaggttacacattctgtggacttgctgccttggtcattctcaaacgcgaaaggtcccttaatctgaagtctctgctgcagtgggtcacctctcggcagatgcgctttgaaggcggctttcagggccggtgtaataagctcgttgatggttgctatagcttctggcaggcggggcttctcccccttctgcaccgggcgcttcacgcacagggagaccccgccctgagcatgtctcactggatgtttcatcaacaggccctgcaggagtatatcctgatgtgttgccagtgtcccgcaggtggcctattagataagccagggaaaagtcgcgacttctaccacacatgttactgtttatcgggtttgtctatcgctcagcatttcgggtccggggccatgttacatgacgtagtgctgggagtccctgagaacgccttacagccaactcatccagtctacaacattggccctgataaagttatccaggccactacctattttttacagaaacctgtacctggctttgaggagctgaaagatgagacgtctgcggagcccgccacggattag

SEQ ID NO: 28611 - DNA, 1176 bp, Artificial Sequence
  Description of Artificial Sequence: Synthetic coding sequence
atgatcgccaaggtggaagagaagatccaggaagtgttcagttcatacaaatttaaccatctagttccacggctcgtactccagcgcgagaaacacttccattatctgaagaggggccttcggcaacttactgatgcatacgagtgtctggacgcttctcgaccgtggctttgttactggattttacactctttagaattgctagatgagccaattccacagatcgtggctacagatgtctgccagttcctcgaattgtgccagagtcctgagggaggcttcggtggaggtccaggccagtatccgcacctggcccccacctatgccgctgtgaacgccctgtgcatcatcggaacagaagaggcgtacgatatcatcaaccgtgagaagctcctccagtacttgtactcattgaaacagccagatggctctttcctgatgcatgttggcggcgaggttgacgtgcgaagcgcttattgtgcagccagtgtcgccagcctgaccaacataataacccctgacctgtttgagggcaccgctgaatggatagcccggtgtcagaattgggaaggtgggataggtggggtgccggggatggaggcccacggtggctacaccttctgcgggctggctgccctcgtcattctaaaacgggagcggtcactcaatttgaaatctttgcttcagtgggtcacttcacgccagatgaggtttgagggagggttccagggcagatgcaacaagcttgtcgatggctgctactcattctggcaagctgggctgctccctctactccatcgtgccctccacgcacagggcgaccccgctctttcgatgtcccattggatgttccaccagcaagctctgcaggagtacatacttatgtgctgtcagtgcccagctggcggtctgctggacaaaccgggtaagtcaagggacttttatcacacttgttactgtctgtccgggctatcaatcgcccagcatttcggcagcggggccatgttgcacgacgtggttctcggggtgcctgagaacgcactgcaaccaacccatcctgtgtataacattgggcccgataaggtgattcaggccactacttacttcctccaaaagccagttccgggatttgaagaactgaaggatgaaacttcagctgaaccagctacagattag

SEQ ID NO: 28612 - DNA, 1419 bp, Artificial Sequence
  Description of Artificial Sequence: Synthetic coding sequence
gccatgtgcggcgattgtgtcgagaaagagtacccaaaccgtggaaacacatgccttgagaacggtagcttcctgctcaactttactggatgtgccgtttgctcgaaacgcgactttatgctcattaccaataaaagtctcaaggaggaagatggagaagagatagtaacttatgaccatctgtgtaagaactgtcatcacgtcattgccaggcatgaatataccttttctattatggacgagttccaggcgaaggttgaggagaagatccaagaagtgttttcatcttataaattcaatcacctcgttcctcgactggtcttgcagcgagagaagcactttcattaccttaaaagggggctgaggcagcttacagacgcttatgagtgtctagatgcgtcccgcccttggctctgttattggattctgcattctctggagctattggacgagcccataccacagatcgtagccaccgatgtgtgtcagttccttgagctgtgccaaagccctgaagggggtttcggcgggggtcccggccaataccctcacctggcccccacctatgccgccgtgaacgccctttgtataattggaaccgaagaagcgtatgacattattaacagggagaaacttctgcaatatctgtactcactgaagcagcccgacgggtccttcttaatgcatgtgggcggcgaagttgacgttagaagtgcttactgcgcagcttctgtcgccagcctaacaaatattattaccccagacttgttcgagggtacagcagaatggatagctcgatgtcagaattgggaaggaggcatcggaggcgtcccaggcatggaggctcatggtggctataccttctgcggcctggccgcccttgttattttgaagcgcgaaagaagccttaaccttaaatctctgctccagtgggtcactagtcgccagatgcggttcgaaggtggctttcagggcagatgtaataagctggttgacgggtgttactcattctggcaagcgggactcctgccacttcttcacagagcgcttcacgctcagggcgaccctgcactgtctatgtctcactggatgtttcaccagcaagcactgcaagagtacattctgatgtgctgtcagtgtcccgccggcggcttgctcgacaagcctgggaaaagcagggatttctatcatacctgttactgcctcagcggtctatcaattgcacagcactttggctcaggagcgatgctgcatgatgtagtccttggtgtgccagaaaacgccttgcaacctacccatcccgtgtataatatcgggcccgataaggtaatccaggcgacgacgtattttctgcagaaaccagtgcctggatttgaagaactgaaggatgagactagcgccgaacccgcaaccgattag

SEQ ID NO: 28613 - DNA, 342 bp, Artificial Sequence
  Description of Artificial Sequence: Synthetic coding sequence
atgtgcggagattgcgtggaaaaggaatatcccaacagggggaatacatgcttggagaacggatctttcctcttgaacttcacaggctgtgccgtgtgtagcaagcgagacttcatgctcattacaaataagagtctcaaggaggaggatggggaagagatagtgacttatgaccccgatttgtgcaagaattgtcatcatgtaatagctcggcacgagtatactttttcaattatggacgagttccaggagtacacaatgctgtgcctgctgtgcggtaaagctgaggacacaatctccattctcccagacgatccaagacagatgacgctgctattctag

SEQ ID NO: 28614 - DNA, 318 bp, Artificial Sequence
  Description of Artificial Sequence: Synthetic coding sequence
atgcggcaaccctacttgtccagtcgtgaggtgagttcctcccgtaagcgctggcgaacattcccggttgactgtgttgctatgtgcggagactgtgtggagaaagagtatcccaatcggggcaacacatgcctggagaacggcagtttcctgctgaactttaccggatgcgctgtttgttctaagcgggatttcatgctcatcaccaataagtccctgaaggaggaagatggcgaagagattgtaacctacgacagggtttatcacgcagtttctgtaatgaggcaaagccggcggtattatcagtactcaccatag

SEQ ID NO: 28615 - DNA, 420 bp, Artificial Sequence
  Description of Artificial Sequence: Synthetic coding sequence
atgagacagccatatctaagcagccgtgaggtgtcttcatcccggaaacgctggcgaacatttccagttgattgtgtggccatgtgcggggattgcgtggagaaggagtaccccaaccgcggaaacacctgtttggagaatggttccttcctgctaaatttcacaggctgcgccgtatgctctaagcgggactttatgctgatcaccaataaatcgttaaaagaagaggatggagaagaaattgttacatacgaccacctgtgcaaaaactgtcaccacgttatcgcaaggcatgagtatacgttcagcattatggatgagttccaggagtatacaatgctttgtctattgtgcggcaaagctgaggacacaatctcaatcctgccggacgaccccagacaaatgacactcctgttctag

SEQ ID NO: 28616 - DNA, 423 bp, Artificial Sequence
  Description of Artificial Sequence: Synthetic coding sequence
atgaggcagccctatttgagtagtcgcgaggtaagttcctccaggaaaagatggagaacattccccgttgactgcgtcgctatgtgcggagactgtgtggagaaggagtacccaaaccggggcaacacttgcctggaaaacggatcttttttgctgaactttacaggatgcgcggtttgttcaaaacgtgactttatgctcattaccaacaagtctctgaaagaggaggatggggaagagatagtaacgtacgacccagatttgtgtaagaactgccaccacgtaatcgctcgccacgagtacacatttagtatcatggacgagttccaagagtacactatgctttgcctcctctgtggaaaggccgaggatacaatctccatcctcccggacgatccaagacagatgacactgctattttag

SEQ ID NO: 28617 - DNA, 381 bp, Artificial Sequence
  Description of Artificial Sequence: Synthetic coding sequence
tgcggagtgtcgacctacgcacctgatatgtctcggatgttggggggagaggaggccagacccaactcctggccgtggcaggttagcctgcagtactctagcaatggacagtggtatcatacatgcggcggaagcttgattgcaaactcttgggtgctgacagctgcacactgcattcgccagatcataaaggcacacaaagtactgcagcggtgctcattaatcctgtttttcgtgcgagacttatgttcctcacaactggaacttactggcgtgtccgccggatcttctggcatctaccgagtcatgctgggccagcacaatctctacgtggctgaatctggaagtctggcagtctcagtgagtaagattgtggtgtag

SEQ ID NO: 28618 - DNA, 813 bp, Artificial Sequence
  Description of Artificial Sequence: Synthetic coding sequence
atgatgctgcggttgttatctagtctgcttctagttgcagtcgcatcaggttatggaccgcccagctctcacagtagcagtcgtgtcgtacacggtgaggacgcagtcccgtattcatggccttggcaggtgtccttgcagtacgagaagtcaggctctttctaccacacctgcggtggaagcctcatcgcacccgactgggttgtgacagccggtcactgcatctctagagacctcacatatcaggtcgtgcttggggaatataatctagctgtcaaagaggggcctgaacaggtgattccaattaactccgaagagctgttcgtgcatccactctggaatcgatcttgtgttgcctgcgggaatgacattgcactgatcaaactctcccgctccgcacagctgggagacgcggtccaactggcgtccctgcctccggctggtgacatcctacccaataaaactccatgttatatcaccggctggggacggctctataccaatggcccactgccagacaagctgcagcaggccagattgccagttgtcgactacaaacactgctccaggtggaattggtggggcagcaccgtgaaaaagacgatggtctgcgctgggggctacatcaggtccggctgtaatggagatagcggagggccattgaactgccccactgaggacggaggatggcaggttcacggggtgaccagctttgtttccgcctttggatgtaactttatttggaaaccgaccgtctttactagagtcagcgctttcattgactggatcgaggagaccattgcttcccattag

SEQ ID NO: 28619 - DNA, 495 bp, Artificial Sequence
  Description of Artificial Sequence: Synthetic coding sequence
atgcggagctgctacgtggcacaagctgggctgaagcttccgggctcttcagaccccccagccagcgcatctcagtctacccgcataacagcatccgggtatggacctccatcttctcattcatcctcccgggtggtccatggggaagatgcagtgccttacagctggccgtggcaggtgtctctgcaatatgagaaatcaggctctttctaccacacttgcggggggtcactgattgcacctgattgggtggtcacagcaggtcactgcatttcaagggacctgacctaccaggtcgttctaggagaatacaacctggccgttaaggaaggtccagagcaggtgattcctatcaactcggaggagctgttcgtgcacccgctttggaataggtcgtgcgtagcctgtggaaatgatattgcactgattaagctcagccgatccgcccagttaggcgacgccgttcaactcgcctccctgccccctgctgggtag

SEQ ID NO: 28620 - DNA, 366 bp, Artificial Sequence
  Description of Artificial Sequence: Synthetic coding sequence
atgatgctgcgcctgttaagtagcttgctgttagtggccgttgcgtcaggatacgggccgcccagcagtcacagctccagccgagtggtccacggggaggatgcagtcccatactcctggccttggcaggtgtccctgcagtatgagaaatccggatctttctaccacacttgcgggggtagtttaatcgcccccgattgggtggtgacggccggacattgtatttcccgagacttaacctaccaagtggtgctgggggaatacaacctggcagtgaaagaggggccagaacaggtgatccccataaactctgaagaattgttcgtgcacccactgtggaacaggagctgtgtagcatgcgggtag

SEQ ID NO: 28621 - DNA, 228 bp, Artificial Sequence
  Description of Artificial Sequence: Synthetic coding sequence
tggtggggcagcacggtgaagaaaaccatggtgtgtgccggcggatacatccggagcggctgtaacggtgattccggagggccgttaaactgcccaacggaggacggcggctggcaggtgcacggggtgacctcttttgtttccgcgttcggatgtaacttcatatggaaaccaacagttttcacccgcgtctccgcgttcatagactggatcgaggagggagggtag

SEQ ID NO: 28622 - DNA, 348 bp, Artificial Sequence
  Description of Artificial Sequence: Synthetic coding sequence
atggataacgtgcaaccaaaaataaaacacagacccttttgttttagcgttaagggccacgttaagatgctcaggttagatctgacaaatagcatcatcactgccgtatttcttagcgtcgtggctatccttgcaatgcaagaaaagaaaagacgccacctgctgtatgttgggggaagtctctgtttaaccgctgttatcgtgtgttgcattgatgccttcgtcgtcactactaagatgcgcactaatctcaagcggtttctcggtgtcgaggtggagaggaagctgtcacctgccaaagacgcctatcccgagacaggacccgacgccccacagaggcccgcgtag

SEQ ID NO: 28623 - DNA, 195 bp, Artificial Sequence
  Description of Artificial Sequence: Synthetic coding sequence
atcaatagcctggtgacaaccgtgttcatgctcatagtatctgtattagccctgattcccgagactacaacgctgacagtgggcggaggtgatctaactaacagtatcatcacagccgtgttcctgtccgtagtggccatactggctatgcaggaaaaaaaacggcggcacctgctgtatgttgggggcagatag

SEQ ID NO: 28624 - DNA, 1395 bp, Artificial Sequence
  Description of Artificial Sequence: Synthetic coding sequence
atgcgcatcatcgagagcaactcttccaagatacagtcccagattgaccatattaaacaatgcagagccgagtacgacacaaaggaagttaaatattgtacattctcaaaggacccgagcaagccaatacctggcatgaccttgcaggagtcaatgaatctggatgccctaacaaagtacatgaaacacctagaggataaatacgctgaaattaagcaagccatgctgatcaaatatgtacccgcacagaggaaagcagatcttgatgaagaaatgatagtgctcctaaagcgacgcgatgttgctgaaaacttgaacaagaaacttcagttctgtcaccaacggctgcagatcattagccaggccctgtccagctgggtgaagtctgacatgtcgagtccatttcaggactttgtagaacagatccagaaaaccaagtacctgcagggcgaccaaggcattgttgaggagctaatggaggacgatcctcgtcgggctaaggaggctgagataatgctccactacatagaaaggttcaacgagctcatttccctgggggagtacgagaaggcggcctgctacgctgcaaactcccctcgcagaatcctgaggaatattggaacaatgaacacttttaaggccgttggaaaaatacgagggaaacctctgccactcctgctcttcttcgaggctctttttattactagccatgcttttccatgtcctgtcgacgccgcgttgaccctcgagggtatcaagtgcgggctgtccgagaagaggctggacctagtgaccaattgggttactcaggagcgcctgaccttcagcgaagaggccggcgacgtgatatgcgactatggagaacaggatacctataataaagcaaaatgcttagccctagcgcagattgtgtactctgagtgtgggctgcacaaaaaagcaatcttgtgcctctgcaagcagggtcagacccacagggtaatggaatacatccaacagctgaaagatttcactaccgacgacctcttgcagcttctcatgtcctgtccccaggtcgagctcattcaatgtctaacaaaagagctgaatgaaaagcagccctctttgtcttttggtttagcaattttgcaccttttttccgcagacatgaagaaggtgggtattaagttgctgcaggaaatcaacaagggcggaattgacgccgtggagtcactcatgataaacgatagtttttgctccattgaaaaatggcaagaagtggccaacatctgctcacagaacggcttcgacaaactgtcaaacgacattactagcatcctcagatcgcaggctgcagtgaccgaaatttctgaagaggacgatgcagtgaacctgatggaacatgtattctggtag

SEQ ID NO: 28625 - DNA, 663 bp, Artificial Sequence
  Description of Artificial Sequence: Synthetic coding sequence
atggctctgattttccggacagcgatgcaatccgtcggactcttattaagcttactgggctggatcctgagcattattaccacctatctgcctcactggaaaaacctgaatctggatctgaatgagatggaaaattggactatgggcttatggcagacttgcgtaattcaggaggaagtgggtatgcagtgcaaagactttgatagttttttggccctcccagcagagctgcgggtgtccagaattctgatgttcctctcgaatgggctgggatttctgggcctgcttgtcagtgggttcggcctggactgcctacgaatcggcgagagccagcgcgatctcaagcggcgactcctcatcctgggcggaattctctcttgggcttccggaatcaccgctttggttccagtttcatgggtcgcgcataagaccgttcaggagttctgggacgagaatgtgcctgactttgttccccgttgggagttcggcgaggccctgttcctggggtggttcgcaggtctgtccctgctgctaggagggtgcctcctgaactgcgccgcctgctcttcccatgctccgctagccttgggccattacgccgtggcccaaatgcaaacccagtgtccttaccttgaggatggcaccgctgacccccaggtatag

SEQ ID NO: 28626 - DNA, 630 bp, Artificial Sequence
  Description of Artificial Sequence: Synthetic coding sequence
atggcatcaatgggactgcaggttatgggcattgcactcgccgtgctggggtggctggccgtgatgctctgttgcgccctgcctatgtggcgggttactgcttttatcgggtccaacatcgttaccagccagaccatctgggaagggttgtggatgaactgcgtggtccagtcaacaggccaaatgcaatgtaaagtctatgattctcttcttgcattgccccaggacctccaagctgcaagggcgctcgtcatcatatctattattgtggccgcactcggggtcctcctgtcagtcgtaggcggaaaatgcacgaactgccttgaggatgaatccgccaaagctaaaacgatgatcgtggctggagtagtcttcctcctggcaggcctgatggtaattgtgcccgtcagctggaccgcacataacattatccaagacttttataaccctctggtggcatctggacagaagagggaaatgggcgccagtttatatgtggggtgggccgccagcgggctgcttctccttggaggcggcctgctatgttgtaactgtccccctcgcacagacaagccatattccgcaaaatactcagcggcacgatcagctgctgcaagcaactacgtgtag

SEQ ID NO: 28627 - DNA, 630 bp, Artificial Sequence
  Description of Artificial Sequence: Synthetic coding sequence
atggcaagcatgggactccaagttatgggcatagccctggccgttctcggctggctcgccgtgatgctgtgttgtgccctgcctatgtggcgcgtcaccgccttcatcggcagtaatatagtgacttcacagactatctgggaggggctatggatgaattgtgtggtgcagtccacaggacagatgcagtgtaaggtatacgactctcttttggccctgccccaggacctccaggctgcccgggccctagtgatcatcagtatcatagttgctgcccttggggtgctgctgtctgtggtgggggggaaatgcactaattgtttggaggatgaaagcgctaaggctaagacaatgattgtggctggggtcgttttcctccttgccggactgatggtgatcgtgcctgtgtcatggaccgcccataatatcatacaagatttctacaaccccttagtggcctccgggcagaaacgagagatgggggccagtttgtacgtgggatgggctgcctctggcctgctgctgctgggcggcggtttgttatgttgtaattgtccccctcggactgacaagccttatagtgccaagtacagcgcagcccgcagcgctgcagcaagcaactatgtctag

SEQ ID NO: 28628 - DNA, 540 bp, Artificial Sequence
  Description of Artificial Sequence: Synthetic coding sequence
atgcaggaggtgattgccggactggagaggttcacatttgcctttgagaaggacgtcgaaatgcagaaaggcacgggcctcctgccctttcaagggatggataagtcagcttcggccgtctgcaatttttttactaaaggcctctgtgaaaaaggtaagttgtgtcctttcagacacgaccgcggcgaaaagatggtcgtgtgcaagcattggttgcggggtctctgcaagaagggggaccactgcaagttcctgcaccagtatgacttgacacgaatgccggagtgttatttctatagcaaattcggagactgcagcaacaaggagtgctccttcctacacgtcaaacccgctttcaaatcgcaagattgtccttggtacgaccagggtttctgtaaggatggaccactgtgcaagtatcgccacgtgcctcggattatgtgcctaaactacttagttggattctgtcccgagggacccaagtgtcaattcgcccagaaaatccgggagtttaaacttttaccagggtctaagatatag

SEQ ID NO: 28629 - DNA, 459 bp, Artificial Sequence
  Description of Artificial Sequence: Synthetic coding sequence
atggtggtgtgtaagcactggttgcgaggcctctgtaaaaagggagatcactgtaagttcttacaccaatacgatctgacacgcatgcccgagtgttacttctacagtaaatttggagactgtagcaacaaagaatgtagcttcctgcatgtgaaaccggcctttaagtcccaggactgcccttggtacgatcaggggttctgcaaagatgcaggccccctgtgcaaatatcgccacgtaccaaggatcatgtgcctaaactacttggtcggattctgcccagagggccccaagtgccagttcgcccattgtagtctgccagctgggcctggcatccaacatttactgttcctcctgtggaaattaggtaacccccatccacaacagagcgcatgctctccggcatggggatctggtgtgaagggaagggcatgcgcaactggccctctctgtcagtag

SEQ ID NO: 28630 - DNA, 678 bp, Artificial Sequence
  Description of Artificial Sequence: Synthetic coding sequence
atgtccaaggagatttttcccttttgcagagtcgggaacatcccctacgaagccaccgaggagcagttgaaggacattttctccgaagtagggcccgtcgtctccttccgcctggtgtacgatcgggagaccggaaagccaaaagggtatggcttttgtgaataccaggatcaggagaccgccttgtctgcaatgcgcaatttaaacgggcgggagttcagtggccgcgccctacgagtcgataatgccgcttccgagaagaataaagaagagctcaaatcccttggaaccggagcccccgtcatcgagagtccatacggtgagaccatttcacccgaggatgcccctgagtcaataagcaaagcagtcgcctctctgccccctgagcaaatgttcgagctgatgaagcagatgaaattatgcgtgcagaactcaccccaggaagccaggaatatgctcctgcagaaccctcagcttgcgtacgcgctactgcaggcacaagtggttatgagaatcgtggaccccgaaatcgcgctgaaaattctgcataggcagacaaacatacccaccttaatagcaggtaatccccaacctgtacatggggccggcccgggaagcggtagcaacgtatccatgaatcagcagaatccccaggccccgcaagcccagtccctctag

SEQ ID NO: 28631 - DNA, 1794 bp, Artificial Sequence
  Description of Artificial Sequence: Synthetic coding sequence
atggcagggctgacagttcgggatcctgcggtggatagatccctcagaagcgtgttcgtggggaacattccgtacgaggccactgaggaacaattgaaggacatcttcagtgaggtggggcctgtggttagcttccggcttgtttacgaccgggagaccggaaaaccgaagggctacggcttttgcgagtaccaggaccaggagacagcactgagtgccatgcgtaacttgaatggccgggagttttcaggacgcgcactgagagtagacaacgccgcttccgagaagaacaaggaagagttgaagagcttgggcacaggagcacctgtgatcgaaagtccatatggcgagaccattagccctgaagatgcacctgagagtatttctaaggccgtcgcctctctgcctccagagcagatgtttgagctgatgaaacagatgaagctctgtgtgcagaatagtcctcaggaagcccgaaacatgctgctacaaaacccccagcttgcctatgccctgttgcaagcacaagtcgtgatgagaattgttgaccctgaaatcgcactgaagatcctccaccgacagaccaatattcccacactgattgcaggcaatccccagcctgtgcacggcgctgggcctggcagcggctctaatgtgtctatgaaccagcaaaacccccaagctccacaagctcaaagcttgggtggtatgcacgtgaacggagcgccgcccctcatgcaggccagcatgcagggcggcgttcctgcaccaggccagatgcccgccgcagtgactggccctggccccgggtctcttgctcctggtggtggaatgcaggcccaggtaggcatgccaggctccggccctgtgagcatggaacggggtcagggtactctgcaacattcacccgtaggaccggccggccccgcaagcattgaacgggtgcaggtccccatgcaggaccccagagcggctatgcagaggggtagcctgcctgcaaatgtacccactcctcggggactgctgggggacgctccaaacgacccaagagggggaacactgttatcagtgactggggaagtggagccacgcggctacctcgggccaccccaccagggaccgcccatgcatcatgtgccgggtcacgaatcaagaggcccgcctccacatgagctacgaggtggccccctgccggagcctcggccattaatggcagagccccggggacctatgctcgatcagcggggaccccctcttgatggaaggggaggacgcgacccaagaggaatcgacgctagagggatggaggccagggccatggaggcaagaggactcgacgcccgcggtttagaggcccgagccatggaagcgagggctatggaagcccgcgccatggaagcgcgagccatggaggcccgggcaatggaggttagaggtatggaggctaggggaatggacaccagagggcctgtacccggcccacgcgggcccattccttcggggatgcaggggccatcccctattaacatgggcgcagtcgtgccccagggaagcaggcaggttcccgtcatgcaggggacaggcatgcagggggcttcaattcagggcggatcccagccaggcggctttagtcctggccagaaccaggtgacaccgcaggaccatgagaaggcggcactgatcatgcaagtccttcagttaaccgccgatcaaattgccatgttacccccagagcagcggcagtccatactgatcctgaaagaacaaattcagaagtccaccggcgccccgtag

SEQ ID NO: 28632 - DNA, 786 bp, Artificial Sequence
  Description of Artificial Sequence: Synthetic coding sequence
atgcatggagaagctagtgatggcgagggcgaaggagacactgaggtcatgcagcaagaaactgtgcccgttcctgtgccttccgagaaaacaaagcagccgaaggaatgctttctcatccaaccaaaagagcggaaggagaataccaccaagacccgtaagcgcagaaagaagaaaatcacagatgttcttgccaaaagtgaacctaagcccggtctgcccgaggatctgcagaaacttatgaaggactattacagcagtcgcagactcgtgatcgagttagaggaattgaatttgcccgactcttgcttcctgaaagccaacgacctgacacactccctttcatcatacttgaaggaaatttgccctaagtgggtgaaactgagaaagaaccactcggaaaagaagtcagttctcatgctcattatatgttcttccgccgtacgcgccctggaactgattcggtcgatgaccgcctttcgcggcgatggcaaggtgattaaactatttgccaaacatatcaaggtgcaagcacaggtaaagttgctagaaaaacgcgttgttcacctcggcgtgggtactccaggacggatcaaagaactagtgaagcaaggcggtctcaatctgtcacccctgaaattcctggtcttcgactggaactggagagatcagaagctgaggcgtatgatggacattcccgaaatcaggaaagaagtttttgaacttctagaaatgggcgtcctgtcattgtgtaagtctgagagcctcaaactgggtctgttttag

SEQ ID NO: 28633 - DNA, 732 bp, Artificial Sequence
  Description of Artificial Sequence: Synthetic coding sequence
atgagtcctgaccagttcttgctcaccgtgagcgctcttcagcatgccaggaactccggagagttcgcatatccgtgtcgacctcagaccgaaattaccgatgtctggggcccctctatctcttacccccggaaggtccttaacttcaaaggaaaatcaattcagagagccgtcgatagactgcgcctgtctaatccccccattgatgtgaagcgcaccagcatccccctggaaatccaaaagctgcagcccaacttaaaaattagcctccacagtccccgggcacaatctaccatccccgagccaatgatcatcaggagcagattttctggctctctcaagggcggagatcaggtgacgagctccatcgaacgcgccgtgtgtagcacaggtccgctgacatccatgcaggtaattaagcccaaccgcatgttggcccctcaggtcggtaccgctacactttctctgaaaaaagagaggccgcgaatatacaccgccctcgatccattccgcgtcaacgctgagtttgtgctcctaaccgtgaaagaggagaaggagcatcaggaagcaaaaatgaaggaatatcaagcgcgggaaagcacgggggtagtggatccaggcaaggcatcgaaggcagcctggatccggaagattaaagggctcccaattgacaatttcacaaagcaaggcaagaccgcagcacccgaactcggccagaatgtgttcatttag

SEQ ID NO: 28634 - DNA, 759 bp, Artificial Sequence
  Description of Artificial Sequence: Synthetic coding sequence
atggatctgtgtaaaaataggttggtgtctggaggaagagactgccaagtgaaggtttgggatgtggacactggtaagtgcctgaagacatttaggcataaggatccaattttagctaccagaatcaacgacacctacatcgtgtctagttgcgaacggggcctagtcaaagtgtggcatatcgcaatggctcagctcgttaagactttatccggccatgagggcgctgtcaaatgcctgtttttcgatcagtggcatctcctatctggctcaaccgatggcctggttatggcctggtccatggttggcaaatacgagaggtgcctcatggcctttaagcaccctaaggaggttctcgatgtatcactgctatttttgcgagtgatcagcgcctgtgccgacggcaagattcggatttataactttttcaacgggaactgcatgaaggtgatcaaggccaatggaaggggcgaccccgtgctcagtttcttcattcagggcaaccgtattagcgtctgtcatatcagtactttcgctaagagaatcaatgttggctggaacggcatcgagccttctgcgaccgcacaaggtggtaacgcctccttgaccgagtgcgcccatgttaggctgcacatcgcaggacacctccctgctagtcggttacctgtggccgccgtacagccgatgacaggcggaatggcccccactaccgccccgacccacgtgctagcgatgctgatcctgttttcaggtgtctag

SEQ ID NO: 28635 - DNA, 2259 bp, Artificial Sequence
  Description of Artificial Sequence: Synthetic coding sequence
atggagaatctggaaagccggcttaaaaatgctccatattttagatgcgaaaaggggacagattccatccctctgtgccgaaaatgtgaaacccgcgtcctggcttggaaaatcttttccaccaaggaatggttttgtagaattaatgacatatctcaacggaggttcctggtggggatacttaagcagcttaacagcctgtacctgttacactactttcagaacatattacagaccactcaggggaaggactttatctataatcgttctcggatagatctgagtaagaaagagggaaaagtcgtcaagtcttctcttaaccagatgttagataagactgtcgagcagaagatgaaagaaatattgtattggtttgcaaattccacacagtggacaaaagcaaattacacactgctacttctccagatgtgtaaccctaaactgttgctaaccgcagccaacgtcatcagggtccttttcctgcgggaggagaataacatatccggcctcaaccaggatattaccgacgtgtgcttctctcccgagaaagatcacagctccaagtcggctacatcacaagtctattggaccgcaaaaactcagcacacatcactcccattgtccaaggctcccgaaaacgagcatttcctgggtgccgcgtcaaacccagaagagccctggcgaaactccctaaggtgtatttccgaaatgaatcgtctttttagtggcaaagctgacatcactaaaccaggttacgacccctgcaacttgcttgtcgatctggacgacattcgggacctgtcctccggatttagtaagtatagagactttatcagatatttgcctatccacctgagtaaatacatccttagaatgctcgatagacacaccctgaataagtgcgcctccgtcagccagcattgggccgccatggctcagcaggttaagatggatcttagtgcacacggttttatacagaatcagattacttttttgcaaggaagctacaccagagggatcgaccccaactacgctaacaaggtctccatccccgtcccaaagatggttgacgacggtaagtctatgagagtgaagcaccccaagtggaaattacgaacgaaaaacgagtacaacctgtggaccgcttaccaaaacgaagaaactcagcaggtcctcatggaggaaaggaacgttttttgtggtacatacaacgtgcggatccttagtgacacatgggaccagaaccgagtgatacactactccggtggggacctgatcgcagtgagtagcaatcggaagatacacttacttgatattattcaagttaaagccatccccgtcgagttccggggacatgcaggtagcgtgagggccctgtttctctgcgaagaggaaaacttcctattgtctgggtcttacgacttatctatccgctactgggatctgaagagcggggtatgtactagaatattcggcgggcatcagggcactattacctgcatggacttatgcaagaaccgactagtcagtggtggcagggactgtcaggtgaaggtttgggatgtcgatacaggaaagtgtctcaagacattcagacacaaagacccgattctggccaccagaatcaacgatacctacatcgtctcttcctgtgaacgcgggctggttaaggtgtggcacatagccatggctcagctggtgaagaccctctctggacacgagggcgccgttaaatgtctgttctttgatcaatggcatcttctgagcggttctacagacggactggtgatggcctggtcaatggtgggaaagtacgagcgatgtctcatggcctttaagcatcctaaggaggttttggacgtctccctgttgtttctacgggttatctcggcatgtgccgacgggaagatccggatttacaatttctttaacggtaattgtatgaaggtcatcaaggcaaacggtcgcggggatccggtcctgagtttttttatccaaggaaacagaattagcgtgtgccacatctccaccttcgcaaagcgcatcaatgtcggttggaatggcatcgaaccctccgccaccgcacagggcggcaatgccagcctcaccgaatgcgctcacgtgcggctgcatattgccggccacctgccagccagccggttgcccgtagccgcagtccagcccatgaccgggggcatggcccctacaacagccccgacacacgtcctggcaatgctcattttgttctctggagtttag

SEQ ID NO: 28636 - DNA, 567 bp, Artificial Sequence
  Description of Artificial Sequence: Synthetic coding sequence
atgttttcttgctgtttccctacttcaaggggctgttgtttccgcaatggagggagcgagtcccttttccgccgatgtaggcgcaggttgattccccacccacgaagactcagtccagtcgttatccggcgcattcaggtcccccaagattctctgggccaggcgcttgccggacaggctacccctgagattcctctcgggctgcagctgcacacagtcttagtgcaggagattcaggagcttatcgaggcgcagacattagctcctggcccttgtgctgaagtacgtgcccttccagcccccgccgcagagcccgaacctgcatgggaagaggctccccctgagagggctttagagcttgagggggcaccagccaaagatcaaacaaacgaagagctgccggagattactgaagttcctgaatccatcaaaagacgcctgggtagacgggttccagcggcaacccccgccccacgcgggaacttactccttcaggcctggatgcgtgttcatagctgggcttctaggcttttcgccccaaatgtccttccggggacagggccctag

SEQ ID NO: 28637 - DNA, 369 bp, Artificial Sequence
  Description of Artificial Sequence: Synthetic coding sequence
atgccaaagaaagcccatccaagtcctcagactccggtggcccggtgcaacaaggcgcaccctgcccctggcccctgtgccgaagttagagctctccctgcccctgccgccgaacctgagcccgcctgggaagaagccccaccagaaagggctttggaactggaaggggctcccgcaaaggaccagactaatgaagaacttcctgagatcaccgaagtccctgaaagtattaagcgtcgactgggacggagggtgcctgcagcaacgccagctccacgcggtaatttgttgctgcaggcgtggatgcgcgttcactcatgggcatcccgtttattcgctccaaatgtgctgcccgggactggcccgtag

SEQ ID NO: 28638 - DNA, 846 bp, Artificial Sequence
  Description of Artificial Sequence: Synthetic coding sequence
atgttctcatgctgtttccctaccagtaggggatgttgtttccggaacggaggttccgagagcttgttccggcaatgtagaagaagactgatccctcatccgcggcggctgtggcctttcgtcaggaggcggacacaggtcccccaggatagcccagggcaggccctggcaggacaggccacgccagagatcccctcaggactgcctctgcacatcgttctggtgcaggaagagatcagggagcccatggaggcacaaacacacgcacctggcccgtacgcagacatcgctgctctcgccgccccagctgtggagcccaagcctgcctgggaggaacctcctccggagcgcgccctggaggtggagggcgctccagccaaggaccaaccatctcaggagctaccggagataatggctcccactgtcgccaccggattgaatgcaggagcggaaaacgtcgcaggcgaaagatccggaagggaaggggttacgagcactgctcctgcctctaggagtcacgccgcaccaagccctggccatggtggcaagcacgggggtggggatcagggcattcagaccggattgctgtatttagcaggtgaaaggctgctgtccttcgctggcaccaccgccctactgctgcaaggtctgtttatcgtgttaatcctcgtgggttatatttccgtcaaagtgatgttgaagtcaataaaaactcggctcggccgaagagtccctgctgccccccctgcattgcggcgaaatctgcttttacaagcctggaagtgcgtgtgcaactgggcttccaggctgttcgcgcctaacgtgctgcctaggactgggtcctag

SEQ ID NO: 28639 - DNA, 456 bp, Artificial Sequence
  Description of Artificial Sequence: Synthetic coding sequence
atggatgcaaggagaatgaagaaggaagggctgaccgagaacactgggctgcctcgcaagctgctcgaaaaacatgacccctggccagcctatgtgacatacacatcacaaacagtgaaacgcctgattgagaagagtaaaaccagagagctggaatgcatgagagcactggaggagaggccctgggctagtcgccagaataagcccagcagcgtgattcagccgaaaagaaggaagagttccaaatcatccggtaaagcggtgtttagagatacactcagcgaatcaacactatccatgtggggtgcctattccgtcctagcaatggctcccacaatgatccctgagccgacacacctgcacgcagacagtcgggactgccctacagaaaattacaacaaaattatctttgcacggaaacccatgatgagaatgttgccaacagtccgttactag

SEQ ID NO: 28640 - DNA, 459 bp, Artificial Sequence
  Description of Artificial Sequence: Synthetic coding sequence
atggacgctcgaagaatgaaaaaagaggagggactgaccgaaaataccggcctccccagaaagctgttggagaagcacgacccgtggcccgcttatgtgacctacacttcgcagaccgttaaaaggttaattgagaaatctaaaacgagggagctggaatgcatgcgcgctttggaggagaggccatgggcgagtaggcaaaacaagccgtcaagcgtgatccagccaaaacggagaaagtcctcaaaatcctccggtaaggctgtgtttcgggacactctttctgagtcaactctgagcatgtggggcgcttacagcgtgttagccatggcgccaaccatgatccctgaacccactcacctgcatgccgactctagagattgccccaccgagaactacaacaagatcatcttcgctcggaagcccatgatgcggatgctgcctaccgtgcgctactag

SEQ ID NO: 28641 - DNA, 75 bp, Artificial Sequence
  Description of Artificial Sequence: Synthetic coding sequence
atggatgcgcggcgcatgaaaaaagaggaagggctaacggaaaacaccggccttccgagaaaactgctagagtag

SEQ ID NO: 28642 - DNA, 627 bp, Artificial Sequence
  Description of Artificial Sequence: Synthetic coding sequence
atgcagcgacccgagtggccgcgaccccacccgggcgaaggagcagccgccgctggacggggacctgccccccccgcccgagctggggaaccatctggcctccggctacaggagccatccttatatactataaaagccgtgtttattcttgacaatgatggacgccgactgctcgccaaatactacgacgacactttcccttcaatgaaggagcaaatggtgttcgagaaaaacgtcttcaacaagactagtagaactgaatctgagatcgcgttttttggtgggatgacaatcgtatataagaattcaatcgacctgttcctttatgtcgtgggatcaagttatgaaaacgaactgatgttgatgtccgtgctgacatgccttttcgagagtctaaaccacatgctacgcaaaaatgtcgaaaagaggtggctgctggaaaacatggacggtgccttcttagtgcttgatgagatcgtggacggcggggtaatcttagaaagcgaccctcagcaggttattcaaaaggtgaatttccgcgcagacgacggaggcttaacagaacagtctgttgcccaagtgcttcagtcagcaaaggagcagataaagtggtccctcctcaagtag

SEQ ID NO: 28643 - DNA, 3702 bp, Artificial Sequence
  Description of Artificial Sequence: Synthetic coding sequence
atgcctcctagttggagcccgttgatgtgtgggcgagctgcagaggccgccgcaagctctagaactccaggcagggagatggggcaggctgttacacggagacttggtgccggggcacgggctgcacccaggcgagcaatggatggaagaacccctcggccccaggacgccccagcgcgcagagaaattgccggctcctggagaaagcctaaagctaaagcaccactcccgcctgctgagactaaatacactgatgttagctctgcagcagactctgtcgagtcgacagcttttatcatggagcaaaaagagaacatgatcgacaaagacgtggaattatccgtcgtgctgccaggcgacatcatcaaatcaaccactgtgcacggctctaaaccaatgatggatttgctgatctttctttgtgcacaataccatctcaacccatcatcctatacaatcgatctgctgtccgcagagcagaaccatatcaagttcaagcccaacacaccaataggaatgctggaagtggagaaagtgattctcaaacctaaaatgctggacaaaaagaaaccaaccccaatcattcctgagaagaccgtgagggtggttataaatttcaagaagacacagaaaactatcgttcgagtcagtccgcacgcaagcctgcaggaattggctcctatcatctgctctaagtgcgaatttgacccactgcacactctgctgctgaaggactaccaaagccaggaacccctggacctgacgaaatctctcaatgatttgggtctacgcgagctgtacgctatggacgtgaaccgagccacttcagtaaccgtattctccaagtcgtcattacaagagagctgccaaatctcacagaatttggacatcatgaaagagaaagagaacaagggattctttagcttttttcagcgaagcaaaaagaagagggatcaaaccgcctccgctcccgctaccccactcgtgaacaagcatcgacccaccttcacacggtctaacaccatctctaagccttatatctctaatactctgccctccgacgctccgaaaaagaggcgcgctcctctcccccccatgcctgcctcgcaatccgtgcctcaggacctggcacatatacaggagcggccggctagttgcatcgtgaaatccatgtccgttgatgaaacagacaagtccccttgcgaggcagggagggtcagggccggttctctccagctctcatccatgagtgcggggaactcatcactgaggcgaacaaaacgaaaggccccgtcaccaccctctaagatacctcctcaccagagcgacgaaaactcgagagtcactgccctgcagccagtggacggggtgccacccgactcagcctcagaggctaactcccccgaggaactgagttctccagaaacctttcacccaggtctcagtagccaagagcagtgcaccgccccgaagctcatggaggagacgtccgtgtttgagtgtccaggcacgccggaggctgccatcacatcccttacaagcggaatctcatccgactactctctggaggaaatcgacgaaaaggaagaactgagcgaggtgcctaaagttgaagcagaaaacatcagtccaaagtctcaggacataccatttgtatcaaccgatattatcaacacgttgaagaacgatcctgactccgctctgggaaatggcagcggggaatttagccagaactccatggaggagaaacaggagaccaagtctaccgatgggcaggagccccatagtgtcgtgtacgacacatctaacggtaagaaggtcgtggactccatcaggaatctcaagagcctcggcccgaatcaggagaacgttgttcagaatgagatcatcgtgtaccccgaaaataccgaagataatatgaaaaatggggtgaagaaaaccgagattaatgtcgagggagttgccaagaacaataacatcgacatggaggtcgaaagaccgtctaattctgaagcccatgagacagacaccgctatctcttacaaggagaaccatttagccgctagcagcgtaccggaccagaaactgaatcagccttccgcagagaagacaaaggatgccgccatacagactacaccttcctgtaattcgttcgacggcaagcaccaggatcataacctgagtgacagcaaagtcgaggagtgtgtccagacaagtaacaataacatcagtactcaacacagctgcttgtcatctcaggattctgtaaacacctccagagaatttcgctcgcaagggaccctcattattcactcggaggaccccttgacggttaaagatccgatctgtgcgcatgggaacgatgacctcctgccaccggtagacagaattgacaagaatagcacagcctcatacctcaaaaattatccactttacaggcaggactacaacccaaagcctaaaccatctaatgagattacacgggagtacattccgaaaattggtatgaccacatataaaatcgtgccaccaaagtccctggaaattagcaaggattggcaaagtgaaacgatcgaatataaggatgaccaggatatgcatgcccttggaaagaagcatacacacgaaaacgtgaaagagacagcaatccagactgaagattcggctataagtgagtcccctgaagaaccattaccaaatctgaagcccaaacccaaccttaggaccgagcatcaggtcccgtctagtgtgtcttctcctgatgatgcgatggtatctcccctgaaacccgcaccaaagatgactagagatacaggcactgctccttttgctcccaatctggaggagatcaataacatcctggagtctaaattcaaatctcgtgccagcaatgcccaggcgaagccttcttccttttttctccaaatgcaaaagagggtcagcgggcactacgtcacgagcgccgccgccaagtccgtgcacgcggctcccaaccctgccccgaaagaactgaccaacaaagaagctgagcgagacatgctgccttcccccgagcaaactctttctcccttgtctaaaatgccacacagtgtcccgcaaccgctggtagaaaaaacagatgatgatgtaattgggcaagcccccgctgaagcctcaccccccccaatcgcacccaaacctgtgacaatcccagcatcacaggtttcgacacagaatcttaaaaccctcaagaccttcggggctcccaggccgtactctagcagtggaccatcacccttcgccctggccgtcgtgaagagatcccagtcttttagcaaagagagaacagagagtcccagtgcctccgcactggttcagcctcccgcgaataccgaggaggggaaaactcactccgtgaacaagtttgtggacattccacaacttggtgttagtgataaagaaaataattctgcacacaatgagcaaaattcccagatccctacacctaccgacggcccgtcatttacagtcatgcggcagagttccctgactttccaatcatcagaccccgagcagatgagacagagtttgctcactgccatccgtagcggagaagccgccgctaagctaaagcgcgttaccataccatccaacactatctctgttaatgggcggtcgcgactctcccacagcatgtcaccggacgcacaagatgggcattag

SEQ ID NO: 28644 - DNA, 3501 bp, Artificial Sequence
  Description of Artificial Sequence: Synthetic coding sequence
atggacggaaggacgcctaggcctcaggacgccccagcacgcaggaagcctaaagcaaaggctcctttaccaccagcggaaaccaaatacactgatgtgtcttccgccgcggatagcgtcgagtctacggccttcattatggagcagaaggagaacatgatcgataaggacgttgagctgtcagtggtgttacctggagacatcataaagtctacgaccgtgcacggtagtaagcccatgatggacctcctcatttttctgtgtgctcagtaccatctgaatcccagctcgtataccattgatctacttagcgcagaacagaatcatattaaattcaagcctaatacacccatcggcatgttagaggtggaaaaagttatcctgaagcctaagatgctcgataaaaagaaaccaacccccatcattcctgaaaagactgtacgggttgtgattaactttaagaagacccagaaaactattgtgcgggtgagcccccatgcctctctgcaggaactggctcccattatatgtagcaaatgcgaatttgatccactgcacacactgctgctcaaggattaccaatcccaggaacctctcgacctcaccaaatcactgaatgacttaggcctgcgcgagctatatgccatggacgtgaacagggaatcttgccagattagccagaatctggatattatgaaagagaaggaaaacaagggatttttcagcttcttccaaagatccaagaaaaaacgcgaccagaccgcaagcgctcccgccaccccgctagtcaacaaacacagacccactttcaccagaagcaacacaataagcaaaccttacatatcaaatactctcccgtccgacgcccccaagaagcgaagagctccacttccccctatgcctgcaagtcagagcgtgccccaggacctggcacacatccaggagaggcccgcttcatgcattgtaaagtctatgtccgtagatgagacagataagtccccatgtgaggcggggagggtgcgtgctggatctctccagctgagtagcatgagcgcgggtaatagcagcttacgtagaactaaacgcaaagctccaagccccccctccaagatacctcctcatcaaagcgatgagaatagtcgggtaacagctttacagcccgtggacggcgtgcctcctgattctgcaagtgaggctaatagccccgaggaacttagttccccagagaccttccacccaggattgtcctcgcaggagcagtgtactgctccgaaacttatggaagaaacttcggtgtttgagtgccccggaacgcctgaagccgctatcacttccctcacgagtggaatttccagtgactactccctggaagaaattgatgaaaaagaagaactgagcgaggtgcccaaggttgaagcagaaaacattagccctaagagtcaggacattccttttgtctctactgatatcatcaacactctgaagaacgatcctgatagtgctctaggcaatggttcaggagagtttagccagaactccatggaagagaaacaggagactaagtctacagacggccaagaaccccactccgttgtatacgataccagtaatggcaagaaggtcgtagactcaatacgtaatttgaagtcactgggccccaaccaagagaacgtacagaatgagattattgtttaccccgagaacaccgaggataatatgaaaaatggcgtcaagaagacagaaataaacgtcgagggcgtggcaaaaaataataacattgacatggaagtggagcgcccgtccaatagtgaggcccacgaaacagataccgccatctcatacaaagaaaaccatctagcagcatcaagtgtcccggatcagaagctgaaccagccaagcgcggagaagactaaggatgctgcaatccaaaccacccccagttgcaatagcttcgacggtaagcaccaggaccataatttatccgacagcaaggttgaagaatgcgtacagaccagtaataataatatctctactcagcacagttgtctttcaagccaggattctgttaacaccagcagggagtttcggagtcaggggacacttatcattcattctgaagacccactaactgtgaaggacccaatctgtgctcacggcaatgatgaccttctccctcctgtggataggattgataagaacagcacagcttcctacctcaaaaattacccactttatcggcaggattataatcccaaaccaaagccttcaaacgagatcactagagagtacatccctaagattgggatgactacatataagatcgttccgcccaagagccttgagatctcaaaagactggcagtcagagaccattgaatataaggacgaccaggatatgcacgccctgggcaagaaacatacccatgagaacgtcaaagagaccgcgatccagaccgaggactctgctattagtgaatctcctgaagaaccactgcccaacctgaagcctaaaccaaatctgaggactgaacatcaggtccccagctctgtgtctagtcccgacgatgccatggtgtctccgctcaaaccagcccccaagatgactcgggatactggtacggcccctttcgctcccaatctggaggagatcaataatatactggagtcaaaattcaaatctcgcgcttctaatgcacaagctaaaccatcctccttttttctccaaatgcaaaagagagtttctggccactacgtaacctcggcagccgcaaagagcgtccacgccgctccaaaccctgcccctaaggagctcacaaataaggaagctgaacgtgatatgcttcctagccccgagcagactttatctcctttgagcaaaatgcctcacagcgtgccgcagcccctggtggagaagacggacgacgacgtgattgggcaggcccctgcagaagctagcccgccccctatcgccccaaagcctgtcactattcccgccagccaggtatctacacagaacctgaagactctaaagacatttggcgccccaaggccctatagttccagcggcccctctcccttcgctctagccgtcgtgaagcggagtcaaagttttagtaaagaaaggactgagtcacccagcgcatctgctctggttcaaccgcccgcgaacacagaagaaggcaagacacacagtgtcaacaagtttgtagacatacctcaattgggcgttagcgacaaagagaataatagcgcccacaatgaacagaattcgcagatcccaacaccgactgatgggccatccttcacagtgatgcgccagtcaagtctgacatttcagagctccgaccccgagcagatgcggcagtcgctgttgacagcaatcaggtctggagaggctgctgctaagttgaaacgcgtcactatcccgtctaacaccatatccgtgaacgggcgaagtcgcctcagccactcaatgtctccagatgcacaggacggtcactag

SEQ ID NO: 28645 - DNA, 3387 bp, Artificial Sequence
  Description of Artificial Sequence: Synthetic coding sequence
atggacgggcgcacaccgaggccgcaggacgccccagctcgacggaagccgaaggccaaggctcctttaccccccgccgagaccaagtatactgatgtatcaagtgccgctgactctgtcgaatctaccgcctttatcatggaacagaaagagaatatgatcgacaaagatgtagaacttagcgtagtgctgcctggcgatataattaagagcacaacagtgcatgggtcaaagccgatgatggacctgcttatcttcctgtgtgcccagtaccacctcaatcctagcagttacacgatcgacctgctgtctgccgagcaaaatcatatcaagttcaagccaaatacacccatcgggatgctggaagtagaaaaagtgattctgaaaccgaagatgctcgacaagaagaaaccaacacctataattccagagaaaactgttagagttgtgatcaactttaaaaaaactcaaaaaacaatagtgagagtgagtcctcatgcctccttacaggagctggcacccatcatatgcagcaaatgcgagtttgatcccttgcacacgctgctgctcaaggattatcagagtcaggagcccctcgaccttaccaagtctctcaatgacctaggactgagagagttgtacgccatggacgttaaccgcgagtcttgtcagatcagccagaaccttgacattatgaaagagaaagagaacaaaggcttcttcagcttcttccagcgaagcaagaaaaagagggatcagacagcctcagccccagctaccccactggtcaacaaacatcggcccacctttactagatctaacaccatctctaagccgtatatctctaacacactccctagcgatgctcctaagaaacgaagagctcctttgcccccaatgcctgcaagccagagtgtgccacaggacctggcccacattcaggagaggccggcctcttgtatcgttaagagcatgagcgtggatgaaaccgacaagtctccgtgcgaggctggcagagtgcgcgccggctcactgcagttgtcctctatgtctgccggtaatagtagcttacgccgcacaaagcggaaagccccgagcccccctagcaagattcccccccaccagagcgacgagaactcgcgagtgacagcactccaacctgtggatggggtcccacctgactccgcgtcagaggcaaactccccagaggagttgtcatcgcctgctgggattagctccgactattcacttgaggaaatcgacgagaaagaagagttaagcgaggtacccaaggtggaggcagaaaatatttcacccaagtcacaggatatcccatttgtttcaacagacatcattaataccttaaaaaatgaccccgattccgcactgggcaatggctcaggcgaattcagccaaaatagtatggaagagaaacaggaaacaaaatcaacggatgggcaggaaccccactctgtggtgtatgacacctcgaacggaaagaaggtcgtggatagcattcgaaatctgaaaagccttggaccgaatcaggagaacgtggtgcagaatgagatcatagtgtaccccgaaaacactgaagacaacatgaagaatggggtgaaaaagaccgaaatcaacgtggagggcgtggccaaaaataacaatattgacatggaagtcgaaaggccctccaattctgaagcccacgaaacggataccgctatctcatacaaggagaatcacctggccgcctcgagcgtccccgaccaaaagctgaatcagccttcggctgaaaagacaaaggacgccgctatccaaacgaccccaagctgcaactcttttgatggaaaacatcaagaccacaacctctcagactcaaaggtcgaagaatgcgtccagactagcaataacaacatctctacgcagcatagttgcctaagcagtcaggatagcgtgaacacgtcccgggagttcaggtcccagggtaccctcatcatacatagcgaggaccctctgaccgtcaaagaccctatttgcgcacatggaaacgatgacctgcttccacctgtcgataggattgataaaaatagcacagccagctacctgaagaattatccattgtatcgtcaggactacaaccccaaacccaagccgtccaacgagattacaagagagtatatcccaaagattgggatgacaacctacaaaattgtgccacctaaaagtctggaaattagcaaagactggcagtctgagacaatagagtataaggatgatcaagacatgcatgctcttggaaagaagcacactcacgagaacgtcaaggagactgccatacagacagaagactccgctatctccgagtcacctgaggagcccctgccgaatttaaagccaaaaccaaatttgagaacagaacaccaggtgcctagctctgtgtcctcgcccgacgacgccatggtctcccctctgaagcccgccccaaaaatgacaagagacactgggactgccccctttgcccccaacttggaggagattaataatattttggagagtaagttcaaatccagagccagcaatgcacaagctaaacccagctcattctttctgcaaatgcaaaagagggtttcagggcattacgtgacctctgccgctgctaaaagcgtccatgccgctcctaatcccgctcccaaagagttgaccaacaaggaagccgaacgggacatgctgccaagtcccgagcagaccctgagccctctgtcaaagatgccacattcggtaccacagccattagtcgaaaaaaccgatgacgatgtgatcggccaggctccagcagaagccagcccccccccaattgcaccgaagcctgtgaccatccctgcttctcaggtaagtacacagaacctgaaaacgctcaagacatttggggcaccccgaccatatagtagttcagggccgtccccgtttgccttagccgtcgttaaacggtcccagtcattctcaaaagagaggactgaatcaccgtccgcctctgctctagtccagcctcctgcaaacaccgaggaaggcaagacccatagtgtgaataagttcgtcgacatacctcagctaggtgtgagtgataaagagaataactctgcacataacgagcaaaactcacagatcccgaccccaaccgacggccctagctttactgtcatgagacagtccagcctcacctttcagtcctccgatccagagcagatgcggcagagcctgctcacagccatccggtccggggaggcagccgctaagttaaagcgcgtcaccatcccaagcaacaccatcagcgtcaacggcagaagtaggctaagccactccatgtcacccgatgcacaagatggacactag

SEQ ID NO: 28646 - DNA, 3615 bp, Artificial Sequence
  Description of Artificial Sequence: Synthetic coding sequence
atgtgcggtagggccgcagaagctgcagccagttcaagaacacccggacgagagatgggacaggcagtgacccgtcggctgggagccggagctcgggccgcgccgcggagggccatggatgggagaacaccacgcccccaggacgcacccgcccgaaggaagccaaaggcaaaggcccccttgccccctgcagaaacgaagtatactgacgtatcgtcagcagctgacagcgtggagagtaccgcatttattatggagcaaaaagagaatatgatcgataaggatgtggagctgtcagttgttcttcctggcgatatcataaaatccactaccgttcacgggtcgaagcctatgatggacctgctcatcttcttatgtgcccagtatcaccttaatcccagtagttacactatcgatctgttgtctgctgagcagaaccacatcaaatttaagcccaatacaccaatcggtatgctcgaggtcgaaaaggtgattctcaagccaaaaatgctagataaaaagaaaccaacaccaattatacctgagaagacagttcgtgtggtcattaatttcaaaaagacccagaaaacaatcgtcagagtgtccccacacgctagtctgcaggaactggcacctataatctgtagcaaatgtgaatttgaccccttacacacattgctgctgaaggattaccaatcccaggagccactagatctgactaagagtctgaacgacctgggtctcagggagctatacgctatggatgtgaaccgggagtcctgccaaatctcacagaatctcgatatcatgaaggaaaaggagaataaagggttctttagtttcttccaacgcagcaaaaagaaacgggatcagaccgctagtgccccggctaccccccttgtgaacaagcatagacccacgtttacacgtagtaatacaatatctaaaccttacatatcaaacacacttcctagcgatgctcccaagaagcggagggcccctctgccccccatgcctgcgagccagagtgtgccacaggatctggctcacatccaggagcgccctgccagttgtattgtgaagtccatgtctgtcgatgaaactgacaagtcaccttgtgaggccgggcgggttagagccggctctctccagctctcatccatgtccgcgggaaactcctccctgagacgcacaaaaaggaaggccccaagtcccccctccaaaattccaccccatcagtctgatgagaattctagagtgacagcgctacagccggtggacggcgtaccgcccgattctgcctccgaagcaaactctcccgaagaattgtcatccccagagacattccaccctggattgtcatcccaggaacagtgcactgcgccaaagttaatggaggagacctctgtttttgagtgtccaggcacccccgaggccgccatcacaagcttgacttcgggcatttcctccgactactccctggaggaaattgatgaaaaggaagaactttctgaggttcccaaagtggaggctgagaatatcagccctaagagtcaggacatcccatttgtaagcacagatatcataaacacactgaagaatgatcctgatagcgcactgggcaatggatctggtgagtttagtcagaactccatggaagagaagcaggaaacaaaaagcaccgatgggcaagagccacactccgtcgtgtatgatacatcaaatgggaaaaaggtggtcgattccatacgcaaccttaaaagtctgggacccaatcaggaaaacgtccagaacgagatcatagtatatcctgagaacacagaagacaacatgaagaacggtgttaagaaaactgaaattaacgtggagggtgtggcaaaaaataacaatatcgacatggaggttgaacggccttctaattccgaggcccatgagactgataccgcgattagttacaaggagaaccacctagcagcctcaagcgttcccgaccaaaagttgaatcagccttctgccgaaaagaccaaggatgctgccatccaaaccacccccagctgcaacagttttgacgggaaacatcaagatcataatctgagcgattctaaagtagaagagtgcgtgcagaccagcaataataatatcagcacacagcactcatgtctctcttctcaggatagcgtgaatacttctagggaattccgtagtcaaggcacccttataattcattccgaggaccctctaaccgtaaaagaccctatctgcgcccatgggaacgatgacttgctgcctcctgtcgaccggatagataagaactcaacagcatcatacctgaagaattacccgctgtatcgtcaggattacaaccccaaacctaaaccctctaatgaaattacgcgggaatatataccgaaaattggaatgacgacctacaagattgtgccccctaagtcactggagatatcgaaggattggcagtcagaaacaatcgagtataaagacgaccaggatatgcatgctttaggcaagaaacatacacatgaaaacgtcaaagaaacggcaatccagacagaagatagtgctattagcgagtcaccagaggaacccctgccaaatttaaagcccaagccaaacctgagaacagaacaccaggtgcccagttctgtgtcttcaccagatgatgcaatggtttctcctctcaagccggcaccgaaaatgaccagggacacagggactgccccgttcgccccgaatcttgaggagatcaacaacatcctagagagtaaattcaaatcaagagcttccaatgcccaggcgaaaccttcctctttcttccttcagatgcagaagcgggtctctggacactatgtgacttccgcagcagcgaagtcagtgcatgcagcacctaatccagcgcccaaagagttgacaaacaaggaggccgaacgcgatatgctgccaagccccgaacagacactttctcctcttagcaagatgccacattcagtcccgcagcctttagtcgagaaaacggatgatgacgtcattggacaagcccccgccgaggcgtcgccgcctccaattgcccctaaaccagtaaccataccggctagccaggtctccacccagaacctgaagacccttaagaccttcggcgctcctagaccctatagcagcagcggaccttcacctttcgcattagccgtggttaagcgctctcagtctttttctaaggagcgcaccgaatctccctccgccagcgcactggttcagcctccagccaacactgaggagggcaagactcactcagttaataagttcgtggatattcctcagctcggtgtgagcgacaaggaaaacaattccgctcataacgaacagaattcccagataccaacgcccaccgacggcccatcttttacggtgatgcgccaatcctccctgacctttcagtcctccgatcctgagcagatgcgacagtctctcctcaccgctattcgctctggagaggccgctgccaaacttaaacgcgtgactataccctcaaatacaatcagcgtgaatggccgcagtcgtcttagccactccatgtctcccgatgcgcaggacgggcattag

SEQ ID NO: 28647 - DNA, 3501 bp, Artificial Sequence
  Description of Artificial Sequence: Synthetic coding sequence
atgtgtggtagggctgcagaggcagccgcaagctcccgcaccccgggccgtgaaatgggacaggctgtcacacggcgcctcggcgctggagccagggccgctccgaggcgcgcgatggacggccggaccccccgacctcaggatgcacccgctagacggaagccaaaggccaaagccccgcttccccctgcagaaaccaagtacactgacgtgtcctccgcggccgattcagtggaaagtaccgctttcattatggagcagaaagagaacatgatcgataaagacgtcgagctctcagtagtgttgcctggtgatatcattaaaagcacgaccgtacacggttccaagcccatgatggatttgctcattttcttatgtgcccaataccatttaaatcccagttcctacaccattgatctgctgtctgccgagcagaaccatatcaagttcaaaccaaatacccctattggaatgttggaggtggagaaggtgatcttaaagccaaagatgctggataaaaagaaacccacaccgatcatcccagagaaaaccgtgcgtgtggttatcaacttcaaaaagacacagaagacaattgtgagggtctctcctcatgccagccttcaggagctggctcccattatctgttccaaatgcgaattcgatcccctacacacgctgcttctgaaagattatcagagtcaggaaccactggatctgactaaaagcttaaacgaccttggtctgagggaactatatgccatggacgtgaatagagaatcctgtcaaatctctcagaacctggacataatgaaagagaaagaaaacaaagggttcttcagcttctttcagcggtccaagaaaaagagagatcaaaccgcatctgctcccgctaccccgctcgttaataaacaccgaccaactttcacaaggtcaaataccatctctaagccttacatctcaaacaccctgccaagtgacgcaccgaaaaagcggcgagcaccacttcccccaatgccagcaagccaaagtgtgcctcaagatctggcacatatccaggagcgccccgcatcctgtattgtaaaaagcatgtcagtggacgagacagacaaatctccatgcgaggccggaagagtgcgggccggttctcttcagttatcatcaatgtccgcaggaaattcttccttgaggcgtaccaaaagaaaagcccccagcccgccttctaagataccccctcaccagtcggacgagaattccagggtgacagccctgcagcccgtggacggagtgccaccggactctgcttctgaggctaattctccagaggaactctctagccccgctggaatctcctctgactattcactcgaggagatcgacgaaaaggaggagctgtctgaagtccccaaagtcgaagctgaaaacatctctccaaaatcacaggatatcccattcgtctctaccgacataatcaacaccctcaaaaacgatcccgacagcgctctcgggaatgggtctggtgaattctcccaaaatagtatggaggagaagcaagagacaaaatccacagatggtcaggaaccacattcggtggtgtatgacaccagtaatggtaagaaagtggtggattctatcagaaacctgaaatcccttggccctaaccaagagaacgtcgtgcaaaacgaaattatagtgtaccctgagaatacagaggataatatgaaaaacggggtcaaaaaaacggagatcaacgtcgaaggggttgcaaagaacaacaacatcgacatggaggtggagcggccgagcaactctgaggcacacgaaacagacacagcaatttcctataaggagaaccacctcgcagcttccagtgtccctgaccagaaattaaaccagccatcagccgagaagactaaggacgcggcaatccagactacaccctcctgcaatagcttcgatggaaagcatcaagaccacaatctgagtgactccaaagtcgaggagtgcgtacaaactagtaacaacaacatcagcacacagcattcttgcctctcgtcccaggacagtgtgaatacttcaagggaatttaggtctcagggaaccctgattattcacagtgaggatcccctgacagtgaaggatcccatttgcgcacacgggaacgatgaccttctgcccccagtagacaggatagataagaactcaacagcaagctacctgaagaattatcctctgtatcgacaggactataacccgaaaccaaagccttcaaacgagataactcgagagtatatccccaagatcggaatgaccacatataaaattgttccccctaagagtctggagattagcaaggattggcagtccgagaccatcgagtataaagacgatcaggacatgcacgccttaggcaagaaacatacacatgagaacgtgaaagagaccgccattcagaccgaagattccgccatatctgagtcccctgaggaaccactgccgaatttgaagcctaaaccgaacctcaggactgagcatcaggtcccatcctctgtcagtagccccgatgacgcaatggtgtcacctctaaagcccgcacccaaaatgaccagagacactgggaccgcaccatttgcacctaatctcgaagagattaataatattttagaaagcaagttcaagtcccgggcctctaatgcccaggcaaagccctcttctttcttcctgcagatgcagaaacgcgtctccgggcattacgtgacatccgctgccgccaagtcagtacacgcggctccaaacccagcacctaaggagttgacaaataaagaggccgagcgtgatatgctgccaagtccagaacagaccctgtcccctctgtcgaaaatgccgcatagcgtccctcaacctctggtagagaaaaccgacgatgacgtcatcggccaggcgcctgcggaggcttcaccgcctcccattgctccaaagccagttacaatccccgccagccaggtctcaactcagaatttgaaaactttgaaaacattcggcgcaccgcgcccttacagcagcagtggccctagccctttcgcccttgccgtggtcaagcggagccagtccttttctaaagagcgcacagaatctcccagtgcaagtgccttggtgcagcctcccgctaataccgaggagggaaaaacacactctgtgaacaaatttgttgatatcccacagctaggcgtttctgataaagagaacaattccgctcacaacgagcaaaattcacagatccctaccccaaccgatggtccatcattcactgtgatgcgccagtcgagtctgacatttcagtcatctgatccagagcagatgcggcaaagcttgctgacagccattcgatccggagaggcggccgcaaaactgaagagagtgacaattccgagtaacaccatttccgtgaacggtcgcagccgcttaagtcactcgatgagccctgatgcgcaggacggccattag

SEQ ID NO: 28648 - DNA, 420 bp, Artificial Sequence
  Description of Artificial Sequence: Synthetic coding sequence
atggacggaaggacgcctcgtccccaggacgcacctgccagaaggaagcccaaagccaaggcacctcttccccccgccgagacgaaatatacggacgttagctcggctgcagattccgtggaatcgacggcatttattatggagcagaaagaaaatatgatcgacaaggatgtggagttgagcgtggtccttccaggggacattattaaaagtacgactgtgcacggtagcaaacccatgatggacctgctgatcttcctgtgcgcacagtaccacctgaatccttcttcttacaccattgacctcttgtctgctgaacagaatcacataaaattcaagccgaacacgccaataggtatgctagaggtggagaaagtgatactgaaaccaaagatgctcgacaagaagaagcccacttag

SEQ ID NO: 28649 - DNA, 474 bp, Artificial Sequence
  Description of Artificial Sequence: Synthetic coding sequence
atggatggtagaaccccacgcccccaggatgctccagcacggaggaagcctaaagctaaagctcccctgccccccgcggagacaaaatacacggatgtatcaagcgcagccgatagtgtggagagcaccgcgttcatcatggaacagaaggagaacatgatcgacaaggatgttgagctgagcgtcgtgttgccaggcgatattataaagagtaccacagtccacggaagcaaacctatgatggacctgctcatcttcttgtgcgcccagtatcacctcaatccttcctcctatacaatcgatctgcttagtgctgaacagaatcatattaagtttaaacccaatactccgatagggatgctcgaagttgagaaggtaattctaaaacctaagatgctggataaaaagaaaccgaccccaattatcccagagaaaactgtgagggtggtcatcaacttcaagaagacccaatag

SEQ ID NO: 28650 - DNA, 1080 bp, Artificial Sequence
  Description of Artificial Sequence: Synthetic coding sequence
atgtactttaagcgcgcccctcgggcctttccagtgctactgacaggggcaggaaagaccaccctgctgaattacattcttactgagcagcattccaaacgcgtggcagtgattctgaatgaatccggggaaggtagcgcccttgaaaaaagcctcgctgtgagtcagggaggtgagctatacgaggaatggcttgaactgcggaatggctgtctttgttgctcggtgaaggacaacggtctgcgtgctatcgagaacctcatgcagaagaagggcaagtttgacgacatcctcttggagacaaccggactcgcagatcctggtgctgttacatcaatgttctgggtcgatgcagaactcggctcagatatttaccttgatgggattatcactatcgttgattccaagtacggcttgaaacacctgactgaagaaaaacctgacggactgattaatgaggccacaagacaagttgccttagcagacattattctgattaataaaactgacctcgtgccagaggaagacgtcaaaaaattgaggacaaccattagatccatcaacgggctgggccaaatactggaaacccagcgatcccgggtggacttaagcaacgtgttggacctgcacgctttcgactccctgtctggcatcagccttcaaaagaaactgcagcatgtcccgggcacccagcctcacctagatcagtccatcgttactatcactttcgaggtgccaggcaacgccaaggaggagcacctgaacatgtttatccagaatctcctatgggagaagaatgtccgaaacaaggataatcactgcatggaggtcatacgcctgaagggcttggtttctatcaaggacaagtctcagcaggtcatagtgcaaggagtgcacgagctgtatgatttagaggaaactccagtctcatggaaggacgacaccgaaagaacaaaccggttagtgctcattggccgcaatctggacaaagacatcttgaaacagctgttcattgcaaccgttactgagacagaaaaacagtggaccacccatttcaaagaggaccaagtctgtacatag

SEQ ID NO: 28651 - DNA, 1188 bp, Artificial Sequence
  Description of Artificial Sequence: Synthetic coding sequence
atgctgcctgccgtgggctcagtggatgaggaggaggaccctgctgaggaggattgcccagaactcgtccctattgaaaccacccaaagcgaggaagaggagaagagcggattaggggccaaaattccagtgaccattatcaccggctacctcggagcaggcaagacaactctgcttaactatattctgacagaacaacactcaaagcgggtggcagttattcttaacgagtctggcgaggggagcgctctggagaagagtttggccgtgtcacagggtggggagctttatgaagagtggcttgaactccgcaacggatgtctctgctgttccgtgaaggacaacggcctgagggcgatcgaaaatctaatgcagaagaagggcaaatttgatgacatactgctggaaaccacagggttggctgaccctggggccgtgacgtccatgttctgggtggacgcggaactgggctctgatatctatttggatgggataattaccattgtggactcaaaatacgggcttaagcatctcacagaggagaagccagatggcttaataaacgaggccactcgccaagtcgctcttgctgacattatactcattaataagacggacctggtgccggaggaagatgtgaagaagttgagaacaaccatcaggtctattaacggtctgggtcagatcttggagacccagcgttccagggtggatctgtcgaatgtgctcgaccttcacgcctttgatagtctgtctggtatttctctccagaagaagttacagcacgtgcccggaacacagcctcacctagaccagagtatcgtgaccatcacatttgaagtgccagggaatgccaaggaagaacacttaaatatgttcattcagaacttactttgggaaaagaacgtcaggaataaggataaccactgcatggaggtgataaggctgaagggactcgtctctattaaggacaagtctcagcaagtgatcgtgcaaggcgttcacgaattgtacgatctcgaggagacccctgtttcttggaaggatgacaccgaacggaccaatcggcttgtgctgattgggcgtaatcttgataaggacatactgaagcaactattcatcgctacagtgacagagacagagaagcagtggactacccatttcaaggaggaccaggtgtgcacttag

SEQ ID NO: 28652 - DNA, 1044 bp, Artificial Sequence
  Description of Artificial Sequence: Synthetic coding sequence
atgctccccgcagtgggctcagttgacgaagaggaagaccccgcggaggaggattgcccggaactggttcccatcgaaacgacgcagagcgaggaggaggagaagtcaggcctaggggccaagatccccgtgactattatcacaggctacctgggggctgggaagacaaccctgttgaactacattcttactgagcagcacagcaagcgggttgccgtgattctgaatgagtcaggtgaagggtccgctctggagaagtccctcgccgtcagccaaggtggcgaactatacgaagaatggctagaactacggaacgggtgcttatgttgtagcgtaaaggacaatggcctccgcgcgatcgaaaatctgatgcaaaagaaaggaaagtttgatgatattctgttagagactacaggattggctgacccaggagcagtgacaagtatgttctgggtagacgccgagctgggaagcgatatctatttggacggcataattaccattgtagacagtaaatacggcctcaaacacctgactgaggaaaaacccgacgggctcatcaatgaggccactaggtccataaacggactggggcagatcctcgaaacccagaggtctagtcttcaaaaaaaactgcagcatgtgcctggaacccagcctcacctggatcagagcattgtgaccataactttcgaagtgcccgggaatgccaaggaagagcacctgaacatgttcatacaaaatttgttgtgggaaaagaatgttagaaataaggacaatcactgcatggaggtcattagactgaaaggcttagtgtcaataaaagacaagagtcaacaagtgatcgtgcaaggcgtccacgaactgtacgacttggaggagactccagtgtcctggaaagacgacactgagagaacgaataggctggtattaattgggcgtaacttggataaagatatcttgaagcagcttttcatcgccaccgtaacggaaactgaaaagcagtggacaacccatttcaaggaagatcaggtgtgcacgtag

SEQ ID NO: 28653 - DNA, 249 bp, Artificial Sequence
  Description of Artificial Sequence: Synthetic coding sequence
atgctgcctgctgtcgggtcagtggatgaggaggaggacccggcagaagaggattgccccgagttggtaccaattgagacgacacagtctgaggaggaggaaaagagcggactgggagccaagatccccgtgactataatcacaggttacttgggtgccggtaagacaactctattgaactacatcctcaccgaacaacattccaagcgggttgctgtgatccttaatgagtccggggaaggaaagtag

SEQ ID NO: 28654 - DNA, 342 bp, Artificial Sequence
  Description of Artificial Sequence: Synthetic coding sequence
atgctgcctgccgtcgggagtgtagatgaagaagaggaccccgctgaggaagattgccctgaactggtcccaatcgagacaacccagtccgaggaagaggaaaagtctggtctcggggccaaaattccggtaaccatcatcaccgggtatttgggcgctggtaaaaccacccttttgaactacatcctaactgagcaacactccaagagagtggccgtgatcttgaacgagagcggagagggaagcgctctcgaaaagtcccttgccgtcagtcagggtggcgaactgtacgaagaatggctcgagctcaggaatggatgtctgtgttgttcagtgaaatag

SEQ ID NO: 28655 - DNA, 729 bp, Artificial Sequence
  Description of Artificial Sequence: Synthetic coding sequence
atgctccccgcggttggttctgtggatgaggaggaggatcctgccgaagaagattgccccgagctcgtccccattgaaaccactcagagcgaggaggaggagaagagcggtctaggcgcgaaaatcccggtaactataattaccggctatttgggggccgggaaaaccaccctgttgaactatatactcacagaacagcactcaaagcgcgtggccgtcattcttaacgagtctggtgagggctctgccttggagaaatcactcgctgtgtcacagggtggcgagctgtatgaggagtggctggagctccgaaacgggtgtctgtgttgcagtgtcaaggacaatggcctgagggctattgagaacctcatgcagaagaagggtaagtttgatgatatactccttgagacaacaggtttggccgatcccggggctgtggcctcaatgttttgggtagacgctgaactaggaagtgacatctatctggatggaattatcacaattgtcgatagcaagtacggtctcaaacatctgaccgaagagaagcctgacggcttgattaatgaagctacaaggcaagtggctttggctgacatcattttgatcaataagaccgatctcgtccctgaagaagacgtgaaaaaactgagaaccacgctgaggtataaaatgatgtgcgtcaagtgccttcagattcatatcgtgtataccgagtgcttcttactgtag

SEQ ID NO: 28656 - DNA, 1080 bp, Artificial Sequence
  Description of Artificial Sequence: Synthetic coding sequence
atgtattttaagagagctcccagggcgttccctgtgctgttaaccggcgcgggaaagacaactcttctgaattatattctcaccgagcaacactcgaagagagtggcggtgatcttgaacgaaagcggtgaaggttccgcactcgaaaagtctttagcagtttcgcagggcggggagctgtatgaagagtggcttgaactgagaaacgggtgtctgtgctgttctgttaaagataatggcttacgggccattgaaaatctcatgcagaagaaaggtaagttcgatgatatcctgctcgagaccaccggccttgccgacccaggcgctgtcgcttcaatgttctgggttgacgccgagttaggatccgatatctatctcgatgggattattaccatagtggatagtaagtatggactcaagcacctcacagaggagaaacccgacggcctaatcaacgaagcaacccggcaggtcgccctggccgatataatacttatcaacaaaaccgatctggtgcccgaagaggacgtcaaaaagttgcgaacaacgctcaggtctatcaacgggctaggacagatcctcgaaacacagcgcagtcgcgtggatctaagtaatgtcttggatctgcatgcattcgatagcctgtccgggatctctctacaaaagaagctccagcacgtgcccgggacacagcctcatcttgaccagagcatcgtgaccatcaccttcgacgtccccggcaatgctaaggaggagcatctcaatatgtttatccagaatctgctgtgggaaaagaatgtgcgtaataaagacaaccactgtatggaagttattagattgaagggactggtgagtatcaaggataaatctcaacaggtgattgtgcaaggagtccacgaactgtgcgacctggaggaaacccccgtttcctggaaagatgacacggagagaacaaaccgcctggtcctcatcggacgtaacctggacaaggacatactgaagcaactgttcatcgccaccgtgacggagaccgagaaacagtggacgacccactttaaggaggaccaagtgtgcacttag

SEQ ID NO: 28657 - DNA, 1044 bp, Artificial Sequence
  Description of Artificial Sequence: Synthetic coding sequence
atgttgccagccgtagggtcagttgatgaggaagaagatccggccgaggaggactgtccagagctggtccccatcgaaaccacccagagtgaggaagaggaaaagagcggattgggcgcaaaaatacctgtaactataattaccggatacctgggagccgggaagacgaccctgctgaactatatactaaccgaacagcactccaagcgggtggccgttatattaaacgagagcggcgaaggaagtgctctggaaaagagtctcgcagtgagccagggcggcgaactctatgaggagtggttagagctgcgcaatggctgcctgtgctgcagcgtaaaggataatggtctgcgggcgattgagaaccttatgcagaaaaagggcaagttcgacgatatcctgctggaaacaactgggcttgctgaccctggggcagttgctagcatgttctgggtcgatgccgagctgggaagtgatatatatttagacggcataatcactatcgtggattcaaagtatggtctcaagcatctcaccgaggaaaaacctgatgggctgataaacgaagcgacacgcagcatcaacggccttggacagattctggagactcagcgatcatctttgcagaaaaaactgcaacatgtgcccgggacacaacctcatcttgaccagagtatcgtgactatcacattcgatgtgcccgggaatgccaaagaggagcatctaaacatgtttatccagaacttgctgtgggaaaagaacgtgcgaaacaaagataaccattgtatggaggtcattcggctgaagggacttgtctcaatcaaggataagtcacagcaggtcattgtccagggcgtgcatgagttatgcgatttggaagagacacctgtgagttggaaagatgacacggagagaacaaatcgcttggttctgattggtagaaacctagacaaggatattctcaaacagctgtttattgccaccgtaacagagaccgaaaaacagtggacaacccattttaaggaggaccaggtctgcacctag

SEQ ID NO: 28658 - DNA, 1188 bp, Artificial Sequence
  Description of Artificial Sequence: Synthetic coding sequence
atgctcccggccgtcggttctgtggacgaggaggaagatccggctgaggaggattgtccagagctcgtacctatcgaaactacgcaaagcgaagaggaggagaagtcagggctaggagcaaaaatccctgttacgatcattacagggtacttgggagcaggaaagaccacacttttaaactatatcctcaccgagcaacacagcaaaagagttgccgtgatcctgaatgagtccggcgagggctctgctctggaaaagtctctggccgtaagccaaggtggagagctatacgaggaatggctcgagctgagaaacggctgtctgtgctgtagtgtaaaagataacggcctgagggcgatagagaacctgatgcagaaaaaggggaagttcgacgacattctcctggagacgaccggtctggcggatcctggggccgtggcaagtatgttctgggtggatgcggaactgggaagcgacatctacctggatggaattatcacaattgtggactcaaaatacggtctcaaacacctaaccgaggagaagccagatggactgataaatgaggcaacccgtcaagtggcactcgcagacataatcctgattaacaagaccgatctggtgccagaagaagacgtcaagaagctgcgcacaaccctgcgtagcattaatggactggggcagatcttagagacccagaggtcccgtgtggatttgtcaaatgtgcttgatctccacgcgttcgactcgctgagcggaataagcctgcagaaaaagctgcagcatgtccctgggacacagccacacctagatcagtccatcgtgaccatcacctttgatgtacccggaaacgctaaagaagagcaccttaacatgtttatccagaatctcctgtgggaaaagaacgtgcggaataaagataatcattgcatggaggttatcagattgaagggcctggtctcaattaaggataagtcgcagcaggtgatcgttcagggagtccatgaactgtgtgacctggaagagactcctgtctcctggaaagatgacacggaacgtacaaacagactggtgctgatcggacgtaacctagacaaggatatcctcaagcagttatttatcgccaccgttaccgaaactgagaagcaatggactacacactttaaggaggatcaggtgtgtacatag

SEQ ID NO: 28659 - DNA, 1128 bp, Artificial Sequence
  Description of Artificial Sequence: Synthetic coding sequence
atgttgccagcggtcggaagtgtggatgaggaggaggaccccgccgaggaggactgcccggagctcgtgcccatcgagacaacccagagcgaagaggaagaaaaatccggtctcggcgccaagattcctgtgaccatcatcaccggctacttgggggcagggaagacaacgctgctaaattacatcctgactgaacaacactccaaacgggtagctgtaattctaaatgaaagtggtgaggggagtgccctcgagaagagcctggctgtctcccaggggggcgaactctacgaggagtggctagagctacgcaatggatgcctctgttgtagtgtgaaagataatggcctgcgcgcaatcgagaatctaatgcaaaagaaagggaaatttgatgatattctccttgaaacaacaggccttgcagacccagggattattacaatcgttgactcgaagtatggcctgaaacatctcactgaggaaaagcctgatggactgataaacgaagcaaccagacaggtggcactggctgacattattctcatcaacaaaaccgatcttgtgcccgaggaggacgtgaagaaactacggacaaccctccgcagtatcaacgggctggggcagattttggaaacccagagaagccgggtggatctgtctaatgttctcgatctgcatgcctttgatagcctttctggcatctccctgcaaaagaaacttcagcacgtccctggaactcagccgcaccttgatcagtcaattgtgaccatcacttttgacgtacccgggaacgccaaggaggaacacctgaatatgttcattcaaaatttgctgtgggaaaaaaacgtgaggaacaaggacaaccactgtatggaggtgatccggctgaagggactagtgagcatcaaggataagtcacagcaggtcattgtccagggtgttcacgagctctgcgacttagaggagacgccagtgtcttggaaggacgacacagagagaacgaacagattggtactcattggccgcaatttagacaaggatatcctgaagcagctattcatcgccaccgtcaccgagacagagaagcagtggaccacacacttcaaggaagaccaggtgtgtacctag

SEQ ID NO: 28660 - DNA, 282 bp, Artificial Sequence
  Description of Artificial Sequence: Synthetic coding sequence
tagttggatctacatgcctttgatagcctgtcagggatttctctccagaaaaaactccaacacgtgcccggtacacagccccacctggatcagtccatcgttaccataacttttgatgtgccagggaatgctaaagaagaacacctgaatatgttcatccaaaacttgctttgggaaaagaacgttcgcaacaaggacaaccactgcatggaggtgattcgcctaaaggtgcaattcacagttgcagacttttggacgaagtccttttcatggctgctttag

SEQ ID NO: 28661 - DNA, 543 bp, Artificial Sequence
  Description of Artificial Sequence: Synthetic coding sequence
atgcttccagcagtgggttccgtggacgaggaagaagaccccgccgaagaagattgccccgagctggtgccaattgaaactacccaatcggaggaagaggagaagtccgggctgggtgccaagattcccgttaccatcattaccgggtacctgggtgctgggaagacaacactgctgaactacattttgacagagcaacactccaaaagggtggcggtcattctcaatgaaagcggggagggttctgcgctggaaaaaagtctggcagtctcccagggcggagaactgtatgaagagtggctagaattgcgcaacgggtgcctgtgctgctccgttaaggataacggactccgggctatcgagaacctgatgcagaagaaaggtaagttcgatgatatcctgctggaaacaactggtctggctgatcctggcgcggttgcctcaatgttctgggtggacgcggaactcggttcagacatatacttggatggtattatcacaattgtcgacagcaaatacggacttaaggtttctcaccattag

SEQ ID NO: 28662 - DNA, 759 bp, Artificial Sequence
  Description of Artificial Sequence: Synthetic coding sequence
taagccgtgaccagcatgttttgggtcgacgcggagttgggctctgacatatacctggacggaatcattaccattgtggactcaaaatacggcttgaaacacctgaccgaggagaaacccgatgggctgatcaacgaggccaccagacaggttgccctggcagatatcattttgatcaataagacagatctggtgcctgaggaggacgtgaaaaagctgcgaactaccattcggagcatcaatgggcttggacagatcttggagacacagcgctccagggtggatctgtctaacgtgctagatctgcatgcctttgattccctgagcgggatctccttgcagaagaagttgcaacacgtccccggaacccagccacaccttgatcaatctatcgtgacaatcactttcgaggttccaggaaacgcaaaagaggagcacctaaacatgttcatccaaaatctcttgtgggagaagaacgtgcgaaataaagacaaccactgtatggaggttatccgactgaaaggccttgtgtcgatcaaggacaaaagccagcaggtgatcgtgcagggtgtgcacgagctttacgacctggaggagacacctgtgtcttggaaagatgatactgagcgcaccaatcggctggtcttgatcggccgaaatctggacaaagatatccttaagcagttgtttatagccaccgtgactgaaactgagaagcagtggaccacccatttcaaggaggaccaagtctgtacctag

SEQ ID NO: 28663 - DNA, 702 bp, Artificial Sequence
  Description of Artificial Sequence: Synthetic coding sequence
tgagccgtcaccagcatgttttgggtagacgccgagcttggctccgatatctatttggacggaataatcaccatcgtggactcgaagtatggacttaagcacttgactgaggaaaagccagacgggttgattaatgaagccactaggcaagttgccttggcagacatcattttgattaacaaaactgatctagttccagaagaagatgtcaagaagttaagaaccacaatcagatccattaatggtctagggcaaatcctagagactcagcgttcatccctgcaaaaaaaactgcagcacgtgcctggaacacagccgcacctcgatcaatctatagtgacaatcactttcgaggtacccgggaacgccaaagaagagcacttaaatatgttcattcaaaacttactgtgggagaaaaacgtgaggaataaggacaatcactgcatggaagtgatcaggctcaaaggactggtgtcgataaaagataaatcccagcaggtcatagtccagggggttcatgagctttatgacctcgaggagaccccagtctcctggaaggatgacacagaacggacaaaccggctggtactcatcgggcggaatcttgataaagacattctcaagcaactttttattgcaaccgtaaccgaaaccgagaagcagtggacaactcatttcaaagaggatcaggtgtgcacgtag

SEQ ID NO: 28664 - DNA, 420 bp, Artificial Sequence
  Description of Artificial Sequence: Synthetic coding sequence
tgagaagaggttcgtaaacgcgccatccgcatgttcaaaaatgagaaatcaatcgtgactatcaccttcgaggtccctggaaacgccaaagaggagcatttgaatatgtttatccagaacctgctgtgggaaaagaacgtccgcaataaagataaccattgcatggaagtaatccgtctcaaagggctcgtgtccatcaaggacaaaagccagcaggtgatcgtacagggcgtgcacgaactttacgatctggaggagacccctgtaagttggaaagatgatactgagaggacaaacagattagtactgatagggcgaaacctcgacaaagacatcctgaagcagctctttatcgcaaccgtaaccgagaccgagaaacaatggactacccattttaaagaggaccaggtgtgtacatag

SEQ ID NO: 28665 - DNA, 531 bp, Artificial Sequence
  Description of Artificial Sequence: Synthetic coding sequence
atgtacttcaccgaatttcccactgcacacgtgagcttcctgcccttccgcgtcgacctgtccaatgtgctagatttgcacgcttttgactcactgtctggcatctctctgcagaagaaactgcaacacgtgcccgggacccagccacacttggaccagagtatcgtgactatcacctttgaggtcccgggaaacgctaaagaggagcacctgaatatgttcattcagaacctcctctgggaaaagaatgtgagaaacaaagataaccactgcatggaggtgatccggcttaagggtctcgtttcaataaaggacaaaagccaacaagttatcgtgcagggtgtccacgaactctatgaccttgaggagacccctgtgtcatggaaggacgatactgagcgcacaaataggctggtgcttataggacgtaacctagacaaggacatattgaagcagctgttcatagcaactgttaccgagaccgaaaagcagtggacaactcactttaaagaagatcaagtttgtacctag

SEQ ID NO: 28666 - DNA, 2559 bp, Artificial Sequence
  Description of Artificial Sequence: Synthetic coding sequence
atgatgcccggcccaaggcccaggaaggggccacaagcacgcggccagggcgtagccgctgcgaaacagatggggttattcatggaatttggaccagaagatatgctcctagggatggacgaggcggaagacgatgaagatttggaggccgagcttttggcccttaccggcgaggcccagacgacagggaaaaagccagccccgaaaggccaggcccccctgcctatggcgcatatcgaaaaactggccgctgattgcatgcgggacgtcgaagaagaggaagaagaagagggacttgaagaggatgcagagttactgactgagctgcaggaagtgctcggtgtggatgaagagaccgagcccttagatggggatgaggtggcagaccccgggggaagtgaagaagaaaatggtctcgaggataccgagccaccagtgcagacagcagtactgacggcctcagcccctgccgcccaggccggagcctcgcaaggcctacacgcccttcttgaggaacggattcacaattacagggaggctgccgccagcgcgaaggaggccggtgaggcggccaaggcaaggagatgcgagcgcgggctgaaaacactcgaatcccagctagcctctgttagaagaggacggaagataaacgaagatgagatcccccctccggtggctttgggcaagagacccctcgccccgcaggaacctgcaaacagaagccccgagaccgaccctccggctcctccagctctggaatccgacaatccatcacagccggagaccagtctgcctgggatatctgcacagcccgtgtccgacctggacccagacccccgagctctgctttcatctaggcagagggaatacaaggtcgccgccctaagcgccaagcgggccggtgaattagatcgggcccgtgagcttatgcggattggaaagcgtttcggcgccgtactagaagctttagagaaaggtcagccggtggatctttccgcaatgcccccggcgcccgaagacctgaagccacagcaagcaagccaggcacccactgctccatcggtcattccaccagcagtggagagagtgcaacccgtcatggcgccagacgtccccgccacacctgtggcccctaccgaatcgcaaactgtgctggatgctctccagcagcgcctgaacaagtatcgggaggctgggattcaggcgcgcagcggaggtgacgaacgtaaggccaggatgcacgagcggattgctaagcagtaccaggatgccatcagggcacatagggccggtagaaaagtaaattttgcggagctacctgtcccgcccgggttccctcctataccagggctggaaagcactatgggggtcgaggaagatgcagtcgctgctaccttagcagcggccgagaagctcgcctctgcggaggacagcgcccctgccgacaaggacgaggatgagggggaaccaccagcgcaagctcccgttgcaaagaaacctgcgcgcccaaccgtccccagcagccagaggctgcctgagccacgcgcgagttcttctaaggaatctccctctccttcggtgcgggagcagctcgcgctactggaggctcgaaagcttcaataccaacgcgccgcattacaggccaagcggtcgcaggacctggagcaggctaaggcgtatctgagggtggctaagtggctcgaagcccagataattcaggcccgaagcggaagaccggtcgacctatcaaaggtaccttctccacttacggatgaagaaggcgacttcatcctgatccatcatgaagatctacgcctttcgcagaaagccgaggaggtctatgcccaacttcagaagatgcttcttgagcagcaggaaaagtgtttgctcttcagcaaacagttcatgcaccaggggaacgtcgcagaaaccacgcggttcgagaagctggcccaggacaggaagaagcagttggagatcttacagctggcacaggcacagggcctggatccccccacacatcatttcgagctcaaaacattccagaccgtgcggattttctctgaattgaactctacagagatgcatctcataatcgttcgcggtatgaacctgcccgccccacctggtgtgacccctgacgacctagacgcatttgtcaggttcgagtttcattaccctaacagcgaccaggcccagaagagcaaaacggcggtcgttaaaaacactaacagccctgaatttgatcagcttttcaagttaaacatcaacagaaatcacaggggtttcaagagggttattcaatcaaaggggatcaaattcgagatttttcacaaaggctccttctttcgcagtgacaaacttgtaggaactgcccacctaaaactggaacggctagaaaacgaatgcgagatcagagagatcgtagaagtgcttgacggacgcaaaccgaccggaggcaaactggaagtcaaggtgagactacgggagccattatccggacaggacgtccagatggtgaccgaaaattggttggttttggagcctcggggcctctag

SEQ ID NO: 28667 - DNA, 2268 bp, Artificial Sequence
  Description of Artificial Sequence: Synthetic coding sequence
atgagggatgtggaggaagaagaggaagaggaaggcctggaggaggacgccgagctcctaacagagctccaagaggtgctcggtgttgatgaggaaaccgagccactggatggggatgaagtggccgaccctgggggcagcgaagaggagaacggcctggaggacactgagcctcccgtgcagaccgcggtgctgactgctagtgcacctgccgcccaagcaggggcatctcaagggctccacgccttattggaggagcgaatccacaactacagagaggccgccgccagcgctaaggaagcgggagaggctgccaaggcaagacgttgcgagaggggccttaaaacactggagtcacagttagcaagcgttaggaggggtcggaaaatcaatgaagacgagattccgcctccggtggctctgggaaagcggcccctggcccctcaggagcccgctaacagatctcctgaaactgatccacccgccccccccgcccttgagtccgacaacccttctcagcctgaaacctcactgccaggaattagtgctcagcctgtctcagacctggacccagacccccgcgcgctgcttagctcccggcagcgtgagtataaagttgcagctctctctgcgaagcgggccggggaacttgaccgagcccgtgagctaatgcgaatcggcaagcggttcggggctgtgttagaggcactcgagaaaggacagcccgttgacctctctgccatgcctcccgcccctgaagacctgaagccccagcaggcttctcaggcccctaccgccccttcagtaataccccccgccgtcgagagagtccagcccgtgatggccccggatgtacccgcaacgccggttgctccaacggagtctcaaacggtgctggacgccctccaacaaaggcttaacaaataccgagaagcaggaatccaggctaggtctggaggcgatgaacgcaaggcacgcatgcacgaaagaatcgccaagcagtaccaggacgcaatacgagcgcacagagccggccgcaaggttaacttcgctgaacttcccgtcccccctggcttcccacccattcctgggctcgaatcaacaatgggtgtcgaggaggatgcagtcgccgctaccttggcggccgctgaaaaactggcgtcggccgaagattctgccccagccgacaaggacgaggacgagggggagcccccagcgcaggcgccagtcgcaaaaaagcccgcccgtccaaccgtgccttcctcacagcgcttgcctgagcctagagcaagttcgtctaaagagtcaccttctccaagcgtgcgagaacagctggccttgctcgaggccaggaagttgcagtatcagcgagcagcattgcaggcaaagcggtctcaggacctggagcaagccaaggcttatctgagagttgctaagtggctggaggctcagatcatccaggcaagatccggcaggccagtggacctgtccaaagttccaagtcccttgacagacgaggaaggagactttatcctgattcatcatgaggacctccggttatcccagaaagctgaagaggtctatgcccagctgcaaaaaatgttgctcgaacagcaggaaaagtgtctgctgttttcaaagcaattcatgcatcaaggcaatgtcgccgaaaccaccagattcgaaaagcttgcccaagacaggaaaaagcaactcgaaatcttacagctggctcaggcccagggattggatccccccacacatcacttcgagcttaagacattccagaccgtgcgcattttctccgagctcaactccacagaaatgcacctcataattgtacggggcatgaatctccctgccccccccggcgtaaccccagacgacctggacgcgttcgtgcgctttgagttccattacccaaattcggatcaggctcagaaaagtaagaccgccgttgtgaagaacactaattctcccgagtttgaccagcttttcaaactcaatatcaatagaaaccatcgaggctttaagcgggtgatacagtccaagggaattaaattcgagatattccacaaagggtctttctttcgatccgacaagcttgtgggaacggcacatctgaagcttgagcggctggagaatgagtgtgagatcagagagatcgtggaagtcctcgacggacgcaagcccacaggcggcaagctggaagttaaacctatggcatccacacgacgcggagtgaggccgagactgtgcaggaggtag

SEQ ID NO: 28668 - DNA, 372 bp, Artificial Sequence
  Description of Artificial Sequence: Synthetic coding sequence
atgatgccaggccccaggccgcggaaagggcctcaggcacgggggcagggggtagctgctgccaaacagatgggactcttcatggagttcggccctgaagacatgctgctcgggatggacgaagcggaagatgacgaagatcttgaagcagaactgctggccctaactggagaggcacagactactggcaagaaacccgcacccaaaggccaagcaccgctccctatggcccacatcgagaaactagcagccgactgcatgcgcgatgtggaagaagaggaggaggaggagggcctggaggaagatgccgggagagattgcgccggagacgactttcctagcttcgccggctttaggtccttgtgcacctag

SEQ ID NO: 28669 - DNA, 2577 bp, Artificial Sequence
  Description of Artificial Sequence: Synthetic coding sequence
atgatgccaggcccccgcccacgaaagggcccgcaggcccgtggacagggggtggccgccgctaagcagatgggactatttatggaattcggacctgaggatatgctgctggggatggacgaagcagaagacgacgaagatttggaggccgagttgttagctctcacgggcgaggcccagaccaccggcaagaaacccgcacccaaaggccaggctcctctccctatggcacacatcgagaaactggccgctgactgtatgcgagatgtcgaggaggaagaggaagaagaggggctggaggaagacgccgagctgctgaccgagctgcaggaggtcttgggcgtggatgaggagacagagccactagatggggacgaggtcgcagaccccggtggcagtgaagaggaaaacggtctggaggacacagaaccccctgtgcagactgcggtgctgaccgcatcagctccagccgcccaggccggcgcctcacaaggtctgcatgctctgttggaagaacgaattcataattaccgcgaagctgcggcctccgcaaaggaggccggcgaggcggctaaggcccgcaggtgtgagcgaggcctgaagacgttagagtctcagttggcttctgttcgacgtggaaggaagatcaacgaagacgagatccctcctccagtagcattgggaaaacgtcccttggcccctcaagaacctgcaaacaggagcccagagacggacccaccagctccacccgctcttgaatctgataatccgtcccaacccgaaacctctctcccaggcatctctgcacaacccgtgagcgacctggatcctgacccccgcgcactcctttcatctcgtcaacgcgagtacaaggtggccgcattatccgccaaaagggctggagagctcgatagagctagagaacttatgaggatcggtaaacggtttggggccgtcctggaagcactggaaaaagggcagccggtcgacctgtcagccatgcccccagcacctgaggatctaaagccacagcaggcatcccaggcacctactgccccgtctgtcatccctccggcggtggagcgcgtgcagccagtgatggctcctgatgtgccggccacccccgtcgctcctaccgagtctcagaccgtgctagatgccctgcagcagcggctgaataagtatcgggaggccggcatccaggcaaggtctggaggagacgagcgaaaagcccggatgcacgagcgaattgccaagcagtatcaagacgcgattcgagctcatcgtgccggcaggaaagtgaactttgcagaactgccggtgccaccaggattcccacccatcccagggcttgagtcaactatgggcgtagaagaggacgcagtagcggctacgcttgccgcagctgaaaagctcgccagcgccgaggatagcgccccagcagacaaggacgaggatgaaccccccggacacttgcagggagaaccgccagcccaggccccagttgcaaagaagccagcacgccccacagtgccgagctctcagagattgcccgaacctagggcttcttcatctaaggaatctccctcgccctctgtgagggagcagttagccctgctggaggcgaggaaattacagtaccaacgggctgccctacaggccaagcggtcacaagaccttgaacaagcaaaggcttacctccgggtagccaagtggcttgaggcccaaatcatacaagcaagatccggaaggcctgttgatctctctaaggtaccgagtcctttgactgatgaagaaggtgacttcattctaattcaccacgaggacctcagactgtcacagaaagcagaagaggtctatgcccagctgcagaagatgctcctggagcaacaggagaagtgcctgttattcagtaagcagttcatgcatcagggaaacgttgccgagactacccggtttgagaagctggcacaggatcgcaaaaaacagctggagattcttcaactggctcaggcacagggactggacccaccaacccaccacttcgaactgaagacctttcaaacagttcgaattttctccgagctgaattcaacggagatgcatcttatcatcgttcgggggatgaatctccccgcccctcccggcgtcactcccgatgacttggacgctttcgtgcgcttcgagtttcactacccaaactctgaccaggcgcaaaagagtaagactgcagtggttaaaaacacgaactccccggagttcgaccagctctttaagttgaacatcaacagaaaccaccgcggttttaaaagggtgattcagtctaaggggatcaaattcgagattttccacaaaggcagtttcttcagaagtgataaactcgtggggacagctcatttaaagttagagcgcctggaaaatgagtgcgaaattcgtgagatcgtagaagtgctcgacggcaggaaacccaccggagggaaactagaggtgaaagtacgactccgggaacctctgagcgggcaggacgtccagatggtgaccgagaactggctcgtcttggagccacgaggtctgtag

SEQ ID NO: 28670 - DNA, 1887 bp, Artificial Sequence
  Description of Artificial Sequence: Synthetic coding sequence
tagaagatcaatgaggatgagattccacccccagtcgcactggggaaaaggccccttgccccgcaggaacctgcgaataggagtccagaaaccgacccccctgcccctcctgccttggaaagcgacaaccccagtcagcctgagacctccctgcctggtatctccgcacaacctgtgagtgaccttgaccctgacccacgggctctgctttcaagtcgacagcgcgagtacaaggtggccgctctctcagccaagagagccggcgaactcgatagggcccgggaactcatgagaatcggaaaacgattcggggccgtacttgaggccttagaaaaggggcagcctgtggacctgtcggccatgccgcccgctcccgaggacctcaagccccaacaggcctcacaagctccaacagccccaagcgtgatcccacctgctgtcgagcgagtacaacctgtcatggccccagacgtaccagccactcccgttgctccgaccgaatcacaaacagtgcttgatgccttacagcagagactgaacaagtaccgcgaagcagggatccaggccagatctggaggcgacgaacgcaaggcaaggatgcacgagcggatagcaaagcaatatcaagatgccattcgggctcacagggctggtagaaaggtgaatttcgccgagttgcctgtccctccaggcttccctcctattcctggtctggagagcaccatgggagtggaagaagacgccgtcgcagccacactggccgccgcagaaaagctggcttccgctgaagactccgcccctgcggataaggatgaggacgaaggggagcctcccgcacaagctcccgtagcaaaaaaacccgcccgcccgactgtgccctcaagccaaagattacccgagccccgcgcgtcgagttccaaagaaagtccttcccctagcgtcagagagcagctcgctctcctggaggccaggaagcttcagtaccaacgcgccgcccttcaggccaagaggagccaggacctggagcaggccaaggcgtatctgcgggtcgccaagtggctagaggcccaaattatacaggcgcgatctggcaggcccgtggacctctctaaggttcctagtcctctaacggacgaggaaggagatttcattctgatacatcatgaggacctccgccttagccagaaagccgaagaggtgtatgcccagctccagaagatgctgctggaacaacaggaaaagtgcctgctgttctcaaaacagttcatgcatcagggcaacgttgcggagaccacaaggttcgaaaagctcgcccaggatcgcaagaaacagctcgaaattctccaactagcccaggctcagggcctggacccccccacccaccactttgagttaaaaactttccaaactgtgcgcattttttccgaattgaattccacggagatgcatctgatcatagtgcgcgggatgaatctgcccgcaccacccggggtcactccggatgacctggacgcctttgttcgctttgagttccattatcccaactcagaccaggcccagaagtctaaaacggcggtcgtcaaaaacaccaactccccagagtttgatcaacttttcaagctgaacataaacaggaaccaccgagggtttaagcgtgtgatccagtctaagggcatcaaattcgagattttccacaaggggagcttctttcggtccgacaagttagtgggaaccgcgcacttgaagttggaaagactggagaatgaatgcgaaattagagaaatagtagaagtgctcgacggtcgaaagcccaccggcggaaagttagaagttaaaccgatggcttcaactagacgcggcgtgcgccctagactttgcaggcggtag

SEQ ID NO: 28671 - DNA, 645 bp, Artificial Sequence
  Description of Artificial Sequence: Synthetic coding sequence
atgctgctcgagcagcaagagaagtgcctactcttctccaaacagtttatgcaccaaggcaacgtcgccgagaccaccaggtttgaaaaacttgcacaggaccgcaagaagcagctggagatcctgcagctcgcacaagcccaaggcctggacccccccacacaccacttcgagctaaaaacctttcaaaccgtgcggattttttccgagctgaacagcactgagatgcacttgatcattgtgcgaggcatgaatttacctgcgccccccggggtcacaccagacgacctggacgctttcgttagatttgagttccactacccaaatagcgatcaggcacagaagagcaagaccgccgtagtcaagaatacgaactctcccgaatttgatcagctcttcaaactgaacatcaaccgaaaccatagaggatttaaacgagtgattcaatccaagggcataaaattcgaaatctttcacaagggtagctttttccgctctgacaagctggttgggacggcccatctgaagttggagcgcctggagaacgagtgcgagataagggagatagtggagatggagcggttcagacgctccgaaaagtcgcaccgaggcacacaggagaaagcagcctccctcttcccctag

SEQ ID NO: 28672 - DNA, 2319 bp, Artificial Sequence
  Description of Artificial Sequence: Synthetic coding sequence
tagactactggaaagaaacccgcccctaagggccaggcccccctacccatggcccatattgaaaaactcgctgctgattgcatgcgggatgtggaagaagaggaggaagaggagggacttgaggaagacgctgagttactcaccgagttgcaggaggtgctgggtgtggatgaagaaactgagcccttagatggagacgaagtggctgaccccgggggctcagaagaagagaacggtctggaggatacagagcccccagtccagaccgccgtacttaccgcgagcgcacctgctgctcaggcaggtgcatctcagggtctgcacgcccttctggaagaacgtattcataactacagagaagcagcagcttcagctaaagaggctggagaggccgcaaaagcacgacgatgcgaaaggggcctaaaaactctcgaatcacagttagcgtccgtgcggcgtggcagaaagattaatgaagatgagatcccaccccccgtggccctgggcaagcggccattagccccacaagaacctgccaaccgctcacccgaaacagacccaccagctccaccagcactggaatctgacccagatcccagggcactactttctagtagacagagggagtataaggtcgctgcgctgtcagccaagcgcgcaggagagctggaccgggcccgcgaactcatgagaattggaaagcgatttggagccgtgctggaggctctggaaaaaggacagcccgtcgatttgagcgccatgccaccagcccccgaggatttgaagccacaacaagcttcccaggcccccacagcaccctctgtaatcccccctgcggttgagagagtacagcctgtgatggcacccgatgtgcccgccacgccggttgctcccaccgagagccagacagtactggacgcattacagcagagactaaacaaatatcgtgaggctggcatccaggcccgaagtggaggagatgagagaaaagctaggatgcacgagcgaattgctaagcagtatcaagacgccattagggcacaccgggcgggtagaaaggtcaatttcgcagagttgcccgtgcctcctgggttcccgcccattcccggccttgagtctacaatgggcgtggaggaagatgccgtggccgccacactggcagccgccgagaaactggccagcgctgaggacagcgcccctgcagacaaagatgaggacgagggcgagccaccagcacaggctcccgtggcaaaaaagcctgcgaggccaacggtcccctccagtcagaggttaccagagccaagagcttccagctcaaaggaatcgccaagtccatctgttagagagcagttagcattgctggaggcccggaagctccagtatcagagagccgccttgcaagccaagagatcgcaagatcttgagcaggctaaagcatatctgagagtggcgaagtggctggaagcccagatcatccaggcaagatccggcagaccagtggatttgtctaaggtgcctagcccactgacagatgaggaaggtgatttcatcctgatccatcacgaagatctacgactctcgcagaaagctgaggaggtctacgcccaacttcagaaaatgctcctggagcaacaagagaaatgcctgttgttttcaaagcaatttatgcatcagggaaacgtcgccgagacaaccagattcgagaagctggcccaggatcggaagaagcagcttgaaatactgcaactcgcacaggcccagggactggatcccccgacacaccacttcgagttgaaaacatttcagactgtgcggatctttagtgaactgaacagcacagagatgcacctgatcatcgtgcggggaatgaatcttcccgctccacccggcgtgacaccagatgacctcgatgcattcgtccggttcgaatttcactaccccaatagtgatcaggcacagaagtcaaagaccgcagtagtcaagaatactaatagcccggagttcgatcagttgtttaagctgaacattaacaggaatcaccgggggtttaaaagagtgatacagagtaaaggtattaagtttgagatctttcacaagggcagtttcttccggtccgataagcttgtggggacagctcacctgaagcttgagcgccttgaaaacgaatgtgaaatcagggagattgtggaggtcctggacggaagaaaacctacaggcgggaaactggaggtaaaggtcaggctgagagaaccacttagtggacaggatgtgcagatggtcacagaaaattggttggtcctagaaccgaggggcctctag

SEQ ID NO: 28673 - DNA, 969 bp, Artificial Sequence
  Description of Artificial Sequence: Synthetic coding sequence
atgatgaccgaaaagcatgaggatcattgtctgaagagctgctctggacactcatacatccggaagaattggctcggatgcattgtcttcccatttagtgcgctcttgcaacagtcagagtttctagatcagaccgaagtgctccagagggcccagatattcaaaaagaattgcaaggccatgtttcctaataggcggatcgtgacaacggttttcaatgacgaggggattcaattcctcgtcacgcgctacattaaagctttgaacccacctcagcagctgctcgatatcttcctgcacaattcaaatgccacatttgatttgattgcgcgctttgtaagcttgatccctttcgtgcctaatacccctgacgagaatgacggcagcgacatttggatgactagcgaacactgtatatccctggcaattggtaacaaggaggagcatgctatactgctgtgtaattttttcttatacttcggcaagaaggccctcgtgctgttgggaacatctgtgcttgaaggacatgtcgcgtacgttgtcactcaggagacaaatgaatatctgttgtggaacccttctactgggcagtgctacaagcagttcgatcccttctgtcccttgaagagcgtcgattgcttgttcgacgacagaaacgtatggttcaatatccagcagaacaacacaccaatggctgttttttttgattattccaaggagtcattttggaagcagctactccccaaaaacgtgcaaggtaccaaaattcagtctatccaggttactggattcccaatccagatgccttatatagacgttcagagcatcatcgacgccgtgtaccagaccgggatccacagtgcggaattccctcaaaccgagttcgctctcgcagtctacattcatccataccctaacaatattctcagcgtctgggtttacctggctagcctggtgcagcaccagtag

SEQ ID NO: 28674 - DNA, 417 bp, Artificial Sequence
  Description of Artificial Sequence: Synthetic coding sequence
atgcccacatgcctcaagagttctatctcttgcctacgacacagagagactatcaaatctgttgcctccgatgagacgctgcacgaggatacagttcatcccttcgtggaggtcagcttccagcacactgtttataaaacaaataccgcgagcggtagtcatccctgctggaacgaagagattaaggtggatttcgtgtcacctggtcacgactatagcttcagctcattgagtaaaatcaaagacaatatttacatcaacatcttcgacgaaatgatgaccgagaaacatgaggatcattgcctcaaatcctgtagtgggcatagttatatccggaaaaactggctggggtgtatcgtgttcccattttcagccttgctccagcagtccgaggatagaaaggatagtgaggagtag

SEQ ID NO: 28675 - DNA, 1206 bp, Artificial Sequence
  Description of Artificial Sequence: Synthetic coding sequence
atgatgaccgagaagcacgaggaccattgcctgaagagctgtagcggacactcatacatccgcaagaattggttagggtgcatcgtcttcccttttagtgctctgctgcagcagagtgagtttcttgaccagacagaagtgctacagagggctcaaatcttcaagaaaaattgcaaagccatgtttcccaaccggcgcatagtgaccaccgttttcaacgacgaggggatacaattcctcgtaacccgctatatcaaggctttgaaccctcctcagcaactgcttgatatctttctacacaattctaatgcaacattcgaccttattgcccggtttgtcagcctaattcctttcgtgcccaacacccccgatgagaacgacggctcggacatctggatgacatctgaacactgtatatcactcgctatcggaaacaaggaagagcatgccatcttgctgtgtaacttctttctgtactttggaaaaaaggccctggtgctcctcggaacgtcggttctggagggtcacgtcgcatatgtcgtcacccaagagacaaacgaatacctgctgtggaatccttccaccggtcagtgctataaacagttcgaccctttctgtcctctgaagagtgtggattgcctgtttgacgacagaaatgtgtggtttaatatccaacagaacaacactccgatggcagtgttttttgattacagcaaggaaagcttctggaaacagctgcttcccaagaacgtgcaggggacaaagatccagtcaatacagcccgaagagatcatttattttgagaccgataagagtatggtcgaagacctgcgtaaccgaatcgagcggacgctgaagagcaaggttatggaatggaggcccaagcacccaacacactggaataggcagtgcactttcatcctccggcaaattctgccaaagctggaatttgggattggctccttcgtttcatcagaaggagataacgaattcgagcgcatactgcagttctattgggttactgggttcccgatccagatgccgtacattgacgtgcagagcattattgatgctgtgtatcagacaggcatacactctgcggagttcccacagactgaattcgcattggctgtctacattcatccctacccgaacaacattctgtcagtgtgggtctacttggcctccctcgtacaacaccagtag

SEQ ID NO: 28676 - DNA, 1653 bp, Artificial Sequence
  Description of Artificial Sequence: Synthetic coding sequence
atgagccacgggcctagccctaggctggcagagtcgccccagttaagcaagggaagcctcctaaccatactgggctcgccaagccccgagcgtatgggacccgccgattcacttcctcccacaccaccttccggtaccccctccccaggtcctccgccagcactgccgctccctccagctcccgctctgctggcagacggagactgggagagccgggaggagcttaggttgagggaactggaggaagctcgtgctcgagctgctcaaatggaaaagactatgagacgctggtccgattgcaccgctaactggagagagaaatggtcaaaagtgagggccgaacggaacagagcccgggaagaagtgagacagcttcggcagcgcttggatgctttgactaaggagctcgccggggctcgccgtgaacggcaggaggcccagggagagtgtgaggcccgaggacgggaactggccaggctccgtggcgcccgcggcgtggctgatcagacccgtgacggccccgagccagaggcagaaagggagcctgtgcgcgacgttgggagcgagcggccaccaggttcccaggagctggagctagtagagtctctcttgaaaagcatgccagaggagagtgaggactgctgggaggcccgatccctcggcgcaggtggcccccgagggtctagcggcagacaggagcgatccaggctgccatgggaggacactgcagctactgaggaggaagcatccaagctgaccgccttgagactccggctggatgaaagccagaaagttctgttgaaggaaagggaggataaacttgctctcagccgcaatatcgaaaagttagagggggagctgagccagtggaagattaagtatgaagaactttcgaagacgaaacaagagatgctgaaacagttaagcatccttaaagaggcccaccaggatgagctggggcgtatgtctgaagatctggaagacgaacttggcgcccggtccagcatggaccgcaagatggccgagctgaggggcgagatggaacgtctgcaggcagaaaatgcagcagagtggggcagacgcgaaagactcgaaacagaaaaattggggcttgagcgagagaataagaagttgcgggcacaagtgggcgacctggaggaggccctagctagaaggcggagacagactgccagcgcactggactgcgacctccgcgcatcccaagcagccctttttgagaagaataaagagctggctgacttgaaacacgtccatggcaagctaaaaaaacagttccaagaaaaggtcgcagagctggctcacgctaacaggcgagtcgagcagcatgaggccgaggtgaagaagcttagattgagggtcgaagaacttaaaaaggagctcgctcaggcagaggacgaacttgacgaggcacacaaccaggcccgcaaactgcagcgaagcctggatgaacagactgaacagtcagagaaccttcaggtccagttagaacacctccagtcccgcctacggagacagcaacagaacgcgcccctgttcggcaagattcggtccgcaaggttcggaacggaagaggccgaggatgggacctcagacctggacgaggacgaagacctacagattcaggtggcctag

SEQ ID NO: 28677 - DNA, 1542 bp, Artificial Sequence
  Description of Artificial Sequence: Synthetic coding sequence
atgaatctcgattctatacaccggctgattgaagaaacacagatcttccaaatgcaacagtcttcaataaagagcaggggtgatatggtcgcccctgccagcccaccccgagacacctgcaacacctgttttcctcttcatggacttcaaagtcacgccgcacataacttctgtgcacactcctacaatactaacaagtgggacatctgtgaggaattgcgccttcgggagctagaagaagtcaaagccagagctgcgcagatggagaaaactatgcgctggtggtcagattgcacagccaactggagagaaaagtggagtaaagtccgcgccgagcgaaactctgcacgcgaggagggacggcagctgcggattaaacttgagatggcaatgaaagagcttagcaccctgaaaaaaaaacaatctttgcctcctcagaaggaggcactagaggccaaggtgacccaagatttaaagcttccaggttttgtggaggagtcttgcgagcataccgaccagttccaactatcaagccaaatgcacgaatcaatcagagagtacctggtgaagcggcagttcagcacaaaggaggacaccaacaataaagagcagggagtggtgattgacagtctgaaactgagcgaggaaatgaaacctaatctcgacggagtggacctctttaataatgggggatccgggaatggcgagaccaagactggcctgcggctgaaagcaatcaacctgccactcgagaatgaggtaacggagattagcgccctccaggtccatctagacgaatttcaaaagattctgtggaaggagcgagagatgcgcactgccttggaaaaagagattgagcgccttgagagcgctcttagtttgtggaagtggaaatacgaggaattaaaggaatctaaaccaaagaacgtgaaggaatttgacattctcttggggcagcacaacgatgaaatgcaggaactgagcggtaacattaaagaggaatctaaatctcagaacagcaaggacagagtcatctgcgagctgcgcgctgagcttgagcggctgcaagccgagaatacgagcgaatgggataagcgagaaatcttagagagagagaagcagggactggagagggaaaatcgccggctgaagatccaagtgaaagagatggaagagctgctggataaaaaaaatagattatctgcgaatagccagtccccagactttaagatgtcacaaatcgacctccaagagaagaaccaggagttgctgaacctgcagcatgcttactacaaattaaacaggcaatatcaggctaacattgccgagttaacccatgcaaataaccgggtggatcagaatgaggcagaagttaaaaagctgcgtctaagggtggaggagctcaaacaaggactgaaccagaaagaggacgaactggatgacagcttgaatcagattagaaaactgcagagatcattagacgaggagaaggaaaggaacgaaaacctcgagacagagctaagacacctgcaaaactggtag

SEQ ID NO: 28678 - DNA, 1275 bp, Artificial Sequence
  Description of Artificial Sequence: Synthetic coding sequence
atgaatttggattccatccatcgcttgatcgaggagacccagatatttcagatgcagcaaagctccattaagtccaggggggacatggtcgcaccagcttctccacccagggatacctgcaacacctgctttcctctccacggcttgcagagccacgccgcacacaacttttgcgcccatagttacaacaccaacaaatgggatatttgtgaagaactgcgtttaagagagcttgaggaggtgaaggctagagctgcacaaatggagaagactatgcgttggtggtccgactgtacagccaactggcgggagaaatggagtaaggttcgagccgagaggaacagcgccagagaggagggccgacaactaagaatcaagttggaaatggccatgaaagagttgtctacgctgaaaaagaagcaatccttgcccccccagaaggaggccttagaggctaaagttactcaagatttgaagctccctgggttcgtcgaggagagctgtgagcataccgatcagttccagctctcgtcacagatgcacgaaagtatacgggaatacttggtgaagcggcaattcagcactaaagaagataccaataataaggagcaaggagtggttatcgactcgctgaagcttagtgaggagatgaagcccaacctggatggggtggatctctttaataacggcgggagtggcaacggggagacgaagacagggttacgcctgaaggctataaatcttcccctcgagaatgaggtgaccgagatttctgccttgcaggtccatctggacgagtttcaaaaaatcttatggaaggagcgggatttgtcattcaagtctctgaagatcgtaaatacggatcggctgaatgcacacagctttggcaaaagaaatcgtgaaactggcgtgggctttgttagcgtcgaagtcgagttcgatatactgctggggcagcataatgatgagatgcaggaattatctggaaatattaaagaggagtcaaagtctcagaacagcaaagatcgggtaatctgcgagctccgagcggagcttgaaaggctgcaggccgaaaacacatctgagtgggacaaacgtgagatactggaacgggagaagcaaggtctagaaagagaaaacagaagactgaaaatacaggtgaaggagatggaggagctgctggacaaaaagaatcgcctgtcggctaacagccagtctccagacttcaagatgtctcaaatcgatttgcaagaaaagaatcaagacgtaaaatag

SEQ ID NO: 28679 - DNA, 1542 bp, Artificial Sequence
  Description of Artificial Sequence: Synthetic coding sequence
atgaacctggattcaatacatagactcattgaggagacccaaatcttccaaatgcaacaatcttccattaagagcagaggcgatatggtggccccggcgtcaccgccaagggacacttgtaatacatgcttcccgctccacggccttcaatctcacgcagcccataatttttgcgcacattcctataacacaaacaagtgggacatttgcgaggaactcagactcagggagctggaggaagtcaaggccagagccgcccagatggagaaaaccatgcggtggtggtccgattgcaccgccaattggagggagaagtggtccaaggttagggccgagcgcaattcagcacgcgaagagggtaggcagttgcgcatcaaacttgaaatggccatgaaagagttatccaccctgaagaaaaaacagtccctgcctccacagaaagaggcactggaggccaaggtcacacaggatctaaaactcccaggcttcgtagaagaaagctgcgagcacacagatcagtttcaattgtcctctcagatgcacgaatcaatcagggagtacctcgtgaaacggcaattttcaactaaagaggacaccaataacaaggaacaaggagtcgtcatagactctctcaaactcagcgaggaaatgaagccgaatctcgacggcgtcgatttattcaataatgggggaagcggcaacggggaaactaagaccggtctgcggctgaaggccatcaatctaccgctcgagaatgaggtaaccgagattagtgctctgcaggtccatcttgatgagtttcagaagattctgtggaaggagagagaaatgaggacggccttggaaaaggagatcgagagactagaatcagccctcagcctctggaagtggaaatatgaggagctgaaggaaagtaaacccaagaatgtgaaggaatttgatatcctcctgggacaacacaatgacgagatgcaagagcttagtggtaatatcaaggaggagagtaaatcccagaactcaaaggatcgcgtaatatgtgagctgagggccgaattggagcggttacaggccgaaaacactagtgagtgggataagcgcgaaattcttgagcgcgaaaaacagggcctggagcgcgagaacaggaggttaaagatacaagtaaaggagatggaagagctgctcgataagaagaataggttatccgccaacagtcagagtcctgattttaagatgtctcaaatcgacctgcaggagaaaaatcaggagttacttaatcttcagcatgcttattacaaactcaacaggcagtaccaggctaacatcgccgagctcactcatgcaaacaaccgcgttgaccaaaacgaggctgaggttaagaaactgaggttacgggtcgaagaactgaaacaggggttaaatcaaaaggaggatgaacttgatgactccctgaaccagatcaggaaactacagcggtcgctggatgaggaaaaggagcggaacgagaacctggagaccgagctcagacatctacagaattggtag

SEQ ID NO: 28680 - DNA, 714 bp, Artificial Sequence
  Description of Artificial Sequence: Synthetic coding sequence
atggagagaaacgatatcatcaacttcaaggccttggaaaaagaattgcaggcagccctgaccgccgacgagaaatacaagcgcgaaaatgccgcaaagttgcgagccgtggagcagagagtggcttcctatgaggaattccgaggcatcgtattggcctctcatcttaagccattagagcgtaaggacaagatgggtggcaaaagaacagtgccctggaactgtcatacaatacagggccggaccttccaggatgtggcaacagagatctcccccgaaaaagcccctctacagccagagacgagcgccgacttctaccgcgattggcgtcgacacctaccttctggccccgagaggtaccaggcgttgctacagctcggcggacctaggttgggctgcctgttccaaaccgatgtcggattcgggctgttaggagagctgttggtggctctcgcggatcacgtgggccccgcagatagagccgctgtgctcggcatcctgtgttccctggcgagtaccggtcgatttaccttaaacctgtcccttctgtcaagagcagaaagggaatcatgcaaaggactgtttcagaagctgcaggccatgggcaatccaagatctgttaaggagggcctttcttgggaagagcaaggattggaagagcaatccggcgggctccaagaggaagaaagactactgcaggaactgcttgaatag

SEQ ID NO: 28681 - DNA, 729 bp, Artificial Sequence
  Description of Artificial Sequence: Synthetic coding sequence
atggaacgaaatgacatcatcaattttaaagctctggagaaagaactccaagctgcacttaccgccgatgaaaaatataagagagaaaacgccgctaagctcagggccgtcgagcagagggtcgcgtcttacgaggagtttcgaggtattgtccttgcctcacaccttaagcccctggagcggaaggacaaaatggggggcaaacggacagtgccctggaattgccacacaatccagggtagaacgtttcaagacgtcgcaactgaaatctcccctgagaaagctccactccagccagagacaagtgccgatttttatcgcgactggagacggcatctaccctcagggcccgaacggtaccaggctctccttcagctgggagggccacggctcggttgcctgtttcagacagatgtcggtttcggtcttctaggagagctcttggtggcgcttgcagaccatgtaggccccgcagaccgggcagccgtactcggtatcttgtgcagtctggcaagtactggaagatttactttgaacctgtcactgctctcaagggccgaaagagagagctgtaaggggttattccagaaactgcaagccatgggaaatccacgatctgtgaaagagggactatcttgggaagagcaagggcttgaggagcagagcggcggcctgcaggaggaagagcgccttctacaggagttactggagctttaccaggtggattag

SEQ ID NO: 28682 - DNA, 729 bp, Artificial Sequence
  Description of Artificial Sequence: Synthetic coding sequence
atggagcgcaacgacatcattaattttaaagctctagagaaggaattacaggctgcgttgactgctgacgagaaatacaagcgagaaaacgccgccaaactccgcgctgtggagcagcgagttgcttcctacgaggaattccgcggtattgttctggccagtcacctgaaacctctcgaaaggaaggacaagatgggcggtaagagaacagtgccatggaactgccataccatccagggaaggacttttcaggatgtcgcaaccgagattagtcctgagaaagctccacttcagccagagactagcgcagacttttaccgcgactggcgcagacacctgccttccgggccagagagataccaagccctcctgcagctgggcgggcctcggctgggctgtctgttccaaactgacgttggtttcggcctgctgggtgaattactggtagcactggccgatcatgtgggaccggccgaccgggccgctgtcctcggtatcctgtgttcactggcctccacaggacgatttacgctgaacctttctcttcttagcagagccgagagagagtcctgcaaagggctgtttcagaaactccaggctatggggaacccaaggtccgtgaaagagggactgtcttgggaagagcaaggattggaggaacagtctggtgggctccaggaggaggaacgccttctgcaggagttactcgaactatatcaggtggactag

SEQ ID NO: 28683 - DNA, 1104 bp, Artificial Sequence
  Description of Artificial Sequence: Synthetic coding sequence
atggcagccgaggaggaagacgaggtggagtgggtcgtggagagtatcgccggatttctgaggggtcctgactggagcattcccatcctcgacttcgttgaacagaaatgtgaagtgaactgtaagggcggccacgtgattacccctggctccccagagccggtaattttggtggcatgtgtgccactagtattcgacgatgaagaagaaagcaagctcacctataccgagattcaccaggaatataaggagctcgtggagaagcttcttgaggggtacttgaaagagatcggcataaacgaagaccagtttcaggaagcctgcacgagccctctggctaagacacatacatcccaggccatacttcagccggtgctggccgcagaggattttacgatcttcaaggctatgatggtgcagaagaacattgagatgcagctccaggcaattcggatcatacaagagcgtaatggggttctgcccgactgtcttaccgatggttcagatgtcgtgagtgatcttgagcacgaggagatgaagatactgcgcgaggtccttaggaagagtaaggaagagtacgatcaggaggaagagaggaagcggaaaaaacaactgagcgaggctaagaccgaggaacccacagtgcattcctcagaagctgctatcatgaacaattcgcaaggcgatggtgagcacttcgcacaccccccgtccgaagtaaagatgcacttcgccaaccagtcgatcgagcctctgggccgtaaagtggaacggtccgagacctcttctctaccacaaaaggatttgaaaattccggggttagagcacgcttctatcgaggggccgatcgcgaatctgagtgttctgggcactgaggaactgcgtcagcgggaacactatttgaaacagaagagggacaaactgatgagcatgaggaaggacatgagaacaaaacagatccaaaacatggagcagaaaggcaaacctaccggggaggtggaggagatgactgagaagcccgaaatgacggctgaagaaaagcaaacactcctgaagcggaggctgctggcggagaagcttaaggaggaggttatcaacaaatag

SEQ ID NO: 28684 - DNA, 1029 bp, Artificial Sequence
  Description of Artificial Sequence: Synthetic coding sequence
atggctgctgaggaggaagacgaggtggaatgggtagtcgagagtattgccgggttcctccgcggccccgattggagtatcccaatccttgattttgtagagcagaagtgcgaagttttcgacgacgaagaagaaagtaagctcacttatacagaaatccaccaggagtacaaagagctggtcgaaaaacttctcgaggggtacctgaaggaaattgggattaacgaggatcagtttcaggaggcgtgcacatcccctttagcaaagactcacacctctcaagctattctccaaccggtgctggccgccgaagatttcacaatcttcaaagcgatgatggtgcagaaaaatatagagatgcagctgcaggcaattcgcatcatacaggagaggaacggagtgcttcccgactgtttaacggatggctccgatgttgtgagtgacttagaacacgaggagatgaagattttaagagaggtcctcaggaaatcgaaggaagaatatgaccaggaagaagaacggaaaagaaagaaacagcttagtgaggccaagaccgaggagccaaccgttcacagttccgaggctgcaattatgaataacagtcagggtgatggggaacatttcgctcacccgccatctgaagtcaaaatgcacttcgcgaatcaaagtatcgagcctttaggccgtaaagtggaacgatcagaaaccagctccctcccacagaaagaccttaaaataccagggctcgagcatgcctcaatcgaaggccccattgccaacctgtccgtgctggggacagaagagttacgacagcgtgagcactacctgaaacaaaagagggataagctgatgagtatgaggaaggatatgcggacaaagcaaattcagaatatggaacaaaagggcaagccaacaggcgaggttgaggaaatgactgaaaagccggaaatgaccgcagaggagaaacagaccttacttaagaggagactgctcgccgagaagctcaaggaggaagttataaacaagtag

SEQ ID NO: 28685 - DNA, 1545 bp, Artificial Sequence
  Description of Artificial Sequence: Synthetic coding sequence
atgtattctcagcgctttgggaccgtgcaacgcgaggtgaaggggccaaccccaaaagtggtgattgtgcgttccaaaccaccaaaagggcagggagccgaacatcacctcgaaaggattagacgttctcatcagaaacataatgccattttggccagcattaagtcatctgaaagagataggctgaaggccgaatgggatcaacacaatgactgcaagatcctggactctttggtgcgtgcgcgaatcaaggacgcagtacagggattcataatcaatatagaggagcggagaaacaagctgcgtgagttgctagccctcgaggagaatgaatatttcaccgagatgcaactgaaaaaggagactatcgaagaaaagaaagataggatgcgagagaagaccaagctgcttaaagaaaagaacgaaaaggaacgtcaagatttcgtggccgagaaactggatcagcagtttcgtgaacggtgtgaagagctgcgagttgaactgctgtcaatccatcagaagaaggtgtgtgaggagcgaaaggcgcagatcgcgttcaacgaagagctgtccaggcagaagttagttgaagaacaaatgttcagtaaactgtgggaggaggaccggctagccaaggagaagagagaggcgcaggaagctcgacgacaaaaggagctgatggagaacacaaggttggggttgaacgctcaaatcacaagtatcaaggcccaaaggcaggctacccaattgcttaaagaagaagaagcaaggctcgtcgagagcaataacgcacaaattaagcatgaaaatgaacaggacatgctcaaaaaacagaaggccaagcaagaaacccgaaccattctgcagaaggctctacaggagaggatcgagcacatccagcaggagtacagagatgagcaggacctcaatatgaagctggtacaaagggcgctccaggacctccaggaagaagcagataaaaaaaaacaaaagcgcgaggacatgattcgagagcaaaagatataccacaagtacttagcccagagacgggaggaagagaaagcccaggaaaaggaattcgaccgcatattagaagaggacaaggccaaaaagctagccgagaaggataaagagctgcgattggaaaaggaggctcggaggcagcttgtggacgaggtcatgtgcacgagaaaactgcaggtacaagaaaagctgcaacgtgaggccaaagaacaggaggagagggccatggaacagaaacatattaatgaatctttaaaagagttgaattgcgaggagaaggagaattttgcacgcaggcagcgcctcgcccaggagtataggaaacaactgcagatgcaaattgcctaccagcaacagagccaggaagcggagaaagaagaaaagagaagggagtttgaggcgggtgtggccgctaacaagatgtgcttagacaaggtacaagaggtcctcagcacccaccaagtcctgccacagaacattcatcccatgaggaaagcatgcccttccaaactgccgccgtag

SEQ ID NO: 28686 - DNA, 1683 bp, Artificial Sequence
  Description of Artificial Sequence: Synthetic coding sequence
atgaataggaagtgggaggctaagctcaagcagatcgaggagcgtgcctcacactatgagcgaaagccccttagctctgtatatcggcctcggctctccaagcccgaggagccgccaagtatctggcgcctgttccaccgccaggctcaagcatttaacttcgtgaaaagttgtaaagaggatgtgcacgtcttcgcactcgagtgcaaagtcggtgatggtcagaggatctacctggtcacaacatatgccgaattctggttctactataaatcgagaaagaatctgttacattgctacgaggtaatccccgaaaacgctgtctgtaaactttacttcgacttagaattcaataagcccgccaatcccggggcggatggaaagaaaatggtagccctgctgatcgaatacgtctgtaaggccttacaggaattgtatggcgtgaattgcagcgctgaggatgtcctgaatctagactctagtaccgatgaaaaattttctcagcacctgatattccagctgcacgacgtagcattcaaagataacatccacgttgggaacttcctgcggaaaatccttcagccagccctcgatctgttggggtcagaggacgatgattccgcaccagaaacgacaggtcacggcttcccgcattttagcgaagctccggcacggcaggggttctcattcaacaaaatgtttaccgagaaggccactgaggaaagctggacaagcaattcgaagaaactggaacgactgggaagcgcagagcagtcatcccctgacctgtccttcctagttgtgaagaacaatatgggggagaagcacctgttcgtggaccttggtgtttatacacggaacaggaactttaggctgtataagtcctccaagattggcaaacgggttgctctggaggtgaccgaagacaataaattctttccaatccagagcaaagacgtgagtgacgaatatcaatatttcttatcctctctggtgtcaaacgttcggtttagtgacacactgcgtatcctgacttgtgaacctagtcaaaataagcagaaaggagtgggctatttcaatagtatcggtacaagcgtagaaacgatcgagggttttcaatgctctccatatccggaggttgatcatttcgtgctgtccttagttaataaagatggcattaaggggggtatccgtaggtggaattattttttccccgaggaactcctcgtgtacgacatatgcaaataccgatggtgtgaaaacattggaagagctcataagtcaaataacatcatgattcttgtagatctaaagaacgaggtgtggtaccagaagtgccacgacccagtatgtaaggctgaaaactttaagagcgattgtttccctctgcctgctgaagtctgtttactattcctgttcaaggaggaagaggagttcactacggatgaggccgacgagactcgctccaacgaaacccagaacccacacaagcccagcccgagccgtctgagcactggggcctcagctgacgccgtctgggataacgggatcgatgatgcatattttttggaagccacggaggatgccgagttagcagaggcagcagaaaattcattactgtcatataacagcgaggtggatgagatcccagacgagctgataattgaagtcctgcaggagtag

SEQ ID NO: 28687 - DNA, 1590 bp, Artificial Sequence
  Description of Artificial Sequence: Synthetic coding sequence
atggccgccctgactaccgttgttgtggcggctgccgctactgccgtggctggggcagtagctggggcaggggccgctacggggacgggggtcggtgcaactcctgcccctcagcaaagtgatggctgcttctcaacctccggcggcatccgtccattccacctgcaaaactggaaacagaaggtaaaccaaaccaaaaaggccgagttcgtccggaccgctgaaaaattcaagaaccaggtaatcaatatggagaaggacaagcactcccatttttataaccagaaaagcgattttcgtatagaacatagcatgctggaggagctggaaaataaactgattcattcccggaagacagaaagggctaagatacagcaacagctggcaaaaatccacaataatgttaagaagctccagcatcagctgaaagacgtgaaaccgaccccagatttcgttgagaagttacgtgaaatgatggaggagatcgaaaatgctatcaacaccttcaaggaagagcagaggctgatctacgaggagcttatcaaagaggagaagactactaacaatgaattatcggccatctcaaggaaaatcgatacgtgggccctgggcaactccgagaccgagaaggccttcagggcgataagcagcaaggtcccggtggataaggtcacacccagcacacttcctgaggaggtactcgactttgaaaagtttctccagcagacaggcgggagacaaggggcttgggatgattacgatcaccagaacttcgtgaaagtgagaaataaacataaaggtaaacccaccttcatggaggaggtactggagcatttacctggtaaaacacaagacgaagtgcagcaacacgaaaaatggtaccagaaattccttgccttagaggagagaaaaaaggaaagcatccaaatctggaaaactaagaaacagcagaaacgggaagagatatttaagttgaaggagaaggccgacaataccccagtcctgtttcacaataaacaggaagacaaccagaagcagaaggaggagcaacgaaagaagcaaaagcttgcggttgaagcatggaagaagcagaagagtattgagatgagcatgaagtgcgcaagtcagcttaaggaggaagaggagaaagagaagaagcaccagaaggaaaggcagcggcagtttaagttaaagcttctgcttgagtcttatacccagcaaaagaaagagcaagaagagttcttgcgcctcgagaaagagattcgggaaaaagccgagaaggccgagaaacgcaaaaacgctgccgatgaaatttctagatttcaagaacgcgacctccataagctggagttaaagatcctggacagacaagcaaaggaggacgaaaagtcacagaagcagagacggctggctaaactgaaggagaaggtggaaaataacgtgagtcgcgatccatcgcggctatataaaccaaccaagggctgggaggagagaacgaaaaaaataggaccgaccggctcaggaccactactgcatatcccccacagagctatccccacttggcgccagggcattcaaagacgcgtgtag

SEQ ID NO: 28688 - DNA, 1341 bp, Artificial Sequence
  Description of Artificial Sequence: Synthetic coding sequence
atggagaaggacaagcactcccacttctacaatcagaaaagtgatttcaggatcgaacacagtatgctcgaggaattagagaacaagctgatccattcaaggaagactgagagggcaaaaatccagcagcagctcgccaagatccacaacaatgttaagaaattacaacaccagttgaaggacgtaaagcccacccccgactttgtcgagaagctccgggagatgatggaagaaatagagaacgcaatcaacacctttaaggaagagcagcgccttatctacgaggagctgattaaagaggagaaaactaccaataatgagctatctgccattagtcggaagatcgacacttgggcgttgggaaatagtgagactgagaaggcttttcgagctatttcgagtaaggtgcctgtggataaagtcacacccagtactcttcccgaggaggtgctggacttcgagaaattcctgcagcagaccggaggacgccagggagcgtgggatgattacgaccatcagaacttcgtgaaagtgcgcaacaaacacaagggcaaaccgacattcatggaggaggtcttggagcacctccccggaaaaacacaagacgaagtgcagcaacacgagaagtggtaccagaaatttttggccttggaggaacgtaagaaagagtctatacagatctggaaaacaaaaaagcagcagaagagagaggaaatcttcaaactcaaagagaaggccgacaataccccggtgctgtttcacaacaagcaggaggacaatcaaaaacagaaggaagagcagagaaaaaaacaaaagctggccgtcgaagcgtggaagaaacagaaaagcatcgaaatgtcgatgaaatgcgcgtcgcaacttaaggaagaggaggagaaagaaaagaaacatcaaaaggaacggcaacgccagttcaagctgaagttactgctggaatcctatacccaacaaaaaaaggaacaagaagaattcctacgattggaaaaggaaatcagagaaaaagctgagaaagctgaaaaaagaaaaaacgcggcagatgaaatttcacgcttccaggagagggaccttcacaagttagagctgaagattctagacaggcaggctaaggaggacgaaaaaagccagaagcagagaaggctggccaagctgaaagagaaggttgagaacaatgttagtagagacccttcaagactttacaaacctactaaggggtgggaggagcgcacaaagaagattggaccaaccggaagcgggccgctcctgcacatccctcaccgtgctatccccacatggcgtcagggcatccagaggcgtgtctag

SEQ ID NO: 28689 - DNA, 798 bp, Artificial Sequence
  Description of Artificial Sequence: Synthetic coding sequence
atgtcagccgctccgctggttggatacagctcgagcggctcagaagatgaatctgaggacggtatgcgcaccaggcccggtgacggcagccaccggaggggccagagtcccttgccacggcaaagattcccagtgcccgatagcgtgctgaacatgttccccgggacagaagagggccctgaagacgattccactaaacacggcggccgggtgagaacatttccacacgaacggggcaactgggccacccatgtgtacgtgccatacgaagctaaagaagagttcctcgatctcttggacgtgctcttgccccacgctcagacctacgtaccacggctcgtcaggatgaaagtgttccacctttcccttagtcagtctgtggtcttgaggcaccactggatactgccttttgtccaagctctaaaggctcgaatgacatcattccatagattcttctttacagccaaccaggtcaagatttatactaatcaagagaagacaaggacctttataggtctagaggtaacatcagggcacgctcaatttctagatctcgtgtccgaagtcgaccgggtgatggaagagttcaacttgactacattttaccaagacccctccttccatctgagtctcgcctggtgtgtcggggacgcccgcctgcagctggagggtcagtgcttgcaggaacttcaggctatcgtcgatggtttcgaggacgctgaggtcctgctcagggtgcataccgagcaggttaggtgtaaaagcggaaataaatttttctccatgcccctgaaatag

SEQ ID NO: 28690 - DNA, 972 bp, Artificial Sequence
  Description of Artificial Sequence: Synthetic coding sequence
atgactgacgacgagtccgagagtgtgttgtctgactcacacgagggcagcgaactagagttgcccgtcatccagctgtgtgggctggtggaagagttgagctacgtgaactccgccttgaagacggagaccgagatgtttgaaaaatattacgcaaagctggagccaagagaccagcgacctccaagactttcagaaattaagatttctgcagccgactatgctcaggccataatagaagaggcagagattcggtggtctgaagtttcgagagaagtgcatgagtttgagaaggacattctcaaggccatcagtaagaaaaaggggtctatcctcgccacccagaaagtgatgaagtacatcgaggatatgaacaggcgaagggacaatatgaaagagaaactgaggctcaagaacgtgtcactgaaggtccaaagaaagaaaatgctgctccagttgaggcagaaggaggaggtatccgaggcccttcatgacgttgattttcagcaattgaaaatcgaaaatgcacaatttctggaaaccatcgaggcccgtaaccaagaacttacgcagctgaaactctcaagtgggaacactttgcaggtactgaacgcttacaagtctaagttgcacaaggccatggagatttaccttaacctcgataaggagatcttactgaggaaagaactgctggagaaaatcgagaaggagactcttcaggtcgaggaggaccgggctaaggccgaagctgtgaacaagaggctccgaaagcagctggcggagtttagggcaccgcaggttatgacctacgtgcgagagaagatcctgaatgctgatctggaaaagtccattcgtatgtgggagcgcaaggtggaaatagcagagatgtcgctgaaggggcaccgtaaagcctggaacagaatgaagataacaaacgagcagctgcaggctgattacttggctggcaaatag

SEQ ID NO: 28691 - DNA, 2013 bp, Artificial Sequence
  Description of Artificial Sequence: Synthetic coding sequence
atggagggagaaagacgggcctactcgaaggaagtccatcaaagaataaataagcagttggaagagatccggaggctcgaagaggtgaggggcgatctacaggtccaaatctcagccgcacaaaaccaggtgaaaaggttgagggactcccagcgtctggagaatatggaccgactgctgaagggtagggctcaggtgcaggccgaaatcgaggagctccaggaacagacaagggctctcgacaagcaaattcaagagtgggaaacacggatattcacccattctaagaacgtgagaagcccaggtttcatattggatcaaaaggtcaaaattagaaggagaatccgtatcttagaaaaccagcttgacagagttacttgtcacttcgataaccagctagtccggaatgccgccctgcgcgaggagctggatctgctgcgcatcgacagaaacagatacttaaatgtggaccgtaagttaaaaaaagagattcaccacctgcaccacctggtgagtacactgatactctctagcacctcagcatacgcagtgcgagaagaagccaaggccaagatgggcttgctccgcgagagagccgagaaagaagaggcccaatcagagatggaggcccaggtgctccagcgacagattctccatctggagcaactgcaccattttctgaaactgaaaaacaacgatagacagcctgaccccgatgtgctggagaaacgcgaaaaacaggcaggtgaagtggccgaaggcgtgtggaaaacctcccaggaacgcctggtgctttgttatgaggatgcactgaataagttgagtcaattgatgggagagtctgaccctgatcttcttgtgcaaaagtatctggagatcgaagagcggaacttcgccgaattcaatttcataaatgagcagaacctggaactggagcatgtacaggaggaaattaaagagatgcaggaagcattagtgagtgcacgtgctagtaaggacgaccaacacctcctccaggaacaacagcagaaagtattacaacaaaggatggacaaagttcacagcgaagccgagaggctagaagcacgatttcaggacgtgcgggggcagctggaaaaattgaaagccgacattcagctgttgttcaccaaagctcactgcgatagttcaatgatcgatgacctgctgggagtgaagacttctatgggggaccgagacatgggccttttcctgtccctgatcgagaaacgccttgtggagctgcttacggtacaagctttcctgcatgcccagtcatttacctcactagcggatgccgcccttctagtgctgggacagtctctggaggatcttcctaagaagatggcccctttgcaaccccctgacaccctggaagacccgcccggtttcgaggctagcgatgattaccccatgtcaagggaagaactgcttagccaggtcgagaaactggtggagctacaggaacaagccgaggcccaacgtcagaaagacttggcggccgccgctgcaaaattagacggcactctgtctgttgacctagcctctactcagcgcgcgggaagttccaccgttctagtaccaacccggcatcctcatgctattccaggctctatcctaagtcacaaaacctctagagatcgcggctctctcggccacgtgaccttcggcggcctgtcctccagcaccgggcacttgcccagtcacatcacccatggggatccaaatactggccatgtgacattcggtagcacttcagcatcctcaggcggccatgtgactttcagaccggtgtctgccagctcctatttgggctccacgggatacgttggatcgtcccgtgggggagaaaatacggaagggggggtggaaagtgggggtaccgcatccgactcatctggcggattaggcagttcacgtgaccatgtctctagcactggccccgccagctcaacaggccctggctcatctacttccaaggactcacggggctag

SEQ ID NO: 28692 - DNA, 1842 bp, Artificial Sequence
  Description of Artificial Sequence: Synthetic coding sequence
atggcgagatgcaggcaccacagcggttaccttgccgatgacgaagccagccactccatgtgcagcgccagggtgcagttgccgaagaaacctctggtgcctgaaatgcggcccgcttgtaagcccggtagagtaccccatccccccagtacatgcggaagctctgctctacagggacagcggcgaaataagcgacatccccagccattcggccactttctggatttcctcaccgaatcccaggtcctagacagcctggagaccgtggtggagaaagctacggagcgcatggcggctatgaagactgaagcaggggtgcccctggtcgaagtgcaagatcctgtggaggttccctcgggtggccgacgggctcatgccaggccgtcactatcaacggtacaccgccaccgcgtgaggcctaccctgtgtaccggccaccctaacaactatccgtcctcgtcctcgtcgatgtccaactgtcacagttctcttatggccggatgcctcggatcccactctcgcgacagcgaccttggcgcccagggcagtctgccacctgtccgcgacaagttgttactggagaagaacctgaaaagactgttgcagctcgaaagagaagggaaaggactatcgcagtcttgctctcaaagagacagtctgctctgggactcactggggtctcaaacatcttttcagtggactcaagaacagcctctcagctggttcagcgggttgttgggcagttcctcaggggtgccggaagcctcggaacccagacccggggagcaagaacctatcttccgcaagagagagtttaacaaggaaatcaagtccctgcttagccaacttgagtcattggaccttccaggctattgtcccctgcgagaaccccaccgcactcttaatttcttggccgatcaccggttgttcccggctctacagagcgtggtgtcccaggccgtggacaaactgagaggggcgcactgtcgagatggccggccgctcttccctacttcgctggagcctacatccgatcttccccccctcggttctgagccagctaagccgactaacggtgggcagccttatgctagcccaagaccaacagtgtctagtccgaagatgttgcagagaaagcgcaaggaccggggtggctctccctctatgtcaagcgcccaggtcgccacccggtttaaactgaaaagcccgtgttcatcaagcagattcactaaaaaaaagcccctgccctcaattagctccaaatcctctatgtctcatttctcaaatcggctatatgaagaactggccgacttcttgacccagcaggctgccagcttggtaattagaaaatacgaattcgagaaggacttatccaaacagctcggattttttagtttccctatcacacacgtccttagggatctgagcttagggctaaagaaggtgaaagggagtcgaattcacctctcctccgagacccaccggagctgtctgttgaggaaattggaggagtcaaagcgtgcaaggcaggcctcacgtttatcaaccagtcactgcagcaccgagacaccgtcagtccagcaggagcctgccacacatacggctcaggatcaggcaacagagccttgcagaagtctgtacaccaaccttcctgcaagtcgccagctctctccactggagccaaaactgtacatgtccgcctgcactggcatgggaagtagtcctcctaaatctaaggatatggataacgaagggcgcgacaaggcagagattgaggatgaggacgaggatgaatttaaagatgaggatcaagacgaggacaaagacgaagatggcgtttag

SEQ ID NO: 28693 - DNA, 840 bp, Artificial Sequence
  Description of Artificial Sequence: Synthetic coding sequence
atggcggcgctgggcagaccattttctggtctacctcttagcggaggcagcgatttcctccagcctccccagccagctttcccaggcagagccttccctcccggcgccgatggcgcggaactcgcaccaagaccaggacctcgcgccgtcccatcctcgcccgcagggtccgctgcaaggggaagagtcagcgtccactgtaagaagaaacacaagcgcgaggaggaggaagacgacgattgccccgtgagaaagaagcgcattaccgaagcagaactgtgcgccgggcccaatgactggatactatgcgcccaccaggacgtggagggccatggagtgaacccttcggtgagtggtttaagcattcctggcatccttgatgtgatctgcgaggaaatggaccagactacaggagagccccagtgcgaagtggcacggaggaaattgcaggagatagaagacagaatcatcgatgaggacgaagaggtagaagccgaccggaatgtgaatcaccttcctagtctagtgctgagcgatacgatgaaaaccggactaaagcgtgagttcgatgaagtgttcacgaagaagatgattgagtccatgtcacgcccgtccatggaattagtgctgtggaagcccctgccagaactgctgagcgataaacccaaaccgtcgagtaatacaaagaactatactggcgagtcccaggcaaaacatgtggccgcaggtactgcgttcccccagcgcacagagctatttagcgagcccaggccgacaggtatgtccctatacaactctctggaaaccgcaacttctacagaagaagagatggaactgtag

SEQ ID NO: 28694 - DNA, 615 bp, Artificial Sequence
  Description of Artificial Sequence: Synthetic coding sequence
atggctgccctggggaggccattctccgggctgcccctgtcaggaggatccgattttttacagcccccgcagcccgcctttccagggagagccttccctcccggcgcggacggggccgaactggcaccccgccccgggcctcgcgctgtgcccagctcgcccgccggttcagctgcacggggccgggtaagcgttcattgcaagaagaagcataaaagggaagaagaggaagatgacgagattattgatgaagacgaggaagttgaagccgaccggaacgtcaaccacctgcccagcctcgtcttatcagatacgatgaagaccggactgaagagagaatttgatgaagtctttactaagaaaatgattgaatccatgtctcgcccaagtatggaactggtcctgtggaaaccactgcccgagctgttaagtgataaacccaaaccctcctctaacaccaaaaattataccggagaatcacaagcaaagcatgtggcagctggaacagccttcccccagcggaccgaattgttttccgaaccgagaccaaccggaatgtcattatacaacagcctggagaccgccacttcgaccgaagaggagatggaactgtag

SEQ ID NO: 28695 - DNA, 444 bp, Artificial Sequence
  Description of Artificial Sequence: Synthetic coding sequence
atggatcaaaccacaggtgaaccgcagtgtgaagtggcaagacgcaagctccaggagatcgaggaccggattattgatgaggatgaggaggtagaggccgaccgaaatgttaaccacctgccatcactggtgcttagcgacaccatgaaaaccgggttgaagcgtgagttcgatgaagtgttcacaaaaaagatgattgagagcatgtcacggccatctatggaacttgtcctgtggaagccattaccagagcttctgtctgacaaaccaaagcctagttccaacactaagaactatacaggcgagtcccaagccaaacacgtcgctgccggcaccgcgtttccccaacgtaccgaactcttcagcgaacctaggcccacagggatgtctttatacaatagcctggaaactgctacctccactgaggaagagatggaattgtag

SEQ ID NO: 28696 - DNA, 786 bp, Artificial Sequence
  Description of Artificial Sequence: Synthetic coding sequence
atggccgcccttggaaggccctttagtgggctgcccctcagcgggggtagcgatttcctgcaacctcctcaaccagcttttcccggtagggcctttccacctggcgcggatggagctgagctggccccacggcccgggccgagggccgtccctagtagtcccgccggatcagctgcgagaggccggtgtccagtgagaaaaaaacgcatcacagaagcagagctatgtgccggtcctaacgattggatcctctgtgcccatcaagacgtggaggggcacggagttaaccctagcgtgtctggcctgagtatccccgggatactggacgtgatctgcgaggaaatggaccagaccaccggcgaaccacagtgcgaagtggctagaaggaagctgcaagaaattgaggacaggatcatcgatgaggacgaggaggtggaggctgacaggaacgtgaaccacctgccaagcctggtgttgagtgacacaatgaaaacagggcttaagcgggaattcgatgaagtgtttacaaagaagatgattgagagtatgtccaggccatctatggaactggtgctgtggaaacctctgccggaactcctctccgacaaacccaaaccatcttctaataccaagaactataccggcgagtcacaagctaagcacgtggctgccggaaccgctttcccacaacgaactgaactcttcagtgagcctcggcccaccggaatgtccctgtataatagcctggagacggcaacaagtacagaagaggagatggagttgtag

SEQ ID NO: 28697 - DNA, 540 bp, Artificial Sequence
  Description of Artificial Sequence: Synthetic coding sequence
atgcaggatggaagaaaggggggtgcttacgcaggcaagatggaggcaactactgcgggtgtcggtcgattggaggaagaagctttacggcgtaaagaacggctgaaagccctaagagagaagaccggccgaaaggacaaggaggatggagaaccgaaaaccaagcatctacgcgaggaagaggaggaaggtgagaaacaccgagaactccgtctaaggaattatgttcctgaggacgaggacctgaagaagaggagggtccctcaggccaagcccgtggctgttgaggagaaagtgaaggagcaactagaagcagctaaacctgagccagtgatcgaggaggtagacctggcgaacttagcaccacgaaaaccagactgggaccttaaacgggatgtcgccaagaagctcgagaagctgaagaagcgaacacagagggccattgccgagcttattcgggaaaggctcaaaggtcaggaggattccctcgcctctgccgtagacgctgccaccgaacagaaaacttgcgattctgactag

SEQ ID NO: 28698 - DNA, 540 bp, Artificial Sequence
  Description of Artificial Sequence: Synthetic coding sequence
atgcaggacggaagaaaaggcggggcttatgccggcaagatggaagccacaacggctggcgtgggaaggcttgaagaggaggctctcagacggaaagaacgcctcaaggccctgcgcgagaaaacgggaagaaaggataaagaggatggcgaaccgaaaactaaacatctacgtgaagaggaagaggaaggagaaaaacaccgagaattgcgcttaagaaattatgtgcctgaggacgaggatctgaagaagaggcgggttccgcaggccaagcccgttgcggtggaagagaaggtgaaagagcagctggaagctgccaagccagagcccgtgattgaagaagtggatcttgccaacctagcgcccaggaagccggattgggaccttaaacgggacgttgccaagaaactcgaaaagctgaaaaaaaggacacaaagagccatcgcagagctcattagggagcgcctgaaggggcaagaagactcccttgcttcggcagtcgacgccgccaccgagcagaaaacttgcgatagcgattag

SEQ ID NO: 28699 - DNA, 309 bp, Artificial Sequence
  Description of Artificial Sequence: Synthetic coding sequence
atgcaggatggacgcaagggtggcgcatacgccggcaaaatggaggctacaacggccggagtggggcgcctggaagaagaggccctgcggcggaaggagaggttgaaggcactcagggagaaaaccgggcggaaagacaaagaggatggggaaccaaagaccaaacatttaagggaagaagaagaggaaggcgagaaacaccgcgaactgcggctccggaactatgtgcctgaggacgaagacctcaaaaagcgacgcgtgccacaggccaagccggtggccgtagaagagaaagtgaaggaacagtag

SEQ ID NO: 28700 - DNA, 501 bp, Artificial Sequence
  Description of Artificial Sequence: Synthetic coding sequence
atggaagccaccacggccggcgtgggacgccttgaagaggaagcactcagacgtaaggagaggcttaaggctctgcgagagaagaccggaaggaaggataaggaagacggagaacccaagaccaagcaccttcgtgaagaggaggaagaaggagaaaaacacagggagcttaggctgcggaattacgtgcccgaagacgaggatctgaagaagaggcgggtcccacaggctaagccagtggccgtggaggagaaggtgaaggagcagctagaggccgcaaagcccgagccagtcatcgaggaagtggatctggcaaacctggcaccgcggaaaccagattgggatctaaagcgggacgttgccaagaaactggaaaaactcaaaaagagaactcagcgcgccatagccgagttaattcgagagcgtctcaagggtcaggaggatagtctggccagcgccgtcgatgcagcaacagagcaaaagacttgcgattcagattag

SEQ ID NO: 28701 - DNA, 1893 bp, Artificial Sequence
  Description of Artificial Sequence: Synthetic coding sequence
atggaagtgaaaggccagcttatctcatcacccacatttaacgctccggcggctctttttggtgaggcagcccctcaggtaaaaagcgaaagactacggggattacttgacagacaacggactcttcaggaagccctttccctcaaactccaggagctgagaaaagtctgtcttcaagaagcagagttgacaggccaactccctccagagtgtccactggagcctggagagaggccgcagctggttcggcgcagacctcccacagctcgggcctaccctccgccccaccccaatcaggcgcaccattcactgtgtccagccgaggagctggccctcgaggctttggaacgagaagtgtctgtacagcagcagattgcagccgcagcaaggcgtctggctctggctccagatctctctaccgagcagcggaggcggcgaaggcaggtacaagccgatgccctgcggcgacttcacgagctggaggaacagctgcgggacgtaagagcaagactgggactaccagtgctacccttgccacagccgttgccactctcaaccggcagtgtcatcaccacacagggagtttgtcttggcatgagactcgcacagttaagccaggaggatgttgtgttacacagcgaatccagctcgctctccgagtccggcgcctcacacgataacgaggagcctcacggatgtttttctcttgccgagcggccctcaccgcctaaagcatgggatcagctcagagccgtgagtggcgggtcacctgagcgccggacgccctggaagccacccccttcagatctgtacggggacctcaaatcacggcgcaacagcgtggcctcacctacgagcccaacccgctccctccctaggtcggccagttctttcgagggacgctctgttcccgccacccccgtcctcacacggggtgctgggccgcagctgtgtaagcctgagggactgcactcaagacagtggagcgggagccaggacagccaaatgggatttcctcgagccgatcctgcttctgatagagcctccctgttcgtggcacgcacgcggaggtctaattcaagtgaagccctgctggttgaccgagcagccggaggaggggccgggagtcccccagcgcctctggccccgtccgctagcggcccccctgtgtgcaagagctccgaggtactgtacgaaaggccacagcctacgcctgccttctcttcacggaccgccggcccccctgacccacctcgagccgcgcggcctagctctgctgcaccggctagccgtggcgccccccgccttcctccagtttgtggagatttcctgctggactactctttagacagggggttaccaagaagcggcggagggacaggatggggcgaactgcctccggccgccgaagttcccggtcctctgagtagacgtgacggcctactcactatgctgcccggcccgcctccagtgtacgccgctgatagtaacagccccctcttgcgcacgaaagatccacacactagggccactcgcacaaagccatgcggactgcctccagaagcggccgagggccccgaagtgcaccccaaccccctgctgtggatgccgccccctacccgcataccatcagcaggagagagaagtggccataagaaccttgctcttgaagggctgagagactggtatataaggaattccggcctcgccgccgggccccagcggcgaccagttctcccttctgtggggccaccccatccaccctttcttcacgctaggtgttacgaggtcggccaggccttatacggggctccttctcaggcccctctaccgcacagtcgctcgtttactgctccccctgtgagcggacggtatggaggttgtttttactag

SEQ ID NO: 28702 - DNA, 1986 bp, Artificial Sequence
  Description of Artificial Sequence: Synthetic coding sequence
atggaggttaaagggcagttaatctcaagtccaacttttaacgccccggctgcgctgttcggagaagccgcaccccaggtgaaaagtgagagactgcgcggcctgctggataggcagaggacactccaggaggccctgtcgctaaaactgcaggagctccgaaaggtatgtctacaggaagctgagctgaccggacaactgccccccgagtgtcccctggagccgggggagcgccctcagctggtgagacggcgcccacctacggcacgtgcatacccaccaccccacccaaaccaggcacaccattctctgtgtcccgctgaagaactggcgctcgaggcgctggagcgagaggtgtccgtccagcagcagattgcagccgcggcccggcggctagcgctcgcacccgacctctcaacagagcagcgccggcgacggcgtcaggtccaggccgatgcactgagacggctccacgaactagaggaacagctgagagacgtacgcgcacgcctcggactgccggtccttcctttgcctcaaccgctgccactctcaactggctcggtcatcaccacacagggtgtgtgcctggggatgcgattggcccagctgagccaagaagacgtggtgttgcattcggaatcatcatctcttagcgaatcaggggctagtcacgacaacgaggaaccccacggatgtttctctctagccgagagacctagccctcctaaggcatgggaccagctgcgcgcggtgagcggaggatcccctgagagacgtaccccatggaagcccccaccctctgatctgtacggcgacctcaaatctcgccggaatagtgttgcctctcctacaagtcctacccgatctctgccccgctcagccagctccttcgagggccgttcagttccagcaactccggtgttgacgaggggcgccggaccgcagctctgcaaacctgagggactgcacagcaggcagtggagcggttctcaggatagccagatgggattcccgcgcgccgaccccgcctccgatagggctagtctgtttgtggctaggaccagaaggtccaacagctctgaagcgctcctagtggatagagccgctggcggtggcgctggctctcctccagctcccctggcaccttctgcaagcggcccacctgtgtgcaaatcatctgaggtactttacgagagaccacaaccaacacccgccttctcttcccgcacggccggacctcctgaccccccacgtgctgcgaggccatcctcagccgcaccagcttcccgaggcgccccaaggctcccccccgtgtgtggcgatttcttattagattattccctggaccgcggactcccacgcagcggcggcggtacgggctggggagaactgcctccagcagcagaagtgcccggcccgctctctcgacgagacggcctgctgacaatgctcccaggccctcctcccgtctatgccgcggatagcaactccccgttgcttcgaactaaggacccgcacacacgggcgacgaggacaaagccatgcgggctccctccagaagccgctgaggggcccgaggtgcacccgaatccactactttggatgcctccgcccacccgtatccctagtgccggggaaagaagtgggcacaaaaacttagcgctggaggggctgagagactggtacattcgcaactctggtcttgcagccggcccccaaagacgccctgtgctcccctcagtgggtccaccacatccaccgttcctgcatgctcgttgttacgaagtgggacaagctctgtacggagcccctagccaggccccactgccccattcccgctcctttactgctccacccgtcagcggacggtactacgcggactttctttaccctcccgaactcagtgcccggttgagcgatcttaccctcgaaggagaacagtcctcctcaagcgatacccaaactcctggcacactggtctag

SEQ ID NO: 28703 - DNA, 1857 bp, Artificial Sequence
  Description of Artificial Sequence: Synthetic coding sequence
atggaggtaaaggctgccctgtttggcgaggctgctccccaggtgaaatcagagcgactgcggggcctgctcgacagacagcggaccctgcaggaagctctgtccctaaaacttcaggagctgaggaaggtctgcctccaggaagcggagttaacaggccagttgccacctgaatgcccattggaacccggcgagcgaccccagctagtgagacgccgtccccccactgcgagggcctacccccccccacatcccaatcaggcccatcactctctctgccccgctgaggagctagcacttgaggcgttggagcgcgaggtgtccgtgcagcaacagatcgccgccgctgcccgcaggcttgcactggcacctgacctcagcactgagcagagaagacggcggcggcaggttcaagcagatgctcttcgacgcttgcatgaattagaggagcagttgcgagacgtacgcgccaggttgggactgcccgtgctccccctgccacagcccctcccgctgtcaacggggtccgtaattacaactcaaggggtgtgtttggggatgcgtctcgctcagctcagccaggaagatgttgtactgcactccgaatctagctctctgtctgaaagcggagctagtcacgacaacgaagagccccacggttgcttctcgctcgccgaacggccttcacctccaaaggcatgggatcaactgcgtgccgtttccggcgggagtcccgagaggaggacgccatggaagccccctccaagcgacctgtatggcgatttaaaatctaggagaaactccgtcgccagcccaacgtctccaacccgcagcctgccacgcagcgcatcctcctttgagggcagatcggtgccagcaactcccgtgttgactagaggggctggtccccaactctgtaaacctgaaggcttacattccaggcagtggagcggctcacaggactcacaaatgggatttcctcgagcagatcccgcttccgatcgcgcttcgctgttcgttgcccggacccggcgcagcaactcctccgaggctctcctcgtcgatcgagccgctggcggaggggccggctctcctccagcacctctcgcaccttcagcttcaggcccaccagtctgtaagagtagcgaggtgctgtatgaacggccgcagcccactcccgcattttcctctaggactgctggacccccagatcccccgcgggctgcccggccctcaagtgcagccccagcatctcgtggcgctccacgcctcccgcctgtttgtggggacttcctattagattactccttagatcgcggcctgcctcggagtgggggcgggacaggctggggggagctcccgccagctgccgaggtgcccggccccctcagccgaagggacgggctcctcaccatgctcccagggccaccacctgtctacgccgccgattcaaatagcccactcctccggactaaggaccctcacactcgggccaccagaaccaagccctgcggactgccacctgaagcggctgaaggccccgaggtgcacccaaaccctctcctatggatgccgcctccgacgcgcatcccatcagcaggcgaacggtcaggccacaaaaatctggcccttgaaggtcttagggattggtatatccggaatagcggattagcagccggacctcagcgtcgcccagtgctgcccagcgtgggccctccccatcccccttttcttcacgccagatgctatgaggtggggcaggctctgtatggcgcaccctcacaagcacctctgccgcacagccgttcatttactgccccacctgtcagcggacgatacgggggatgcttctactag

SEQ ID NO: 28704 - DNA, 837 bp, Artificial Sequence
  Description of Artificial Sequence: Synthetic coding sequence
atgaccgacctcaataaacacataaaacaggcccagacgcaacgaaagcagcttctggaggagtccagagaactacaccgggaaaagttgttagtgcaagccgaaaacagattcttcctggaatatctcaccaataagaccgaggagtacaccgaacagccggagaaggtgtggaacagctacctgcaaaagtcaggggaaatcgagcgcagaagacaggagtccgcttcacgatacgccgagcagattagcgtgttgaagaccgcgctgttacagaaggaaaacatacaatcctctttgaagcggaaacttcaggctatgcgcgatatcgctatactgaaggagaagcaggaaaaagaaatccagaccctccaggaagaaaccaagaaggttcaggccgagaccgccagcaagacccgggaagtgcaggcgcagctactccaagagaagcgccttctggaaaaacagctttctgaacccgataggcggctactcggaaagcgtaagcgtcgcgaactcaacatgaaagcgcaagcccttaagctcgccgcaaaaaggttcatcttcgaatactcatgcggcattaaccgggaaaatcaacagtttaagaaagagctcctgcaacttattgaacaggcccaaaaattgaccgccacccagtcccacttggagaacagaaagcagcagctccagcaggaacagtggtacctggagagcctgatccaggcacggcagagactgcaaggatcccacaatcaatgcttgaacaggcaagacgtacccaagacaactccttcccttccacagggcacgaagtctagaatcaaccccaagtag

SEQ ID NO: 28705 - DNA, 1323 bp, Artificial Sequence
  Description of Artificial Sequence: Synthetic coding sequence
atgggcagtaggggccaaggaagccattccaagaaaacacgctccatgcccgttatcctctccccccagcggacaggcagcggggcgacagggggaccagcagcccgggcctacagtgttgcggaggccgtcaagcagtttcgggctggacctgctgggacaggcgcgggatgtagcctacaaggatgctgggctgccccaaggcctttcgagcacaggaccaacaagctgagagaactaagcacgttggcgcactgcagccgagaactccagacccaagtccctgacgcatcggctcactccctggcagtaaccctttctgaactccattcttgccgggatttgcaggacgaatgtctcgatagtagatttgccgaaggaccgagaagattgcttcctccataccactcccttatcaataacttcgtcaagcccgaaaaattaacaaaagtggagacgcgcctgaaggagaaaatagtagccgaaatgacagacttaaacaaacatatcaagcaggcccagacccaaaggaaacagctcctggaggaaagtcgggagcttcacagagagaaacttttggtgcaagccgaaaatagatttttcctggagtacttaacaaataagacggaagaatatactgagcagccggagaaagtctggaacagttatctgcaaaagagcggagaaattgaacggcggaggcaagagtcagcttcccggtacgccgaacagattagtgtcctgaaaactgcactgctgcagaaggagaatatccaaagctctctcaaaagaaagctccaggcaatgcgggatatagcaattctcaaggagaaacaggaaaaagagatccagaccctgcaggaggaaaccaaaaaggtgcaggccgagactgcgagcaaaacgcgcgaagtgcaggctcaactcctgcaggagaaacgactattagagaagcagctgagtgagcctgaccgcagattactcggtaaaagaaagcggagggaactcaacatgaaagcacaagcgctcaagctggcagctaagagattcattttcgagtattcctgcggaataaatagggagaatcagcaatttaagaaagaacttttgcaactgatcgagcaggcccagaagcttacggcaacacaatcgcatctggaaaaccgcaaacagcagctccagcaggagcaatggtacctcgaatcgctgatccaggccaggcagcgcttgcagggcagccacaaccagtgtctcaacagacaagacgttccgaagactactccgtcactacctcagggtacaaagtctcgaatcaatccaaagtag

SEQ ID NO: 28706 - DNA, 672 bp, Artificial Sequence
  Description of Artificial Sequence: Synthetic coding sequence
atgcctaagaaattccagggggagaataccaaatccgccgccgctcgggcccgacgggccgaagcaaaagccgctgccgacgccaagaagcagaaagagctggaggatgcctactggaaggatgacgacaaacatgttatgaggaaggaacagaggaaggaggagaaggagaaacggaggttagaccagttagagcgcaaaaaggaaactcagaggttactggaggaggaggactcgaaactgaaaggcggcaaggctccacgcgtggcgacttcctctaaagtcacgcgcgcccagatcgaggataccctgaggagggaccaccagctgcgggaagcccccgacactgccgagaaagctaagagccatctggaggtgcctcttgaagagaacgtaaatagaagggtccttgaggagggttcggtggaagcccggacaattgaagatgctatcgccgtcctttccgtggctgaagaggccgccgaccgacacccggagagacgcatgagggccgcttttactgccttcgaagaggcccagctgccacgactcaaacaggagaacccaaatatgcgactcagtcaattgaagcagctgctgaaaaaggagtggctgcgatcaccggataatccaatgaatcagcgcgcagtgccctttaacgcgccgaaatag

SEQ ID NO: 28707 - DNA, 672 bp, Artificial Sequence
  Description of Artificial Sequence: Synthetic coding sequence
atgcctaaaaaattccagggggaaaacactaaatcagcggccgcaagagcccggagagccgaagccaaggcagcagcagacgctaagaagcagaaagagcttgaagacgcctattggaaagacgacgacaagcatgtaatgcgcaaggagcagcgaaaagaagagaaagagaaacgtagacttgatcaactagaacgaaaaaaagagacacaaaggcttcttgaggaggaagatagtaaacttaagggtggtaaagccccaagggttgccacttcctcgaaggtgactcgcgcgcaaatcgaggacactctgcgcagagaccatcagctgagagaagcgcccgatacagccgagaaggctaagagccacctggaggttcctcttgaagaaaatgtgaataggcgagttcttgaagaagggtctgtggaagcaaggactatcgaggatgcaatcgcggtacttagtgttgctgaagaggctgctgaccggcatcctgagcggcgtatgagagctgcctttaccgcctttgaggaggctcaattacccaggcttaaacaggaaaatcccaacatgcggctgtctcagctcaagcagctgctgaaaaaggagtggttacggtctccggacaatccaatgaatcagcgtgccgtccccttcaacgcgcccaagtag

SEQ ID NO: 28708 - DNA, 783 bp, Artificial Sequence
  Description of Artificial Sequence: Synthetic coding sequence
atgaataatctcaatgacccacccaactggaacattcgcccaaactctcgcgccgatggaggcgacggctccagatggaattatgccctgctcgtacctatgcttgggctggctgctttccgctggatttggagtcgcgaatcacagaaagaagtagagaaagaacgggaggcgtacagaagaagaaccgccgctttccagcaagatctggaagccaagtatcatgcgatgatcagtgagaaccgtcgcgctgtggcacagctgagtctggaactggaaaaggagcagaatcgcacagcctcatacagggaggccctgatcagtcaggggaggaaactggtggaggaaaagaagctgctcgaacaggaaagggctcaagtgatgcaagaaaagcgacaggttcagcccttaaggtctgcttatttaagctgcctacagcgcgaggagaattggcaacgccgagcccgcctactcctgaaagagttcgaggccgtgctcactgagcggcaaaatatctactgcagtctcttcttgcctagaagcaagagactagagattgaaaaatccttgctcgtgagggccagcgtcgacccggtggcagctgacctggaaatggctgcaggcttgacagacatcttccaacacgacacttactgtggggacgtttggaacacgaacaaacggcaaaatggcaggctaatgtggctgtacttgaagtactgggagcttgtcgtggagttaaagaagtttaagagggtagaggaggctattctggagaaatag

SEQ ID NO: 28709 - DNA, 210 bp, Artificial Sequence
  Description of Artificial Sequence: Synthetic coding sequence
atgaataacttaaatgatccaccaaactggaacatccgccccaactcgcgagcggacggtggtgacggatccaggtggaactacgcactcctggtgcctatgctgggcttagctgctttccgctggatctggtcgcgggagtcccagaaggaagtcgagaaagagcgggaggcctacaggaggcgtacggcggcttttcagcaggactag

SEQ ID NO: 28710 - DNA, 2691 bp, Artificial Sequence
  Description of Artificial Sequence: Synthetic coding sequence
atgatggctcagaagagtcagggctcagataacctgcaagaaggtcaagagaaatctaaaagagaaattctcaaatgtaccaaatcagcttgggccccgctggacgagtggctcccccccgatcctgaagaagaatctcagagtttgactatcccaatgctggaagacagtaaacaggagagcatccagcaatggctggactctggcttctttgtgtctgcaaatgagaattttcagcaggtgatagaccggaccgtgtctttgtacgaacagggaatggtccagatgacagtaaaggattacatgcgaagcctgcatcagtttagcgaaacgcctattctctcacggggcacatcatttaactcctgttactccactgcatctgtaccccagagcatcccagagtggttggaattttgggagatcgatcccgtggaaatcctcctcgatctgggcttcggagctgatgagcccgacatttgcatgcaaattccagcccgctttctgggttgcgggagcgcagcgagaggtattaatatccgcgttttcttggaagcacagaagcaaaggatggatattgaaaaccccaatttgtacggcaggtttcgacagctggagatattggaccatgttacaaacgccttctcctctcttctctctgacgtgtccatcctccccaatcgcgcagaggaaaaggccggtggagagtcagtgcaacgcacgagtgttcaaagctttgaggaggagaccggcaatcctcttgacatgacatcaggaaccgtcggggctcgggtggatcgggcaaactcatgccagtccgacagttctggattcctggaggagcctctggagcccctgccgttacagatgccaagcttgcccaatagccagagcccagctgagaatggtggccggaaacccagagaccagtcacatagcctggtttcctctcaggattgccagctggaaagtgacggtccggacagtaaaagcagagcttctatgagcttcagctcccaggaggctaacgcactcgaacagagggcaagcgtctctgtgatggaggaagaattcctcctcgaggcaatggagggaccacctgaactgtacataccagacatggcgtgtgcgaaaactaccaccagaggcgagtgcccccgcaaagacagtcacttatggcagctgctcccaatgcctcatgcagaatacgaagttacccggccaactgccacctctaaatacgatcatcccctaggtttcatggtgacccacgtaacagagatgcaggactccttcgttcggccggaaggagctggcaaggtgcagtctcatcacaatgagtctcagcgctcacccgggaacgaccacacccaagacaagttccttcatgtggatagcgaggctcctagagaggaggagtcatcagggttctgccctcataccaatcactctctgctcgttcccgaatcaagttcccagtgtattcctaaacattccgagatcacgccatacgcaaccgatctcgcccagacttctgaaaagctgattccacatctacacaagctgcccggagacccagcccaggtcaaatctcggtccgggactctgggccagatcttgcctggaaccgaggctgaaatggaaaacttaccacttaacactggatcctcacgatccgttatgacacagatgtctagctcccttgtgtccgcagcacaaagagccgtagcattagggaccgggcctcgcggcacttccctggagtgcaccgtctgcgatccagtgacagccacggaaaccaggctgggcaccaaagctcgccaattgaatgatgccagtatccagacgagtgctctgtccaataaaacccttacgcacggacctcagccccttacgaagagcgtctccttggactccggcttctctagcatatgcccaatgggcacttgccacgccatacccgcccattgttgcatctgttgccaccatcatccacactgccacggagagcgccagagtcctggccctgagcctagtgtttgccggcattgcctctgtagtttaactggtcaccaagaagcccagtttatgaccaccctgaaggcactgcaggacacaaccgttcgggagctctgcagttgcacagtgcatgagatggaggcaatgaagaccatctgccagagcttcagggaatatttagaagagattgaacagcatctcatgggacagcaggcattgttttccagggatatgagcgaagaagaaagagaagaggctgagcagctacaaactctgcgtgaggccctgcgtcaacaggtggctgagctggaattccagttgggggatcgggcccagcagattcgggaaggcattctacttcagctggaggtgctcactgcagaacctcccgagcactacagtaacctccaccagtacaactggattgaggaaagcaatggccagacgtcctgcagcaagatccatccagggatggccccaagaactgtcttcccaccagatgacggacaagaggccccatgctccgggggaactcaactagctgcctttacgccacccactctcgaaaatagcactcgaatgagcccctcctcttccgcttgggccaaattgggccctacacctctctcaaactgtcccgttggagagaaggacgccgatgtctttctctag

SEQ ID NO: 28711 - DNA, 3135 bp, Artificial Sequence
  Description of Artificial Sequence: Synthetic coding sequence
atgatggcccagaaatctcaggggtcagacaatctacaggaggggcaggagaaatctaaacgagaaatcctcaaatgcacaaaatcagcctgggccccgctggacgagtggctcccccctgaccccgaagaagagagccagtctttgaccatcccaatgttggaggatagcaagcaggaatctatccagcagtggctcgattctggtttcttcgtcagtgccaatgaaaattttcaacaggtcatcgaccgcaccgtgagcctgtatgaacaggggatggtgcagatgaccgtcaaagattacatgagatcactccaccagttttctgagacaccaatactcagccggggcactagctttaactcctgctactcaacggcctctgtaccgcagagtattcctgaatggctcgaattctgggaaattgaccccgtggaaatattgctggatctcgggttcggcgccgatgaacctgatatttgcatgcaaatccccgctaggttcctggggtgcgggagcgccgcaaggggaatcaatattcgcgtgtttcttgaggcccagaagcaaaggatggacatcgagaatccaaacttatatgggcgctttagacagctggaaatcctggatcacgtgacaaatgctttctcttcactcctgagcgacgtgagcatcctgcccaatagggcagaggagaaagccggaggagagagcgttcagcgcacctcagtatccgctgccaaagagcaccggagacgcatggggaaattgctccgcagggccagcaagcagaacatcagacgcgactgcaaccctgaagttagcgaatcattcaaggtgaaagatgaagtgttcgtacccttcacaaaaccctgggattgcggggccgaattagcagctacttctattaaccataaacagaaccacctgtcactgtccgtggagcaccaatcgctgcaggcttgtgacgacctgctgccatatcccccacacggactgttgtccaagcagtggccttgctccagcatgccggctaagcaggccccaccatcgtgcgtcagtgagggctcagtgaaaggccgtacgcagaaagagaatctgttccagaccaacaagttaaagtccctctcccatttggctggaaaaggaccggattctttcgagatggaagaagtccagtctttcgaagaggagactggaaatcctttggacatgacatcgggcaccgtgggggcgcgggtggaccgagcaaattcctgccagtctgatagcagcggttttctggaagagcctctggaacccctgccattgcaaatgccaagcctcccaaattctcagtccccagccgagaacgggggccgaaagccccgggaccaatctcacagcttggtctcatctcaggattgtcagctagaaagcgacgggcctgactctaagagcagagcttctatgagtttctcatctcaggaggctaatgctttggagcagcgtgcttccgtgtcggtgatggaagaagagttcctgctggaagcaatggagggacctcccgaactatacatccctgatatggcctgtgccaaaaccaccacgaggggcgaatgcccgaggaaagactcacacctctggcagcttcttcctatgcctcacgccgaatatgaagttactcgccctacggcgacatccaaatacgaccaccccctgggctttatggtgactcacgtaaccgagatgcaggacagctttgtacggccagaaggagccggaaaagttcagagccaccataatgaaagccagcggtcaccaggcaatgaccacactcaggacaaattcctccacgtcgacagtgaagcgcctcgcgaggaagaatcctcaggattctgcccccacacaaatcactcgttattagtgccagagtcctccagccaatgcattcccaaacactctgagatcacaccatacgccacggatctggcacagaccagtgagaaactcataccacatctgcataagctccccggcgatcccgctcaggtgaagagtcgaagcggcacattagggcagatcttgcccggtactgaggctgagatggagaatctcccactgaacactggctccagcaggagcgtaatgactcagatgtcctcaagccttgtcagcgcagcacaacgcgccgtagccctgggaacaggacctaggggtaccagcctcgagtgcaccgtttgcgatccagtgacagcgactgagacgcgtctgggaactaaagcaaggcagctcaatgatgctagcatacagacgtccgccctaagcaacaagacactgacccacgggcctcagcccttaaccaaaagtgtatcactggattctggtttctcctctatatgccccatggggacgtgccacgcaatccccgcacactgctgcatctgctgtcatcatcaccctcactgccacggtgagcgccaaagcccagggccagaacccagtgtgtgcagacattgcctgtgttctttaaccggacatcaggaggcccagtttatgacgactctgaaagcattacaggacactactgtgagagagctttgctcatgcaccgtacacgagatggaagctatgaagaccatctgccagtcttttagagagtatctggaggagatcgaacagcatttgatggggcagcaagccctgttcagccgagacatgtcagaggaggagcgcgaggaggctgaacaactacagacgctgcgcgaagccctaaggcagcaggtcgccgagctcgagttccaactgggcgatcgagcccagcaaatccgtgagggaattctgcttcagctggaagtcctgacagctgaaccgccagaacattatagcaaccttcatcagtacaattggatagaagagagtaatggacagacttcatgtagcaaaatccaccccggaatggcccctaggacagtcttccccccagatgacggacaggaggccccctgctccggaggcactcagctggcagccttcaccccccccacccttgaaaattcaacgcggatgagcccatccagttccgcctgggccaagctcggacccactcccctctccaactgtcctgttggagaaaaggatgcagacgtcttcctctag

SEQ ID NO: 28712 - DNA, 429 bp, Artificial Sequence
  Description of Artificial Sequence: Synthetic coding sequence
atgatggctcagaagtcacagggtagtgacaacctgcaagaagggcaggagaagagcaaacgcgagatcctaaaatgtaccaagagcgcctgggctcctctagacgaatggctgccaccggatccagaagaggaatcgcaatccttaactatcccaatgctagaggatagcaagcaagagagtatccagcaatggttggattcgggtttttttgtgagcgcgaatgagaatttccagcaggtaatcgaccgaacagtgtccctgtacgaacaggggatggtccagatgaccgtgaaggactacatgcgatctctgcaccagttttccgagacccctatcttgagtagaggaacctcctttaattcgtgttattccaccgcctcagtgccccagtcaatccctgaatggctggagttttgggagatttag

SEQ ID NO: 28713 - DNA, 3189 bp, Artificial Sequence
  Description of Artificial Sequence: Synthetic coding sequence
atgcccacaactgcgtcatgcaagacgatcagcttactgaagctcctgtattccgtatccctgcagaactactcacccatgatggcacagaaatctcagggctcggacaacctgcaagagggacaggagaaatccaaacgagaaatcctgaaatgtacgaaaagtgcgtgggcacccctggatgaatggctcccccctgaccccgaggaagagtctcagagcctgaccatcccaatgctggaagactctaaacaggagtccatccagcagtggctcgattctgggttcttcgttagtgccaatgagaactttcaacaggtgatcgacagaacagttagtctgtatgagcagggaatggtccagatgaccgtgaaagattacatgagatcgttgcaccaattctctgagactcctattctgtctcgaggtactagttttaattcgtgctatagtacagcatccgtgccccaaagtatcccggaatggctcgagttctgggaaattgaccctgtagaaattcttctcgacctgggattcggtgccgacgagcctgacatctgtatgcagattcctgcccgctttctggggtgtgggtcagccgcccggggaatcaacattagggttttcttggaagctcagaagcagaggatggatatcgaaaatcccaatctctacgggagattccgacaactggaaattttggatcacgtgactaacgccttcagctcactgctgtcagacgtctcgatcctcccaaatcgggccgaggagaaagcagggggggagagcgtgcagcgcacctccgtgagtgccgcgaaggagcacaggcgcaggatggggaaactgctgcggcgcgccagtaagcagaacatccggcgagattgcaatcctgaagtgagcgagtctttcaaggttaaagacgaagtttttgttcccttcacaaaaccttgggactgcggcgccgaactggcagctacaagtatcaaccataaacaaaaccatctgagcctgtccgtagaacaccagtcgctgcaggcatgcgacgatctgctgccataccctccacacggcctcctctccaaacaatggccatgttctagcatgcccgccaagcaagcccctccaagctgcgtctccgaaggcagtgttaaaggcagaactcagaaagaaaatcttttccagacaaacaagctcaagagccttagccacctggccggcaagggccccgattccttcgagatggaggaggtgcaatctttcgaagaagagaccggcaaccccctagacatgacaagcggcaccgtgggtgcaagagtcgacagagctaactcctgtcagtcagactcctccggttttctcgaagaaccactagaacctctgcctctgcagatgccctctctgccaaacagtcagtcacctgcggagaacgggggacgcaaaccacgcgatcagtctcatagcctagtatcaagccaggactgtcagctggagtctgatggcccagacagcaaatcccgcgcatctatgtccttttcatcccaggaggccaatgctttagaacagcgcgcttctgtcagtgtcatggaagaagaattcctgctcgaggccatggagggtcccccagagctgtatattccagatatggcttgcgccaaaactactactagaggagagtgtcctcggaaggattcgcatctatggcagctgctccctatgccccacgcagaatatgaggtaacaagacctaccgcgacctctaagtacgatcatcctcttggcttcatggtaacccatgtaaccgaaatgcaggattcgtttgtccggcccgaaggggcaggaaaagtccagagtcatcataatgaaagtcaacggagcccaggtaatgaccacacgcaggataagttcctgcacgtggattcggaggccccacgggaggaggagagttctgggttttgcccccataccaaccactccctccttgttccagagtcatcgtcccagtgtatacctaagcatagcgaaattactccgtacgccacagacctggcccagacgtctgagaagcttatccctcatcttcacaagctgccaggggaccctgctcaggtcaagagcaggagtgggactcttgggcagattctgcctggaacggaagcggagatggaaaacctacccctcaatacgggatcttccagatcggtaatgacgcaaatgtcttcatcgctcgtctctgccgctcaacgggcagtcgccctgggaaccggccccaggggtacttccctggagtgtactgtgtgtgatcccgtgacggctacagagaccaggcttgggactaaggccagacagttgaacgacgcaagcatccagacctcagcgctgagtaacaagacactgacccatggaccacaacccctgaccaagagcgtgagcctcgactcagggttcagctcaatttgccccatgggtacttgccacgccatccctgcacattgctgtatctgttgtcaccatcaccctcattgtcacggagagcggcagagtcccgggcccgagccgagtgtttgccgacattgtttatgctctctcacaggccatcaggaagcccagtttatgactactctgaaagcactccaggacaccactgtgcgagagctgtgcagttgcacagtccacgaaatggaagccatgaagaccatctgtcagagcttccgagagtacctggaagaaattgagcaacacctcatggggcagcaggcacttttttcccgggacatgtctgaggaagagagggaagaagccgagcagttgcaaaccttgcgggaggcattgcgccagcaggtggcggaactcgagttccaactaggtgatagggcccaacaaattagggagggcatcctgctgcagttagaggtgctgacggcagaaccccccgaacattactcaaatctgcaccagtataattggatcgaagaaagtaatggccagactagttgcagcaaaattcacccagggatggctccacggactgttttcccacccgacgatgggcaggaggctccttgcagcggagaactccttagcgctgaactagacccattcttcttcagctccaaggctaacaactccgcgaaggacgaaaagatcaaaagcaaggacttcctcaaaacacaggactcagggcttctttag

SEQ ID NO: 28714 - DNA, 492 bp, Artificial Sequence
  Description of Artificial Sequence: Synthetic coding sequence
atgatggcccagaagtcccaaggtagcgataatctgcaggaggggcaggagaagtctaaaagagaaatcctgaaatgcacaaagagtgcctgggctcctttggatgaatggctccctcccgaccccgaagaggagtctcagagcctcactatccccatgcttgaagacagtaaacaggaaagtattcagcagtggctcgactcagggtttttcgtttccgccaatgagaacttccaacaggtgattgataggactgtgtctctttatgagcagggcatggtgcagatgacagtcaaagattatatgcgatcgcttcatcaatttagcgaaacaccaattctcagccgcggcacgtctttcaacagctgctacagtaccgccagtgtgcctcagtccattcctgaatggctcgaattttgggagatcgatcctgtggagatactgctcgatcttggatttggggcagatgaacccgatatctgtatgcagtag

SEQ ID NO: 28715 - DNA, 507 bp, Artificial Sequence
  Description of Artificial Sequence: Synthetic coding sequence
atgatggcacagaaaagtcaggggtcggacaatctccaggaggggcaggaaaaatccaaacgggagattttgaaatgtacaaagagcgcgtgggccccactggatgagtggttgccccccgatcccgaggaggaaagccaatctttaacgattcctatgctggaggatagcaaacaggaatcgatccagcaatggctcgactcaggattcttcgtttcggcgaacgagaatttccagcaggtcatcgatagaaccgtgtctctgtatgagcagggcatggtacagatgaccgttaaggattacatgaggtctctccaccaattttctgagacccctattctgtccaggggtacaagctttaactcttgttacagcactgcatccgttcctcagagtattccagagtggctggaattctgggagatagatccggttgaaattctattagatctgggattcggggctgatgagccggatatttgtatgcaaattccagcgcgattctag

SEQ ID NO: 28716 - DNA, 3165 bp, Artificial Sequence
  Description of Artificial Sequence: Synthetic coding sequence
atgtccttctcactacagaattattcccctatgatggcacagaaatctcaaggcagtgacaatttacaggagggccaggaaaaatccaaacgcgaaatactgaaatgcaccaagtcagcctgggctcccttggacgaatggctccccccggatcctgaagaggaaagccaaagtttgacaattcccatgctggaggactccaaacaggagtcaatccagcaatggttagattccggtttcttcgtttccgctaacgaaaattttcaacaagtcattgatcgaacggtttcattatacgaacagggtatggtgcagatgacagtgaaggactacatgaggtctctgcaccagttcagtgagactccaatcctgtcaagggggactagttttaacagttgctactcaaccgcgtctgttcctcagagtatacccgagtggctcgagttctgggaaatcgatccagtggagatcttactggatctgggttttggagcagacgagccggatatctgtatgcaaatcccagcccgattcttggggtgtggatccgcggcacgggggatcaacatccgcgtgtttctggaggcgcaaaagcagcggatggacatagagaacccaaacctgtatggccgctttcgtcagctggaaattctggaccacgtgacaaatgccttctctagtttgctgtcggatgtgagcatcctgcctaaccgcgcagaggagaaagctgggggtgagtctgtacaaaggacttcagtgtccgcggcgaaggagcatcgccgcaggatggggaagctgttgcgccgggcctctaagcagaacatcagacgcgactgcaacccagaagtgtctgaatcctttaaagtgaaggacgaggtgtttgttccattcaccaaaccctgggattgcggtgctgagctggctgccacaagcattaatcataagcagaaccatctgtcactctcggtggagcatcagtctttgcaggcctgcgatgatctcctgccataccctccccatggcctccttagtaagcagtggccttgcagctcaatgcccgcaaaacaagccccacccagttgcgtgagtgagggcagcgtaaagggacgaacccagaaagagaatctgttccaaacaaataaactgaagtcactgtctcaccttgcggggaaaggccctgattcttttgagatggaagaggtgcagagtttcgaagaagaaacagggaatcctctggatatgacctctggtaccgtcggagccagggtggatcgggccaactcatgccagagtgacagcagtggtttcctcgaagaacctcttgagccactccccctgcagatgcccagtctgccaaatagtcaatcacccgctgaaaacggaggtagaaagccacgcgaccagagtcatagccttgtctcttcccaagactgtcagttggaatcagacgggcctgactccaaatcgcgagcctctatgtccttctcatctcaggaggcaaatgcactcgaacagagggcttctgtgtcggtaatggaggaggaattcctgctcgaagcgatggagggacctcccgagctgtacattcccgatatggcctgtgcaaagacaacgactaggggggaatgcccccgcaaagatagccacctgtggcagctcctgccaatgccacacgccgaatatgaggtcacaaggcccacagcgacctccaagtacgaccaccccctggggtttatggtgactcacgttaccgagatgcaagactcttttgtgcggcctgaaggcgcaggcaaagtgcagagccaccacaatgagagccagagaagtcccggtaatgatcacacacaggataagttcctgcatgtcgattcagaggcaccaagagaagaggagtcctctggcttttgtccccatactaatcatagcctgttagtgcccgaatcttccagccagtgcatcccaaagcactccgagataacaccctacgcaaccgatctcgcgcagacatccgaaaaactgattcctcatctgcacaagttgcctggagatcccgcccaggtcaagagccgcagtggcacccttggccaaatcctcccaggtacagaagcagagatggagaatttacctttgaacacggggtcatcaaggtctgtgatgactcagatgtcctcgtctcttgtaagtgcagcccagcgcgcagtggccctcggcactggccctcgcggaaccagtctggaatgcaccgtgtgcgatcccgtgacggctaccgagacgcgcttgggcacaaaagcgcggcagctgaatgatgcctctatacagacttctgcactgagtaataaaacacttacccatgggcctcagccactcaccaagagcgtctcactagactccggctttagcagtatttgcccaatgggcacctgccatgccattccagcccactgttgtatatgttgccaccaccatccgcattgtcacggtgaaagacagagcccgggcccggagccatctgtctgtaggcactgtctgtgctccctaacaggccatcaggaggctcagttcatgacaacgctaaaggcgctacaggatacgaccgtccgagagctgtgttcttgcacagttcatgaaatggaggctatgaaaaccatttgccagtcgtttagggagtacctggaggaaattgaacagcatctcatggggcagcaagccctgttctcccgcgatatgagcgaagaggaacgggaggaagccgaacagctgcagacactcagggaggcgctgcggcaacaggtggcggagctggaatttcaactgggtgatagagcacaacagatcagggagggaatcctgctccaacttgaggtgctgaccgcagagcccccagaacactattccaacttgcatcaatacaattggatagaagagtcaaatgggcaaacttcctgtagtaagatacatcctgggatggcacctcggacagtgttccctcccgatgatgggcaggaagccccatgcagcggcgggactcaactggcagcattcacaccgcctacactggaaaattccactcgcatgtccccctcaagctctgcatgggccaagctcggaccaactcctctatccaattgcccagtgggtgaaaaagatgccgacgtcttcctatag

SEQ ID NO: 28717 - DNA, 2148 bp, Artificial Sequence
  Description of Artificial Sequence: Synthetic coding sequence
atggcggctgacgaaagcagtcaaaacactcttcgcctgcaatttaaggctatgcaagagatgcaacataagaggctgcagaagcaaatggagaaaaagagagagaaggagctaagtcttaaaagtcgtgccgatgatcaggaggaaccattagaggtctccgacggtctgagtctcctccacgctggggagccaaactctaaaaattcattcgaaaaaagggttctcgaggatgagattgagcatctgagaaacgagctgcgcgagactgtggatgagaatgggaggctgtacaagcttttaaaagaacgagacttcgagattaagcatcttaagaagaagatcgaagaggacaggttcgcttttaccggtaccgctggagtggcaggggatgtggtcgccactaagattgtggaactgtcaaaaaagaatagacttctgatggcagaaagcgaaggagccaagaccagggtgaagcagctgaccaacagaattcaggagttggaaagggaacttcaaactgcacttactcgcctcagcgccaagggggcgactgacgcgggggctaagcctccgcgcgcccagatgggggacagagcactcctggagaccccagaagtcaaggcactgcaggaccggttggtggcgacaaatctgaaaatgagcgacttgcggaatcagattcagtcagtgaaacaggagctgcgtatggcgcagaaggtgctagcaagagaggtgggcgaggacatcaacgttcagcaactgctctcctcaccagggacttggaggggcagagctcagcagatcctggtgttacaatccaaagtgcaggagctagaaaagcagctcggccaggctcgtagtcagagtgcggggaccgcctccgacgaactgtctgtctaccctgacccaagaaagctcagtgcacaggaaaagaatctgcttcggattagaagtctggaacgagagaagcaggagggcttggaaaagctggccagcgagagggacgtcctccagagggagcttgaggaactgaaaaaaaaatttgaaggaatgcgttcacggaacaagctgttgagttccgagatgaaaacattgaagagtcaaatgggcacactggtagagaagggacggcacgacgatgaactgatcgacgcgttgatggaccagctcaagcagttgcaggagattctaggcagcctgtcactgcaggaggagaagacaagagtgagtcagcatcacctggatcagcaattaaactccgaggcacagaggtctaatagtctcgtggctcaactacaagcgatggttgcagaacgggaggcgaaagtaagacagctagagatggagatcggccaactcaatgttcattacctccgaaataagggcgttggagagggttcatcagggagggaggtatcacctgcttacacccaattcctcgaggacccaggactgactaaatcccctgcatcggctggggaccatgtggggagacttgggagttcccggtccgtcacctctctgggccacactctcgttgagtccgcgctgacaaggccgtcactgccttccccgcatcgtactagtccacgcttcagcgatagtccagagcaaaaaggttggcaggcccaagtgtctgaaatcaaggccttgtggcaggcagccgaagtggaaagggacagactgacagaattcgttaccgtgctgcagaaacgggtggaagagtccaattctaaattgctggagtctgagcgaaaacttcaagaggagcgccatagaacggtggttctggagcaacacttagagaagatacgattggagccggggaaggcttctgcatcccagagggcggcccctcgcacgaagaccggactgccaacctccaataatcgccataatccaaccgggagcgagaagaaagacccttcctttgcccaattgagcgacgttccagtggaatctcagatggaggagctaactacaaggttggctatccaagtggaggagaacgaaatgctgaaggcagcactggggtccgcactgcgggggaaggaagaggacttcaggatgtaccacgagattctgggccaggtcaagtctgtgttcctgcaagccctcaggcagcagaagaccggcaaacagtag

SEQ ID NO: 28718 - DNA, 1947 bp, Artificial Sequence
  Description of Artificial Sequence: Synthetic coding sequence
atggagggtgccggatatagggtggtctttgaaaaggggggggtttatctgcacacgtccgccaagaaatatcaagatagggatagtttgatcgcaggggtgatccgcgtagtggaaaaggataacgatgtccttttgcattgggcgcctgtagaggaagctggtgactctacacagattttattttctaaaaaggactcatcaggcggcgatagctgtgcatccgaagaggaaccaacttttgatcccgattacgaaccagactgggctgtgatatcaaccgtgcgaccccagctgtgccactcagagcccaccagaggtgcagaaccctcttgccctcagggctcctgggccttcagcgtgtccctaggcgaactgaagagcatcaggagaagcaagcctggcctgtcttgggcctacttggttctggtcactcaagctggcggtagcctgccggccctgcacttccacagaggcgggacgagagccctactgcgagtcctgtctagatatttactgctcgctagttcccctcaagactctcggctatacctcgtgttcccacatgattcctcagccctgtcaaacagtttccatcatttgcaactgtttgaccaagatagttcaaacgtggtaagtaggtttctccaagacccatattcaacaactttctctagtttttcccgcgtgaccaatttttttcggggggctctgcagccccagccggagggcgccgcctcagatctccctccacctcctgacgatgaaccagaaccaggatttgaggtgatttcctgtgtggagctgggcccacgtcctacagtggagagagggcccccggtgacggaggaagagtgggcccggcacgtggggcctgaaggtcggctccagcaagtacccgagctaaaaaatagaatcttcagcggagggttgagcccctccctgaggcgggaggcctggaagttcctcttgggctatctgtcatgggaggggaccgccgaggagcataaggctcacattaggaaaaaaactgatgaatattttcgtatgaagctgcagtggaagagtgtgtctccagagcaagagaggcggaacagcctgctgcacgggtataggtctctcatcgagcgtgatgttagcaggacagacagaacaaacaagttctatgagggccccgagaacccaggccttggcctcctaaatgatatcctcttgacttactgcatgtatcatttcgatctggggtacgtgcagggtatgagtgatctactgtcccctattttatacgtcatccagaatgaggttgatgccttttggtgcttttgtgggtttatggagctggtacagggcaattttgaagagtctcaggagactatgaaacgccaactcggccgacttttgctgctgctgcgtgtgttagatccactcctatgcgatttcttggactctcaggactctggaagcctgtgtttctgcttccgctggctgttgatttggtttaaacgcgagttccctttccccgacgttctccggctctgggaggttctctggacagggctgcctggaccaaatctccatctgttagtggcatgcgcaattctcgatatggagagagacaccctgatgttgtctggttttgggagtaatgagattctgaagcacataaacgaactgactatgaagctctccgtggaagacgtgttaacccgggcagaggccctccaccggcagctcaccgcatgccccgagctgccccacaacgtgcaggagatcctggggctggcgccacctgcagagccccacagcccgtctccgacagcaagccccctgccgttgagtcctaccagggcacccccgacccccccccctagcactgacactgccccacagccggactctagtctcgaaattctgccagaggaggaggacgagggtgcggattcttag

SEQ ID NO: 28719 - DNA, 480 bp, Artificial Sequence
  Description of Artificial Sequence: Synthetic coding sequence
atgggcgaacggaagggggtgaacaagtactatccccccgattttaaccctgaaaagcatggaagtttgaaccggtaccacaactctcatcccctgagagagcgtgcccgcaagttgagccaaggtattctaataattcgtttcgagatgccatacaacatctggtgcgacggctgcaagaaccatatagggatgggagttcggtataatgcggagaaaaaaaaggtcgggaattattacaccacccccatttaccgctttaggatgaagtgccatctgtgcgtgaactacattgaaatgcagactgatcccgcaaattgtgattatgttatcgtgtccggggctcaaagaaaggaggaaaggtgggacatggcagataatgaacaggtgctgactacgggggaaaggcacccgctcacttgcctgggtgctctggcactgtccttacgctgggggccacagtccccagctgaattgtag

SEQ ID NO: 28720 - DNA, 984 bp, Artificial Sequence
  Description of Artificial Sequence: Synthetic coding sequence
atgcaaaaaatcaagtcgctgatgactaggcaggggctaaagagtccccaggaatctctctcagacctgggcgcaattgaatcactaagagtccctggaaaggaagagttcagagagctgagggaacaaccctcggaccctcaggctgaacaagaactgattaactctattgagcaggtgtacttctcagtcgattccttcgatatagtgaagtacgagctcgagaagctgccacccgtgcttaatttgcaggagctggaagcctatcgcgataaactaaaacagcagcaagctgcggttagcaagaaagtagcagatttgatactggagaaacaacccgcatatgtgaaagaactcgagagggttacgagcctgcagacgggtctgcagctggcagctgtgatttgcactaacggacggagacacctgaatattgctaaggaaggatttactcaggcgagcctggggctgttggcgaaccagaggaagcggcagttgctgattggattgcttaaaagtcttcgcaccatcaagaccctgcaacggaccgacgtcaggctgtcagagatgcttgaggaggaggattatccaggcgctatccagctgtgtctggagtgccagaaggccgcctccacattcaagcactattcatgcatcagcgagctgaacagcaagttgcaagatactctggagcagattgaagagcagctggacgtggcgttaagtaagatttgtaagaacttcgatatcaaccattatacgaaagtgcagcaggcatatcgtctccttggcaagactcaaaccgctatggaccaactccacatgcacttcacgcaagccatccacaataccgtgttccaggtagtgctcggctacgttgaactctgcgccgggaataccgacaccaaatttcagaagctccaatacaaagatctctgtactgtttgctctgaccttatcactattcacatctctttgctgtag

SEQ ID NO: 28721 - DNA, 2895 bp, Artificial Sequence
  Description of Artificial Sequence: Synthetic coding sequence
atgcaaaagatcaagtcccttatgactcgacagggattaaagtcacctcaagagagtttatcagacctcggtgctatcgagtcattacgggtgccggggaaggaagagttccgagagctgagagagcagccgagcgaccctcaggcagagcaagagctgataaactctatcgagcaggtttactttagcgtagattctttcgatattgttaaatatgagctggagaagctgcccccggtattaaacctgcaggagctcgaagcctaccgcgacaagttaaagcagcaacaggccgccgtgtctaagaaggttgctgatctgatccttgagaagcaaccagcttacgtgaaagagctggagcgagttacctccttgcaaactggacttcagttggccgcggtcatctgcaccaacggtagaaggcacctcaacatagccaaagaaggctttacccaggccagcctcggactcctggccaaccagagaaagagacagctattgataggcttgctcaaaagtttgaggactattaaaaccttgcaacggacagatgtgcgcctgtccgaaatgctcgaggaagaggattacccaggagctatccagctatgtctggaatgtcagaaagccgcatccaccttcaaacattattcttgcatatctgaactgaacagcaagctgcaggacactctggaacagattgaagaacagctagacgttgctctctccaaaatttgcaagaattttgacatcaaccattacacaaaggtgcaacaagcctatcggcttctgggtaagactcagacagctatggaccaattacatatgcattttacccaggccattcataacaccgtgtttcaggtggttttaggctatgtggaactgtgtgcaggcaacacagacacaaagttccagaagctgcagtacaaggacctgtgcactcacgtgacacctgactcctatattccctgcctggcagacctttgtaaagcactctgggaagtgatgctgagctactacaggacaatggaatggcacgaaaagcatgacaacgaggataccgcttctgccagcgaggggtccaatatgataggaacagaagaaactaattttgaccgcggctacattaagaaaaagcttgagcatggactgactcgaatatggcaagacgtacagctgaaagtcaagacatacctattgggtacagatctctctatcttcaaatatgacgattttatttttgtgttagacattattagccggctgatgcaggtgggtgaagagttctgtggaagtaaaagcgaggtgctgcaggagagtattagaaagcaatctgttaactatttcaaaaactaccaccgcacacgcctcgacgaattgagaatgttcctggaaaatgagacatgggagctgtgcccagtgaaaagcaatttctccatcctgcagctacacgaatttaagttcatggagcaaagccgttccccaagtgtatcccccagcaagcagcctgtgagcacttcctcgaagaccgtgacactgttcgagcagtattgctcaggggggaatcccttcgaaattcaggccaaccacaaggacgaggagacagaagacgtccttgctagtaatggatatgaatctgacgagcaagaaaagagcgcataccaagaatatgactctgacagtgacgtgcctgaagagctgaagcgagattacgtggatgaacagaccggtgatggaccagtaaaatctgtgagtagggagactctgaaatccagaaagaagtccgactattcactgaataaggtaaatgctcctattctgactaatactacccttaacgtgattagacttgttgggaaatatatgcaaatgatgaatatcctaaagcctatcgctttcgacgtgatccatttcatgtctcagttgttcgactattatttgtacgccatctacacatttttcggacggaacgactcgttggaatctactggcctggggctgtcaagcagtcggttgcgaacaaccctgaacagaatccaggaatcactgatcgatttggaggtcagcgcggaccctactgctaccctgactgccgctgaggagcggaaagaaaaagtgccctccccccacttgtctcacctggtcgtgttaaccagcggcgacacactgtacggacttgctgaacgggtagtggccacggagagcctggtgtttctagcggagcagttcgagtttctgcagcctcatttggatgcagtcatgcccgctgtgaagaagccgttcctgcaacagttttattcacagacggtgagcactgcttccgaactcaggaaaccaatctactggattgtggctggaaaagctctagactatgagcaaatgctccttttaatggctaacgtgaagtgggacgtaaaggagatcatgtctcaacacaacatttatgtcgacgccttgcttaaggagtttgaacagttcaaccgtcggttaaacgaagttagcaagcgggtgaggataccacttcctgtttctaatattctgtgggaacattgtatccgactagctaacagaacgattgtcgaaggctatgctaacgtgaaaaagtgctcaaatgaaggtcgtgccctgatgcaactggatttccagcagtttcttatgaagttagaaaagttgaccgacatccgacctattcccgacaaggaattcgtcgaaacctatattaaggcttattaccttaccgagaacgatatggaaagatggattaaagagcaccgcgagtattctaccaagcaactgaccaatcttgtgaacgtgtgtctgggcagtcacatcaataaaaaagctcggcaaaagctgctagccgctatcgatgacatcgaccggcctaaaaggtag

SEQ ID NO: 28722 - DNA, 1242 bp, Artificial Sequence
  Description of Artificial Sequence: Synthetic coding sequence
atggatcagctccacatgcattttacccaagcaatccacaacaccgtgtttcaggtcgttctggggtacgttgaactttgcgccggaaacacagacactaaatttcaaaagctgcagtacaaagatctgtgtacacacgtcactcctgactcttacattccctgccttgcagacttatgtaaggctttgtgggaggtcatgctgagttactaccgcacaatggagtggcacgaaaaacacgataacgaagatactgccagcgcatcggaggggagtaatatgatcgggaccgaggagactaacttcgataggggatacatcaaaaaaaaactggagcacgggctcacacgcatctggcaagacgtccaactgaaggtcaaaacttacctcttgggaaccgatctctccattttcaagtacgacgactttatatttgtgctcgacatcatctcacggctgatgcaggtcggtgaggaattttgcggtagtaaatccgaggttttacaagagtccataagaaaacagtctgttaattacttcaaaaactaccaccggacccgcctcgacgaactacgaatgtttctggagaacgaaacgtgggagttgtgccctgtgaaaagcaattttagcatcttacaactccatgaattcaaattcatggagcaatcacgctccccgagtgtatcacccagcaaacagccagtctccacgtcatcgaaaaccgtcactctgttcgagcaatactgtagcgggggcaaccctttcgagattcaagcgaaccacaaagatgaagaaacagaggatgtcttagctagcaacggttacgagtctgatgaacaggagaagagtgcgtatcaggagtacgactccgactcagacgtccccgaagaactgaaacgcgactatgtcgacgagcagacaggggatgggcctgtaaagagcgtgtcccgagagactctgaagtcaagaaaaaaaagtgattatagtttaaataaagtgaacgctcccatcctgacaaacacaacgctcaacgtgatccggctcgttgatggagtgtcgctctgctgtctcgggtggagcacagtggcacacctccattcgctgcaagctcctccaccagggtttaagcctttctcgtgtctgagcctgcctcgctcttgggattaccggcgcccccctccaaggcccgctaactttctttactttctgttcttttcccgggatggcgttagcccgtgttag

SEQ ID NO: 28723 - DNA, 2055 bp, Artificial Sequence
  Description of Artificial Sequence: Synthetic coding sequence
atgcagaaaatcaagtctctgatgactcggcagggactcaaatctccccaggagtccctatctgatctcggcgccatcgaatccttacgggtcccgggtaaacacgtgacaccagactcatacattccatgcctggcagatctttgcaaggctctctgggaagtgatgctttcatactatcggacaatggaatggcatgaaaagcatgataacgaagatacagcaagtgcatccgagggaagtaacatgataggaacagaagagacaaatttcgatagagggtacattaagaagaaattagagcatggccttacacgcatatggcaagacgtacagttgaaggtgaagacctatctcctgggcaccgatctctctattttcaagtacgacgactttattttcgtcctggacattataagccgactcatgcaggtaggggaagaattttgtggttccaaatcagaggttctgcaggagtctataagaaagcaaagtgttaattactttaagaactaccacaggacacgcttggacgagctgcgtatgttcctggaaaatgagacctgggagctttgccctgttaagtcgaacttcagtatccttcaactccacgagtttaaattcatggagcagtcacggtctccttccgtgtctccgtcaaaacagcctgtctccacctcctctaaaacggttaccctttttgagcaatactgttccgggggaaatccatttgaaattcaggccaatcacaaagatgaggagactgaggatgtactggcttccaacggatacgaatcagacgagcaggagaaaagtgcttatcaggagtatgacagcgatagtgacgtgcctgaggaactaaagcgggattatgttgatgagcagaccggggacggccccgtgaaatcagtatcccgcgaaactcttaagagccggaaaaagtccgactactctctgaataaggttaatgctccaattctcacaaataccaccttaaatgtaatcagactggtgggaaagtatatgcagatgatgaatattctgaaacctatcgcattcgatgtcatccattttatgtcccagcttttcgactattatttgtatgccatctatacctttttcggtcggaatgacagcctggagagcaccggacttgggctgtctagctcgagactacgaaccacattgaacagaattcaggagtcactcattgacttggaagtgtctgccgatccgaccgccacactgaccgccgcagaagagcgcaaagagaaggtgccgtcccctcatctttcccatctcgtggtgttgaccagcggcgacaccttgtatggcctggctgagcgggtcgtcgccacagaaagcctcgtctttctggccgaacagttcgagtttctccagcctcacctggacgctgtgatgcctgccgtcaagaaaccatttcttcagcagttttattcccagacagtttcaactgcctctgagctgcgaaaacctatctattggatcgtggccgggaaggcgctcgattatgagcaaatgctgttactgatggcgaacgtgaaatgggatgtgaaagaaattatgtcccagcacaacatttacgtcgatgcactgctgaaggagttcgagcagttcaatcgtcgccttaacgaagtctcgaagagagtcaggattcctctccctgtttctaacatcctgtgggagcactgcattaggctggcgaatagaacaatcgtcgaggggtatgccaatgtgaagaagtgtagtaatgagggcagggccctaatgcagctggacttccagcagtttctcatgaaattggagaagttgactgacataagaccaattcctgataaggaattcgtggaaacatatatcaaggcttattacctgaccgagaacgacatggaacgttggatcaaggaacaccgggagtatagtactaagcaactgacgaacctggtcaatgtctgcctggggtctcacatcaataaaaaggcccggcagaagttgctcgctgcgattgacgatattgatcgaccgaagagatag

SEQ ID NO: 28724 - DNA, 1782 bp, Artificial Sequence
  Description of Artificial Sequence: Synthetic coding sequence
atgctggaggaggaggactatccaggggctatccagctttgtctggagtgccagaaggccgcctctacatttaaacactattcttgcatttctgaattgaactccaaacttcaggacaccctggaacagatcgaagagcagctggacgtagctctctccaagatctgcaagaatttcgacataaaccattacactaaggtgcaacaggcttatcggctactgggaaagacgcagaccgccatggatcagttgcacatgcacttcacacaggctatacacaatacagttttccaagttgtcttagggtacgtggaactgtgcgctggaaacaccgacacgaagttccaaaaattacaatataaggatttgtgcacacacgtcacacctgatagttatataccatgtcttgcagacctgtgcaaagcactctgggaggtgatgctcagctactaccggacgatggagtggcacgaaaaacatgataatgaagataccgcgtcggcctcggagggaagtaatatgattggcaccgaggagacgaatttcgacaggggctacattaaaaaaaagctggagcacgggctgacccgtatctggcaggacgtgcaactcaaggtgaagacatatttgctgggtacagacttgagtatttttaagtacgacgatttcatttttgtgctggacatcattagtcgccttatgcaggtaggtgaggagttttgcggctccaagtcagaagtgctccaggagagtatcagaaaacagtcagtgaactactttaaaaactaccatcggacacgcctcgatgaactgaggatgtttctcgagaatgaaacctgggagttgtgtcctgtgaagtcaaattttagcatcctgcagctgcacgagttcaagtttatggaacaatcacgttcaccctcagtctcgccctcaaagcagccggtctctactagtagtaaaaccgtgacgctgttcgaacagtactgctcaggaggcaacccttttgagatccaagcaaatcacaaggatgaagagacggaagacgtgctggcaagtaatggctatgagagtgatgagcaggagaagagcgcctaccaggagtatgactccgactctgacgtgcctgaagagctgaaaagagactatgtagacgagcaaacaggagacggacccgtaaaaagtgtctctcgggagacactgaagagccggaagaaaagtgactacagtctcaacaaagtcaatgccccaattctgaccaatacgacactcaatgtgatccggctggtgggaaagtatatgcaaatgatgaacatcctgaaacctatcgctttcgacgtaatccactttatgtctcagttgtttgactattacctttacgccatatacacgttttttggaaggaatgactctctggagtccactggcctcgggctgagtagttctcgcctccgcactacactaaacaggatacaggaaagcctgatcgatctagaggtgtctgccgacccaactgccaccctcacggctgccgaagaacgtaaagaaaaagtcccgagtccacatctgagccatttggtggttctcacctccggcgatactctttatggactcgcagaacgcgtggtggcaacagaaagcttggtattcctggcagagcagttcgaattccttcaacctcaccttgatgctgtgatgcccgcagtgaagaagccgtttctccagcagttttattctcagtcccagccgccagtgaattatggtaaccaattcactggcctgtag

SEQ ID NO: 28725 - DNA, 2805 bp, Artificial Sequence
  Description of Artificial Sequence: Synthetic coding sequence
atgttgaccttggaagagtttcgggagttacgggaacagcccagcgacccgcaagcagaacaggaactcatcaacagcatagaacaagtctacttctccgtggacagtttcgacatcgtgaagtatgaactggaaaaactgccgcccgtactgaatctgcaggaactggaggcctaccgggacaaactgaaacagcagcaggctgctgtttctaagaaggtggcggacctaattctggagaagcagcctgcgtacgtcaaagagttggagagagtcaccagtctgcaaacaggactacaactggctgccgtgatttgcaccaatggcagaaggcacctgaacattgcaaaagagggttttacccaggctagcctaggtctcctcgccaatcagaggaagcggcagcttttaatcggccttctcaaaagcttacggaccattaaaaccctgcaacgcacggacgtccggctttccgaaatgctagaagaggaggactatccaggtgccattcaactgtgtctggagtgtcagaaagctgcctctacatttaaacactacagctgcatctcagagttgaacagcaagctgcaggatactcttgagcaaatcgaagagcagctggatgtggcactgagtaagatttgcaaaaactttgacatcaaccactacaccaaggtccagcaagcctacaggttgctggggaagactcaaaccgctatggatcaactccacatgcactttacacaagctatccacaacacagtgtttcaggtggttctcgggtacgtagaactgtgcgccggaaacaccgacaccaaatttcagaagctgcaatataaggacctgtgcactcacgtgactcccgacagctatattccttgccttgcggatctctgcaaggctttgtgggaggtcatgcttagttattacaggactatggagtggcatgagaagcacgacaacgaagacaccgctagcgcttctgagggaagtaatatgatcggcaccgaggaaaccaatttcgaccgtgggtacataaagaagaagctggagcatggcctcactagaatttggcaggatgtgcaattgaaagtgaaaacctacctactggggacggacctgagcatattcaagtatgacgacttcatttttgtccttgatattatcagccggcttatgcaagtgggagaggagttctgcggttcaaagagtgaagtgctgcaggaatctattcggaagcaaagcgtcaattattttaaaaactatcacagaactcggcttgacgaactgcgcatgtttctagagaatgaaacttgggaactgtgccccgtgaaaagtaacttctccatccttcagctccacgaattcaagttcatggaacaatctcgctctcctagcgtcagtccgtcgaagcagcccgtctcaaccagctccaaaactgtaaccctctttgaacaatattgttccgggggaaaccccttcgagattcaagccaaccacaaggacgaagaaacagaggacgtgctcgctagcaatggctacgaatccgacgagcaagagaagtccgcctatcaggagtacgattccgattcggacgtccccgaggagctcaagagagactacgtggacgagcagactggcgacggcccagtcaagtctgtctctcgtgaaactcttaaatcccgtaaaaagtcggactacagcctgaataaagtgaacgcgccaatcctaacaaacaccaccctgaacgtgatccggctcgtgggcaagtatatgcagatgatgaatattttgaaaccaatcgctttcgatgttatccacttcatgagccaactgtttgactattatctgtacgccatctacactttttttggtcggaacgattccctggaaagcaccggtctggggctttcctctagtagactgagaaccaccctgaacaggatccaggagtccctaatcgatttggaagtgtcagcagatcccaccgctacactgacagctgcggaggaaaggaaggaaaaagtgccaagccctcacctgagtcacctcgtcgtgttgacaagcggagacacactctacggcctggccgaaagagtggttgccacggagtccctagtgtttttagccgaacagttcgagttcttgcagccgcacctggacgccgtgatgcccgcagttaagaagcccttcctccagcagttttactcacagacggttagcacagcttccgagctgcgcaagcctatttactggattgttgccggtaaggccctcgattatgaacagatgcttctcctgatggccaacgtcaagtgggatgttaaagaaattatgagccagcataatatctacgttgatgccctgctcaaggaattcgagcaattcaaccggaggctaaacgaggtgtcgaaaagggtaaggatcccgctgcctgtcagcaatatcctgtgggaacattgtatccggctcgctaatcggactattgtcgagggttacgccaacgtcaaaaaatgttccaacgagggccgcgccttaatgcagctcgattttcaacagttcctgatgaaacttgagaaattaactgatattagaccaattccggacaaagaattcgtcgagacctatataaaagcctactacttaaccgagaacgatatggagcggtggataaaagagcatcgggaatactcaaccaaacaacttaccaacctcgtgaatgtctgcctgggcagtcatattaacaagaaagctcgccaaaaactcctcgccgccatcgatgatatcgaccgccccaaacggtag

SEQ ID NO: 28726 - DNA, 1998 bp, Artificial Sequence
  Description of Artificial Sequence: Synthetic coding sequence
atggagcccagagtggtgaagccacccggccaagatctggtggtagagtctctaaagtctcgctatggccttggaggcagttgtcctgacgagtacgacttttctaatttttatcagtccaaatacaagaggcgaacactgacttcaccgggggatctggacatttactccggggacaaggtaggttcttcattaaagtattccgatgagtcgaagcactgccgcacgcctctgggctcactatttaagcacgtgaacgtcaactgcctggacgacgagttggatagtttccacgacttgaaaaagcaggaaactgaggaagagctgatagagaatgactaccgggttagcacctcaaaaattaccaaacagtcatttaaagagatcgagaaggtcgccttaccaactaataccacctcctccagaccgcgaactgaatgttgcagtgacgccggcgactccccactgaaacccgtcagttgtccaaaatcaaaggcatccgacaagcgttccttgctaccacaccagataagccaaatctacgatgagttgttccagattcacttaaagcttcagtgtgagacagctgcccagcaaaagtttgccgaggaactccagaagcgcgaaaggtttttgttggagagggaacaactgctttttaggcacgagaatgccctgtccaagattaagggagtcgaagaagaggttcttacccgatttcagatcatcaaggaacagcacgatgcagaagtcgagcatcttaccgaggtgctaaaggaaaagaacaaagagacaaagcggctgagatccagcttcgacgctctaaaggagctcaacgacaccctcaagaagcagcttaacgaagctagtgaggagaatcggaaaattgatatccaggcaaaaagagtgcaggcacgccttgataacttgcagagaaagtacgaatttatgactatacagcgtctgaaggggtcatcacatgccgtgcatgagatgaaatcactgaagcaggagaaggcacctgtgtccaaaacctacaaggtgccgcttaatgggcaggtttatgagttactgaccgtgttcatggattggatctcggatcatcatttatcaaaggtgaagcacgaggagtccgggatggatgggaagaaaccacagctaaaattcgctagccagcgcaacgacatccaggagaaatgcgtaaagcttttgccactgatgaccgaacaattgcaatggatgcccttcgtgaatatcaaactacacgagccgtttgtaaaattcatttactggagcctgcgccagcttgacgcaggagctcagcacagtaccatgaccagcactctgcgacgccttggcgaagacatattcaagggagtggtgaccaaaggcattcaggacaattcacctcaacactccgtcgagaataaacctaagacggctgctttctttaaaagctcaaatctgcctcttcggtttctgtcaacactgatagtgctgaaaacagttacacaggctgactatctggcgcaagccttcgattcactctgtctcgatctcaagaccgaagagggtaaaaccctgtttctggagtatcaggcggtgcctgtgatcctctcccatctaagaattagcagtaagggcttgctcagtaacgtgatagactcgctgctccagatgacagtggaatcgaagagtttgcagccctttttggaagcttgttcaaatagcttattctttcgcacatgttcagttcttctacgtgccccaaagctggatttgcagatcctggagaagctgagcatcattttgcagaaattgagtaagatcaagagcaacaagaagctctttgagctcttcaccatccatctaatgcttcaggaaattcagaggactaccaacccagagcatgcatttctatgcattaatctgaatagcacactattcaaccttggtcttactaaatgcaatagcctagtgtctagtgcttctccgtag

SEQ ID NO: 28727 - DNA, 1734 bp, Artificial Sequence
  Description of Artificial Sequence: Synthetic coding sequence
atggaaccccgagtggtaaagccccctggccaggacttagtcgtggagtcgcttaaatcacgatacggactgggcggatcttgtcccgacgaatatgacttctctaacttttatcagtcaaaatataagcggcggaccttgacgtctccaggagatttggatatctatagtggcgataaggtcggatcatctctaaaatacagtgacgaatctaaacattgtaggactcccctggggagtttgttcaagcatgtcaatgtcaactgtttagatgacgaattggactcctttcatgatctgaaaaagcaggaaaccgaggaggaattaatagaaaatgattacagagtgagcacatccaaaattactaagcagtcgttcaaagagattgaaaaagtagccctgcctacgaacacgacatcctcgagaccaaggaccgagtgctgcagcgatgctggagattcccctctcaagcccgtgtcatgtccgaagtcgaaagcgagcgacaaaagatcactgctgcctcatcagatttcccaaatatacgatgaactgttccaaatccacctcaaactgcagtgcgagactgcggcacagcagaagttcgctgaagagcttcagaaacgtgagcggttcctgttagagagggaacagctgctgttcagacacgaaaacgccctttccaaaatcaagggagttgaagaggaggtcctgacacggttccagattataaaagaacagcatgatgctgaagttgagcatctaacagaggtgcttaaggagaagaacaaagaaacgaaacgtcttagaagcagcttcgacgctctgaaggagctcaacgatactctcaaaaagcagctgaatgaggcctctgaagaaaatcgtaagattgacatacaggcaaaaagggtacaggcccgattagacaatctccagaggaagtatgagtttatgaccatccagaggctgaagggcagttcccatgctgtccacgaaatgaagagccttaaacaagagaaagcgcccgtttctaagacatacaaggtgccactcaatgggcaggtgtacgaactgctgaccgtgtttatggactggatctctgatcaccacctgtctaaagtgaagcatgaggagtcaggcatggatggaaagaagcctcaacttaagttcgcaagtcagcgcaatgatatacaagagaagtgtgtgaagctcctcccactaatgacagaacaactgcagtggatgccatttgtgaatatcaagttgcatgaaccttttgtgaagtttatctactggtccctgaggcaacttgatgcaggggcccagcatagcacaatgacatcaaccttgagacggctgggtgaagatatctttaaaggcgtcgtgacgaaaggaattcaggacaacagcccccagcattctgttgaaaataaacccaaaaccgcagccttttttaaaagcagcaatctgccactaaggtttttgagcactttaatagtgctcaagacggtcacccaagccgactacctggctcaagcctttgacagcctctgcctagacctgaaaacagaggaaggaaagacactattcctcgaatatcaggcggtcccagtgatactgtcccacctgcgcatctcctccaaaggcctgctgtcaaacgtcatcgactccctcctccagatgacggtggagtctcgagtaattagatcaagcctgaatttcctcaggttcatctag

SEQ ID NO: 28728 - DNA, 492 bp, Artificial Sequence
  Description of Artificial Sequence: Synthetic coding sequence
atgggcgacgaatgttcaaatccagatctgctggctgaaccaggatcatctcctccatgggatcacgggaaccagcgccaggaggccgccaacgaaagcaacacccgtgtgcctcgagtccttaaggcccatctggggccagagaccgcacagccgaccaagaggtccaaacggaaccgctggcggcggcagtcatgccagggacccagcccagcaagatctgggcaatttcttggctctgctgacctcgggcttcaacgtggagtactaaaatcagccgcccgcacatgtttgtcggagatctctaattctactcgcgcatcccctgagtctgcccaatctactgaccccggacgagctgcccgtcctaggacccgtacactgccaacaccccacagttttaagatcggtgaggaagccgaagaaatgaagaagaagaaggagaggaaacgtcgtaaagaacgaaagaaggaaaggaacttcaagaaatag

SEQ ID NO: 28729 - DNA, 54 bp, Artificial Sequence
  Description of Artificial Sequence: Synthetic coding sequence
atgggagatgagtgcagcaatcctgatctcctggccgaacccggtagctcttag

SEQ ID NO: 28730 - DNA, 2628 bp, Artificial Sequence
  Description of Artificial Sequence: Synthetic coding sequence
atgcagttccagagtctcaaggagttttatgagaccgagattcctcagaaggagcaggacgacgcgaaggcaaaacactgctccgatagtgccgagaaacagtggcagctttttctgaagaagtcttttattacacaagatctcggtttggagttcctcaacttgataaatatggctaaggagaatgagatcctggacgtgaaaaacgaggtatacttgatgaagaataccatggaaaaccaaaaggcagagcgcgaggagttgtcattgcttcgtttagcttggcaattgaaagctactgaatctaaaccaggaaagcagcagtgggctgccttcaaggaacaactaaagaagacctctcataacttgaaactacttcaggaggcactgatgccagtgagtgccttggatttggggggctcgctgcagttcatcctggacctgcgacagaaatggaacgatatgaagcctcaattccagcaactaaacgacgaagtacagtacatcatgaaagaatccgaggaactcacaggccgaggagcacctgtgaaggaaaaatcccagcagctcaaagatctgattcacttccaccagaagcagaaagagcgaatacaggactacgaggacatcctttacaaggtcgtgcaattccatcaggtcaaagaggaactggggaggctgatcaaatcacgggaactggaatttgtcgaacagccaaaggagctgggggacgctcatgatgtgcagattcacctcagatgcagccaagagaaacaagcgagagtggatcacctgcacaggttagccttgtcgctcggagttgacatcatttcctccgtgcaacggccgcactgtagtaatgtcagcgcaaagaatttgcaacagcagttagaacttctcgaagaagactcgatgaagtggagggcaaaggctgaggagtatggccggactctgagtaggtcggtggaatactgcgccatgagagatgagattaacgaattgaaggactcgttcaaagatatcaaaaaaaaatttaataaccttaagtttaattacactaagaaaaatgaaaaaagcaggaatttaaaggctctgaaatatcagatccaacaggtagacatgtatgccgagaagatgcaggcccttaagagaaagatggaaaaagtgtcgaataaaaccagtgattcattcctgaactacccctcagacaaggtcaatgtactgctggaggtcatgaaagacctacagaagcacgtggacgatttcgacaaagtcgtaacagactacaaaaagaatctggacctgactgagcactttcaggaggttattgaggagtgtcacttttggtatgaggacgctagtgccaccgttgtaagagtggggaagtacagtacggagtgtaagaccaaagaggcggtaaaaatattgcaccaacagttcaataagttcatcgctccttcggtgccccagcaggaggagcgaatacaggaggctacggaccttgcgcagcatctctatggcttggaggaaggtcagaagtacatagaaaagattgtcactaaacataaggaagttctggaaagcgtcactgagttgtgtgagtccctaacggagttggaagagaagttgaaacagggagatgtactgaagatgaatcccaacctcgaggactttcactatgattatatcgacttactaaaagagcccgcaaagaacaagcagactatttttaatgaggagcgtaataaggggcaggtacaggtggctgatcttcttggcattaatggaacgggggaagagcgtctcccacaagatcttaaggtctcgactgataaggaaggcggagtgcaggatctgctcctgcccgaagatatgttatcaggcgaagagtatgaatgtgtgtctcctgacgatatatcactgccccctttgcctggctctccggaaagtcccctggctcctagtgacatggaagtggaggagcccgtctcatcaagtctgagcttgcacattagtagctatggagttcaggcaggtacctctagtccaggagatgcgcaagaatccgtcttaccaccgcctgtggccttcgcggatgcctgcaatgacaagagagaaaccttttcaagccatttcgagaggccatacctgcaattcaaagctgagccacctctcaccagccggggatttgtagagaagagtactgcactgcatcgcatatccgctgagcacccagaatcaatgatgtcagaagtgcatgaacgggccctacaacagcaccctcaggcacagggcgggttgctcgagactcgcgaaaagatgcacgccgataacaatttcaccaagactcaagaccgcctccatgccagctctgacgccttttccggtttacgcttccagtccggaacctcccgcgggtaccaacgccagatggttccaagagaagagattaagtccacgagcgctaagagcagtgtggtgtcactcgccgatcaggcccctaacttcagtaggttactgtctaacgtaacagttatggaaggcagccccgtgaccctggaggttgaagtcacagggttccccgaacccactctaacatggtgggtggcctacaacgacaagccttag

SEQ ID NO: 28731 - DNA, 2685 bp, Artificial Sequence
  Description of Artificial Sequence: Synthetic coding sequence
aggtcccaggtgctacagacctacgtcgctttcctgaaatcttctgaagaggtcgaaatgcagtttcaaagtcttaaagagttctatgaaacagaaattccgcagaaggagcaggatgacgccaaagcgaaacattgctctgattccgccgagaagcagtggcagctctttctgaaaaaaagcttcattacacaggacctgggcctggaattcctcaatttgatcaacatggcaaaggaaaatgaaatactggatgtgaagaatgaggtttacctgatgaagaataccatggaaaaccagaaggcggagcgtgaggagctgtcactgctgaggcttgcatggcagctgaaggccaccgaatcaaagccgggtaaacagcaatgggcagcattcaaggagcagctaaaaaagacctcccacaacctaaaactgctccaggaagctctaatgccagtatcagctttagatcttggtggatcgctgcagttcatcctagacctgcggcagaaatggaatgacatgaagccccagtttcagcagctcaacgacgaagtccaatacattatgaaggagtcggaagaattgaccggtcgcggcgctcctgtgaaagaaaagagtcagcaacttaaggacttaatccatttccaccagaaacagaaggaaaggatccaggactacgaagacatactatacaaggtcgtccagttccatcaggtgaaagaggaattgggaaggctgatcaaatctagagagctggaattcgtcgagcagccgaaggaactcggggatgcccacgacgtgcaaatacacctgagatgttctcaggagaagcaagcccgtgtcgaccacttgcaccgcttagccctcagcttaggtgtcgacattatcagtagcgtgcagcggccacattgctccaatgtgtcggccaagaatcttcagcagcagctggagttgctggaagaagatagcatgaaatggcgcgctaaagcagaggagtacggcaggactttgagcagatccgtggagtactgtgccatgagagacgagattaacgaactcaaagatagtttcaaggatattaaaaaaaaattcaacaacctgaagttcaattataccaaaaagaatgaaaaatctcgcaacctaaaggccttaaaataccaaatacagcaggttgacatgtacgctgaaaaaatgcaggctttaaagcggaagatggagaaggtgagcaataagacatccgattcctttctcaattacccatcagacaaggtcaatgtgctcctggaagtcatgaaggacctgcagaagcatgtcgatgactttgataaggtggtaacggactacaaaaagaacttagatctaacggagcacttccaagaggtgattgaagagtgccacttctggtatgaggatgccagtgcaacggtggttagagttggcaaatactctactgaatgtaagaccaaggaagctgtgaaaatcctccatcagcagttcaataagttcatcgccccctccgtgccccaacaggaggaaaggattcaagaagccaccgatttagcccaacacctgtatggactggaagagggacagaaatacatagaaaagattgtgaccaaacacaaggaagtcctggagtccgtgaccgaactctgcgagtccctcacggagctggaagagaagctgaagcagggggacgtgctgaaaatgaatcctaatttagaggattttcactatgattacatcgacttgcttaaagagcccgccaagaacaagcaaacaatttttaacgaggagagaaacaaaggacaagtccaggttgccgacttacttgggattaatggcactggcgaggagagactcccacaggacttgaaggtctcaaccgataaggaaggtggggttcaggatttgttgctgcccgaggatatgcttagtggagaggagtacgagtgcgtttcccccgatgatatctcgctgccgccccttccaggctcaccagaaagccccctggcaccgtctgacatggaagtggaggaacccgtgtccagtagtctgtctctgcacatctctagctatggcgtacaggctggcacgtcttctccaggggatgcccaagagtccgttcttccaccacctgtggccttcgccgatgcttgcaatgacaaacgcgaaacattttcctcccacttcgagcggccatacttacagttcaaggcagaacccccactcaccagccgggggttcgtagagaaatccactgctctgcaccggattagcgctgaacatcccgagagtatgatgtcagaggtccacgaaagagctctgcagcagcacccacaggctcagggaggtttgttggagactagagaaaagatgcacgcagacaacaactttactaagacgcaggaccgcctgcacgcatcatctgacgcattcagcggcttaaggtttcagtctggtactagtcgaggatatcaacgacagatggttcctcgggaggagataaaaagcacctcagccaaaagctctgttgtttctctggccgaccaggctccaaatttttcccgattgctgtctaacgtgaccgtcatggagggctccccagtcaccctggaagtagaggtgaccgggtttccagaacccacactgacgtggtgggtggcctacaatgacaaaccatag

SEQ ID NO: 28732 - DNA, 4593 bp, Artificial Sequence
  Description of Artificial Sequence: Synthetic coding sequence
atgtcatcccagggtagcccctcggtcgcactgtctaccacaacggtttcatctgtggccgtgcaagccggggatagcaagatagttatagctgtgatcaaatgcggaaaatgggttcagcttcagctggcagaatcacaacctaacttactggaaattggtagttcccaggatgagacaaagaagctgctgcacgaccatgagttgttgttagctaaactaaaggccctggaagaccgtgtctgggagctgctccaagaggctgacaaaacagccgaggagaacaaagatcagtcccaggtttacgatgccatggcagaaaccctgggagaggcttgggctgcgctggtatccatgctggaaagaaggacagagctgctacgtttgacgtctgagtttttcgaaaatgccttagagttcgctatcaaaatcgaccaggcagaggatttcctgcagaatacacatgagtttgagagcgcagaatcactgaagagcctgctgcagctccacgagcaccacaccaaggagctccttgaacgcagcttagcgctcctgaataagtcccagcaacttacagactttattgagaagtttaagtgcgaagggcctaacgtgaatcctgagctgactcagggtgcccactcttcttgcctcaaggtggaccgcctgctggaactgctgcaggatcgcagaagacagttagataaatatctgaagcagcagtggcaagaactgtcccaggtgctccagatctgccaatgggatcagcaggagaaccaagtgacatgttggttccaaaaaaccattaggaatctgcaggaacagtcattgggttcttcgctgtccgacaacgaagatcgtattcacaaacaagaggaactaatcatcaaggccaaggagtggaactctgcagttgagaaattgaagagcgaagcactcagaatcttgctttcgaaagattacgtggagaaggagcatcttcagctttcccatcaaaaactatctcagctgcaggaagagttcggccagttgatggttgagaggaatacgtggctgaagaaggctaatgagtttttcaactcagcgaataaagcttttgacgtgttgggccgcgtcgaggcctacttgaaattgttaaagtctgaaggcctgagcctcgctgttttggcagtgagacacgaagagctgcaccgcaagatcaaagactgcaccaccgatgccttgcagaaggggcaaactcttatctcccaggtcgatagctgttccagccaagtgagcgggattcacgagatgatgggctgcataaagcgccgcgtagaccatctgaccgagcaatgttctgcacacaaggaatacgctttgaaaaaacaacagctaaccgcaagcgtagaaggatatctgcgaaaagttgaaatgtctatacagaagatctctcctgtcctgtcaaatgccatggacgtcggttccacgcggtctgaatcggaaaagatcctgaacaagtacctggaactcgatattcaggccaaggaaactagccacgagctggaagctgccgcaaagacaatgatggagaagaacgaattcgtctctgatgagatggtctctctgtcatccaaggcccggtggttggcggaagagctcaacctgtttggccagtctatcgactatagatcgcaagtcctacagacctacgtggctttcctgaaatctagtgaagaggtagaaatgcaattccagtccctgaaggaattttacgagaccgagattccgcagaaggagcaggacgatgccaaagcgaaacattgctcggattcagccgaaaaacagtggcagctttttctaaagaagtcctttatcacacaggatttaggcttggaattcttgaatctgataaacatggccaaggaaaacgagattttggatgtgaaaaacgaagtgtacctgatgaaaaataccatggagaatcagaaggctgagagagaagaattgtctctgcttcggttggcttggcaattaaaggccacagagagcaagcccggcaaacagcagtgggcagcatttaaggaacagttaaaaaaaacaagccataatctgaaattgctccaagaggctctcatgcctgtgagtgccctcgatttggggggctcccttcaattcatacttgacctcagacaaaaatggaatgatatgaaacctcaatttcagcagcttaatgatgaagtgcagtacatcatgaaagaaagcgaggagctaaccggccggggggccccagtgaaagagaagtctcagcagctcaaagacctcatccatttccaccaaaagcagaaggagagaatccaggattacgaggatattttatataaggtcgtccagtttcaccaggttaaagaagaactcggccgcttgattaagagcagggaattggagttcgtggaacagccaaaagagctgggagacgcccatgatgtccagattcacctgaggtgcagtcaggaaaaacaggcccgagtggatcatctgcaccgactagccttatctctcggggtagatattatcagttccgtccagcgtccgcactgctctaatgttagcgccaaaaatttacagcagcaactcgagttgcttgaggaggatagtatgaaatggagggctaaggccgaggagtacggtcgcaccctgagtaggagcgttgaatactgcgccatgcgggatgaaattaatgaactgaaagacagttttaaggatattaagaagaaatttaataacctgaaattcaattacaccaagaaaaacgaaaagtcacggaacctgaaagcgctgaaataccagatacagcaagtggatatgtatgcggagaagatgcaggcattgaagaggaagatggagaaagtttcaaacaagacttctgatagtttcctgaattatccaagcgataaagttaatgtactgctcgaggtgatgaaggacctgcagaagcacgtggatgactttgataaggtggtcacagactataagaagaacttggatttgacagagcactttcaggaagtcattgaggaatgccacttctggtacgaagacgcctctgctacagtcgtgcgggtgggtaagtacagtacagagtgcaagaccaaggaagcagtaaaaattcttcaccagcagtttaacaagtttatcgcgccatctgtgccacagcaagaggagcgtattcaagaagccaccgatttagctcagcatctctacggactggaggaagggcagaagtacatagagaagattgttactaagcacaaagaagtgcttgagagcgtgaccgaactttgcgagagccttactgagttagaggagaagctgaaacagggggatgttttgaaaatgaaccctaatctggaagatttccattacgactacattgacctcctcaaagaacccgcgaagaacaagcagacaattttcaacgaggagagaaataaaggccaagtgcaagttgccgatttgcttggaattaatgggaccggagaggaacgcctgcctcaagacctgaaagtctcgacggataaggaaggcggagtgcaggatttactattacctgaggacatgctgtctggtgaggagtacgaatgcgtcagtccagacgatatctccctgcccccactacccggcagccctgagtctcctctggccccaagcgatatggaagtggaagagcccgtttccagcagtctgtcactgcatatctctagttatggcgtgcaggccgggacctcctctcctggcgacgctcaggaatcggtgcttccgccaccggtagcgttcgcagacgcttgtaacgataagagagagaccttctcgtcgcacttcgaaagaccgtatttgcagttcaaagcagaacctcctctaaccagccgtggcttcgtcgagaaatccaccgcactacacaggatttccgctgagcaccccgaaagcatgatgtccgaggtgcacgagagggcactgcaacagcacccgcaggcacagggcgggcttttggagacgagggaaaaaatgcacgcagacaacaacttcactaaaacccaggaccggctccacgcgagctccgacgcattcagcggcctcaggtttcaatccggcacatcgcgtgggtatcagaggcagatggtgcctcgggaggaaatcaaaagcacatctgcgaagagcagcgtggtgtcattggccgaccaagctcctaattttagccggctgctcagcaatgtgactgttatggaggggagcccagtaactcttgaagtagaagtaactggctttcctgagcctaccctaacttggtacaaaaaaggacagaaactttcggcggacgggcacttgcaggtgcttcataaggagacgagacactccgtgtttatacccaaggtgtgcaaagctgatgcaggactttatgttgcaagggcacagaattcttcaggtgccctgagctcaaatgtgatactccacgtgaccggtaattgtaggttacctatcacccgggtgaactggattacactgtgcgtcgtgtacgtttcggtgagcttgatgtattggctgttgacccagtag

SEQ ID NO: 28733 - DNA, 2253 bp, Artificial Sequence
  Description of Artificial Sequence: Synthetic coding sequence
atggctcaagcctcccgtagcggttccttgcctcctctcgttatcgttccccccctcagggcccaacccggcggaacaggtgaagagcaatgggaaagatcccgaacaggcggcctcagatgggaggtccactgttggccttccggcacgtcaggaggtactccctggtggcctacgccagccgatgtgtccgaggattacgaggctgacgcggctgcctggcggaggggcccggcaggcggtggacctatccctcccgctctgcagagattacgggctgtgctcctgagacttcatagggagagagagcagctgctgcaggccagggattgtgcctatcatctacagtccgcagtccgccttatgaaaactttgtcacccggttctccttccggtggaccctcccctctcccccaatggtgtagggacctccagctgcacccctctcaaggggcagtgttgcggatcggcccaggcgagaccctggaacctctgttgctcgcgcgacctattggcctggctgcccagtgcctagaggcggtgatcgagatgcagcttagggctttgggtcgcgagccagcatcccccggcctctcatcccagcttgccgagctgctgtttgccctccctgcctaccataccctgcaaaggaaggctttaagtcatgttcccggggcagccagacctttccccacctccagggtgttacgcctcttgacaggggaaagaggctgccaagtagcatcacgcttggatgaggctctgcaaggaagcgcactcagggaccagttacgccggaggtgccaagaggaaggcgatctattgcccggcctactggggctggtcggcggggtggcagggagtgccagctgtggtctggggctgggtggagctggcgctctctggtcgcagtactggacacttctgtgggcggcttgcgcgcaatcattggaccttaacctgggcccttggagggaccctagggcaactgcccagcagctctctcaggccctgggtcaggcaagtctcccacaagagtgcgagaaggaactcgcctctctatgtcacaggctgcttcaccaaagtctgatttggtcctgggaccagggcttctgccaggccctgggttcagcactggggggccagtcctcattgccaaccagcagtgggactgctgaacttctccagcaactcttccctccactgctagatgcactgagggagcctcgcctcagaaggattttctgccagcctgctgatccggctcctgtcgctctgggcctgtgcacacttcagacaacgctgctgtggttccttggacgcgcccagcagtatctggcggcctgggatcctgccagcttcctcctgctaatccaaaaggacttacccccactcctgcacgaagccgaagccttatacagtttggcatctgaggaaagcctcgccttagaggtcgaacagcagctgggactggagatacagaaacttacagcacaaatccagcttttgcccgaggagtccctgagtgttttttctcaggagtgtcacaaacaagcaatgcaaggatttaagttgtacatgcctcggggtcgttactggaggctccggttgtgccccgagcctccatccgctccttccgagtacgctggacttgtggtaagaaccgtcctggagcctgttctgcaagggctgcaggggctcccaccgcaggcgcaggcccctgcattggggcaagctttaaccgccatcgtgggagcctggctggaccacatccttacacacggtattagattttcgttacagggagcgctgcagttgaagcaggactttggcgtggtgcgcgagctgcttgaggaggagcaatggagtctatcacccgacctcagacaaacgctgttaatgttgagcattttccagcaactggatggcgctcttctctgtttgctccagcagcccctccccaagtctcaggtccacaggagacccccgtgctgctgcgcatgccaggaagttcagactaccaagttgccatcttcatgcctgaatagtctggagtcactggagccacctctccagcccggcacttcccccgcacagacggggcagctgcaatctacattaggaggccgaggcccctcccctgagggttacttagttggaaaccagcaggcgtggctagcgctgcgccagcaccaacgcccaaggtggcacctgcctttcttttcatgcctcggcactagtcctgagtcatag

SEQ ID NO: 28734 - DNA, 2232 bp, Artificial Sequence
  Description of Artificial Sequence: Synthetic coding sequence
atggcgcaggcctcacgcagtggtagcctgccccccttggttatcgtgcctccactgcgcgcacagccgggaggtacaggagaagagcaatgggagcgttcccggactggcggcctccgctgggaagtacattgctggcctagcggcacctccggtgggaccccatggtggccaacgcctgccgatgtgtccgaggattacgaagcagacgccgcagcatggcggaggggtcccgcaggtggaggcccaatccctcccgctctacagcgcctcagggctgttctgctccgactccatagggagcgggaacagcttctacaggctcgggactgcgcctatcacctgcaaagcgctgttaggctgatgaagacactgtccccagggagtccaagtggaggacccagccccttgccacagtggtgccgtgatttgcaattgcatccctctcagggggccgtccttagaatcggtccaggcgagactttggagcctttattactggcccggcctattgggctggctgcccagtgcctcgaggccgtcatcgaaatgcagctgcgcgctctgggcagggagcctgcgagtcccggcctttccagccagcttgcggagctgctgtttgcccttcctgcctatcacacattacaaaggaaggcgctgagccatgtccccggtgcggcacggccttttcctacatcccgggtgctcagacttttgacaggcgagcgcggctgtcaggtcgctagccgccttgacgaggccctgcaaggaagcgcattgcgtgaccagcttaggaggcgctgtcaagaagagggagatctcctgccgggcctgctgggtctagtgggcggggtggctggcagtgcttcttgcggactcggcctggggggggccggcgcactgtggtctcagtattggaccctgctctgggcagcttgtgcccagtctctagacttgaacctcggaccttggcgggatccacgagcgacagctcagcagttgtctcaggcattaggacaggcttcccttccgcaggaatgcgagaaagaacttgcgagcctgtgtcaccgactgctgcaccagtctctgatctggtcttgggatcagggcttttgccaagcattaggaagtgctcttggcggacaatcatccctgccgacctctagcggcacagccgaactactgcagcaattatttccaccacttcttgatgccctccgagaaccaagactgcggcggatattttgtcaacccgccgggctatgcactctgcagaccaccctcttgtggttcctcgggagagctcagcagtatctcgcagcctgggaccccgcaagttttctgctcctgatacagaaggatctgcctcccctcctccacgaggccgaagccctttacagcctagcaagcgaggagagtttggcacttgaagtagagcagcagctcggtctggagattcagaagttaacagcacagatccaacttttgccagaagagtctctttctgtgtttagtcaggagtgccacaaacaagcaatgcagggctttaagctttatatgccaagaggccgatactggcggctccgactgtgtccggaacccccatcggccccatcagagtatgccggactcgtggtgcgtaccgtcctcgagcccgtgcttcaaggtctgcaaggcttaccgccacaggcccaggctcccgcgctgggccaggctcttacagccatcgtgggtgcttggttggaccatatcttgactcatggcatcaggttcagtctacaaggggcccttcagttaaaacaggactttggggttgtacgggaactgctggaggaagagcagtggtctctgagccccgacttgaggcagacactactaatgctgtcaatttttcagcagcttgatggagctctgctctgtctgcttcagcagcccctgccaaagtcccaagtgcatagaagacccccatgttgttgcgcctgtcaggaggtccagacaaccaaactgccgtcatcctgtcttaattcccttgaatctcttgagcccccattgcagcccggaacaagtcccgctcaaaccggtcaattacagtccacactcgggggcagaggtccctcgcccgaagggtatcttgtaggaaaccagcaggcttggctcgcgctgagacagcaccaacgccctcggtggcacctcccatttttcagctgtctcggaaccagcccggagtcttag

SEQ ID NO: 28735 - DNA, 666 bp, Artificial Sequence
  Description of Artificial Sequence: Synthetic coding sequence
atggcaagctggggaggagaaaagaggggaggcgccggcggctctcctaaaccagccgtctacgcgactcgcaagacaccttcggtaggatctcaggaagaccagtggtacttagattatcccggcgatcaatggtcgcttggattttcgtactcctggtggaagaattctgtggggagtgaatctaagcacggggagggcgctctcgaccagctgcagcatgacgtgcgcctggaagaccttggcgaattgcatcgggccgcacgctctggggatgttcctggagtcgaacacgtattggcacccggagacaccggcgttgataaacgtgaccgcaagaagtctatccagcagctggtgccggaatataaagagaagcagactccagagagtctgccacagaataacaatcctgccgcccccagccaggccgagggaggtgaagggggggtggcctgcggaaccgtcgaacagatgacgtggctttgctccctgcctcacgctgttggaggaggagatggagatcactcgagtactggcgccgtcggtggacatccccggggaccgggggaatactgccatcttcatgagcagcgggtccatcaccacatctttgcgaggggtaagcgtaagggcaaaaaccatgtgagcaatgtggttagatag

SEQ ID NO: 28736 - DNA, 2757 bp, Artificial Sequence
  Description of Artificial Sequence: Synthetic coding sequence
tgaaaaggttgtgagaataagcagccacaggtggaagaggaaatggaaaagcaccgatctaatagcacagagctcagcggcacactcacagatgggaccaccgtgggaaacgatgatgacggactcaaccagcagataccccggaaggaaaacggagagcacgaccggcctgctgacaaaaccagcaacgagaagaacgaagtgaagaatcagatttatcccgaggcagacttcgcagactcaatggagccctctgagatcgcctccgaggactgtgagctttcccacagtgtgtatgaaaattttatgcttcttattgagcaactccgtatggagtacaaagatagtgcgagcctgccccggatacaggacactttctgtctgtgtgagcacttactcaagctcaagaataaccattgtgaccaactcacagttaagttgaaacaaatggaaaatatggtgagcgtgctacaaaatgaattgtcagagacaaagaagacaaaacttcagctggaactgcaaaagattgaatgggagaaagaactgtatgacctgagactcgcactaaagcaggaaaacgaggagaagcgcaatgctgacatgttgtacaataaggactccgagcaactaagaatcaaagaggaggaatgcggaaaggttgtagagactaagcagcagttaaaatggaatctgagacggctcgtcaaggaactgcgtactgttaggaacaatctcgacctcgtcgtacaggagcgaaacgatgcacaaaagcagctctcagaggaacaagatgcgcgtatcctacaagatcaaatcctaacctccaaacagaaggagctggagatggcccggaagaagatgaattccgaaattagccaccggcaccagaaagagaaagacttgttccacgaagactgcatgttgcaggaagagatagcccttcttagacttgaaatcgataccatcaaaaatcagaacaaacagaaggagaagaagtatttcgaggacatagaggccgtcaaggagaaaaacgataacctgcagaagattattaagctcaatgaggagacgctcactgagaccatcttgcagtactccggccagctgaataatcttacagctgaaaataagattcttaacagtgagttggagaacggtaagcaaaatcaggagcgactggagatagaaatggagtcctatcgttgcaggttggccgcagcagtgagggactgtgatcagtctcagactgctcgcgatcttaaactggattttcagcgaactaggcaggaatgggtgagactgcatgacaaaatgaaagtagatatgagtggattacaggccaagaatgagatactgagtgagaagctgagcaatgctgaaagcaagattaattccctccagatccagctgcacaacacacgtgacgccctcggccgcgagtcattaattctggagcgcgtacagcgggacctgtcacagacccagtgtcagaaaaaggagaccgagcaaatgtaccagatcgagcaatccaagctgaagaaatacatagcaaaacaggaatctgtcgaggagaggctatcacagctccagtccgaaaacatgttactaaggcagcagctcgacgatgcacacaagaaggctaactcacaggagaagacaagctcgacgattcaggatcagttccactccgccgcaaagaaccttcaggccgaatcagaaaaacagatcctcagtctccaggagaagaataaagaactgatggatgagtacaaccatctgaaagagcgcatggaccaatgcgaaaaggaaaaagccgggcgcaaagtcgtcatgcgggaattccagcaagaatggacagatctgctgaagcagcagcccacatccgaggctaccagtagatgtcatatcaacttggatgaaacccaggatagcaagaaaaaactcggccagatccgctcagaaatagacctgactgaggcccaggaaaccgtgcctagtagatgcctccaccttgacgctgagaatgaggtgcttcagcttcagcaaactctgttctccatgaaagctatccaaaagcagtgtgagacactgcagaagaacaagaagcagctgaaacaagaggtcgtgaatctgaagtcgtacatggaaaggaacatgctggaacgtggtaaagctgaatggcataaactactgatcgaagagcgggcgcgaaaagaaatcgaggaaaaactcaatgaggccattctcaccctccaaaagcaagccgctgtcagccacgaacagttggttcagctgcgcgaagacaacacaacatcgattaaaactcagatggaactgactattaaggacctggagagcgagatctcacggataaagactagccaggccgacttcaataaaaccgaactcgagcggtataaagagctttatctcgaggaggtcaaggtacgtgaatccctctctaatgagctgtcacgaactaatgagatgattgccgaggtgagcacccaactcacagtagagaaagaacaaacaaggtcgaggtctctctttaccgcatacgcaactcggcccgttctcgagtctccttgtgtcggcaacctgaacgacagtgagggcctgaacaggaaacatattccaagaaagaagagatccgcattgaaagatatggagtcctacctactcaaagtcagttacctgttttctttcggagttcagatatctgatcggatcctggtgtgctatctggttaagtag

SEQ ID NO: 28737 - DNA, 1716 bp, Artificial Sequence
  Description of Artificial Sequence: Synthetic coding sequence
atggcctcctgggggggagagaaaaggggtggagccgagggctcacccaagccggccgtatatgctacccggaagacaccgtctgtagggtcccagggcgaccagtggtacctgggctatcccggcgaccaatggtccagcggtttcccctattcctggtggaaaaacagcgtcggcagtgaatcaaagcacggcgagggagccctggatcaacctcagcatgacgtccggctggaggacctgggagaactccatcgggctgccagaagcggagatgtccctggcgtggaacatatcctcgctcctggggacacaggcgtggataaaagggatagaaaaaagtccattcagcaattggtgcccgagtacaaagaaaaacagactcccgaaagcctgccacagaacaataacccagactggcatccaacaaacctcaccttgtccgatgaaacttgtcagagatcgaaaaatctcaaagtggacgataagtgtccctcagtgagcccctccatgcctgagaaccagagtgccactaaagaactgggccagatgaacctcacagagagagagaagatggatacgggagtcgtacttctgtctggtaacgacacccttcacgacctgtgtcaaagccaactaccagagaacaaggagtccaaagaggagcaggattctgagttgacttcagaggaggagcaggaaagattgaaaggatgtgagaacaaacagcctcagaaaacaagccaagaacccgagatggctaaggactgtgatcgcgaggatattccaatctaccctgttttgccccacgtacagaagtcggaagaaatgtggatcgagcaaggaaaactggaatggaagaatcaactcaaactggtcatcaatgagctgaagcagcgatttggcgagatctacgaaaagtataaaatccccgcatgtcccgaagaggagcctcttcttgacaacagcacccggggaacagatgttaaagacatacccttcaacttgacgaacaatatccctggctgcgaggaggaagacgcgtccgaaatcagcgtcagcgtagtgttcgaaaccttcccagagcagaaggagcctagtctgaaaaatatcattcacccctactaccacccctactcaggctcccaggagcatgtgtgtcaaagttcttcaaagttccacttacatgaaaataaactggattgcgacaacgacaataagcctggcattggccacatcttctctactgataagaattttcacaatgatgctagcacaaagaaggctcgtaatccagaagtggtgatggtggaaatgaaggaagatcaggaattcgatctgcagatgaccaaaaatatgaatcaaaactccgattcaggctcaactaacaactataaaagcttgaaaccaaaactcgagaacctaagctcgttgcctcctgattccgataggacttctgaagtgtatctccatgaagagctgcagcaggatatgcagaaattcaagaacgaggttaatacgttggaggaagagtttttagccctgaagaaagaggacgtacaactccacaaagacgtggaagaggagatggagaaacacaggagtaattcgacagagctaagtgggacgctcaccgatggaaccacggtaggtaacgatgatgatggactaaatcagcagattccgcggaaagagaatggggagcatgataggtag

SEQ ID NO: 28738 - DNA, 2181 bp, Artificial Sequence
  Description of Artificial Sequence: Synthetic coding sequence
atggccagctggggcggcgagaaacgcggcggagccgaagggtctcccaagccggcagtgtatgctacacggaagactccgagcgtgggttcacagggagaccagtggtatctcgggtatcccggtgatcagtggtcttccggtttcccctactcctggtggaagaattccgtgggctcagagtcaaaacacggcgagggtgccctggaccagccgcaacacgatgtcagactcgaagacctaggagaactgcaccgcgccgcacgttccggggacgtccctggtgttgagcacattcttgcccctggggataccggggtggataagagagataggaaaaaaagtatccagcagctagtaccagaatataaggagaaacaaacccccgaaagtctacctcagaataacaatcctgattggcaccctactaatctcacgctgtcagacgaaacatgccagaggtccaaaaacttgaaagtggacgacaagtgtccctcagtgtcaccaagcatgccggagaatcagtcagcaacaaaggagcttggacagatgaacttaaccgagcgggaaaagatggacaccggcgttgtactgttgtcaggaaatgatacccttcatgacctttgtcagagtcaactccccgagaacaaggaaagcaaagaggcagagcaggactcggaattaacatctgaagaagaacaggaaagactgaagggctgtgagaataagcagccgcagaagacgagccaggaacccgagatggccaaagattgtgaccgcgaggatatccccatataccctgtgctaccccacgtgcagaagtctgaagagatgtggatcgagcaggggaagctcgagtggaagaatcagctgaaattggtcatcaacgaactgaagcagcgttttggcgaaatatatgagaagtataagattccagcctgcccagaggaggagcccctcctagataacagtactaggggtacggatgtgaaggacattcctttcaacttgacaaacaatataccgggatgtgaggaagaagacgccagcgagatatccgtctctgtggttttcgaaacctttccggagcagaaagaaccctccttgaagaacatcattcacccctactatcatccgtactcgggcagccaggaacatgtgtgccaaagttcatcgaagttccatctgcacgaaaacaaattggactgcgacaatgataacaaacctgggatcggacacatcttttccaccgataaaaattttcacaacgacgcatcaacgaaaaaagccagaaaccccgaagttgtgatggtggagatgaaagaggatcaggaattcgacttacagatgactaaaaatatgaaccaaaactccgattctggttcgacaaataactacaagtccctgaagcctaagctggagaacttgtccagtctcccccccgatagtgatcggacaagcgaagtatacctgcatgaagaactgcagcaagacatgcagaagtttaagaacgaggttaataccttagaggaggagtttcttgcactgaaaaaggaggacgttcagctgcataaagacgtggaggaggaaatggagaaacacaggtctaatagcactgagctgtctgggactctgacagacggaacaaccgtcggcaacgatgacgatggattgaatcagcagatacctcgaaaggaaaacggggagcacgaccggccagcagataaaacttcgaatgagaagaatgaagtaaaaaaccaaatctatcccgaagctgactttgctgactcaatggaacccagtgaaatcgcatcggaggactgcgagttgtcccactcagtctatgaaaacttcatgttgcttatcgaacagttgcgtatggaatataaagattctgcgagccttccccgaatccaggatacattctgtttatgcgagcatctgctgaaactcaaaaacaaccattgcgatcagctgacagtgaagctcaagcagatggaaaatatggtgtccgtgttacagaatgaactgtcagaaactaaaaagacgaagcttcagctcgagcttcaaaaaattgaatgggagaaagagctatatgacctgcgctttctcatcggtattagaaaaaaaaggatatcctttatgaagatcgcatgctgcaggaagaaactcccctgttag

SEQ ID NO: 28739 - DNA, 4284 bp, Artificial Sequence
  Description of Artificial Sequence: Synthetic coding sequence
atggcctcctgggggggcgagaaaagaggtggagctgaagggtcccccaagccggcggtgtatgccaccagaaagacacctagcgtcgggagccaaggcgatcaatggtacctcggctaccccggggaccagtggagctccggttttccatactcctggtggaagaacagcgtcgggagcgagtctaagcacggcgagggggcgcttgaccagccccagcacgatgttcgcctagaagacctgggcgaactacaccgggctgcacggtctggggatgttccgggggtggaacacattttggcaccaggcgacacaggagttgataaaagggacaggaagaagagcattcagcagctagtgcccgaatataaggaaaagcaaaccccagaatccctgccccaaaacaacaaccctgattggcaccccacaaacttgactctgtcagatgagacatgtcagagatccaagaacctgaaagtcgatgacaagtgcccctccgttagtcctagcatgcccgagaaccagtctgccacgaaagagcttgggcagatgaatcttaccgagcgggagaaaatggataccggcgtagtactgctgagtggtaatgatacactacatgacttatgtcaaagtcagctacctgagaataaagaaagcaaagaggcagagcaggattccgagctgactagtgaggaagaacaagagcggctgaagggctgcgagaataaacagcctcagaaaacatcccaggagccggaaatggcaaaggattgtgacagagaggacatcccaatctaccccgtgctgcctcacgtgcagaagtctgaggagatgtggattgagcaaggtaagctcgagtggaagaaccaactaaagctggtgatcaatgaactcaagcagcggttcggcgaaatttacgagaaatataagattcccgcttgtccggaagaagagcccttgctcgacaattccacccgcggaaccgacgtgaaggacatcccctttaatctgactaataatatccccgggtgcgaagaagaagatgctagcgagatctcagtgagcgttgtcttcgagacctttcccgagcagaaggagccctcgctgaaaaacataatccatccttactatcacccgtacagcggctctcaagagcacgtttgtcaaagtagcagtaagtttcacctgcatgagaataagcttgactgcgataatgacaacaagccgggcatcggccacatcttctccacagataaaaactttcataacgatgccagcacgaaaaaggcgagaaatccagaggtggtgatggtggagatgaaggaggaccaggaatttgacctccagatgaccaagaacatgaaccagaactccgatagcggctccacaaataactacaaaagcctaaaaccgaagcttgaaaatttgagcagtctgcctccagactccgaccgaacctctgaggtgtacttgcacgaggaactccagcaagatatgcagaaatttaagaatgaagtgaacaccctggaggaggaatttctggcgctgaagaaggaagatgttcagctgcataaagacgtggaggaagaaatggagaagcaccggtccaactcaacagaattaagcggcactttaaccgacggcacgacagtggggaatgacgatgacggcttgaaccagcaaatacctcggaaggaaaatggggaacatgaccgccctgccgacaaaacctcgaatgagaagaatgaagttaaaaaccagatttatcctgaagccgactttgctgattccatggaaccatctgagatcgctagtgaggattgtgagctgagtcactcagtttacgaaaattttatgcttctcatagagcagctgcgcatggagtacaaagactcagcatctctacctcgcattcaagacacgttttgtctttgtgagcatttgctgaaactcaagaataaccactgcgatcagttaaccgtcaaactgaaacagatggaaaatatggttagtgtgctgcagaatgagctctcggaaacaaaaaagaccaaacttcagttggaactccagaaaattgagtgggagaaggaactgtatgatttgcgcttagctctgaagcaggagaatgaggagaagcggaacgctgacatgctctataataaagactcagaacagcttcgcatcaaggaggaagagtgtggtaaagttgtcgaaaccaagcagcaactcaagtggaatctgcgcaggttggttaaggaactccggaccgtgagaaacaatctggatctggtagttcaagaacggaacgacgcccagaaacagttgagcgaggagcaggatgcccgcatcctgcaggaccagatcttaacctcgaagcaaaaggaactagagatggcaaggaagaaaatgaacagcgaaatctcccataggcatcaaaaagagaaagacttattccacgaagattgtatgctgcaagaggagatcgccctgctcagactcgagatagatacaatcaaaaaccaaaacaagcagaaggagaaaaaatactttgaagacatcgaggccgttaaagaaaaaaatgataatctgcagaagattatcaagttgaacgaggaaaccctcaccgaaacaattcttcaatattccggacagctaaacaacctgaccgccgaaaacaagatcctgaatagcgagttggagaacgggaagcagaatcaggagcgccttgagatcgagatggagtcatacagatgccggcttgctgctgctgtcagggattgtgaccagagtcaaactgcaagggatctgaagcttgactttcaaagaacccggcaggaatgggtccggctccacgacaagatgaaggtggacatgtccggcctgcaggctaaaaacgagatcctcagcgagaaactatccaacgctgagtcgaagatcaattccttacagattcaactccataatacaagggacgctctgggccgcgaatccctcatcttggaacgcgtgcaacgcgacctttctcaaacacagtgtcagaagaaggagactgaacaaatgtatcaaatagagcagtccaaactcaagaaatatatcgccaagcaggaatcagtggaagaaaggttgtcccaactccagagtgaaaatatgttattacgacagcaactggacgacgcgcataagaaggctaactcccaggagaagaccagctctaccattcaagaccagttccatagcgcggctaagaatctgcaggcagaaagcgagaagcagatactttccctccaagagaagaacaaggagctgatggacgaatataatcatctcaaagagcggatggatcaatgcgagaaggagaaagctggaagaaagatcgatctcactgaggcacaggagactgtcccaagcaggtgcctgcatctggacgcagagaatgaagtgctccagctgcagcagactctctttagtatgaaagcgatccagaaacagtgtgaaaccctccaaaagaataaaaagcagctgaaacaggaggttgttaatctgaagagttatatggaacgaaatatgctcgagcgcgggaaagccgagtggcacaagctgcttattgaagagagagccagaaaggagattgaagagaaactcaacgaagcgattctgaccttacagaaacaggctgccgtatctcacgagcagctggtgcaactgagagaggacaatacaaccagtattaagacacagatggaactgaccatcaaggacctggagtctgaaatatctcgaatcaagacatctcaggccgacttcaataagactgaactcgagcggtacaaagagctatatttggaagaagttaaagttagggaatccctcagtaatgagttaagccgcacgaatgagatgatcgccgaggtgtccacccaacttactgtggaaaaggagcagactcgcagtcgttccctgtttaccgcgtatgccacccggccagtgctcgagtccccctgcgttggcaatctcaatgattccgagggattgaacaggaaacatattcctcggaagaagaggagtgctctcaaagatatggagagctacctcttgaagatgcagcagaagcttcaaaatgacctcaccgccgaggtagccggaagttctcagactggcttacatcggatccctcaatgcagcagcttttcctcctccagtttgcacctgctgctctgttccatttgtcaaccattcttcctaattctgcaattattactaaatatgaatcttgaccctatttag

SEQ ID NO: 28740 - DNA, 681 bp, Artificial Sequence
  Description of Artificial Sequence: Synthetic coding sequence
atggcatcgtgggggggcgagaagcgcggcggagcagaaggtagtcctaaaccagcagtatacgctactcgcaagactccatccgtcggtagtcagggagatcagtggtacctgggttaccctggagaccagtggtcatctggatttccatactcgtggtggaaaaattctgtcggctctgagtccaaacatggagagggagctctggaccagccacagcatgatgtgagactggaggatctcggcgagttgcaccgggctgccagatctggtgatgtgcccggagtggagcatatcctcgccccaggagatacaggcgtcgataagcgagatcggaagaagagcatccaacagctggttccagagtacaaagagaaacagacacctgaatccttaccgcagaacaacaaccccgattggcatcccacaaatctgacgttgtcggatgaaacatgccagcgttctaaaaacctgaaggtggacgataagtgccccagcgtctcgccaagcatgcccgagaaccagtctgctacaaaggagttggggcagatgaatctgactgagcgcgagaagatggacaccggagtcgtgctgttatctggtaacgacacactacacgatctgtgccagagtcagctccccgaaaataaggagtcgaaagaggggaacaaggaagcatag

SEQ ID NO: 28741 - DNA, 4278 bp, Artificial Sequence
  Description of Artificial Sequence: Synthetic coding sequence
atggcatcctggggcggcgagaaacgcggtggagcagagggcagccctaagcctgcggtttacgccacaaggaagaccccgtcagttgggtctcagggtgaccagtggtatctcggatacccaggggaccagtggagcagtgggtttccatactcttggtggaagaattctgtcggctccgagtctaaacacggagagggggccctcgaccaaccccagcacgacgtccgcctcgaggacctgggggaactgcaccgcgccgcccgtagcggcgacgtacctggtgttgagcacatcctggcgcccggggacaccggagtcgacaaacgggaccgcaaaaaatcaatccagcagcttgttcctgagtacaaggaaaaacagacccccgaaagccttccgcagaacaataaccctgattggcaccccacgaatctcaccctcagcgatgaaacatgtcagcgttcgaagaatctcaaggtggacgacaagtgtcctagcgtaagcccatctatgcctgagaaccagtcggctacgaaagaactagggcagatgaatttgactgaacgcgagaaaatggacacaggagtggtccttctgtccggtaatgataccctccacgatctctgccagagccagctgcccgagaacaaggaatcgaaagaagcagagcaggattctgaattgacctcagaagaggagcaagaaagattgaagggctgtgaaaacaagcagcctcagaaaacgtcccaggagcccgaaatggccaaagattgcgatagggaggacatccctatctaccctgtcttaccccatgtccaaaagtcggaggaaatgtggatcgagcaaggcaaactggagtggaaaaatcaactcaagctcgttattaacgaattaaaacagaggtttggtgagatctacgagaagtacaagatccccgcctgcccagaagaagaacccctgctggataactctacccgggggaccgacgttaaagatattccttttaacctgacaaataacattcccggctgtgaagaggaggatgcctcagagatctccgtttccgtcgtgtttgagacattccctgagcagaaggagccttcattaaaaaatatcattcacccctactatcacccgtactctggttcccaggagcacgtctgtcaatccagctctaaattccatcttcacgagaacaagctggactgcgataatgacaacaagccaggaatcggacacatcttctccacagacaagaacttccacaatgatgcctccacaaaaaaagcccggaatcccgaggtcgtgatggttgagatgaaggaggaccaggagtttgatctgcagatgactaagaatatgaatcagaattctgactcaggtagtactaataactacaagtcactgaaacctaaactcgagaacctctcatctctgcctccagacagtgacaggacatctgaagtttacttacatgaggagcttcagcaggacatgcagaaattcaagaatgaagttaatacgcttgaagaggagtttcttgcactgaaaaaggaggatgtgcagcttcacaaggacgtggaagaggaaatggaaaagcatagatcaaatagtaccgaactgtccggcaccctcaccgatggaaccacagttgggaatgacgacgatggcctgaaccagcaaatacctcgtaaagaaaatggggagcatgatagaccagcggataagacgagtaatgagaagaatgaggttaagaaccagatctaccctgaggccgacttcgccgattctatggagccgtcggagattgcttccgaggactgcgagctgtctcattccgtttacgagaattttatgctgctcattgagcaactgaggatggagtataaagacagtgcttcactgcctcggattcaggacactttctgcctttgcgaacatcttctgaagcttaagaataaccactgcgaccagctgacagttaagctgaagcagatggagaatatggtgagcgttctgcagaatgaacttagtgagacaaaaaagactaaactgcaactggagctccaaaagatcgagtgggaaaaagagctctacgatctacgcctagcattgaagcaagagaatgaagagaaacgcaatgcagacatgctttataataaggatagcgagcagctgcgaattaaggaagaagagtgtggaaaagtggtcgagactaagcaacaattaaagtggaacttgaggaggcttgtcaaggagctgaggactgttagaaataaccttgacttagtcgtgcaggaaaggaacgatgcgcagaaacagctgagcgaagaacaggacgcccgtattttacaggaccagattttgacctccaaacaaaaagagctggaaatggcccgaaagaaaatgaatagcgagatcagtcacaggcatcaaaaggagaaggacctttttcatgaggattgcatgctacaggaggagatagctcttctgcgcctagaaattgatacaatcaagaaccaaaacaaacaaaaagaaaaaaaatacttcgaggatattgaggccgtcaaagaaaaaaatgacaacttgcagaagatcattaaacttaacgaggagaccctgacggagaccattctgcagtattcaggtcagctcaataacctgacagcagagaacaagatcctcaactcagagctggagaatggaaaacaaaatcaggagcggctcgagattgaaatggagagttatcgctgtaggctggctgctgctgtcagggattgcgaccagtcccagaccgcgagagatctgaagctggacttccaacggacccgccaggagtgggtccggctacatgataaaatgaaagtggacatgtcgggcctgcaagctaagaatgagatcttgtctgagaagctgtctaacgccgagtcaaagattaacagcctgcagattcagttacacaatacccgcgatgccttggggcgtgaaagcctcatcttagagcgggtccaaagagacctgtcccagactcaatgtcaaaagaaggagaccgaacagatgtaccagatcgagcagagcaagttgaaaaagtacatcgcaaaacaggaatctgttgaggagagactctcccagctgcaaagcgaaaacatgctgctacgtcagcagctggacgacgctcataaaaaggctaacagtcaggagaagacatcctccacaatacaggatcagttccacagcgccgccaagaatttacaggctgagagcgagaaacagattctgagcctgcaggagaagaacaaggaactcatggacgagtacaaccacctgaaagagcgtatggatcagtgcgaaaaggagaaggccggtcggaagattgatttaaccgaagcacaagaaaccgtgccatcacgttgtctgcacctagacgccgagaacgaggtattgcagctacaacaaactttgttcagtatgaaagccatacagaagcaatgcgagacattacaaaagaataaaaaacagctgaaacaggaagtcgtgaatctcaaatcatacatggaaagaaacatgctggagagaggcaaggctgagtggcataagttgctgatcgaagagagagctcggaaggagatcgaagagaaactgaatgaggcgatcttgactctgcagaaacaggctgcggtcagccatgagcagctggtccagctccgcgaggacaacactacctcaatcaaaacacagatggaactcacaattaaggacctcgagagcgagatttctcgtataaaaacctcccaggccgatttcaataagacggagctggagaggtataaagaactgtacctggaagaagtgaaagtacgggaatctcttagtaacgagttaagccgaaccaacgagatgatcgctgaggttagtacacaacttacggtggagaaggagcagactaggagccggtcattatttactgcctatgcgacgcgcccagtccttgagtcgccatgcgtaggcaatctcaacgattcggagggcctcaatagaaaacacattcccagaaagaaacggtccgctctgaaggatatggaatcatatctcctgaagatgcaacagaagctgcagaacgatttaacggctgaggtcgcagcagcaacaaagtacgaacccggaagttacatcgcctccccactgggatttacccacaaagagaatctgaaccaggatcctgttctggaggtcactaaagaatacgcccaaatcctgcgacgtaaatatatactgtag

SEQ ID NO: 28742 - DNA, 984 bp, Artificial Sequence
  Description of Artificial Sequence: Synthetic coding sequence
atggctagttggggaggagagaaaagagggggggctgagggcagtccaaagcccgcagtgtacgcaaccaggaaaaccccctcagtgggatcccaaggcgatcagtggtatcttggatacccaggcgaccagtggtcctccggatttccttatagttggtggaagaatagcgtcggcagcgagtctaaacatggggaaggtgcgcttgatcagccacaacatgatgtgagactggaagatctgggcgagctacacagagccgcaaggtccggggatgtgcccggcgtagaacacatcctcgcgcccggtgatactggggtggacaaacgcgataggaagaagagtatccagcagttggttcccgagtacaaggagaagcagaccccggagtcactcccacagaacaataacccagactggcaccccacaaatttaacccttagcgacgagacctgtcagcggtctaagaatctgaaggtcgacgataagtgccccagcgtgagtccttctatgcccgagaatcagagtgcaaccaaggagctgggccagatgaatcttacagagcgggagaagatggatacaggagtggtattgctgtctgggaatgataccctgcacgacctgtgccaatctcaactaccagagaacaaggaatccaaagaggccgagcaagattcagagctaacgagtgaagaagaacaggaacgcctgaagggatgtgagaataaacagccccagaagacatctcaggaacccgaaatggcaaaagactgtgatcgagaggacattccaatatatcccgtcctgcctcatgtacaaaaaagcgaagaaatttctctgcccccagatagcgacaggactagcgaagtgtatctgcatgaggagcttcagcaagatatgcaaaagtttaagaatgaggtaaatacgctggaagaggagttcctggcgcttaaaaaagaagacgtccaactgcataaagattag

SEQ ID NO: 28743 - DNA, 783 bp, Artificial Sequence
  Description of Artificial Sequence: Synthetic coding sequence
atggcttcgtggggtggggagaagcggggcggcgcagagggatccccaaaaccagccgtgtatgccaccaggaaaacccccagcgtgggctcccaaggagatcagtggtacctcggctatccaggcgatcagtggtcctcaggcttcccttatagttggtggaagaattcagtgggctctgagagtaagcacggagagggagcattagaccagcctcagcatgatgtgcggttagaagatttaggggaattacacagagcagcccggtctggagatgtacccggagtggagcatattctggctcccggcgacaccggtgtagataaacgggaccggaagaagtctatccagcaactcgtcccagagtacaaagaaaaacaaactccagagtcgcttccccagaataacaacccagattggcatccaactaatctgactttatcagatgagacgtgtcagcgctctaagaacctgaaagtggacgacaaatgtccatcggtttcgcccagtatgcccgagaatcagtcagccacaaaagaactcggccagatgaaccttacagagcgggaaaagatggatactggagtggtgctcctttcaggtaacgacacccttcacgatctgtgccagagccagcttcctgagaataaggagtctaaagaagccgaacaggactccgagctcacctcagaagaagagcaggagcgactgaaaggatgcgaaaacaaacagccgcaggataaggctatttttaaaacctgctccccaaccgagaaaacttag

SEQ ID NO: 28744 - DNA, 4284 bp, Artificial Sequence
  Description of Artificial Sequence: Synthetic coding sequence
atggcgtcttgggggggcgagaaacgcggcggtgccgaaggatcacccaaacctgctgtgtatgccacgaggaagaccccttctgttgggtcccagggcgaccagtggtatctgggatacccaggagaccaatggtcctccggcttcccctacagttggtggaaaaactctgtgggttccgaatccaaacacggagaaggagcgctggaccagcctcagcacgacgtaagactggaggatctaggagaattgcatcgtgccgcccgctccggggatgtgcctggggtggaacacattcttgccccaggagataccggtgttgataaacgagatagaaaaaagtcaatccaacagcttgttcctgagtataaggagaaacagacccctgagtctcttcctcagaacaacaatcctgactggcatcccaccaatcttaccctgtccgacgaaacgtgccagcgatccaaaaatcttaaggtggacgacaagtgtcccagtgtgagcccgtcgatgccagaaaatcagagtgcgacaaaagaactgggccagatgaacctgaccgagcgagaaaagatggatactggagtcgttttgctgtccggtaacgatacattgcatgacctctgccagtctcaactgccagagaacaaggaatcaaaggaggcagagcaggacagtgaactgaccagtgaggaggagcaagaaagactcaagggctgcgaaaacaagcaaccccagaaaacatcccaagagccagagatggctaaggactgtgatcgggaagacatcccaatttacccggtactccctcatgtgcagaagtctgaagagatgtggattgagcaagggaagttggaatggaaaaaccaattgaagctcgtgattaacgagcttaaacaaaggttcggcgaaatttatgagaagtataagattcccgcctgccctgaggaggagccactgctggataacagtactaggggcacagacgtaaaggatattccgtttaaccttaccaacaatattccgggatgtgaagaagaggacgcctctgagatctccgtgagtgtcgtattcgagacgtttcctgagcagaaagaaccgagcctcaaaaacatcattcatccgtattatcatccctactctggctcacaagagcacgtatgccagagttcatccaagttccatcttcatgaaaacaaactggattgtgataatgataataagccaggcatcggtcacatatttagtacagataagaattttcataacgatgcctctacgaaaaaggcacggaaccccgaggtagtgatggtggaaatgaaggaggatcaggagttcgacctgcagatgacaaaaaatatgaatcagaattctgattccgggtcaaccaataattataagtctttaaaacccaagttggagaatttgagtagtttgccaccggactcagaccggacgagcgaggtttatttgcacgaggaattgcagcaggatatgcaaaagtttaagaacgaggtgaatactctggaagaagaatttcttgcacttaaaaaggaagatgtgcaacttcataaggatgtcgaagaagaaatggagaagcacagaagtaattctactgaactgagcggaaccctcactgacggtaccactgtaggcaatgatgacgacggtctgaatcagcagataccccgcaaggaaaacggagaacacgacagacctgccgacaagaccagcaatgagaagaacgaggtcaaaaaccaaatatatccagaggccgactttgctgattccatggaaccaagtgaaattgcttccgaggattgcgaactgagccattccgtttatgaaaacttcatgctacttatagagcagcttcggatggaatataaggatagcgcctctttgcctcgaattcaagacacattctgtctgtgcgagcatctactaaaattgaagaacaatcactgcgatcagctgacggtgaagctgaagcagatggaaaatatggtaagcgtgctacaaaatgaactttctgagactaagaagacaaagctgcagctggagctgcagaagattgagtgggagaaggagctctacgatctgagactcgcgctgaagcaggaaaatgaggagaagaggaacgcagacatgctgtataacaaggatagtgaacagttgcggatcaaagaagaagagtgtggcaaggtggtggagaccaaacagcagttaaagtggaatctccgccgcctggttaaggaattacgcaccgtccgtaataacctcgatttggttgtccaggaacggaacgacgcccagaagcagctcagtgaagaacaggacgctcgaatccttcaagatcagattttgacatcgaaacaaaaagaattggaaatggcaaggaagaaaatgaattctgaaattagccaccggcaccaaaaggaaaaagacctgtttcatgaggattgtatgttacaggaagagattgcattgctacggctggagatcgacacaataaaaaaccagaataaacagaaagagaaaaagtactttgaggatatagaagcggtgaaagagaaaaacgacaatctgcagaagatcatcaaattgaacgaagaaactctgaccgaaacgattttgcaatactctggacaacttaacaatttgactgctgaaaacaaaatcctgaactctgagcttgagaacggaaagcagaaccaggaaagattggagatcgagatggagtcctatcggtgcagactcgctgctgcagttcgtgattgtgaccagtctcagactgcgcgggacctcaagctggacttccaacgtacccggcaggaatgggtgagattgcacgacaaaatgaaagttgatatgtcaggtctccaggcgaagaacgagattctctctgagaagctgtccaacgcagagagcaaaatcaactcgttacagatccaacttcacaacacaagagacgccctgggaagagagagcctgatcctggaacgggttcagcgggatctgtcccagacacagtgccagaagaaggagaccgaacagatgtaccagatcgagcagtcaaagctgaaaaaatacatagctaaacaagagagcgtggaggagagacttagccaactgcagagcgagaacatgcttttgagacagcagctagatgatgctcataagaaagccaattcacaagagaagacctctagcaccattcaggaccagtttcatagcgcagcaaagaacttgcaagcggaatcagaaaaacagattctgtccctccaggagaagaataaggagctcatggacgaatataatcatcttaaggagcggatggatcagtgcgagaaggaaaaggctgggagaaaaatcgaccttactgaagctcaggaaaccgtcccgtcccgatgtctccatctggatgccgaaaatgaagtgctgcagctccagcaaaccctcttttcgatgaaggccatccagaaacagtgtgaaaccctccagaaaaacaaaaagcagcttaaacaggaggtggtgaatttgaagtcttatatggaacggaatatgctagaacgggggaaagcagaatggcacaagctgctgattgaagaaagagcgaggaaggagattgaggagaaactcaatgaagcaatattgaccctgcagaagcaggccgctgtaagccacgagcagctcgtgcagctgcgggaggacaacactaccagtatcaaaacccagatggaacttactatcaaggacctggaaagtgaaataagccggatcaagactagccaggctgattttaacaagacagagcttgaaaggtataaggagctgtacttagaggaggtcaaggtaagggagtccttaagtaatgagctgtcccggaccaacgagatgatcgctgaggttagtactcagctgaccgtcgaaaaagagcagacaagatctcggagcttgtttacagcttatgcaactagacccgtgttagaaagcccatgcgttggaaaccttaatgactccgaaggactgaatcgaaaacatatcccgcgtaagaaacggtcggcccttaaggacatggaatcctatctgctcaagatgcagcagaaattgcagaacgatttaacagctgaagttgccggctcctcacagacaggtctccacaggatcccgcagtgcagttcttttagctcgagcagtctgcacttactgctgtgcagtatttgtcagccattcttccttatcctccagctgctgctcaacatgaaccttgaccccatctag

SEQ ID NO: 28745 - DNA, 2178 bp, Artificial Sequence
  Description of Artificial Sequence: Synthetic coding sequence
atggcgtcatggggaggtgaaaaacgcggcggcgccgagggatccccaaagccggcagtgtacgcaacaagaaagacgccctcagtgggaagtcaaggtgaccaatggtacctgggttatcctggcgaccagtggtcctctggctttccatacagttggtggaagaattctgtcggttccgagtccaaacacggagaaggggctctagatcagcctcagcatgacgtccggctggaggatttgggagaacttcacagggctgcccggtcgggagacgtgcctggggtcgaacacatcctcgcccctggtgacacaggtgtggacaagagagatcggaaaaagagcatccagcagctggtccccgagtacaaagagaaacagactcctgaatccttaccgcagaataacaacccagattggcaccccaccaatctcactctgtctgacgaaacctgccagcgtagtaaaaacctgaaggtcgacgacaagtgcccctccgtgagcccctccatgcccgagaaccaaagcgcgacaaaggaactggggcagatgaacctcacagaacgcgaaaagatggacactggcgttgttttactctcaggtaacgatacactgcacgacctttgtcagagtcagctgccagagaataaggaatccaaagaggcagagcaggatagcgaactgacctccgaggaagaacaagaacgccttaagggctgtgagaacaagcagcctcaaaaaacttctcaggaaccagagatggccaaagactgcgatcgggaggatattcccatctatcccgtactcccccatgtgcagaaatccgaagagatgtggatcgaacaagggaagttggagtggaaaaatcaactgaagctcgtgataaatgagttaaagcagcgatttggtgagatttatgagaaatacaagatccccgcttgccctgaagaagaaccactgctggacaactcaacaagaggaaccgacgtcaaggatatcccttttaacctgaccaacaatatccctggatgtgaggaagaagacgccagtgagatctctgtcagcgtggtatttgaaacgttcccagagcagaaagagcccagtctgaagaatatcattcacccgtactaccacccctattcagggtcacaggaacacgtgtgccagtcctcatctaagtttcacctgcacgaaaacaaattggattgtgataacgacaataaacctggaataggccatatctttagcactgataaaaatttccataatgacgccagtacgaagaaggctcggaatccagaagtagtgatggtggagatgaaggaggatcaggagtttgatttgcagatgaccaaaaatatgaatcagaattcggatagtggctccaccaataattacaaatctctgaagcccaagctggaaaacttgagtagcctgcccccggacagtgaccgcacatccgaggtgtatcttcatgaggagctccaacaagatatgcagaagtttaaaaacgaagttaatacactcgaagaagagtttttggcacttaaaaaggaggatgtgcaactccacaaggaggttgaggaggagatggagaagcaccggagcaacagcacagaactcagtggcactctaaccgacggaacgactgtgggcaatgatgacgatggccttaaccaacagattccacgaaaagagaacggagagcacgatagacctgccgacaaaacaagtaatgaaaagaatgaagtcaagaatcaaatttatccagaagcagattttgctgactcaatggaaccctccgaaattgcgagcgaagactgcgagctcagccacagcgtctatgagaattttatgctgcttatcgagcaattgcgtatggagtacaaggactccgccagtctcccaagaatacaggacacattctgtctctgtgagcacttgctaaagctgaagaacaatcattgcgaccagctaactgtaaagcttaaacaaatggagaatatggtttcagtcctacagaacgagttgagtgaaaccaaaaaaaccaaattacagctggagttacaaaagattgagtgggaaaaggagctgtatgacctgagattggctctaaaacaggagaacagaaggaaggagatgcccatatgttgcattataaagatcgtaaactcgtag

SEQ ID NO: 28746 - DNA, 3465 bp, Artificial Sequence
  Description of Artificial Sequence: Synthetic coding sequence
atggcttcttggggaggcgaaaagaggggcggagctgaaggaagtccaaagccggcagtatacgcgaccagaaagactccttccgttggcagtcagggggaccaatggtatttgggttatccgggggaccagtggagctcaggctttccctattcgtggtggaagaactccgtgggctccgaaagcaaacatggggagggcgcccttgaccagccgcagcatgatgtccgactggaggacctgggggaattacaccgtgcagctagatccggcgacgtccccggtgtggagcatattctagcccctggagacaccggggtggacaagcgggatcgcaagaagagcattcagcaactggttccagaatacaaggagaagcagaccccggagagtctgccccagaataataatccggattggcatcctacaaacctgactttaagcgacgagacttgtcagagaagcaagaatcttaaggtggatgacaaatgtccaagtgtgtccccttcaatgcccgagaaccagtcagccactaaagagctcggacaaatgaatctgaccgaaagagagaaaatggacacaggtgtggtgcttctatcaggtaacgacacacttcacgacctttgccaatctcagctgcctgaaaacaaggaaagcaaggaagcagaacaggactccgaactgacctctgaggaggaacaggaacgtttgaaaggttgcgagaataagcagcctcaggttgaagaagagatggaaaagcatcggtcaaactccactgagctgtccggcactttgactgacggcacgacagttggcaatgacgatgacgggcttaatcagcagattccccgaaaagaaaatggcgagcacgataggccagccgacaaaacttccaacgagaagaatgaagtgaaaaatcaaatctatcctgaagccgacttcgctgattctatggagccttccgagatcgcatccgaggactgtgagctcagccatagcgtatacgaaaattttatgcttcttatcgagcagctgcggatggagtataaggactccgcatctcttccaaggatccaggacacgttctgcctatgcgaacacctcctcaagctgaaaaataatcactgtgatcagctaaccgtgaagttaaagcagatggaaaatatggtgagcgtgctgcaaaatgagctgagcgaaacaaaaaaaacaaaactgcagctggagctccagaaaatcgagtgggagaaagaactctacgacctgaggcttgcattgaagcaggagaatgaggagaagcgtaatgccgatatgctctacaataaagatagtgaacagctgcgcattaaggaggaagaatgcggtaaggtagtcgagactaagcagcaactcaagtggaacctgcgtcgcctggtgaaggaactccgtacagtgcgcaataaccttgatttggtcgtccaggagcgcaatgatgcacagaaacagctttccgaggaacaggacgctaggatcctgcaagatcagatattgacttccaagcagaaagaacttgaaatggcaaggaaaaagatgaatagcgaaatatctcaccgccaccagaaagagaaggacctgtttcacgaagactgcatgctccaggaggagattgccctactgcgcttagagatcgatacaataaagaaccagaacaaacagaaggaaaaaaagtactttgaagacattgaggccgtgaaagagaagaatgacaatctccaaaagattataaaactgaacgaggagactctcactgagacaatactgcagtactccgggcaactgaacaacttgacagccgagaataagatcttgaactcagagcttgagaatggaaagcagaaccaggaaaggttggagatagaaatggagagttaccgatgtagactcgctgccgctgttcgcgattgtgatcagtcccagactgcccgggatctgaaacttgatttccagaggacccgacaggaatgggtccggctccacgataagatgaaggtggatatgagcgggctacaagcaaagaatgagattctgtcagagaaactgagcaacgctgagtccaaaataaactccctgcagatacagctgcataataccagagatgcccttggaagagagtctctcattctggaaagagttcagagagatctttctcaaacgcaatgccagaagaaggaaacagagcaaatgtatcagatcgagcagtccaaactcaaaaagtacatcgctaagcaggaaagtgttgaggagcgactgtctcagctgcagtccgaaaacatgctactgagacaacagttagacgacgctcataaaaaagccaactctcaagagaagacctcctccaccatccaggatcaattccattctgccgctaagaatctgcaggcggagtcagagaagcagatactcagccttcaggaaaaaaacaaagagctcatggacgagtacaaccacctgaaggagcggatggaccagtgtgagaaagagaaggcgggcagaaaggtcgtgatgcgcgagtttcagcaggagtggactgatctactaaagcagcaacccacaagcgaagcaacctccaggtgccacattaacttagatgagacacaggattccaagaagaaactgggtcagattaggtccgagatcgaccttacagaagctcaggaaaccgtgccttctaggtgtctgcatctagatgcagagaatgaagtgctccagctgcaacagactctgtttagcatgaaagccatccaaaaacagtgtgaaacacttcagaagaacaaaaaacagcttaagcaggaggtggtcaacttgaaatcctacatggaacgcaatatgctagaacggggcaaggccgagtggcataagctgctgatcgaggagcgcgccaggaaagaaattgaagagaaactgaacgaggccattctgacacttcagaagcaagccgctgtctctcacgaacagttagtgcagctgagggaggacaacacaacgagtatcaaaacccagatggagctgaccattaaggacttggaaagcgagatcagtaggattaagacatcccaagccgattttaataagactgagcttgagaggtataaggaactgtacttggaggaggtgaaggtcagggagagtctttccaatgaattatctagaacgaatgaaatgatcgcagaagtctcaacgcaattaaccgtggagaaggaacagactaggagccgctcgctttttaccgcctacgccactcgacctgtccttgagagcccttgcgtgggcaatcttaacgacagcgagggtttgaatagaaagcatatccctcgaaaaaagaggagcgctttgaaggacatggagtcctatctgctgaaagtctcttatcttttttcattcggcgtgcagatatccgaccgcatccttgtgtgttacctcgtaaagtag

SEQ ID NO: 28747 - DNA, 681 bp, Artificial Sequence
  Description of Artificial Sequence: Synthetic coding sequence
atggtctcatggggcggggagaaaagggggggcgcagagggatcccctaagccagccgtttatgccacgagaaaaacggggagcgtgcggtcccaagaagaccagtggtaccttggataccctggggatcaatggtcaagcggcttctcatattcatggtggaaaaacagtgttggctctgagtcgaagcacggcgagggtgctcttgatcagcctcaacatgatgtaagactggaagatctgggcgagctgcatcgggccgcccgatcaggggacgtgcccggtgtggagcatgtgctcgttccaggagatactggcgtcgacaagcgggacagaaaaaagtctatacagcagctggtgccagaatacaaggaaaaacagactccagagtctctcccccagaacaacaaccctgattggcaccccacaaacctgaccctaagcgacgaaacgtgccagaggagcaagaacctcaaagtcgatgataagtgtccttcagtgtctccgagcatgccggaaaatcagtcagccactaaggaactgggccaaatgaacttgaccgagcgggagaaaatggatacaggcgtcgtcctgttatcggggaatgacacacttcatgacctgtgccagtctcaactgcctgagaataaagaatccaaggaggggaacaaagaagcttag

SEQ ID NO: 28748 - DNA, 3714 bp, Artificial Sequence
  Description of Artificial Sequence: Synthetic coding sequence
atggtgtcttgggggggagagaaacgggggggagccgaaggatctcccaagcctgcagtttatgctactcggaaaacgggatctgttaggagtcaggaagatcagtggtacctgggctatccaggagaccagtggtcctccggtttttcctactcttggtggaagaatagtgttggatccgagagtaagcatggcgagggagcactggatcagccgcagcacgatgtgaggttggaggacctaggcgaactgcatcgcgctgcccgatcgggagatgtcccaggcgttgagcacgttttggtcccaggcgacacaggagtagataaaagagacagaaagaagagcatccagcagttggtgcccgagtataaagaaaaacagacccccgagtctctcccccagaataataaccccgactggcatcccactaatctgacgctgtccgatgaaacatgtcagcgcagcaagaaccttaaagttgatgataaatgtccgtctgtctcaccatctatgcccgagaaccagtccgcaaccaaggaactgggccaaatgaatctcacggagcgcgagaaaatggacacaggcgtcaagacatcccaggagccagaaatggcgaaggactgcgatcgggaggacatcccaatctaccccgtgctacctcacgtgcagaagagcgaggaaatgaggatcgaacaggggaaactggaatggaagaatcagctcaagctggtgatcaatgaactgaagcaacgtttcggcgagatctacgaaaaatacaaaatacctgcttgcccggaggaagaacccctgctggataactccaccaggggtacagacgttaaggacatccctttcaatctcacgaacaatatccctggctgtgaggaagaagatgcctccgagatctctgttagtgtggtgttcgagacttttcctgaacagaaggaacccagccttaagaatattatacacagctactatcacccttactctggaagccaggaacacgtatgccagtcctctagtaagttgcacctacatgaaaataaactagactgcgataacgacaacaaacctggaatcggccatatcttttccaccgataaaaacttccacaatgacgcctcaacaaagaaggcacggaaccctgaggtggtgacggttgagatgaaggaagaccaggagtttgaccttcagatgacaaagaacatgaaccaaaactccgacagcggctcaacaaacaactacaaaagcctgaaacccaagctggaaaacctgtcatctcttccgcctgatagtgataggacttccgaggtttacctgcacgaggaactacagcaggacatgcagaagtttaagaacgaagtgaataccctggaagaagaattcctcgctcttaagaaagaaaatgtccagctgcataaggaagttgaagaggaaatggagaaacacagaagcaacagcaccgagcttagtgggacactgactgatggcactacagtgggaaacgatgatgatggattgaaccagcagatcccacgaaaagagaatggggaacacgaccggttggcattgaagcaggagaatgaggagaaaaggaatgcagacatgctttacaacaaggatagcgagcaattacgtataaaagaggaagaatgcgggaaggtggtcgaaaccaagcagcagctcaaatggaacctacgccgccttgtgaaggaactccgtaccgtggtacaggagcgcaacgacgctcagaaacagctgtctgaagagcaggatgcaagaatcctccaggaccaaattctgacctcaaagcaaaaagaactcgaaatggcacaaaagaagcggaaccctgagatttcacataggcaccaaaaggagaaagacctttttcacgagaactgtatgctccaggaggagatcgcactcttgcggctcgagattgacacaattaagaatcagaataagcagaaagagaaaaaatattttgaggatattgaggtcgtgaaggaaaagaatgataatctgcaaaaaattattaaacggaacgaggagacattgaccgagactattcttcagtactctggccagcttaataacctaactgctgagaacaagatgttaaactcagaactagagaacggaaaggaaaaccaggagcggctggagattgagatggagagctatcgttgcagactcgcggccgctgtccacgactgtgatcagtcccagaccgcccgcgatctcaaactggacttccaacgaactcgacaggaatgggtccggctgcacgataagatgaaggtagacatgtctgggttacaagccaaaaatgaaattctgtcagagaagctatctaacgccgaaagtaaaattaattctttacagatacaactacataacactcgagatgccctgggcagagagagtctgattcttgagagagtgcagcgcgacttatcgcagacccagtgtcaaaagaaggaaaccgaacagatgtaccagtctaaacttaaaaaatacattgcaaaacaagagtccgtggaagagagactgtctcaactccagtcagaaaacatgctgctgcgtcaacaactcgacgacgtgcacaaaaaagctaacagtcaggagaagacaatctccactattcaagatcagtttcattctgcagccaaaaatttgcaagcagagtctgagaagcagattctgagcctccaggagaaaaacaaagagctgatggacgaatataaccacctgaaagaaagaatggatcagtgcgaaaaggagaaagcgggacgaaaaatcgatctcaccgaggcgcaagaaacagttccaagccgttgtttgcacctcgacgccgagaatgaggtattgcagctgcaacaaacactcttttcaatgaaggctatccagaaacagtgcgaaacactgcagaaaaacaagaagcaactaaagcaggaagtggtcaacttgaaaagttacatggagcgtaacatgctcgaaaggggagaggcggagtggcacaaactgttgattgaggagcgagctaggaaagaaatagaggagaagttgaacgaggcaatactgacccttcagaagcaggcagcggtgtcacacgagcagctcgcacaactacgtgaggacaacaccaccagcatcaaaactcaaatggaactcactgtgattgacctggagtcagagatcagcagaatcaagacatcgcaggcggatttcaataaaaccaagctcgagcgatacaaggagctctatctggaggaagtcaaggtcagagagtcgctgtccaacgagcttagtaggactaatgaaatgatcgcggaagtctccacccagctcaccgttgagaaggaacagacacgaagccgctccctctttaccgcatacgctactcgccccgtgctggaatcgccttgcgtgggcaatttgaatgacagcgagggtttgaataggaagcatataccccggaaaaagcgcagcgccctgaaggacatggagtcatacctgcttaagatgcagcaaaaactgcagaatgatctcactgcagaagtcgccggctcctctcagaccggccttcataggatacctcaatgcagcagcttcagcagctcatcattacacctgttactgtgtagcatctgccagcctttctttctgatcctccagctgctgctcaacatgaacctggaccccatttag

SEQ ID NO: 28749 - DNA, 2868 bp, Artificial Sequence
  Description of Artificial Sequence: Synthetic coding sequence
atggaagactcctcgaccgacactgagaaagaagaggaggaagaaaaggacgaaaaggatcaagagccaatctacgcaatcgtccctacaattaacatccaggacgaacgctttgtcgatctcagtgaaactcccgcctttattttcctgcacgagctccatgccatgggcaaactgcctggcacaaggatggcagctctcaaagccaagtacacactcctacacgacgccgtgatgagcacccaggagtcagaggtgcaactgctgcagaatgccaagagattcactgagcaaattcagcagcaacagttccacttgcagcaggccgataattttcctgaggccttttcaaccgaggtctcgaagatgcgcgagcagctgctcaagtaccaaaatgaatataacgcagtgaaggagcgagaattccacaaccagtatagattgaactcgctgaaagaggaaaagatcatcatcgtaaaggagtttgagaagatcacgaagcccggcgaaatggaaaaaaagatgaagattttgagggagtcaactgaagagctgagaaaggaaataatgcagaaaaagcttgagataaaaaacttgcgagaagacctggcatctaaacagaagcagctcctgaaggaacagaaagagctggaggagctgctgggccaccaggttgttcttaaagacgaagtggcccatcaccagacaattccagtccaaattgggaaggaaatagagaaaattactcgtaagaaggtcgaaatggagaagaagaaaatcgtccttgagcaggaggtgaagacccttaacgactctttgaagaaagtcgagaacaaggtatcagctatagtagatgaaaaagagaacgttatcaaggaagtcgagggaaagcgggccctgttggagattaaagagagggagcataatcagctggttaagctcttggaactggcccgtgagaatgaggccacgtctctaaccgaacgcggaatcttggacttgaacctccggaattctttgatagacaagcaaaattaccatgacgagctgtcaagaaagcagcgggaaaaggaacgtgattttaggaatctcagaaagatggaactgttactgaaggtaagctgggacgcgctgagacagacacaggctttgcaccaaaggctgttgcttgaaatggaggctatccccaaggacgacagtacccttagcgagcgacggcgcgaactgcataaagaagtagaagtcgccaaacggaatctcgcccaacaaaagattatcagtgaaatggagtccaagttagtggagcagcaactcgccgaagaaaacaaactgcttaaggagcaggagaacatgaaggagctggtggtgaatcttctgaggatgacccagatcaaaatcgatgaaaaggaacagaaaagcaaagacttcctcaaggcacagcagaaatatactaatatcgttaaggagatgaaggctaaagatctagaaatccggatccataagaagaagaaatgtgagatataccggcgcctgagagaatttgcaaaactgtacgacaccattcgcaatgagagaaataagttcgtgaacttgctgcataaagcgcatcaaaaagtgaatgaaattaaagaacggcataagatgagcctcaacgagttggagatcctgagaaattctgcagtttcacaggaaagaaagcttcaaaattccatgctcaaacacgccaacaacgtgacgatccgtgaatcaatgcaaaatgatgttagaaaaattgtgtcaaaacttcaggagatgaaagaaaagaaagaagcccaactcaacaatattgacagactcgccaatactattaccatgattgaagaagagatggttcagctacggaagcggtacgaaaaagccgtgcaacaccgcaatgagtcaggagtgcaactcatcgaaagggaagaggaaatctgcatcttctacgagaaaattaatattcaagaaaaaatgaaattaaacggggaaattgagattcacctgctggaagagaaaatccaatttctgaaaatgaaaattgctgagaaacagaggcagatttgcgtgacccaaaaactcctgcccgctaagcgatccttggatgcagacctcgcggtgctccaaatccagtttagccaatgtactgacagaataaaggacctagagaaacaattcgtcaaacccgatggcgaaaaccgagctagattcttacccgggaaggacctgactgaaaaagagatgatccagaagctggataaactagagctccagctggcaaaaaaggaggagaagttgctggaaaaggatttcatctatgagcaagtcagtagactaacagataggctgtgttccaagacacagggctgcaagcaggacacattgcttcttgccaaaaaaatgaatggctatcaacggcgcattaaaaacgctaccgaaaagatgatggctttggtggccgaactgagtatgaaacaggctttaacaatagagctccagaaagaagttagggagaaagaggacttcatttttacatgcaatagccgaattgagaaaggcctacccctcaacaaggagattgagaaagagtggttaaaggtactcagagacgaagagatgcacgcactggcaatcgcagaaaaaagtcaagagtttctagaggctgataacaggcagcttcccaatggcgtgtacaccaccgctgaacaaagacccaacgcctacatccctgaggctgatgctacacttcctctgcctaagccttatggggctctggccccgttcaagccttctgagcccggggcaaacatgaggcacatccgcaagcccgtaatcaagccagtggaaatctag

SEQ ID NO: 28750 - DNA, 513 bp, Artificial Sequence
  Description of Artificial Sequence: Synthetic coding sequence
atggaggatagctccacggacacagaaaaggaggaggaagaggagaaagatgagaaggaccaggagccaatttacgccattgtaccaacaatcaacattcaggatgagcgctttgtagacctgtccgagacccctgctttcatctttcttcatgaactgcacgctatggggaagctgccgggcaccaggatggcagccctgaaggcgaagtacactctgttacatgatgcagtcatgtccacacaggagtccgaagtacaactccttcagaatgcaaagcgcttcaccgaacagatacagcagcaacagtttcatctgcagcaggccgacaactttccagaagctttttctaccgaggtctccaagatgcgggagcagctgctgaaataccaaaacgagtataatgctgtgaaggagcgcgaattccacaatcagtatagactgaactctttaaaagaggagaaaattatcattgtgaaagagtttgagaagattacgaaacccggcgtgtag

SEQ ID NO: 28751 - DNA, 2010 bp, Artificial Sequence
  Description of Artificial Sequence: Synthetic coding sequence
atggaaaaaaagaaaatagtgctcgagcaggaggtgaagactctcaacgattcccttaagaaggtggaaaataaggtcagcgccatcgtcgatgaaaaagagaacgtgattaaggaggtggaggggaaaagggccttgctggagatcaaggagcgggaacataatcaattggttaaattgctggagctagcccgggagaacgaggccacttctttgaccgagcgtggtattttggatctcaaccttcggaactctctgattgacaaacagaactaccatgatgagctgtcccggaagcagagggagaaggagcgcgacttccgcaacctgagaaagatggaactacttcttaaggtgagctgggatgcgcttagacaaacccaagccctgcatcagcgcttactgctggagaagatcatctccgagatggagtccaaactagtggaacagcagttagctgaggaaaataaacttctgaaagagcaggaaaacatgaaggagctcgtggtgaatctgctgaggatgactcaaataaaaattgatgaaaaggagcagaaaagtaaggactttctcaaggcacaacagaaatacaccaacattgttaaggaaatgaaggccaaagacctcgagattaggatccacaagaaaaagaagtgcgaaatttatcggagattgcgggaatttgccaagctgtacgatactatcaggaacgagcgaaacaaattcgtcaacttgcttcacaaggcccatcagaaggtgaacgagatcaaagaacggcataaaatgtccttgaatgaattggagattctacggaatagcgccgtcagccaagaaagaaaactgcagaacagcatgctgaagcacgccaataacgtgacaatccgggagtccatgcagaacgacgtcaggaagatcgtaagcaagcttcaggaaatgaaggagaagaaggaggcacagttgaacaacattgaccgtctggccaacacgattaccatgatcgaggaagagatggtgcaattaaggaagagatatgaaaaggccgttcaacacaggaacgagtccggtgtgcagttaattgagagggaggaagaaatatgtatcttctacgagaaaattaatatacaggaaaagatgaaactgaatggagagatagagatccacctcctggaggagaagattcaatttctgaagatgaagattgcagagaaacagcggcagatttgtgttactcagaagttactgccagccaagaggtcattggacgcagaccttgccgtgttgcagatacagttcagccagtgcaccgacagaatcaaagacctggagaaacagttcgttaaacccgatggcgaaaaccgcgcacgcttcttaccaggaaaggatttaacggagaaggagatgatccagaaactagacaagttggaactacagcttgcaaagaaggaagaaaaactactcgaaaaagacttcatatacgagcaggtgtctcggcttaccgatcgcctgtgttcaaagacccaaggctgtaaacaagacaccttgctactcgcgaaaaagatgaatgggtaccagagacgaatcaaaaatgcgactgagaaaatgatggccttggttgctgagctttcgatgaaacaggccctgactatagaactccagaaggaggtccgtgaaaaggaagattttattttcacctgtaactctcggatcgagaaagggttaccactgaacaaagagatagagaaggagtggctcaaggttctgcgtgatgaagaaatgcacgccttggccatcgcggagaagagtcaggaattccttgaggccgataatcggcagctccccaacggagtgtacactacagccgagcagaggccaaacgcctacatccccgaagccgatgccaccctcccccttccgaaaccatatggggcactagccccattcaaaccaagcgagccaggcgctaacatgcgacatatacgaaaacccgtgattaaacccgtggaaatctag

SEQ ID NO: 28752 - DNA, 279 bp, Artificial Sequence
  Description of Artificial Sequence: Synthetic coding sequence
atggatgagctcctgcgggaacgcgacatcctgaacaaaaatatgctgaaggccgttaacgcgacgcagaaacagactgatttggtgaaactccacgagcaggccaaaagaaacctcgaaggtgagatccagaattacaaagacgaggcccaaaagcaacggaagatcatctttcacttggagaaagagagagatcggtatatcaaccaagcatctgacctgacccagaaggccgactcggtgcgcatgccttggcccctcgataagggtaagtggtag

SEQ ID NO: 28753 - DNA, 279 bp, Artificial Sequence
  Description of Artificial Sequence: Synthetic coding sequence
atggacgagttgctccgggagcgagatatactaaacaaaaacatgctgaaagctgtgaacgcaactcagaaacagacagatttagtgaagctccacgagcaggccaagagaaacctggaaggcgagattcagaattacaaggatgaagcccagaaacaacggaagattatattccaccttgagaaggaaagagataggtacattaaccaggcctcagacctgactcaaaaggcggacagcgtccgcatgccctggccactggataaagggaaatggtag

SEQ ID NO: 28754 - DNA, 2619 bp, Artificial Sequence
  Description of Artificial Sequence: Synthetic coding sequence
atggccgaggagaagggcgggaaacaggtactggaggagtcagccttcgaggaaatggagcgtgactttcaaggggttctgcacgaactctccggcgacaaatccttggaaaagtttagaatcgaatatgagcgattacatgcagtgatgaagaaatcctatgataatgagaagcgcttgatggcgaaatgccgcgaattgaatgcagaaatagttgtcaattcggcgaaggtggcgactgcgctgaaattaagtcaagatgaccagacaaccatcgcctctctcaaaaaggagatcgagaaggcgtggaagatggtcgactcagcttacgataaagaacagaaggcaaaagaaactatcctggctctcaaggaagaaattgtcaatctcacaaaactagtcgaacaggggagcggcctgagcatggatcagcactccaatattcgcgacttactgaggtttaaggaagaagtcaccaaggagcgcgaccagctgttgagcgaggttgtaaagcttcgcgagtctctcgctcagaccacagagcagcagcaggagaccgaacggtcaaaggaagaggccgaacacgcgatctcccagttccaacaggaaatacagcagcggcagaatgaggcctctcgcgagtttaggaaaaaagaaaagctggaaaaggagctcaaacagattcaggcagatatggactctcggcagacggagatcaaagccctccaacagtatgtgcagaagtcaaaggaggagctccagaaactggaacagcagttgaaggagcagaaaattctgaatgaacgagccgctaaagaactagagcagttccaaatgcgaaacgccaagctgcagcaggagaacgagcagcacagcctcgtgtgtgagcagcttagccaggaaaatcaacaaaaagccctggagttgaaagcaaaagaggaagaggtgcaccagatgcggctagacattgggaagctgaataagatccgggagcagattcataagaagttgcaccataccgaagatcagaaggccgaggtggagcaacataaagagaccctaaaaaaccagatcgtgggactcgaaagggaggttgaggcatcaaagaaacaggctgaactggataggaaggccatggacgaactgctgagggagagagacattctcaataagaacatgttgaaggccgtaaacgcgacccagaaacagacggacctcgtgaagctgcatgaacaagctaaaaggaatcttgaaggtgagattcagaattacaaggatgaggcccaaaagcagagaaagattatcttccatttagaaaaggaacgagacagatatatcaaccaggcctctgatcttactcagaaggtgctcatgaacatggaggacattaaggtgcgcgaaacacagatcttcgactacaggaaaaaaattgccgagtctgaaatcaagctgaaacagcagcagaacctctatgaggctgttaggagcgaccgtaatttgtacagtaagaatctcgtcgaggctcaggatgagattactgacatgaagagaaaattgaagattatgatccaccaggtggatgaactgaaagaggacatcagtgccaaggagagcgctctagtgaaactacatctggagcaacagcgaattgagaaagagaaagagaccctgaaagcagagctccagaaactgcggcaacaggccctcgaaaccaaacactttattgagaagcaggaagcagaagagagaaagttgctgaggattattgcagaagctgatggtgagaggttaaggcaaaaaaaggagctagatcaggtgatctcggaaagagatatactgggctctcagctggtccgccgaaacgatgagctggctcttctgtacgaaaagatcaagatccagcagtccgtgctgaacaagggcgaaagccaatataaccaaaggctggaggacatgagaattcttaggctcgagatcaagaagctgcggcgtgagaaaggcattttggcaaggagtatggccaacgtcgaggagctgagacaggagttcttccacatgcagcgcgaactcctaaaggagcggactcgctgtagggccctggaagaggagctggagaaccctctgaatgtccaccgatggcgcaaacttgaagctagcgatcctaacgcttatgaactgatccagaaaatccacactctgcagaaacggctcatttcaaagaccgaagaggtggtcgagaaagaacttttactgcaagaaaaggagaaattgtatatggagctgaaacacgtacttgcgcgacagcctgggcctgaagccgccgagcaattgaagctgtataggcgcacactgcacgacaagaaacagcagctgaaggttctgagcagtgagctaaacatgtatgaggtgcagtctaaggaatacaagtacgaggtagaaaaacttactaacgaactgcagaatctgaagaaaaaatatctcgctcaaaagcgaaaagaacaattacagaagaacaaagatacagctcccatggacaataccttcttgatggtaaaaccaaacggacctggatttaccgggggcgggtttccgctgaggtccaccaaaatgacattctag

SEQ ID NO: 28755 - DNA, 1776 bp, Artificial Sequence
  Description of Artificial Sequence: Synthetic coding sequence
atgtgtgcggcatccgccagtcccgataatctggttttccacatgaagaacgaaatgcgaaatatcaagtacaagcccgtagactatcagcagctgcgggccctgaccgaggctaagaagcttgcctctgcctcggccaagcttaagatacgcaaagccatgctaaccagcaagctgtctaaagagcagactttaattaagcagcacaaacaagtatggtggcaggaataccagcgcttgaacgaggtgagatgtaagatggaatccgagattaagagcctcctgaatgaggagaacatcgggaatgagtgcctttgtgatctcactaattttgagcaggaactgagcgagcagcagtgcacttacttgaaaaacgttatcaatcccatccagcagttaagggcagatctaaaataccggcaacaccacacactgcaacactctcaccctcacatagaattcaacagtatgaaggtgctggaggaggtggatttcgttaaaaagcagctgaaaaccgtctttgaaaggctcaggcttgaacaacagcgcatcgaaaacgacttatcagactggtctatcaagattctggaccattcacttgaggagaagacgaatccactttccgaactccccatcgaactcgaaagcttagagtgcccatacccggacctgaaatcctcaatcctcagtgaattctacaagtttacccagaagtatcagaagaagctccaggattttaatctgcaactcgaagacatctatagaaactgtcaattaagcgaagaggatcattggatctaccaggcaatcttagatcaataccccggtgacctgttcggcagaagaaccctgtacctggatatgctgcagaggtactttccacacaagtccaggcatgacctggtggagcacgagaagtattgtgatcagtaccgctttgctatcgagcaacagaacatactcatctctaattggaataagaacaaaaaagacttcattcagaaagccgttctgaccttaactgaggcctgtgccacacacgaaatggaaagtatgctggcaaaagataaaaaaaagcagcaggagctctgcgccgatctgaaagcaaaagtgagacagtggagagcccaccaggaggaagtggcccggctagaaatggaaatttccgcccggaggcgagagaaggaagaagaaaaggagaagctgtggaagaagaaggagctgcttcagagagcagagaagaaaaagaaaatcaagaagtattgggccaagaagaagcaaaagtggcaggaaatggaaatgagggatctgcaacgtcttgaggaactgaagaagctgatagccgaacaatctctgaaggaccgagaacgcgtgaagtatcggcaagaattactggaacgacggctaatggagaagaaggaagtggccctacaggaggcccacgaggataaggagcgcgcccggcgtttggaggccctgcggaagcaggtcgcggtcgtggcgcaatttgaccctgtcagaatgatgagcgacactatggcttccaaggcacgcatgggaatcgaaatcgaggaggaatttatcttgcagaagcctctgttcacattgaacacctacaacgagcagcagatcataagtgaccccaggctgcggtttgaactcgctctacgcgaggccggcctacacaggacactgtacgctaaggagattctcccaaaaatttctccccagaagcctcctagaaaagacatggaaagcaccgtgttcaaaatatag

SEQ ID NO: 28756 - DNA, 795 bp, Artificial Sequence
  Description of Artificial Sequence: Synthetic coding sequence
atgaacgtctttgtcactctccagattcttgtggactttgttaaaaagcaattgaaaaccgtctttgagcggttacgcctggaacagcagcggatcgagaacgacctttctgattggtctatcaagatcctggatcactccctggaggagaagacgaatcctctctccgaacttcccatcgagctagagtctctagaatgtccttatcctgatcttaagagttccatactaagtgaattctacaaattcacccagaagtatcagaaaaagctgcaggactttaaccttcaactggaagacatctacagaaattgtcagctcagcgaagaggaccactggatctatcaagccatcctggatcaatatccaggagacttatttggacggcgtacactgtacctggacatgctacaacgctattttccccataaatcgcgccatgatctggtggagcacgaaaagtattgcgaccagtataggttcgcaatagagcagcagaatatcctgatttcaaactggaataagaataaaaaagacttcattcaaaaggccgtactcacacttaccgaggcatgtgcaacccacgagatggaatccatgctggccaaagacaagaagaagcagcaagagctgtgtgcagacctgaaagccaaagtccgacagtggcgggcccatcaggaagaagtggcccggttggagatggagatcagcgcgcggcgaagggagaaagaagaggaaaaggaaaaattgtggaagaagaaggagctgctccagcgcgcggagaagaagaaatag

SEQ ID NO: 28757 - DNA, 900 bp, Artificial Sequence
  Description of Artificial Sequence: Synthetic coding sequence
atggagtccgagattaaatccttgctgaatgaagaaaacattggaaacgaatgtctgtgcgaccttactaacttcgagcaggagttatccgaacaacagtgcacgtacctgaaaaatgtaataaaccccatccagcagctgcgcgctgatttgaagtaccggcaacatcataccttacaacattcacacccacacatcgagttcaacagcatgaaggtacttgaagaagtagactttgtcaaaaaacagttgaagaccgtttttgagagattaagattagagcagcagcgcatcgagaacgacctctccgattggtcaattaagattctggatcactcattagaggagaaaaccaatccattgtctgagctgccaatcgagctggagagtcttgagtgcccttaccccgatttaaaatctagcattctttcggagttctataaatttacacagaagtaccaaaagaagctccaggactttaatttgcaactggaagacatttaccgcaattgtcagttaagcgaggaagatcattggatctatcaagccatcctggaccagtatcccggcgaccttttcggacgcaggacactgtacctggatatgctacagcgatatttccctcacaaatcaaggcacgatttggtcgagcatgagaagtactgcgaccaatataggtttgcgattgaacagcaaaacatcttgatctctaattggaataagaataagaaggactttatacagaaagccgtcttgacactgactgaggcgtgtgccacacatgagatggagtctatgctcgctaaagacaagaagaagcagcaggagttgtgcgccgacttgaaagcaaaaagccaggtatgcctgtaccaacagcacgagaacggactaatccaatag

SEQ ID NO: 28758 - DNA, 1362 bp, Artificial Sequence
  Description of Artificial Sequence: Synthetic coding sequence
atggagattcaccacttccttctgaagcggaagcaggctaacctggcacagttgcttcgggactcacaggacagaaacaaacacctgggcgaggaaataaaggaactgcagcagagactgggcgaagttcaaggtgataataaactccttcggatgacaatcgcaaaacagcggctgggtgacgaagctataggcgtgaggcacttcgcagcgcatgagagggaggacttggtgcagcagttggagagggcaaaggagcagatcgagagtctcgaacacgacctacaggctagcgttgatgagctgcaagacgtcaaagaagagaggagctcttatcaggataaggttgaaagactgaatcaggagttgaaccatatcctatcaggccatgaaaacaggattattgacgttgacgcgctctgcatggagaatagatacttgcaggagaggttgaaacagttacatgaagaggttaacttgctgaaaagcaatatcgccaaatataagaatgcgcttgagcggaggaaaaactcaaagggtcagggtaaaagcagtagttccgctctgactggcgttctctcagccaaacaagtacaggacctcctgtcagaggatcatggttgttccttgcccgccaccccgcagagtatcagcgatctaaaatctttggctacagcgctgctcgaaaccatccacgagaagaatatggtgatccaacatcagagacagacaaataaaatcctggggaatcgagttgcggaactagagaaaaaactgcggacccttgaagtgtccggcttatggtctcttcctggcgggaaggacactatattgtttagcgatcccaccttgcccagcggacagagatctagaagcccactcttaaaattcgttgagcaaccaaccgaaaacaaagcggaccccaaggacggtgaggcccaaaaacaggaggaggatgagtcctgcgctgcagcggaggcactgacagcccctgaggatgccgggcggcctgcagtgaatagcccagccaaccagagtagggggaaccagtgtaaacttttccatccctccctgcctcagttaccatcagaggaggaggtaaacagtcttgggagagagataatcaaacttaccaaggagcaggctgccgcagaactggaggaggtgcggcgtgagagtcccatcgagggccagcgttctgagaccgggcccgcacccccaggcctcgctattcagggagagctccctaagtcacacctggacagttttgaggcatctcgacctgccgcgaaggcctctactcccgaagatggcaaaggaattccagaagggggaggcatgaggagtacagttaaaacgtag

SEQ ID NO: 28759 - DNA, 261 bp, Artificial Sequence
  Description of Artificial Sequence: Synthetic coding sequence
atggctaatcaactccgagagaggcatcaaagcttaaaaaaaaagtaccgggaactgattgatggggacccctcacttccccccgagaagaggaagcaggccaacctggcacagcttctgcgggatagccaagataggaataagcacctgggggaagaaatcaaggagctgcaacagcggctaggagaggttcagggggacaacaaaggaagactgcggtctaagaagaagatgaaggtcgtgccactgctgcgacgctag

SEQ ID NO: 28760 - DNA, 1590 bp, Artificial Sequence
  Description of Artificial Sequence: Synthetic coding sequence
atggaagaagaggccatgaacggcgacaggacagaatcggactggcaaggcctagtgagcgagtacctggtctgcaagcggaagctggagtctaaaaaagaagcattactgatcctgtccaaggagctggatacgtgtcagcaggaacgagatcagtataaactcatggccaatcagctgcgggagagacaccaatctcttaaaaagaagtaccgcgagctgattgatggtgatccatctctgcctcctgagaagcgcaaacaagcaaacctggcacagctgctccgggattcccaggatagaaacaagcatctgggtgaagagattaaagagcttcagcagcgcttgggggaagtgcagggggacaacaagctcctgcggatgaccatagccaaacagcgactcggagatgaagctataggggtccgacacttcgcagcacatgagcgagaggacttggtacaacaactggagcgcgcgaaagagcagattgaaagtttggaacacgacctgcaggcttccgtggacgagttacaggacgtaaaagaggaacgttcttcctatcaggataaggtggaaaggctgaatcaagagctgaatcatatcctgagtgggcacgaaaacagaatcattgatgtggacgccctgtgtatggaaaaccgatacctgcaagagagactaaagcaattacacgaggaagtcaatctcctcaaatccaacatcgctaagtacaagaatgctctggagaggcgtaagaattccaagggccagggaaagtcctcatcttccgctttgaccggagtattatctgccaagcaagtccaagatctgctctccgaagatcacggatgctccttgccagctacccctcaaagcatttccgacctcaaatcgcttgccaccgcccttctcgaaaccatccatgagaaaaacatggtcattcaacatcaacgacagacaaacaagatcttgggtaatagggtggctgaattggaaaaaaaattgcggactctggaggtgtcaggcctctggtcacttcccggggggaaagatacaatcctgttcagcgacccaaccctaccaagtggtcaaagaagccggtctcccctgctgaagttcgttgaacagcctactgaaaataaagcagaccctaaggacggagaagcccagaaacaagaggaagacgagtcctgcgctgctgccgaagcgctgactgcccccgaggatgctggcagaccggctgtgaattcccctgcaaaccaatcccgcgggaaccagtgtaagcttttccacccctccctgccgcagctgccaagtgaagaggaggttaactcactaggtcgagagattataaagctcaccaaggagcaggcagctgccgagctggaggaggtaagaagggagagccccattgaaggccagcggagcgagaccggccccgcaccacctggtctggctatccagggagagcttcccaagtcccatttggatagcttcgaggcatccaggcccgcagctaaggcttccacccccgaagacggaaagggtatccctgagggtggaggaatgagaagcactgtgaagacatag

SEQ ID NO: 28761 - DNA, 1590 bp, Artificial Sequence
  Description of Artificial Sequence: Synthetic coding sequence
atggtggtaattgtggtggtgattatcatcatcatcgcaagggctgctacctgggatagcgagtatctcgtatgcaagcggaagttggaaagcaaaaaagaggcactgctaatcctctctaaagagctggatacttgccagcaggaaagggatcagtacaaactcatggctaaccaactgagggaacgccaccaatcattgaaaaagaaatatagggagctcatagatggggacccaagcctaccacctgagaaacgcaagcaggcgaatttggcccagctcctcagggactcacaggaccggaacaagcacttaggcgaagagattaaagaactccagcagagactcggcgaagtgcaaggagataacaagttactgagaatgaccatcgccaagcagaggcttggcgatgaggcgattggcgtgaggcacttcgctgctcacgagcgtgaagacctggtccagcagcttgagcgggccaaggagcagatcgagtccctcgaacacgatctgcaagcgtccgtggatgaactccaggacgtaaaagaggagcgctcctcgtaccaggataaggtcgagagattaaatcaagagctcaaccacatcctctccggccacgagaaccgcatcatagatgtggatgccctctgtatggagaataggtatctgcaggaaaggttgaagcagctgcatgaggaagttaacctgctgaaatcaaacatcgccaagtataaaaatgctcttgagcggcgcaaaaattcaaaaggccagggtaaaagcagttcttcagcccttaccggagtgctgtcagccaagcaggttcaggaccttctttcagaagaccatggatgctcattgccggccaccccccagtccattagcgaccttaagtcactggccacggcccttctagaaaccattcatgaaaagaacatggtcatacagcaccaaaggcaaaccaataagatcctggggaacagagtagcagaattggaaaagaagcttaggaccctagaggtttcgggcttgtggtcgctgccagggggtaaagataccatactgttttctgaccctaccctccctagcggtcaacgatcacgaagcccactccttaagtttgtagaacaacctacagaaaataaggccgacccgaaggacggcgaagcgcagaaacaggaagaggatgaaagctgtgccgccgctgaggctctgaccgctcccgaggatgccggtagacctgccgtgaatagcccagctaaccaatcccgagggaaccaatgtaagctgttccatcccagcttgccccagcttccatcagaggaggaggtgaactccttaggccgcgaaataatcaagttaaccaaggagcaagctgccgccgaactggaagaggttagacgcgagagccctatcgagggtcagcgtagcgagaccggccctgccccacccggcctggctatacagggagagcttccaaaatctcacttagacagctttgaggcaagcaggcctgccgcgaaagcctcaacaccagaggacgggaaagggattcccgaaggtgggggcatgagatccactgtcaagacatag

SEQ ID NO: 28762 - DNA, 2247 bp, Artificial Sequence
  Description of Artificial Sequence: Synthetic coding sequence
atgtcgctccatgaggcgagtgagaaggcacaagtgctgaatgaccagttgactaagaagtgttcagagctgtcctgcatgctgcagactgtaacgatggagaaggctcgtattatcgccgaccaccaggccatcttgcaggtagagcagaaaatgatgacccaaacctttcaagagcaaaatctgttgctcgacgcggcccacgccagtatcacgaacgagctgcagaccgtgcagaacgaaaaaacacagctacaggcacatctggatcatttgatactggaacacaatcaatgtattcaaaaggcgcaggatgcggagaagcgtacagccgtgcaaaaggaacttctcgaatccacaattgcccgtctgagaggggaattagaagcctctatgcaggaaaagaaaagcctgctggaggaaaaagaacgcttccagcgtgaggtcaataaaacagaaaaggagattgtgcaagagcggtgtaatctggagaaagagctggcgaagaataaagtggacatcaatacactgacacacaatttgcagacacttgaggaggagaataagcacctcgccgaccaaatggcttcgcttgaacttcaacaggttacttcggactaccatggactagcgcaacagaaagtagagaagatcaccgaatcaaagaacaagctggcctacgaaaatgggaagctacagattaaagtgaagcagctggaggagcaggtgcagtcatttacagataccagtctgcaaaatgaccatctgagaaagatgaacaagtatctccaaacaaagtatgcgcaggtgaagtctatcctggagaggtccaaagaagaactgtctcggaccgtgaaatgccggaacgccgccctcaaggaaagccaaaagctgaaggaagatcttgaagcagttgaagatcgagaaaacaagaaagtcgggaatttccagaggcagctggctgaagccaaggaggacaattgcaaagtgaccataatgctggaaaatgtcttagcttctcactctaagatgcagggggcgctggaaaaggtgcagatcgagttgggaaggagagactccgaaatcgctggattgaagaaggaacgggacctcaatcaacagcgagttcaaaaactcgaggcagaggtagaccaatggcaggcgaggatgctcgtgatggaagatcaacataattctgagatagaaagtcttcagaaagccctgggagtggctcgggaggacaataggaaactggccatgagtctcgagcaggcgctccagactaataatcatctccaaactaagttggaccacatccaggagcagctcgaaagcaaggagctggaacgccaaaacctggagacatttaaggatcgcatgacagaggagagcaaggttgaggcagagttgcacgcggagcgaattgaggccctccggaaacagttccaaactgaacgggaaaccaccaaaaaggtcgcccaacgtgaggttgcagaactgaagaaagcgctagacgaagcaaacttccgctctgttgaagtctccaggacaaaccgtgaactccgacagaagctggccgagcttgagaagatccttgagtccaataaggaaaagataaaaaaccagaagactcaaatcaaactgcatctgagtgcaaaagcaaacaatgctcagaatatcgaacggatgaagcaaatcgagaaggagctgaaacaaatggagctcataaaagaccagtaccagaaaaaaaattatgagcagtccctcagcatccaaagattcgtgtgcgagatgaccaacctgcaaaaggaaatgcagatgcttgctaagtcccaatatgacgcttctgtcaggaataagcagcaggaactgcatctagaggcagaacggaagatcagacaggagctcgaaaaccgctgtcaagaactagaagagacagtgaggcacctgaaaaaatgcaaggaggccacagaaaataccctcaaggaggctagtgttgagagcgagcagataacggctaacctcgaggaggcccataggtggttcaaacacagattcgatggtctgcagctggagttgacaaaaaacagacttcagcgcccctccggtgaggaccgctggcaggaaaaggaccaagacgtaaagcacgacgtgatgtccaaccagagtgtcctgcacagatgggaaagaaagcagaatctgcgtcctatgccgaaaaagtaccactctgaggtgcaacgtaagtag

SEQ ID NO: 28763 - DNA, 3306 bp, Artificial Sequence
  Description of Artificial Sequence: Synthetic coding sequence
atggattgcaaagtccatatggaaactactgtcagcaggcctgtgttaagccccacccacataaatgcgaccgctagcgagacgtttaccgtattgcaacaacgtatgaggatagtggaggagcagacatctagtctgcgcgatgatttgattatgttagacttcggcgagaaacgggggtatctggaggctcctgactgcctcgaggaccttgacagccagaaggtgatctccccgatccagaatgaagcaatctgtgctgggaagacagatatcctgtggaagaattgcgaattccttgttaatagaatgtgtaggctggaaagcctcatgcaatccctgaagatgaacatctttcggctgcaaaccgagaaagatcttaacccacagaagacagctttcttgaaagatagattgaatgctatccaggaagaacatagtaaagaccttaagctccttcatcttgaggtgatgaacctgcgacagcaattgagagccgtcaaggaagaagaggataaggcccaggatgaggttcagagactgacggcgaccctgaagattgccagtcagaccaaaaagaatgccgcaatcatagaggaagaattaaaaactaccaaaaggaagatgaaccttaagatccaggagctccggaggcagctggcacaagagaagtacctgcgggagtctctggagaagtctgcctccgccatgctcctgaaaattcaggaaatgggcagcaccgtggaggtggagaggaaacaggttcacatcctgcagcaaaactgtatagctctcagagatagtatccaaagcgctcaggagctgcttgcacaagagcagaaaaaaaaagaagaactcgaaattgcaacctcccagctgaagtccgacctgacctcccgggacgacctgatctctaagctggtggaggagaacaagaacttgcagatttctttcaataaggagcacgaggaaaatgcctatctgcggagtgaaataatgagcctccatgaggcaagcgagaaagcccaggttttgaatgaccagctcacaaagaaatgtagtgagctgtcatgtatgctgcaaactgtcacaatggagaaagctcgaattatagcggatcatcaggcaatcctccaagtcgagcagaaaatgatgacacagaccttccaagaacagaaccttctgctcgatgccgcacatgcttccatcaccaatgagttgcagacggtacagaatgagaagacgcaactgcaggctcatctggaccatttaatcctagaacacaatcagtgtatccagaaagctcaagacgcggagaagcggaccgctgtgcaaaaggagctactggaaagcaccattgcccgactgcggggtgagctggaggcatccatgcaggagaaaaagtcgctactggaggaaaaggaaagattccagagagaggttaacaaaactgaaaaggagatcgtgcaggagcggtgcaacctggagaaagaactggccaagaacaaggtggatatcaacaccctgacacataacttgcagactctggaagaagaaaacaaacacttggcagatcagatggcaagcctggagcttcagcaggtgactagtgactatcatggactagcacagcaaaaggttgaaaaaataacagagtccaaaaataaactggcttatgagaatgggaaacttcagatcaaggtgaagcagctcgaagaacaggtgcagagctttaccgatacatcgttgcagaacgaccacttgcgcaaaatgaacaagtatctgcagaccaagtatgcacaagccaatagcgagctttcagccaagcgggtgcatctccagcaggccgacgcccacttaaaggaagtgaagtcgatactggaacgatcaaaagaggagctgagcagaacagtgaagtgtagaaacgccgcccttaaggagtcgcaaaaactcaaggaagacttggaggccgtggaggatcgggaaaataaaaaggtcggtaattttcaacgacagttagccgaagcaaaggaggacaattgtaaagtcactataatgctggaaaatgtgctcgcctctcactctaagatgcagggcgcacttgaaaaggtgcagatcgaacttggaagacgggacagcgagatcgccggtctaaaaaaagaacgggacctgaaccagcagcgggtgcagaagctcgaagctgaggtggaccagtggcaggctcggatgctcgtgatggaggaccagcataattccgaaatagagagcctgcagaaggcactgggtgtggctcgtgaggacaatcgcaagctcgctatgagcctcgagcaggcactgcaaactaataatcacctgcagaccaaactcgatcacatccaggagcagcttgagtcaaaagaattagaaaggcagaacttagagacatttaaggaccgaatgaccgaagaatcaaaagtcgaagcggagctgcacgccgaacggattgaggccctccggaaacagttccagactgaaagagaaaccaccaaaaaagtggctcagagagaagtggccgaactgaagaaagccctcgatgaggcaaattttcgaagcgttgaggtgtcacggaccaatcgcgaactgaggcagaagctggctgagcttgaaaagatattagagagcaataaggagaaaatcaagaatcagaaaacgcagattaagctccacctgagcgcaaaggctaacaacgcacagaacattgagcgaatgaaacagatagaaaaagagcttaagcagatggagctgatcaaagaccagtatcagaaaaaaaactatgagcagagcttaagtatccagagattcgtttgcgaaatgaccaaccttcaaaaagaaatgcagatgcttgctaagagccaatatgacgcctccgttagaaacaagcagcaggagttgcaccttgaggccgagcggaaaatcaggcaggagcttgagaataggtgtcaggaactggaagaaacagtgcgacacttgaagaagtgtaaggaagcgactgaaaatactctcaaggaggcaagcgtggaaagtgaacagatcacagccaatctggaggaagcacaccgctggtttaaacataggtttgacggacttcagctggagcttaccaagaacaggctgcagaggccatcaggcgaagaccgctggcaggaaaaggatcaggatgtgaaacatgatgtgatgtctaatcagagcgtgctgcacaggtgggaacggaaacagaacctaaggcccatgccgaagaaataccatagtgaggtacagaggaagtag

SEQ ID NO: 28764 - DNA, 1767 bp, Artificial Sequence
  Description of Artificial Sequence: Synthetic coding sequence
atgcccctgcggaaacgaaagagtcccgagcgcaccgcaagctctaaaagccccgagattagtcggtctcatgttaattctattaaagaaagaacgagctcagtcggcctaccaagcgtaatccccaattcgaccaggcgcgtgagctttgccccaaatctacccagcatgaagaccagccaggatatcggtgatagccgcatttctctcaaaacgctcctcaatgccatcaaaaccatggaaggtaggttggaaggtaaaattgagatattagcaagtcggccattgattaacgacgagtccccaaacttcctcaagcaagattctgtgaagagcatcctggagcgttccaaggaggaactgtctcgaactgtcaagtgccgcaatgcagctcttaaggaatctcaaaaactcaaggaagacctcgaagccgtggaggacagagaaaacaagaaagtaggcaattttcagagacagctcgctgaagcgaaggaagataactgtaaagtgacaattatgctggagaacgtgctggcttcccacagcaaaatgcagggcgccctggagaaagtccagattgaattggggcggcgcgactccgagatcgctggactgaaaaaggagagggacctgaatcagcagcgagtgcaaaagctcgaggctgaagtggaccagtggcaggctagaatgctggtcatggaggaccagcataactctgagatcgagtcacttcaaaaggctcttggcgtggccagagaagacaatagaaaactagcaatgtctctggagcaggccctgcagacaaataatcacctccagaccaagctggatcatattcaggagcagctggaaagcaaagaactggaacgtcagaatcttgaaacatttaaagatagaatgaccgaggagagcaaggtggaagctgagttgcacgctgagcgcatcgaggcgctgagaaaacagttccagactgaaagggaaaccacgaaaaaagtggcacagcgtgaggtagctgaactaaaaaaggcactggatgaggctaactttcggtcagtagaggtatccaggacaaacagggagttacggcaaaagctcgcagaactggagaaaattttggaaagcaataaggaaaagatcaaaaaccaaaagacccagatcaaattgcatctttccgccaaggcaaacaacgctcagaatatcgaacggatgaagcagattgaaaaggagctgaagcaaatggagttaataaaggaccaataccagaagaaaaattacgaacaatcacttagcattcagaggttcgtgtgcgagatgacaaaccttcagaaagagatgcagatgttagcgaagagccagtacgacgccagtgtcagaaataagcaacaagaactgcacttagaggcagagcgtaagatcaggcaagagctcgaaaatcgctgccaggaactggaggaaaccgtgcgtcaccttaagaaatgtaaggaggcaactgaaaatactctgaaagaagcaagtgtggagagcgaacaaatcaccgccaatctagaagaagcgcaccgatggtttaagcatcggttcgatggactccaattagagctgaccaagaatcggcttcaaagaccaagcggcgaggatagatggcaggaaaaggaccaagacgttaaacacgacgttatgtctaaccagagcgtgcttcaccggtgggagcgcaagcagaacctcagacctatgcctaagaagtaccatagtgaagtacagcggaaatag

SEQ ID NO: 28765 - DNA, 456 bp, Artificial Sequence
  Description of Artificial Sequence: Synthetic coding sequence
atgtctttgcacgaggcatccgaaaaggcacaggtgctaaacgatcagctcacaaagaagtgttccgaacttagctgcatgctccagacagtgacaatggagaaagcgcgcatcatcgccgaccaccaagctattttacaagttgagcagaagatgatgacacaaacattccaggagcagaatctcctactggatgcggcccacgcgagcatcacgaacgaactgcagaccgtacagaacgaaaagactcagttacaggcgcatctggaccacctcatcttagagcataatcaatgtatacagaaggctcaggatgctgagaagaggaccgcagtgcagaaggagctactggagtccacaatcgcaaggctgagaggcgagctggaagcctctatgcaggagaaaaaatcactgctagaggagaaagagcggtttcaacgtgaaggctacctgtag

SEQ ID NO: 28766 - DNA, 387 bp, Artificial Sequence
  Description of Artificial Sequence: Synthetic coding sequence
atgtgccgcctcgagagcctgatgcagtccctcaaaatgaatatcttccgcctccagaccgaaaaagatcttaacccccaaaaaaccgcgtttttgaaagatcggctgaatgcaatacaggaggaacattcaaaagatttgaaactcttgcacctcgaagtcatgaatttgaggcaacagttgcgtgccgtcaaggaagaggaggacaaagctcaggacgaggtccaacgactcacagcaacattgaagatcgcatctcagaccaagaaaaacgccgcaattattgaggaagaactgaagacaacaaaaagaaagatgaacctgaagattcaggagctcctggagatgacctcgtttcccagctggctcaagaaaattcgcttttag

SEQ ID NO: 28767 - DNA, 891 bp, Artificial Sequence
  Description of Artificial Sequence: Synthetic coding sequence
atggactgtaaagtccatatggaaaccaccgtgtctagaccggtgctctctcctactcacattaacgcaactgcgtctgagacctttaccgtgctgcagcagcggatgcgaattgttgaggaacagacgagctcactgcgagacgaccttatcatgctagactttggggagaagagaggatatctagaggctcccgattgcctcgaagatttggactctcagaaagtgatcagtccaatacagaacgaggcaatttgcgcaggtaaaacagacattctctggaagaattgcgaattcctggtcaacaggatgtgccgcttggaaagcctgatgcagagcctgaagatgaacatttttcgcctgcaaacagagaaggatctgaacccacagaaaacagcttttttgaaagacaggttaaacgccattcaggaagaacacagcaaggacttgaaactgctgcatctggaggtgatgaatctgcgccaacagctaagggcagtgaaggaggaagaagataaggcacaagacgaggtgcagcgtttgactgccacactgaagattgctagtcaaacaaagaagaatgccgcgataatcgaggaagagctcaaaactacaaagcgcaaaatgaatctgaagatccaagagctgagacggcagctcgcccaggaaaaatatcttcgtgagagcctcgagaagtctgcttccgccatgctattaaagatacaagagatggggagcacagttgaggtagaaaggaaacaggttcatatcctgcagcagaattgcatagcactgcgagacagtatacaaagcgcgcaggaactgctggcacaggagcagaaaaagaagaaaagctggaggttgctgctgcactcttccaatcttatatag

SEQ ID NO: 28768 - DNA, 1788 bp, Artificial Sequence
  Description of Artificial Sequence: Synthetic coding sequence
atgacttcacccttgtgccgggctgccagcgccaacgcccttcctccacaggaccaggccagtacgccatcgtctcgagtgaaggggcgcgaagcatccgggaagcctagccatctcagaggcaaagggactgctcaggcttggacccccggccggtccaagggaggttctttccacaggggtgctggaaagccctctgtccatagccaagttgcagaactgcataaaaaaattcagcttttagagggtgatagaaaggctttcttcgagtcatcccagtggaatattaagaaaaaccaggaaaccatctcacaattaagaaaggagacaaaggctttagagctcaaattgctcgacctgctgaaaggggacgagaaagtggtccaggccgtgattagagaatggaagtgggagaagccatacctgaaaaaccggaccggacaagcactggagcatctggaccacaggctgcgggaaaaggtgaagcagcagaatgcgcttcgccatcaggtggtcttgcggcagagaagactggaagaattgcagctccagcactccctgcgcctgctggagatggctgaggcacagaaccgtcacacagaagtggcaaaaaccatgcggaatcttgaaaataggttagaaaaggcccaaatgaaagcccaggaggctgagcacataacgtccgtttacctccagcttaaagcctatctgatggacgaatccttgaaccttgagaataggctggattccatggaagccgaagttgtgcgaaccaaacatgagctcgaggcccttcatgtagtgaatcaggaggccctcaatgctcgagacattgccaaaaaccagcttcagtacctggaggaaacactcgtgcgcgagcgcaagaaaagggaaaggtatatcagtgaatgcaagaagagagcggaggaaaagaaactggagaatgagaggatggagagaaagacgcacagggaacaccttctgttgcagagtgatgatactatccaggattccttgcacgctaaagaggaagaactcaggcagcgctggagcatgtaccagatggaggtcatctttgggaaggtgaaggacgcaactgggacagacgagacccattcattggtgcggcgcttcttggcccagggggataccttcgcacaacttgaaacgctaaagtcagaaaatgagcagacattggtgaggctcaaacaggagaaacaacagctgcagagggagctggaagacctcaaatactccggtgaggctactctggtttcccagcagaagctccaggccgaggcccaggaacgcctaaaaaaagaggaacgaaggcatgcagaagccaaggaccagttagagcgggcactgagagccatgcaggtggccaaggactccctggagcacctggcatctaagctcattcacatcaccgttgaggatggccggttcgctggaaaggagctggaccctcaagctgacaactatgtccccaacctgctggggctcgtggaagagaaacttttaaaactccaagcacagctgcaaggacacgatgtccaagaaatgctgtgtcacattgcaaacagggagttcctagcttctctcgagggcagactcccagaatataacacccgtattgcactccctcttgccacttccaaggataaattctttgatgaggagtctgaggaggaggacaacgaggtggtcacgagggcgagcctgaagatccgatcacagaaacttatcgaatctcataaaaagcacaggaggtctcgcagatcttag

SEQ ID NO: 28769 - DNA, 1725 bp, Artificial Sequence
  Description of Artificial Sequence: Synthetic coding sequence
ctgcccccgcaagatcaggctagcacccctagctcgggcaagcccagtcacttaaggggcaaaggaactgcccaagcctggactccaggtcggtctaagggcggcagttttcaccgcggcgccggtaaaccctctgtgcattctcaagtcgcagagttacataagaagatacagctgctggagggcgaccgcaaggcatttttcgagagtagccaatggaacattaagaagaaccaggagacaatctcccaactgaggaaagagacaaaagccctggaactgaagctgctagacctgctcaaaggagacgagaaggttgtgcaggcggtcatcagagaatggaaatgggagaaaccctacctgaaaaacaggactggccaggcattggaacatttggatcacaggctgcgcgagaaagtgaaacagcaaaacgctctacgacaccaggtcgtgctgcgccaacgtcgtctggaggagcttcagctgcaacatagcctgaggctgcttgaaatggccgaggcccagaacaggcataccgaagtcgcaaaaaccatgcggaacttggagaacaggcttgagaaggcgcagatgaaagcccaggaggcggagcacattactagtgtatatctgcagctgaaagcctatcttatggatgagtcattaaacttggagaacaggctggattccatggaggcggaggtggtgagaacaaaacatgagcttgaggccctgcatgtggtgaaccaggaggccctaaatgctagagatatcgcaaagaaccagctacagtacttggaagaaaccctggtccgcgagaggaagaagcgagagagatatatatctgaatgcaagaagagagctgaggagaagaaactggaaaatgagcgcatggaaagaaagacccatcgggaacacctcctgctacagagcgatgataccattcaggatagccttcacgcaaaagaagaagagttaaggcagaggtggtcaatgtaccagatggaggtgatatttggtaaggttaaggatgccacaggtactgatgagactcactcattagttcggaggttcttggcccagggcgacaccttcgcgcagcttgagaccctgaaaagcgagaatgaacagacacttgtgaggctcaagcaggagaagcagcagctccagagggaactagaagatctgaaatactcgggggaggcaacgctggtcagtcagcaaaagcttcaggcagaagctcaggaacggttaaagaaggaggaaagacgacacgcagaagctaaagatcagctggaacgggccttgcgagccatgcaggttgcaaaggattcactagagcacctcgctagcaaactcattcacattaccgtggaggatggcagattcgcgggaaaggagctggatccgcaggctgacaactatgtgcctaatcttctcggcctggtagaagagaaacttctgaagttgcaagcccaactgcagggacatgatgttcaggagatgctctgccacattgctaatcgcgagttcctcgcttccctagaggggagactgcctgagtataacacccgaatcgctctccctctggctacctctaaggataagtttttcgatgaagaaagcgaggaggaagacaacgaagtcgttaccagggcttctttgaagatcaggtcccaaaagctgatcgaatctcataaaaaacataggcgttctagacgttcctag

SEQ ID NO: 28770 - DNA, 1626 bp, Artificial Sequence
  Description of Artificial Sequence: Synthetic coding sequence
atgcacccacccgtggcaccttgcaagaaactgcgctgcccgcctacgagaagctttaccccaaccagagggcggagtaaggaaggcgaccggaaggcatttttcgagagctcccagtggaatattaaaaagaatcaggaaaccatctcccagttgcgtaaagagaccaaagctcttgaattaaaactgctcgacttgcttaaaggcgatgaaaaggtggtacaggcagttatcagagagtggaagtgggaaaagccgtacttaaaaaacaggaccggtcaggctctcgaacatttggatcatcggctgagagagaaagttaaacagcagaatgccttacgccaccaggtcgtgctgcgtcagcgtaggctagaggaactccagttacagcactcgctgcggctactggaaatggctgaagcccagaaccggcataccgaggtggcaaagaccatgagaaatcttgaaaatcgactggagaaggcccaaatgaaggcccaagaggcggagcatattactagtgtttatctacagctgaaggcctacctcatggacgagtccctgaatttagaaaaccgactggactccatggaggccgaggtcgttcgcacaaaacatgaattggaagctctgcacgtagtaaaccaggaggctcttaacgctcgggacatagccaagaatcagctccagtacctcgaagagacactggttagggagcgcaagaaaagggagcgttatatatccgaatgcaagaagagagctgaggagaagaagttagaaaacgaacgcatggaaaggaagacacatcgtgagcatctacttttgcagagtgacgacaccattcaggactccctccacgcaaaggaggaggaattgcgccagcggtggtccatgtatcaaatggaagtgatctttgggaaagtgaaggatgcaactggcaccgatgaaacccactctctcgtccgcaggtttctcgcccagggggatacttttgctcagctagagacactgaagagtgagaacgaacaaacgttggtgcggcttaaacaggagaaacagcaactacagcgtgaattggaggatcttaagtactcaggagaggctactctcgtgtcccagcaaaaattgcaggctgaagcacaggagaggcttaagaaagaggagcggcggcacgcagaagccaaggatcagcttgagcgcgccttgagggccatgcaggtggcgaaagattccttggagcacctggctagtaaactgatccacatcaccgtggaggacgggcggttcgcaggcaaggagctggatccccaggcagacaactacgtgccaaatctgctgggcctggtggaagagaagttgctgaagctgcaggcccaactccagggacacgacgttcaggagatgctatgccacatagctaaccgggaatttttagccagcctagagggccgcttacctgagtacaatacccgcattgctctccccctcgccacttcgaaagacaagttcttcgatgaagaatccgaagaggaagacaacgaggtggttactagggctagcctgaaaatcagatcgcagaaactgattgagagtcacaaaaaacatcgcagatctcgtcgatcctag

SEQ ID NO: 28771 - DNA, 765 bp, Artificial Sequence
  Description of Artificial Sequence: Synthetic coding sequence
atggaccagagctcagagggttgcatgaaaaagatcagttccgttaatttggataagctgattaatgacttttctcagatcgaaaagaagatggtagaaaccaacggcaaaaataacatcctggacatccagctcgaaaagtccaattgtctcctgaaagtaatgcaggccaaggaggtctccattaaggaggaatgcgctaccctccataatatcatcaaggggctgcaacagaccatagagtaccagcaaaatctaaagggcgagaacgaacaactgaagattagcgccgacctgataaaggaaaaactcaaaagtcatgaacaagagtataagaataacattgccaaacttgtttccgaaatgaaaatcaaagaagagggatataaaaaggagatctccaaactataccaggatatgcaacggaaggtagagttaaacgaggagaaacacaaggagctgattgagaagaaagagatggaaatttctgagctgaatgctaaactgcgctcccaagagaaggaaaagcagaacgaaatcattaagcttcagcttgaatttgatgcaaagcttgcaagagtccagacaaagtcaaagtcatatcaggatagtacagtccttccacagtcaatttatcgcagaaaacttcagcacttccaggaggagaaaaacaaggaaatagcaatactgagaaacaccatccgcgacctggaacagaggctgagtgtgggtaaagattctcatctaaaaagacgccggttctag

SEQ ID NO: 28772 - DNA, 633 bp, Artificial Sequence
  Description of Artificial Sequence: Synthetic coding sequence
atgccccctaaaaataaagagaaaggtaagaagagtggtgcccagaagaagaaaaaaaactggggtgcggacgtcgtggctgagtccaggcatcgcctggtggtcttagaaaaggagctcctgcgcgaccatcttgccttgcggcgcgacgaggcgcgtagggccaaagcaagcgaggatcaactgaggcagaggcttcagggagtggaagctgagttggaaggcgctcgttctgaaggcaaggccatttatgccgaaatgtctcgtcaatgccacgcactccaggaagatatgcagacccggtccaaacaactggaggaggaagttaagggcctgagaggtcagctggaagcatgtcagcgggaggctgctgctgccagagaggaggcggagcaggccttgggtgagcgggaccaggcactggcacagctgcgggcccatatggctgacatggaggctaagtatgaagagattctccatgacagtctggacaggctgttggccaagctgcgggccatcaaacaacagtgggacggagctgccttgaggctccacgccagacataaagagcagcagagacagtttggattgactccacctggcagccttaggcctcccgctccttccctctag

SEQ ID NO: 28773 - DNA, 633 bp, Artificial Sequence
  Description of Artificial Sequence: Synthetic coding sequence
atgccacctaaaaataaagagaagggcaagaagagcggagcccagaagaagaaaaaaaattggggagcagacgttgtggctgaatcaagacaccggctcgtggttctcgagaaagaacttctgagagatcatctcgccctccggcgggacgaagccagaagggcgaaggcttcagaggaccagctgaggcagcggctgcagggagtggaagcggagctggagggtgcccgaagtgaggggaaggcgatctacgctgagatgtcgcgccagtgtcatgccctgcaggaagacatgcagactagatcgaagcagctcgaggaagaggtgaagggcctgcgcggtcaactggaagcctgccagagggaggcagctgccgcaagagaggaagccgagcaggctctgggtgagagggaccaggctctcgcccagcttcgggcccacatggctgacatggaagccaaatacgaggaaattctgcatgattcactcgacagattgctggccaagctcagagcgattaaacagcagtgggatggggcagctctccgactccacgcacgtcacaaagagcagcagcggcaattcggtctcaccccccccggaagcctacggccccctgccccatctctctag

SEQ ID NO: 28774 - DNA, 2025 bp, Artificial Sequence
  Description of Artificial Sequence: Synthetic coding sequence
atgtctgaactagccgactccggcccctccggcgcaagcgctccgtcacagttacgcgcggtaaccttggaagatctgggcctgttactagctggcgggctggcatccccagagcccttgtctttggaagagctctctgagcgctatgaatccagtcaccccacatccacagctagcgtacctgagcaggataccgctaaacactggaatcagctcgaacaatgggttgtcgagctgcaagcagaggtggcttgtctccgggaacacaaacaaagatgcgaacgggccactcggagtctgcttagggaacttctgcaggtccgggcccgcgtccagctgcaaggctcagaattgcggcaactacagcaggaagctcgtcccgcagcacaggcccccgagaaggaggcccctgagttctcagggctgcagaaccagatgcaagcactagacaagcgtctggtagaggtccgcgaagccctgacacggctcaggagaaggcaggtacagcaggaggccgagcgcaggggtgctgaacaggaggccggtctcagacttgctaagttgactgacctgctacagcaggaggagcagggcagagaagtcgcatgcggggcactccagaaaaaccaggaggattcgagccgccgggtggatctagaggtcgcccggatgcaggcccaagtcacgaaactgggcgaagaggtgtcacttcgcttcctgaaacgagaagccaagctatgcggattcctgcagaaatcctttctggccctcgagaagagaatgaaggcctctgaaagttcacgcctaaaactcgaaggctccctacggggagagctcgaaagtcgttgggaaaaactccgggggcttatggaggaaaggctgcgggcactgcaagggcagcatgaagtgggcccggggggcaggcgagcagaggagtcccatttgttggagcagtgtcaaggtctcgacgctgcggttgcacagctgactaagttcgttcagcagaatcaagcatcactgaaccgggttctcctcgcagaagagaaggcctgggatgcaaaagggagactggaagagagcagagcgggggaactagcagcatatgttcaggaaaacctggaagctgcacagcttgcaggggagctcgctcggcaggagatgcatggcgagctcgtcttgctgcgggagaagtcgagggcgcttgaggccagcgtagctcagttggccggtcagctgaaagaactaagcggccatctccctgcgcttagcagcagactggatctgcaagaacaaatgctgggcctgcggctgagcgaagccaaaactgaatgggagggcgctgagcggaagtccctggaagatctggcacgttggagaaaggaggtgacagagcacctccggggtgtccgggagaaagtggacggactcccgcagcagattgagagcgtgagtgataaatgtctcttacacaagagtgacagcgacttacggattagcgccgaaggaaaggctcgcgaatttaaggttggggctctccgccaggagcttgccacgttgctctcatctgtacagctcctgaaggaggataaccccgggagaaagattgcggagatgcagggtaaactcgctaccaatcaaatcatgaagctggaaaactgcgtccaggctaataagaccatccagaatttgcgctttaacactgaggctaggctgcggacccaggaaatggcaacactgtgggaaagtgttctaaggctgtggtcggaagaagggccaagaaccccccttggctcgtggaaggcccttccttccctggttaggcctagagtgtttataaaagatatggcccctggtaaggtcgtgcctatgaattgttggggcgtttaccaggctgtgcgctggctgagatggaaggcctcactgatcaaactccgcgctttacgccgcccaggaggagtgctagaaaaaccccatagtcaagagcaggtacagcagttgacaccatccctgtttatacaaaaatag

SEQ ID NO: 28775 - DNA, 1569 bp, Artificial Sequence
  Description of Artificial Sequence: Synthetic coding sequence
atgcaggcgttggacaagcggctagtcgaggtgcgtgaggccttaacccggctcaggagacggcaggtgcagcaggaagcagagcggcggggagctgaacaggaggccgggctgcgcctcgctaaattaaccgatctgctgcagcaggaggaacagggccgggaagttgcgtgcggagcactgcaaaagaatcaagaggactcttccaggcgtgtggacttggaagtggcccgaatgcaagcgcaggttacaaagttgggagaggaggtttcacttcgttttttgaagcgagaggccaaactctgcggctttcttcagaaaagcttcctcgcccttgagaaaagaatgaaggctagcgaaagctctagacttaagcttgagggctccctgaggggagagctggagtccagatgggagaagctgcgcggtctgatggaggagagactccgggctcttcagggtcaacatgaagagtcccacctcttggaacagtgtcaggggctcgacgccgccgttgctcaattaactaaattcgttcagcagaaccaggcatcgctcaacagagttctgctcgcagaggagaaggcctgggacgcaaaaggaaggctggaggaatccagagcaggcgagcttgcagcctacgtacaggaaaacctcgaagctgcccaactggccggcgagctcgctagacaagagatgcatggagagcttgtcttactacgcgaaaaaagtcgagctcttgaagctagcgtggctcagctggcgggacagctcaaagaactctctgggcacctgcccgccctgtctagcaggcttgacctgcaagagcaaatgctagggctcaggctctccgaagcgaaaactgagtgggagggggcagagcgaaaatccctggaggacctggcacgctggcgcaaggaagtgactgagcacctaagaggcgtgcgggaaaaggtggacgggctgccccaacagatcgaaagcgttagcgataagtgcctcctgcacaagtctgattcagacctcagaatctctgcagagggtaaggcacgcgagttcaaggtgggtgctttgcgacaggagctggcgactctcttgagctcggtgcagttgctcaaagaggacaatccgggcaggaaaattgccgagatgcaggggaaattggccactttccagaaccagatcatgaagcttgaaaattgcgtgcaggcgaataaaaccatccagaaccttcggtttaacactgaggccagactgcgaacgcaggagatggccactctgtgggagtcggtgctgagactgtggagcgaagagggcccacgtacccccctgggaagctggaaagccttgcccagtttggtcaggccccgcgtgtttatcaaggacatggcaccgggaaaggtggtccccatgaactgctggggagtttatcaggcagtgcgctggctaagatggaaggctagcttaattaagctccgtgccttacggaggccagggggtgttctggagaagcctcacagccaggaacaggtacagcaattgacaccctcccttttcatccaaaagtag

SEQ ID NO: 28776 - DNA, 2259 bp, Artificial Sequence
  Description of Artificial Sequence: Synthetic coding sequence
atggcccacttgctgggctctcaggcctgcatggagtcgctgcgcactgatttgaccgacttacagggcgccatcgtcgatgtgttcagtagggcaggtcccgtgcggtttccaagctggaaattccctgaccggatggcttgcgatcttgacatggtggcacttttggagcattatgatcatgtgcccggtgatcctgagtttacccaactcagtcacgccgtattgctcgaactggtgattgaccgtctgctgctgctcctgcagtcttgtatgagttacctcgaaaacctgggaagcgagcagatgatgcctcccgcacaggccgccggaccttgtatgagcgtaggcctgactgtgagacgcttctgggactcattgttgcggttggggaccttacaccaacaacccctgccccagaaaggggccaaccagagggagactcccacctctaagccaaccactaagggcgagcctgcccgctccccggagtatttgactaccaagctgattaaacccagttcccccgtcctcggactgccgcagacctgccaagaaccagagtcgatcccagtgagggcttcacttcagtttcccgctacaaccttcaaaaacacaaggagcgtccacagccaaacaatcgaaacagccctagttccctgcgacgcttgcgcctcagtacaggggagccttcaaaaggtaggcaaggtagtgatctctctatgccagagccaaaacttgcccagctctctcggacagtttcagcagttagttcaagatagtatggggctgagacctcttcccgccgccaccgtcggtcggtgggctgcagagcaacgtaaagacctgaccaggctttcaaagcatgtagaggccttgcgcgctcagcttgaggaagcagagggacagaaggacggactcaggaaacaggccggcaaacttgaacaggccctgaagcaggaacagggtgctagacgtaggcaggccgaggaagatgagcagtgcctttccgagtgggaacatgataaacagcagctgctgaccgagacttccgaccttaaaactaaaatggctaccctggagcgagagttaaaacagcagcgggaaagtactcaagcagttgaggctaaagctcagcagcttcaggaggagggcgagaggcgcgctgctgctgaacggcaggttcagcagttggaagagcaggtccagcagctagaagcccaggtgcagttattggtcggtcggctggagggggcagggcaacaggtgtgctgggctagcaccgagctggacaaggagaaagctcgggttgattccatggtgaggcaccaggagtccctgcaggcaaagcagagagccctactcaaacagttagactccctggaccaggagcgggaggagctccgggggagcctcgatgaagctgaagcccaaagagctagggtcgaggaacagttacagtcagagcgtgaacaaggacagtgccagctgcgcgctcagcaggagctcctgcagtctctgcagcgagaaaagcaaggcctggagcaggcaaccaccgaccttaggcttacgattcttgagctcgaacgggagctagaggaattgaaagagagagaacgcctgttggtggctttccctgatctgcaccgacccaccgagacacagatacatggcggcagaagtagcagtgtggagagccagattacctgccccacagactcaggaaatgtgacagaccatatggagaggcaagtccaaagcaatgacatcaggattcgggtgctgcaggaagagaatggtcgactgcagagtatgctctccaaaattcgtgaagtggcccagcagggcggcctcaagttgattcctcaagatcgattgtggtcaccctcctccaagggcactcagggagcgaccccacctgttcaggcaaagagtacatccccgggcccgctcggacggcagcacctcccatccagccggacaggcagaactttgttaggtcaaccctgcacgagtcctccccgccaaccgtgcacaagccccccccggcaaccctgcactagcccacccagacagccttgcacttctccttccaggcaaccatgctctcaacccagcaagtcattactggaaggagtgacacatctggacacctgcacccagaacccaatcaaggtacttgtgcgactgcgaaaacgtttatctccagggcgaggccaagcctcctccgctcatcaacctcaggagaggcccatgtag

SEQ ID NO: 28777 - DNA, 2259 bp, Artificial Sequence
  Description of Artificial Sequence: Synthetic coding sequence
atggcccatctcctcggaagtcaagcatgcatggagtcattgcgcacggacctcacagatctccagggggcgattgtagacgttttctctagggctggccccgtgcggtttccatcgtggaagtttcctgataggatggcttgtgatctcgatatggtcgccctgctggagcattacgatcatgttcctggcgacccagaatttacccaactcagccacgccgttctcttagaactcgtgatcgatcggttgcttttgttgttgcagtcctgtatgtcctaccttgagaatctgggaagcgagcagatgatgcctcctgcccaggctgccggaccatgcatgtccgtgggacttacagtacggcgcttctgggattctctcctacgccttggcacgctgcaccagcagcctctgccccagaagggagcaaatcaaagggaaactcctactagcaaaccaacaactaagggggagcctgcaagatcacccgagtacctgacaactaagctcatcaagccttcatctcccgtcctcgggctgccccagacctgccaggaaccagaatccattccagtgcgagcgtctttgcaattccctgccactacattcaagaacactcgaagcgtgcactctcagacaattgaaacagccctggtgccttgtgatgcttgtgcaagcgtacaagggtcactgcagaaagtgggaaaggtggtcatctccctgtgccagtcacagaatttgcctagcagtttgggacagttccagcagctcgtgcaggattctatgggactgcgcccactccctgctgctaccgtgggcaggtgggccgctgagcaaaggaaagatctcactagactgagcaagcatgtggaggcactgagggcacagcttgaggaggcagagggacagaaggatggtttgcgaaaacaggccgggaaactggagcaggccctcaaacaggagcaaggagcaagacgaaggcaggccgaggaggatgaacaatgcctgagcgagtgggagcacgacaagcaacaactactcaccgaaacctcggatctgaagactaagatggcaacattggagagggagcttaaacaacaacgcgagagcactcaggccgttgaggccaaggcgcagcagctgcaagaggagggggagcgcagagcagctgccgaaagacaggttcagcaactagaagagcaagtgcagcaactggaggcacaggttcagttgctcgtgggaagactcgagggagctggacaacaggtctgctgggcctcaacagagctggacaaggaaaaagcgagggtggactccatggtcaggcatcaggagtcacttcaggctaaacaaagggccctgcttaagcaactggactctctggaccaagagcgggaggaactacgcggaagcctggacgaggcagaagcacagcgagcccgggtcgaagaacaattgcagagcgaacgcgagcaggggcagtgtcagcttagggcccaacaagagttgctccagtcccttcagcgggagaaacagggccttgagcaagccactacggacctgaggctaacaattctggaactggaaagagaactggaagaactgaaagagcgagaacgcctactagtggcctttccagacctgcaccgccccaccgaaacccagattcatggaggacggagctcctctgtcgaatcacaaataacatgccctaccgacagcgggaacgtgacggatcacatggaaaggcaggtgcagtccaacgacatcaggattcgcgtacttcaggaggaaaatgggcgactgcagagcatgctgtccaagatccgggaagtggcacagcaaggaggtcttaagctcataccccaggaccggttatggtccccaagttcgaagggtacccagggcgctacgccgcctgtgcaagcaaaatctacttcccctggtcctttggggaggcagcatctgcccagctctaggaccggcaggaccctgctcggacagccatgcacttcaccccctagacagccttgtacatctccaccgcgccagccctgtacctcccctccaaggcagccatgcaccagtccttctcgccagccatgctcacagcccagcaagagtctgctggaaggtgtgacccacttggacacatgcacccagaatcccatcaaggtgctagtacgtttgaggaagcgcttatctccagggcggggtcaggcgtcctccgcccatcagccccaggagaggcctatgtag

SEQ ID NO: 28778 - DNA, 1602 bp, Artificial Sequence
  Description of Artificial Sequence: Synthetic coding sequence
atggagagcaaggcctgggagtctaacaatgaagacctcttatcatctagcggagtgactagtaacggcgggtccagctcttctttcttcgtcagttctattcgaggcacaattatcgaaaatacctcctccgcaggcaccctgacacaggtgcctttcttcccaaaatatgaggtggaattggattctcccagaaagattattccaagccccggcaaagagcatttcgagcgtgtgttggaagagtacagtcatcaggtaaaagacctgcagaggagattgaacgagagcaacgaactgcacgagaagcagaaattttacctacggcaaagtgtcatcgatctgcagacaaagctacaagagatgcaaatggagcgtgacgcgatggcagatatcaggcgacgtgaatcccagtcacaggaggacctgaggaaccaactgcagaacaccgtgcatgagcttgaggctgccaagtgtttgaaagaggatatgctgaaggatagcaacacccaaattgagcaactgcggaaaatgatgctctctcatgaaggggtattgcaagagattcgatctatcctggttgatttcgaagaagcttcgggtaaaaaaatctgtgagcacgactctatgtctacccttcattttcgatctttagggtccgcgattagtaagatcttgcgtgagctggacacagagattagctatctgaagggtcgtatcttcccagtagaggatcagctcgaagcactgaagtccgaaagtcaaaacaagatcgagctactgcttcagcagcaccaggatagaattgagcaactcattagtgaacacgaagtcgagatcacaggtctgacagagaaggccagcagcgcaagaagtcaagctaactctattcaatcacagatggaaatcatccaggagcaggcccgcaaccagaactccatgtacatgagacagctgagtgacctcgagtccactgtctctcagttgagatccgaactcagggaggcaaagagaatgtacgaggataagactgaggagctggagaaacagttagtgctcgccaattctgaacttacggaagctcgcactgagagggaccagtctagtctcagatccgatatgtgccaccggtccaacaactctttaagagattccaccgagggatcgaaaagctctgagacgctgagcagggagcccgtcacactgcacgccggagatcgagaagacccaagcggctgttttacgttcacatctgctgcctcaccctcagtcaagaattctgctagtcggagcttcaactcatctcctaaaaagagccctgtgcactcattgcttacctccagcgtggaaggttcaattggatccactagccagtatcggtccgctaaaccaattcacagttcagactcggtgaaggatagccagagccctcctatagaaactacaggcaaaacttgccgaaagctccagaatcgtctcgaatccctccaaactctcgtcgaggaccttcaactcaagaaccaagccatgtctagcatgattcgcaatcaggaaaagcgtatccagaaggttaaggatcaggagaagatgctgttgaagtag

SEQ ID NO: 28779 - DNA, 3342 bp, Artificial Sequence
  Description of Artificial Sequence: Synthetic coding sequence
atggagagtaaggcttgggaatccaacaacgaggatctcctttctagctccggtgtcaccagtaacggcggtagtagttcctctttctttgtttcttccataagaggcaccataattgaaaacacttcatccgcaggcacactcactcaggtgccctttttccctaagtatgaggtggaactggatagcccccgcaaaatcataccatctcccggtaaagaacacttcgagagagtgttggaagaatacagccaccaagtcaaggacctgcagcgccgactgaacgaaagcaacgaactccacgagaagcagaagttttatctgaggcagagtgtgattgatctgcagaccaagctccaggagatgcagatggaaagagatgccatggccgacatccgaagacgagagtcccagagccaagaggacctgcgcaatcagttgcagaacacagtccatgaacttgaggccgcaaagtgcctgaaagaggatatgctgaaagacagcaacacccaaatagagcaactacggaagatgatgctaagccatgaaggcgtgctccaagagattcggtccatcttagtggactttgaggaggcgagtggcaaaaagatttgcgagcacgacagcatgagcactctccactttcgcagcctggggtccgccataagcaagattttacgcgaactagatactgagatatcatacctgaagggaaggatcttcccagtggaggaccaattggaggcactgaagtcggaatcacagaacaagatagagctgttgctgcaacaacaccaggaccggatcgaacagctcatctcagagcatgaagtggagattacaggtctgactgagaaagcatcttcggctcgttctcaagctaactcgatccagtctcagatggaaatcatccaggaacaagctagaaatcagaattccatgtatatgcgccagctgagcgacctcgagagtacggtgtcccagctccgcagcgagctgagggaagctaagcgcatgtacgaagataagaccgaggagcttgaaaaacagctggtgcttgccaacagcgagctgaccgaagcccgcactgaacgggatcagttttcacaggaatccgggaatctggacgaccaactccagaagctcctggcggatctgcataagcgagagaaagagctaagtcttgaaaaggagcagaataaacgtctgtgggaccgagacacgggaaactctattaccatagaccatctcaggcgagaactagacaacaggaacatggaggtgcagcgtctggaggcgctgctgaaggcactgaagtctgagtgccagggccagatggagcgacagatggctgccatccagggaaagaacgaaagccttgagaaagtgagcagcctgaccgctcagctcgagagcactaaggagatgctgcggaaggtggtcgaagagctgaccgccaagaagatgaccctggagtccagcgaacgaacgatatcagacctcactaccagcctacaggaaaaggaaagggccattgaggcgactaatgccgaaatcacgaaactgcgttcccgcgttgatttaaagctgcaagagctgcaacatctgaagaacgaaggagatcatctccgtaatgttcagactgaatgtgaagcccttaaactccagatgactgagaaagacaaagttatcgagatattacgtcagcagatcgagaacatgactcagttggtcgggcagcatggtagaaccgcgggagctatgcaggtcgagaaggcccagctggagaaagagatcaatgacagacggatggaattgaaggaactcaaaatcctaaaggataaaaaagatgccaagataagggaactcgaggcccgcgtgagtgatttggaactcgagaaggtgaagctggtgaacgccggaagtgaaaggttgcgtgcagtgaaggacattaagcaggaacgtgaccagctcttaaacgaggtgaaaacttccagaagtgagctcaataaccttagtgaggaatatgaggtcttaaagagaaatttccgtaacaagagtgaagagatggagatgaccacaaataaactcaagatgcagttaaaatctgcacagagcgaattggaacaaactagaaacaccctgaaaagcatggagggaagcgacggacacgcaatgaaagtggcaatgggcatgcagaaacagataacagctaaaaggggccagatagatgccctgcagagtaagatccagtttctggaggaggctatgacaaacgccaataaggaaaagcattttctgaaggaggaaaagagcaagctgtctcaggagctcagcacagttgcgaccgaaaagaataagatggctggagagctcgaggtgctcagatcccaagagcgcagactcaaggagaaagtgacgaatatggaagtcgctttagacaaagcgagtctccagtttgcagaatgtcaggacatcattcagcggcaggagcaagagagcgtgaggttgaagcttcaacatacactggatattaaagagttacaaggcccaggctacacctcaaacagctcactcaaacctaggttgctccagcccgcctccgtgaccagaagccacagcaatgtgccaagctcccagagcaccgccagtttcttgtcacaccatagtaccaaagctaatactctgaaagaagaccccacccgtgaccttaaacaacttctccaggagctccggtccgtcatcaatgaggaacctgctgtgagtttatctaaaactgaggaggacggaagaacgagtcttggagcgctggaggatagggtgcgagattgcatcacggaaagttcactgcgttccgacatgtgccataggtccaataactcgctgcgtgatagcaccgagggaagtaaaagttctgagactctatctagagagcctgtcaccctccatgctggagacagggaggatccttctggatgctttacattcacatccgccgccagtccctctgtgaagaactctgccagtcgatccttcaactcctccccgaagaagagccccgtgcatagcttgcttacatcatccgtagagggctccatcggcagcacgtcccaatacagatcagcgaagcctattcatagtagtgactccgttaaggacagtcaaagcccccccattgagactacagggaaaacatgccggaaactccagaatcgtctggagtcccttcaaacgctggtcgaggacctgcagctgaaaaaccaggccatgtcttctatgatccgcaaccaggagaagcgaatccaaaaggtgaaggaccaggagaagatgttgttgaagtag

SEQ ID NO: 28780 - DNA, 1239 bp, Artificial Sequence
  Description of Artificial Sequence: Synthetic coding sequence
atgcttctcccggcatctgatccactgctggccggtttgccccgcgatcctgattattcagtctcgtgtctctactcgccaccctcgcctagtagcatgtgtcttccagctaatatgaagtgtgacaaatactgggggagtagctcggacaaggcgctggaacggaccgcacactggtcacggacgcctgaacccgaaaccctgggttgtccagcctccggagataccgtgcggaccgcagactgtaggcccggctggggctctggaccgagccctcacgaagcagccccatccccctcaccagacttacagaagcagtgctgcaatgaccaggatatcctgaaacgacaccataacgttgccaaaaagcctctcgagacaagttcatctaaagtcaaggctaagactattgtgatgattcccgacagtcaaaagttacttcggtgcgagctggaaagcttgaaaagtcagcttcaggcacagactaaagcattcgagtttctgaaccattctgtgaccatgttggagaaagagtcttgtttacagcagataaagatacagcagttggaggaggtgctgtccccaaccggaagacagggagaaaaggaggagcataagtggggaatggaacaggggaggcaagaactctacggagcccttacacaaggccttcaaggcctcgaaaagaccttgcgcgatagcgaagaaatgcagagagcaaggactaccaggtgcctgcagctactggcgcaagaaatccgggacagcaagaaatttttgtgggaagaactcgaattagtacgcgaagaagtgacattcatttaccaaaagttgcaagcccaggaagatgaaattagtgagaacctcgtcaatatacagaaaatgcaaaagactcaggtcaagtgccgtaaaatactaacaaaaatgaaacagcaggggcacgagacagccgcctgccccgagactgaagagattccccagggggctagcggttgctggaaagacgaccttcagaaggaactgagtgatatctggtcagcagttcacgtgctgcagaattccatagactccctgaccctgtgtagcggggcgtgccccaaagccagttcattgagggggcacaagggtcatcagtgtctgtctccccctctcccgagctgggactccgactctgattgtgaccaggacctctctcagccgccatttagcaaatccggccgatccttccccccaggctag

SEQ ID NO: 28781 - DNA, 894 bp, Artificial Sequence
  Description of Artificial Sequence: Synthetic coding sequence
atgggcgaacacgagcaggtcaagccactggagacttcgtcatccaaagtgaaggccaagacgattgtcatgatacccgattctcagaagttgttgaggtgtgaactagagtccctgaaatcacagctgcaagcccaaacgaaagcttttgagttcctcaatcattccgtaactatgttggagaaggagtcctgccttcagcaaatcaagatccagcaactcgaagaagtgttgtctcccacaggtaggcagggggagaaggaagaacataagtggggtatggaacaagggcgtcaggaactgtacggagctctgactcaaggacttcagggcttagagaagactctcagggacagtgaagaaatgcaaagagcacgaaccactaggtgtcttcagcttttggcccaggaaatccgcgactctaaaaaattcctgtgggaagagctggaacttgtccgcgaggaggtgaccttcatataccagaagcttcaggcccaggaggacgagatcagcgagaacctggtgaacattcagaagatgcagaagacccaagtaaaatgccggaagatcttaacgaaaatgaagcagcagggtcacgaaactgccgcgtgcccagagacagaagagatcccacaaggtgcgagtgggtgttggaaagacgatttgcaaaaggaattatcagacatatggagtgcagtgcacgtgctgcagaattcaatcgattccctgactctgtgctccggggcatgtcctaaggccagctcgctcagaggtcacaaaggccatcaatgcctcagcccgccacttccctcgtgggattccgattccgattgcgatcaagacttaagccaacctcctttcagcaagtccggacgaagctttcctcctgcgtag

SEQ ID NO: 28782 - DNA, 894 bp, Artificial Sequence
  Description of Artificial Sequence: Synthetic coding sequence
atgggtgagcatgagcaggtcaaaccgctggagacatctagttccaaagtcaaagccaagaccatcgtgatgatcccagactctcagaaactcctccgctgcgaacttgaatcgctgaagtcacagctgcaagcccagacaaaagcgttcgagttcctgaatcatagtgtgaccatgctcgagaaggaatcttgtttacagcagataaagatccaacagctggaagaagttctgtcccctactgggcggcagggagaaaaggaagaacacaagtggggtatggagcagggcaggcaagagctgtacggagcactcactcagggcctgcagggcctcgaaaaaaccctacgagattcagaagagatgcaaagggcgagaacaacacgctgtctgcagttgctagcacaggagatccgggattccaagaagttcctgtgggaggagttagaactcgtgcgcgaggaagtgacatttatatatcagaagctgcaggcccaagaagatgagataagtgaaaacctggtgaatattcaaaaaatgcagaagacccaggtgaaatgccgcaagatcttgaccaaaatgaagcagcaggggcacgaaactgcagcttgccctgagacagaggagatccctcagggagcctcagggtgttggaaggacgacctccagaaggagctgtcagacatttggtccgcagtccacgtgctccagaactcaatcgatagcctgaccctgtgtagcggagcttgccctaaagcttcctccctgaggggacacaaagggcaccagtgcctgtcaccccccttgccgtcttgggactccgacagtgactgtgaccaggatttgagccagccgcccttttctaagtccgggaggagtttcccacccgcctag

SEQ ID NO: 28783 - DNA, 978 bp, Artificial Sequence
  Description of Artificial Sequence: Synthetic coding sequence
atggatgcccggaggaagcactggaaggagaacatgttcacacctttctttagtgctcaggacgtcttggaagaaaccagcgaacctgagtcctccagcgaacagaccaccgcagattcttctaaggggatggaggagatctacaacctgagtagcaggaaattccaagaggaatctaagtttaagcgcaaaaaatacatcttccagcttaatgaaatcgagcaggagcagaacctgcgggagaacaaacgcaacatctcaaagaacgaaaccgatacgaattctgcttcatatgagagctcgaacgtggacgttactactgaagaatctttcaactccacagaagataactccacctgcagcacagacaaccttccagcattactgcgccaggacatcagaaagaagttcatggaacgaatgtcaccgaagctctgcttgaatctcctgaacgaagagttggaggagctgaacatgaagtacagaaagattgaagaggagttcgagaacgccgagaaggagctgctccactacaagaaagagatattcacaaaaccgctgaatttccaggagactgagactgacgcctcgaagtccgactacgaacttcaggccctgaggaatgacctgagcgagaaggctactaacgtcaagaacttgtccgaacagctgcagcaggccaaagaggtcatccacaagctaaacctcgagaacagaaatctgaaggaggctgtgcggaagttgaaacatcaaaccgaggtaggcaatgtgttgttgaaagaggagatgaagtcctactacgagttggagatggccaaaatcagaggcgagctctctgtcatcaaaaacgaactaaggacagaaaagaccttgcaagctcggaacaatcgggctctggagctgctaagaaaatattacgcctcctcaatggttacctcctcctcaatccttgaccactttacaggtgattttttttag

SEQ ID NO: 28784 - DNA, 978 bp, Artificial Sequence
  Description of Artificial Sequence: Synthetic coding sequence
atggacgctcgaagaaagcactggaaagaaaacatgtttacccccttcttttctgcccaggacgtcctggaagagacatccgagcccgagtcttccagtgaacagaccactgcggattccagcaagggcatggaagaaatatacaaccttagctctaggaagtttcaggaggagtctaagttcaagagaaagaagtacatctttcagcttaacgagattgagcaggagcagaatctgagggagaacaagcggaatatcagcaagaatgaaactgatactaactctgcttcctacgagtcatcaaacgtggatgttactacggaggaaagcttcaattctactgaagacaatagcacatgctccaccgataatctcccggcattgcttaggcaagatattaggaaaaagtttatggaacgtatgtcacctaagctgtgtttaaacttgctcaacgaggagctcgaagaactgaacatgaaatacaggaaaatcgaggaggagtttgaaaacgccgagaaggaactgctacactacaaaaaggagatcttcacaaaacccctaaattttcaggaaactgaaactgacgcaagtaagtccgactatgaactgcaggccctgcgaaatgatttaagcgagaaagctactaacgtgaagaatctgagcgaacaattgcagcaggcaaaagaagtaatccacaagttaaacctggagaacaggaatttaaaagaagccgtaagaaaacttaagcatcagacagaagtgggaaacgtgttgctgaaggaagagatgaagagctattacgagttagaaatggctaaaatcagaggagagctgtctgtaatcaagaacgagcttaggacagaaaagaccctgcaggccagaaacaatcgcgccctcgagttactgagaaagtattacgcctcttctatggttaccagttcttccatcctcgatcactttactggtgatttcttctag

SEQ ID NO: 28785 - DNA, 2223 bp, Artificial Sequence
  Description of Artificial Sequence: Synthetic coding sequence
atgaaccctcccgggagcctggaggcactggaccccaatgtcgacgagcacctctcaacccaaattctggcgccttctgtccatagtgacaatagtcaggagcgtattcaagctcggcggctgagaattgcagcccgactagaagcgcgaaggcgcgaagcactgggcgaatatctggacggtaagaaggaatccgaagaagaccagagcaaaagctacaagcagaaagaggagtctaggctcaagctggcaaagttactactgtgcggaactgagctcgttaccaatattcaggttgcgatcgacattcgagaaatccataggcgggtggaggaagaggagattaagcgacaaagaatagagaagttagaaaatgaagtgaaaacctcccaggacaagttcgacgaaattacctccaagtgggaagaagggaagcaaaaaagaataccacaagaactgtgggagatgcttaatacacagcaacttcactgcgctggcctgctcgaggacaagaataagctgatctcagagctgcagcaagaactgaaaactaaagacgatcaatacgtcaaagacctgaaaaagcagtcagacgatatttgtctccttctggaacgcatggaagaacaggtgaaaaacgtgatgaaaaccttcagggaagagctgtacaatatcgagaaagcattcgaagtggagcgccaggaactgctggccagtaataagaagaagtgggaacaagctctgcaggcccacaatgctaaggagctcgaatatttgaataaccggatgaagaaagtcgaagactacgagaagcagttaaaccgccaacgaatttgggattgtgaagaatacaacatgatcaaaatcaagctggagcaagatgtacagattcttgagcagcagctgcaacagcggaaagccatctatcagcttaaccaggaaaaactggaatacaatttgcaggtgcttaaaaagcgggatgaggaaagcaccgtcattaagtcgcagcagaagcggaagattaatcgcctgcacgacattttaaataacttgcgaagcaagtacgccaagcagattaagcaatttcaggaggagaatcaaagcttaacttcagattataaaaggcttgtgatgcaattcaaagagctgcagaaggccatgcgccattttgctcttattgacgacgaaaagttctgggagatatggctgatgaacgaagaagaagctaaagatctgatagcccgcgccttcgacgtcgacagaatcatccacacccatcatctgggactgccatgggcggcacccgatttctggtttttgaataacgtgggtcctatttcacaacaaccccagaagtccgcgacccagatcgtggaggagatgctcatgagatccgaggaggaagaggctgaggaagcagccgcagaaccagaaagctacttagacctcccgaagcagatctctgaaaaaacaacaaaacggatactgatgttgctgtgcgacgagagtgggtttctgattgagtccaagctcttgtcactgttactcccactagaacagaatgagtgttacctccttcggctggatgctatttttagtgcgttgggtattgagtccgaagacgatctctataagctcgtgaacttcttcctgaaatatcgtgcacatcggctgtcaagtagcctgcagatcaaaccttgcagccaggcctccatggagaaagcgtctatggaagaaacttcaactcgtagcgagctggagctcgcggagcagactgaaatggaaggagaaaaggaagagtcactggtggagggcgaaaaagaggaggaggaagagacacctcctagcccatgggtaatacacccaaacgatgtgctcaaaattttggaagcctttgtgatgggtctgaagaagccgcgcgatagcagggcgccgctgagggtgcagaagaatgtgcgggacaacagtaaggattccgaatactggcaggccctaacaacagtgattccaagcagcaaacaaaatttgtgggatgccttgtataccgcactggagaagtatcatctggtgctcactcagcgggcgaagctgctgctagagaatagctcactagagcagcagaataccgagctgcaagctctactgcagcagtacttgaattctaaaattaacagcgagctccaggtcccacccacacaggtgctacgagtaccaaccaaatag

SEQ ID NO: 28786 - DNA, 522 bp, Artificial Sequence
  Description of Artificial Sequence: Synthetic coding sequence
atgggctcccacagcccctctcactttcttgtgcatggatggattctcagcatgatgttccccgaggaggaagaagcagaagaggcggcagccgagcccgaatcatacctcgacctacctaagcagatttcggaaaaaacgactaagcgtatcttaatgttgctttgcgatgaatcgggtttcctgatcgagagcaagttactgagcttgcttcttccactcgaacaaaacgaatgctacctgctacggctggacgctatcttcagtgctctaggtatcgaaagcgaggacgatctgtataagcttgtgaacttttttctcaagtaccgcgctcatcggttatcctccagccttcagatcaaaccctgtagtcaggcttccatggagaaagcatccatggaagaaacctcaacacgctctgaactggaactagctgagcaaacagaaatggagggcgaaaaggaagagtctctcgttgagggcgaaaaagaggaggaagaggagactcctccaagcccatag

SEQ ID NO: 28787 - DNA, 2931 bp, Artificial Sequence
  Description of Artificial Sequence: Synthetic coding sequence
atgcacagtttggcattgcagaatactctgcacgagaggacttggtccgacgagaagaatctgatgcaacaggaactccggagcctgaagcagaacatcttcctcttctacgtgaaactccggtggctgttgaagcactggcgccagggaaaacagatggaagaagaaggagaggaatttacagaaggtgagcaccccgaaacgctgagtcgcctgggagagctcggcgttcaaggagggcatcaagccgacggccccgatcacgactccgaccgtggatgtgggttccccgtgggtgagcattccccccactctagggtgcagattggcgatcactctttaaggctacagacagccgacaggggccagcctcataagcaggtggttgagaaccagcagctcttttccgccttcaaggccctgcttgaagatttccgggccgaactgcgtgaagacgagcgggccagattgcgtttgcagcagcagtacgctagcgataaagccgcctgggacgttgaatgggccgtgctgaaatgccgcttggaacaaaattgctgtggttaccccaggatcaatattgaggaggaaacactgggcttcacaagactgcccgccggcagcaccgttaagaccctgaaatccttagggctccagcggttagaactggaggagaaaaccgaaaataagcttggggagctcggcagtagcgccgagagcaagggagctctaaagaaggagcgagaagtccatcaaaagctgctggcagattcccatagcctagttatggaccttaggtggcagatccatcatagcgagaagaattggaacagggagaaagttgagctgttagatagactggaccgcgataggcaagagtgggaacgtcaaaagaaggagtttctgtggcgaattgagcaggggtcactgcgaatgccccggcccgtggctatgtggccctgcgccgatgctgacagtataccttttgaggaccgcccactgagcaagctgaaggagagcgatcgctgtagtgcatccgagaacctgtatctggatgccctgtctctcgatgacgagcctgaggagccccctgcacacaggcccgagcgggagttccgaaacaggctgcccgaagaggaagagaaccacaaaggtaacttacaaagagctgtgagcgtgtccagcatgtccgagtttcaacgtctcatggatattagccctttccttcctgaaaagggtctgccctctacctctagtaaggaagacgttacacctcccctatccccagatgacctcaagtacatagaggaattcaataaatcctgggattacacccccaacagaggccacaacgggggcggacccgatctgtgggccgataggaccgaagtcggacgggccggacacgaagacagcactgaaccgttcccagattcaagttggtacctgaccacttcagtgacaatgaccaccgacactatgacatcacccgagcactgtcagaagcaacccctgcgttctcacgtactgacggagcagtctgggctccgagtactgcactcaccgcctgctgtcaggcgtgtggactccatcacagctgcgggcggcgaaggcccctttcccactagtcgggcaagagggtcccctggcgatactaagggtggcccacctgaacccatgcttagccggtggccttgcacctcgcctcgccactccagagattatgtggaaggagctcgacgccccttggactcacctttgtgcacaagcctagggttcgccagtcctctgcacagccttgaaatgtccaaaaatctgagcgacgatatgaaagaggtggctttcagtgttaggaacgccatctgttccggtcctggcgaattacaggttaaggacatggcctgtcagaccaacgggtcgagaacgatggggacccagactgtacagaccatcagtgtaggcctgcagaccgaggctttgaggggatcaggcgtcactagttctcctcataaatgtttgacacctaaagccggcggcggcgctacgcccgtctcaagtcccagcaggagcctgcgtagccgccaggtggcacctgccatagagaaggtgcaggcaaaatttgagcgcacatgctgtagcccaaagtatggcagccccaagctccagaggaagccactgcccaaggccgaccagcccaataacagaacaagccccgggatggcacaaaagggctactctgagtctgcttgggctaggtctaccacgacaagggagagtcctgttcatacaactatcaatgatgggctgagctcactgtttaacatcatagatcactcacccgtagtccaggaccctttccagaaaggcctcagggcaggaagccggtctcgtagtgctgaacctaggcctgagctgggtcctgggcaggaaaccggcactaattcccggggccgctctcctagtccaattggagtcggctctgaaatgtgtagagaagaaggtggtgaaggcacgcccgtgaagcaagacctgagcgctccaccgggctacaccctgacagagaatgtggcacggatcctgaacaagaagctgctggagcacgctttgaaagaagaaagacggcaagccgcccacggaccacccggactacacagtgactcacactctctcggcgacacagctgaacctggcccaatggaagaactgccatgttcagccctggctccgagcctggaaccttgtttttcccgtcccgaacgacccgccaataggaggccaccatcccgatgggcgccccattcacctactgcctcgcaaccacagtctcccggggatccaactagcctggaggaacatggaggggaggaaccgccagaagagcagccacacagagatgcatccctgcacggcctcagtcagtataacagcttgtag

SEQ ID NO: 28788 - DNA, 4761 bp, Artificial Sequence
  Description of Artificial Sequence: Synthetic coding sequence
atggaagaaatgcgagattcctatctggaggaggatgtgtaccagctgcaagagctgcggcgcgagttagaccgggcgaataaaaattgccggattctgcaataccggctacggaaggccgagcagaagtccctaaaagtggctgaaactgggcaggtggatggcgagctcattcgctcactcgaacaggaccttaaagtggcaaaggacgtgagtgtgcgtcttcatcatgagcttaagacagtcgaggagaaacgcgccaaagcagaggatgaaaatgaaacattgagacagcagatgattgaggtcgagatttccaagcaagccctgcagaacgagttggaacgtcttaaagagtcttcactcaagagacgttcaacccgggagatgtacaaggaaaagaagacctttaatcaggatgacagcgcagatctccgctgccagctccagttcgctaaggaggaagccttcttgatgcgtaagaagatggccaaattaggccgcgagaaggacgagttagaacaggaactccagaaatacaagtccctgtatggcgatgtcgatagtcctctgccaactggagaggccggggggcccccctcgaccagagaggccgaactgaagttacgactgaagctcgtggaagaggaggcaaatatcctggggagaaagatcgtagagttagaggtggaaaatagggggttaaaagccgaaatggaggatatgaggggtcagcaggagagagaagggcccggcagggatcacgcaccatcaatcccaacctccccttttggagactctctcgagtcaagcactgaacttaggcgccatcttcagttcgtcgaagaggaagccgagctgttacgccggagtattagtgaaattgaggatcacaacagacagttaacccacgaattgagcaaattcaagtttgaacctccgcgcgaaccaggctggctgggtgagggggcgtcgccaggagccggagggggtgctcccctgcaggaagaattaaagtccgcccggcttcagatttccgagctctcagggaaggtcctaaaactgcaacacgagaatcatgctcttctgagcaatatccagcggtgtgatttggccgctcacttggggttacgcgccccttcaccccgcgattctgatgctgaaagcgatgccgggaaaaaagaatccgacggggaagagagtcgcctgccccagccaaaacgcgaagggcctgtgggcggcgagagcgactccgaagaaatgtttgaaaagacttcgggcttcggttcagggaagcccagcgaggcatctgagccttgtcccacagaactcctgaaagctcgggaagatagcgagtatttagtgaccctcaaacacgaggctcagagattagagcggactgtagaacgactgataaccgatacggacagtttcctgcacgatgcaggactccgcggaggtgctcctctccctggcccaggacttcaaggcgaggaggagcagggcgagggtgaccagcaggaaccgcaactgctcgggaccattaacgcaaaaatgaaggccttcaaaaaggagctgcaagctttcctcgaacaagtgaacagaatcggtgatggtctgagtcccctgcctcatctaactgaatcatcctctttcctgagcaccgtgaccagcgtgagccgggattcccctatcggtaatctcggcaaggagctaggacccgatctccagtctagactgaaggagcaactggagtggcaactagggccagcacgcggggatgagagagaatccctgagactccgagccgctcgggagttgcaccgaagggccgacggagatacgggtagccatgggctgggaggacagacttgcttttcactggaactgaggggccctcccgtgttaccggagcagagcgtcagcatcgaggagcttcaggggcagctggttcaggccgctaggctgcaccaagaggagacagaaacctttaccaacaagattcacaagatggaagaggaacatctctacgctctcaggtggaaagaactcgaaatgcactcattggcactgcaaaatacactgcatgaaaggacttggtcagatgaaaaaaatcttatgcagcaggagctgcgctcacttaaacaaaacattttcctattctatgttaagctcagatggctgctcaagcactggagacagggaaagcaaatggaagaggagggcgaggaattcaccgagggtgaacaccctgagacactctctcggctaggcgaactcggggttcaggggggtcaccaggccgacggtccagatcacgatagcgatcgtgggtgcgggttcccagtgggggagcattctccccattcaagagtgcaaatcggcgatcactccctaagattgcagaccgcagacagaggacaacctcacaagcaggttgtcgagaatcagcagctgttcagcgcatttaaagctcttctcgaggatttcagagccgagctccgagaggacgaacgtgcccgcctgcgcctgcagcagcagtacgcaagcgataaggcagcttgggatgtggaatgggctgtgcttaaatgtcgcctcgagcagctagaggagaagaccgagaataagcttggagaactgggctcgagcgccgagagtaaaggcgccctgaagaaggagagggaagtgcaccagaagctattggccgattcccactctttggttatggatctgaggtggcagattcatcactcagaaaaaaattggaatagagaaaaggtcgagcttttagaccggctggatcgcgatcgccaggaatgggaacggcagaaaaaagagttcttatggagaattgagcagctgcagaaggaaaacagccctcgacgcggaggctcattcttatgcgatcagaaggacggaaacgtgcggccgtttccacatcagggttctctacggatgccaaggcccgtcgcgatgtggccatgcgcggacgccgatagcattcccttcgaagataggccattaagcaaacttaaggagtctgaccggtgtagcgcaagcgagaatctgtatctggatgcactttcattagatgacgaacccgaggaaccacccgcccatagacccgagcgagaattcaggaacagacttcccgaggaggaagagaaccacaaggggaacctgcagagggcggtgtcagttagctccatgtccgaattccagcggctcatggacatttcaccttttctgcctgaaaagggattaccgtccacgagctcaaaagaggatgttacacctccgctgtccccagacgatctaaaatatattgaagagttcaataagtcgtgggactacacacccaaccgtggtcataatgggggtggaccagatctgtgggccgatcgtactgaagtgggtagggccggccacgaagattctacagaaccgtttcctgacagctcatggtacctcaccacatctgtgacaatgactacagatacaatgacctcacccgagcactgccagaaacagccattaaggtctcacgtcctgacagagcagtcagggctgcgcgtgctccactcccccccggctgtgcggcgcgtcgattctattaccgcggctggcggggaaggcccgttcccaacgtctcgcgcccgtggtagccccggcgatactaaaggcggcccacccgaaccgatgctatcaagatggccttgtacctctccgcgccatagcagggactacgttgaaggggcaagacgccctctcgactcccctctctgtaccagcctcggttttgcttctccactgcactcccttgagatgagcaaaaatctcagcgacgatatgaaggaagtcgccttttccgtaaggaatgcaatttgttctggtcctggagaattgcaagttaaagacatggcctgtcagaccaatggctctagaactatgggtacacagaccgttcagaccatctcggtgggtctccaaactgaggcactgaggggctccggagtcacttccagtcctcataaatgcctgactcccaaggcaggcgggggtgcaacccccgtcagtagcccttcccgttccttaaggtctcgtcaggtggcgccagctattgaaaaagtccaagcgaagttcgagagaacttgttgttcacctaaatacgggtcccctaaactccagcgcaaaccactgcccaaggccgatcaacctaataatcgcacttctcctggcatggcacaaaagggctacagcgaaagcgcttgggcccgttccacgacgaccagggaaagcccagtgcacaccactataaacgatggactgtccagcctatttaacataatcgatcatagtcctgtggttcaggacccgttccaaaagggcctacgcgccggctcacgaagtagaagtgcagaaccgaggcccgaactggggccgggacaggaaaccgggactaattctagaggtaggtccccttcccctattggagtcggatctgaaatgtgtagagaggaaggcggggagggcactcccgtcaagcaggatttgtctgcccctccagggtatacacttactgagaatgtagcccgaatcctgaataagaagctgctggagcatgcacttaaggaggagagacggcaggccgcacatggccctcccgggctgcattctgactctcacagcctgggtgatacggccgagccgggccctatggaaaatcagacagtcttgctcactgccccctggggtttgtag

SEQ ID NO: 28789 - DNA, 4638 bp, Artificial Sequence
  Description of Artificial Sequence: Synthetic coding sequence
atggaagaaatgagagatagttatctggaagaggacgtctatcagttgcaagagttgcgacgggagcttgatcgagcaaacaaaaactgtcgcatcctgcagtaccggctccgaaaggcggaacagaagagtctaaaagtagccgagacgggccaagtcgatggcgagcttatcaggagcctggaacaggatttgaaggttgcaaaagatgtttcagtgaggctgcatcacgagctgaagacggtggaggaaaaaagagctaaggccgaggatgagaacgagacattgagacagcaaatgattgaagtggaaatcagcaaacaggcactacaaaacgagcttgagcgtttaaaagaatcctctctgaaaagaaggagtacccgagagatgtacaaagaaaaaaagactttcaaccaggatgactctgctgatcttagatgtcaacttcagtttgccaaagaagaagccttcttgatgcgaaaaaagatggctaagcttggccgagagaaagatgagcttgaacaagagttgcagaaatacaagtcattgtatggcgacgtggatagccccctgcccacaggcgaagccggaggtcccccaagcaccagggaggccgagttgaagttaaggctcaaactggtggaggaggaagccaatattttaggaagaaagatcgttgaactggaggtcgaaaaccgaggtctgaaagctgagatggaagatatgcgcggacagcaggagcgtgagggtccaggaagggaccatgcgccaagcatccccactagtccgtttggcgatagtctggagtcaagcacagagttgaggagacatctccagtttgtcgaggaggaagctgagctgttacgtaggtccatttccgagattgaagatcataatcgccagttgacccacgagctcagcaaattcaaattcgaaccgcccagagaaccaggctggcttggagagggagctagccctggcgcaggaggcggcgcacccctacaagaggaacttaaaagtgcacggctccagattagtgagctctcaggaaaagtgttgaaacttcagcatgagaaccacgccttgctgagcaatatccagagatgtgacctggctgcccacctgggcctgagagcgcccagtccacgcgactccgatgctgagtctgacgccgggaagaaagagtccgatggtgaagaaagtcggttgcctcaacctaaacgcgaaggccctgtgggaggggaaagtgacagtgaggagatgttcgaaaagaccagcggcttcggcagcggcaagccttctgaagcgtcggaaccctgtcccacagaacttctaaaagcacgagaggactccgagtacctggtaacactcaagcatgaagcccagagactggagcgaaccgtagaacgtctgatcactgacactgacagtttccttcacgacgctggcttaagaggcggagcccctctgccaggccctgggctccaaggtgaggaggaacagggcgaaggagaccaacaggaaccacagctgctgggcaccataaacgcaaagatgaaggcattcaaaaaggagctacaggcattcctggagcaggttaatcgcatcggcgatggcctctccccgcttccgcatttgaccgaatcaagctcttttttgtcaaccgtgacttctgtatcgcgggactcacccatagggaacctggggaaggaactcggccctgatttgcagtctcgactgaaagagcagctggagtggcagcttgggccagctagaggggacgagcgggaatcgttgcgtctgagagccgcccgagaacttcatagacgggccgatggagacacaggatcccacggtctggggggccagacctgtttctcacttgagatggaagaggagcacctgtatgcactaaggtggaaagagctggagatgcactcactggctttgcagaacaccctccacgagagaacctggagcgatgagaagaacttgatgcagcaagagctacgcagcctgaagcaaaacatttttttgttttacgtaaaactgcgatggctgctgaagcactggcgtcaaggcaagcagatggaagaggaaggggaggagtttaccgaaggagagcacccagagaccctgtcccgcttgggtgagctcggtgtgcaaggcggacatcaggcagatggccccgatcatgacagcgaccgcgggtgtggctttccagtcggagaacattccccccattcaagggtccaaatcggcgaccactctctgcggttacagacggcagaccgtggccaaccacataaacaagttgtggaaaatcaacaactcttttctgcctttaaagccctgttagaagactttagagcggaactacgggaagacgagcgtgctcgcctccgactacagcagcagtacgccagtgacaaagcggcttgggatgtggagtgggccgtgctgaagtgccggctggaacaactcgaagagaagactgaaaataaattgggtgaactaggctcctccgccgagagtaaaggggcactgaagaaggagcgtgaggtgcaccagaagctgctggctgactctcattctctggtcatggacctaagatggcaaattcaccacagcgaaaagaactggaaccgcgaaaaggtcgagttgctggacagacttgaccgggaccgccaggaatgggaaaggcagaaaaaggaatttctctggcgaattgagcaattgcagaaggagaactcaccccgcagagggggatcgtttctatgtgaccagaaagacgggaatgtaagacctttcccgcaccaggggagcctgcgaatgccccgaccagttgccatgtggccctgtgcagacgctgactccatcccgtttgaagaccgaccgctctctaaactgaaagagtctgaccggtgctccgcaagcgagaatctctatctggacgccctgagcctggatgacgagcctgaggaacctcccgcgcatcgcccagaaagagagtttagaaatcgcctacctgaagaggaggagaaccacaaaggcaatcttcagagagccgtctcagtgagcagtatgtcggagtttcaaagattaatggacattagtccctttctgccagagaaagggctcccttccacaagcagcaaggaggacgtgacaccaccgcttagccctgacgatctcaaatacatcgaagaatttaacaaatcttgggactatactcccaatcgtggtcataatgggggaggacctgatctctgggccgaccggactgaagtgggccgggcgggccatgaagacagtaccgaacccttcccagactcttcatggtatctcacaaccagtgtgaccatgaccaccgacaccatgacctctcccgaacattgtcagaagcagccactgcgctcccacgtcctgaccgagcaaagtggcctgcgggtcctgcatagccccccggctgtacgccgtgttgatagcattaccgctgctgggggggaagggccctttcctacttctagagctaggggtagtccaggcgacaccaagggcgggcctcctgagcccatgttgtcaagatggccctgcacctctccaagacactcgagagactacgtggagggagcccggcgacccctggatagccccctatgcaccagcctggggttcgcctcccccttacatagtctggaaatgtctaaaaacttgagcgatgacatgaaggaagtagccttttctgtgcgtaacgcgatttgcagcggcccaggggagctgcaggttaaggacatggcttgccagacaaacgggagtaggaccatgggtactcagactgtgcagaccatttcggtgggcctgcaaactgaagcactgcgggggagcggggtgacaagcagcccacacaaatgtctgaccccgaaggcaggcggcggagccacccccgtgagcagcccttccaggtccctgcgctcacgtcaagtggcccccgccatcgaaaaagtacaagccaagttcgaaaggacatgctgctctccaaagtatggctctcctaagttgcaacggaaacccctcccgaaggcggatcagccaaataacagaacctcgcctgggatggcacagaaaggttacagcgagtctgcgtgggctaggtccacaacaacacgggagagccccgtccatacaactatcaatgacgggctgtcctcccttttcaacattatagatcattctccagtggtgcaagatccctttcagaaggggcttagagccgggtcccgctctcggtcggccgagccacgccccgaactgggacctggtcaggagaccggcaccaattcccgtgggagatcgccatccccaatcggggttggcagtgagatgtgtagggaggaggggggcgaggggacccctgtaaaacaggatctttcagccccaccgggatacactctcactgagaacgtagccagaatccttaataagaagctgctcgagcatgcactgaaagaggaacgacgccaggcagcccacggtcccccggggcttcactctgattctcatagcctgggagatacagcagagccaggcccgatggaaaatcaaacagtcctgttgacagcaccctggggcctttag

SEQ ID NO: 28790 - DNA, 1320 bp, Artificial Sequence
  Description of Artificial Sequence: Synthetic coding sequence
atggcgccaaagaagaagcgaggacccagtgcaggttcccagcccggaggggcagccgcggctggggccgaacagccgctgtccgagcgggctcagtatctacagagagagcatgcgctcttgagcgagcagttggatacatgcgaggagagtgtcgaccaggtcctcagagaaaatgcatttttggatagggaagcactcagacttcgcgaagagaacagattatacgcctcgtacgtctcagcaagagcccagaggtgtgccaaggcgattgtcagattagatgagcagaatcgagtggacctcgcgcagatccactggcaacgagccgaacttgcgtcactgtatcatggacgtgaagacggcgtgagagcacagcttctggaaatggaagcccgcgcagcacagatggcccagcaagtccaggaactccaaccttataaggtattgcagctagagcagctggctcgtatccgggccctggagcgtgaacttcttcatatgcgggtcgagcacacccaactgctgcacagggtgaaacgacgcttcctggaggataaggcagcatttgaaagggaggcccgccagcgtgtgcaatcacttgcaagacgcgccgaacgtgaggccgttagggccctcgtggcccatacccaagccattaaggctgacaatgggcgtcttagacaggagctattactgctgctccggcggactcagctgctccatcataccagacgtcaactcctcgagcaaagggaacagctgcatcgggagcacgaggatacacgtgatctggcccgcgtacacgggtggttgcgtcgcggtccaggcggtccacccctatgggagcgcccagcgttttcacagcctacaagtagacctggttccctcgcagcacctattagtcccagcagagccgctagccagacacctagcgtggtgccaagccgcgcggctcctcgggcgagctcagtagtcccttcacgggaggcttctagggtgcccagtttggttcttagctcaatggattcccgggtaccgtcccttgctaccagtaaggtcggctctaggatgccaagtttgacagcctccagggcgggctcacgcgccctttctcttgtgcagagcctggaaggcagtgggatatcgtcgggctcaagcccccgggtgagctcccaggatacattaagatcaactaaatccggcccaaagctgctgagtggtctgtctagagaccgggatcctgctctcttgcccccgcagagcgaggactctgtgaacgccgaagcagcagcggaagcttctcctggccgcgcatag

SEQ ID NO: 28791 - DNA, 7359 bp, Artificial Sequence
  Description of Artificial Sequence: Synthetic coding sequence
atggcgcagatccagaaggacaaagctaacatatcagaaaaatccgtgatgcatccggagtatatcgctgtgaaggcagagaagagccctctttctcatattttgaagaccaaggaactgcaggtgaatatatcacagcagggcgaaaaggcgcaggagggagaagtcgagattgttgtacttctgtcaaaaacttgccccttcgtcacatcatcggcctttcttgaacttgattccatcaaggaagaggagggagagccaaggattacccgctcctttatgcctcacctggagattcaggaatccctcccgtccaggcagacagctcccaccaagcccaccgagtctctggtcaaaaaggaaaaacaattactgccacagaaagaggatagagtgcaaactgtgagtatgcacggacttatgcaccctaacggggcagtcttcaaagctaaaacatccgctccgccacaagttttttccattaccgagcattctccactgagcaagaggaaagagccacaatgggggatgaaagaacgtgccggccagaaacaggatagaactggtagacctcatgtgatccttacgaagacacacccattcatgcccagcctgtcacaccatagattctcccccagtcagcccaagttgcctatttcctcgggagcaggtaaaagccgattggcgaactccaacgaagggatatcaagccacaaggtgattctaaaagctaaccagcagatgccctataaagaggcgaaggacagggtgaaaatcgaggggcgggaagggagaatcctccctaagcggattcacttgcgagctgaagcactccctctggctctgctttgtaatggaaagaactacagtcttcatattgaggagcagggggagggagtccaggaatcaaaaaaggagcccggtgtcgtcccccgaaagtcagctagctttcctccccctcccttttacctcaactgcgatactcggcggaatgaaaaggaaggcacccttgggaaaacgcagtttagctttccccccctcaaaattcaggactcgagtgactccgggaagaaggcctacaccgaaagtctgcacgggtatactttgtcaaactctaagggccccgttcagcctacagctcaaggtgaagagaagggtggcctgaggattgatatggaggataagatgctaccgaagtgcacggatttgaaagctaagcaactcctgctgtcagatatcttaaacactaagaagctgcagtggaaatccaaggagcagaaacgcaagatccaggaggacaaaaataagcaggtgaaaggcctgccttccattaatacgtcactcctgacaccaccctatctgaaattcgatactacagagggccaagagaacgtcatccggatcgctaaagtgtcgctgccccaaagccgctctaaagaatctagtgatgccggtagaattgcctgtcccgaggccacgcatggggagctctcttccgacgtcaagcagctgaaggcccacctgttgcagaaggaggagaaagatcgggagaaagtggctgatatgacttccgtgctcgaccccaataaaatgtatctgaaagcgaagaagtctccagttctacatacccatagcttctcggatttgcaatggaagacacgcgagcaggaagaagagaaggttcagaaagtaaaaagtggacctggagtgatgctttcaaagagtccctccaggtcctcaccattacacctgaatgtgaacactggatttcaggaagagagtataccaatcctgacccgtccttcttttccactggtgaagctgcaggtctcccccgacacagaaggagggacctgtatccggcccatagctggagacatcttgatctatttgcagaaaggcaagcatgtttcccaaaataaggaagaggatgatgtccagatcgtgtccatcctcatcttccccaagcatcaagaggaaaaagtccaagagtgcgagggcgagccaggggttgtcctcaccaaatctaccagcctcccatctctcagtcagttagagctggataaggaaacccacttaggcaatgaaatgctgcgactcaagagacctattctacggagaattagtcacatcggagagactgtgcaccgagagtcagtggtgggcgatatacctaaggatgtaaaaaatgagaaacagcacattccacagaaggaggaacgaaatcagaagaagataattgatatgaggggtaccgacatcactctcaaatctaaaaaaagcccgaggagctgcatgctgcaccggacagagctgcatgttaatatcggtggacagggccgcaaggagcatgagggccaggataagccaccagggatgattcaacgcaaaatgtgtatcctctttagcaagcctttgccaagcaacctgaaactggagcgggctacccacgccgatgaagaacggctcggtggaaagaccagtttcgtactgcctctcatgccgagcgcactccctgataccgaaaagaccgccgacgccgaggcacgcagcggagacgtccgcaagggaaaaccacacaggagtcagaaagaaaatcgccatgaagtaaagaccatcgacatgagattcaggatccattgccaagaggcacgtatcagccctatgagtcatatactaaacgcaaaagaactcgtgctgaatatcaataagctggagaaaaaggtacataaagacaaggatgaagcatgtgtggttttgtctcggaccttcttgtcaatcccttctgccccaccgctgtatctggacagcgggaataagactgacaaggacacacccggaatcacaggctcatcttgcccacaaagaaccttgcatgtcccgtccaacacgcagaagatcaccaatagagactccgtcgaaggagtggacaagaatgtggtgaagcaagccgagcagtatgtccctcgaccagaagccgagcagcaactaacctccaatttcatgatttccgtccagcagcgtaaccaaccgtcccgagtgagaagcgaggaggacctaaaccagttagtactcaatagccgagacgaggatatctacttcaccggtttcgggaccatccgtagcgggaaacggcccgagtggctgttcacaggaaagaaagcacaacctgtgaaatataaaactgagactctgaccgcattcctgagttatcctactatggatgccacgaaaatgggaggacttgaggaggatactgaaatcatggacaacctgaatcacaaaattagccctaaagcatccgtgagcctgatcaggaagatcagcaaagagctgtatgtcactctgggcacacccgccaacagcaaggggttttccgttagtgagcggtatgctcaccagcaggaaacttctagcaaagtttcacctgagttggccggaagctgcaagttcgacaagccgaaagaagacggccagagcaacgatcgcatctccaagatgttttcccctaaggtgcttgctcctcaaaccaaaggcagcttgaaaaaaatcagtattgtcaccaactggaatgccccacagaacatcgaagagcaggatatcgtgatgaaaaagcaagtgattagacggtgcgaacacgggcacaagacccgaaccaacacaattctctccaagtttcctctgcagtcaggaaagcagaagacaccatctgagactgacgttgacaagaaaacaacagcccacctgagcttgcaaatgttgcctggaatccacatggatatgaccgaaattgacccggccaaggggggccgcaaacaggccttgttgatttccgaacaagaggagggagttctggagttcctcccaaagtcactgtttcccccatggactttccagttccaatccggagacctggaagagaagcatcagaccgatgcaaatactaatattaatctcgagcagaaaaagctcgagatggataatgattcgacagtgaaccaaaaagaggggaaactcaagattgggacaaatcgggccctgcacctccaggaagagaagaccgagatgcacaaggcaaggaccgccaacttagagaaggagcgaggccgtatggacacttccagtagcgctcacccccatctgctcagcctaaaagctgaggagtcgcagatgaagacacaagttattactcatagggaaaattcccggctgatcatgcagaaacagaagaaggagctcgaggcatcaaatgccaaacagtctatccaactgcagaaactctttcagcgaaacgtgctggatagcttctactcatatgtgcccttatctccaaagcggaaggaccaaaagggcaggcttacgataagggatctgaagcgcgagctgtccactaaatacttgactatgaagatacagaaccatcccattccccaaatgctgaacataaccggacgcggcacgccaagcaatcgcaagaagcttgaatacgatgtcaagctgaaaaacattgcctcctggtcaaaggatgtgtccggcatttttattaggagcctgtctataagcatcatgaggtctccccacaccgacccaaaaaccaacctagaaagagagaaaagaatctgtctcccaaaattccaggagaagtcccctaatacatccgaaatgtccaagcgagatacactgacaattgtcaaaggagagcagaattttacaaatactgttcctcaagacccccagccgttcgcagtggacaagcagcagatgcagaaactaccaaatgtcaaatcagaagcgaaccttagatccgagatgaacaagaagtatttaaaggcacagacaaaggagcgaattgtgcctgagcacgatgtcagtcgcattattaagaagcccgacctgagaatcatcgagcaggaggaaaagatcctcaagcgaatcctcacaccaacggaatgcccatctatgctcgaggaccccaaattgcccaaacagcgggatcaatcggaacccgtgtgggacatgacgacccagaaagtgcaacagcagaaggctttccccggcaccgtgcctattccaccccaggtcaaaagctccgaagttaaaatcgtggcagattctactaatgccgaacacctgcttcccatctgtgaagctacaaaagccattagtgaatcccaggtgaaaaacatgatccaggataaagtctcctccgacaaacttgataatatccaggcctacaagcccgatgacctcaagagtcccccttttcccgagggaccagacacaatttctactgccatctatcccaagacccagcataaatcattgctggaacaattcactcctaaggaaaaaaataaactgacctctcacctagagagcaaggctctcgagatccagctgaatctgattccagagatggcgagaaagagcctccaaatgtttaatttttaccccaaaggcaccatttcaaaggacaactcctggcggttttactcacgtcacaaaacaatgaatttcatgtctctcgagggcacggataccatcgagccaaatagcaagcacaaacaccagaaggactcccccttggcaagtaacatgaagactttgatagtcgacgtcagcagcgattccgaagaaactataactaagctccaaagtataaataagcttgagaatggcacctctgccgtcactagcgcatctgagatgctgctcccccatacgctccagaatcactccgtcaaagagaagggcaaactgctcatgcatttctcagttaagactctggagattcagatgaaagcgttcccccggatcgtacgggaatcttatgctatgacatctgctcatgaaagaaagaaaccgctatccaactgcattcacccaggatttacaggaccaaagcggcagaaccgaatattgctgctgtctgaggaaaagtctctgcaccagatcgatttggacctgcaatataagtacctccgttttctactcggtctgccggtgggaagtacattcccaaaacccaacgttctcccgaaacactccaagctgaataccattgctgtctgtaaaaacgtgaatgctgggggccaatccggcagcctgagcatcgacaccgagctgctggagcagcacatcagcttcaagaagcagtcacctcacgagaattctagcttaattagaaagttcccccagccgactctagtctgtgcttcagatcgggacctacatagccctaggaaaaaggacactcaagtgctgtccgagtctgaattccacgtgactcccgaaaaaaataaacaataccacgtttggtttcaagaaagaaatacctgtgaatccgtggacctccgcacccagcgtaacgccacgggatcagctgtgtcctgcgagactcagatcagcgaagatttcgtggacatccagactgatattgaatcacctgctgacctggatgaatgcagctgccttgaagtttcagagtcagaggaatgcgtttttttggaagcgaactcatacctatcccaggagtcagagaacatcctgtttgaactccaaactgggattccacttgaaaatgtatataagatcacaacagatctgaaaagtttttattcagaagactcaggctctcactgtacacgagaatgcaggaaggagacactgataatcacccccccctcctgcaagagtcataagtcaaggaaatatcggtcatcaagcaagatgaaatcacccgactggctctgtcattccagctccaatacggctgagatccagtcccggagctcatctgtcagctttagcgaagaaaaaatctcatggactaccaaatctaggacaagctattcttctgctccactcacagagtctaacataaagagccacctggcaaagaaccaaggcaaatcccatcggcaccctgagagtcaagagcgaaagaaggcccgttccgatctgtttaggaagaatagtagtcactgggaccacgactactcttgtacacactctaaaggcaaacgtgaccggaagaaacgagtctacgactacgagtccgagaggctggactgttttcagtccaaacacaaatccgcttctaagcctcaccatgacgacataaatttctacagtgagaggaagcagaatcgtccatttttcttcgcctgtgtgcccgcggatagcctagaggtgatccccaaaactatcagatggactattcctcccgagactctccggaagagaaactttaggattcccctggtagccaagatcagttcgtcatggaacatttggtcatcctcaaagaaactcctcggcagtctctctggtagcctcacaaccgtctttcacagttag

SEQ ID NO: 28792 - DNA, 645 bp, Artificial Sequence
  Description of Artificial Sequence: Synthetic coding sequence
atgaaagaggaacgcaattacaactttgatggcgtatcaactaaccgcctgaagcagcagctactggaggaggtgaggaaaaaggacgccgtacaattgtccatttttgagctcagacacaagataaccgagctggaggccaaactgaacactgacaacgaggggtccgaatggaaaacacggtacgaaactcagttggaactcaacgacgaacttgagaagcagatcgtctatttgaaagaaaaggtggaaaaaatccacggaaactcctccgacaggctgagcagtataagagtctatgagagaatgccggtcgaaagccttaacacactcttgaaacagctggaggaagagaaaaaaacgctggagagccaggtgaaatactacgcactgaagctcgagcaagaaagtaaagcctaccaaaagataaacaacgagcgccgaacatacctggctgagatgtcacagggcagcggcctgcaccaggtgtcaaaaagacaacaggtcgatcagctgcctcgtatgcaagagaatctcgttaagacaggcagatacaatcccgccaaacagaagaccgtctctgcaaaacgtggtcctgtgaagaaaattactcgtccaaaccatctgcccgagctgcatccgtag

SEQ ID NO: 28793 - DNA, 426 bp, Artificial Sequence
  Description of Artificial Sequence: Synthetic coding sequence
atggaaacgttacaagagtcacttaatactctattgaaacagttagaggaagagaagaaaacgttagaatcccaggtcaagtactacgcactgaaacttgaacaggagtcaaaagcctatcagaaaataaataatgagaggcgcacatatttggcagagatgtcacaagggtctgggctccatcaagtgagcaagcgccaacaggtggatcagcttccccgcatgcaggaaaacctggtgaagaccttacttttaaaagaagagctagacccacttaaggtgagttgccttgagacactgggattttccgccgctggcgtcgctggccctgagaacagaacctgccttggacagaaagccctgtggccagcctgcctgcatggatcaagcacactcgctgtgtgccagacacatctcaaatcctag

SEQ ID NO: 28794 - DNA, 339 bp, Artificial Sequence
  Description of Artificial Sequence: Synthetic coding sequence
atgcccgtggagagcctgaatacacttcttaaacagttagaagaggagaagaaaaccctggaatctcaggtaaaatactacgcacttaagctggagcaggaatccaaagcctaccaaaagattaacaatgagcggcgcacttatctggctgagatgtctcagggttctggactacatcaggtgagcaagcggcagcaggttgatcaactgcctcggatgcaggagaatctggtcaagacaggtcggtataaccctgccaagcagaagactgtgtcggccaagagaggccctgtcaaaaagatcacccggcccaatcacttgccagaacttcatccctag

SEQ ID NO: 28795 - DNA, 420 bp, Artificial Sequence
  Description of Artificial Sequence: Synthetic coding sequence
atgcccgtcgagtctctgaatactctcctcaaacagctggaggaagaaaagaaaacattggaatcacaggtcaaatactacgcattaaagctggagcaggaatccaaggcataccagaagataaataatgagagaagaacttatctggccgagatgagtcagggctctggtcttcatcaggtgagtaaacgccagcaggtggatcagctaccacgcatgcaggagaaccttgtgaagacgctgctgcttaaggaggagctggaccctcttaaagtgagttgcctcgaaaccttgggtttctctgcggccggcgtagccggacctgaaaatcggacctgcttggggcagaaagctttgtggccagcttgcttgcatggctctagtaccttagccgtgtgtcagacgcacctgaaaagctag

SEQ ID NO: 28796 - DNA, 420 bp, Artificial Sequence
  Description of Artificial Sequence: Synthetic coding sequence
atgcctgttgagagcctcaataccttactcaagcaactggaggaggagaagaagacattagaatctcaggtcaaatactacgcgctgaagctggaacaagagtctaaagcctaccaaaaaattaataacgaaagaaggacctacttagccgaaatgtcgcaggggagtgggctccaccaggtgtccaagcgccagcaggttgatcagctgcctaggatgcaagaaaacctcgttaaaactctcctactcaaggaggagctggatcccttgaaggtttcctgcttggagaccctgggcttcagtgccgctggcgtagccggccctgaaaacagaacttgcctcggtcagaaagccctctggccggcttgcttacatggatcttcaaccctcgccgtatgccagacgcacttgaagagttag

SEQ ID NO: 28797 - DNA, 339 bp, Artificial Sequence
  Description of Artificial Sequence: Synthetic coding sequence
atgccagtggaatcactgaacacgctgttgaaacagctggaggaagagaaaaagactctcgagtcccaagtgaaatactacgccctgaaactggaacaggagtcgaaggcctatcagaaaatcaacaacgagcgcaggacctacctagccgagatgagccagggatcaggactccatcaagtgtctaaacgccagcaggtagaccagctgccacggatgcaagagaacctcgtgaagacgggacggtacaatcctgctaaacagaagaccgtttccgccaagcggggacctgtgaaaaagataaccaggcccaatcacctccccgagcttcatccctag

SEQ ID NO: 28798 - DNA, 726 bp, Artificial Sequence
  Description of Artificial Sequence: Synthetic coding sequence
atgaaggaagagagaaactacaatttcgacggtgtttcaacaaaccgtctgaaacaacagctcctggaggaagtcaggaagaaagatgctgtccagctgtccatttttgaactgagacacaaaattacagagttggaggccaaattaaacaccgataatgaagggtctgagtggaaaacaagatatgagacgcagcttgagctgaatgatgagcttgaaaaacagattgtttatcttaaagaaaaggttgagaagatccatgggaattctagtgataggttgtccagcatacgcgtgtacgagagaatgccagttgaatcgctgaatactctactgaagcagctggaggaagagaagaaaacacttgagtcccaggtcaagtattatgcactgaagttagagcaggaaagtaaggcttatcagaagatcaataacgagaggagaacgtacttggctgaaatgagccaagggagcggccttcatcaagtctctaaaagacagcaagtcgaccaactccccaggatgcaagagaacttggtgaagaccctgctactgaaggaggaactggacccgctgaaggtctcatgcctggagactcttggtttctcagccgcaggggttgccgggccagagaatcgtacctgcctggggcagaaagccttatggccagcgtgccttcatggaagctccacgttggcagtctgtcagacacatctgaaatcttag

SEQ ID NO: 28799 - DNA, 1773 bp, Artificial Sequence
  Description of Artificial Sequence: Synthetic coding sequence
atggactcccactcgggggagcctgcattattgccctgcggtacatgtgatatggtgtttcgatcatccgcactgcttgccactcacacacagaggttttgtatcggacatcccactcaggagatgacatttggggcccaagctagcgttgccacagagccccagcgggctgctgtgcaatggctgaggctttctctgcaagagatgcgcccttggatcacggaagtgccccgcgtctttgccggtccctggactaggtcagaagcgcgcccccagagtccaatgtccgaggctgtgggatcaccttctgaacgccttagggccttatttaggacgagagcacgacgagtcgccgagatggaggcccagagccgtgccctgcagttaaggggggaggagctaagcagacgcctccaggtggtagcttgcactcgagggggaatgagtcgcctcttcgggctggaacaggaaatcagggagctccaggccgaggccggaagaactcggggcgcccttgaggtgctgggggctcggattcaggaattgcaagctgaacctggtaaccccttgagctcccgcagagaagccgagctctacagtcccgtccagaaggctaatcccggtacgctcgctgctgaaattcgtgcattacgagaggcctatattcgtgacggcggtcgagatccaggtgtgcttgggcagatttggcagctgcaggtcgaggcctctgccttggaactacaaagatcccaaactagacgcggccgggccggggcaactagcggcgagctccctgtggtcgaggccgaaaaccgacgacttgaggccgagattctggccctgcagatgcaacgtggcagagccccattgggcccccaggatctgagactgcttggcgatgcgagcctgcagccaaaagggcggagggatcctccacttttaccaccccctgttgctccgccactccctccccttccggggttttcagagcctcagctcccgggcacaatgactcggaatttgggtcttgattcgcacttcctgctcccgaccagcgacatgttgggccctgcaccgtatgaccctggagccgggctagtgattttttacgactttctgcgcgggttagaggcatcctggatttgggtacagttgcgcacaggcttggcccgggacggccgggacactggacggaccactgcgctgccacccgccctctgtctgcctcctccacctgctcctggacctatggggaactgtgctatcttggcttctagacaacccgtgcctagactgcctccatctagtagtgtaagcctggtgtgtgagctgcaagtctggcagggcctggcatgggcaagggccccacagcccaaggcttgggtgagcctgggactgttcgaccaggaccagcgggtgttaagcggccgctggcgcctgccactgagagccttaccccttgatccctccttgtctctggggcaactgaacggaatcccccaagcagggcaggcagaactcttcttacggcttgtgaatgctcgcgatgctgctgttcagacactggccgaaatcaatccagcgtccgtgcacgaataccagtaccccccgcctgtcagtagtacatcctcactcgaggctagtttcctaacccctgcagttgggtttgccgatccgcctcctagaacggaggaacccttatccggagtgaaagaccgcgatgagggactgggacctcaccattcaagcgacctcccacctgtcagtttctag

SEQ ID NO: 28800 - DNA, 333 bp, Artificial Sequence
  Description of Artificial Sequence: Synthetic coding sequence
atggatagtcatagcggagaaccagcactgttgccatgcggaacctgcgacatggtgtttcgcagctccgcattactcgcaacacatacccaacggttctgcattggccatccaacgcaagaaatgacgttcggagcgcaagccagcgtggctaccgagccgcaacgcgctgccgtatcttctactagctcactggaagcaagcttcctgactcctgccgttggattcgccgacccaccaccacgaacggaagaacctctgagcggggtcaaagatagagatgagggcctgggccctcatcactcgtctgacctgcctcctgtcagtttttag

SEQ ID NO: 28801 - DNA, 1842 bp, Artificial Sequence
  Description of Artificial Sequence: Synthetic coding sequence
atggattctcactctggtgaacccgccctgttgccttgcggaacttgcgacatggtattcagatctagcgccctgctggccacacacacacagcggttctgcattggccacccaactcaagagatgacatttggtgctcaggcttccgtggcgaccgagccccagagggcagccgttgttccacaggaacaccaaggcgtaccacaggagcctcagggcctcccagatcagcaggctagcaggtctgccctcaagaggctcaccgaggaagaaatgaggccgtggatcaccgaggtaccgcgggtatttgcaggaccatggactaggagcgaggctaggcctcagagcccaatgtccgaggccgttggcagcccctctgagagactccgggccctgtttaggactcgcgctaggcgcgtggcagaaatggaagcccagtcccgtgccctccagctccgtggggaagaactgagtcgacgactccaagtggtggcttgtaccagaggcggcatgagccgcctgtttggactggagcaggagattcgggagctgcaggccgaagccggccggaccagaggggccttggaagtgctgggggccagaatccaggagctgcaagcagaaccaggcaacccgctgtcctcacggcgagaagcagaattatatagccccgtgcagaaggcaaacccaggcactttggcggccgaaatcagagcgctcagagaggcgtatatcagagacggagggagggacccaggcgttctggggcagatttggcagctgcaggtagaggccagcgcccttgagctgcagcgctcccagacgcgtcggggacgtgctggagcaacctccggggagctgccagttgtcgaagctgagaacagacggctggaggcagagattttggctcttcagatgcaacgcggccgcgcccccctggggccacaggacctccgactcctcggagatgcatctctgcagcccaaaggaagacgtgatccgcccctgctgccaccccccgtggccccaccgttgcctcccctgccaggatttagtgagccccagctccctggcactatgacccgcaacctcggcctcgacagccattttttactgccaacatcagacatgttaggtcccgccccatacgaccctggtgccggcctcgtcatcttctatgattttctaagaggcctggaggcaagttggatttgggttcagctgagaaccggcctggcacgggatggtcgagacacagggagaacaacagcccttccacccgccttgtgcttaccaccgccgcctgccccaggccccatgggcaattgtgccattttagctagcaggcaacccgtgccccgactgcccccatccagctcagtgtctttggtctgtgaactccaggtctggcaaggtctggcttgggctcgagctccacagcccaaagcctgggtatctctgggactgttcgaccaggaccagagagttctatcgggcaggtggcgactacctctgcgcgccctccccctcgacccatccctctcactggggcagttgaacggaatccctcaggctggacaggccgagcttttcctgagactggtgaatgcccgcgacgccgcagtgcagaccctggccgagataaatccagctagcgtgcacgaatatcagtatcccccccccgtttcttctaccagcagtttggaagcttcctttcttacaccagccgtgggttttgcagatccaccaccaagaaccgaggagcctctctcaggggttaaggaccgcgacgagggactgggccctcatcactcatctgacttgccccctgtttccttttag

SEQ ID NO: 28802 - DNA, 1869 bp, Artificial Sequence
  Description of Artificial Sequence: Synthetic coding sequence
atggattcacattccggagaacccgcgctgttaccatgcggcacctgcgatatggttttccgctcttctgcattgctggcaacccacactcaacgcttttgcatcggacaccccacccaggaaatgaccttcggagcccaggcctcggttgccactgaaccacaaagagcagcagttgtgccgcaggagcatcagggcgttccccaagagccccagggcttaccggaccagcaggcttctaggagcgccctgaaaaggctcactgaggaagtacaatggctacgcttgtcgctgcaggagatgcggccatggattacagaggtgcccagggtcttcgccggtccttggactcggagcgaagccaggccccagtcccctatgagtgaggcagttgggtctccctctgaacgcctccgggcgctgtttcggacacgggcccgacgagtggcagaaatggaagcccagagccgtgccttacagttaagaggcgaggagctgtcccgccggctgcaggttgtggcttgtactaggggcggaatgagtcgcctgttcggactggaacaagagattagggagctgcaggcagaggccggcagaacccgaggggctctcgaagtgctcggggccaggatccaagagctacaggcggaacctgggaatccattgagcagcagacgggaggcggagctgtatagcccagtccagaaggcaaatcctggcacgctggccgcggaaatacgagctctaagagaggcgtacattagagatgggggccgcgatcccggggtactagggcagatttggcagctgcaggttgaagcgtctgccctcgagctccagagatcccagacacgccgaggcagggccggggccacctccggcgagttgccggtggtggaggcagagaatcgcagattggaagctgagatcctcgctctgcagatgcagaggggacgggctcccctcggaccgcaggacctgaggttgctcggtgatgctagtttgcagcccaagggcaggagagatcctccactcctgccaccgcccgtggcaccgcctttgccacccctgcctggtttcagcgaacctcagctgcccggaaccatgaccaggaacctcggcctagatagtcactttctgttgcctacaagcgatatgttgggtcctgctccctacgacccaggtgcaggactcgttatcttctacgatttcctccgcggcctcgaagctagttggatctgggtccaactgcgcaccggccttgcacgtgacggcagggacactggacggacaactgcattgccacctgccctgtgtctgcctcctccacctgcaccaggtcctatgggcaattgcgcaatcctagcaagtcgccaaccagtaccgcgcctacctccatcctcatcagtaagtctcgtgtgcgagctacaggtatggcaggggttagcatgggcccgagccccacagccgaaagcatgggtttctttaggcctgtttgaccaggatcagagggtgctgagcgggcgatggaggctgcccttgagagctctccctctcgaccctagtctgagtctgggccagttgaatggaatccctcaagcgggacaggcagagctgttcttgaggttggtcaacgccagagatgccgctgttcaaaccttagccgaaattaaccccgccagtgttcatgagtatcagtacccacccccagtctctagtacctcctcgcttgaggctagcttcctcacccctgcagtaggctttgcagatcccccacctaggaccgaggaaccactttccggagtgaaagatagggacgaggggctcggcccacatcactctagtgacctgcctcctgtgtcattctag

SEQ ID NO: 28803 - DNA, 852 bp, Artificial Sequence
  Description of Artificial Sequence: Synthetic coding sequence
atgaaaaaggacgaggctttaaaggcgctgcagaatcaggtgagcgaggagacaatcaaggttcggcaactggatagcgcactggagatttgcaaggaagaactggtgcttcatctcaaccagcttgaaggcaataaggagaaatttgagaagcagctcaaaaagaaatctgaagaggtgtactgcctccaaaaagaattgaaaatcaagaatcattctctccaggagacaagtgagcagaatgtcattctccagcatacattacagcagcagcaacaaatgcttcagcaggagactatccgcaacggggagctggaggacactcagacaaaacttgagaagcaggtgagtaagctggagcaggaactacagaaacaacgcgaatcctccgccgagaaattgaggaagatggaagagaaatgtgaatccgctgcacatgaggctgacttgaagcggcagaaggtgatagaactcacaggaaccgcaagacaggtgaaaatcgagatggaccaatacaaggaggaactgtccaagatggaaaaggagatcatgcatctgaaaagggatggcgaaaataaagcaatgcatttgtctcagctggatatgatcctggatcagacaaagacagaacttgagaaaaagactaatgctgtgaaggagctagaaaaactccaacatagcactgaaaccgagttgacagaggccaagaacgggaagtatttacggacgacaaaatgttcttggcggatcaagaagtactttaagacaactcccggaattgagagatgcacaaccgagggatctatcattattcgcggcaagatacactattacaagggaagccatagttag

SEQ ID NO: 28804 - DNA, 2412 bp, Artificial Sequence
  Description of Artificial Sequence: Synthetic coding sequence
atggtgatcgaaaaagagcaaagcttgcaggaaagcaaggaggagtgtataaaactcaaagtcgatctgctggagcagacgaaacagggcaaaagagcggaacggcagcggaatgaggccctttataatgcagaggagctgtccaaggccttccagcagtataagaaaaaagttgccgagaagcttgagaaggtgcaggccgaagaggagatcctggagagaaacctcacaaattgcgagaaagaaaacaagaggctgcaggagaggtgcgggctctataagtctgaactagagattctgaaggagaagctcagacagctcaaagaggagaacaataatggcaaggagaagttgagaatcatggctgttaagaactccgaagtaatggctcagctaactgagtctcgccagagcatactcaagctggagtccgagttagaaaataaggatgagatactgcgggataagtttagcttaatgaacgagaatcgggaactgaaagtgagggttgcggcgcagaacgaaaggcttgacctatgccaacaggaaattgaatctagcagagttgagctgaggtcacttgaaaaaatcatatcacagttgccactgaagcgtgagctgttcgggttcaagtcatatctgagtaaataccagatgtcatctttcagcaacaaggaagaccgttgcattggctgctgcgaggctaacaaactagtgatctctgagctgcgcatcaaactggccattaaggaagccgagattcagaaactccacgccaacctcaccgcaaatcagctttctcagtccttgattacttgcaacgattcacaagagagtagtaagctgtctagtcttgaaactgaacccgtgaagctgggtgggcaccaggttgcagagagtgtgaaggatcagaaccaacacacaatgaacaagcagtacgagaaggagcggcagcgcttggtgaccggtattgaggaactccggacaaagctgattcagattgaggcggagaattccgatctgaaagttaacatggcccatagaacttcccagttccagcttatccaggaggagctgcttgagaaggcttctaatagcagcaagctggagagtgagatgacaaaaaagtgcagccagcttcttaccctcgagaagcagcttgaggagaagatcgtcgcctattcgtcaattgctgctaagaacgccgaactggagcaggagttgatgctggaggctcagctcgagaagaaggaccagcagttcaaagagcaagagaaaactatgtcaatgctacagcaggacatcatttgtaaacaacatcacctggagagcttggacagattactgaccgaatccaagggcgaaatgaaaaaggaaaacatgaagaaggacgaagctcttaaggctctgcagaatcaagtgtctgaggagacgatcaaagtcaggcagttggattctgctctagaaatttgcaaggaagagctcgttttgcacttgaaccagcttgagggaaacaaggaaaaattcgagaagcagctcaaaaagaaatctgaagaggtctactgtctacagaaggagctaaagataaagaaccatagtttgcaggagaccagcgagcagaacgtgatactgcaacacaccctgcagcagcagcagcagatgctgcagcaagagaccattagaaacggcgagcttgaggacacacagacgaaactcgagaagcaggtgtccaagctggaacaggagctgcagaaacagcgggagtcaagcgcggagaagttacgaaaaatggaagagaaatgtgagtccgctgcgcatgaggctgatctgaagcggcagaaggttatagaactaactggaaccgcaagacaggtgaagatcgagatggaccagtataaagaagaactatccaaaatggagaaagagattatgcatctgaagcgggacggggaaaacaaagccatgcacctctctcagctcgatatgattcttgaccaaacaaagactgagcttgagaagaaaaccaacgccgtaaaagaattggagaagctgcaacatagtaccgagactgaacttactgaggccttgcagaagagggaggtgctcgaaactgaactccaaaatgcccacggagagcttaaaagtacccttaggcaactccaggaactgagagacgttctccaaaaagcccagctgagcctggaggaaaaatacactacaattaaagacctcaccgccgaattacgagaatgcaaaatggagattgaggataaaaaacaggaactgttagagatggaccaggcgttgaaagaacgcaattgggaattaaaacaacgggctgctcaagtgacacacctagacatgacaatccgcgagcatcgcggagagatggagcagaaaatcattaagtag

SEQ ID NO: 28805 - DNA, 3900 bp, Artificial Sequence
  Description of Artificial Sequence: Synthetic coding sequence
atggagagctctagcagcgattactacaacaaagacaacgaggaagaaagtcttctggcaaacgttgcttcgctgcggcacgaactgaagatcaccgaatggtccctgcagtcgcttggggaagagttatcttctgtgagcccgagtgaaaattccgactatgctccgaatccaagcagatctgagaaactgattttagacgtgcaacctagtcaccccgggttactcaattacagcccttacgagaacgtctgcaagattagtggaagcagcaccgatttccaaaagaaaccccgagataagatgtttagcagcagtgcgccggtcgatcaggagataaagagtctgcgagagaagctgaataagttgaggcagcagaacgcttgtttggtaacacagaaccacagtctgatgacaaaatttgagagcatccacttcgaactaactcagagtcgggctaaggtgtcgatgcttgaaagcgcacagcaacaggctgcttccgtgccgatccttgaagaacagattatcaaccttgaagccgaagttagcgcacaagataaggtacttcgcgaggctgaaaacaaactggaacagagccagaagatggttatagaaaaggagcagtcccttcaagagagcaaagaggagtgtatcaagctgaaggtcgatctgttggaacagactaaacagggtaaacgcgcagaacgacagagaaatgaagccctgtacaatgccgaggaactgagcaaggccttccaacagtataagaaaaaggtcgcagaaaaactcgagaaagttcaggccgaagaggagattctcgaacggaaccttacgaattgcgaaaaagaaaataaaaggctccaggagagatgtggcctttataagtccgagctcgaaattctcaaggagaagttgaggcagctgaaggaggaaaacaacaacggcaaagaaaaattacggattatggcagtcaagaacagtgaggttatggcgcaactcaccgagtctcggcagtctattctgaaactggagagtgagcttgaaaacaaggatgagatcctccgggacaagttctctctgatgaacgaaaatagagagctgaaggtgagagtcgctgcccagaatgagcgattggacctgtgtcagcaggaaattgaatcttcacgggtggagctcaggtctctagagaaaattatcagtcagttacctctgaagcgcgagctgttcggattcaaatcttacctgtctaagtatcagatgagcagcttctcaaacaaggaagatagatgcatcggttgctgtgaagcaaataaactcgtgatttccgaactcagaataaagcttgcaatcaaggaggcagagatccagaagcttcatgccaatttaacagcaaaccagctctcccaatctttgattacctgcaacgacagccaagagtcatccaaactctcctctttggaaacagaacccgtcaaactcggaggccaccaggttgccgaatctgtgaaggaccaaaatcagcacaccatgaataagcagtatgaaaaggagcgccagcggttggtcacaggaatcgaggagctgcgaaccaagttaattcagattgaggccgagaacagtgacttaaaggtgaatatggcccatcgcacctcgcagttccagttgatccaggaggagctgctcgagaaggcgagcaacagttccaagctagaaagcgaaatgacaaaaaagtgcagccagctcctgaccctcgaaaaacagctggaggaaaagatagtcgcttattcatctatcgcagcgaagaacgctgaactggagcaggagctcatggaaaaaaatgagaaaattaggtcactcgagacaaacattaacactgagcacgagaagatctgtcttgctttcgagaaagctaagaagatacatcttgagcaacacaaagaaatggagaagcagatcgagcggcttgaggcccagctggaaaagaaagaccagcagtttaaggaacaggaaaagacaatgagcatgcttcaacaagacattatttgtaaacagcaccaccttgagtcgctggaccgcttattgactgaatcaaagggggaaatgaagaaggagaacatgaaaaaagatgaagccttgaaggcgctccagaatcaggtctccgaagaaaccatcaaggtgcgtcagcttgattccgccttagaaatttgtaaagaggaattagtgctgcatctgaaccagttggagggcaacaaagagaaatttgagaaacagttaaaaaagaagagcgaggaagtctactgtctacagaaggaattgaaaatcaagaaccattcacttcaggagacctccgagcagaacgtgattctccagcacacgttgcaacagcaacagcagatgctccagcaggagactattcgaaacggggagctggaggacacgcaaacaaagctggagaaacaggtaagtaaactagagcaggaactacaaaaacagcgagagtcctcagctgaaaaactgaggaaaatggaggagaagtgcgagtcagccgcccatgaggcagacctgaaacggcagaaggtaatcgagctaactgggacggcgcggcaggttaagatagaaatggatcagtataaagaagaactaagcaagatggagaaggagatcatgcatttgaaaagggatggtgagaacaaagctatgcacttatcccagctcgatatgatacttgaccagaccaagaccgaactggagaaaaagaccaacgcagtgaaggagcttgaaaagttacaacactccaccgagacggagctcacagaggccctgcagaaacgggaggtgcttgagacagaactgcagaatgcccacggagagctgaaaagtacactccggcaacttcaggagttacgggatgtgctgcagaaagcgcaactctccctggaggaaaaatatacaactataaaggatcttaccgcggagctgagggaatgcaaaatggagatcgaggacaaaaaacaagaactgctggagatggatcaagctctgaaggagagaaattgggagcttaagcagcgcgctgcccaggtgactcacttggatatgacaatcagggagcaccgtggcgaaatggagcagaaaattattaagcttgaaggcacactagagaagtccgaactggaactcaaagagtgtaacaaacaaatcgagtctttaaacgataaactacagaacgctaaagagcagttacgagagaaagaatttataatgcttcaaaatgagcaggagatatctcagctgaaaaaggagatcgagcgtacacagcagcgcatgaaagaaatggagtccgtgatgaaggaacaggagcagtacatcgctacgcagtacaaggaagcgatcgacctaggccaggagctacgcttgacccgtgaacaagtgcaaaatagccacaccgagctggcggaagcccgacatcagcaggtgcaggcccaacgggaaatcgaaagattgagctccgagctggaggatatgaagcagctgtccaaggaaaaggatgcccatggtaaccaccttgctgaagagctgggtgcatcaaaagtgagagaagctcacctcgaggcacggatgcaggctgagatcaagaaactctccgcagaagtggaatctctgaaagaagcttaccacatggagatgattagccaccaggaaaatcatgctaaatggaagatatcggcagactcacagaagagctcagttcagcaactaaacgaacagctggaaaaggcaaaactcgagctcgaagaggcccaagacacggtaagcaatctgcaccagcaagtccaggatcgcaacgaagttatagaggccgccaatgaagccttgctgaccaaaggcgagaatgtgtag

SEQ ID NO: 28806 - DNA, 4254 bp, Artificial Sequence
  Description of Artificial Sequence: Synthetic coding sequence
atggcttctcccaccaacggccaccacggaggaaactgcggcaagtgctccccagggagggcccctctcgtaggatccggggcactggctgatcacgatcccagacaggccccccggctcaggcggaggcttactcagtcggctccggggcgtggttctgatagagtgggcgcctcgcagcggctgcccaggcggttcgagttctgcgctgcaggagttcgctggtttagtgagctgtgtccacgcctgccgagagctggggcgagagaacgcgtgcgggggtttttaacccagactcgagtgagaagcgctcagagtccgggcgggtcacttcctagcgacgacttaggtgagatggaatcatcatcttctgattactacaacaaagataacgaagaagagtctcttttagccaatgtcgcctcattaagacacgaactcaaaataaccgagtggtctttgcagagtctgggcgaagagcttagctcagtgtccccttctgaaaacagcgattatgcgcccaatccgagccggtccgaaaagctgatccttgacgtgcagccctctcatcccggactcctgaattacagcccctacgagaatgtgtgtaaaattagtggttcttcaactgatttccagaaaaagcctcgtgacaagatgttctcttcttctgcaccagtcgatcaggagatcaagtcactgagggaaaagctgaataagctgagacagcaaaatgcttgtttggttacacaaaatcactcactgatgactaaattcgagtcaattcactttgagctcacgcaatccagggccaaagtgagcatgctggaatctgcccagcagcaggccgctagcgtcccaattttagaagagcagattattaatcttgaggccgaggtaagtgcccaggacaaagtactgagggaagccgagaacaaattggagcagagccagaagatggttatcgagaaggaacagtccctgcaggagtcaaaggaggaatgcattaagctgaaggtggacttactggagcagaccaagcagggcaagcgggccgagcgccagagaaatgaagcgctgtacaacgcagaagaactgtccaaggcgtttcagcagtataaaaagaaagtcgctgaaaaactcgaaaaagttcaggcagaggaagaaattcttgaacggaatctaaccaactgtgagaaggagaataagaggctgcaggagagatgcggactgtataagagcgagctagaaatactgaaggaaaaactccggcagctgaaagaggaaaataacaatggaaaggagaagctgcgcatcatggcagtaaagaactcagaagttatggcacagctgaccgagtctaggcagagcatcctcaaactggaaagcgaactggagaacaaagatgagattctgcgggataagttctcattgatgaatgagaacagagagctaaaggtgagagtggcagcccaaaacgagaggcttgacctctgccagcaggagatcgagagctcaagagtggagctacgctctcttgagaaaatcataagccagctcccactcaaacgagaattgtttggatttaagagctatctttccaaatatcaaatgtcctctttttccaacaaggaggacagatgcatcggttgctgtgaagcaaataagttggtgatttcagagctgcgcattaagctcgcgatcaaggaagcagagatccagaagctccacgccaatctgaccgcaaatcaactgagccaatcactcataacctgcaacgacagccaagaaagctctaagcttagcagccttgaaaccgaacccgttaagctcggaggccaccaggtggccgagagtgtgaaagaccaaaatcagcacacaatgaacaaacaatacgagaaggagagacagagacttgttacgggtattgaagagcttaggaccaagctgatccagattgaggctgaaaattcagatcttaaggtgaacatggcccacagaacaagtcagtttcagttaatccaagaagaattgttagagaaggctagtaactcatccaaactggagagtgaaatgacaaaaaagtgtagtcagctgttgactctcgaaaaacagctagaggagaaaatagtggcttatagttccattgctgccaagaatgcggagcttgaacaggagttgatggagaaaaacgaaaagattagaagcttggaaactaacatcaacacggaacatgagaaaatttgtctcgcatttgagaaggccaagaaaatccatctcgagcagcacaaagagatggaaaaacagattgagcggctggaggcccagctggagaagaaggatcagcagttcaaggagcaagagaaaactatgtctatgctccagcaagatatcatatgtaagcaacaccacctggagtctcttgaccggctcctgacagagtccaagggagaaatgaaaaaagaaaacatgaaaaaggatgaggccctcaaagcattgcagaaccaggtcagcgaggagactattaaggttagacagctggatagcgccttggagatctgtaaggaggagctggtcctgcacttgaaccagctcgagggaaataaggaaaaatttgagaagcaactcaagaagaagtctgaggaagtgtattgcctgcagaaggaactgaagataaaaaatcattcattacaagagacatctgagcagaacgtgatcctccaacatacacttcagcaacagcagcagatgttgcagcaggaaaccattcggaatggcgagctggaagacactcaaactaagttagagaaacaagtatccaaactcgaacaggaattgcaaaaacagcgggaatcctcagccgagaagctgagaaaaatggaagaaaaatgcgagtccgcggcccacgaggccgaccttaagagacaaaaggtcattgagctgacagggactgcgagacaagtgaagatcgaaatggatcagtataaggaggaactgagcaaaatggaaaaagagatcatgcatcttaagcgagatggcgaaaataaagccatgcatctgtcccagttggacatgatcctggatcagaccaagaccgagctggagaagaagacaaacgcggtgaaggagctggagaagcttcagcacagcactgaaacagagttgactgaggctctgcagaagagagaggttcttgagacagagctgcagaacgctcatggggaactgaaatccacactgagacaattgcaagagctgcgagatgtccttcagaaggctcagctgtccctggaggaaaagtataccaccattaaagatctcactgctgagctcagggaatgtaaaatggagattgaagataaaaagcaggaacttctcgagatggatcaggccttgaaggaacgcaactgggaactgaaacagagggccgctcaagtgacacatttggacatgactatccgggagcaccgcggagaaatggaacaaaagatcatcaaactggaaggaacccttgaaaagagcgaattggaactgaaagagtgtaataagcaaattgagagtcttaatgacaaacttcagaacgctaaagagcagttgcgagaaaaggagtttataatgctgcagaatgagcaggaaatttctcagctgaagaaggagatcgagcggactcagcaacgtatgaaggaaatggagtccgtcatgaaggagcaggaacagtacatagccacccagtacaaggaggctattgacctggggcaggagctcaggctgacacgggaacaagtgcagaactcccatactgaactggccgaggcaagacatcagcaggtgcaggcccagcgtgaaattgagagactgtcgagcgagcttgaggacatgaaacagttatccaaggaaaaagacgcgcatggtaaccaccttgcggaggaactcggggcgagtaaggtcagggaggctcacctcgaagcccgcatgcaagccgaaatcaagaaattatcagctgaagtggagagcctaaaggaggcatatcatatggaaatgatttcgcaccaagaaaaccacgcgaaatggaaaatatcagcagatagccaaaagagcagcgttcagcagttgaatgagcagttggagaaggccaaattggagctggaagaggcacaggataccgtgtcaaacctgcatcagcaggttcaggatcgtaacgaggtcattgaggcggccaacgaggctctgctgactaagggcgagaacgtgtag

SEQ ID NO: 28807 - DNA, 201 bp, Artificial Sequence
  Description of Artificial Sequence: Synthetic coding sequence
atggaccctccagctcgtaaggaaaagaccaaagtgaaggaatcggtttcaagagtggaaaaagccaagcaaaagtccgcccagcaggagctcaaacaacgtcagcgcgccgaaatctacgctctgaacagggtgatgactgaattggaacagcaacaatttgacgaattctgtaagcagatgcagcctccaggcgaatag

SEQ ID NO: 28808 - DNA, 201 bp, Artificial Sequence
  Description of Artificial Sequence: Synthetic coding sequence
atggacccaccagcaagaaaggagaagaccaaggtcaaggagagcgtctcccgtgtagagaaagccaaacagaaatccgcccaacaagagctgaagcagcgacaacgtgccgaaatctatgcactgaaccgtgtgatgactgagctagagcagcagcagtttgacgaattttgtaagcagatgcagcctcccggagagtag

SEQ ID NO: 28809 - DNA, 201 bp, Artificial Sequence
  Description of Artificial Sequence: Synthetic coding sequence
atggacccccccgctaggaaggagaagaccaaggttaaagagagtgtgagccgggtggagaaggccaaacagaaaagcgcacagcaggagctcaagcagaggcagcgcgccgaaatttatgcattgaatagggttatgaccgaactggagcagcagcagtttgatgaattctgcaaacagatgcagccgccaggtgaatag

SEQ ID NO: 28810 - DNA, 924 bp, Artificial Sequence
  Description of Artificial Sequence: Synthetic coding sequence
atgctcagacactcacctagcctgtgggaacttgtggaggaacacgtgcctttgagagaaagaagagaagtcaagaggattctgggggaagcggcagtggatctaagtttagaactaagggctgaggttgctatgttacgggcattattacaggaggctaggagcagccaggctccctccagcagacctatctctgacccgtccagcctcctggctcctccccccctcctgaaggaccttctgcggcaggaattacgccaactgttacaggggttgcggcacaaagccatttgcgaaggccgtgaccaggctcaagcatgggtccagtatagccccagagtgctgcatttcgccctggaagaaccccgctgcgacctcccagaacaagagattttccagatgcgcgggggaggcccttctagtgggcatcgggacttgtcaattattaaggatcagctcaacgtgagtaacatagatcaggtggcacggcacctgcgcggattgctagaggaagagtgtcatactctggaaagggaaattctaattctccaaagatgcctcgaagaggaatatttaagaccttgccatccttcagaagcggccctggaacctaccctggcggaattgaaggagcagaagaaagccatggagcaggagctgcaggcctcagtggggccaagctgcgtgagtcctaaccataggcaacgtcccctggggtctagcacacaaggcctgcgaccccccctgcctctctgcggggtggcgcctttacagtgctgcctcccggcacctccactagagccctacctgcgcccgagagggcagtcagccacccaccgctggggcagacaactccaatgtagcccacgcgagggccctgcttccacccccatgagctctgcggcccctcaagcacctgcgtag

SEQ ID NO: 28811 - DNA, 627 bp, Artificial Sequence
  Description of Artificial Sequence: Synthetic coding sequence
atggtgttttattttacaagctcctctgtgaattccagcgcctacacaatctatatgggcaaggacaagtatgagaacgaggatcttattaagcatgggtggcctgaagatatctggttccatgttgataagctgagcagtgctcatgtctacctgcgtctgcataagggtgagaacattgaagacatacccaaggaggtgcttatggactgcgcccatcttgtgaaagccaactctatacagggctgtaaaatgaacaacgtgaatgtggtgtatactccctggtcaaatttgaagaaaactgccgatatggatgttggccaaatcggtttccacaggcagaaggatgtgaaaatcgtcacagtcgaaaagaaggtgaacgagattttgaacagattagagaaaaccaaggttgagagatttcccgacctcgcagctgagaaggagtgccgtgatcgggaggagcgaaatgagaagaaggcccaaattcaggaaatgaagaagagggaaaaggaagagatgaagaagaagcgtgagatggatgagctgcgcagctactcctcgttgatgaaggtggagaacatgtcttcaaatcaggatgggaacgactctgacgaatttatgtag

SEQ ID NO: 28812 - DNA, 423 bp, Artificial Sequence
  Description of Artificial Sequence: Synthetic coding sequence
atggattgcgcccaccttgtcaaagccaactctattcaggggtgcaaaatgaataacgtaaacgtggtctatacaccatggagtaaccttaaaaagactgctgatatggatgtgggccaaatcggtttccacagacagaaagacgtgaagattgtaaccgtggagaaaaaagtgaacgagatcctgaaccgactggagaaaacaaaagtagagagattccccgatctggccgcggagaaggaatgtagagatcgggaagagagaaatgaaaagaaggcacagattcaggagatgaaaaagagagaaaaggaggagatgaaaaagaagcgggagatggacgagttgcggtcttatagtagtttgatgaaggtggagaatatgagttcgaatcaggacggaaatgatagcgatgaattcatgtag

SEQ ID NO: 28813 - DNA, 1971 bp, Artificial Sequence
  Description of Artificial Sequence: Synthetic coding sequence
atgttcgaagccattttcccctccacccctcaggcccgactcaaacgagatccccgggagaagcctggcctgtcgagttttcggtcaacttttcggcaacagagcagcctgggactgtgtatacccaggttgatgttgcccaaggaagccagtccctcacagaggcattcctccatgtcctcttccatggcaagggcactcgtgctgctacagagcatggccagccgggacgctagatgcccagagtggaagccgcatcagaagccaaggactctgtccaaatcagtccagactatctcaagatactatcgcaagacatcagagcccaaagatgctgcatccttgacggggttcatgagtaagatggagcttagaagggtgttccctactcacccagactgcccgcaattctctacaagagccaccagtatgagccactgcggatcaccaacagaggccgacctctcaggcgagatagataatagcagcgaaacttggcggggaacccaggatctttttttggcgcgcagggggtctgatactaacgtggatgggtacctgctgccgttctcaaaatccatttgcgagtttgattacctcaggaagaggaggaagagccaaacgctttctccagtcacatcttccagtgtggcctcacaatcctgcttgcgcaaacgcatgccatggtatctgtctgtgatccacgagaaagatcattgtctgagcgaacttgaaatccaagtccagaagaaggatgaggaaatactcctgttgcaggaggagcgtgaagccttgaagatgcaactcaagtgcctgctgaaagggaagggccaggaaacttcgatgtcgccaggcaggcgagaacagctcagtgatgcaagcctcaagcttggccgattgagcctgctcaaagctttttctcgccatgaggaggagctccagcattggtggcaaatgcaggaggaatctgccgccccagagcgcgggaaggaacccgaccttggcgggggagaggaggacgagggtctggagggggaacccgatggagtggaggatacaggcgcctggggcggggtgtcacaaatgggctctgttcatgaagagggatctgaggaggaagaagaggaggaaggagaccgggatgaagatagtgaggagagagagttgcccgaggaagaagaaatccccaggagacgcgcctccagcctggctgagtctttcgaagaagaattattagcccagttagaagagtacgaacaggtgattctggattttcagttcaacctggaggccactcggacgcggtattcgctggctactggcgtgattgctagcctccagcagcaggtagactttcaagaaacacagctgcgtaaaataaacaccgagaatgaaactctgcagaaggagcttagagaacggcgtcagcagcttcaggccatgactgacaaatttagcaacctaagagaggataagaagcaccaggagatgatgggattgatcgagaaagataaccagctcttgagacagcaggtgagcgaactcgaacggaagcttactaaacgagactgcgtaatttctgaattagatactaaagtgtcccagctgcaagagcaggttgagctcgaccaaaaccatttgcagcgttggaagcagttgcaggaagacctgcagagtaagaaggaaatgatccagcaggccgaacaacacactagagtggccctggaatcaagtcagtctcggctggaaagattgcgcaacaaaataatccaggctactttcagcattagtggcacaaagtctctggccaatgaaatatccgacaatgatatcctggaggcccttcagcgaataatatcagaacgtagcgactactacaatcagctgaagcaaaaaggtgtgaaggtacctcccctgcaacagtccgaggcttttctaacctccaaatcaaagaagggcaccagcaagtag

SEQ ID NO: 28814 - DNA, 486 bp, Artificial Sequence
  Description of Artificial Sequence: Synthetic coding sequence
atgccaaagaatgctatcccagtctcaaaatcaactggattctccaaccccgctagtcagagcacgtcccagcggcccaaattaaagagggttatgaaggagaagactaaacctcagggcggcgaagggaaaggcgcccaatctaccccaatccaacactccttcctcactgatgtgtcagatgtgcaagagatggagagaggactgctaagtctgttaaatgatttccactctggtaagctgcaggctttcggcaacgagtgttcgatagagcagatggagcatgtccgcggaatgcaagagaagctcgcccgcctgaatctggaactgtatggggagcttgaagaattgccagaagataagagaaaaactgcaagcgatagcaacctggataggctgctgtcggatctggaagaactaaactcttcgatccaaaagctgcatctggctgacgcccaggacgtgcctaatacctcagccagttag

SEQ ID NO: 28815 - DNA, 825 bp, Artificial Sequence
  Description of Artificial Sequence: Synthetic coding sequence
atgcctagagctgaacccagagccacattaggtgaacaggaaaaggccgggttacctctcggggcctggagactgtacctgctcaggcacttccggaagcagaccgaactccgaagaagcggcagccgcgatgttactggagcgttgctggtagctgcagccgtcgccagcgaagcagtaggcagtcttagagtagcagagggagggcccaacacactgctgctgcaggtgttacggagttggccgtggtgcaataaagaactaaagacgatggaggaaagaaaagtgaagcgaaggtctcctaagtccttcagcgcacactgcactcaggttgttaatgctaagaagaacgccatacctgtgagtaagagcactggtttttccaatccggcgtcccagtccacatcccaacgccctaagctcaaacgtgtaatgaaggagaaaacaaaaccgcagggaggagaaggcaagggagcgcagtctacccccatccaacactcctttttgacagatgtgtccgatgttcaggagatggagaggggattgctgtcactgctgaatgactttcacagtggcaagctgcaggcctttgggaacgagtgcagtatcgaacagatggagcatgttcggggaatgcaagagaaactggccagattaaacctggaactgtacggtgaactcgaggagctgcctgaggacaagaggaaaacggccagcgatagtaaccttgacagactgctttcagatctggaggaattgaatagttccattcagaaacttcatcttgctgatgctcaagacgtaccaaatacatccgcttcatag

SEQ ID NO: 28816 - DNA, 2352 bp, Artificial Sequence
  Description of Artificial Sequence: Synthetic coding sequence
atgtcccaggagaagaatgaaatgtttgaatccgaatggagtaaggagcgtgaacgtgagaagcagctggctagcggcctcgacacagcagaaaaagctctgaaggtggaatcggaagagctccaaaagtcaaaaagcgaactgatttgcctatataatgaagtgcacaaccttccaggggaatccgagagcaaagaccactttcttatagcctgcgacttgctgcaacgcgagaacagcgaactggagaccaaagtccttaagctgagccaggagttcgctcagcttaaccatttcacactgggaggcaaaacagctccaagtaacctgattacgagcgagaatacatgtaaggatccagagagtaatgaacctattcttgagacagaaatccagagtagaaaggaagaaaccgaagagctctgccctaaactgggggagagaaaacaaaaggaaatccccgaggaaagtgtaaaagagggctcctttcctcgcgagggacaaaaagaagaaggaagccagcagaatcgtgatatgaaagatgaagaaaaagaacaacagttgacgatgaagcctgaagaaatcgtgcgcctacgtgaagaactcagtcacatcaaccagtccctgcttcagtcccagtcttcaggagattccagcgacgattccggcgcccagcaccctagttccggggaaaaactcaaatacaatcaacagggagaggtccaacagctgcatcagaatctgcaccgtctccagatcttatgcaatagtgccgagaacgagctgcgttatgagcgcggacagaaccttgacctgaagcagcacaattccctcttgcaggaggaaaacataaagataaagatcgagttgaagcacgctcagcagaagctgctggactccacaaagatgtgcagtagtcttaccgctgaatacaaacactgtcagcaaaaaatcaaggagctcgagctcgaagtcttgaagcacactcagagcatcaagtctcagaacaatctgcaggaaaagcttgtccaggagaagtcaaaagtcgccgacgcagaagaaaagattcttgaccttcagcgtaagctcgagcatgcacacaaagtttgccttaccgatacttgcatctccgaaaagcaacaattagaggagaagatcaaggaagccacacaaaatgaggctaaagtcaaacagcagtatcaagaggagcagcagaagcggaaactcctgtatcagaatgtcgatgaacttcatcggcaggttcggacactccaggataaagaaaacctgctggagatgacctgctcacaacagcagtcgaggatccaacaacaggaagcgcttctgaagcagctggaaaacgagaagcgcaaatatgacgaacatgtgaagtcaaatcaggaactgtccgagaagttatctaagctgcagcaagaaaaggaggccctaagagaagagtaccttcggttgctgaaattgctgaacgtgcacgtgcggaactacaatgagaagcaccaccagcagaaggttaaattgcaaaaagttaagtatagactaacgaacgaagtggagctgcgcgacaagagaatcaaccagtttgaagatgagataggcattttgcaacacaagattgagaaagaaaaagccattcaggaccagattacagcccagaatgatacattgctgctcgagaaacgaaaactccaggagcaagtcatcgaacaagagcagttgattcattcgaataaatggactattagttccattcagtctagggtgctctacatggataaagaaaacaagcagctacaggaaaactccctgagacttacccagcagatcgggttcctggagcggattataagaagcatacacattaggcgcggcgaaaacctgaaggaattccccgtgccgaagtggtggcacaggggaaagctggcttctctgcctccaacaaaaaaacagaaggagatttatagcacagaggtgtttacgagtaacaacgccgaactccaacatgaagacgagagcgtgcctgaggcaacagaaaaatggaagcatagcgaacagatggaaaccaccatcagtgacatactcgaatccgaagtggtgaacgagatattgccgctttctaattctagcttttcagggaaaggactggtggagagcttcgcgagcttacaggaaactgaggaaatcaaaagtaaagaggctatggctagctcgaaaagtcccgagaaatctcctgaaaacctggtgtgcagccagaattcagaagctggctatattaatgtcgccagcctcaaggaaactcatggcatacaagagcaggaccagaaatcagaattgtag

SEQ ID NO: 28817 - DNA, 2352 bp, Artificial Sequence
  Description of Artificial Sequence: Synthetic coding sequence
atgtcacaggaaaaaaacgagatgtttgagtctgagtggagcaaggagcgggaaagggaaaagcagttggcatccggattagacaccgccgaaaaggcactgaaagtcgagtccgaagaactgcagaaatccaagagtgaactgatatgcctgtacaatgaagtgcataatctccctggggaatccgaaagcaaagatcactttttgattgcctgtgatctgttacagcgtgagaactccgagctggagaccaaagtcctgaagctctcccaggagtttgcacagctgaatcattttacccttggagggaagaccgctcccagcaatctgatcacctccgaaaacacatgcaaggaccctgagtccaacgagccgatccttgagactgaaattcagtctaggaaggaggaaactgaggagctctgccctaaactcggagagaggaaacaaaaggagattccagaggaatcagttaaggaaggttcctttccccgggaaggccaaaaggaagaaggcagtcagcagaaccgagacatgaaggacgaggaaaaggagcagcagttgaccatgaaaccagaggagatcgttaggcttcgagaagaactgagccacatcaaccagagtctcctgcagagtcaatcatccggagacagcagcgacgactcaggtgctcagcacccatcgtccggcgaaaaactgaagtacaatcagcaaggtgaagtgcagcagctgcaccagaacctccatcggctacaaattctctgcaactcagccgagaacgagctgagatatgagcgcgggcagaatctggacttgaaacaacacaacagcctcctccaagaagagaacatcaaaatcaagatagagctcaagcacgctcagcagaaactcctagactctactaaaatgtgcagttcgctgaccgccgagtacaaacactgccaacagaaaatcaaagaattggaactggaagtgttgaagcacacacaatctattaagagccaaaacaatctgcaagagaaactcgtgcaagaaaaaagtaaagtcgccgatgccgaagaaaaaattctggatctgcagcgcaaattagagcacgcccataaggtctgcttgaccgatacatgcatttcagaaaaacagcagctggaagaaaagatcaaagaggcaacacaaaatgaggccaaggttaagcaacagtatcaggaggagcaacagaagcgtaaacttttgtatcaaaacgtcgacgagctccacaggcaggtacgaactctgcaagataaggagaatctgctagagatgacatgtagccagcagcagagcagaatacaacagcaggaggccctgcttaagcagttagaaaacgaaaagcgaaagtatgacgagcatgtgaagtccaaccaagagttgagcgagaagctctccaaactccagcaggagaaggaagcccttagggaggagtaccttagactgctaaaacttctgaacgttcacgtgcggaattataacgagaagcaccatcaacagaaggtgaaactgcagaaggtcaaataccgccttacgaacgaggtggagctgagagataaaagaatcaaccaatttgaggatgagattgggatcttacagcacaaaatcgagaaggaaaaggccatccaggatcagatcaccgctcagaacgatacgctgcttctagaaaagcggaagttacaagagcaggtaatcgaacaggaacagcttatccatagcaataagtggacaatcagtagcatccagagtcgcgttttgtacatggataaggagaataagcagctgcaggaaaactcactgcgacttacccaacagattggttttttggaaaggatcatccggtcaattcatatacgaagaggcgaaaacctgaaagaattccctgttcccaaatggtggcatcgagggaaactggcctccctgccaccaaccaaaaaacagaaagagatatatagcacagaggtgtttacctcaaacaacgctgaactgcaacacgaagatgaatcagtccccgaagcaacagaaaagtggaagcacagcgagcagatggaaactaccatttccgacattcttgagtccgaggtggtgaatgagatcctgccgttgtcaaactccagcttctctggaaagggcctggtggagagctttgcctcccttcaggaaaccgaagaaattaaatccaaggaagcaatggcctcttcaaaatcaccggaaaagagcccggaaaacctcgtttgtagccagaatagcgaggccggttatatcaacgttgcctctctcaaggagacccatggcattcaggaacaggaccagaagtcggagctgtag

SEQ ID NO: 28818 - DNA, 1719 bp, Artificial Sequence
  Description of Artificial Sequence: Synthetic coding sequence
atgatccacccccctcgccctccaaaagtgctggggctgcaacacccgtcatccggcgaaaagctcaaatataatcagcaaggcgaagtccagcagctccaccagaaccttcaccggctccagatcctatgtaattccgcggagaacgagctcaggtatgagagggggcaaaatctggacttaaagcagcacaacagcctgcttcaagaagagaatatcaaaatcaagatcgagctcaaacacgctcagcagaaacttctggacagcactaagatgtgctctagcctcacagcagaatacaagcattgccagcaaaagattaaggagctggaactcgaagtacttaaacacacacagagcattaagtcccagaacaacctacaagagaaattagttcaggagaagtccaaggtcgctgacgctgaggaaaagatcctcgatctgcaacgcaaattggagcacgctcataaagtgtgtcttacagatacatgcatttccgagaaacagcaactggaggaaaagatcaaggaagctacacagaatgaagcgaaggtgaagcagcagtatcaggaggaacagcagaagcggaaactcctgtaccaaaatgtggacgagctgcacaggcaggtacgcacgctacaggataaggaaaaccttttagagatgacttgttcacagcagcagagtaggatacagcagcaagaagccttgctgaaacagctggaaaacgagaagcggaagtacgatgaacatgtcaagagtaaccaagaactatctgaaaaactttccaaactgcagcaggagaaagaggccctgcgggaagagtatctgcgcctcctgaaacttctgaacgtccacgtgagaaactacaacgagaaacaccaccagcagaaggtgaagctccagaaagtgaagtatcgccttaccaacgaggtcgagctaagggacaaaagaatcaatcagttcgaggatgagatagggatattgcagcataagatagaaaaagagaaggccattcaggaccaaatcacagcccaaaatgacactctgctcctggagaagcggaagctgcaagagcaagtaattgagcaagaacaactgattcatagtaataaatggaccatcagctccattcagtccagagtgctgtacatggataaagaaaacaagcaactgcaggaaaattcccttagactgacacagcagatcgggtttctggagcgtattattagatcaatccatataagacgcggagaaaaccttaaggagttcccagtgcccaagtggtggcacaggggcaaactggcctctttgccgccaacaaagaagcagaaggagatctactccacagaggtgtttacatccaataacgcggagctccagcatgaagacgagagcgtgcccgaagcaactgagaaatggaaacactccgaacaaatggagacgaccatctcagatatcctcgaaagtgaagtggttaacgagattctacccctgtcaaattccagcttttctggtaagggtttagtggagagcttcgccagcctgcaggagacggaggagattaaatccaaggaagccatggcctcttccaagtctccggagaaaagccctgagaacctggtctgctctcagaactccgaggctggctacatcaacgttgcctcccttaaggaaactcacggaatccaagaacaagaccagaagtcagaactctag

SEQ ID NO: 28819 - DNA, 2352 bp, Artificial Sequence
  Description of Artificial Sequence: Synthetic coding sequence
atgtcccaggagaaaaacgagatgttcgagagcgagtggtcaaaagagcgagagagagaaaagcagttagcatctgggctggataccgctgaaaaagccctcaaagtggaaagcgaagagctacagaaaagcaaaagtgagctgatctgtctctataacgaggtgcataatcttccaggggagtcagagtcaaaagatcactttcttattgcatgcgatctgttacaacgtgaaaactccgagcttgaaactaaggtgctcaaactgtctcaggaatttgctcagctaaaccacttcacgctgggcggaaagacagcaccttctaatcttatcacatcagagaatacctgcaaggatcccgagagcaacgaaccaatcctcgagactgagattcagtccaggaaagaggagactgaagaactctgtcctaaactcggcgagcggaagcagaaggagattcccgaagaatcagtgaaggagggcagcttcccccgggaaggacaaaaggaagaaggctcacagcagaaccgggacatgaaagatgaggagaaggaacagcagctcaccatgaagccagaggagattgtccgcctccgagaagagctgtctcacataaatcagagcctgctccaatcccaaagttctggcgactccagtgatgacagtggcgcacagcacccatcatccggggagaagttaaaatataatcagcagggagaagtgcagcagctgcatcagaatctgcaccgtctgcagattctgtgcaatagcgccgagaacgaactcaggtacgagcgcggacagaatttggaccttaagcagcataactcactcctgcaggaagagaacataaaaatcaaaatcgaactgaagcatgctcagcaaaagctgcttgatagcaccaagatgtgttcgagcctcacagccgagtacaagcattgccaacaaaaaattaaagaattagagctggaggtgctgaagcacacacagagtattaaaagccagaacaatctgcaggagaaacttgtgcaagaaaaatcaaaagtcgccgacgcggaagagaagatactcgacctgcaaagaaagctggaacatgctcacaaggtgtgtctgacagatacgtgcataagtgaaaaacagcagttagaggaaaaaatcaaggaagcaacacagaacgaagccaaggtgaagcagcaataccaagaagagcagcagaaaagaaagcttctctatcagaatgtggacgagctgcaccgccaggtccgcaccctgcaggacaaggaaaatctcctagaaatgacgtgttcgcagcaacagagtcgaatccagcagcaggaggcactactcaaacaactcgaaaacgagaagcggaagtacgatgagcacgtgaagagtaatcaggagctgtcggaaaagctgtccaagctgcaacaagaaaaggaagccctacgcgaggaatacctgaggcttctgaaattgctgaacgtgcatgtccgcaactataacgaaaaacatcaccagcagaaggtgaaactgcagaaagtcaaataccggttaaccaatgaggtggagctgagagataaacggatcaatcagttcgaagacgaaattggaattctgcagcacaagatcgaaaaggaaaaagctatccaagatcagatcacagcgcaaaatgacacattgttactggagaaacgaaagctgcaagaacaagttatagagcaggagcaattgatccatagcaataagtggactatatcgtcgatccagagtcgcgtcctgtatatggacaaagaaaataaacagctacaggagaatagtttgcggttgacacagcagatcggcttcctcgaaagaatcatcagaagcatccacattagacgaggggagaacctgaaagagtttcccgtgcccaagtggtggcacagaggaaagctggcaagcctccctcccactaagaagcagaaagaaatctacagcaccgaggtcttcaccagcaacaacgctgaactgcagcacgaagacgagtctgtgcctgaggctacagagaaatggaagcattccgaacagatggagactactatatcagacatcctagaatctgaggtggttaatgagatcctgcccctgagcaacagtagtttctctggtaaaggcctggtagaaagtttcgcaagtctgcaggaaactgaagaaattaagtccaaggaggcgatggccagctctaagagccctgaaaaatctcctgagaatcttgtgtgtagccaaaattctgaggcgggctatattaatgtcgcttccctgaaggagacacacggcatccaagagcaggaccagaagtctgagctatag

SEQ ID NO: 28820 - DNA, 120 bp, Artificial Sequence
  Description of Artificial Sequence: Synthetic coding sequence
atgtctcaggaaaagaatgaaatgtttgaatcggagtggagcaaagaacgcgagagagagaagcagctggcctcaggcttggataccgccgaaaaggccctaaaagtcgaatctgaatag

SEQ ID NO: 28821 - DNA, 1104 bp, Artificial Sequence
  Description of Artificial Sequence: Synthetic coding sequence
atgggcgagcccgggcccccaagcccaccagcccctaaagcggcaccgggcctgattgatagcttttcagagatgaataactacaggcgcgcgatgcaaaaaatggccgaggacatcctgagcctacggaggcaagcctccatcctggaaggagaaaatcggattctacgaagccggctcgctcagcaggaggaggaggagggacagggaaaggcctctgaagcccaaaacacagtttctatgaaacagaaactattgttgagtgaacttgacatgaaaaaactgcgcgatcgagtgcagcacctccagaatgaactgataagaaaaaacgacagagaaaaagagctgctcctgctctaccaggctcagcagccccaggcggcactcctgaagcaatatcagggaaaactgcagaagatgaaagccttagaggagacagttcggcatcaagagaaggtaatagaaaaaatggagcgcgttctggaggatagactgcaggataggtcaaaaccgccaccactgaatcgccaacagggaaaaccctatactggcttccccatgctgtctgcttcgggcctccctctggggagtatgggggaaaatttacctgtcgaattgtacagtgttttgctggctgagaatgccaaactccgtacagaactcgataaaaaccgacaccagcaggcaccgataatcctccagcaacaggccctgccggtggaccccggtgagctgggggcggggggtgatctcacagaaagactacaggaaactcacggacctggccattctgagtgtacggagacccttccagctcaggatctactcagtgggactagcgacaaatttaatctgctagccaagctcgaacacgcacaatctagaatactgagtttggagtctcaactggaggacagcgctcgacggtgggggagggagaaacaggatctggctacgagacttcaggagcaggagaaaggctttaggcatccttctaactcgatcattattgagcagccagtcagcgatccccccggggtcgcaccgcgtggcagcggggggggggccggatcccataggacccctaaggtaactggtccatag

SEQ ID NO: 28822 - DNA, 3072 bp, Artificial Sequence
  Description of Artificial Sequence: Synthetic coding sequence
atggcctttcggggacccgagccatgggttagtgctagtcttctgcggcaaagacttaaagcagaagagaagactctggacctagagtttgaggtgctgtcagtcggcttcaacgaagctggacggtacgcattgagattaagcgccgaaaatcccttacaagtgggttctggcgcaggtgtgcagctgcaagtgaatgacggggatccattccctgcatgcagtgccataactgacgtcatcgaacagcaagaaccgggtcaaagtttaaccctcacccggagtaaatttatctttacattacccaaaggattttgtaaaaatgacggtcaacacgatgcccagttacatgttgaggcgctgagactagatgaacccctagggcgcgccgcccagcgcgtcggagaagccatctttcccatatacccacggcccgatcagccccgaatgaacccaaaagcgcaggaccacgaggatctttacagatactgcggtaacctagcactgctgcgagcttctacagatcctactgccagacactgtggctctctggcgtattctgtggcatttcacgttcatcggggacctcagccgcccgttagcgacagcccacctcgtgccgggcagcctgagttaatttctcccgaggaacccctcattgcaagccagtctacggagcctgaaataggacacttgtcaccctcaaaaaaagagaccattatggtgaccctgcatggcgcgaccaatttgccagcctgcaaggatgggtccgagccatggccttatgtggtggtgaaatctacatctgaagagaagaacaaccaaagttcgaaggcggtgacttctgtcacttctgagccaacgagggcaccaatttggggcgacaccgtgaacgtagagatacaggcggaagacgccggacaggaggatgtgatacttaaggtcgtagacaaccggaaaaagcaggaactgctttcttataagatcccgatcaagtatttgagggtgtttcacccataccactttgagctggttaaaccaacagagagcggcaaggccgatgaagccactgctaagacccagttatatgccacggtggtgcgcaaatcgagctttattccgaggtatatcggctgtaaccatatggccctcgagatttttttgcgtggtgtgaacgagcccttggcaaataatccaaaccccatcgtggttatcgcgcgcgtcgtgccgaactataaggagttcaaggtctcacaggctaaccgggatctagcatcagtagggctgcctatcacaccactgtccttccccatcccatctatgatgaatttcgacgtccccagggtgagtcagaatggatgtcctcagctgagcaagcctggcggtccacccgaacagcctttatggaaccagtccttcctgtttcagggccgcgacggggctacctcatttagtgaggatactgcactcgtgctcgaatattacagttcaacaagcatgaagggatcacagccatggactctcaaccaaccactaggaataagcgtgctgcctcttaagagcaggctataccaaaagatgttaaccgggaaaggtctggatggtctgcatgtcgaaagactgcctattatggatacatcactgaaaacgatcaacgacgaggcacctactgtggccctttcctttcaactgctgtcctccgagaggcctgagaactttttgacccccaacaattctaaggctctgcctaccctggatcctaaaatccttgataaaaaactccggaccattcaggaaagttggtcaaaggacacggtcagttcgactatggacctgtccacctctacccctcgggaagcagaggaggaacccttggtgccggaaatgtcccacgacacagaaatgaataattacaggcgagctatgcaaaaaatggccgaggacattctcagcctgcgcagacaggcatctattctcgagggagagaataggattctgagatcacggctggcccaacaggaggaagaggaaggccaaggtaaagcatcagaggcccaaaacaccgtgagcatgaaacagaagctgttgctgtcagagcttgatatgaagaaactgcgggaccgagtgcagcatttgcagaatgagctcattaggaagaatgatcgagaaaaagagctgctgttgttataccaggcgcagcagccgcaagccgccctcctgaagcagtaccagggaaaactccagaagatgaaggccctcgaggagaccgtgagacaccaggagaaagtgattgagaaaatggaaagagttttagaggatagattgcaggataggagcaaaccgcctccacttaatagacagcagggaaagccctataccgggttccctatgctctcagcttctggactgccactgggctctatgggtgaaaatctgcctgtggagctctactccgttctcctcgcggaaaacgcaaagcttaggactgagcttgacaagaataggcatcagcaggctccaatcatcctccagcagcaggctcttccggtagacccgggagaactgggcgctggaggagatttaactgaaaggttacaggagactcacggaccaggacactctgaatgtaccgagacactacccgcccaggatttgctgtctggcacctcagacaagttcaatctgttggctaaacttgagcatgctcagagccggattctctctctggagagccagctagaagattccgccagacgttggggccgggagaagcaggacctggccaccagactgcaagagcaggagaaagggttccgtcacccaagcaacagcatcatcattgagcagcctccatactctttaccccccgcccctggtgcctccatctttgggaaaccgagagccaccgttgaccccggagggtggcgcgaggaggcttttcaatcccgcgggcagggcgacggccctttacctgacccagagaagaagcaggggcatcaacgcccagcccttttaggtaatacgagagaggcatgtcccttccacctgccccagaacatatatcacgtgtag

SEQ ID NO: 28823 - DNA, 2268 bp, Artificial Sequence
  Description of Artificial Sequence: Synthetic coding sequence
atgggcctcaaaaacaagaagaatactgaggaccctgaggaaccactgatcgcgtcccaatctaccgagcccgagatcggccacctgagtcccagcaagaaggagactatcatggttacactgcacggggcaactaatctgcccgcttgtaaagatggatccgagccctggccctatgttgtggtgaaaagcacctctgaagaaaaaaataatcaaagtagcaaagccgtgaccagcgtgacctcagaacctactcgggcccctatttggggtgacacagtgaatgtggagatccaagcagaagatgctgggcaggaggacgttatattgaaagttgttgacaaccggaaaaaacaagagctactgagctataaaattcccattaaatacctgagggtttttcatccgtaccattttgaactagtaaaaccaacagagagcggtaaagccgacgaggcaaccgccaaaacacagctatatgctaccgtggtgcgtaagagctcattcattccccgttacatcgggtgtaatcatatggccctggaaatcttcttgaggggtgtgaacgagcccttagccaacaaccctaacccgatcgtggtcatcgctcgcgtggttccaaactacaaggaatttaaggtttcccaggccaatcgcgacttggcctctgtggggctgcctatcacacctttaagttttcctatcccctctatgatgaacttcgatgttcccagagtcagtcagaacggatgtcctcagctgagtaagccagggggaccccccgaacagccactctggaaccagtcctttctctttcaagggagggacggagccactagcttcagcgaggataccgccctggtgctggagtactatagtagtacaagtatgaaaggctctcaaccgtggactcttaaccaacctctgggaatctctgtgctgccgctaaaatctagactgtatcagaagatgcttacagggaagggcctggacgggcttcacgtcgaaaggcttcccatcatggacaccagcctgaagactatcaacgacgaagcccccaccgtagcactatcatttcagttgctgagctctgagagacctgagaactttttgacacctaataattccaaggctctgccaacgctggaccctaagatcctggataaaaagctccgcaccattcaagaaagctggagtaaggatacagtgagttctaccatggatctcagcacctctactccaagggaagcagaagaagagcccctggtgccagaaatgtctcatgacactgagatgaataattatcggcgtgcaatgcaaaagatggcagaagatattctgtcactccggcgacaggcgagtatcttagagggggagaacagaatcctgcgttctagactcgctcagcaagaggaagaggaaggtcagggtaaggcgtctgaagctcagaacaccgtgtcaatgaaacagaagctgttgctttcggagcttgatatgaagaagttacgcgaccgtgtccagcacctgcagaatgagctgattcgtaaaaatgaccgagaaaaagagctgctgctgctttaccaagcacagcagcctcaggctgctctactgaaacagtaccaagggaagctgcagaaaatgaaggcactcgaagagacagtcagacaccaagagaaagtaattgaaaaaatggagagagtgctggaggataggctacaggataggagcaagccgcctccgctcaacagacagcaggggaaaccttatactggctttccaatgctgtccgccagtggtctgcctctgggcagtatgggagagaaccttcccgtcgagctctactcggttctccttgccgaaaatgctaaattgagaaccgagcttgacaagaaccgccaccaacaagcccctataatcctgcagcagcaagcgctccccgatctcctgagcgggaccagtgataaatttaacctgcttgccaaactggaacacgcacagagtagaattctaagcctggagtcacagctcgaagattcagcaaggcgctggggccgggagaaacaggatctggccactcgcctgcaagagcaggagaaagggtttagacacccttctaattccataattatagaacagcctagcgctctcacgcacagcatggatctcaaacagccgtccgaactggagcctttgttgccttccagcgattcgaaactcaataaacctctgagtccacagaaagaaaccgccaatagtcaacaaacctag

SEQ ID NO: 28824 - DNA, 1002 bp, Artificial Sequence
  Description of Artificial Sequence: Synthetic coding sequence
atgggggaacctggcccaccaagtcccccagcccccaaagccgcacctggcctgatcgattcctttagcgagatgaataattacagaagagcaatgcagaagatggcggaggatatactgagcctcagacgacaggcttctatacttgagggggagaataggatactgcgtagccgcctggcgcagcaggaagaagaggagggccagggaaaagctagcgaggcacagaataccgtttcaatgaagcagaagctgcttctgtccgagctcgacatgaagaagctccgcgatagggtccagcatctgcaaaacgagctgatccgtaaaaacgacagagagaaagaactccttctgctttaccaggcccagcagccccaggccgccctgctcaagcaatatcaaggcaagctgcagaagatgaaagctctggaagaaactgttagacatcaggagaaggtgatcgaaaaaatggagagagtgcttgaggatcgcctccaagacaggagtaaacctcctccccttaatagacagcagggaaagccatacaccggcttccccatgttatctgcaagcggactgcctctgggctctatgggtgaaaaccttcctgtcgagttgtactcagtgctcctagccgagaacgccaagctgagaactgagctcgataagaaccggcaccaacaggcccctattattctgcagcagcaagctcttcctgacctattgtcaggcacaagtgataagttcaacctgctggccaagctggagcacgctcaatcgagaatccttagcttggaatcacagctggaggattcagcccgaagatggggacgggagaaacaggacttagcgacgagactccaagagcaggaaaaaggcttcaggcacccatccaatagtataataattgaacagcctgtatcggatccgccgggtgtggcaccccgcggcagtggaggcggggcggggtctcataggactcctaaggtaaccgggccatag

SEQ ID NO: 28825 - DNA, 1785 bp, Artificial Sequence
  Description of Artificial Sequence: Synthetic coding sequence
atgaacttcaacgtgtggaatattaaggaaatgctaagtatcccttcaggttccgggaataagaaatcctcgaattggaataacaatcaaaacgactatagttctttgtcagattcccaattcctctttggctcccagttttgccctgagaatagtgaaacactctccgctcccctggacttcggtgctcacctcaggcatagtaagcaaagtcagcagaactatctcgagggcgaacctagtatatttaccaagtatcagacaaagccccaactgtttggcggggacatcaaggatggtggcctcttcccacccccactgagtgttggtaaatccaaagggctgctagaacagttcgaggagaaaaaaaagagggccaaggataagtgcgacagcgagacgttgtataatttcgtttccaacgtccgggaaagcatcttgaggctccaaacgtccgttgagaaatccgaggaccatcttagcagtaggtctcagtccattttggactctctcgagacagttgcaaaaacactacaggagacaatccaggcacagaacgacttggtttttgaggcggttcaggataagggaaatatggagcaggcaatcctagagatgaagaaacggtttgaagcccgtcaaggtgaatttattgagatgaaatcaaatctcaaacatttggaagtgctggtcgcacagcagtctcaagagtttcagcaactttgtgaacagctgggtcagctgaacgtcccatctgtgctcgcagaacttaaacgccttatctccgtgcctccagtcaaagacagtgcttcacagacaagtccacctttagctcagtctctgaatctgacgagacaagagaaatacacaagtgaaaagcccgttctttggcaagcacaggctctccccgcagcatggaaccctgggatgggaagtctgcagccaggtgaatttgacgtctggggagaaggcgccaagaatgacgacctccaagaggaggcggcactcccggctttcggtagccacgagcggaaccggcatgtaaaggataaagtcgtgcagacaaattgcaaaaattgggcagtcactaaaacaggcgctaagaatcacggcagttctgtgcccgggcataagattccatccgaccgtgacctggtctcacagggagccagtcagctaactagtttagaaataaacttttcgactagtattaagaacgcgtgccaaaagtaccaggcgcagtcaatgttcctgtgtgacccacgcgaacatcttgtcattaagcagaaagacggcaccgtagagatgaggggtaaagataaaaagcaacaacctcgcaaggcccaccgagctcatagaggccggctgatcgcttcgaagcagaaacagatcccaattcagacttgcaaattcaattctaaataccaatccccgcaaccagccattagtgtcccccaatccccctttctgggtcagcaggagcctagagctcagccactgcacctccagtgtccacgttctcctcgaaaaccggtgtgtccgattctcggagggactgttatgccaaacaagaccgtgcgagcagtccagggccgccttctgcagctgtcaagatgctcgagtcaggacaactggttactttcatcatccagccagggggatcaccagatgagctggttctccgacctgaaccttgggtgtagtgagacacctctgtgtaaagaggccgggaaaaatctcttgtatgatctcgggttcgactcaagcgacgatgacggtttctag

SEQ ID NO: 28826 - DNA, 1725 bp, Artificial Sequence
  Description of Artificial Sequence: Synthetic coding sequence
atggcccgggtcgacgcgaaagccaaggaggccccgagggcttctgaggggtgtcagcatgcagttacatcccagcgcaacaagaagagctcaaactggaataataatcaaaatgactacagcagcctctcagactcgcagtttctattcgggtcccagttctgtcccgaaaactctgaaaccctctcagctcctctggattttggcgctcacctccgacacagcaaacagagccagcagaactatctcgagggggaacctagcatatttaccaagtaccagactaagcctcagttcgaggaaaaaaagaagagagcgaaagacaaatgcgacagcgaaacattgtacaattttgttagcaacgtaagagaatccatccttagattgcagacatctgtggagaaatctgaggatcacttgagtagtcgcagccaatctatattggacagtctggagacagtggccaaaactctgcaagaaacaatccaagcgcagaacgacctcgttttcgaagcagtccaggataaaggcaacatggagcaggccattctcgagatgaagaaacggtttgaggctagacagggagaattcattgagatgaaaagcaacctgaaacacctcgaggtgctggtggcgcagcagagccaggagtttcagcagttatgcgaacagttggggcagctaaacgtgccttcagttctcgctgagcttaaaaggttgatatcggttccccccgtgaaagacagtgcttcccagacaagccctccgctggcccagtcattgaacctgacccgccaagaaaagtacactagtgagaagcccgtactttggcaggcgcaggctttaccagctgcttggaacccaggcatgggctcccttcaacccggcgaattcgacgtgtggggcgaaggcgcgaagaatgacgatcttcaggaagaggctgccttacccgcctttggatcacatgagagaaaccggcatgtcaaagacaaggttgtgcagaccaattgcaagaactgggccgtcactaagacaggcgctaaaaatcacggaagctctgttccggggcataagatccccagtgaccgagacttagtctctcagggcgcttctcaactgaccagcttggagatcaacttcagcacatccatcaaaaatgcctgccagaaataccaagcacaatcaatgtttctttgcgaccctcgcgaacatctggttatcaaacagaaggatggtactgtcgaaatgcgtggaaaggacaaaaaacagcagccccggaaagcccatcgggcccacaggggccgcctcatcgccagtaagcagaagcagattcccattcaaacatgcaagtttaactctaagtatcaatccccacaacccgccatcagcgtcccacaatcccctttcttaggacagcaggagccacgggcccagccactgcacctgcagtgtccgcgtagtccaaggaaaccggtatgcccaatcctgggtggcacagttatgcccaacaaaaccgtccgcgccgttcaaggcagactactccagctgtcacggtgtagcagccaagacaactggctgctgagctcttctagccagggcgaccaccaaatgagctggttttctgacctgaacctcgggtgttctgagacccccctctgtaaggaggcggggaaaaatctgctttacgacttgggattcgattcttctgacgatgatggcttctag

SEQ ID NO: 28827 - DNA, 612 bp, Artificial Sequence
  Description of Artificial Sequence: Synthetic coding sequence
atgaacttcaatgtctggaatatcaaggagatgctcagtatcccgagtggaagcggtaataagaaaagcagcaactggaacaataatcaaaatgattacagctccctcagcgactcccaattcttgtttggctcgcaattttgtcccgagaattccgaaaccctcagcgccccgcttgatttcggagcccacctgcggcactctaagcaatcgcagcagaattatcttgaaggcgagcccagcattttcactaaataccaaactaagccccagctgtttggtggggacataaaagatggtggactattcccacccccgctctccgtgggtaaatccaagggcctactcgaacagttcgaggagaagaaaaaacgggcaaaagataaatgtgacagctgccgacgcctctggaagtcactcagaacgatcagtgttcaggaagccaacctgttctggatcttatggcgcctatggccgcgtcacgtgtctgcatcatgtttgagatatcagcagcgcgccctggttaatgacgaacatgaattaagcgacccatccttggtgtccagcggcgaagtgccacatagagtaagtgacgagagaatggggatttag

SEQ ID NO: 28828 - DNA, 1785 bp, Artificial Sequence
  Description of Artificial Sequence: Synthetic coding sequence
atgaactttaatgtctggaatattaaagagatgctgtccatcccgtctggatcgggtaataaaaaatctagcaactggaataacaaccagaacgattatagctcactgtctgatagtcagtttctcttcggcagccagttctgccctgagaatagtgaaacattgagtgcccccttggacttcggcgctcatcttaggcacagcaagcaaagccagcagaattatctggaaggggagccaagtatcttcactaagtatcagaccaaaccacagctgttcggtggtgatattaaggacggggggctgtttccgccccccctcagcgttggaaagtcaaaaggactgctcgagcagttcgaggagaagaaaaaaagggccaaggacaagtgcgattcagaaaccctgtacaacttcgtctccaatgtaagggagagcattctcaggctccagacttctgtcgagaaatcggaagatcatctgagcagcagaagtcagtctatcctggattctctggagactgtggcaaagaccttacaggagactattcaagcccaaaacgatctggtgttcgaggcagtccaggataagggtaacatggaacaggcaattctggaaatgaagaaaagattcgaggctaggcagggcgagttcattgaaatgaaaagcaatttgaaacatctggaagtgctggtcgcgcagcaatctcaggaattccagcagctgtgtgagcaattgggccagctcaacgttccttcagtcctcgccgagctgaaacgactgataagtgtacccccggtcaaggatagcgcgagccagacatccccaccactagcacagagcctcaacctgacccggcaggaaaaatatactagtgaaaagccagttctgtggcaagcccaggcgctgccagctgcctggaaccccgggatgggcagcttgcagcctggagagtttgacgtgtggggcgagggagctaagaatgacgacctgcaggaggaggccgctttacccgcttttggctcacacgagcggaaccggcacgttaaagacaaagtggtccagactaattgtaagaactgggcagtcactaagactggggccaaaaatcacggctcatccgttcctgggcacaagatccctagcgaccgcgatctggtgtcccagggagctagtcagctcacatctctggagataaacttttcaactagcataaaaaatgcctgtcagaaatatcaggctcagtccatgttcttatgcgacccccgggagcacctcgtgatcaagcagaaggatggtacagtggagatgcgggggaaggacaagaaacaacagccacgcaaagcacatagggctcacaggggacgtctgattgccagcaaacagaagcaaattcctatccaaacttgcaagttcaattctaaatatcagtcaccgcaaccagcaatctcagtgccccagtcaccattcctgggacagcaggaaccacgggcacagcccttacacctgcagtgtcccaggtctccccggaaacccgtgtgccctattctcggcggcaccgtcatgcccaataagaccgtgagggcggttcaagggcgcctgctgcagcttagccggtgcagttcacaagacaactggctgttaagctcctccagccagggggatcaccagatgtcctggtttagcgatctgaatctgggctgttcagaaactccattgtgtaaggaggcaggtaaaaatttactgtacgacctgggttttgatagttcagacgacgatggtttctag

SEQ ID NO: 28829 - DNA, 582 bp, Artificial Sequence
  Description of Artificial Sequence: Synthetic coding sequence
atgctgagtacacccaaatcacagggtaacaagaagtcctcaaactggaacaacaaccagaatgactactcttcactgagcgactcacagttcctcttcgggagccagttctgccccgaaaacagtgaaactttgagcgcccctttagatttcggagctcatctgcgccactccaagcaaagccagcaaaactatctggaaggtgagcccagcatctttacaaagtatcagaccaagccacagctgttcgggggcgatataaaggatggcggactttttccaccacccctctctgttggcaaatctaagggcctgctggaacaatttgaagaaaagaagaaacgcgcaaaagataaatgtgatagttgccgacggctgtggaaaagtttgagaaccatctccgtccaggaggctaacctgttctggatactgtggcgactgtggccaaggcatgtgagcgccagctgcctgaggtatcaacagagagctctcgtaaatgatgagcatgagttgagtgatcccagtttggtgagttctggtgaggtaccacacagagtctcagacgaacgtatgggaatctag

SEQ ID NO: 28830 - DNA, 1785 bp, Artificial Sequence
  Description of Artificial Sequence: Synthetic coding sequence
atgaatttcaatgtctggaatattaaagaaatgttgagtattccatcaggctccggcaacaaaaaatccagcaattggaacaacaatcagaatgactactcctctttgagtgatagtcagtttctgtttggaagtcagttctgtcccgaaaacagcgaaacactgtcggcccccctcgactttggcgcccaccttcgtcactccaaacagtcacaacagaattatttggagggggagcctagcatcttcactaagtaccaaactaagccacagctatttgggggagatatcaaagatggcggattgtttccccctcccctcagcgtgggtaaaagcaaaggcttgcttgagcagtttgaagagaaaaaaaagcgggcaaaggacaagtgtgactccgagacattatataacttcgttagcaatgtgagagagagcatactgaggttgcagacttctgtggagaagtctgaggaccacctgtcctccagatcccagtccatactcgacagcttggagactgttgctaagacgctgcaggaaaccattcaagcccagaatgacctggtctttgaggctgttcaggacaaaggtaacatggagcaagctattctggaaatgaaaaaacgctttgaagcaagacagggtgagttcattgaaatgaagtccaatctgaaacatctggaggtgctggttgcacaacagtcacaagagttccaacagctttgcgaacagctagggcagctgaacgtcccctcggtcctggcagagctgaagcgtctgatctccgtcccacccgtcaaagactcagccagccaaacctcccctcctttggcacaaagcctgaacctgacgcgccaagaaaagtataccagcgagaaacccgtcttatggcaggctcaggcattgccggcagcttggaaccccggaatgggcagtcttcagcctggggaatttgacgtctggggggagggtgcgaaaaacgacgacctacaggaagaagctgccctgccggcctttggtagtcatgaacggaaccgccatgtgaaggacaaagtcgttcaaacgaattgcaaaaattgggccgtcactaagaccggtgcaaaaaaccatgggtcttccgtgcccggccacaagatccctagtgatcgggacctcgtgtcacagggagccagccagctgactagtctggagatcaattttagcacttctattaagaatgcctgccagaaataccaagctcaatctatgttcttatgtgatcctcgcgaacacctggttataaagcagaaggacggcactgtagagatgaggggtaaggataaaaagcagcagcccaggaaagcccaccgcgcacatcgcggccgccttatcgcctctaaacagaaacagattccaatacaaacatgcaagtttaattccaaatatcaatctccgcagcccgccatctctgtgccgcagagtccttttctgggtcagcaggaacctcgtgcccagcctctgcacctgcagtgtccgcgctcccccagaaaacccgtttgtcccatcctaggcggaacagtgatgcccaacaagacagtgcgcgcagtgcagggtcgactgttgcagctctctcgctgcagctcacaggataactggttgctgtcaagttcaagccaaggcgatcaccagatgagctggtttagcgatctcaacctgggatgctccgagacccctctgtgcaaagaggctggcaagaacctactttatgacctaggattcgactcctctgacgatgatgggttttag

SEQ ID NO: 28831 - DNA, 1836 bp, Artificial Sequence
  Description of Artificial Sequence: Synthetic coding sequence
atgagcgagatccctagcaccatcgtgtccaagaacatgactaatgataagaattccttggagtctatgaacatctcctctagcagttctacagaggaaaatcctaagaaacaagccaggaagaatgaagagcacgggccggatccatccgcgaatccattccatctgtccggcgatgtcgacttttttctactcagggaccaggaacgcaacaaggctcttagcgaacggcaacagcagaaaacaatgagggtgcatcaaaaaatgacctacagttctaaagttagtgccaagcacaccagcctccggcgtcaactgcagctggaagataagcaagaagacctggaagctcgcgccgaggccgagcaccaacgcgccttccgtgattacactacgtggaagctaacgttaacgaaggaaaagaacgtggaaccagagaatatgtctgggtatatcaagcaaaagagacaaatgttccttctccagtacgccctggatgtgaaaaggagagagattcagcggctggagactctggcgactaaggaggaagctagactggaacgcgctgagaagtctctcgagaaagacgccgccctgttcgatgagttcgtaagagagaacgactgttcctcagtgcaagctatgcgagccgcggagaaggagacaaaagcgaagatcgagaagattttggaaattcgcgatctgacaactcaaatagtcaacattaaatctgaaatctctcgctttgaagataccctgaagcattataaggtgtacaaagactttctctataaactgtctccaaaggagtggttggaagaacaggaaaagaaacactctttccttaaaaaagccaaggaggtgagcgaggcctctaaagagagcagtgtgaacagcacccctggtgataaaggccccggcataaagggaaaagccagcagcatgtgggccaaagaaggccaggggactaaaaaaccctggagatttctccaaaccatgcggctgggacggtctccgagctatctttcttcaccccagcagggcagccagccttccgaatcctcaggcggggacagccggggatccaactccccaatccccccaacacaagaggataccgactcggatggtgaagagcctcaactgtacttcacggaaccccaacagctgctcgatgtgtttagagagctggaagagcagaatctcagtctgattcagaatagccaagaaaccgagaagactctggaggagctgagccataccctcaagcacacccagattaggatggaccgcgaagtcaaccagctgaagcagtgggtgacaactatgatgatgagcattacaaaggaagaagatacagccgccgagctggaactgaaggcccgcgtcttccacttcggagagtataagggcgaccaacaagataaactgctcgagagtctgaactgcaaagtcttggacgtgtacagacactgtaccgggacgcagcaggaagccaatctgggaacagtgcagatgctgacaatcatcgagcatcagttggatgaactgcttgaaaacctcgaacacgtacctcaggtcaagatcgagcaggccgagagggctaaagaaaaggagcggcgcatcagactgcgtgaggaaaagttgcaaatgcagaaaattcttcaggaggaacacctgcagcgggcaagagctagagcccaggccgaaattaagaaaaagcgagggcggacactggtttgtcgcagccgccccccagctcatcgtattaagcagcaatcagagcacacattaatggacaaggaggaggaggaacttttatttttctttacctag

SEQ ID NO: 28832 - DNA, 1839 bp, Artificial Sequence
  Description of Artificial Sequence: Synthetic coding sequence
atgtccgagataccgtcaaccattgtaagtaagaatatgactaacgataagaacagcctagagtctatgaatattagctcctcttcgtctactgaagagaatcccaagaagcaagcccgaaagaatgaagaacacgggccagacccaagtgccaatcccttccaccttagcggagatgtcgacttcttcttgcttcgggaccaggaacgcaacaaggccctgtccgaacgacaacagcaaaaaacaatgcgagtgcaccaaaagatgacatacagctccaaagtgtccgccaagcacacctcattaagacgacaactccaactggaggacaagcaggaggacctggaagcccgtgctgaggcagaacaccagagggcctttcgcgactacactacatggaagctgacgttgacaaaggccgagaagaatgtcgaacccgaaaacatgagcggttacatcaagcagaagaggcagatgtttctgctgcaatacgcacttgacgttaagaggcgggaaatacaaagactcgaaacacttgccaccaaggaagaagccaggctagagagggctgaaaaatctctggaaaaagatgcggccctgttcgacgagttcgtgagagagaacgactgctcttccgtgcaagcgatgagagcggctgagaaggaaactaaggcaaagatcgagaagatcctagaaattagagacctgacaacacagatagttaatatcaaaagcgaaatcagccgatttgaggataccttaaagcactacaaagtctacaaggatttcctgtacaagctgtcgccaaaagaatggctggaagaacaggagaagaaacactcttttctcaaaaaggccaaggaagtgagcgaagccagcaaagagtcatctgtgaactcgacgcccggagataagggtcccggaattaaagggaaggcctcctccatgtgggccaaggagggtcaggggaccaaaaagccctggcggtttttacagactatgcggttgggtcggtctccctcatatctctcctcaccccaacaaggttcacagccttcagagtcgagtggcggcgacagtcgaggttcgaacagcccaatcccaccaactcaggaagatacagattcagacggggaggagccgcagctgtacttcactgaaccccagcagctgctggacgtctttagagagctggaagaacagaacctttctctgatccaaaattctcaagagactgaaaaaaccctagaggagctttcacacacactcaagcacactcagatccggatggacagagaagtgaatcagcttaagcagtgggttactacaatgatgatgtcaatcaccaaggaggaagataccgccgcggagctcgagcttaaggcccgagtttttcattttggggagtacaagggggaccaacaggacaagctgctcgaatccttaaattgcaaggtactcgacgtgtatagacattgcacaggcactcagcaggaagccaacctgggtacggtccaaatgctgactattatcgagcatcaactggacgagctgctcgagaaccttgagcatgtgccacaggttaaaatcgagcaggccgaacgagcaaaggagaaggaacgacgaatccgattgagggaggaaaagctccaaatgcagaagattctgcaggaagaacacttacagcgagcaagggccagagctcaagccgagatcaagaagaagcgcgggcggacgctggtttgtaggtcacgacctcccgctcaccgcataaagcagcagtcagagcacacactgatggacaaggaggaggaggaactgctcttttttttcacctag

SEQ ID NO: 28833 - DNA, 1692 bp, Artificial Sequence
  Description of Artificial Sequence: Synthetic coding sequence
atgagctcaaacctgctcccaacgttgaacagtgggggaaaggttaaggatggaagcactaaggaggatcgaccctacaagattttctttcgcgatctctttctggtgaaggagaacgagatggcagcgaaggagacagaaaaatttatgaatagaaatatgaaggtctaccagaagacaacattcagcagtcgtatgaaaagccattcctacctgtcccagctcgcgttctaccccaaacggtcagggcggtccttcgagaagttcggacctggccctgcaccgattccccgactcattgaagggtctgataccaaaagaactgtccacgagttcataaacgaccagcgcgatcgcttcctgttagagtacgcactgagtacaaagagaaacactattaagaagtttgaaaaggatatcgcaatgcgtgaacggcagctcaaaaaggcagaaaaaaagcttcaggacgacgctctggcattcgaagagtttttacgtgagaacgaccaacgaagcgtcgatgctctcaagatggccgcacaggaaacaatcaacaaactgcagatgactgccgaattaaagaaagcttcaatggaagttcaagccgtgaagagcgagattgccaaaaccgagttcctcctgcgcgaatacatgaagtatggcttctttcttctccagatgtcacccaagcactggcagatacagcaggcgctgaaaagggcccaggcctcaaagtcgaaagccaacatcatcctcccgaagatcctggccaagctatcgttacatagttctaataaagaggggattcttgaggagtccggtcggacggcggtcctctcagaggatgcctcgcaggggcgggacagtcagggtaaaccctccagatccttgacaagaaccccggaaaagaagaaatctaacctagccgagtctttcggctcagaagattcattggagttccttctcgacgacgagatggatgtagacctggagcccgccctgtactttaaggagcctgaagaactcctccaggtcctccgcgaactggaagagcagaatctgactctgtttcaatactcacaggacgtggatgagaacctggaggaagtgaacaagagagaaaaggtgatacaggataaaacaaattcgaacatcgagttcctgctcgaacaggaaaagatgctaaaggctaactgcgtgcgggaggaggagaaagccgccgagctgcaactcaaaagtaaattgttctcctttggcgaattcaactccgatgcccaggagattctaattgactcactcagcaagaaaattactcaggtctataaggtgtgtataggtgacgcagaagatgatgggctaaatcctattcagaagttggtgaaagtggagtcacggcttgtggagctctgtgatctcatagaatccatcccaaaggagaatgtggaagctattgaaaggatgaaacagaaggaatggagacaaaagtttcgggatgagaagatgaaagagaagcaaagacatcaacaagagcggctcaaggctgcactggaaaaagcggtcgcacaaccaaaaaagaagctaggtcgccggctcgtgttccattccaagcctccctccggtaacaaacagcagcttcccctggtaaatgaaacgaagacaaagagccaggaggaggagtatttttttacttag

SEQ ID NO: 28834 - DNA, 2106 bp, Artificial Sequence
  Description of Artificial Sequence: Synthetic coding sequence
atggtagtgagcaccttcacggacatggacacatttcccaataacttcccccctgggggtgactccggcctgactggcagtcagtctgaattccaaaaaatgttgatcgatgaacggttaaggtgcgagcatcataaagccaattatcagaccctgaaagctgagcacacacgactccagaatgaacatgtcaaactccagaacgaactgaagcacttgttcaatgaaaaacaaacacagcaggaaaagctccagctactgctggaagagctaagaggagagttagttgagaagactaaggaccttgaagagatgaaactacagattctgacaccccagaagcttgaattactaagggcccagattcagcaggagctcgaaacccctatgagagaacggttcaggaatcttgacgaagaggtcgagaagtacagagccgtctacaacaagttaaggtacgaacacacctttctgaagtctgaattcgagcaccaaaaagaagagtacgctcgcatcttggacgaagggaagatcaagtacgaatcggagatcgctcgcctggaggaagataaggaagagctcaggaaccaacttctgaatgtcgatctgaccaaggactccaagcgggtggagcagctcgccagagaaaaagtctatctgtgtcagaagctgaagggactggaagccgaagtagccgagctgaaggccgagaaagagaattccgaggctcaggtggagaatgcccagcgcatccaggtgaggcagctcgccgaaatgcaggccactgttagatcactggaggctgaaaagcagtctgctaatctgagagccgagagactagagaaggagctgcagtcctcatcagaacagaatacattcctgattaataagctgcataaggccgagagagagataaacacactcagttccaaagtgaaagagctgaaacattccaataaactcgagattactgacatcaagctagagacggcacgggcaaaatctgaactggagagggagcggaataagattcagagtgagctggatggtctgcaatcggataatgaaatccttaaagccgctgtcgaacaccacaaggttctgctggttgagaaagatcgcgagctcatcaggaaggtacaggctgcgaaagaagaaggctaccaaaaactggtcgttttgcaagatgagaagctggagctagagaatagactcgctgatttggaaaaaatgaaggtggagcacgacgtctggagacagtcagaaaaggaccagtacgaagagaagctgagagcttcccagatggctgaggagatcacacgcaaggaattgcaatcagtgcgcctcaagcttcagcagcagattgtgacaatcgagaatgcagagaaagaaaagaatgagaattccgatctgaaacaacagatcagctcacttcagatccaggtcacttcactggcccagtccgagaacgacttgctgaactctaaccagatgctgaaggagatggtggagcggctgaaacaggagtgccgtaactttcggagccaggccgaaaaggcgcagctagaagctgagaagacactggaggaaaagcagatccagtggctggaagagaaacataaacttcatgagagaattaccgaccgcgaggagaagtacaatcaggcaaaggaaaagctccaacgagccgctatcgctcaaaaaaaaagaaagagccttcacgaaaacaagctgaaacgattgcaagaaaaagtagaggtcctggaagccaaaaaagaggagctggaaactgagaatcaggtcctaaacagacagaacgtgcctttcgaggactacactagactgcagaaacgcctgaaggatattcaaagacgccacaatgagtttagatctttaatactcgttccgaatatgcccccaaccgcctctatcaatcccgtgtcctttcagtcttctgcgatggtgccctctatggagcttccctttccgcctcatatgcaggaagagcagcatcaaagggagctttctctcttgagaaaaagactggaagaactggaaacaacccagagaaaacagctcgaagagctcggatcatccggcgagtag

SEQ ID NO: 28835 - DNA, 1707 bp, Artificial Sequence
  Description of Artificial Sequence: Synthetic coding sequence
atgctcatcgatgaaaggctgcgatgcgagcaccacaaagctaattaccagactctgaaggccgaacacacacggttacagaatgaacatgttaagctgcagaacgaactgaagcacctgtttaatgaaaaacagacacagcaggagaaactgcaacttctgctagaagagctccgcggagaattggtggagaaaacaaaagatctcgaggagatgaaactgcagatcctgacgccccagaagcttgaactgctgcgcgctcagatccaacaggagctagagacgcccatgcgggaacgattccgtaatcttgacgaggaggttgaaaaatatagagcagtgtacaataaactcagatatgagcacactttcctgaagagtgagtttgagcatcagaaagaagagtacgcaagaatcctggacgagggaaaaataaaatatgaatccgagattgcacgactcgaggaagacaaggaggagctgagaaatcagctgttgaacgtggacctgacgaaagactcgaaaagagtagagcagctggcacgggagaaggtttacctgtgtcagaaattgaagggtctggaagcggaggtggccgaactgaaagctgaaaaagaaaactctgaggcccaggtggagaacgcacagcggatacaggtgaggcagcttgcagagatgcaagccaccgtgcggagcctcgaggcagaaaaacagtctgcaaacctgagggccgaacgtctggaaaaggagttacaaagctccagcgaacagaatacgtttctgattaataagcttcacaaagcggagagagagattaacacattatctagcaaggttaaagagttaaaacattctaataaactcgaaattactgatatcaagcttgagacggcacgcgcaaagtcggaactcgagcgcgaacgaaataaaatacagtctgagctggatgggctccagagtgataacgaaattctgaaggcagcagtcgaacatcacaaggtgttgctggtggaaaaagatcgggaattgatcagaaaggtgcaggccgctaaagaagaaggctaccagaaattagttgtgctccaggatgagaaactggagctcgagaaccgcctggctgacctagagaagatgaaggtggagcacgatgtgtggagacagtctgaaaaagaccagtatgaggagaagctccgggccagccagatggcagaggagatcactagaaaggagctccagagcgtcaggctgaaattacaacagcagatcgtgaccattgagaacgctgaaaaggagaaaaacgagaatagcgatctgaagcaacagatttcctccctccagattcaggtgacctcactggcccagagtgaaaacgatttactaaactctaatcagatgctgaaagagatggtggagagattgaagcaagagtgcaggaacttccgtagccaagcggaaaaagctcagcttgaagcggagaagactctcgaagagaaacaaattcagtggctcgaagagaaacataagctccacgaacgtattactgacagggaggaaaagtataaccaggccaaggaaaagcttcagcgagctgccatagctcaaaaaaaacttgagcaggatcttgagctgggttgtcctagtgtgacagacacatacagagagtcagtctttcccccacccccactgaaacgcgatttacttaaatag

SEQ ID NO: 28836 - DNA, 2106 bp, Artificial Sequence
  Description of Artificial Sequence: Synthetic coding sequence
atggtcgtctccaccttcactgacatggacacattcccaaataatttcccccctggtggggatagtggcctgaccgggagtcaaagcgaattccaaaagatgctcatcgacgagcgcttaagatgtgagcaccataaggcgaactatcaaacgctgaaggcagagcacaccagattacagaacgaacacgtcaaactccaaaatgaactgaaacacctgttcaacgagaagcagacgcagcaggaaaagctgcagttgcttcttgaggagctgcgcggtgagctggtcgaaaaaaccaaggacctggaagaaatgaagctgcagatcctaacgccacagaaactggaacttcttcgagcccagatccaacaggagctggaaacccctatgagagagcgcttcagaaacctggatgaggaagttgagaaataccgggccgtgtacaataagcttagatacgagcacaccttcttgaaaagcgagtttgaacaccagaaggaggagtacgccagaattctcgatgaaggtaaaattaagtatgagtctgagatcgccagattggaggaggacaaagaagaactccggaaccagctgctgaatgtcgacctcaccaaagactcaaagcgcgtggagcagctagccagggaaaaagtttatctctgccagaagctgaaggggctggaggctgaagtcgcagagttaaaggcagagaaggagaattctgaggcacaggtcgaaaacgcgcagagaattcaggtgcgtcagttggcggagatgcaggcgacggttaggagcctggaggctgagaaacagagcgctaacctgagagcagagagactcgagaaagagttgcaatcttcctctgagcaaaacaccttcctgattaacaaactgcataaagccgagcgagaaataaacactctcagtagtaaagttaaggagctcaagcacagcaacaagctggagatcacggacataaaactcgagacagcccgggcaaagagcgaattggagcgcgaacggaataagatccagtctgagttggacggattgcagtcagataacgagatcctgaaagcggccgtggagcaccacaaggtccttctggttgaaaaggacagagagctgatcagaaaggtgcaggcagcaaaggaagagggctaccagaaattagtggtcctgcaagacgaaaagttggaattggagaataggctggctgacctggagaagatgaaggtggaacacgacgtgtggaggcagtcagaaaaagaccagtacgaagagaaacttcgcgcctctcaaatggccgaggagattaccagaaaggaactgcagagtgtgcgactaaaactccaacagcagatcgtgactattgaaaatgctgagaaggaaaagaatgaaaacagtgacttgaaacaacagatctctagcctgcagatccaggtgacatctctggcccaatcagaaaatgacctgctcaattctaaccagatgctgaaggaaatggtcgagcgcctgaagcaagaatgtaggaactttaggagccaggccgagaaggcacagttggaggccgaaaaaaccctcgaggaaaagcagatccagtggctggaagagaagcataaactacatgagcgaataactgacagagaggagaaatacaatcaggccaaggagaaactccagagagctgctatcgcacagaaaaagcggaagagtttgcatgagaacaagctcaaacgtctccaggagaaggtggaagtactcgaggccaagaaggaggaacttgaaacagaaaaccaggtactgaaccggcaaaacgttccattcgaagattacacacgcctgcagaagaggctgaaggacatccaaagaagacataacgagttcaggtcactgatactggtgcccaatatgccccccacagccagcataaaccctgtgtccttccagtcatctgctatggttccctcaatggagctcccgttcccacctcacatgcaggaagagcagcatcagagggaactatcactgcttcgaaagcggctcgaggagcttgaaactacccagcgcaagcagctcgaagagctgggatcatcaggcgaatag

SEQ ID NO: 28837 - DNA, 9 bp, Artificial Sequence
  Description of Artificial Sequence: Synthetic coding sequence
atggtttag

SEQ ID NO: 28838 - DNA, 951 bp, Artificial Sequence
  Description of Artificial Sequence: Synthetic coding sequence
atgagccttgggatcatggaggaagaagatctggccgaatattttcggctccagtatggcgaacggcttctgcagatgcttcaaaaactccccaacgtggaaggggcaagtgagtcgcctagtatttggctcctggagaagaaaaaggaaactgaaatcatgcatcagacaatggtccagaagaaaaaaatgttccagaggcggatggaaaccctcaacttaagatgggaagaactcggtgtaaaggaggctcagcttaaagctcacattcaaaaaagcgagcagttcatacaggaaaacgaccagaagagaatcagggctatgaaaaaggccaacaaagagagggaacttaagtgccaacatatgcaggaactcaccaagcgaaaacaggagatggtggccctgagacttgaacatcagagactcagcgccaagctgaaagattattacattttcaacaaatatctggaaaaggtagtggagaattctgagtttgaggaaattcatgaagtgatcgcccggtacaagaccttggtctcgatgcgacacgatttgatgcagtcagctcaagagggccaggaaaagattgagagagccaaagcaaggctggcgagatatatggaggagaaggatgatgagatactgcaacagaataatgagttagcacgccttcaaatgcgattcgaccgcgctcggagcaacgtaatcttttgggagagcaggtgggcccatatccagaatacagccgccaagaagacactgttgttggggaccatcaaaatggccacgctgaacctgttccagatagtgagcaagcacttgaaggaggttactgaggtggcactggaggacacccataagcaactcgacatgatccaacagtttatccaggataggtccgacatctgggcggaggtgaaaaagaaggaacagcaaagagtcaggatttag

SEQ ID NO: 28839 - DNA, 729 bp, Artificial Sequence
  Description of Artificial Sequence: Synthetic coding sequence
atgtccctaggtatcatggaagaggaggacctcgcagaatacttcaggctgcagtacggcgagagactgctgcagatgcttcagaaattgccgaatgttgaaggagcctcagagtcacctagcatctggctgctcgaaaaaaaaaaggaaaccgagatcatgcatcagactatggtacagaagaaaaaaatgttccagcgcagaatggaaacgcttaatttgcgttgggaggagctcggggtcaaggaagcgcagctgaaggctcacattcagaagtctgagcaatttatccaggagaacgaccagaagcggattagggctatgaaaaaggcaaacaaagagcgagaactgaaatgccaacacatgcaggaattgactaaacgcaagcaggagatggtggccctgagattagaacaccaacgcctttccgcaaagctcaaggattattacatctttaacaagtatttggagaaagtggtggaaaatagcgaggaatcacgctgggctcatattcagaacaccgctgccaagaaaaccttacttctcggaactattaaaatggcaacactcaatttgttccagatcgtgtccaagcacctgaaagaagtcacagaagttgccctcgaagacacccacaagcagttggacatgatccaacagtttatccaagacagatccgacatttgggctgaagttaagaagaaggagcagcagcgcgtcagaatttag

SEQ ID NO: 28840 - DNA, 927 bp, Artificial Sequence
  Description of Artificial Sequence: Synthetic coding sequence
atggctgtgccttgggaggaatacttcagactggcgctgcaggaaaaactgagcactaaactccctgagcaggctgaagatcacgtgccgccagtactccggctcctggaaaaacggcaggagttagtggatgccgaccaggctcttcaggctcagaaggaggtctttcgcactaagacagcagctctgaagcagcggtgggagcagctagagcaaaaagagagggagctcaagggatcgttcatccgctttgacaaattcttgcaagatagcgaagctaggagaaaccgcgcattgaggcgggcagccgaggagagacaccaggcaggcagaagggaggtcgaggctttgagactgtggacacagttacaggaacttagaagagagcacgcccggttgcagcgccgtcttaagagactcgagccttgtgctaggctgctcgaacaagccctggaactgctgcctggcttccaagaggtgcccgagctcgtggccagatttgatgggttggctgagactcaagctgcacttcgcctgcgtgagcgcgagcagcttgccgaactggaggcagctcgggctcgcctccagcagcttcgggatgcatggcccgacgaggtgctggcacagggccagagacgggctcagcttcaggaaagattagaggcggcgagggagcgaaccctgcagtgggagagcaagtggatccaaatccagaatacggcggcggagaagacgctcctgctcggccggagtagaatggcagtcctaaacctgttccagctggtatgccagcatcaaggacagcccccgacactggacatcgaagataccgaaggccagctggagcatgttaagctgtttatgcaggacctgtcagccatgctggccgggctaggtcaggccgaaccagccgcccctgcaagctag

SEQ ID NO: 28841 - DNA, 675 bp, Artificial Sequence
  Description of Artificial Sequence: Synthetic coding sequence
atggctgcacccagtgaggtggcagccatcgctcccggagaaggtgacggcggaggagggggcttcggaagttggttggacgggagactcgaggcccttggggttgatcgggctgtgtacggagcctacatcctggggattctgcaggaagaggaagaggaagaaaaactggacgcgctgcaggggatcctctccgcctttctcgaagaggacagcctcctcaatatctgcaaggagatagtcgaacgatggagcgaaacacaaaacgttgtgaccaaagtcaagaaggaagatgaggtgcaggccatcgctactctcatcgaaaagcaagcacagatcgtggtcaaaccccggatggtcagcgaagaggagaagcaaaggaaagctgcacttctggcccagtatgcagatgtaaccgatgaggaagatgaggccgatgaaaaggacgactctggtgcaacaactatgaacatcgggtccgacaaactgctcttccggaacaccaacgttgaagatgttttgaacgcacgtaagctcgaaagagactcactcagagacgagagtcaacgcaaaaaggaacaggataagctccagcgggaaagggacaaacttgccaagcaagagaggaaggagaaagagaagaaacgaacacagcgaggagagcggaagcgttag

SEQ ID NO: 28842 - DNA, 465 bp, Artificial Sequence
  Description of Artificial Sequence: Synthetic coding sequence
atggccgctccaagcgaagtggctgccatcgcccctggcgagggggatggcgggggcggggggtttggctcctggctcgatggcagactggaagccttgggagtcgatagggccgtgtatggagcttatatattaggaattctccaggaggaagaagaggaggaaaaattggatgctttgcagggtatcctctccgccttcctagaggaggactccctgttgaacatctgtaaagaaatagtggagcgctggagcgagacacaaaatgttgttactaaagtaaagaaggaggatgaggtgcaggcaatcgcaactcttattgagaagcaggctcaaatagttgtcaagcctcggatggtgtccgaggaagagaaacagcggaaggccgccctgctggcgcagtatgccgatgtcactgacgaggaggactctgttcctaagcaccagtgtggaaggtgtccatag

SEQ ID NO: 28843 - DNA, 486 bp, Artificial Sequence
  Description of Artificial Sequence: Synthetic coding sequence
atgacatatttcggacactttgggggagctaatcacgcacacacattgggggagctcgaagcctgtatcgcaatgctggtggaacagttaagaacccaggggtgcggaggtagaactttagggacaagcgaggaggaggctgaactccaacagaaagttgaagagaatgagcacctcaggctggagctccagatggtcgaaacagaacgcgtccggctatctctgctagaggaaaagctggtggatgtactccagctgctccagcggctgcgtgacttgaatatctcaaagcgagccctaggtaagatcctgctctccacgctagacgcattcagggaccctactcacgagggccggccgtcacccgcggccatactggacgccctgcatcaggccttggctgcctgtcaattacttcggcggcaaccatctgcccctgcctcagccgccgctgccctaaccaacccattactagtcagctgttag

SEQ ID NO: 28844 - DNA, 987 bp, Artificial Sequence
  Description of Artificial Sequence: Synthetic coding sequence
atgtatacactccacacaaaacgagtgaaggccgcggctcggcagatgtggacgtcaaatctctccaaggtgcgccaatcactgaaaaacgtctaccacaaatgcaagattcgccaccaggattccactggctaccctacagtgacaagcgatgattgtaaccaggacgacgattcctatgacggtaagatgaacctgccggtcgtgctgcaggacgtgaagactgctcaggttgagctattctctcagatgaccgatattgtccacatgatccctaaggtgcaggagaaaactgatttgtatcagaaacaaatggaagtcctcgaaactaggatgaatgttaacgaggataaacagtgcactacaaccaaagacattctgagtatgaaagaagatattaaagccttaaaaaagaaggtgaccgagcttgaaattcagaacagctgctcaacgatccactgcctggaaatcttagagggagaacgcgggaaggaaattacggagctgctctacaagcttatacagcccgccactctgaaaaatacactggcgagtacagacatggaaatatcctctgccgaacctgagaaggtgccatcctatcctaagtccaccgatcaccttgagaagaaaacaatttcccctcagatgaaaactctgaaaaagagaaaccaccagaacgccagccgaagctttgagaaagccaagcccaatatatacatctatcccgatttctcaacttggatcaagttaaccttcgtacatggcggcaagtggaccttctttctcagcgcaactaagcttgaggaattcatccagtggctgctatcccggcccaccatcttgcccgaggaacctcaggttattacacagaggtattgtccttttacaggcccaattctcagcctaacgaccatctgcctctcgatcttcaataatatctacggttttatatgcagcttgaaagaggaagtcacaaggctctag

SEQ ID NO: 28845 - DNA, 906 bp, Artificial Sequence
  Description of Artificial Sequence: Synthetic coding sequence
atgggcaaccgccttcgggctgaactcgggcgtccagaacgttggcttcttcatcatgcactgccccccgctccagaggcccggaaacctggagaggaaccccgccgtccactcgatcgctctccgccactgggtcaggtgcagccccatttcacatcccaggacgccaagtccgccgaagatgaggccccctcccggcacttgggcaagcaccagccgcgatcagctcaggttggatctcggctcgatgcccttcagggacccaaaactcagcactctattcacacagtgacttgtaaatctcccagacaaaaggaggatagatctcctaagcccccccaggctccccagcacccagaggaacacggaaggcaatcgcacagtagctctagcttcgcttctgggacactgcaagatatgtggaggcttctggaccttggatcttctccaagtggcgtgacatcccaaggagacagcaccccagaaatgggctcccactacgtgacccaagcaggattggagctgctagggtctagttccccggcagccttggcatcccagtcagccgaaatgactggtgtcgggcccaccccttccctggcttggagcggcgcccttcaccccaacatgaatcaagaagcttcccttgtgcgatccacgtgggctcctggaatgaggggaggaatgaatggcggtagctcttctgtgtgtaagaacatgcagcgcggcccccattggagtccttcccagcagccctgtagcggaatccgaaccgtcctgctgtccagaaaagagagaactctgctgagttgctttagcctaccagctccagtagtactggtacccctccttctgtcgggccaagctgtgaccgagcgagccggtcatgcaggagacatactgtag

SEQ ID NO: 28846 - DNA, 2751 bp, Artificial Sequence
  Description of Artificial Sequence: Synthetic coding sequence
atgctgcccctcggatctgagcctgcactgaacgaattactcctcaggaaggaggaggaatggcgcgccctgcaggcccaccggacccagctgcaggaagccgccctccaggacaccaggtcccagctggaagaagcccaaggaaagcttagatgccttcaggaggattttgtttataacctgcaggtcctggaagaaagggatcttgaacttgagcgttatgatgcggcgttcgcccaagcccgcgaatgggaagaagctagaagggcagaagtttcagagctcaagatagaggcagccaaattacggcaggccctggcaagggaggcccgaaaagttgaggagctccagcagcagcagcagctggcttttcaggagcataggctcgagctggaaagggtacacagcgacaaaaatggtgaaatcgaccatcatcgggaacagtacgaaaacctgaagtggactctggagcgtaagctcgaggagctggatggtgaactcgccttacagagacaagagttactgctagagtttgagtctaaaatgagaaagagggaacacgaattccggctacaggctgataatatgtccaataccgccctgtcacgggaactcaaggtcaaattgctgcataaagaacttgaggcactgaaagaggctggtgccaaagccgccgagagccttcagagagccgaggccaccaatgcagagttggagcgaaagctccagtctcgagctggcgagttacaggaccttgaggctatgtccagggctcgggtaaaggacctggaggacaaactgcactccgtgcagctgacgaggaagaaagaagaggaaacattcaaaaggaagcacgaagagctcgataggctcgcccgtgagaaagacgcagtcctggtagcagtgaagggcgcccatgtcgagcagcttcaggaactgcagacgagggtcctggagctgcaggctcattgcgagacattggaggcccagctccgtagagcagagtggcggcaagctgatacagcgaaagagaaggatgccgccattgaccaattacgcgaggatgctagcacagtaaaaagtgcttgggatgctcagattgcccagctttctaaggagatggtgtcccgcgacctacagattcagacactgcaagaagaggaagtgaagctgaaggcccaggttgccagatcccagcaggacatcgaacgctacaagcaacagctctctctcgccgttgaacgggagagatctttggaacgggaccaggttcagctaggccttgattggcaacggcgatgcgacgatatcgagagagaccagatccaaaagagcgaagcactgatacaggggctctctatggcaaagagtcaggtggccgccaagctgcaagagactgagcaggccctgcaggagcaggaggtggtactcaaggcagtcacccttgaacgcgatcaggccgtacaggcgcttagaatgcatggacttcccagacctggcgcccaaatgttacttcgacaacatgaagaagagatttcaaaggattttccgtccagtgagatacaaaggctgcgagaacagaacacatccctccgcaacgctatcgctcagatgagaaaggagatggaggcactgagtcatcagatccccccccctatacagacagccgcagagagcaccgatgcaaaccagcccgatcctgaagctggtggtgacgccgcgacccctgactacgtcctggccctggaggccgaaattagaacgctaaaacacaaattcaaaactctggagaaacacttggaggacgtcttggatccactgaagatgtcctccccccatgctgaatcccagccctccgttcgaacctccactgagactacgggcgggtctgctcaggcgggccaggccgggggcagcgtgcaggcaggccaggccggaggatcagtgcaggccggacctgtgtcctctggcttggctttgcgcaagctcggggatcgtgtccagctactgaatcttctagtgaccagactccgacagaaggtgcttagagaaccattagaaccggccgccctacagagggagttgcctagagaagtcgaccaggttcatcttgaggttctggagcttcggaagcaggttgcggaactgggcaagcacctccgtattgcccaacatggaggagccgaaccctcaggaagaaagcagcctcctgcctccgatgccgtggcactgggccgtgaacaggatgccaagagcgccgaggatgaggccccctcaagacatctcgggaaacatcagccccgaagcgcccaggtgggatcccgcctggatgctcttcaggggcctaaaacccagcatagtatccacacagtcacatgcaaaagccctcgccagaaggaggatcggagtccaaaaccacctcaggcaccccagcaccccgaggagcatggcagacagtctcactctagctcgagcttcgctagcgggactttgcaggacatgtggcggctactggatctggggagttctccttccggggtgacctcacagggcgattccacaccagaattgcccgccccccccgcagcggacaggcgaccagtcaaaatgcaagcaggcatcgcaacacctggaatgaagacagctgcgcaggcgaaagccaagacaaccggagccagccgctcccaccctgccaaagcgaaaggatgtcagcggccacctaagataaggaattataacatcatggactag

SEQ ID NO: 28847 - DNA, 2751 bp, Artificial Sequence
  Description of Artificial Sequence: Synthetic coding sequence
atgctgccactgggctccgaacccgcactcaatgagttgctactgcggaaggaagaagaatggcgggccctacaggcacatcggactcagcttcaagaagccgccctgcaggatacacgatcccagctggaggaagcccaaggcaagctgcgatgtctacaagaggatttcgtgtataacctgcaggtccttgaggagcgcgatctcgagttggagaggtatgacgctgcattcgcccaagccagagaatgggaggaagctcggagagccgaggttagcgaactgaaaatcgaggcggccaaacttcgccaagccctggcccgtgaagcaaggaaggtggaggagttgcagcagcagcagcagcttgcgttccaggagcaccggctggagttggaacgagtccactctgataaaaacggagagatcgatcatcacagagagcagtatgagaacttgaaatggacattagagagaaagcttgaagagcttgacggggagctggccctccaacggcaggagcttttgcttgagttcgaaagcaagatgcgcaagcgggagcatgagttccgcctccaggcggataacatgtctaatactgccttgtcccgggaactcaaggttaagctgctgcacaaagagctcgaagcgctgaaggaggccggagccaaagctgctgaatctctacagcgtgccgaggctacaaacgctgaactggagcgcaagctgcagagccgcgccggcgagttacaggatctggaagctatgagcagggctagagtgaaagacctagaagataagcttcactcagtgcagcttacacgcaagaaggaagaagagacatttaagcggaaacatgaagaactggataggctggcaagagagaaagacgccgtactggttgctgtgaaaggagctcatgtggaacaactgcaggaactgcagacgcgggtccttgaactccaggctcactgcgagactcttgaagctcagctcaggagagctgagtggaggcaagccgataccgcgaaggagaaggacgcagctattgaccaactaagggaggacgcctctacagttaagtcggcctgggatgcacagattgcacagttgagcaaggaaatggtgtcgcgagacctccagatacagaccttacaagaggaagaagtgaagcttaaagctcaggtggctagatcacaacaagatattgagaggtataaacagcaactttccctcgccgtcgaacgcgagaggtcactggaacgggatcaagttcagctaggtctcgactggcaaagacggtgtgacgatatagagcgcgaccagatccagaagtctgaagcactgatccaaggcctgagtatggctaagtcccaagtggctgctaaactgcaggaaacagaacaggcgctacaggagcaggaggtcgtgctgaaggccgttacattagaacgggatcaggcggttcaggcccttaggatgcacgggcttcctcgtcccggcgcccagatgctcctgcgacagcacgaagaggagatatctaaagactttccatcgtcggaaattcagcgtttacgggaacagaataccagcttacggaatgcaattgctcagatgcgaaaggagatggaggccctgagtcaccaaataccacctcccattcagacagctgccgaatccactgacgcaaatcaaccagaccctgaggccggtggcgatgccgccacccctgactatgtgctggcacttgaagcagagatcaggaccctgaaacacaagttcaaaaccctggaaaagcatctggaagacgtgctggatcctttgaaaatgtctagcccacacgccgagtctcagccctcggtcagaacctccaccgagacgaccggcggcagcgcacaagccggccaggctggcggctcagtacaggctggccaggccgggggtagcgtccaggctgggcccgtttcctccggtcttgctctacggaagcttggggacagagtccagttgcttaacctgctcgtgactaggcttagacagaaagtgctacgcgagcccctggagcctgccgctctacagcgggaactgccccgagaagtcgaccaggtgcatttggaagtgttagaactccggaaacaggttgccgaactcgggaaacatctcaggatcgcccagcatggaggagcggaaccatctggccggaaacagccgcccgccagcgatgcagtggcactgggccgggaacaggacgcaaaatctgccgaggacgaagccccctcccggcaccttggaaagcaccagcccaggtccgcccaagtcggctcccggcttgacgccctccagggccctaagactcagcacagtatacacacagtgacatgtaaaagccccaggcagaaggaagatagatcccccaagcccccacaggccccccaacaccccgaggaacacggaaggcaaagccattcatcgagctccttcgcctccgggactctgcaagatatgtggcgccttctcgatcttggtagctcccccagtggagtgacgtcccagggagacagtacccctgagctcccagctcctccagccgccgatcgccgtcccgtgaagatgcaggcaggcatagcgaccccagggatgaagactgcagcgcaagctaaggccaagaccaccggagccagtaggtcacatccggccaaggcaaaaggatgtcaacggcctcccaagattagaaactacaacattatggattag

SEQ ID NO: 28848 - DNA, 1653 bp, Artificial Sequence
  Description of Artificial Sequence: Synthetic coding sequence
atgacaaaagttccagcaactaaaaagcttcagtcttctcccaattcgggtgcagtgagacccttctacgcatctgagaatttacggcaagtgccggataaaccaatgaaaagcatcaagtatatggacaaagagattattaacttgaagaaagatctgatcagatctcgcttccttatccagagcgtcaaaatcggccggggatactttgctattctacgcgaagagactgcgaaaaagaagaaacagcaacaactgcagaagctgaaggaagaagaacgtaacaaattccaacccgctgagaaaatttctgaaattcactacggcgacacactcctgtcaacctacgacgatgaaaagctgaaaacattgggagccagagttacgcggaggcccttcacccctatccacagctgtatcatctctccgtctctgacagaggcccatgtggagccactctttagacagctttgtgcccttcactggttgctagaggccctgactatcgaccacacccatcataccatgaaacccgtcatcacttgctggaatcccaaggatccaggggggagtaaaagcacaatcaagaaaattaacaaggacaagagcatggggcagaagtgggagcatttcattactgcccccaagacaaaaaagtttaaaattcccacaatgagggtcacaaataggaaaccgagccgccggggttccacgttatctctctcccgtgcttctgggggaagctctcctcaatccagcatgatcagcgtgaaccctggcagcgacgagcccccatcagtcaacacacaagtaacctcatcaaaggatatcgaggataatgaatcaagttctacgaaacccgacgaagaacccctgtacatgaatttacagaagctgcttgagatggtccgggaggacgccaggcgcacagtgactattgagaatggaatgcaacgaaaagctccctccattctaagtgtgcttaagcagaacaaatccaacagcgcctataaagaaatgcagacaactctgaagtcatctgaaaggtcttcaagcaccagtgccgaatctcatatccagccagttcagaagaagtctaagaaccgcacaaattgtgacatcaatattcactataagagtggcgtgtgtaacactatgcgggctaagttttattctgttgcccaggaggccggattttgtctgcaggataagatggagatccttatgaagaggcaggaggagcgggggatccagaaattccgcgcattcgtgctggtgtccaacttccaaaaggatatcgctaagatgcggcaccatatcagtgtggtgaaaggtgacgcagaagaaatcgcagaccactggtattttgatctgctcagcaaactaccagaggatcttaagaatttcaggccagcaaagaaaattttggtgaagctgcagaagttcggcgagaacctcgacctgcggattaggccacacgtgctcctgaaggtgctgcaggatttgagaatatgggaactgtgtagccccgacattgcagtggctattgaatttgtccgggaacacattattcacatgccacaggaggactatatatcatggctgcagagtagaattaatattcccattgggccctactctgctctcagatag

SEQ ID NO: 28849 - DNA, 1692 bp, Artificial Sequence
  Description of Artificial Sequence: Synthetic coding sequence
atgagcgtgctgaaaaagaatagaaggaaggattccgataccccacaggaaccatctgagaaggctaaagagcagcaagcagaggcggagttgcgtaaactccgtcaacagtttcgaaaaatggtcgagtctaggaagtccttcaagttccgcaatcagcagaagatagctagccagtacaaggagatcaaaactctcaaaactgagcaggacgaaatcaccctgctcctctctttaatgaaatccagcagaaatatgaaccgctccgagaaaaattatatggagctgcggcttttgctgcagaccaaggaagattatgaggccctgattaagagtctgaaagttctgctcgcagaattagatgagaaaatactgcaaatggagaaaaagatagcaaaccagaaacagatcttcgccaagatgcaggaggcaaacaatcctcggaaattgcagaagcagatacatattctggagacccgcctgaatctggtgactgtgcattttgataaaatgctgactactaacgccaagctgcggaaagaaatcgaggacctgcgtttcgaaaaagccgcctacgacaacgtgtaccagcagttgcagcattgcctgctgatggagaaaaaaactatgaacctagcgattgagcagtcttcccaggcctatgaacagcgagtagaggcaatggcccggatggccgctatgaaagatcgacagaaaaaggatacaagtcagtacaacttagagatcagagagctcgagcgattgtacgctcacgagtcgaagttgaaaagtttcctgcttgtcaaactgaacgaccgtaatgagttcgaagaacaggccaaaagggaagaggcgttgaaagccaagaaacatgttaagaaaaacagaggagaatcctttgaaagttacgaggtggcccacctgcgactccttaagctggctgaaagcggaaacctcaatcagctgatcgaggattttttggccaaagaggaaaagaactttgcaaggtttacttatgtgacagagctgaacaacgatatggagatgatgcataagagaacgcaaaggattcaggatgagataatcctgctacgctctcagcagaagctgagccacgatgataaccatagtgtcttacggcaattagaggataaactcaggaaaactacagaggaggctgacatgtacgaatcgaagtatggcgaggtgtctaagaccctggacctgctgaagaactcagtggagaaactgtttaagaagataaactgcgatgccactaagattttggtacagctaggcgagacggggaaggtaacggatattaatttgccccagtatttcgctatcatcgagaagaagacgaatgacctgcttctcctggaaacctaccggcggattcttgaggtggagggggctgaggccgagatcccccctccattcataaatcctttttggggagggagtgcgctgctgaaacccccggaacctataaaggtgattccaccagtgctgggcgctgaccccttctctgatcggctggacgacgtggagcaacccctggaccacagcagtctccggcagcttgtgttggataactacatcctcaaagagaaccgctccaaagaggtccgcggtgacagcttaccagagaaggtcgacgactttcgaagcagaaagaaagtcaccatgtag

SEQ ID NO: 28850 - DNA, 1527 bp, Artificial Sequence
  Description of Artificial Sequence: Synthetic coding sequence
atgtcaagccccgacgggccttctttcccttccggcccactgtcaggtggcgcctcccccagcggggacgaggggttttttcctttcgtcctggaacgtcgcgatagtttcctggggggtggacctggtccagaggagcctgaagatttagccctgcagctgcagcaaaaggagaaggacttgcttcttgctgccgaactgggtaaaatgctcctggaacggaacgaagaactgaggcgccagcttgaaaccctctcagctcagcacctcgagagagaagagaggttacagcaggagaaccatgaacttcggcgaggcttggcggctagaggagcagaatgggaagccagagcagttgaacttgaaggagacgtggaggcccttagagcccaactcggggaacagcggtccgaacaacaggattctggacgcgagagggcccgggcgttgtccgagctgagcgaacagaatttgcgattgagtcagcagctagctcaggccagtcagaccgaacaagaactgcagcgggaactggacgccctaagaggtcagtgtcaggcacaagccctggctggggcagaattacggacccgactcgaaagcttgcaaggagagaatcaaatgctacagtctcgcagacaggaccttgaggctcaaattcgggggcttagagaggaagtggaaaagggcgaaggcagactgcaaacaacgcatgaagagctgctccttctacggagagaacgcagagagcactccctggagctagaacgggcaagaagcgaagctggagaggctctttccgccctgaggaggctccaaagaagggtgagcgaacttgaagaggagagccggctacaggacgccgacgtttctgcagctagcctccaatccgagttggcacattcacttgacgacggagaccaaggacagggagcagacgctcccggggatactccaacaacaagatcaccaaagacccgcaaagctagtagtccccaaccctccccacccgaggaaattttggaaccccccaagaaacgcacctctctttcccccgctgaaatcctggaggaaaaggaggttgaggtggctaaactgcaggacgaaatcagccttcaacaggcagagctacagagcctacgcgaagaactgcagagacagaaagaactccgagctcaggaggatcccggtgaagccttgcattcggccttaagcgatcgcgacgaggcagtgaacaaggctcttgaactgtcacttcaattgaatagagtgtcactggaaagagattcattaagtagagagttgctaagggccatcagacagaaagtcgccctaactcaggagttggaggcttggcaagatgacatgcaggtggtcatcgggcaacagctgcgcagtcagaggcagaaggagctgtcagccagcgcctctagtagcacgccacgtagagcagctcctaggttttctctacgactcggcccaggccccgcgggcggattcttgagcaatctattccgtcggacctag

SEQ ID NO: 28851 - DNA, 2745 bp, Artificial Sequence
  Description of Artificial Sequence: Synthetic coding sequence
atggggaacaaggcaaagatagcaaagtgcccactgaggaccaagactggccacattctgaagagcacccaggatacttgtattggcagtgaaaagctccttcagaaaaagccagtgggtagtgaaacctcccaggctaagggagagaagaacggtatgactttctcatcaactaaggacctgtgcaaacagtgcattgataaggactgccttcatatacaaaaggaaatctcccctgcaacacctaatatgcagaagacccgtaacaccgtcaatacgtctttggtgggaaagcagaagccccacaaaaagcatattaccgccgagaacatgaagtcctctttggtctgtttaacccaggaccaactgcaacaaatcctcatgactgtaaaccaggggaaccggagtctgtcactgacagaaaatggcaaggaggcgaaatcacaatatagcttgtacttaaactcgatcagcaaccagcctaaagacgagaacatcatgggattattcaaaaaaaccgaaatggtctcgtcagtgccagcggaaaataagagcgtcctcaacgagcatcaggagacctcaaaacagtgcgaacagaagattgccattgaaaatgagtggaagccggctgatatctttagtactctgggggaacgagagtgcgatcgcagctctttagaggccaagaaagcacagtggcgtaaagagctggatgaacaggttgctctcaagaaaaaagagaaagaagtatccgagaagtggaatgacccctggaaaaaaagtgagagtgacaaaatcatctgggagaaacatcaaattctggatcagtcacgcgaaaccgtgcttctagaacaccccttttcggctgtgaagcaagagttgcagagaaaatggatagaggaactgaacaaacagatcgaggatgaccggcagcggaaaattgaagagaagataatctactccaaaggggaagagcacgacagatgggctatgcatttcgattccctcaagtcgtatccaggatctcagtcccagttgttctctcagtcaacccacaagcagccagagtacttttgcgtgagcccagatacacaggagttagccgacgtcagttccgtgtgcacacctactaccggatctcaggttgaaccaagcgaggaggagcacatcgcaaaacctatcaaggatgttgtgatggctaattctaagaagaccaattttctccggagcatgaccgctctgctcgatccggctcagattgaagagagagaccggcgtaggcagaagcaacttgagcaccaaaaagccatcacggcacaggtcgaggaaaaaaggcggaagaaacagttggaggaagagcaaagaaagaaggaagagcaggaagaagagttgcggctcgcccaggaacgagaagagatgcaaaagcagtatgaggaggatatccttaagcagaaacagaaagaagagattatgaccctgaagaccaacgagctctttcagaccatgcagcgcgcacaagaattagcacagcggctgaagcaagaacagcgcattagggaattggcccagaagggccacgacacctctagactcatcaagaatttgggcgttgatacaatacaaatggagtacaatgcatccaatatttccaacagcaggcacgatagtgacgagatctctggaaaaatgaacacttatatgaatagcactactagcaaaaaggacactggggtccagacagatgatttaaatattggaattttcacaaatgccgagtcgcactgcgggtccttaatggaacgcgacatcacaaattgctcctctcccgagatttcagccgaactcatcgggcagttcagtactaagaagaacaagcaggagctgacccaagacaaaggtgcatctctcgaaaaggagaataacagatgcaatgaccagtgtaatcaattcacacggatcgaaaagcaaactaaacacatgaagaagtatcctaagaggccggactggaatatcaataagcccccaaagagatatatccctgcctcggagaagtatccgaaacagcttcagaaacagcgtgaggaaaagaaggtaagaagacaaatggaacttctacatctagtggaaaaaaataaccctgggcatctgagtcaaaacagaggcatctctcctgagatttttcactcctctcaccaggagactgagtccaaacttaggtggcatctggtgaagaaggaggaagaaccactgaacattcactccttcagcaaggagcgctccccatccagccctgtgcccgtagtaaagaaccgtacacagcaaacacaaaatacattgcacttacctctgaaaaattccagctacgagagagaaaacctgatatccggctccaatcagaccgagctgtcttctggaatttcggagtcatcccattttatcccttatgtaagaactaacgaaatctattacttagatccagacgctcctctctctggaccctctactcaggaccctcagtaccagaactcacaggattgcggccagaagcggcagctctttgattctgattgcgtgagggaccccctgctcaatccgaatatggttaagaaccgggacaggcagcaggccatattgaagggccttagcgagctgagacagggtctgttacagaagcagaaagagcttgagagcagcttattgcctctcgccgagaatcaggaagaaagcttcggatcatccttctag

SEQ ID NO: 28852 - DNA, 2847 bp, Artificial Sequence
  Description of Artificial Sequence: Synthetic coding sequence
atgaacctgggcgacgggcttaaacttgagactgagttgctggatggcaagaccaaactgatactcagcccttacgagcacaaatctaagattagcgtcaagatgggcaataaggcaaagatcgcaaaatgtcctctgcgcaccaaaaccggacatatattaaagtccacacaagacacatgtattggatcagaaaagctcctgcagaaaaaaccagtggggtctgaaactagtcaggccaagggagagaagaatgggatgaccttttcttcaaccaaagatctgtgcaaacagtgcatagataaggattgcctgcatatccaaaaggagattagcccggccacccctaatatgcaaaagacgcggaataccgtgaataccagcttggtgggtaaacaaaagccgcataaaaagcacattactgcagagaacatgaaaagcagtctagtgtgcttaacacaagatcagcttcagcaaattctaatgaccgttaatcaaggcaatcgctctctgagtttgacagaaaacgggaaagaggctaagtctcagtatagtctttatttaaactccatcagcaaccaaccaaaggacgaaaacattatggggctttttaagaagaccgaaatggtgtccagcgttcccgccgagaacaagagcgtgctcaacgaacaccaggagacttctaaacagtgcgaacagaaaatcgcaatcgaaaacgagtggaagcccgcagacatattcagcacattgggagagcgggagtgtgaccgctcatcactcgaagcaaagaaagcccagtggcgtaaagagctagacgaacaagtcgccctgaagaaaaaggagaaggaagtctccgaaaaatggaacgacccatggaagaaatcagaatcagacaaaatcatctgggagaaacatcaaattttggatcagtcacgcgagacggttctattggaacaccccttcagcgccgtgaaacaagaactgcagcgcaagtggattgaagagttaaataagcagatcgaggatgaccgtcagaggaagatcgaagagaaaattatctactctaaaggcgaggagcacgatagatgggccatgcactttgactccctgaaatcctatcctggtagccaatcccaattattttctcaatcaacccacaaacaacccgagtatttttgcgtcagccccgatactcaggagctcgcagacgtgtcctccgtgtgcacccccaccaccgggtcacaggtagagccatccgaagaagagcatattgcaaagcctatcaaggacgtggtcatggccaactctaaaaagacgaactttttgcgcagtatgaccgccttgctggatccggctcagatcgaagagagagaccgacgccggcagaagcaactggagcaccagaaagcaatcaccgctcaggtcgaagaaaagcgaaggaagaagcaacttgaagaggagcagcggaagaaggaggagcaggaagaagaactgaggttggctcaggaacgggaggaaatgcaaaaacagtatgaggaggacattctcaaacagaagcagaaggaagagataatgactctgaagactaacgagctgttccagactatgcagagggcacaggaactagctcagaggttgaagcaggagcagagaataagggagctggcgcagaagggtcacgatacaagccgcctgataaagaacctcggcgtggacaccatccaaatggaatataatgcttcgaatattagcaacagtagacatgattcagacgagattagtggcaagatgaacacatatatgaattctactacctctaagaaggacacaggtgtgcagaccgatgacctcaacatcggaatttttaccaatgctgagtcgcattgtgggagtctcatggagagggatatcactaattgctcttcccctgagatttctgccgagctcatagggcagttctccactaaaaaaaacaagcaggagttaacgcaggacaagggggcctcattggagaaagagaataacagatgcaacgatcagtgcaatcagtttacaagaatcgagaaacagacgaaacacatgaaaaagtatcccaaacgcccagattggaacatcaataagcccccgaaacgctatataccagcctccgagaagtatcctaagcaactgcaaaagcagcgggaggagaaaaaagtgaggagacagatggagctactccacctggtagagaagaacaatcccggacacctctcacaaaatcgtggaatctctcctgagatttttcactccagtcatcaggagaccgaatcgaagctcagatggcatctcgtgaaaaaagaggaggagcctctcaacatccatagcttttctaaagagcgctctccttctagccccgtacccgtagtgaagaatcggacacagcaaacgcagaatacgcttcacctaccacttaagaatagctcttacgagcgggaaaatttgatatcaggctctaaccagacagaattgagctcgggtatttctgagtccagtcattttatcccctatgtacggacgaacgagatctattatcttgaccctgatgcccctctgtccgggccttccacacaggacccccagtaccagaattctcaggattgtggtcagaaacgccaactattcgacagtgactgtgtccgtgacccactgttaaatcccaacatggtgaagaacagggatcgacaacaagctatcctgaaggggctgtcagaactgcgtcagggcctcctccagaaacagaaagagttggagagcagcttacttcccctggctgagaatcaggaagagagtttcggatcatccttttag

SEQ ID NO: 28853 - DNA, 2847 bp, Artificial Sequence
  Description of Artificial Sequence: Synthetic coding sequence
atggatctgctggacggactcaagctggagactgaactgttggacggtaagaccaagctgatccttagcccatatgagcataagtccaagatttcagttaagatgggaaataaggcaaagattgcaaaatgtcccctgcgaacaaagaccggccatatcctgaagagcacacaagatacctgtattgggtcagagaaactgcttcagaagaaaccagttggaagcgaaactagccaggcaaagggggagaagaacggcatgactttttccagtacgaaggacctgtgtaagcagtgcatagacaaagattgcctgcatatccagaaagagatttcccccgctactccaaatatgcagaagactagaaacactgttaacacttctctcgtgggcaagcagaagccacataaaaagcacattaccgcagaaaacatgaaatccagcctggtctgtctgacccaggaccaactccagcagatcctgatgacggttaaccaaggcaaccgctccctgtccttgaccgaaaacggcaaggaagccaagtctcagtattcactgtatttgaatagtatctccaaccagcctaaggacgaaaacattatgggcttgtttaagaaaaccgagatggtgagtagcgtgcctgccgagaacaagtccgttcttaatgaacaccaggagacaagtaaacagtgtgagcagaagatcgctattgagaacgaatggaaacctgctgacatctttagtaccctgggggagcgggagtgcgacaggtcaagcctggaggcaaagaaggcgcaatggcgtaaggaactagacgagcaagttgccttgaaaaagaaggagaaagaggtatccgaaaagtggaatgacccctggaaaaagtcagagagcgacaagatcatctgggagaaacaccaaattctggatcagtcccgtgaaacagtgctgctggagcatcctttctcagctgttaaacaggagttacagcgtaagtggattgaagaactaaataaacaaattgaggacgacagacaaaggaagatagaggagaagatcatctattccaaaggagaggaacacgatcgttgggccatgcactttgactcgcttaagtcttatcccggcagccaaagccagcttttttctcagtccacccataagcagccagagtacttttgcgttagcccagacactcaggagcttgcagatgtctcgtctgtttgcacacccactaccgggtcacaagtcgaaccatcggaggaagaacatatcgccaagcctattaaagacgtggtcatggcaaactctaaaaagactaactttctgcgtagtatgaccgctctgctggatcctgcccagatcgaggaacgggacaggaggagacagaagcagttagagcatcagaaagcgatcaccgctcaggtggaagagaagagaagaaagaagcagctcgaggaggagcagcgtaaaaaagaagagcaggaagaagaacttaggttagcccaagaacgcgaggagatgcagaagcagtatgaagaagatatcctaaagcagaaacaaaaagaggaaatcatgaccctgaagactaacgagctcttccaaaccatgcagagggctcaagagctcgctcagcgccttaaacaagagcagagaatcagagaactcgcccagaaggggcatgatactagccgtcttataaagaaccttggcgtagacacaatacagatggagtacaacgcttccaatatatctaacagccgacacgattccgacgagatttccgggaagatgaacacctacatgaactcaactactagtaagaaagacactggtgtgcagactgacgatcttaacattggtatcttcactaatgccgaaagtcactgtggctctttgatggagagggatattactaattgttcaagtccggagatctcagctgaactcattggacaattctctactaagaagaataagcaggagctcacccaggataagggagcctccttagaaaaggaaaacaatcggtgcaacgaccagtgcaaccagtttacccgcatcgaaaagcagactaaacatatgaagaaatacccaaaacgtcccgactggaacatcaacaagcccccgaaaagatatatacccgcctcagagaagtacccaaaacaactccagaaacaacgggaagaaaagaaagtccgccggcagatggagctattgcacttagtagagaagaataatcctggacatctgagtcaaaacaggggcatcagtcccgaaatatttcactcaagccaccaggaaaccgaatcaaaactgcgctggcacctagtcaagaaagaggaagaacctctgaacatccacagcttttccaaagaacggagcccctcttcacccgttcccgtggtgaagaacagaacacaacagacacaaaatactctgcacctccctctgaagaatagctcatatgaaagagagaatctgatcagcggctctaatcagacagaactaagcagtggtataagtgagagctcccacttcattccctacgtacgcaccaatgagatatattacctcgacccagacgctccactttctggaccttctacgcaggacccgcagtatcagaattcacaggactgtgggcagaaacggcagctgtttgactcggactgtgtcagagatcctctgctgaatcctaacatggtgaaaaaccgcgatcgacagcaggcaattctgaaggggctctcggaactgaggcaaggactcctgcagaaacaaaaggagctggaaagtagtctgctgccgctggccgagaaccaggaggagtcctttggttcttctttctag

SEQ ID NO: 28854 - DNA, 864 bp, Artificial Sequence
  Description of Artificial Sequence: Synthetic coding sequence
atggatttgttggacggtttgaaattggagaccgagttactcgatggtaaaactaaacttatactgtccccctacgagcataaatccaagatctctgtcaaaatgggaaacaaggctaagatcgctaagtgcccattgcggacgaagactgggcatattttgaagagcacacaggatacatgcatcgggtccgagaagcttctccaaaagaagccagtgggatcagagactagtcaggcaaaaggtgaaaagaacggtatgactttctccagcacaaaagatctctgtaagcagtgcatcgacaaggactgccttcatattcagaaggagatctctccggccacaccaaacatgcagaaaaccaggaacactgttaatacgagcttagtagggaaacagaaaccacacaagaagcacattaccgctgaaaacatgaaaagttcactggtttgcctgacgcaggatcaattgcaacagatactgatgactgtcaaccagggaaatcggtccctgagcctgactgaaaatgggaaggaggccaaatctcagtactcactgtatctgaattcgatttctaatcagcctaaggacgagaacatcatgggactgtttaagaagaccgaaatggtctctagtgtgccagccgaaaataaatctgtgctgaatgagcaccaggagacctcgaagcaatgcgagcagaaaattgcaatcgagaatgaatggaaacctgccgatatttttagtacacttggtgagcgtgagtgcgatagatctagcctcgaggccaagaaagctcaatggcgaaaggagctggtcctgcagaccgtccaggcgtggtaccagcatttgttaggcttttggtag

SEQ ID NO: 28855 - DNA, 1815 bp, Artificial Sequence
  Description of Artificial Sequence: Synthetic coding sequence
atggagaaccaagctcacaatacgatgggtacctccccttgtgaagctgagctgcaggaactgatggaacagatcgatattatggtgtcaaacaagaaaatggactgggagaggaagatgagagccctggagacgcgactcgacctacgcgaccaggagcttgctaatgcacagacctgtctggaccagaaaggccaggaggtcggcctgctgaggcagaaactggactcactcgagaaatgtaacctcgccatgacacagaactatgagggccagctgcaaagcctgaaagcacaattttccaaactgaccaataacttcgaaaagttacgtctgcaccaaatgaagcagaataaggtgccccgaaaggagcttccgcacctcaaggaagaaataccatttgaactgagtaacctgaaccaaaagttggaagagtttcgtgccaaatcgcgtgagtgggacaaacaggagatcttgtatcagacacatctcatttccttagacgcgcagcagaaactcttgagcgaaaagtgtaatcagttccagaaacaggcgcaaagttaccaaacccagttaaacgggaaaaaacagtgcctggaggattcgtcaagcgagataccaagactgatctgtgaccccgatccaaactgcgagatcaacgagcgggatgagtttataatcgagaaattgaagtccgctgtgaatgagatcgcactttcccgaaataagctgcaagatgaaaatcagaaactgcttcaggaattgaagatgtatcaacgtcagtgtcaggccatggaggctggcctctctgaggttaagtccgaactgcaatcacgggacgatctcctgcgcattatcgaaatggagcggttacagctacaccgggaactgttgaaaataggcgagtgccaaaacgcgcagggcaacaaaactcggctggagtcctcatatcttccatcgatcaaagagcctgaacggaagattaaggaactcttttcagtgatgcaggatcagccaaatcacgagaaagagctgaataaaattcgatcccagctgcagcaggtggaagagtaccataattcggaacaggaacgcatgcgaaatgagataagcgacctcactgaagaactgcaccagaaagagatcaccattgctaccgttacaaaaaaggcggcactcctggaaaagcaactgaagatggaattggaaattaaagaaaagatgttagccaaacagaaggtcagtgacatgaagtataaggccgtgcgtactgaaaatacgcatctgaagggcatgatgggggatttagaccccggagagtatatgagtatggacttcaccaaccgggaacagtccagacataccagtatcaacaagcttcaatacgaaaacgagcgcctgaggaacgatctcgctaaattacatgtgaacggcaagagcacttggacgaatcagaacacctacgaggagacagggaggtatgcttaccagtctcagattaaggtggaacagaacgaggagcgcttgtcccacgactgcgagccgaatcggagtacaatgccgcctctgccaccatcaacgtttcaagccaaggagatgacttctcccttagtgagcgatgatgatgtgtttcctttgagtccgccggatatgtcctttccagctagcctggccgcccagcatttcttactcgaagaagagaagagggctaaggagctcgaaaagttgttgaatactcacatcgatgagctgcaacggcacaccgaattcacgctcaataaatactcaaagctgaagcagaaccgacacatatag

SEQ ID NO: 28856 - DNA, 990 bp, Artificial Sequence
  Description of Artificial Sequence: Synthetic coding sequence
atggagaatcaggcccacaatacaatgggaacatccccctgcgaagccgagttacaggagctgatggaacaaatcgacataatggtatccaataaaaagatggactgggagaggaagatgagagccttggagacaagactagatttaagagaccaggagctggccaacgctcagacctgtctggaccagaaaggacaggaggtgggactgctccggcagaaactggattcccttgagaagtgtaacctcgccatgactcagaactacgagggacagcttcaatccttgaaggcccagttttctaagctgacaaataactttgagaaactgcggctgcatcagatgaaacagaataaggtaccgagaaaggagctgccgcatcttaaagaggagattccctttgaactcagcaatctcaaccagaaactggaggagttccgggctaagagccgcgagtgggataaacaagagattctatatcagactcacctgatcagtctggatgctcaacaaaagctgctgtctgaaaagtgcaaccagttccagaaacaagctcaaagttatcagacacagttgaatggcaagaaacagtgtctggaagactcttctagtgagattcctaggctcatatgcgaccccgacccaaattgcgagatcaacgagagggacgaattcatcatcgaaaaactgaaatcagctgtgaatgagattgctctctctcgcaataagctgcaggacgagaatcagaaactcctccaggagctgaaaatgtaccagcggcagtgtcaggctatggaagctgggttgtcggaagttaagtcagagctccaaagccgcgacgacctcctgcgcattattgagatggaaagactgcagctgcaccgcgagttgcttaagatcggcgaatgtcagaacgcacaaggcaacaagactcgattagagtccagctatttgccatccatcaaggaacccgagcgtaaaataaaatag

SEQ ID NO: 28857 - DNA, 1815 bp, Artificial Sequence
  Description of Artificial Sequence: Synthetic coding sequence
atggagaatcaggcccataataccatgggaacgagcccctgtgaggccgaattgcaggaactgatggagcaaatcgacataatggtctcaaataagaaaatggactgggagagaaaaatgcgcgctctagagactcgcttggatctccgagatcaggagctcgctaatgcacagacctgtctggatcagaaagggcaggaagtgggactactgcggcaaaaacttgacagcctcgagaagtgtaacttggccatgactcagaactacgagggacaattgcagagtctgaaggcacagttcagcaaacttacgaacaatttcgagaagctgaggcttcaccagatgaagcagaacaaggtaccccgcaaggagcttccacatctgaaggaagaaattcccttcgaattaagcaacctcaaccaaaagcttgaagagttccgtgcaaagagccgcgagtgggacaagcaggaaatcctgtatcagacgcacctgataagcctggatgcacagcagaagttgttgtctgagaaatgtaaccagttccagaagcaggctcagagctatcaaactcagctcaacggcaaaaagcaatgtctcgaagactccagcagcgagattcccagactgatttgtgatccagacccaaactgtgagataaatgagcgcgacgaattcattatcgaaaaattaaaaagcgcagtaaatgagatcgccttgtccaggaacaaattacaggacgaaaatcaaaagctgctgcaggagctcaaaatgtaccagagacaatgccaggcgatggaggccggcctttccgaagtcaagagcgagttgcagagtagggatgacctcctgagaatcatcgaaatggagaggctccagttgcatagagaacttctgaaaattggtgagtgccagaatgcccaggggaataagactcgcttggagtcctcgtacctcccttcaatcaaggagcctgagagaaagatcaaggagttgttcagtgtgatgcaggaccagcctaaccacgaaaaggagcttaataagattcggtctcagttgcagcaggtcgaggaataccacaattccgaacaggagcggatgaggaacgaaatcagtgacctgactgaagagctacaccaaaaagagataaccattgccaccgtcacaaaaaaggccgcccttctggagaagcagttaaagatggagcttgaaattaaggagaagatgctcgccaaacaaaaggttagcgacatgaaatacaaagcagtccgaactgaaaatacgcatctcaagggcatgatgggagaccttgaccctggcgaatacatgagcatggactttacaaacagggaacagtctcgccacacaagcattaataagctccagtatgagaacgagagactgcgcaatgaccttgccaagctgcatgtgaacggcaaatccacttggactaatcaaaacacgtacgaagaaactggccgctacgcatatcagtcacagatcaaagtagagcagaatgaagagcgcctgagccatgattgtgagccaaacaggtccactatgcctccgctgccacctagcacctttcaggcaaaggaaatgacctcacccctcgtttccgacgacgatgtcttcccattgagtcctccagacatgagcttccctgcctctctcgctgcccagcacttcctcctggaggaggagaagcgggccaaagagcttgaaaagcttctcaatacccacatagacgagctgcaacgacacaccgaattcaccttgaataagtacagcaaactgaagcaaaatagacacatctag

SEQ ID NO: 28858 - DNA, 1008 bp, Artificial Sequence
  Description of Artificial Sequence: Synthetic coding sequence
atgaccaccgtcaccgtgaccaccgagatccccccaagggacaagatggaagacaacagcgctctgtatgaatctaccagtgcgcatatcatagaggagacggagtacgtgaaaaagatccgcacgactcttcagaagatacggacccagatgtttaaggacgaaatacgacatgatagtacaaatcacaagctggatgccaagcactgtggaaatctgcagcaaggatctgattccgagatggatcctagctgttgctctttggacctgctgatgaaaaaaattaaaggcaaggatctgcagctgttagaaatgaataaggaaaatgaagtcctgaaaattaagctgcaggcatcaagggaagccggtgcagccgcactgagaaatgtggcccagagactgtttgagaactaccagacacagagtgaagaagtgcgtaaaaagcaggaggactcaaaacagttgctgcaggtgaataaattagagaaagaacagaagttaaaacaacacgtggaaaatcttaatcaggtggcagaaaaactggaagagaaacactcccagatcactgaactggaaaacctggtgcagcggatggaaaaggagaaaagaaccctgctcgaacgcaagctcagcctcgagaacaagctgctgcagttgaagtctagcgccacatatggaaaatcctgccaggatttgcagagagagatttccatcctccaggagcagattagccatctgcagttcgtcattcattctcaacaccaaaacttgcgttccgtcatacaggagatggaaggtctgaagaacaatctcaaagagcaagacaaacggatcgaaaacctacgcgagaaagtgaacattctcgaggcccagaataaagaactgaaaactcaggtggccctcagctctgaaacacctcgaaccaaggtttctaaagccgtcagcacctcagaacttaagacagagggagtatcaccttatttgatgcttatcagattgcgcaagtag

SEQ ID NO: 28859 - DNA, 1008 bp, Artificial Sequence
  Description of Artificial Sequence: Synthetic coding sequence
atgacaacagtgactgtgaccacagaaattccccctagagataaaatggaggacaactcagcactgtacgaatctacctcagctcacatcattgaagaaaccgagtacgtcaagaaaatacgaacaaccctgcagaaaatcaggacacaaatgtttaaagacgagattaggcacgattctaccaaccataagctggatgctaaacactgcgggaaccttcagcaggggtccgattcagagatggacccaagctgctgtagcctggacttgctgatgaaaaagatcaaggggaaggatctgcagctcctagagatgaataaggagaacgaggtgttaaaaatcaaactgcaggcaagtcgggaagccggagcagcagctttgcggaacgtggcccagcggctgtttgaaaattaccagacccagtccgaggaggtgcggaagaagcaggaggatagtaagcagttgttacaggtcaataaactggagaaagaacaaaaacttaagcagcacgtcgagaacctgaatcaggtggccgagaaactcgaagaaaaacattcgcagataacggaactagagaacttggtacagcggatggaaaaagagaagcgaaccttgctggagagaaaactgagcctggagaataagctgttgcagttgaaatcctctgcgacctatggcaaaagttgccaagacctgcagagggaaattagcatcctgcaggagcagattagccacttacagttcgtgattcacagtcagcaccagaatctccggagtgtgattcaggaaatggaggggctgaagaacaacctgaaggaacaggacaaacggatagagaatttgcgggaaaaggtgaacatcctggaggcccagaacaaggaactcaaaacccaggtagcgctttcatccgaaactccaagaaccaaagtatctaaagcagtgtccacttcagagctgaagaccgagggggtgtccccctacctgatgctgatccggcttcgaaagtag

SEQ ID NO: 28860 - DNA, 1008 bp, Artificial Sequence
  Description of Artificial Sequence: Synthetic coding sequence
atgactactgtgacggttaccactgaaatcccacccagggacaaaatggaagacaacagcgctctgtatgagagcacgtccgctcacatcatcgaggagacagagtatgtgaagaaaatcaggactacactgcagaaaatacgcacacagatgttcaaggacgagatccgtcacgactccaccaatcacaaactcgatgctaagcattgcggaaaccttcagcaaggttccgattccgaaatggatcccagctgttgtagcctggacctgcttatgaaaaagattaagggcaaagatctccagctcctggaaatgaataaagagaacgaggtgcttaagatcaaactgcaggcatcaagagaagccggcgctgccgccttacgtaacgtggctcagagactgttcgaaaactaccagacgcaatcggaggaggtcaggaagaagcaggaggatagcaagcaattgctccaggttaacaagcttgagaaggagcaaaaactcaaacaacacgttgaaaatctgaatcaggttgcggagaaactggaggaaaaacattctcagatcacagaactggagaacctggttcaacgcatggagaaggaaaagcgtacactgctggaacgaaaattgtcacttgagaacaaactactgcagctcaagagctctgctacctacggcaaatcttgtcaggacctgcagcgtgaaatctctattcttcaggagcagatatcacatttgcagtttgttatccatagtcagcatcagaaccttagatctgtgattcaagagatggagggcttaaaaaataatctaaaggaacaagacaaacgcattgagaatctccgggagaaggtcaacatcttagaggctcaaaacaaggagcttaagacccaggtcgctctctcttccgagactcctagaacaaaagtatccaaggccgtcagtacctccgagttaaagaccgaaggtgtgtcaccgtatctgatgctgattcgactcaggaagtag

SEQ ID NO: 28861 - DNA, 891 bp, Artificial Sequence
  Description of Artificial Sequence: Synthetic coding sequence
atgggttgtcgtcactcgagattaagttcctgcaagccgcctaagaagaagcggcaggagcctgagcctgagcagccaccccgtccagagcctcacgagctggggcctctgaatggcgatactgccattacagtgcagctgtgtgcttccgaagaagcagaacgacaccaaaaggacatcacaagaattctacagcaacacgaggaggagaaaaagaaatgggctcaacaggtcgagaaagagcgcgaattggagctccgcgacagactcgatgagcagcagagggtgctggaaggaaaaaacgaagaggctctgcaagtgttgagggccagttatgagcaggaaaaagaagcgctaacccacagctttagggaagcatcctccacccagcaggagactatagacagattaacttctcaactcgaggcatttcaagcgaagatgaaaagggtcgaggagtctatcttaagtcggaattataaaaagcacatccaggattatggatcacctagccagttctgggaacaagaattagaatctctacatttcgtcatcgagatgaaaaatgagcggatacacgagcttgatcggagactgattctcatggagaccgtgaaagagaagaacctgatactcgaagagaaaatcacaactctgcagcaggaaaacgaggatcttcatgttcgctctcggaatcaagtagttctttcacggcagctgagcgaggacctcctgctcactcgggaagctctggagaaggaggtgcagctgagaaggcagctgcagcaggagaaggaggaattgctatatcgagtcctgggcgcgaacgcctctccagccttcccactggcccctgtaacacccactgaggtatctttcctcgccacctag

SEQ ID NO: 28862 - DNA, 609 bp, Artificial Sequence
  Description of Artificial Sequence: Synthetic coding sequence
atgaggactagcatgagcgaggccgccacaagatggagttgtcaggggtcttgtcagaagacatgtttctctagagtgagaccgtggcggcgaaggtgctcgtgcggggattcctctagccggcggagacgatcctgttgcactggcagtctggggcctatgccccggctccctagtctctggccactcagcttgccactgagaagtctgtcctccccccatcgggtgcagggcctcggacccccacgtaggctcaagtcacagctgctcccccgcttcttctggcgccgccagcaggagcctctctccagcttccctggccgcaatgagggaggcagcgagatggaaatactgggtgtttgccctgtgtcccccggcgctctatcctatatggagagcccaactggcttttggagacccagagaagcctcttccttagaactggcaaagggaataagcaagaggagacacttcctccccgctcccgctctgtgccccaacccccgctcttccgaggcttttcctggccagtccgtgagccggtggcctttcgacattaaggagacggccccaggacccagcctgagcgccttgctacctacatgttag

SEQ ID NO: 28863 - DNA, 1461 bp, Artificial Sequence
  Description of Artificial Sequence: Synthetic coding sequence
atgaaacctgtcaagcatctgctaactacatcgaataagtctgccaacgtaccagccctcacaactaaaaaaggtctccataatctgcctctgagccctgagttgaaggaaaaacacaatgccaagctaatccatgacaagattgagcctatggttctccgatctcctcctacgggcgagtctatactgagatacgcgcttcccatcccctctagtaagaccaagaatttgcttcccgaggacgaaatgatcgggaaaattatcaaacatctgaagatggtcgtgtctacgttagaagagacctacggccactgtgatcagaatggagaggaacctttcgtcaaacacgagcacgaagagctatctctgagtgttggggatgatatgaatagcttcctgacatactgcagccagttcgccgcacagcttgaggaagccttgaaagaggagcagaatatcttggagtcactgtttaagtggttccagtggcaggtcaatcagatggaagagatttctaaagatcagacattactgcaggcagagccccccaaaccagataaaactgtgatccttaacatcgccgagatcgttagattggtgcagagatttgaggaactgaagaataggttaaaacagcgctccaagagtagcgtgaaagtaatgctgtcgaagacgatggataaggagaatcgtccagaagctgtgaaaagctgcgaggcactcgcccaaaagattgaggaatttcttgaggcacacagcactgacgaattcaaagacgtctccgccacagaacctcagacagctcatagtatgacaaatagattcaacgcaatgttgaaggtctttgagaaccaggcgaatatgctggagcgtgccgtgaacgatcaggtgctcctggatgcagagtacaagcagatgcaatgcgactttcagctgctatctgaagaaaagctggtgttagagaacgagcttcaaaagttgaaagacaaggagaagactaagccaactaataaccggactaaaaaggccgtgaagacggtcaagaaaaaggataagggcaaatccgaagattcggagaagaagatgtctccagagaaggagttcaaaatcaaggaagacttagaccaggtacagaaggtagcaagacttgaaatcgaaaataaagtccttcaagagcagctaaaacaagcactccaagaggccgaaaaggccaaacatcagttgaactatttcctgaaccaggagaagctattgaaaagcgaaggcaaaacggaaaccaccatgcaagtggggaactcacagaccaaggtgaaaggggaggattcaaagaatatccccctcgagaaggagacccggaaatctcttgttagcgattcagggggacaacgcacctccgataaaatccaagagtacccccaaatcaccgcgcagtccggccgcctaatagaaaaacggtgctag

SEQ ID NO: 28864 - DNA, 840 bp, Artificial Sequence
  Description of Artificial Sequence: Synthetic coding sequence
atgaaaccagtgaaacatttgctgacgacatcgaataaaagcgccaatgtccccgccttaaccaccaagaagggtctccacaaccttcctttgtcccccgaactgaaggagaagcacaacgcaaagctgattcacgacaagatcgaacccatggtgctgcgttcaccacctacaggggagagcatccttagatatgcccttcccattccaagttccaagactaagaacctgttgcccgaggacgagatgattggaaagattatcaaacacttaaagatggtggtttctactctggaggaaacttacggacactgcgaccagaacggcgaggagccatttgtcaaacatgagcacgaggagttgtccctgtctgtgggcgatgatatgaactcatttctgacttactgcagtcagttcgctgctcagcttgaagaggcactaaaagaggagcaaaatgtgtgcatactgtatattctaagcattttcctgaaatggttccagtggcaggtcaaccaaatggaagaaattagcaaggatcagactctgcttcaagctgaaccccctaaacctgataaaacagtgattctaaacattgccgagattgtgcgtctggtgcagaggttcgaagagttgaagaatcggttgaaacagcgctccaaatccagtgtcaaagtcatgttatccaaaactatggacaaggaaaaccggccggaagccgtgaagagctgtgaggctctggcacagaaaatcgaagaattcctcgaagcacatagcacagatgaattcaaggacgtttccgcaacagaaccaagaaaattcccactgatcaaagctctctag

SEQ ID NO: 28865 - DNA, 1461 bp, Artificial Sequence
  Description of Artificial Sequence: Synthetic coding sequence
atgaaaccagtcaagcacctgctcacaaccagtaacaagtccgccaacgtacccgccctcacaactaaaaaggggctgcacaatctcccactgtcaccagagcttaaagaaaagcacaatgccaagctcatccacgataaaattgagcctatggtactccggagtccaccgacgggagagagcatactgcggtatgccttgccaattccatccagcaagacgaagaatctgctgcccgaggacgaaatgatcgggaaaatcatcaagcatctgaagatggtagtttctacattggaggaaacttatggtcattgcgatcagaatggggaagagcccttcgttaaacatgagcatgaggagcttagtctctctgttggggatgacatgaattctttcctaacatactgttcccagtttgccgctcagctggaggaagcgctgaaagaagaacaaaacatcctggagtctctgtttaagtggttccagtggcaggtcaaccagatggaggagatatccaaagatcaaactctgctccaagccgagccgcccaaaccggataagaccgtcattctgaatattgccgagatagttaggttggtgcagcgctttgaagagttaaaaaatcgcctgaagcagaggtcaaagagttccgttaaggttatgctttctaaaacgatggacaaagaaaaccggccagaggccgtgaaatcttgtgaggccctggcccagaaaatcgaggagtttctcgaagcccattctactgacgagttcaaagacgtatctgccaccgaaccacaaactgcccattcgatgaccaacagattcaatgccatgctgaaggtctttgagaatcaggccaatatgctggagcgggctgtaaacgaccaggtgctgctagatgccgaatataaacaaatgcaatgcgatttccagctgctgtcagaggagaagcttgtgctagagaatgaacttcagaaactgaaagataaagagaaaacgaagcctacgaacaaccggacgaagaaggcggtgaaaacagtcaaaaagaaggataagggaaagtctgaggattcagaaaagaaaatgtcccccgagaaagaatttaaaatcaaggaagatctggatcaggttcagaaagtcgcccggctcgagatcgagaataaggtcttgcaggagcagctgaagcaagctctgcaggaagcagaaaaggcaaagcatcagctcaattatttccttaaccaagagaaactgctgaagagcgagggcaagacagaaactacaatgcaggtcggcaacagtcaaacaaaggtcaaaggcgaagactcaaagaatatcccacttgagaaggaaacgcggaagagtctggtttctgattcaggaggtcagaggacttcagacaaaatccaagaatatcctcagatcacagctcaatctgggaggctcatcgagaaacgttgctag

SEQ ID NO: 28866 - DNA, 483 bp, Artificial Sequence
  Description of Artificial Sequence: Synthetic coding sequence
aaaactaagcctaccaacaacaggaccaaaaaagccgtgaagaccgtgaaaaaaaaagataaggggaaatcagaagactctgaaaaaaagatgtctccagagaaagaattcaaaatcaaggaagacctcgatcaggttcaaaaggttgcacgcctcgaaatagaaaacaaggtgctgcaggagcaattaaaacaagcattgcaggaggctgagaaggccaagcatcaactaaattattttttgaaccaggaaaaactgctaaaatcggagggcaaaacagagacaacaatgcaggtgggtaacagccagactaaggtgaagggtgaggacagcaaaaatattcctttggaaaaggagactagaaagtccttagtgagcgactcaggaggtcagagaactagcgataaaatacaggaatatcctcagatgcttatcgagttccttaaatattttggaaaagttagccaaacctttagagaatag

SEQ ID NO: 28867 - DNA, 516 bp, Artificial Sequence
  Description of Artificial Sequence: Synthetic coding sequence
atgaaaccggtgaaacacctcttgacaacctctaacaaatctgcaaatgtgcctgcactaaccaccaagaaaggccttcacaatttgcccctgtcccctgagctcaaggagaagcacaatgctaaactgattcatgacaaaattgagcctatggtgttgaggtctccacccaccggtgagtccatcctgagatatgctttaccaatccctagttctaagacaaaaaacctgctaccagaagatgaaatgattggcaaaataatcaagcatctgaagatggtcgtgtctacactcgaggagacctatggacactgtgatcaaaatggtgaagaacctttcgtcaaacatgagcacgaggagcttagtctgagcgtcggagacgatatgaacagctttctcacctactgctcacagtttgccgcgcaattagaggaggccctgaaagaagaacagaatatcctcgagagcctgtttaagtggtttcagtggcaggtaaatcagatggaggaaggatag

SEQ ID NO: 28868 - DNA, 528 bp, Artificial Sequence
  Description of Artificial Sequence: Synthetic coding sequence
atgaaacccgtgaagcacctgttgaccacatccaacaagagcgccaacgtgccagcgcttaccaccaagaaggggctgcacaatttacctctatcgccagaactaaaagagaaacacaacgcgaaactgatacacgacaaaattgagccaatggtgttgagatcccctccaaccggggaatcaatccttaggtacgcccttcctatcccttcatccaaaaccaagaacctgctgccagaggatgagatgattggcaagataataaagcacttgaaaatggtcgtgtctactcttgaagaaacctatggacactgtgaccagaacggggaggagcccttcgtgaaacatgagcacgaggagttgtccctcagtgtcggggacgacatgaacagtttcctgacttactgttctcaattcgccgcccagctagaggaagcactgaaagaggagcagaacatcctggagagccttttcaagtggttccagtggcaagtgaaccagatggaagagaaactcctgattcagtag

SEQ ID NO: 28869 - DNA, 522 bp, Artificial Sequence
  Description of Artificial Sequence: Synthetic coding sequence
atgaaacctgtcaagcacctcctcacgacctctaataaatcagccaatgtaccagccctgacaactaagaagggcctgcacaatctgccactgagtcctgagctaaaagaaaaacacaatgccaagctgatccacgataagattgagccaatggtcctgcggagtcccccaaccggagaaagcatcctccggtatgccctccccatcccatcgtccaagacaaagaatttgctgcccgaagatgaaatgattggaaagatcataaaacacctgaagatggtggtgtccacactggaggaaacctatgggcattgtgatcagaacggtgaagaacccttcgtgaagcacgaacatgaggagctgagtctcagcgtcggggacgatatgaacagcttcctgacctactgcagccagtttgcagcacaactggaggaggccttgaaggaggaacaaaatattctcgagtccctctttaaatggttccagtggcaggtgaatcagatggaagaaagctgcaagtag

SEQ ID NO: 28870 - DNA, 516 bp, Artificial Sequence
  Description of Artificial Sequence: Synthetic coding sequence
atgaagcctgtgaaacacctcctcaccacaagcaataagtcggctaatgtgccagccctcacaacgaagaaagggttgcataacctgccgcttagtccggagttgaaggagaaacacaatgctaagttgattcatgataaaatagaacctatggtcttgcgaagcccgccaacaggtgagtctatcctgaggtatgccctccctataccttcctctaagacaaaaaaccttctgcctgaggatgagatgatcggaaaaatcattaagcatctgaagatggtggtgagcaccctggaagaaacttatggtcactgtgaccagaatggggaagagcccttcgtgaagcatgaacacgaggaactgtcactttctgtcggcgatgatatgaactccttcctcacatattgcagccagttcgccgctcagctggaggaagctctcaaggaggagcagaatatcctggaaagtttgtttaagtggtttcagtggcaagtgaaccagatggaggagggatag

SEQ ID NO: 28871 - DNA, 1404 bp, Artificial Sequence
  Description of Artificial Sequence: Synthetic coding sequence
atgtccgtcgtagtccagcacgttgaagagaaggctgttcatagctggagtcgcataagtaccgctggcaagaaggccctggaagaagcactcctggtcttcaatccaatgtcccaagacctgtccgcgacagaagcgcagcttgtcgcattcctgcagggacttcgagatgatgggttccagccaaccatcttgagatccggggacgtgtatgggtatagttcatgcaccgccaacccaccttcccagaccaagctccaggcgagagcgcctaaccccaccgccacttctccgcccgccagtgctccacgcactgccatgaggctacccgcaggaagagccacactgttgcctatgcctctgtccggacgtctcgctaaagccagcacacccgccctggccaagcacgctactacaaatttactcctctcttcactcaagcagtctagcgcctcacatgctcggggggccgccgtgggctttcccacgcacttgtaccccggggtgtaccccgctatgcggctgtcggtggtgctcgaggctctcgtgcccctgaagacccctatgccatgccttggtgccaagcacaaggctcagagtttacagctttcgttggccgatagccctttgaagcttaggaaatcttctgggaagggtcctgggaatcctcggcctaaagccccccgtaagacaacgagcaaaggcccaaaatgcctcacgaggaaaggcccgggcgccgggccaagacgaggaagcggccatcagagtaaaacaaacagagccacaggatctccaagcgtccggcggatgaagggagggtccgctctagggacgaaaacagcgcaggccaaggtggcccgtactctcgcaaaggccgccagggctcaggccaaagtggcccgcacccaagctaaagccgctaaggcccgcgcaaaggctaaggcagcccaggtgaaagcaaaagctaaagccaaggctgcccaagtgaaggccaaagcaaaggtgatggccgcatgggccaaagccaaggccaaggcaaaggctgtccgtgccaaggcgaaagtggctcgcacgcagcccaggggtagaggaaggccaaaggggtctgctaaagcacggactacgagaaaggggcaaaagaacagacctgagaccgtgggccagaagcgcaaaagggctgaggaggctaaggatcttcctcctaagaaacgaacccgacttggaccgcgtagtcctaaagcctggctgggtccaggaaccgcaaaactcttgaaatttcgcgccatcaaggttgaccgaagaagcagcgacgatgaggtgaggcagagagctcaaaggatcctccgcgtgaacctcagcccagtaatcaggctacagcctttgctgccctatagcgcagtgtag

SEQ ID NO: 28872 - DNA, 708 bp, Artificial Sequence
  Description of Artificial Sequence: Synthetic coding sequence
atgcgccgttccatgaagcggcgccgtcgccgcaggcccgtggcccccgccacagccgctcggggcggcgatttcagagccgaagacggggccggtctggaggctcgagaagagaaggtcgtgtactcacgatcccaactttccctggccgactccaccaaagcacttggtgatgccttcaaactgtttatgccccggtccacggagtttatgtcaagtgacgctgaactctggtcctttctgtgcagtctgaaacaccagttttcgccacacatcctgaggagtaaggatgtctatggatactcttcttgtcgagcgcttgtgcccgatccacccggaccgccgacggctcgaggccaggcccggagacccgttccaagagctgccgctcgccggaggaggcgaggcgccagagccgcagcagctaggcgccgcaagccccggccacctccacctccacctcctcctccagaagagagctgtccagccaaacctgttgccccagggccttgtttcggaggaagaacccttgaagagatctggcgcgctgcaaccccaacgctgactacgttccccacaattagggtggggagtgacgtgtggggcgagcggtccttggcagcggcaagaagaagggccaggcaggtacttcgcgtgaatctcgagcctatggtcagactcagacgctttcccgttccacgcgcctag

SEQ ID NO: 28873 - DNA, 195 bp, Artificial Sequence
  Description of Artificial Sequence: Synthetic coding sequence
atgagcgggcgagagggaggcaagaagaagccactgaaacaacccaagaagcaggcgaaggagatggacgaggaggataaggcctttaagcaaaaacagaaggaggagcaaaagaaactggaagaacttaaggctaaagctgcaggaaagggacccctggccacaggcggaatcaagaaaagcggaaaaaagtag

SEQ ID NO: 28874 - DNA, 1137 bp, Artificial Sequence
  Description of Artificial Sequence: Synthetic coding sequence
atgagcggcgctggcgtggctgcaggcactcgacccccttcaagtccaacaccgggatcccgcagacggcgtcagaggccctccgtaggggtgcaaagtttgaggccacagtccccacaactgcgccagagcgatccacaaaaaagaaatctcgacctcgagaagagtctccagtttctccagcagcaacactcagagatgctggctaagctgcatgaggagattgagcaccttaaaagggagaataaggatctccactacaagctgattatgaaccagacatctcagaagaaagacggccctagcggcaatcatctctctcgagccagcgcaccactgggcgctcggtgggtttgtatcaacggagtatgggtcgaacctggaggcccaagtccagcgagactgaaggaaggctcgtcacgaactcacaggcccgggggcaaacgcggtcgcctcgccgggggcagcgccgacaccgtcaggagccctgctgatagcctgtctatgagcagttttcagtctgttaaatctatcagcaacagcggcaaggctcgtccccagcccggatccttcaacaagcaggactcaaaagccgatgtttctcagaaggctgacctggaagaagagccattgctgcacaactcaaagctggataaagtcccgggagtgcaaggacaggctcggaaagagaaggcagaagctagtaatgccggcgcagcttgcatggggaactcccagcaccaaggacgacagatgggggcaggggctcacccacccatgatcctccccctccccctccgtaagccaaccactctccgccagtgtgaagtattgattcgggagctgtggaacacaaatctgctgcagactcaggaactgaggcatctgaagtctcttctggaaggatcgcagaggccgcaagctgccccagaagaggcaagtttcccaagggaccaagaagctacccactttcccaaggtctcgaccaaatcgttgtccaaaaaatgtctcagtccaccagtggcggaacgagctatacttcccgcccttaagcagactcccaaaaacaattttgccgagagacagaaaagactccaggcaatgcaaaagaggcgcctacacagaagcgtactctag

SEQ ID NO: 28875 - DNA, 993 bp, Artificial Sequence
  Description of Artificial Sequence: Synthetic coding sequence
atgggccgcaatccttgggactcaccttgcccagctaggagtttgcctcagattgcagccgtcgcgcgcccaagaatctccagtcccatggccctgtcaccgcatatgctaggcgcgcaggggctctggacacatagtatccagggcagcttgcccgcaatttgggctgcaacaatggggaccaagggggggagcagagtattgtttccatgccatctttcgaaagcactgccacacccagattccggcccgcatcccgcacaggacccagggctctggtcgcaagctcacttccctttgtcattgggactgggactcacatccggtggtcatctcactggaggttggtctcagcccggaaacatcgctgctggcgccgtgccacgtgcgctgccttcacaaggcgatatggagaaaggtgttgagggggggcccttcccttcccggtgcggtaacagctcggagcttttctgggctaaatgtggcccctcccggcagccacagccgtgtagcgctggcgacgcagaccggacgcgcgaggaagccatgttgagcctagggacctgctgttcaatgtgcccaaaacccagctgttttcccgatggcccaagtggaaatcacctaagcagggcctccgccccgctgggtgctcgatgggtctgcataaatggggtgtgggtcgaacccggaggcccaagccccgcccgcctgaaggagggtagctcccgcacccatcgacccgggggcaagagaggaaggctggctgggggcagcgctgacaccgtacgaagtcccgcggattccctttccatgtccagtttccagtcggttaaaagtatttctaattcgggtaaagctcggcctcaaccaggttcattcaataagcaagactctaaagctgacgtgagtcaaaaagcagatctggaggaggagcctctcctgcacaattcaaaattggacaaagtacccggcgtccaagggcaggcccggtag

SEQ ID NO: 28876 - DNA, 939 bp, Artificial Sequence
  Description of Artificial Sequence: Synthetic coding sequence
atgtctggtgcaggggtggcagctggcactagacctccatcctcacccacaccaggaagccgccgtaggcgccagcgcccaagtgtcggagtgcaatccttgcggccacagtcaccccagctgaggcagagcgacccccaaaagcgcaacctggacctcgagaaaagcctgcagtttctgcagcagcagcattcagaaatgctggcaaaactccatgaggagatcgagcatctaaaacgcgagaacaaagacctgcattataagctgattatgaaccaaacttctcagaaaaaggattcgctgagcatgtcctctttccagagcgtgaaatcaatatccaattctggcaaggcccgcccacagccgggttcgttcaataagcaagactcaaaggcagatgtcagtcagaaggcagatttggaagaagaacctttgctgcacaatagtaaattggataaggttcccggcgtccaggggcaggcgcggaaagagaaggccgaagcaagcaatgccggagccgcatgtatgggcaactctcagcaccagggcaggcagatgggagcaggggcgcacccacccatgatcctaccattgccactccggaaaccaacgactctccggcaatgtgaagtacttatccgagagctgtggaacaccaatctactgcagacacaggaactacgccacttaaaatctctgctcgagggctcccagcgccctcaggctgcccctgaagaagcctcttttcccagagatcaagaggccactcattttccaaaggtctctactaaaagtttgagcaagaaatgcctgagtccgcctgtagccgagcgtgctatactcccagcgttaaaacagacccccaagaataatttcgctgaaagacaaaagcggcttcaagccatgcaaaagcggaggctgcaccgcagcgtgctgtag

SEQ ID NO: 28877 - DNA, 1143 bp, Artificial Sequence
  Description of Artificial Sequence: Synthetic coding sequence
atgagcggggccggagtggctgccggaacacgtcccccctcttcacctacacctggtagccgtcgtcggcggcagcgaccaagtgtgggtgtgcagtctttgcgccctcaaagtcctcaattacgccaatcagatccacagaagcgaaacctggatctggagaaatccttgcaattcttgcagcagcaacactcggaaatgttagctaagctccacgaggaaatagaacacctcaaacgagaaaataaagacctacggtacaagcttatcatgaaccagacgagccagaaaaaggatgggcctagcggaaatcatctgtctcgggcctcggcccctttgggagctcgctgggtctgcatcaatggcgtttgggtggagcctggcggtccctctccagcccggctcaaggagggatccagcagaacccatcgtcccggggggaagcatggacgcctcgccggcggctctgcggacaccgtaaggagtccagccgacagccttagcacctcgagtttccagagtgtgaaatccatatctaactcaggcaaggctcgacctcagcccgggtctttcaacaagcaagacagcaaagcagatgtgccccagaaagctgacctcgaggaggaacctctgctgcataactcaaagctggataaagtgcccggggtccagggccaggccaggaaggaaaaggccgaagctagtaacgccggggctgcctgcatgggaaattcacaacaccagggaagacaaatgggtgcagcggcacaccccccaatgattctgcccttgccacttaggaagcctaccacactgcggcagtgtgaagtgttaattcgggagctgtggaacactaatttactccaaacccaggagctgcagcatctgaaaagtctgctcgaaggctctcagcgtcctcaggctgtgcctgaagaggccagcttcccaagggaccaggaagcaacccacttccctaaagtgtctaccaagtcactctctaaaaagtgccttttattaagccctccagtagcggaacgagccatcctccccgcgttaaaacaaaccccgaaaaacaacttcgccgaacggcagaagcggctgcaggcaatgcaaaaaaggaggttacatcgttctgtgctgtag

SEQ ID NO: 28878 - DNA, 1449 bp, Artificial Sequence
  Description of Artificial Sequence: Synthetic coding sequence
atgggccgtaatccctgggatagcccttgtccagctcggtcgctgccccagatagccgccgtcgcccgacctcggatctcaagcccaatggccctcagccctgacatgcttggcgctcagggtttgtggacacacagcatacagggctctctgcccgcaatttgggccgccacaatgggtaccaagggcggtagtcgagttctatttccatgtcatctgtccaaggccctgccacatccggacagtggccctcaccctgcacaggactccggtttgtggtcacgcgcccatttccccctgtccctgggcctgggcctgacttccggaggtcacctcacgggaggatggtcccagcccggcaacattgtggctggagcagtgccacgagccttgccctctcagcgtgacatggaaaacggtgtggaggggggaccatttcccagtaggtgcgggaattcaagtgagctgttttgggccaagtgtgggccttcgagacagccccaaccttgtagtgccggggatgctgaccgtactcgcgaagaggctatgttatcattggggacttgttgcagtatgtgtccgaagccatcctgcttccccgacggtccgtctggtaatcacctctcacgcgcatccgcgcccctgggcgccagatgggtgtgtatcaatggtgtgtgggtcgagcccggagggccctcacccgcacggttaaaggaaggctcctcccggacccatcgccccggcgggaagcatggtagactagccggcgggagcgctgacactgttcggtcaccagccgatagtctgtccacctcatcatttcaatccgttaagagcatatcaaactccggcaaggcccggccacaacccggcagctttaacaagcaagactccaaagctgacgtaccccagaaagcagatcttgaagaggagcccctgctacacaacagcaaactggataaggtgcccggcgtccagggacaggctcgcaaagaaaaagccgaggcatctaacgccggggcggcttgcatgggtaactcgcagcaccagggtaggcagatgggtgccgctgctcacccccccatgatcttacccctgcccctccgtaagcctacaacactgcgacaatgcgaagtgcttatcagggagctttggaacaccaacctgctccagactcaggagctgcaacacttgaagagtttactcgagggcagccagcggcctcaggccgtaccagaggaagcttcatttccccgggatcaggaggctacgcattttcccaaggtcagcacgaaatctctgtctaagaagtgcctgttactgagcccgccggtcgcagagagggctattttacccgcccttaaacagaccccgaagaacaattttgcggagcgccagaagcggctgcaggctatgcagaaaaggcggctacatcgcagcgtgctgtag

SEQ ID NO: 28879 - DNA, 945 bp, Artificial Sequence
  Description of Artificial Sequence: Synthetic coding sequence
atgagcggggccggcgtggctgctggtactcggcccccttccagtccaacgccgggctctcgccgccggaggcagaggccaagcgttggcgtacagtctctcaggccgcagtcgccccagctacgacagagcgatccacagaaacgcaacctggatctcgagaagtccctgcagttcctgcagcagcaacattctgagatgctggccaagttgcatgaagaaatcgagcacctcaaacgagagaataaagatctgcgttacaagttgataatgaaccagacttctcagaagaaggacagcctgagcaccagtagcttccagagcgtgaaatccatttcaaattccggaaaagcccggccccagccaggttcgttcaacaagcaagatagtaaagccgacgtgccccagaaggcggatcttgaggaggagccactgctccacaactcgaaattagataaagtccccggggtccaaggccaggctcggaaagagaaggccgaggcctccaacgcaggggcggcctgcatggggaactcacaacaccagggtcgccagatgggagccgctgctcatccccccatgattctccccctccccttgcgtaaacctactacactccgacaatgcgaagttctgatcagagaactttggaacaccaacttgctccagacacaggagctgcagcacctaaagagcttactcgagggatcacaaaggccacaggccgttcccgaagaagcctcttttccccgggatcaagaagctacgcatttcccaaaagtttccaccaaaagcctgagtaagaagtgcttgctcctatcacctcctgtggcagagagagccattcttccagccttgaaacaaactccaaagaacaactttgccgagcgtcagaaaaggctgcaggctatgcagaaaaggcgcctgcatcggagcgtgttgtag

SEQ ID NO: 28880 - DNA, 618 bp, Artificial Sequence
  Description of Artificial Sequence: Synthetic coding sequence
tgaagtggcgctggcgtagctgccggaacaaggcccccaagtagtcccacacccggcagcaggcgtcggaggcagcggccttctgtaggcgttcagagcctcagaccgcagtcccctcagctgcgtcagagcgatccccagaaacggaatctagatctggagaagtctctgcagttccttcaacaacaacattccgaaatgctcgctaagctgcatgaagaaatcgaacacttaaaacgggagaacaagggggaaccagcacgcggcccaaggcccgccctgcctcctcaggcacattctactctgcctttgccccagcatcggaatacggcaatcaattctagtacccgccttggatcagggggaacgcaggatgacttgaggtacaaattaattatgaaccagacctctcagaagaaggacggtccaagtgggaatcatctctctagggcgagcgctcccctgggcgctcggtgggtttgcatcaacggcgtctgggtggagccaggagggccctctccggctcgcctgaaagaaggatcctcacggactcatcggcctggtggcaaacacggccgacttgctggcggatcggctgatacagtgagatctccttag

SEQ ID NO: 28881 - DNA, 471 bp, Artificial Sequence
  Description of Artificial Sequence: Synthetic coding sequence
atgtcccgtaagagcggcattggacatgaggcaagcctgaaacgcaaagccgaggagaagctggagagctatcgcaaaaagatacatatgaaaaatcaggccgaggagaaagccgcggagcagtttcgtatgcgcctcaagaacaaacaggacgaaatgaagttggagggagacctgaggcgctcgcagcgggcgtgccaacagcttgacgtccagaaaaatattcaggtcccacgcgaggcctggtactggctgaggttggaggaagaaacagaggaagacgaagaggagaaggaacaggacgaagacgagtacaagagcgaggacctgtcagttcttgagaagcttcagatcctgacctcctacctgagagaggaacatctctattgtatttggtgtggtacagcatacgaagataaggaggatctcagttccaattgtcctggccccaccagtgcagaccacgattag

SEQ ID NO: 28882 - DNA, 780 bp, Artificial Sequence
  Description of Artificial Sequence: Synthetic coding sequence
atggccgaagaggaggattatatgtccgactccttcattaacgtgcaggaagatattaggccaggtctgccaatgctgcggcaaatccgggaggcacgcaggaaagaggagaaacagcaggaagctaacctcaagaatcggcaaaagagcctaaaagaggaagagcaggagcggcgtgatatcggcctcaagaacgccctagggtgcgagaataagggttttgccctcctgcagaaaatggggtacaaatcaggacaggcgctcgggaaaagcggaggcggaatagtcgagccaattcccctgaacatcaagactggtaaatcaggtatcgggcacgaggctagcttgaaacgtaaagcagaagaaaagctggagagttatcggaaaaagatccacatgaaaaaccaggccgaagaaaaagcagcagagcagttcaggatgcgccttaagaacaaacaggacgagatgaagctcgagggagatctgcgtagatctcaacgggcttgccagcagctggatgtgcagaaaaatatacaggtacccagagaagcctggtactggcttcggctggaagaggaaactgaagaggatgaggaggaaaaggaacaagacgaggatgagtacaaatcagaggacttgtcagtgctggaaaagcttcagatccttacctcataccttcgcgaagaacacctgtactgtatctggtgcggaaccgcttatgaagataaggaggacttgtctagcaattgcccaggtcccacgtccgcagaccacgattag

SEQ ID NO: 28883 - DNA, 393 bp, Artificial Sequence
  Description of Artificial Sequence: Synthetic coding sequence
atggtggtagccgctggtaaacgtttttgcggcgaacacgcgggggctgcggaggaagaggacgcaaggaagcgaatcctgtgccctctggaccccaagcacaccgtttacgaggaccagcttgcaaagcatctcaaaaagtgcaacagcagggagaaaccaaaacctgacttttacattcaggacattaatgccggcctgagggacgagaccgaaatccccgagcaattggtgccgatcagttctctgtcggaagaacagctagagaaactgattaaaaagcttcggaaagcctctgaagctttacacgacgcgctgaatgacccaaagaatggggactccgcaactaagcatctcaaacagcaggtctgtctcggttatagcaactactag

SEQ ID NO: 28884 - DNA, 1446 bp, Artificial Sequence
  Description of Artificial Sequence: Synthetic coding sequence
atggcaactagcgcaacctcgcctcatgcccccggctttcccgctgaaggccgctgcgggtactatgtggaaaagaagaaacgcttctgtaggatggtggttgcggctggcaaaaggttctgtggagaacatgcaggcgcagcggaagaggaagatgctcgcaagcgaatcttatgcccccttgaccccaagcacaccgtgtacgaggaccagctcgctaagcatcttaagaagtgcaactcccgggagaaaccaaaaccagacttctacattcaggacataaatgcgggcctccgggatgagaccgagatccccgagcagttagtccccatttcatctctcagtgaggaacagcttgagaaactcataaagaagttacgaaaagcttctgagggactgaactcaacgttgaaggatcacataatgtctcaccccgccctacatgatgccctgaatgatcctaaaaacggagacagcgccactaaacacctgaaacagcaagcatcaatccttgggaatatcgagaacttgaagctgctcggccccagacgctgtttcgtagaattcggcgccggcaaagggaagcttagccactgggttgacatcgccctaaaggacgccgaaaaagtgcactttatcctggtggagaaagtgaccaccaggttcaaagtggatggtaaacataggaaaaaaaatagcgttttcgagagactccagatcgacattcagcacctttgtctaaacaagattccggtgttaagggaagagaagcttccggtggtgggaatcggcaagcatctgtgcgggatggcaaccgatttagctctccgttgtcttgtggaaacctatgcagcaagttttgaagaacgcaatgaagagcctctagctaaacgtatcaaaaacgacaaaacagagaaggaaatctatacgctggctaaagagggaaatgagaagaatgtccctgagaaatggaatccggttgctggtatagtgattgccctgtgctgccatcaccggtgtgactggagacactatgtagggaaagagtattttcgggcactgggcctcggcgccgttgaatttcactacttccaacggatgagttcatgggctacttgcgggatgcgcaaaacttcactggagacatctaactccactactaagcggcaggacaatcagaacgatgactcagaagaacatgacgacggcggttatcgcatcaccgatgacggggccgattgcttgcctgggcttctgagcgttgaagagaagaagaagatcgggcatctctgcaagttactgatcgatcagggaaggattcagtatctgcaacagaaaggtttttctcctgcattgcagtactatacggatcccctagttagcctggagaacgtcctccttactgccttaccaaaccattcatctagcccagagactaccgcatag

SEQ ID NO: 28885 - DNA, 330 bp, Artificial Sequence
  Description of Artificial Sequence: Synthetic coding sequence
atggctacctcggcgaccagcccacacgcacctggcttccctgccgaaggcagatgtggctactatgtagagaaaaagaagaggttctgcaggatggtcgtcgcagcagggaaacggttttgcggagagcacgccggggccgccgaagaagaggacgctcgaaagaggattctgtgcccgttggaccccaagcatacagtctacgaagatcagttggcaaaacacctgaagaaatgcaacagcagggaaaaacccaagcctgacttttatatacaggacattaatgcaggcttacgggacgagacagagattcctgaacaactggcctag

SEQ ID NO: 28886 - DNA, 1317 bp, Artificial Sequence
  Description of Artificial Sequence: Synthetic coding sequence
atggagcatgctgcaactaccggtccacgcccaggccccccctcaagaagggtggagaacgtggttcttcgggctaaggactggttaccaggagcgccggggggcacagcagtgtgggccacctcactggaggcggaggtgccaccagacctcgccctaaataaggagcaacagctgcagatctcaaaggagctcgtggatatacaaatcactactcatcatctacacgaacagcacgaggcagagattttccagctgaagtccgaaatcctcaggctagagagccgagtcctggagctggaactgcgaggagatggaaccagtcaaggctgcgccgttcccgttgaatccgaccctaggcatcctcgagctgctgcgcaagagctgcgacataaagcccaagttcccgggcactcggacgaccaccggtttcaagtgcagccaaaaaatacgatgaaccccgagaacgagcagcatcggctgggatccgggttgcagggcgaggtgaagtgggcactggaacaccaggaggcccgtcagcaggccctggtgacaagagtggccacactcggccgccaactgcagggagccagagaggaggcacgcgcggccggacaacggcttgccacccaggccgtcgtgctctgctcgtgtcaaggccagctgagacaggcagaggcagagaacgcccgcttgcaattgcaactgaagaagctgaaagatgagtacgtgctcaggctccagcattgtgcatggcaagccgtagagcacgccgatggagccggtcaagctccggccactaccgcgctgcgaacatttttggaagccacattagaagacatcagagcagctcaccgtagccgggaacagcagctcgctcgcgccgcaaggtcctatcataaaagactggtggacctcagtagacgtcacgaggaactgttagttgcttacagggcaccaggtaacccccaagctatcttcgatatcgctagcctagatttggaaccactcccagtgccgctcgtcaccgatttttcacacagggaggaccagcatgggggacctggtgcgctgctctcctccccgaaaaagcgccccggcggggcatcccaaggaggcactagcgagccccaggggttggacgcagcctcctgggcccagattcatcagaagttgagagatttttcccggagcacccaatcatggaacgggtcaggccacagttgttggtcagggcctagatggttgaaaagtaactttttgtcatatagatcaacctggacgtcgacgtgggctggaacaagtaccaaatcatag

SEQ ID NO: 28887 - DNA, 864 bp, Artificial Sequence
  Description of Artificial Sequence: Synthetic coding sequence
atgcacagtgtggcgcatccacatccaggggtcccaccatgggtacctgcgacactgattataacggggaagaggaggggggcggccgccggaggcgcaggtttagagcacgggggatccggaagagctcacctacgtgaggttagtgctgaaacttggcggacacgaggtgttggcgcaggccggttggtgaccggcccggccctggcctctggacctccctgcagccaactgtataacgggcagggcagccctcggaccatttcctgggggcttggccatacacgtgtgggagtggccagtctgctaatgttggaatcccttagcggcctagccctatggtttagcccacccccagccgctagtagacctcctggccctggcctctctctgtacaccgatggctctaaggcgtggggggctccccaggaacacggtggagcacatgcatccctgactcatagccaggtctcaccaccaggctccggtaatcttacacagcatggccacgtctgcccctgcgttactatgccagccctgaagacaacccccccctttttgagcccacacaggggattggatgctgcatcatgggcccagatccaccaaaagttgcgggacttttcaagatcaacccaagtaggaggaaagggctggccccgacccatcctgacaccgtgtcctagctcttggctgacgtcgccttgtcaggccgagctcgagcgggagcgcgcccaactgctcgttagggctactatggctgaggagcaattgtcggagcttcaagagtacgttgaccaacacctcggtcgatgggccgaaggagccggatgcgatcctcgggcactcgtgtggctggagtag

SEQ ID NO: 28888 - DNA, 1527 bp, Artificial Sequence
  Description of Artificial Sequence: Synthetic coding sequence
atggagtcagaggatacgaagaagacccaggaaatgaagactgatttgaatctcctgctcgagtgcctgaaatatcaaatggataatgcgttcagccagaaggaggctctggtgacaatccattccatctgtcagcagaactcaaacgcaagcgtttacttccgcgagatcggcggactaatgttcgtgaaaaaccttgcgaagtcttctgaacacagcatggtgaaggaggcagctctgtacactctgggagctatcgctgagaagaacgtttactgccagcagactctgtgcacatccgaattgttcgaagacctgacatggttcctgagcaatgactcaaacatcaatctcaagcgtatgagtgtttacgtgattctggtgctggtgtccaacaatagaaccggtcaaacattagtgcgagaaaccggttgcatcaccgtcctgtcccggctattcaggacggtcatttctaaacacgagcttgatctgagtgacaaaaacgtctttcagagctaccaactctggagtagcgtttgtagcactctgtgcgtctgcgtgaacaatcctcaaaacgatgaaaaccagatgttttgctgctcactcttcccacacgcaaacgagtggcttaaaaattgtaccacacctgagatcatacgccctatatgctcctttattggcctcaccttggctaacaacacctacgtccaaaagtacttcgtatctgtgggcggactggatgttctgtcgcaggtattaatgcagttggagagtgactcacatgaaactcttagttctgctaagctggccgtcgtagtaaccaagaccgtggacgcgtgtatcgccgataaccccacctttggaatcgtcctgagtaaatatcatattgtcagcaaactattggcgcttcttctgcacgagtcgctggactcaggcgagaaattcagtatcatgctgactttgggacactgcaccgaggactgcgccgaaaaattgagcctaagcctcggcgaatacccttttgatgagaatgaaacccagcagctgaaggacatctcagtgaaggagaacaatttggaggaacactggcggaaggccaaggaaatcctgcatagaatcgagcagctggagagagaaggaaacgaagaagagatccagagagaaaattatcaagacaatatatctagcatgaacattagtatccagaacacctggaaacacttacacgccgaccgtattgggagagggagtaaagctgaagacgaagataaaagtcattctcgccaattgcagagttataagtcccatggagttatgtcaaaggcttgcaccaatgacgaccagatgaagacaccccttaagtccgcaaacccagttcacgcttgctatcgcgagtccgagcagaacaagacactctataaggccaagtcgagctgcaatcagaacctccacgaggagaccactttcgagaagaatttcgtatcacagtccagatctatatacattatgtttagatataacaagtag

SEQ ID NO: 28889 - DNA, 2043 bp, Artificial Sequence
  Description of Artificial Sequence: Synthetic coding sequence
atggagagcgaagacacaaagaaaactcaggagatgaagaccgacctgaacctcctgttggagtgtttgaagtaccagatggacaatgctttctcccagaaggaggccctggtcaccattcactcaatttgccagcagaactccaatgcgtctgtgtactttcgggagattggtgggttgatgtttgtcaagaatctggcgaaatccagtgaacattccatggttaaagaagccgccctgtacaccctgggggccatcgctgaaaagaacgtgtactgccagcagactctatgtacgagcgaattgtttgaagacctgacgtggtttctttccaacgactccaatatcaatctcaagcgcatgagcgtttacgtgatcctggtgctggtgagcaataatcggacgggccagacactggtacgcgaaacaggatgcattaccgtgttaagtcgcctgtttaggaccgtgatctccaagcatgagctcgacctgagtgataagaacgtttttcagtcctaccagctatggtcaagcgtatgttccacactgtgcgtgtgcgtgaacaacccccagaacgacgaaaaccaaatgttctgctgcagcctgttcccccacgccaacgaatggctgaaaaattgcactacccctgagattatcaggccgatctgttcgttcattggcctgaccctggcgaacaacacatacgtacagaagtactttgtgagtgtgggaggcctggatgttctatctcaggtgctgatgcagctggagagcgattcccacgagacattgtcaagcgcaaagttggccgtagtggtgaccaagaccgttgacgcatgtatcgccgataaccctacatttgggatagtgctcagtaagtatcatattgtgagtaaactgctggctctgcttctgcatgagagcctcgacagtggcgaaaaattctcaataatgctgacgctgggccactgcaccgaggactgcgaagagaaccagtacgatttgttcaagaataacggactgcccttgatgattcaggccctcacagaaagccagaacgaggagcttaacaaggcggcaacctttgttttgcataactgcaagaagatcactgagaaattgtccctgtcccttggggaataccccttcgacgagaacgagacacagcaactgaaggatatctcggtgaaagagaataatctagaggagcactggcggaaagccaaagaaattctacaccgcatcgaacagcttgagagagaagggaacgaagaggaaattcagcgagaaaattatcaagacaacatcagcagtatgaatatttcaatacagaacacatggaagcacttgcacgccgacaggataggaaggggctctaaagccgaggatgaggacaaaagccactctcggcagctgcaatcatacaaatctcatggggtgatgtccaaggcctgcactaatgatgatcagatgaaaacccctctgaagtcagctaaccccgtgcacgcatgttaccgggagagcgaacaaaacaagacactgtataaggccaaatcctcctgcaatcaaaatctgcacgaggaaaccacgtttgagaagaacttcgtgtctcagagtcggtactcactcatcattgtgtgctgcatcgctgtcgagaagagtctgaactccagaaattttagcaagctgctgcattcatgcccataccagtgcgatcggcataaagttatcgtggaagctgaggatcggtacaagtctgaactgagaaaaagcctcatctgcaataagaaaatcctgctgactcctcgcagaagacagcgactttcgaatgagtctactacgcctggcggaataaaaaagcgccggatccgtaagaacttcacagaagaagaagtgaactacctgttcaatggagtgaagaaaatgggaaaccattggaacagtatactctggtcctttccattccagcaaggacgtaaagccgtggacttggcacacaagtaccacaaactcactaagcatcctacatgcgcagcctcttag

SEQ ID NO: 28890 - DNA, 2184 bp, Artificial Sequence
  Description of Artificial Sequence: Synthetic coding sequence
atggaaagtgaagatactaagaagacccaggagatgaaaactgacctgaatctgcttttggaatgcctgaagtaccagatggacaacgccttctcacaaaaggaggctttggtcacaattcactctatatgtcaacagaattcaaacgcctcagtgtatttccgcgaaattgggggcctgatgttcgtcaagaaccttgcaaaatccagtgagcacagcatggtcaaagaggcggcactgtataccttgggcgccattgcggaaaagaacgtatattgtcaacagactttatgcacttcagagctgttcgaagatctgacatggtttctgagcaacgattctaatattaacctgaagcgcatgtccgtgtatgttatcttggtactggtgagcaacaatcggactggccagaccctagtgcgggagacagggtgcatcactgtgctcagccgtctcttccgtaccgtcatctccaagcatgagttagatctgtccgataaaaatgtgttccagtcataccaattatggagctctgtctgttccacactttgcgtgtgcgtcaacaacccacagaacgatgagaatcagatgttttgttgctctctctttcctcacgcaaacgaatggctcaagaattgcaccacacccgaaatcatcaggccaatatgtagcttcattggcctcacactggctaacaatacttatgttcagaagtattttgtcagtgtggggggactagacgttctgagtcaagtgctaatgcagctcgagagcgattcccacgaaaccctgagctcagctaagcttgctgtcgtggttacaaagacagttgacgcctgcatcgccgataatcccacttttggcattgtcctctcaaagtatcatatagtttctaaactgctcgctttgctgttgcatgaatcactcgattctggcgagaagttcagtatcatgctgacacttgggcattgcaccgaggactgcgaggaaaatcaatacgacctattcaagaacaacggactccctcttatgatccaagctctcaccgaatctcagaacgaagaactgaataaagccgcaacatttgtgctgcacaattgtaagaagatcaccgagaaactgtctctcagcctgggagagtaccccttcgatgagaatgagactcagcagctgaaagacatatcggtgaaagagaataacttggaagaacactggcggaaagccaaagaaattctacacagaatcgagcagctagaacgggagggaaacgaagaagaaatacagcgagaaaattaccaggacaacatcagttctatgaacatctccatccagaatacttggaagcacctccatgcggatcgaattggcagaggatcgaaagctgaggacgaagacaagtctcacagccgccagctgcaatcctataagtctcacggggtaatgtccaaagcatgcacgaacgacgaccagatgaagactcctcttaagagcgccaaccccgtccacgcatgctatcgggagtccgagcagaacaaaactttgtacaaagctaagagcagttgcaaccagaatctacatgaggaaaccacctttgagaagaatttcgttagtcagtcatccgatcatgtgtttaagcacccggtacatatcgctaagaatattaaacagcagctgccggttaccgatcccttcactctgtgttcggatatcatcaataaagaggtagtgtcctttctcgctacaccctcatgcagcgaaatgttgacctacaggtgcagtggatgcattgctgtggagaagagtctgaattcccgtaatttttctaagctgctacattcttgcccctatcagtgcgaccgacacaaggtgattgtggaagcggaagacagatacaagtctgaattacgaaagagccttatctgtaacaaaaaaatactgctgaccccacgcaggcggcaaagattgtctaatgaaagcaccactccaggcggcataaaaaagcggaggatcagaaaaaactttacggaagaagaagtgaattatcttttcaatggagtgaagaagatggggaatcactggaatagcattctatggtcctttccctttcagcagggacggaaggctgtggacctggcgcacaaatatcataagttgaccaagcaccccacctgtgccgcgtcatag

SEQ ID NO: 28891 - DNA, 1653 bp, Artificial Sequence
  Description of Artificial Sequence: Synthetic coding sequence
atggagagcgaggacacaaaaaaaacacaagagatgaagacggatctcaatctgctgctcgaatgtctcaaatatcagatggacaatgccttcagccagaaagaggccctcgtgaccattcactcaatatgccagcagaatagcaacgcttctgtttactttcgggagattggggggctgatgttcgttaagaatctggccaaatctagcgagcatagcatggtaaaagaggcggccctgtatacactgggtgccatagctgaaaagaacgtttactgccagcagaccttgtgcacctctgagctgttcgaagatttgacctggttcctctctaacgacagtaatattaacctgaagcgaatgtccgtttatgtgatcttagtgctggtaagcaataacagaactggacagactcttgtgcgagaaaccggatgtataaccgttttatcaaggctcttcaggaccgttatctccaagcacgagctagatctttcggacaaaaatgtgtttcaatcataccagttgtggagttcggtctgtagtactctttgtgtatgcgtcaataacccacagaacgacgaaaaccagatgttctgctgttctctgtttccccatgctaacgagtggcttaagaactgcacaacacctgaaataatcagaccaatttgcagtttcatcgggctgacattggccaataatacctacgtacagaaatattttgtctctgtagggggactggatgtcctgtctcaggtactgatgcagttagagtcagactcccacgagaccctgtccagtgcaaagctggccgtggttgtcaccaaaactgttgacgcttgcattgccgataaccccactttcggtatagtgctttctaaatatcacatcgtgtccaagttactggcgcttctcctccacgagtcgctggacagcggagagaagttcagcattatgttgactcttgggcactgtactgaagactgcgaggaaaatcagtatgacttgtttaagaataacgggctgcccctgatgattcaggcattgactgagtcacaaaatgaggagctgaacaaggcagccacatttgtactccacaattgcaagaaaatcacggaaaaattaagtctttcactcggcgagtacccgtttgacgagaacgaaacccagcaacttaaggacatttcggttaaggagaataaccttgaggagcactggcggaaggccaaagagattttgcatagaatagagcagctggaacgggaaggaaatgaggaggaaattcagcgagagaattatcaagataacattagctccatgaacataagcatccagaacacctggaaacacctgcacgcagacaggataggcagggggagcaaagccgaagatgaggacaagagccattctaggcagctgcagtcgtataaatcccatggagtgatgagcaaagcatgcactaatgatgaccagatgaagacacccctgaaatccgccaatcccgtacacgcttgttatagggaatcagagcagaataagacactgtacaaagcgaagagctcatgcaaccaaaatctgcatgaagagacaacttttgagaagaattttgtgtctcaaagcagaagcatttacataatgtttcgctataacaagtag

SEQ ID NO: 28892 - DNA, 1164 bp, Artificial Sequence
  Description of Artificial Sequence: Synthetic coding sequence
atggagaataagctgcctatggaaacactcgttgaagagtgtggcgagaatcgcgagaggaagtgtaagttgaaagatcagtccgataaagaagaaggaacccgcgacattagctcaccaaagcgcttacgcgacagacaagcgctgtttccagctaaggtaaccaacgtaagcctcctagaaaaatttgaaaggagtgaatccggaggtaagataatgactcccgagagtctctcctacccatcatgcctaaagcacgacagcgaaatgaagcctcagactagccctgcttgccaggaccacaacaaggccggccagatgaaatccctggctaccagagaacagaatcaaaagaatgctgcatataacctgggggtggcggaggccattaggaatcacaaaaacgagaaaccagagttctacaaaagtttcctattcgataagaggcctttgtcccctgccttgaatgccctgaagcaggaggagtacagtagatcccttctgaaacagatggacaaccggcaggaaaatgagattaagcagaggcagtatagagagctgatggatagacttgaacaagtgcagcttaccgaagagctggcagcccagagggcgaaattcttgaaagataagatggaggagactcaatgttacaagcgggcattagacgcacagatcaaaaataagcctagtagacttccaccatttgagcccgactcgtcggagcccatttttggaaagaatgaaggggagctgatggtggagaaacagaaacgtgagcagaactacatgaaacaccagttagaagcagccgcaaatcacaagaggaaagcgatcctccatcagttggtggaccaacggcgggatctccagatgctccagaggacgcagcgagaacatctagccgatcgcaccgccgagctcgaaagagtgaatcgcgtaaaccagtgtctgcaggaagactgggaaaggagcgccgcgatgaaaaaacaacgggatcttgaagacaaagccttcgagcgtgcaagcgataaattgttcctgctggatcagtgtgaaaagtacaggcggtgcaagcagtgccagagaaggacatctaacgtaggtgaatctaacctgtggccactgaataagttcttgcccgggtcccgcctgcttgtgtag

SEQ ID NO: 28893 - DNA, 1689 bp, Artificial Sequence
  Description of Artificial Sequence: Synthetic coding sequence
atgctcgatactatcgcccgagctctacaggacctggggaggcaggtcctgcctacccttccttctctgtctcaggaagaggtctccataatctgggggaacgtcagcgagtttgtgagacgccagctgaccttacacaaaggggtgcagatccccgcctttggcacatttacattcatacgtcagaaactggaggtaggaaacaataagttcattctaatccagaggcccgtcttcattatggtcgaaaaactggttcagatacatggcctgaagcaaaacaagaggccaggtactgttgattcggttttgagctcgcgcgaggctcttcgaaagtggccatcgagtgtattggcatttcccaggatcgaattaaaagaaatggagaacaaacttcctatggagaccctcgtggaggaatgcggcgaaaatagagaacgtaagtgcaagctgaaagaccaatccgacaaagaggaaggtactcgggatatctcctccccaaaacgcctgcgggatcgacaggctcttttcccagcaaaggtcactaacgtcagcttgcttgaaaagttcgagcgaagcgagtccggtggcaagatcatgacacccgaatctctgagctacccatcttgcctgaagcatgattctgagatgaagccacagacgagccctgcctgtcaggatcataacaaggcaggccaagaaatgtgttacgtgtgtcttcagagagcacagcgtaactcacttctgtattactccgaggaacggagacgagagatcgaggacgagcgactgatccaacagtaccagatgctgaaggatcaggaggctctctttcggcatcagatgaaatccctggctaccagggagcaaaatcagaagaatgcagcctataacctgggcgtcgccgaggcgatccggaaccacaaaaacgagaagcctgaattctataagagtttcctgtttgacaaacgccccctgagcccagcattgaacgcccttaaacaggaagagtacagccgctcactgctcaagcagatggacaatcgccaggagaacgagatcaagcaacgccaatatagggaactcatggaccgactcgagcaagtacagctaacagaagagctggctgcgcagagagctaagtttcttaaagataaaatggaggagactcagtgttataagcgagcccttgatgcccagattaagaataaaccaagccgcctgcctccctttgagccagatagcagtgagcctatctttggcaagaatgagggggagcttatggtcgaaaaacagaagcgggaacaaaattatatgaagcatcaactcgaggctgccgccaaccataaaagaaaagcgattctccaccagctcgtggaccagcggagggatctgcagatgctccagaggacacaacgagaacatcttgctgacaggactgcggaactcgaacgggtcaatcgggtgaaccagtgtctccaagaagactgggagcgtagcgctgccatgaagaagcagcgggacttagaggataaagcttttgagcgtgcatcagataaactgtttctcctggatcagtgtgagaagtatagaaggtgtaaacagtgtcagagaagaacctccaacgtgggagaaagtaacctgtggcccctcaacaagttccttcctggcagccgcctcctcgtatag

SEQ ID NO: 28894 - DNA, 1959 bp, Artificial Sequence
  Description of Artificial Sequence: Synthetic coding sequence
atgttggacacaattgctcgggctctgcaggaccttggccgtcaggtcctcccaacattgccctctttatcgcaggaagaggtgagtattatctggggcaacgtctccgagtttgtgcggcggcaactcacactgcacaagggagtacagatacccgcattcggcacgtttacgtttatccggcagaaactcgaggtgggaaacaacaagttcatattaattcagcgccccgtgtttattatggtggagaagttagttcagatccacgggctgaagcagaacaaagtttacacaccaggagaaatccccatagtgccactcaattttgtaatgatttctcttgaagggccatttaatcgagacgtggtggagggctgcgtgaaagaaactctcctctttctgtctcgtagtataagcatgaaacagaatgtcgagtttacctttaaggggatcggcgtcctgatgattcgcgactcgaaagtgaagatgcggttttacaaggacttcttatgcacgatggacggctccggagcactcgccaaagcgctggctaaccgccccggcactgtggactctgtcctctcgagcagagaggccctacgcaagtggcctagctccgtcctggcatttccacgaattgagttgaaggagatggagaataagctgccgatggagaccctcgtcgaagagtgtggagagaacagggagcgcaaatgcaaactcaaggaccagtcagataaggaagagggtacacgcgacatctcttcgcctaaaagactgcgagataggcaagcactgttcccagcgaaagtcacaaatgtgtctctgctggaaaaattcgaacgttccgagtccggtgggaaaattatgaccccggaatccttgagctaccctagctgtctgaagcatgattccgagatgaagcctcagacttcacccgcttgccaggatcacaacaaggctggacaggagatgtgctacgtatgcttacagcgagctcagaggaatagcctgttgtactactccgaggaaagacggcgggagatagaagacgagagactgatacagcagtatcagatgctgaaggaccaagaagccctgttccggcaccagatgaaaagcctagccaccagagaacagaaccagaagaatgcggcctacaatctgggtgtggcagaggctatccggaatcacaaaaatgagaagcctgagttttacaagagttttctttttgataaacgtcccttatcacccgctctgaacgccttgaaacaggaagagtactctaggtcacttctgaaacagatggataatagacaagagaacgagatcaagcagagacagtatagagagctaatggacaggctcgagcaggttcagttgacagaggaattggccgcccagagagcaaagttcctgaaggataaaatggaagagacccagtgttacaagcgagcactggacgcacagatcaagaacaaaccatcgcggcttcctccttttgagcccgactcgtctgagcccatattcggaaaaaacgaaggagagttaatggtggagaaacagaagagagagcagaattatatgaagcatcagctagaggcagctgcaaaccacaagagaaaggccatcctacaccagctggtcgatcagagacgagacttgcagatgttgcagagaacacagcgcgagcacctcgccgacaggacggccgagttagaacgagttaacagggtgaatcaatgtcttcaggaagactgggagcgttccgcagctatgaaaaaacagcgcgacctggaagataaagcattcgaacgggcatcagataagctctttcttctggaccagtgtgagaaataccgtcgctgcaagcagtgtcaaaggaggaccagtaacgtaggcgagtctaacctgtggcctctgaataaattcttgccgggttcaaggctactagtgtag

SEQ ID NO: 28895 - DNA, 1635 bp, Artificial Sequence
  Description of Artificial Sequence: Synthetic coding sequence
atgattcatgtgaggagacatgagacaaggcgcaattctaagagccacgtgccagagcaaaaaagccgagtggattggcgaaggaccaagcgttcatccatctcgcagctactggactctgacgaggagcttgactcagaagagtttgacagcgacgaggagcttgattccgacgaatccttcgaaaacgacgaggaattggacagtaataaaggccccgattgcaacaaaacccctggttccgaaagggagctgaatctctccaaaatacagtccgagggaaatgacagcaaatgcctgattaacagtgggaatggcagcacctacgaggaggaaaccaacaaaataaagcataggaacatagatcttcaggatcaggagaagcatttaagtcaggaggacaacgatctaaataaacagaccggacagattattgaggacgaccaggaaaagcacttgagtcaggaggacaacgatcttaacaaacagacaggccaaattatcgaggatgatctggaggaagaagatatcaaacgtggcaagcgaaaaaggctgtccagcgtgatgtgtgacagtgacgagagtgacgactccgacattcttgtcaggaaggtcggagtaaagcgcccacggcgagtggtggaggatgaaggcagttctgtggaaatggagcagaagactccagagaaaacactcgctgcccagaaacgggagaaactgcagaaactaaaggaactcagcaagcaacgctccagacagaggaggagctccgggcgggacttcgaggattcagagaaagaaagctgtccatccagcgatgaggtcgacgaagaagaagaggaggataattacgagagcgacgaagacggggatgactacattatcgacgatttcgtcgtccaggacgaggaaggagacgaagagaataaaaaccaacagggagagaagttgaccacctctcagctaaaactcgtaaagcagaatagcctatacagctttagcgaccactacactcacttcgagcgggttgtgaaggctcttcttatcaatgcactggatgaatcgtttctgggcacgctatatgatgggactcgccaaaagtcatacgccaaggacatgctgacctctctccactaccttgataatagatttgtccagcctcggcttgaaagccttgtctctcggagtcgttggaaggaacagtacaaagagagggtggaaaactactccaatgtgtcgatacatcttaaaaatccagagaattgctcatgtcaagcatgtggcttgcacaggtattgcaagtacagcgtgcatctgtcaggggagttgtacaatactagaaccatgcagatcgacaattttatgagccatgacaagcaggtatttacggtgggccgaatctgcgcaagccggacccgcatctaccataagctgaaacattttaaatttaaactgtaccaggagtgctgtacaattgccatgaccgaggaagtcgaggatgaacaggtgaaagaaaccgttgaacgcattttccggcgctctaaggaaaatgggtggattaaggagaaatatggccagctcgaggagtacctgaacttcgctgactatttccaggaggaaaaattcgagctatag

SEQ ID NO: 28896 - DNA, 1635 bp, Artificial Sequence
  Description of Artificial Sequence: Synthetic coding sequence
atgatacatgtgcggcggcacgaaacccgtcgtaacagcaaatcacatgtgccagagcagaagtctcgcgttgattggaggcggacaaagcggtcctcaatatcccagctcctggacagcgacgaggaactggactctgaagaatttgattccgacgaggagcttgacagcgacgagagcttcgagaatgatgaagagttggacagcaacaagggccctgactgtaacaagaccccagggtcagagcgagaactgaacctttccaagatccaatccgagggtaatgactccaagtgtctgatcaacagtggtaacgggagtacctacgaggaggagacaaataagataaagcataggaacatcgaccttcaggatcaggaaaagcatctatcccaggaggataacgacctgaacaaacaaacggggcagatcatcgaggacgaccaagaaaagcatctgagccaggaagacaacgatttaaataagcaaacaggacagatcattgaggacgatctggaagaggaagatattaaaagaggaaagaggaagcggctcagcagcgtgatgtgcgattctgacgagtcggacgacagcgatatacttgtccggaaagtgggagttaagcgacccaggagggtagtggaggacgaaggctctagcgtggagatggaacaaaaaactccagaaaagaccctggctgcacagaagagggaaaagctgcagaaactgaaagaattgtcaaagcagcggtcccgacagcgcaggtctagcgggcgtgatttcgaagactccgagaaggaatcctgcccctcatcagacgaggtggacgaagaggaagaggaggacaattacgaatccgacgaggatggcgacgactatattattgatgactttgtggtgcaggacgaggagggcgatgaagaaaacaagaaccaacagggggagaaactcacaaccagtcaactgaaacttgtgaagcagaacagcctttatagcttctcggatcattacacccattttgaacgggtagtaaaagcactccttataaacgctctggacgagagctttctcgggaccctttatgacggaacacgacaaaagagctatgcgaaggacatgctgacatctctccattacctggataatagattcgtccagccgcgactagagtccttggtgagccgttctcggtggaaagagcagtataaagagcgtgtggagaattattccaacgtctcaatacatctcaaaaaccccgaaaattgttcgtgccaggcatgcggcctgcatagatattgtaaatacagtgtgcatctttctggtgagttgtacaacacccggactatgcagattgataacttcatgagccatgataagcaggtgttcaccgtaggacggatctgcgcgtcaagaacaagaatctatcacaagcttaagcatttcaaatttaaattataccaggagtgctgcaccattgcaatgacagaagaggtggaagatgagcaagtgaaagagactgtcgaacgtatcttccggcgctctaaggaaaatggctggattaaggagaaatacggtcagctggaggagtacctcaacttcgcagattatttccaagaagagaagttcgagctgtag

SEQ ID NO: 28897 - DNA, 93 bp, Artificial Sequence
  Description of Artificial Sequence: Synthetic coding sequence
atgatccatgtgagacgtcatgaaacacgacggaattccaagtctcacgtgcctgagcagaagagcagggttgattggcggagaacaaagtag

SEQ ID NO: 28898 - DNA, 789 bp, Artificial Sequence
  Description of Artificial Sequence: Synthetic coding sequence
atgattcatgtgaggagacatgagacccgaaggaactctaagtcccatgtccctgaacagaaaagccgagtggactggaggcgaaccaaacgcagctccatatcccagttattagatagcgatgaggagcttgattctgaagaatttgattcagatgaagaactcgatagcgatgagtcattcgaaaatgacgaagaactcgactccaataaggggcctgactgcaacaagaccccaggtagcgagcgcgaattgaacctaagtaaaatacagtccgagggcaacgatagcaaatgtctcatcaattcaggaaatggaagtacttacgaagaggaaaccaacaagattaagcaccgcaacatcgatctgcaggaccaggaaaagcacctgagccaggaggacaatgatctgaacaaacaaacgggccagattatcgaggacgatcaagagaagcacctgtctcaagaagacaacgacctcaacaagcagacaggccagatcattgaggacgacctggaggaagaggatattaagagggggaagaggaaaaggctgagcagcgtgatgtgtgatagtgacgagtctgatgatagcgatatcttagtgcgaaaggtcggcgtaaagcgccccagacgcgtggtggaggatgaagggagttcagtcgaaatggagcagaaaactcccgaaaagaccctggcagcccaaaagcgcgaaaagctgcagaaactgaaggaattgtccaaacaaagaagtcgacagcgccgctcatccgggcgcgacttcgagtag

SEQ ID NO: 28899 - DNA, 1635 bp, Artificial Sequence
  Description of Artificial Sequence: Synthetic coding sequence
atgatccacgtgaggagacatgaaacccgacgcaacagcaagagccatgtaccagaacagaaaagtcgcgtggactggcgaagaacaaaaagatcgtcaattagccagctgttggactccgacgaggagttagattcggaagaattcgactctgacgaggagctcgattctgatgagagctttgagaacgatgaggagctggatagcaataaaggccctgattgcaataagaccccaggatctgagagagagctgaacctctctaagatccagagcgagggcaacgactcgaaatgtctgattaatagcggaaacggctcaacatacgaggaggagaccaataagatcaaacacaggaatatcgaccttcaagaccaagaaaagcatctgagtcaagaagacaacgacctgaacaaacagaccgggcagatcattgaagacgaccaggagaaacatctctctcaggaggataatgaccttaataagcagacaggacagatcatagaagatgatttggaggaggaggacatcaagagaggcaaaagaaaacggttgtcttccgtcatgtgtgacagcgatgagagcgacgactctgatatcctggtaagaaaggtaggggtcaaacgacctcgacgagttgttgaggatgagggaagttcggtggagatggaacagaagacaccagaaaaaaccttagcagcccaaaaacgggagaaacttcaaaaactgaaagagttgtcgaaacaaagaagtcgccagaggcggtcttctggtagagatttcgaagactccgaaaaggaatcttgccctagctctgatgaggttgacgaggaggaagaggaggataactatgagagcgatgaggacggtgatgactatatcattgacgacttcgtcgtgcaggacgaggagggcgacgaggaaaataagaaccagcagggagaaaagctgaccacctcccagctgaaactcgtaaaacagaactcattgtacagcttttctgaccactatacgcacttcgagcgcgtggttaaagcgctcttgatcaatgcactcgatgaatcctttttgggaacactttacgacggcacgcggcagaaaagttacgctaaggatatgctgaccagtttgcactatctggacaaccggttcgttcaaccaaggcttgagtctctcgtcagtcgtagcaggtggaaggagcagtacaaggagcgcgtagagaactattctaatgtttctatccacctgaagaacccggagaactgcagttgccaggcttgcgggctgcaccgttactgtaaatattcagtgcatcttagcggcgaactctataacacccgcactatgcagattgacaactttatgtctcatgacaagcaggtattcactgtcggacgcatttgcgcttccaggactagaatttaccataagctgaaacattttaagttcaagttgtatcaagaatgctgcactatagcgatgacagaggaagtggaagatgaacaggttaaggaaactgtggagcgtatcttcaggcggagcaaagaaaatggctggataaaggagaagtacggccagctcgaagaatacttgaactttgccgactactttcaggaagagaagttcgagttatag

SEQ ID NO: 28900 - DNA, 1335 bp, Artificial Sequence
  Description of Artificial Sequence: Synthetic coding sequence
atggagaactcagggaaagctaataaaaaggatacccacgacggaccacctaaggaaataaagctccctaccagcgaggccctgcttgactatcaatgtcagatcaaggaggacgctgtggagcagtttatgttccagataaaaacgctacgcaaaaaaaaccagaagtatcatgagcgcaacagccggctgaaagaggagcaaatctggcacataagacatctgctaaaagagctgtcagaagaaaaagctgagggcttgcctgtcgtcacccgcgaggacgtggaagaagccatgaaggagaaatggaaatttgagcgcgatcaggaaaaaaacttaagagatatgagaatgcagattagtaatgccgagaaattgttcttggaaaaactgagtgagaaagaatattgggaagagtataagaatgtcggtagcgaacgacatgcaaagctcatcacaagcttacagaacgacattaacacggtcaaagagaacgccgagaagatgagcgaacattacaaaattacacttgaagacacgaggaaaaaaatcattaaggagactctcctgcaactggatcagaaaaaggagtgggcaacgcagaacgcggtgaaattaattgacaaagggtcctacctcgagatatgggagaacgactggctcaaaaaagaggtcgccatccaccgtaaagaggtggaggagctgaagaacgcaatccacgaacttgaagcagagaatctggtgctcatcgaccagctgtcgaattgccgtctggtggatctgaagattcctagatacccagttctacactcctgccccacatcaaatcctagacatctactgttgctgcctttagagagctgcttgatctctgcacgccggtgctggcgtctgtatctaacccaggccgccgggctggaagtcccgcctgaggagatgagtctggaattgcctgagacacatatagaggagaaatctgagttacagcccaccgaagtggaaagcagagacctgatgagctccagtgatgagtccaccattctccatctcagccacgaaaactctatcgaagacctacaatacgtgaaaattgataaagaggagaacagcggcaccgagttcggggatactgatatgaagtatttgctctacgaggacgaaaaggatttcaaagactacgtgaacctgggtccactcggcgtcaaactgatgagcgtggaaagtaaaaagatgcctattcattttcaagagaaggagatccctgtcaagctgtacaaagacgtgcgcagcccagagagccacatcacctacaaaatgatgaaaagttttctttag

SEQ ID NO: 28901 - DNA, 1242 bp, Artificial Sequence
  Description of Artificial Sequence: Synthetic coding sequence
atggaaaacagtggcaaagctaataagaaagatacccatgacggaccaccaaaggagatcaaactgcccacctccgaagcacttttggactaccagtgccagataaaagaggatgccgtcgaacagttcatgtttcagatcaagaccttgcgaaaaaaaaaccagaagtaccatgaaagaaatagtcgactgaaggaagagcagatttggcacattcggcatcttctaaaggaattatccgaggagaaagccgagggacttcccgtggtaactagagaagacgttgaggaagccatgaaggagaaatggaagttcgagagagatcaagagaaaaatctgagggacatgcgcatgcaaatctccaatgccgagaaactgttcctcgagaagcttagtgaaaaagaatactgggaggaatataagaacgtaggttccgaacgccacgccaagctaattactagcctgcaaaacgatattaacaccgtcaaagaaaacgcagaaaagatgagtgagcactataagattacactggaggacactcggaagaaaatcatcaaagagactctgttgcagttggatcagaaaaaagagtgggcgacccaaaacgcagtcaagttaatagataaagggagctatctcgagatctgggagaatgattggctcaagaaggaggtggccatccatcgtaaagaagttgaagaattgaagaacgctatccatgaacttgaagccgagaacctcgtcctcatcgaccaactttcgaattgccggctggtggatttgaaaatcccaagaaggctgtacctcacacaggccgcaggtcttgaggttcctcctgaggagatgtccctggagctgccggaaacacacatcgaggagaaatctgagttgcagcccaccgaagtggagtctagagatctgatgtcaagttcagacgagagtaccatcctccatctgtcacacgaaaacagcattgaagacctacagtatgtgaagatcgacaaggaggaaaactccggaactgaattcggggatacagacatgaagtatttgctgtacgaagatgaaaaggattttaaagactatgtgaatctcggtcctctcggggtaaagctaatgagtgttgaatccaagaaaatgcccatccactttcaggaaaaggaaattccagttaaactctataaggatgtgcgtagtcccgagtctcatattacctacaagatgatgaagtctttcttgtag

SEQ ID NO: 28902 - DNA, 942 bp, Artificial Sequence
  Description of Artificial Sequence: Synthetic coding sequence
atgttccagataaagaccctccgcaagaaaaaccagaaatatcatgaaaggaattcaagattgaaagaagagcaaatttggcacatacgccatctgctcaaggaactcagcgaggagaaggctgaaggactccccgtggtgactagggaagatgtggaagaggccatgaaggagaaatggaagttcgagagggaccaagagaagaacttgagggagcattacaaaataacgttggaggatactcgaaagaagataattaaggagacgcttctgcagcttgaccaaaaaaaggagtgggcaacccaaaacgccgtgaaactgatcgataaaggcagctatctggaaatatgggaaaatgattggctaaagaaagaggtagccatacataggaaagaagtggaggagctcaagaatgcaattcacgagttggaggctgagaacctagtgctgattgaccagctctccaattgtaggctggtggatctaaagatcccaagacggctctacttgacgcaggctgcgggtctcgaggtgccacctgaggagatgtccctcgagctgcccgaaactcacatcgaaaagtccgaacttcagcccacggaagttgagagtagggatttgatgagctcctctgacgagtccacaattctacacctgtctcatgaaaattccatcgaggatctgcagtacgtgaaaatcgataaggaggagaattccggcacagaattcggagataccgacatgaaatacttattatatgaggacgagaaggactttaaagactacgtgaacctggggccactgggcgtcaaactgatgtccgtagagagtaagaagatgccaatccattttcaagaaaaagagattccggttaaactatataaggatgtgcggtctcctgagtcacatatcacctacaagatgatgaaaagttttctttag

SEQ ID NO: 28903 - DNA, 999 bp, Artificial Sequence
  Description of Artificial Sequence: Synthetic coding sequence
atggcccccgcccaacggtgtccactctgccgtcaaaccttcttttgtggcaggggccacgtgtactcacggaaacaccagagacagctgaaagaggccctcgagcggcttttaccccaagtcgaggctgcgcggaaggctattagagcggcacaggtggagcggtatgtgcctgagcatgagagatgttgctggtgtctgtgttgcggttgtgaggttagagaacacctctcacacggtaatttaactgtgctttatggagggctcctggaacacctcgcatcgccagaacacaagaaggctacaaataaattctggtgggaaaataaggcagaagtgcaaatgaaggagaagttcctggtcaccccccaagattacgcccgctttaaaaagagcatggtgaaaggtctggactcatatgaggagaaggaagataaggtaatcaaagagatggccgctcagattcgtgaggtggagcagagccgacaagaggtcgtcaggtctgtattggaacctcaagcagtcccagaccctgaggagggttcatctgcccctcggtcctggaagggtatgaactctcaagtcgcttcatctctccaacagccctccaacttagatttgccgcccgcccccgaactggattggatggaaactggaccctccttgacgttcatagggcatcaggacattcctggggtcggaaacattcatagcggtgcgactccaccttggatgattcaagatgaagagtacatcgctgggaaccaagagattggaccatcctacgaagagtttttgaaagaaaaggaaaaacagaagctcaaaaagctgccgcccgacagagtcggggctaacttcgaccatagctctagaaccagcgccggatggctgccatccttcgggagggtgtggaataatgggcggcggtggcagtcacgccaccaatttaagaccgaagcagctgcaatgaagaagcagtctcatacagagaagagttag

SEQ ID NO: 28904 - DNA, 1662 bp, Artificial Sequence
  Description of Artificial Sequence: Synthetic coding sequence
atgagcaaggctgctggaggagctgcggccgcggccgccgcagcagaatcatgtagcccagcacctgcaggtagctcagccgcccccccagctccagtggaggatttgagcaaggtgtcagatgaggagcttctgcagtggtccaaagaggaactcattcgctccttacgacgggctgaggccgaaaaggtctccgctatgctcgatcactccaacctgatcagagaggtcaatcgccggctgcagcttcatctgggcgagatcaggggactgaaagatatcaatcaaaaactacaggaggacaaccaggagctcagggacctgtgttgttttctcgacgacgatagacaaaaaggtaagcgggtatccagggaatggcagagattggggcggtatacagcaggcgtgatgcacaaagaggtcgcactgtatctccagaagctgaaggatctcgaggtgaagcaagaggaggtcgtgaaggaaaatatggaattaaaggagttgtgtgtgctgcttgacgaggaaaagggggcgggatgtgcaggcagtagatgtagtattgattctcaggccagcctctgtcagcttactgcttccaccgccccctacgtccgggacgtgggcgatggttcatccacttccagcactggcagtactgactctccggatcaccataagcaccacgcctctagtggaagtccagagcacctccaaaaacctcggtctgaagggagccctgagcactcaaaacaccgctctgccagtcccgaacacccgcaaaagccccgcgcttgcgggactcctgatcgtcccaaagccctcaagggcccctctcctgaacatcacaaaccactgtgcaaaggctcaccggaacagcagagacacccacatccaggaagctcaccagagacattacctaaacatgtgttgtcagggagccccgagcacttccagaagcaccgctcgggctcatcccccgagcacgcgaggcactctggaggctctcccgagcatctgcagaagcacgcactgggcgggtccctggagcacctgccacgggctcgggggaccagcccagagcatctaaagcagcactacggcggaagcccggaccacaaacacggcggcgggagtggtgggagcggcggaagcggtgggggctctcgggaaggtaccttgagacgccaggctcaagaggatggaagcccccaccaccgtaatgtgtactccggcatgaacgagtctaccctgtcctacgtgagacaactggaagccagggtgcgtcagttggaggaagaaaaccgcatgctgccacaagcgtctcagaatcggaggcagccccctacaaggaattcttctaatatggaaaaagggtggggatcccgggcacggcgcgtcctgcagtggtggcaggggtgtagagggatcggcaggtgtctgcccacattgccaggatctttccggctgagcagcggcgcagatgggtccaactcctctcccaattccgcagcatctttctcggggcacgctaccccttcacagcagccggaacctgtcgtgcatagtctcaaggtggtgtggaggaaactcggagacgctgcaggcagttgccccggtattcgccagcatctgtccggtaatcagtataaagggcccatgtag

SEQ ID NO: 28905 - DNA, 1260 bp, Artificial Sequence
  Description of Artificial Sequence: Synthetic coding sequence
atggctaagcccgccgccaccgctgctgccgctagcgaagaactctcccaagtgcccgacgaggaattgctccgttggagcaaagaagaactggccagacgcctgcgtagagctgagggagagaaggtggggttgatgctggaacacggtggtttgatgcgagacgtcaatcggaggctgcaacagcatctcttggagattagaggcctgaaagatgtcaaccagcgactacaggacgacaatcaagagctccgggaactatgctgtttcctggatgacgatcggcagaaggggaggaaactggccagagagtggcagagattcggccgtcacgctgccggagccgtttggcacgaagtggccaggagccagcagaagctgagagagttagaggccaggcaggaggccctactaagagagaacctggagctgaaggagctagttctcctgttggacgaggaaagagcggcccttgctgccacgggtgctgcttccggggggggtgggggcggtggaggggccgggtccaggtcgagcattgactcacaggcttccctgtccggtcccctgagcggcggtgcccctggcgccggggcccgagacgtgggcgacggctcttcaaccagcagcgccggctcgggaggatctcccgaccaccaccatcatgtccctccgccactcctccccccaggtccccacaaggccccagatggtaaggctggagccactagacgcagtctcgacgacctctcggcgccaccccatcaccgaagtatccccaacggcctgcacgatccatcatctacatacatccggcaactggagtctaaagtgagattgctggaaggcgataagctactggcccagcaagcaggaagcggcgaattccgtacattgcggaaaggtttttcaccctatcattctgaaagtcagctggcctctctgcccccatcataccaagactctctccaaaatggacccgcatgtccagcaccagagctcccttctcccccttcagccggatactccccggcaggacagaagcctgaggcagtcgtacacgctatgaaggttctggaagtgcatgagaacctggacaggcagttacaggattcttgcgaggaagacttgtccgaaaaagaaaaggcaatcgtgagggagatgtgtaatgttgtgtggcggaagcttggcgacgccgcttcttccaaaccatccattcggcagcatctgagcggtaaccagttcaaaggaccactctag

SEQ ID NO: 28906 - DNA, 2550 bp, Artificial Sequence
  Description of Artificial Sequence: Synthetic coding sequence
atgatggaaccacctaaaccagaacctgaactgcagaggttttaccatcgcctgctgcggccactgtctctgtttccaacgaggacaacatcccccgagcctcagaagcgtcctccacaggagggcaggattctgcagtccttccctctggccaagctgaccgtggcatctttatgttcgcaggtcgcaaagcttctagccgggagcgggatcgctgccggcgtgccccccgaggctcggctgaggctgataaaggttattctggatgagctaaagtgttcgtggagagagccacccgcggagctgagcctgtctcacaagaacaatcaaaagctgcggaagcggctggaggcatatgtactgctgtcttccgagcagcttttcctgaggtaccttcatctgctcgtgacaatgtccactccccggggggtgttcaccgaatcagcaacgcttactagactggccgcttctctggctcgggactgtactctgttcctcacctcgccaaacgtctataggggcctgctggctgattttcaggccttactaagagcagagcaggcatccggagatgtggacaaactgcaccctgtgtgcccagcaggcacctttaagctgtgtcctattccttggccccattcgacaggtttcgctcaggtgcagtgttccaacctgaatcttaactacttaattcagctctcacgccccccagaattccttaatgaacctgggcgcatggaccctgttaaggagctgaagtccatcccacgattgaaacgcaagaagccattccactggctcccaagtatcggcaagaaaagagaaatagacattagctccagccagatggtgtcgctccccagttacccagttgcccctacaagccgcgctagtcctagcccattctgtcccgagctgcggcggggccaatcaatgccaagccttagagagggctggcggctggccgatgagctcggccttcctccactgccatctagacccctaacccccctggtgctggctaccgaaagtaaaccagaactgactgggctgattgtggcggaagatctgaagcagctgatcaaaaagatgaagttggaagggacacgctacccacccctcgatagcggtcttccccctttactcggtgtggtcactcgccacccggcggctggccatcggcttgaggaactggagaagatgctgagaaatctacaggaagaggaggcaagcggccaatgggacccacaaccccccaaaagtttccctctccacccacagcccgtgactataacgctgaaactccgtaacgaggtcgtggtgcaggcagctgcagtacgagtatccgacagaaactttctcgactcctttcatatcgaaggagcaggagccctctataatcacctggccggagagctagatcccaaagctatcgagaaaatggatatcgacaactttgttggctccaccaccagagaagtgtataaagagctgatgagccacgtgtctagcgatcatttgcatttcgatcagggccccctcgttgagcccgccgctgataaggattggtctacgttcctatcctcggcttttctacggcaggagaagcaaccacagattatcaatccggaacttgtaggtctttatagtcaaagggccaacactctccaaagcaatactaaaaagatgccctcactgccgtctctccaagcgacgaagtcatgggagaagtggtccaacaaggcttctttgatgaacagttggaagacaactctgtccgtggatgactatttcaaatacctgacaaatcacgagactgacttcttacacgtcatttttcaaatgcatgaggaagaagtacccgtggagatcgtggcccctgcaagggaaagtctggaaattcagcatccacctcccttgctggaagacgaagagcccgacttcgtgcctggggaatgggattggaacacagtgctggagcataggcttggtgctggaaaaacacctcatctaggggagcctcacaagattttaagtcttcagaaacatctggaacagctctggagcgtcctcgaagtacctgacaaggaccaggtcgacatgaccattaagtactccagcaaggctcggttgcgccagcttccctcactcgtgaatgcttgggaaagggcgcttaaacctattcagctccgggaagctctactggcacgtcttgaatggtttgagggtcaggcgtctaaccctaacaggttctttaagaagactaacctgtcctcgtctcactttcttgaggagaaccaagtgcgctcgcatctacacagaaaactgaatctcatggagagctccctggtgagtcttctcgaggagatcgaactgattttcggggaaccagtcatctttaaggggcgcccatatctcgataagatgaagtccgataaagttgaaatgctctactggttgcagcagcagaggcgcgtccggcacttggtgagtgctctgaaagatccgcatcaatcaacgctttttcgttcatcagccgcgagtctttag

SEQ ID NO: 28907 - DNA, 741 bp, Artificial Sequence
  Description of Artificial Sequence: Synthetic coding sequence
atgctcagtttgtcgctgtgctcccacttgtggggcccactcattctctccgcactgcaagcgcggtcaacggattccctggacgggcccggcgagggatccgtgcagcctttaccaaccgcgggagggccaagcgtcaaagggaaaccaggaaagcgcctgagcgcccccagagggcctttcccccgactggccgactgtgcgcactttcattacgagaatgtggactttggacatattcagctcctcctctctcctgaccgagaaggcccgagcctgagtggggaaaatgaacttgtttttggcgtacaagtgacttgtcaaggcagatcctggcccgtgctaaggtcctatgacgactttcgcagcttagatgcacacctccacaggtgtatcttcgaccgcagatttagttgcctgccggagcttccccctccgccggagggggctagagcagcccagatgctggtgccactgctattgcagtacttggagactctctcgggacttgtggattcaaatctgaactgcgggccagtgctaacttggatggaggtgggattgggaaggggtttaggcgacagtgaatgggtacggggttgtgtatgccaccacgctcagcacagggaaattctggatggcaatagggttgcaagcgccgtggaagacgagggagctgaggtggatggcgaggcatttcggtggggttcactgtgggtcggagagtcgtgggacatgtag

SEQ ID NO: 28908 - DNA, 1542 bp, Artificial Sequence
  Description of Artificial Sequence: Synthetic coding sequence
atggccgccaccctggacctcaagtctaaggaggaaaaggacgctgaattggataagaggatcgaggccctgcgtcgaaaaaatgaagccctaattaggaggtatcaggaaattgaggaagatcgtaagaaggcggagttagaaggcgttgccgtgactgcgccgagaaaggggcgctccgttgagaaggaaaacgtggctgttgagtccgagaaaaacctcggtccctctcgcagatctcccggcacacctcggccaccaggagcaagcaaggggggtaggactcccccccagcagggtggaagggccggcatggggcgcgcctccagatcttgggagggatctcccggagaacagccacgtggcgggggggccggtgacacttctatcagcgatagaaagtcaaaagagtgggaggaacgaaggcgccagaatatcgagaaaatgaacgaggaaatggagaagattgccgagtatgagaggaaccaacgcgagggtgttttagagccgaatccagtgaggaatttcctggatgatcctcgccgcaggtcaggacctctggaggaatcggaacgagatcgccgtgaggagtcacggagacacggccgcaattggggaggtcccgactttgaacgagttaggtgcggcctagagcatgagcggcagggccgtcgcgcgggcttgggatcagccggcgatatgactctctcgatgaccggtagagagaggtccgaatatcttcgttggaagcaggaacgggagaagatcgatcaggaacgactacagagacatcggaaacccaccggccaatggcgacgcgagtgggacgctgagaaaaccgatggcatgtttaaggacggccccgttccagcccacgagccttcccacagatatgatgaccaagcatgggctcgcccaccaaagccaccaacctttggtgagttcctgagtcagcacaaggccgaagcatcatctcgacgcagacgtaaaagtagcaggccccaggctaaggcagcccctcgcgcctatagcgaccatgacgaccgatgggaaacaaaggagggcgctgctagtccagctccagaaacaccccaaccaacttccccggaaacttcccctaaagagacccctatgcagcctccagaaatacccgcacccgcccaccgaccaccagaagatgaaggagaggaaaacgagggtgaggaagacgaggaatgggaagacatttcggaagacgaggaagaagaagaaatagaagttgaggagggggacgaagaggagcccgcacaggaccaccaagctcccgaggcggccccgactggtatcccctgctctgaacaggcgcatggagtgccattcagtcccgaagagcccttactcgagcctcaggcccccgggactcccagctcacccttttcgcctccatcagggcaccagccggttagcgattggggagaggaggtagagctgaattctccacgaacgacccacttagccggagcactttccccgggtgaggcttggcctttcgagtccgtatag

SEQ ID NO: 28909 - DNA, 996 bp, Artificial Sequence
  Description of Artificial Sequence: Synthetic coding sequence
atgacaagcccccatttcagctcttacgatgaggggcccttagacgtgtcgatggccgctaccaacctagagaatcagcttcattctgcacagaagaatctcctgtttctgcagagggagcatgcatctacgctaaaggggctccactcagagatccgtcgcctccagcaacattgcactgatctgacatatgaactgacagtgaagtccagcgagcagacaggcgatggaactagtaaaagctccgaattgaagaagcgatgcgaggaactggaggcccaactgaaagttaaggagaatgagaacgccgaattgctgaaggagttggaacagaaaaacgccatgatcaccgtcctggagaatacaatcaaagagcgcgaaaaaaaatatttggaggagctgaaagctaagagtcacaaactaactctgctctctagcgaacttgagcagcgggccagcactatcgcctacctgaccagtcaacttcatgcagccaagaagaaattaatgagcagctctggcaccagtgatgcaagcccttctggtagtccagtgctcgcctcctacaagcctgcccctcctaaagataagctcccggagacacccagaagaaggatgaagaagtccttgtctgcacctctgcatcccgaattcgaggaagtttatagatttggagcagagtctaggaaactgcttttgagagaacctgtggatgccatgcccgacccgacgccattcttgttggcccgggaatctgcagaggtgcacctgattaaagaacgccctctcgtgatcccccccatcgctagtgatcggagcggcgagcaacactccccagctcgcgagaagccccacaaggcacatgtaggggtcgcccaccgaatccatcacgctactcctccgcaggcccagcccgaggtcaaaaccctcgctgtggatcaggtgaacgggggaaaagtggtacgcaaacacagcgggactgaccggaccgtttag

SEQ ID NO: 28910 - DNA, 291 bp, Artificial Sequence
  Description of Artificial Sequence: Synthetic coding sequence
atgacctcgccgcatttctcctcatacgatgaggggcctctggatgtgtcaatggcagctactaacctggagaaccaactgcattccgcgcaaaagaacctgttgtttctgcagcgggagcacgcaagcaccctgaagggactgcattccgagattaggcgcttgcagcagcactgcacagatctgacctacgaattgacagttaagtcctccgagcagactggtgacggcacctctaaaagttctgaattgaaaaagcggtgcgaagagctcgaagcacaactgaaatag

SEQ ID NO: 28911 - DNA, 369 bp, Artificial Sequence
  Description of Artificial Sequence: Synthetic coding sequence
atgacctcccctcacttttctagttatgatgaaggaccactggacgtgtctatggcagcgaccaacctggaaaaccagttgcactccgctcaaaagaacttacttttccttcaacgcgaacacgcttcaacactgaaggggctgcattcagaaatccggcggctgcagcagcactgtacggatctcacctacgagctgacagtgaaatcttcagaacagaccggcgatggcacctcaaagtcctccgagctcaagaagagatgcgaagaactcgaggcccagcttaaggtgaaggagaatgagaacgccgaactgctaaaagagctggaacagaagaacgcaatgatcacagtgctggaaaacacatag

SEQ ID NO: 28912 - DNA, 39 bp, Artificial Sequence
  Description of Artificial Sequence: Synthetic coding sequence
atgacctccccgcacttttcttcctatgacgaggggtag

SEQ ID NO: 28913 - DNA, 1896 bp, Artificial Sequence
  Description of Artificial Sequence: Synthetic coding sequence
atgggcctaccccgcggccccgagggtcagggcctccccgaggtggagacccgagaggacgaggagcagaacgtgaaactcaccgaaatcctggagctgctggtcgccgcgggctatttccgtgcccgcattaaaggcttgtctccattcgataaggtggtgggcgggatgacgtggtgcatcacaacatgtaactttgacgtggacgtggacctactatttcaggagaactccaccatcggccaaaaaatcgcactgagtgagaagattgtctctgtgcttcctcgaatgaagtgcccacaccagctggaacctcatcaaattcaaggaatggacttcatccatatcttccccgtggtgcagtggcttgtgaagcgtgcgatagagacgaaagaggagatgggcgattacatccggtcctattctgtgagtcaattccagaaaacctattccctgccagaggatgatgacttcattaaaaggaaagagaaggcgattaagaccgtcgttgatctgtctgaagtctacaagccacggcggaagtacaaacgccaccagggcgcagaggagttgcttgatgaagaatcaagaatccacgccacactgttagaatacggaaggcgctatggatttagcagacagtctaaaatggaaaaggcggaggacaaaaagactgctttgccggctggactcagcgctaccgaaaaggcggatgcccatgaggaagatgagcttagggctgccgaggaacaaaggattcagagtctgatgacaaagatgaccgccatggcaaacgaggaatcaaggctcacagcgagcagcgtgggacagattgtgggtttgtgctccgccgagatcaaacaaattgtgtccgaatatgccgagaaacagtcagaattaagtgctgaagaaagtcctgagaagcttggcacctctcagctccaccgacggaaagtgatttcattaaacaaacagatcgctcagaaaaccaagcatttggaggaactgagggcatcccacacctcgcttcaggccaggtataacgaagcaaagaaaactctaacagaacttaagacatattctgagaaactcgacaaagagcaagcggccctcgagaagattgaaagtaaggccgatcctagtattctgcagaatctccgagctttagtagccatgaacgaaaatctgaaatcgcaagaacaggaatttaaagctcactgtcgtgaggaaatgaccaggctccagcaagagatagaaaacttaaaagccgagcgggctccaagaggcgacgaaaaaaccctatcatcaggagagccacccgggactttgacctccgccatgacgcatgatgaggatctggataggcgctacaatatggaaaaagagaagctgtacaaaatccggctgttgcaggcaagacgcaatcgtgagattgcaattctccaccggaagatcgatgaagtgccctcacgcgcggaactcattcagtaccagaaaagatttatagaattgtacagacagatcagcgcagttcacaaggagactaagcaattcttcaccctgtacaataccctggacgacaaaaaggtgtacctggagaaagagatctcccttctgaattccattcacgagaatttcagccaggccatggctagtccagctgcacgtgaccaatttttgaggcaaatggaacaaattgttgagggcataaagcagtcaagaatgaaaatggagaaaaaaaaacaggaaaataagatgcgccgcgatcagttaaatgatcaatacctggaattactcgaaaagcaaaggttatatttcaaaaccgtcaaagagttcaaagaagagggtcggaaaaacgaaatgttgctgtctaaagtgaaggctaaagctagctag

SEQ ID NO: 28914 - DNA, 972 bp, Artificial Sequence
  Description of Artificial Sequence: Synthetic coding sequence
atgtcagaaaggaaagtgctgaataagtactatccgcctgatttcgatccttctaaaatcccaaaattaaaacttccaaaggaccgtcagtacgtggttcgcctcatggcgccgttcaacatgaggtgtaagacctgcggcgaatatatttataagggaaaaaaattcaacgcaaggaaggaaaccgtacagaacgaggtataccttggactgccaattttccggttttacatcaagtgcacccggtgccttgcggagataaccttcaagaccgaccctgaaaacacggattacacaatggaacatggagctacacgaaatttccaggcagagaagctcctggaagaggaggagaagagagtgcagaaagagagggaagatgaggagttaaataacccaatgaaggttcttgagaatagaactaaggacagcaaattagaaatggaagtgctggagaacttacaggaactgaaagacctgaaccagagacaggcccatgtggattttgaggctatgttgagacagcatcgcctcagtgaagaagaaaggaggcgccagcagcaggaggaggacgagcaggaaaccgcagcattgttagaggaggcccggaagagacgactcctcgaggatagcgactccgaggacgaagccgccccctcaccactgcagcctgcactccggccaaatcctaccgccattctggacgaggccccgaaacccaaaaggaaagttgaggtgtgggagcagtccgtcggaagtctcgggtctcggccccccctgtcccgactcgtcgtggtgaagaaagccaaggctgaccccgattgttctaatggccagccacaggcggctcctacccctggtgccccccaaaaccgaaaagaggctaacccgacccctttaacacctggcgccagcagcctttcacagcttggggcatacctggacagcgacgactccaacggaagcaactag

SEQ ID NO: 28915 - DNA, 1668 bp, Artificial Sequence
  Description of Artificial Sequence: Synthetic coding sequence
atggatgtcagcagtgaacacaccaaggatccaggcggtgagggaggtgacggcgaatccttagcagcacgtccttctaaaatcaaggcctcaagcggcccgcctacgagccctgagcccggcgagttggagagcgaaccagaagaagaggaagaggagcaggctgcctctcaaggagggacagccgctgacgagcaggccgaggcccctaaggggcttactgctgcggaggcagcaggcgaggagggcccaggggaaccgggtcgcccagcggaacctcagcccgaacctgaagagcccgcagaggtaggcgcggaagaacccgcccagccagaaccaggggcgggaccagaagaactggaagcagaagccggagccgaagagctcgaacaggctgctgaaggcaaggaggtcagattccaagcgtcactgccactcacccgcatagacgaagaggaggccgccgccgctcctgaagccgagacagagcgagtagaaggagaggaggaggataaggaggagacccagagagacggtgcagagagtaaggaacgggacggcgagggccgccccgcgaagtctcaggaggaaggcaagcggctttacggacgggacgaatttgaggatttggaatggtcggaggaggtacaaaagcttcaagaacagcagttgcggtcagacttactcgaccagtaccggtctctccttgtggaacgaaacaggagtcagcgctataacttgtacttgcagcacaagatttttgaagctctgagaaggaagaagggccttgaagcagccgaagtggctgatcgaggcgccgaagcggaagcgccagagaaggaacaggcatacctgcggcacctgggtatgctcgaagagctgaagaaacagcaggctgacgacctgcaatggtatcatcaggaactcggccagctaaagagacaatgtcaggaaaaattaacccgcgtcgagaaggaatggagacgcttccaggcactgaagaaacaggtagtgatgcaggccatgggtagctgtcgtatgaggggaggccggcaggctgccctgcgagaggtggagcagatccaagcccttgaggacaagaaggaaaaagaaatgtctgccgtcagactggagaacattcaacttaaacagagcttagttcacttcgaaacgcgcatgaggactcaggaagatctgactcagggtttactgctcatcgacttcgaacaattgaagatcgagaatcagactttcaacgaaaagattgaagagcgaaacgaagagcttctgaagctcagatccaaggtgacaaacagcgtacaggtaattacccacgtaaaggagaagcttcatttcatggacatggaaaatgcatgtaagaagacccagctggcagagattgaggcccaggctgcactgggacgggatattctaacgaagactaaacaagctagagaaggtttaagaactgataacattcgcctgaatcaaaaatgcggcctgctgggcaaagattcgctgttgagggatctggaggagaaggtagataagacggagctgttacaccgtcgtcttgaatcactgaagcgtcatcacgcgagtctcacactatcgtgtagaggtgtgcggcagaagatcagggaggccaaagcgtttttgccaagctag

SEQ ID NO: 28916 - DNA, 1032 bp, Artificial Sequence
  Description of Artificial Sequence: Synthetic coding sequence
atggaggcggttgcaactgcgacagccgctaaggagcctgacaaagggtgtatcgagccaggaccagggcactggggtgaactaagcaggaccccagtgccctcaaagcctcaggacaaagtggaagctgccgaggctacacctgttgccctcgatagtgatacttcaggagctgaaaatgctgccgtgtcagccatgcttcacgctgtggccgctagcaggctgcccgtgtgctcccaacagcagggagagcctgacctgacggaacacgaaaaagtggctattcttgctcagctctatcatgagaagcccctggtgtttctcgaaaggtttaggactgggctgagagaggaacatctggcttgcttcggccacgtcagaggagaccacagagccgatttttactgcgcagaggtcgcgcgccaaggcacagcccgccccaggaccttgagaacaaggcttcgcaacaggagatatgcagccctcagggagctgatacagggtggagagtatttctccgatgaacaaatgcgctttagggcccccttgctgtacgagcagtatatcggtcagtacctgacacaggaagagttatcggcgcggacccctactcaccagcctcccaaaccaggatcaccgggacgcccggcatgccctctgtcgaatctcttgctgcagagttacgaagagcgagagctgcagcaacgtctcctacagcagcaggaggaggaggaggcttgtctagaagaggaagaagaggaggaggactccgatgaagaggatcaaaggtctggaaaggatagtgaagcttgggtgcccgattccgaggaaagactaattctgcgagaggagtttacaagtagaatgcatcagcgcttcctggatggcaaggacggcgacttcgactacagcacggtggacgacaatcccgacttcgacaatcttgatattgttgcccgcgatgaggaggaaaggtacttcgacgaggaagaaccagaagatgccccttcaccagagctggacggagactag

SEQ ID NO: 28917 - DNA, 462 bp, Artificial Sequence
  Description of Artificial Sequence: Synthetic coding sequence
atggagcctctctaccaggctggcagtatcctgatgaccgtgaacactctgcagggaaagaagatgattgagtcaggactgcagtcaggtgatttcagtttatcccagtcgtggcctagttgcttaccacctcctgcagaccttgagattttacaacaaaaagtcgccggcgtgcaaagagaactggaagactttaagaaggaggccctcaagtccattcattacttagaagatgctttttgcgagatgaacggtgccttagttcaacaagaggagcaagcagctcgggttaggcagaggctacgggaagaagaagacagaggtatagtgaggaataaagtcttaacctttctgctgccacgtgagaagcagcttagggaacattgcaaacggctcgaggaccttttgctcgaccgcgggagggatgccctgagggccacaaagaagtctcaggccgactag

SEQ ID NO: 28918 - DNA, 333 bp, Artificial Sequence
  Description of Artificial Sequence: Synthetic coding sequence
atgcaggctgctctggaagttacggcccggtactgcggacgcgagctcgaacaatacggccagtgcgtggctgccaagccggagagctggcagcgcgactgtcactatctcaagatgtctattgcccaatgtacaagttcccaccctatcatccggcagatcaggcaggcctgcgctcagcctttcgaggcattcgaggagtgtttaaggcagaacgaggccgcggtgggaaactgcgccgagcacatgcgacgatttttacaatgtgcagagcaggttcagccacctcggagcccagccacagtggaagctcagccactgcctgcctcctag

SEQ ID NO: 28919 - DNA, 708 bp, Artificial Sequence
  Description of Artificial Sequence: Synthetic coding sequence
atgggtagcacagagagcagtgaggggagaagagtcagtttcggggtcgacgaggaagaaagagtgcgggtgctccagggtgtgaggctgtccgagaatgtggtgaaccgcatgaaagaaccgtcttcccctccaccagcaccaacatcctcaacgtttggcctgcaagatgggaacctgcgagcgccccacaaagaaagcactttacctcgctctgggagcagcggaggacaacagccttccgggatgaaagagggagtgaaaaggtatgaacaggaacacgcagctattcaggacaagctcttccaggtggccaaaagggagcgggaggccgctaccaagcactccaaagccagtctgcctacaggtgaagggtccatttcacacgaagagcagaaaagcgtgaggcttgcacgggaacttgagtcaagagaggcagagctgaggcggcgcgacacattctataaggaacagttggaacgtatcgaaaggaagaatgccgagatgtataaactatcatcagagcagttccacgaggccgcctcaaagatggagtccacgatcaagccgcgtagagttgagcctgtctgttcaggcctgcaggctcaaattctgcattgctatagggaccgccctcacgaagtcctcctttgttcagatctcgtcaaagcctaccagcggtgcgtttccgccgcccacaagggctag

SEQ ID NO: 28920 - DNA, 501 bp, Artificial Sequence
  Description of Artificial Sequence: Synthetic coding sequence
taaacactgcctagatctggcagctccgggggacagcagcccagtggtatgaaggaaggcgtcaaacgctacgaacaggagcacgccgctatccaagacaaactgttccaagtcgctaaaagagagagggaggccgctactaagcattctaaggctagcctccccaccggtgaaggaagcatttcgcacgaggaacagaaatccgtgcgcctcgcccgggagctggagagcagagaagctgagctccggaggagagacacattttacaaggagcagctggagcggatcgagcgcaaaaacgctgaaatgtacaaattatccagtgagcagtttcacgaggccgccagcaagatggagtctacgatcaaagttgagccagtttgttcagggctgcaagcacaaattctgcactgctaccgtgataggccacacgaggtactgctgtgttccgaccttgtcaaggcgtaccagcggtgcgtgagcgctgcacacaaagggtag

SEQ ID NO: 28921 - DNA, 600 bp, Artificial Sequence
  Description of Artificial Sequence: Synthetic coding sequence
atgctcctcgagctgagcgaggagcataaggagcatctggcattcctgccccaggttgactccgcggtggttgccgagtttggaaggattgccgtggaatttctgaggagaggcgcaaaccccaagatatacgaaggggccgctcggaagttgaacgtgtccagcgataccgtgcagcacggtgttgagggactgacctacctgctcaccgagtcaagtaaactgatgatatccgagttggacttccaggattctgtttttgtgttaggcttttctgaggaactgaataagcttttgctgcagctgtacctggataaccgcaaggaaattaggaccatcttaagcgaactagctccatctcttcctagctatcacaatctggaatggagactggatgtgcaacttgcctcccgctccctgcgacaacaaataaagccagccgttaccattaaactccatctcaatcagaacggggaccacaacaccaaggttcttcagacagatccagctaccctccttcacttagtgcagcaactggagcaggctctggaagagatgaaaacgaaccactgccgaagggtggttcgaaatattaagtag

SEQ ID NO: 28922 - DNA, 534 bp, Artificial Sequence
  Description of Artificial Sequence: Synthetic coding sequence
atggaattatccgagagcgtgcagaagggtttccagatgttagcagatcctagaagtttcgactcgaatgcgtttaccctgctccttagagccgcgttccaatctctgcttgacgcccaagcggatgaagccgtactcgatcatcctgacctcaaacacatcgatcccgtggtgttaaagcattgccacgccgccgctgccacgtacattctcgaagcaggcaagcacagggcagacaaatctactctgtctacatatctggaagattgcaaatttgatcgagagcgcatcgagttattttgcactgagtatcaaaataataagaattctcttgagatcctattgggccgcacactgattccacaccctattcaaaggttggtactggtagcagcctggaacaattaccgaacatggtggggaaacctgaaaatgctccgcaaagcatggaaagagcagttgtcctgtaacttgggtaaactcactattaggcccagcgcagaggagaaccagaagcggttggctttcagctag

SEQ ID NO: 28923 - DNA, 489 bp, Artificial Sequence
  Description of Artificial Sequence: Synthetic coding sequence
atggaactctcagaatctgtgcagaaagggtttcagatgttagccgatccaaggtcattcgactctaatgcctttactctgctgttacgcgccgccttccaaagcctcctggacgcgcaggccgacgaagccgtgcttgaccaccccgaccttaagcacatcgatcctgtcgtgctcaaacactgccatgccgctgccgcaacttatattttagaagcgggcaagcatcgcgccgacaaaagtactctgagtatcggaaggtcactgcctcatatcaccgatgtgtcatggaggctcgaataccagatcaaaacgaaccagcttcaccggatgtatcgaccggcctatctagtgacccttagtgttcagaacacagactcccccagctacccagagatttctttcagttgctcaatggagcaactccaggatctggtgggaaagctgaaagatgccagcaaatctttagagcgcgctactcaactgtag

SEQ ID NO: 28924 - DNA, 588 bp, Artificial Sequence
  Description of Artificial Sequence: Synthetic coding sequence
atggagctctctgagagcgtccagaagggatttcaaatgctggcggatcccaggtcattcgattctaatgcattcaccctcctgctccgcgctgcctttcagagcctgctggacgctcaggctgatgaggcggtcttggatcaccctgacctcaaacacatcgaccccgtggtgctgaaacactgccatgcggccgccgccacatacatcttggaagcaggcaagcacagagccgataagtctacactgtcaacctatcttgaagattgcaagttcgatagggagcgcatcgagctcttctgtacggaatatcagaataacaaaaattcactggagatcctcctaggctctatagggcgcagcctgcctcatattaccgacgtgagttggcggcttgaatatcagatcaaaactaatcagctgcacaggatgtatcgcccagcctacttggtcactctgtctgttcaaaatactgatagccccagttacccagaaatctctttcagctgtagtatggaacagctgcaggatctggtcggtaaattgaaagatgctagtaaatcgcttgaaagagcgacccaattgtag

SEQ ID NO: 28925 - DNA, 534 bp, Artificial Sequence
  Description of Artificial Sequence: Synthetic coding sequence
taggagctctccgagtccgtgcagaaaggattccagatgctcgccgatcccagatcttttgattctaatgctttcacgctcctgttacgcgctgcttttcagtctttattagatgcacaggccgacgaagccgtcctggaccatcccgatctgaaacatatcgatcccgtggtgcttaaacactgtcacgccgctgctgccacctatatcctggaggcaggtaagcacagagctgacaagtccacattaagcacctacctcgaagactgcaaatttgacagggaacggatcgagctattttgcactgaatatcagaataataaaaattcactggaaatcctgctgggacgcaccttgatcccccatcccatccagagattagtgctggttgcagcctggaacaactaccggacgtggtggggaaatctgaaaatgctccggaaggcctggaaggaacagctttcatgtaatttaggcaaactgacgatccgtccatctgctgaggaaaatcaaaagcggctcgccttttcctag

SEQ ID NO: 28926 - DNA, 450 bp, Artificial Sequence
  Description of Artificial Sequence: Synthetic coding sequence
tgactccctgatgctggtgggagccccctgttgcgcctccagcggctccacgcctccccgcccggcggcattccagagagcgccgggcgacccgggggccgcgggcgggtgtccacctacctagaggattgcaagttcgaccgcgagcggatcgaactcttctgcacagagtaccagaataataaaaacagtttggagattctccttgggagtattggcaggtccctgccgcacataacagatgtgtcctggcgtctcgagtatcaaataaaaaccaatcagcttcatcgaatgtatcggcccgcatacctggttacgctttcagtccagaatactgatagcccatcataccctgaaatttctttttcctgctccatggagcagctgcaagatctggtgggaaagcttaaagacgccagcaaatcgctagagcgcgctactcagctctag

SEQ ID NO: 28927 - DNA, 492 bp, Artificial Sequence
  Description of Artificial Sequence: Synthetic coding sequence
tgaatggagctgagtgagtccgtgcagaaaggctttcagatgctggctgaccctcgatcctttgattctaacgcgtttaccttactgctgcgtgccgcctttcagtctctcctcgatgcccaagccgatgaagctgtgctggatcaccccgatttgaaacacatcgatccagtagtactcaaacattgccacgccgccgccgccacttacatccttgaggccggcaaacacagagcagataaaagtacgctttcaatcggccgtagccttccacacatcacggacgtgtcctggcggctagaataccagatcaaaaccaaccagcttcacagaatgtacagacccgcttacttagtcacactgagtgtgcagaatacagactcaccatcataccccgaaatttcattctcctgtagcatggaacagcttcaggaccttgtcggcaagctaaaggacgctagtaagagcctggagagggcgactcaactgtag

SEQ ID NO: 28928 - DNA, 603 bp, Artificial Sequence
  Description of Artificial Sequence: Synthetic coding sequence
atggggaggctgcattgcacagaggaccccgttcccgaagcagtcggcggggacatgcagcaactgaatcagctcggcgcgcagcaatttagtgcgttgaccgaggtcctgtttcattttctgacggaaccaaaagaagtggaacgctttttggcccagctcagcgagtttgcgactaccaatcagatttcacttggaagcttgcgcagtattgtgaagagccttctgctcgtaccaaatggagccctaaaaaagagtctcactgccaagcaggtccaagctgattttatcaccctgggccttagcgaggagaaggctacctatttcagtgagaaatggaagcagaacgctcccacactcgcgcggtgggcaattggtcagactcttatgataaaccagttgatcgacatggagtggaagtttggcgtgacatccgggtccagcgaactggagaaagtggggtctatctttctgcagctcaaactggtcgttaaaaaaggaaatcagaccgagaacgtatatattgagctgactttaccccagttttactcattcttgcacgaaatggagagagtgagaaccagtatggagtgtttttgctag

SEQ ID NO: 28929 - DNA, 600 bp, Artificial Sequence
  Description of Artificial Sequence: Synthetic coding sequence
atgggtcggctgcattgtacagaagacccagttcctgaggccgttggcggtgacatgcagcagctgaaccaactgggcgcccagtttagcgccctaacagaggtcttattccattttttgaccgaacctaaggaagttgagcgatttctggctcagctgtcagaatttgcaaccacaaaccaaatatccctcggctccctgaggtcgatcgtgaaaagcttgctattggtccctaacggggccctgaaaaaaagtctgactgccaagcaggtccaggctgactttatcacgttgggcctgagtgaggagaaggccacatatttctcagaaaagtggaagcaaaatgcacccacgttagcgaggtgggcaataggacagacactgatgattaatcaactgatcgatatggaatggaaatttggagtcacatctggctcgtctgaactagaaaaggtgggatctatattcctacagctgaaactggttgtgaaaaagggtaaccaaacggaaaacgtgtacatcgagctgacactgccacagttctatagctttctccacgaaatggaaagagtgcgcaccagtatggagtgcttctgctag

SEQ ID NO: 28930 - DNA, 552 bp, Artificial Sequence
  Description of Artificial Sequence: Synthetic coding sequence
atggaaccagaggagggtacacctttatggagattacagaaactgcccgccgagcttggtccccagcttcttcataaaatcatcgatggaatatgcggaagagcctacccagtgtaccaggactaccatacagtgtgggaatctgaagagtggatgcatgtcctggaggacattgccaagttcttcaaagctatcgtcggtaagaacctcccagacgaggagatcttccagcagcttaatcagctgaacagcctgcaccaggaaacgattatgaaatgcgtgaaaagccgcaaagatgagattaaacaggcactgtctcgagagatagtggccatcagctctgctcagctgcaggacttcgattggcaggtgaagctggcgctgtcatccgataagatcgcagcactacgcatgccattgctgtccctgcacctggacgtgaaagaaaatggagaagtgaaaccttatagcattgaaatgtcacgcgaggaactacagaacctgattcagtcactggaggcggcaaacaaagtcgttttgcaattaaaatag

SEQ ID NO: 28931 - DNA, 597 bp, Artificial Sequence
  Description of Artificial Sequence: Synthetic coding sequence
atggctgcactgaccgcagagcatttcgctgctttgcagtcactgctcaaagcctcatctaaagacgtggtgcgtcagctgtgccaggagagcttttcttccagtgctttaggcctgaagaagttgctcgatgtaacatgttcgagtctgagcgtgacgcaggaggaggcagaagaacttttgcaagccctccaccggctgactaggctagtggcattcagagacttgagtagtgctgaagctatcctagcattatttcccgaaaactttcaccagaatcttaaaaatctgctgaccaaaatcattctggagcacgtgtccacatggaggaccgaagctcaagccaaccagatcagcttaccacgtttggttgatttagactggcgcgtggacatcaaaacttcttccgactctatctccagaatggcagttcccacctgtctcttgcagatgaaaattcaggaggatccctctctgtgcggcgacaaaccgagtatcagcgcagtcacagtggaactatccaaggagactctcgacactatgttggacggccttggtcgtattagagaccagctgtccgcggtggcctccaagtag

SEQ ID NO: 28932 - DNA, 510 bp, Artificial Sequence
  Description of Artificial Sequence: Synthetic coding sequence
atggccgccttgaccgccgagcattttgccgccctccagtcccttctgaaagcatctagtaaagatgtggtgcgtcagctctgtcaggaatcattctctagctccgccctcggactcaagaagctgctggatgtgacatgttctagcctttccgtaacacaggaggaggctgaggagctactgcaggccctccacagactcacaaggctggtcgcttttcgtgacctctctagtgccgaagctatcctagccctattccccgagaatttccaccagaatctgaaaaatcttcttaccaagatcatcttagaacatgtctctacttggaggactgaggcacaagcaaatcagatcagccttccccgcctggtcgacctcgactggagggtggacattaagacatcgagtgatagtatttcgcggatggccgtgccaacctgtctcctccaaatgaaaattcaggaggacccttctttatgtggagataagcctagcatatcagctgtatag

SEQ ID NO: 28933 - DNA, 471 bp, Artificial Sequence
  Description of Artificial Sequence: Synthetic coding sequence
atggccgccctgaccgcggagcattttgctgctctgcaatcactcctgaaactgctccaggctctacatcgactgaccaggttggtcgccttccgggacctgtcaagtgctgaagctattctagctctgtttcctgagaacttccaccaaaatttgaagaacctgctgaccaagattatactggagcatgtgtctacctggcggaccgaggctcaggccaatcaaatctctctcccacggctggtcgacctggactggcgggtcgatataaagacatcatccgattcaatcagcaggatggccgtgcccacgtgtctcctacagatgaaaatacaggaggacccatctctgtgtggcgacaagcccagcatcagtgccgtgactgtggagttgtccaaagaaactcttgacacaatgttagacgggctcggccgcattcgggatcagctctctgcggtggcaagcaaatag

SEQ ID NO: 28934 - DNA, 2067 bp, Artificial Sequence
  Description of Artificial Sequence: Synthetic coding sequence
atgtggtgcatagtgttgttctccttgcttgcttgggtgtatgccgagccaacgatgtatggggaaatcctcagcccaaattatccccaggcatacccttccgaagtggagaagagttgggatatcgaagtgcccgaaggttatgggatccacctgtattttactcatcttgacattgagcttagtgagaattgtgcctacgatagtgtgcagatcatctcgggggacacggaggaaggacgcctctgtggacagcgaagcagcaataatccgcactcccccatagtagaagagtttcaagtgccttataacaagctgcaggttatcttcaagtccgatttctctaacgaagaaaggttcactgggtttgccgcatattatgtcgccaccgacatcaacgaatgcacagacttcgtcgatgtgccttgtagccacttctgcaataattttatcggcgggtacttctgctcatgcccccccgaatattttcttcacgatgacatgaaaaattgcggggtgaactgcagtggggacgtgttcacagctcttatcggggaaattgcgtctcccaactaccccaagccataccccgaaaattctcgatgcgagtaccagattaggctggagaagggttttcaggtcgtcgtaactctacgccgagaagacttcgacgtcgaagctgccgattctgcgggaaactgcctcgattcgttggtctttgtggcgggcgacagacagtttggcccatattgcggacacgggttcccaggacccttgaatattgagacaaagtcaaatgcgttggatattattttccaaaccgatttaactgggcagaaaaaaggatggaaactcaggtaccacggagaccctatgccttgccctaaagaggatacacctaatagcgtctgggaacctgctaaagccaaatacgtgtttcgggatgtggtgcagatcacctgtctagatggattcgaagttgtggaaggcagagttggagccacatctttctactctacttgtcaatcaaacggcaagtggagcaactccaagctgaaatgtcagcccgtggattgtggcatccccgagagcatagaaaatggaaaagtggaggacccagaatcaactctcttcggctctgtgataagatatacatgcgaggagccttattactatatggagaacggtgggggcggtgaataccattgcgccgggaacggctcatgggtgaacgaagtgctcggcccagagttgccaaagtgtgttccagtctgcggtgtcccgagggaaccattcgaggagaagcagagaattattggcggatcagacgccgatataaagaacttcccatggcaggtcttctttgataacccatgggcagggggtgccctgattaatgaatactgggtcttgaccgcagcgcatgttgtcgaggggaatagggagcccactatgtatgtgggctccacaagcgtgcagacatcgcggctggccaaaagtaaaatgttgactccagaacatgtatttatacatcccggctggaagcttctggaggtacccgaggggaggacaaactttgacaatgacatagctcttgtacgtcttaaagaccccgtaaaaatgggccccacagtcagtccaatctgtttgccaggcaccagctcagactacaatcttatggacggggatctgggtctaatttccggctggggccgcaccgagaagcgcgacagggccgtacgtttgaaggcggctcggctgccagtggccccacttcgcaagtgcaaagaggtcaaggtggaaaagccaacggccgacgctgaagcttatgtgtttaccccaaatatgatctgtgctggaggcgaaaaagggatggacagctgtaaaggggacagcggaggagctttcgctgtacaagaccccaatgataagaccaaattctatgctgccggcctggtgtcttggggccctcagtgcgggacctatgggctatacactcgcgtaaagaactatgtagactggattatgaagaccatgcaggagaattccactcccagggaggattag

SEQ ID NO: 28935 - DNA, 2067 bp, Artificial Sequence
  Description of Artificial Sequence: Synthetic coding sequence
atgtggtgcatagttctgttttccctgctcgcatgggtgtacgctgaacctacaatgtatggagagattttgagtcctaattatcctcaggcgtacccatcagaggttgagaaaagctgggacattgaggttcctgagggctacggcatccacctgtactttactcatctcgatattgaattgtctgaaaactgcgcctacgatagtgtgcagattatctccggcgacaccgaagagggaaggctgtgtgggcagcgaagctcaaacaatccacactcaccgatagtggaggaatttcaggtgccctacaataagctgcaggtcatctttaagagtgatttcagcaacgaggagaggtttacaggcttcgctgcctattacgtggctacagacatcaacgagtgcactgatttcgtagacgtgccatgttcccatttttgcaacaacttcatcggcggttacttctgctcctgccctcccgaatacttcttgcacgatgatatgaagaattgtggcgttaactgttcaggcgatgtgttcacagcactcatcggcgagattgcatctcccaattatcccaagccttaccccgagaactccagatgcgagtaccagataagactcgaaaagggctttcaagtggtggtgactctgaggcgagaggatttcgacgtggaggcggccgacagtgcgggaaactgtctagatagcctcgtgttcgtcgcgggtgatagacagttcggcccatactgtgggcacggcttcccagggccactcaatattgagaccaaaagcaacgctttggatattatttttcagactgacctgacaggtcagaagaaggggtggaaactgagatatcatggcgatcctatgccatgtcccaaagaggatacacctaatagtgtatgggaacccgcgaaagccaaatatgtgtttagagatgtagtgcagatcacctgtctcgatgggttcgaggttgtggaagggcgtgttggggcaaccagcttctacagcacctgccagagcaatgggaagtggagtaatagcaaactgaaatgccagcctgtggactgcggaatcccagagagcattgagaatggaaaggtcgaggatcctgaaagcacgctcttcggaagcgtcatccgctatacatgcgaggagccctattactacatggaaaacggcgggggtggagaataccactgtgccggcaacgggtcgtgggtgaacgaggttctcggccctgagctcccgaaatgcgtgccagtttgtggcgtccccagggagccatttgaggagaaacaacgcatcatcggcggatctgatgccgatatcaaaaacttcccttggcaggtattctttgataacccatgggcaggtggggccctgattaacgaatattgggtattgaccgcagcacacgttgtagaggggaacagagagccaactatgtatgtggggtccacatctgtgcagactagcaggctggcgaagtctaagatgctgacaccagagcacgtgttcattcacccgggctggaaactcctggaggtgcctgagggcaggaccaattttgacaacgatatcgctctggttcgactgaaagacccagtgaagatgggccccacagtttctcctatctgtctgccgggaaccagcagcgactacaacctaatggatggtgatctgggcttgatcagcggatggggacgtacagagaaacgggacagggcagtccgcctcaaagcagctcgccttcccgtcgcacccctgcgcaagtgcaaagaggtgaaagtcgaaaagcctacggcggatgccgaggcttacgtgttcacacctaatatgatatgcgctggcggcgagaagggcatggatagctgtaagggagatagtggtggcgcatttgccgtgcaagaccctaatgataagaccaaattttatgccgccgggttggtgtcctggggtccccaatgcggcacatacggactgtatacaagggtgaagaactatgtcgactggatcatgaagaccatgcaggagaatagtactcccagagaggactag

SEQ ID NO: 28936 - DNA, 483 bp, Artificial Sequence
  Description of Artificial Sequence: Synthetic coding sequence
atggctttcttgatgaagagtatgatttctaaccaggtgaaaaatttgggttttggaggaggctcagaggagaacaaggaggagggaggtgccagtgacccagcggcagcacagggcatgacccgggaagagtacgaggaataccaaaaacaaatgatagaagaaaagatggaacgggacgccgcatttacacagaagaaggctgagcgcgcctgtctgcgcgtccacttgagagaaaagtacaggttacccaagtccgagatggatgagaatcagatccagatggccggtgacgacgtggacctccccgaagatctgaggaaaatggttgacgaggatcaggaggaggaagaggacaaggacagcattctcggtcagatccaaaatctacaaaacatggatctggacacaattaaagaaaaggcccaggctacatttaccgagattaaacagacggccgagcagaagtgcagtgtgatgtag

SEQ ID NO: 28937 - DNA, 3924 bp, Artificial Sequence
  Description of Artificial Sequence: Synthetic coding sequence
atgggatctgtgactggggctgtccttaagaccctgctgctctcaacccagaattggaaccgtgtagaggccggtaacagctatgattgcgacgatccactagtgtccgctctccctcaagcatcattcagcagctcttccgagttgtcttctagccatggaccgggctttgccaggctgaaccgccgcgacggcgccggagggtggtcccctctggtgtcgaataaatatcagtggcttcagatcgacctgggcgagcggatggaggtcaccgcagtggcaacccagggcgggtacggctcatccaactgggtcacctcttatctgctgatgttttcagactcaggatggaactggaaacagtataggcaagaggactccatctggggtttctccgggaacgctaacgcagactctgtcgtatattatcgccttcagccgagcatcaaagcacgcttccttcgcttcattccactcgagtggaatccaaagggtcggattgggatgaggatcgaggtgttcggctgcgcgtatcgctctgaggtggtagacctcgatgggaaaagctcattgctctacaggttcgaccaaaaatccctatcgcccataaaggatatcattagcttgaaatttaagactatgcaatccgacggtatccttctacatagagaaggacctaacggggaccatataaccctacagcttcgacgtgcacggctttttctgctgataaacagcggtgaggcaaagctgccctccactagcaccttggtgaatttaactctgggcagcctcctggacgaccagcactggcacagcgtgctgatccagaggctgggcaagcaggttaatttcacagtcgacgagcataggcaccactttcatgcccgcggggaattcaatcttatgaatctagactatgagatttcattcggaggaatacccgcccccggtaaaagcgtcagctttccgcacaggaactttcatgggtgcttagagaatctctattacaatggggttgacatcatcgacctggccaagcagcagaaaccccagatcatcgcgatgggaaatgtgagcttcagctgttcacaacctcagagcatgcccgtcacttttctctcttcgcgttcgtacttagcgctcccagattttagcggtgaggaggaagtttctgccactttccagttccgaacatggaataaggctgggctcctgctctttagtgagcttcagctgatctcaggcgggatcctcctgttcttatccgacggcaaactgaagtccaacctgtaccagcctgggaagctacctagcgatattactgctggcgtagagttgaacgatggccagtggcattctgtgtctttgagtgctaaaaagaatcacctgagtgttgcagtcgacggtcagatggccagcgcagctccactgttgggaccggagcagatatattcaggagggacatactatttcggcggatgtcccgacaaaagttttggatctaaatgtaagtcaccactgggggggtttcaagggtgtatgcggctgatatctatttctggcaaagtagtggacctaattagcgtccagcagggcagtctaggtaacttttctgatctgcagattgacagctgtggcatcagtgaccgatgtctgccaaattattgcgagcatgggggcgagtgcagccaatcttggagtacatttcactgcaactgtaccaatacggggtataggggcgcaacatgtcacaacagtatctacgagcagtcctgtgaagcatacaaacatcgcggaaacacttctggcttttactatattgactccgacggatccggccccctggagccctttctgctgtattgcaatatgaccgagactgcatggacaattatccaacacaatggctctgacctgacccgcgtgaggaacacaaatcccgagaatccctacgcaggtttttttgaatatgtggcttccatggagcagttacaggcgacgattaacagggctgaacattgtgaacaggagtttacgtactactgtaagaaaagccgcctggtgaacaaacaggacggcacgccactgagctggtgggtgggacgcacaaatgaaacccaaacctattgggggggaagttcccctgacctgcaaaagtgcacctgtgggcttgaaggcaactgcatcgatagtcaatactattgcaattgcgacgccgacaggaatgagtggacaaacgatactggccttttggcctataaggaacatttgcccgtgaccaagatcgtgatcacagacactggccgtttacatagcgaggccgcatataaactaggtcccctgctttgccagggggaccgtagtttctggaattctgcctcttttgataccgaagcttcatatttgcacttcccgaccttccacggggaattgtccgctgatgtctctttctttttcaaaaccactgcatcgagcggtgtgtttctcgagaatctcgggatcgctgacttcatccgaatcgaactgcgaagcccaacggtggtcacgttttccttcgatgtcggtaacgggcctttcgagatttctgtccagagtccaacccatttcaatgataaccagtggcaccacgtgcgagtggaacgaaacatgaaggaggcgtcattgcaagtggatcagctcacacccaaaacccagccagctcccgccgatggtcacgtgttgctgcagctcaacagccagttgtttgttgggggcacagcaacacgacagagaggtttcctgggatgtatccggtctctgcagctcaacggcatgacattggaccttgaagaaagggctcaggtcacccctgaagtgcagccgggatgcaggggtcactgttcttcatacggcaaattatgcagaaacggcggcaagtgccgggagagaccgatcgggtttttctgcgattgtaccttcagtgcatacaccgggccattctgcagtaacgagatttcagcctacttcggcagtggctcatccgtgatatataactttcaggagaactatttgcttagcaaaaatagttcctcccacgccgcgtcttttcatggggacatgaaactgtctcgggagatgataaaatttagttttcgaaccactcggaccccatcactgctgctgttcgtgtcctcattctataaagagtacctgtccgttattattgccaagaatggcgacctgcaaatcaggtacaagctgaataaataccaggaacctgacgtggttaatttcgatttcaagaacatggccgacggtcagctacatcatataatgattaaccgagaggaaggcgtggtgtttatagagatcgacgataaccgacgccggcaggtccatctgagctctggcacggagttttctgctgttaaatccctcgtcctcggacgtattctcgagcatagcgatgtagaccaggatactgccctcgccggagctcaaggtttcacaggatgcctatcggctgtacagctatcccatgtggctcccctgaaggctgcgctgcacccctcacaccctgaccctgttacggtcactggacatgtgaccgaatcctcatgcatggcccaaccgggcactgacgccactagtagagagcggacgcactcatttgcagaccactccgggacaatagacgaccgggagccactagctaatgcaatcaaaagtgacagcgcggtcatcggcggtctaattgcagttgtgatatttattctgctgtgtatcaccgccatcgctgtgcggatttaccaacaaaagagactctacaagcggtccgaggccaaacgctcagaaaacgtcgacagcgccgaagcagttctgaaaagtgagctgaatattcaaaatgctgttaacgaaaaccaaaaagagtatttcttctag

SEQ ID NO: 28938 - DNA, 3780 bp, Artificial Sequence
  Description of Artificial Sequence: Synthetic coding sequence
atggggtcagtgaccggcgcggtgctaaaaacactgctgctgtccacgcagaattggaacagggtcgaggccggcaacagttatgattgcgatgatcctttagtgtccgcactaccacaggcctcattcagcagtagttcggagttatctagttcacatggcccagggttcgcaaggcttaaccgcagagatggcgcgggcgggtggtctcccctcgtgtcaaataagtatcagtggcttcagatagatctgggggagcggatggaagtgacagccgtcgccactcagggaggttacgggtcctccaactgggtaacctcttaccttcttatgttctcagacagcggctggaactggaaacagtacaggcaggaggacagcatctgggggttttccggcaatgccaacgcagacagtgtggtatactacaggcttcaaccttccataaaagcccgattcctacgcttcattcccttagaatggaatcctaagggtcgcattggaatgaggatcgaggtgttcgggtgcgcctaccgcagcgaagtcgtggatttggacggcaaatcatcccttctgtaccggtttgatcagaagtcccttagccccattaaagacatcatttcactcaaattcaagacaatgcaaagtgatggaatccttcttcatcgtgaagggccaaatggggatcatattactcttcagctgaggagagcccggcttttcctactaattaactctggagaggcaaaactccccagtacatctactctggtaaatctcactcttggcagtttgctggatgaccagcactggcactctgtgctgattcagagactcggcaagcaggtgaatttcacagtggatgaacatcgacaccattttcacgctaggggtgaattcaacctgatgaacctggactatgagggaaatgtcagcttctcttgctcacaacctcagtccatgccagtgacgtttctgtcatccagatcatatctggccctaccagattttagcggcgaggaggaggtgtcagcaacattccagtttcgcacatggaacaaagctggcctcctgttattttcagagttgcaactcattagcggagggatattgctgttcttgtcagatgggaagctgaaatcaaacctctatcagcccggaaagctcccctcagatatcacagcaggagttgagctcaacgatgggcagtggcatagtgtgagcttaagcgccaagaagaaccatctgtccgtggctgtggacggccagatggcttcagcagcccctctcctgggtcccgaacagatttacagcggtggcacctactacttcggcggatgcccggacaagtcctttggctccaaatgcaagagcccactgggcggatttcagggttgtatgcgtctgattagcatttctggcaaggtcgtagacctcatctctgtccagcaaggcagtctgggcaatttttcagatctgcagatcgacagctgcggcatctccgaccggtgtcttccaaactattgcgaacatggcggtgagtgctctcagtcttggagcaccttccactgcaattgcaccaatacaggatatcgtggggccacatgccacaattccatttacgaacagtcctgcgaagcttacaaacatagggggaacacaagtggattctattatatcgattctgacggaagcggcccacttgaacccttcttgctgtactgcaacatgaccgaaacagcttggactataatccagcacaatggaagcgatttgacacgggtgaggaacactaaccctgagaatccctacgctggtttctttgagtacgtagcctcgatggagcagctccaggccacaatcaatagagcagaacattgcgaacaggaattcacttattattgtaagaaatcacgcctggtgaacaagcaggacggcacgccattgagctggtgggtaggtcggacaaatgaaactcagacatattggggcggaagctctccggatcttcaaaagtgcacctgtggtctcgaggggaactgtattgactcccagtattactgcaactgtgatgcagatcgaaatgagtggaccaacgacaccggacttctcgcctataaagaacacctacccgtgaccaaaattgtcataaccgataccggcaggctgcattccgaggccgcatataagcttgggccgcttctgtgtcagggtgataggtccttttggaacagtgccagttttgacaccgaagctagttatctgcattttcccaccttccatggagagctgagcgcagatgttagcttcttttttaagacgacagctagctccggggtgtttctcgaaaacctgggaatcgccgacttcataaggattgagctgcgctcccctacagtcgtcacattctcttttgacgttgggaatggcccatttgagatctcagttcagtctccaactcatttcaatgacaaccagtggcaccatgtgagagtggagaggaacatgaaggaggcttcattgcaggttgaccagctaacgcctaaaacccaaccagctcctgcagatggccacgtcctgcttcagctcaactcccagctgtttgtgggtggaacagcaacgcgacagcgggggtttcttggctgcatccggtcactccagctgaacggtatgacactggacctggaagaaagggcccaagtaactcctgaggtgcagcctggctgtagaggtcattgctctagttatggcaaactctgtaggaacggggggaaatgtcgggaaagacctatagggtttttctgtgattgcacattctccgcatatactggcccgttctgctcaaacgaaatctcagcctacttcggctccggctcctccgtgatttataactttcaggaaaattacctcttgagcaaaaattcgagttctcatgcggcatcctttcatggggatatgaagctttcaagggaaatgataaagttctcgtttaggacaacacgtacccccagtctgctgctattcgtctcatctttttataaggagtacctctccgtgataattgctaaaaacggggacctgcagattcggtacaagctgaacaagtaccaagagcccgacgtagtgaatttcgatttcaaaaacatggccgatgggcagctgcaccacattatgattaatcgagaggaaggggtggtttttattgaaatcgatgacaatcggaggaggcaggtccacctctcttcaggcaccgagttctccgccgtcaagagcctggtcctcggccggatcctggagcatagtgacgtggaccaagacaccgctctcgctggagcccagggcttcacaggctgtttatcggcagtgcagttgtctcacgtcgccccactgaaggcagctctacacccctcacatcccgaccccgtcactgttacgggccatgttactgagagtagctgcatggcgcagccagggacagacgctacatcccgggagcgaacccacagctttgctgatcacagcggcaccatagatgatcgtgaacccctggccaatgccattaagagtgactccgccgtcattggggggttaattgccgtggtgatttttattctcctctgtattaccgcaatcgctgtcagaatatatcagcagaagcgcctgtataaacgaagcgaagcgaaacgatcggaaaacgtggactccgccgaagcagttctgaagagtgaactgaacattcaaaatgctgtgaatgagaaccagaaggaatattttttttag

SEQ ID NO: 28939 - DNA, 3708 bp, Artificial Sequence
  Description of Artificial Sequence: Synthetic coding sequence
atgtggaattatgactgtgatgatcctttggtctctgctctgccacaagccagcttctctagcagcagcgagctgtcttcttctcacgggccgggcttcgcacgcctaaataggcgggatggtgctggcggctggtcccctctggtgagcaacaagtatcagtggctgcagatcgatttgggcgagagaatggaggtcacagccgtcgctacacagggggggtatggttcgtcaaactgggtcacctcctatctactgatgttctcagactctggatggaattggaaacagtaccgccaagaagactccatttggggttttagtggaaatgccaatgccgacagtgtagtgtactacaggctccagcccagcattaaagccaggtttctcaggttcatcccattagagtggaatccaaaaggtaggattggcatgcgcattgaggtcttcggatgcgcataccggtccgaagtggtagatctggacggcaaaagctctctgttgtaccgcttcgatcagaaatctctgagccccataaaagatattatcagcctcaaattcaagacaatgcagtctgatgggatcttgctgcaccgcgagggccccaacggggatcacataacactccaactgcgcagggcacgcctatttctgctcatcaacagcggcgaagcgaagttaccttcgacctctacactggttaacctcactctgggatccctcctcgacgaccagcactggcactctgtcctgatccagcggctaggcaaacaggtcaacttcacagtcgacgaacataggcaccatttccatgcacggggcgagttcaatcttatgaacttggattatgagggaaatgtttctttttcttgttctcaaccacaatcaatgccggtgacttttttgtcgagccgatcatacctggctctgcccgatttctctggcgaagaggaagtgtccgccacttttcaattcagaacatggaataaggctggactgctgctcttttcagagctacaactcattagtggcggtatcttactgttcttatcagacgggaaactcaagtctaacctttatcaacctggtaagctgccctctgatataaccgccggtgtggagttgaatgatgggcagtggcacagcgtgagcctgagtgccaagaagaatcaccttagtgtagccgtcgatgggcagatggcgagcgccgctccccttctcggtcctgagcagatatacagcggaggcacgtattatttcggtgggtgtcccgacaaatcttttggtagcaagtgtaagagcccgttgggcggcttccaaggctgcatgagactgatcagcatctcaggcaaggtcgttgacctcattagtgtgcagcagggcagtctgggcaatttttcagatcttcaaatcgacagctgtggcatctccgacaggtgcctccccaattactgcgagcacggcggagagtgttctcagtcctggtcaacatttcattgcaattgcaccaacaccggctacagaggggccacatgccacaatagcatatacgagcagagttgtgaggcctacaagcataggggcaatacctccggcttttactacatcgactcagacggttctggaccactagagcctttcctgctgtactgtaacatgaccgaaactgcgtggacgataatccagcacaatggctcagacctcaccagagtccgcaacactaaccctgaaaatccttatgccggctttttcgaatacgtggcatccatggagcagttacaggccaccataaatcgggccgaacattgtgagcaagagttcacgtactactgcaagaaatcccgccttgtcaacaagcaagacggcactcccctgagctggtgggtgggccggacgaacgagactcagacatattggggagggagttccccagaccttcaaaaatgtacttgtggcctcgaaggcaactgcatcgatagccagtactattgcaactgcgacgcagataggaatgaatggacaaatgatacaggcctgctagcttacaaggaacaccttcctgtgacaaaaatcgtgatcactgacacagggcgtctccattcagaagctgcatataagctcggccccttactctgtcagggtgatcggtcattctggaactccgcttcattcgacacagaagcttcatacctgcactttccgacgttccacggggagctctcggctgacgtgagctttttttttaagactacagcctcctccggggtgttcctggagaacctcgggattgccgattttatccgaatcgaactgagatcccctactgttgtgacgttctctttcgatgtaggcaatggcccatttgagatctcagtgcaatctcctacacacttcaatgataatcagtggcaccacgtccgggtggagcgtaatatgaaagaagcctcccttcaggtggatcagcttaccccaaagacccaaccagcccccgccgacggccacgtcctgctccagctgaattcacagctgtttgtgggcggaacagcaacccgccagcggggctttctcggctgtatacgcagcctccagctgaatggtatgactctggatttggaggagagagctcaggtgactcctgaggtccagcccggctgcaggggacattgttcctcttatggtaagttgtgccgcaatggaggtaaatgcagagaaaggcccattggctttttttgcgactgcactttttccgcttacaccgggcccttttgctctaacgagatctctgcttactttggatctgggtcctctgtgatctacaattttcaggagaattacctgctttccaagaacagtagctcgcacgcggcaagttttcatggcgatatgaaactgagccgagagatgattaaattctctttccgtacaacccgaacgccttccctgctgctctttgtctcgtctttttacaaggaatacttatcggttattattgcgaaaaatgggagtctgcaaatcagatataaacttaacaagtaccaggagccagacgtggtcaactttgacttcaagaacatggccgacggtcagctccatcacattatgatcaaccgggaagagggtgtcgtcttcatcgagattgatgacaacagacgcagacaggtccacctgtcgagtggtactgagttttccgccgtgaagtccctggtgctgggtaggatcctggaacattccgatgtggaccaagacaccgccttagccggggcacaggggtttacaggatgtctgtcggccgtgcagctgagccacgtggcccccctgaaggcagctctccacccctctcatcctgaccctgtcacagtgaccggacacgtcacagaaagctcctgtatggcccagccgggaacagatgctacgagcagagaacggacacactcctttgccgaccatagtggaacaatcgatgacagagaacctctggcaaacgcaatcaaaagtgattctgctgttatcggtggactgatcgcagttgtgatatttattttactatgcattaccgccattgccgtgcggatctatcagcaaaaaaggctgtacaaacggtccgaagctaagcgcagcgagaatgtggatagtgctgaagctgttctgaaatctgaattgaacattcagaacgcagtcaacgaaaatcagaaagaatacttcttttag

SEQ ID NO: 28940 - DNA, 1512 bp, Artificial Sequence
  Description of Artificial Sequence: Synthetic coding sequence
atgtctttgggaggagcttctgagaggagcgtgcccgcaacaaagatcgaaattacggtgtcctgcagaaaccttctggatctcgacaccttcagcaagtcagacccaatggtggtgctgtacactcagagccgggcctcacaggaatggcgcgaatttgggaggaccgaggtgatcgacaatactttgaaccccgatttcgtcagaaaattcgttctggactactttttcgaggagaaacagaacctgcggtttgacgtgtataatgtcgactcgaagactaacattagcaagcctaaggactttctcggccaagcatttctagccctcggggaggtaattggggggcaagggagcagagtcgagcgtacactcaccggtgtccctggaaagaaatgtggaacaatcctcctgaccgcagaggaactgagcaactgccgggacatcgccactatgcaactctgcgccaacaagctggacaagaaggacttcttcgggaaatctgacccatttctagtgttctaccgcagtaacgaagatggaaccttcaccatatgtcataagactgaagtggtgaaaaataccctgaacccagtatggcagccattcagtatccccgtgcgagccctctgtaatggagactatgatcgcacagtcaagatcgacgtgtacgactgggatagggatgggtcccacgactttatcggcgaatttactacgtcctacagagagttgtccaaagcacagaaccaattcaccgtgtatgaggtactcaatccaagaaagaagtgtaaaaaaaaaaagtatgtcaattccggcacagtgactctgctgtcattcagcgtggactccgagttcaccttcgtcgactacattaagggaggtacccagttgaacttcaccgttgctattgactttaccgcttcgaatggcaaccctttgcaaccgacgtctctccactatatgtctccttatcagctaagcgcttacgccatggctttgaaggcagtgggggagatcattcaggactacgacagtgataagcttttcccagcttacgggtttggtgccaaactgcctcccgaggggagaatttctcatcagttcccacttaataataatgacgaagacccaaattgtgccggcatagaaggtgttcttgaaagttactttcagtccttgcggactgtgcagctctacgggcctacctatttcgccccagtgatcaaccaggtggctagggccgctgcaaaaatttccgacggctcccagtactacgtcctcctcataatcactgacggggtcatttccgatatgacacaaactaaggaggccatcgtttctgcttccagtctgccaatgagcattatcatcgtgggagtcggaccggcaatgttcgaggctatggaggaattagacggggatgatgttcgggtcagcagtaggggcaggtatgctgagagagacattgttcaggaaggctgttgctccctcgggacaagtgtggtgtag

SEQ ID NO: 28941 - DNA, 1662 bp, Artificial Sequence
  Description of Artificial Sequence: Synthetic coding sequence
atgtccctcggcggagcgtcggagaggtccgtgccagcaactaagatcgaaataactgtctcctgtcggaatctcctcgatctcgatacattctcaaaatctgaccctatggtggtgctgtatacccaatctagagccagccaagaatggagagaattcggtcgaacagaggtgattgataatactctgaatccagactttgttagaaaattcgttctggattacttcttcgaagagaaacaaaacctccgctttgatgtatacaacgttgactcaaaaacaaacatctcgaagcctaaggatttcctgggtcaggcctttctggccttaggcgaagtgatcggcgggcagggaagcagggtcgagaggacactgaccggtgtgccgggaaaaaaatgtggaaccatactgttgaccgccgaggaactttccaattgccgcgatatcgctacaatgcaactgtgtgctaacaagctggataagaaggacttttttggaaagtcagacccgtttctagtgttttacaggtccaacgaggatggtacctttaccatatgtcacaagacggaggttgtcaagaacaccttgaatcctgtgtggcagccgttctcgattcctgtccgcgcgctctgcaacggagattacgaccgcacggtaaagattgatgtctacgactgggatcgcgacggctcacacgacttcatcggcgaatttaccacgagttatcgcgagctatcaaaagcgcaaaatcagtttactgtctacgaggtgctgaacccaagaaagaagtgcaaaaaaaagaagtacgtgaattctggtaccgtgactctgctctctttctccgtcgattcagaattcaccttcgtggattatatcaaaggcggaactcaactcaattttactgtcgctatagactttaccgcttcaaatggtaacccactgcagcctaccagcttacattatatgtctccataccagcttagcgcttacgccatggccttgaaagcggttggagagataattcaggactatgacagcgataaattattccctgcttatgggttcggagcaaaactgcctccggaaggacgaataagtcaccagtttcccctcaataataacgacgaggatcccaactgcgctggcattgagggagtattggagtcctattttcaatccttgaggactgtgcagctttacggcccaacatatttcgctcccgtgatcaatcaagtggccagagcagccgctaagatttctgacggttcccagtactatgtcctgcttattattactgacggagtgatcagtgacatgactcaaactaaggaggccatcgtaagcgcctcctcactgcccatgtcaatcataatcgtcggggtgggcccagcaatgtttgaggcgatggaggagctggacggggacgacgtcagggtcagctcgcgcggcaggtacgccgaacgtgacatcgtgcagttcgtgcccttccgggactacgtcgatcggtcaggaaaccaggtgctcagcatggcgcgcctggctaaggatgtgctcgcagagattcccgaacagcttttgtcatacatgaggactagagatatacagccacgaccacccccaccagcaaacccctctccaatccctgcgcccgagcagccatag

SEQ ID NO: 28942 - DNA, 1614 bp, Artificial Sequence
  Description of Artificial Sequence: Synthetic coding sequence
atggctcactgcgtcaccctggtccagctgagcatttcttgtgatcatctgattgacaaagacattggctccaagagcgatccattatgcgtgctgctacaggatgtcggcggcggcagctgggctgagttagggaggactgaaagggtgcgcaattgctccagtcctgagttctctaagacattgcagctagaatacagattcgagacagtgcagaaacttcgctttggcatttacgacattgacaataagaccccagaattgagggatgacgattttctcggtggcgcagagtgcagcctgggtcaaattgtgtccagccaagtcttgacactccctctgatgctgaaacctggcaagccagcgggcaggggcacaatcacggtgtctgcgcaggaactaaaggacaaccgtgtggtcacaatggaggtcgaagcacggaatctcgataagaaggactttttaggcaagtctgatccctttttggaattctttaggcagggcgacggcaaatggcacctggtgtacagatcagaagttatcaagaacaatttaaatccaacatggaagcggttttctgtccccgttcagcacttctgcggcggaaacccttccacccccatccaggtccagtgtagtgattacgattctgatggttcacatgatctcattgggacatttcacactagcctggcccagctccaagcagtccccgcagaattcgaatgcattcaccccgagaagcagcagaagaagaagtcttacaaaaactctgggactattcgcgtgaagatatgccgcgtggaaacggagtatagcttcctggattatgtcatgggtgggtgccagattaattttaccgtgggagtcgattttacgggctctaatggcgatccaagctcccccgactctctgcactatctctccccaacaggagtaaacgaatacttaatggcactatggagcgtgggctccgtagttcaggactacgactccgataaactcttccctgcctttggctttggcgctcaggtccctcctgattggcaggtcagtcacgaatttgctctgaatttcaatccctcaaacccatattgtgcgggtattcagggcatcgtcgacgcctaccgtcaagccctgccacaggtgcgcctgtatggccctacaaactttgctcccatcatcaaccatgtggcaaggtttgccgcgcaggccgctcaccagggaactgcttcccagtatttcatgctgttactgctgaccgacggtgctgtaaccgacgtcgaagccacccgggaggcagtggtgagagcgtccaacttaccaatgagcgtgataatagtgggggtggggggcgctgactttgaggcaatggaacaattggatgcagatggagggcctcttcacacccgctctggccaagccgccgctcgggatatcgtgcagttcgtcccctatagaagatttcagaacgcgcccagggaggcccttgcacagacggtgttggccgaggtcccaactcagcttgtctcttacttcagagctcagggatgggctcctcttaaaccccttcctccaagcgctaaggatcccgcacaggcccctcaggcatag

SEQ ID NO: 28943 - DNA, 1629 bp, Artificial Sequence
  Description of Artificial Sequence: Synthetic coding sequence
atgaaaatgatgcatatggctcactgtgtgacactggtccaactgtctatctcctgtgaccatttgattgataaagacataggcagtaaatccgaccctctgtgcgtgctcctgcaggacgtcgggggcggtagttgggccgagttaggaagaacagaaagagtgagaaactgtagttcgcccgagtttagtaagacactccagctcgaatacagattcgagacagtacagaagctccggtttggcatatacgatatcgataacaagacacccgagctgagggacgacgacttcttgggcggcgcggagtgctccctagggcagattgtttcgtctcaggttctgacacttccgttaatgttgaagcccggcaagcctgcagggagaggtacaattacggtgtctgcgcaggaactgaaggataatagggtggttaccatggaagtggaagcaagaaatctggacaagaaggacttcctggggaaaagtgatccattccttgagtttttccgacagggcgatggtaaatggcacttggtctacagatctgaagtcataaagaataacctaaaccctacatggaagcgtttttctgtgccggtgcaacatttctgcggaggtaacccgtccacaccaattcaggtgcagtgctccgactatgactcagacggaagccatgacttaatcggcacatttcacacttctctggcccagttacaagctgtcccagccgagtttgaatgcattcaccccgaaaagcagcagaagaaaaaatcctacaagaactcaggaactatccgcgttaaaatttgcagagtagagaccgaatactcatttctggactatgtcatggggggctgtcagatcaacttcaccgtgggtgtagatttcacaggatctaatggcgatccttcctcccctgactcactccactacttgagtccgaccggagtaaatgaatatctgatggccctgtggtccgttggctcagtggtccaggactacgactctgacaaactctttccagcattcgggttcggcgctcaggtgcctcccgactggcaggtatcccacgaattcgcccttaacttcaatccatcaaatccctattgtgctggcatccagggaatcgtcgacgcctatcgccaggctctgccccaggttaggctctacggaccaaccaacttcgcacccattatcaaccacgtggcccggttcgccgcccaggctgcccaccagggtaccgccagccagtatttcatgcttttgctgcttactgacggcgccgtgactgatgtggaagcaactcgagaggcggttgtgagagcttctaacctccccatgagtgtcatcatagtgggggtgggaggggctgacttcgaagcaatggaacagttagacgccgatggagggccactgcatactagatcaggacaagctgctgctagggacatcgtccagtttgtgccttaccgccgctttcagaacgccccccgcgaggccttagcccagaccgtgttggctgaggttcctacccagcttgtttcttactttcgggcccagggctgggcaccgctgaaacctctgcccccctctgcaaaagaccctgcacaggctccccaggcatag

SEQ ID NO: 28944 - DNA, 1614 bp, Artificial Sequence
  Description of Artificial Sequence: Synthetic coding sequence
atggcccactgtgtgacactggtccagctgagcatcagctgcgatcatctaattgacaaggatattgggagtaagagtgaccccctgtgcgtgctcttacaagacgtgggcggtgggtcctgggcagagctgggcaggaccgagcgtgtgaggaactgcagctccccagaattttccaagaccctccaactcgaataccgctttgaaacagtgcaaaagctccggttcggcatctacgacatagacaacaagactccagaactgcgggatgatgacttcctgggcggagccgaatgtagtctcggccagatagtgagctcccaggtgcttaccctgccactgatgttgaaacccggaaaacctgcaggaagaggaacaatcactgtgtcagctcaggagctgaaggataatcgcgtggtcactatggaggtggaggctcggaatcttgataaaaaggactttctaggtaagtccgacccttttctggagttctttcgccagggcgacggtaaatggcacttagtgtatagatcagaggtgataaaaaacaacttaaatccgacctggaaacgcttcagtgtacctgtgcaacacttctgtggaggtaacccatcaacgcctatacaagtccaatgctccgactacgacagcgacggctcacatgacctaataggaacttttcatacctccctggcccagttgcaggccgttcctgctgagttcgagtgtatccaccccgagaaacaacaaaagaaaaaatcttacaaaaacagcggaacgatccgggtcaagatatgccgcgtggagacggagtactcattcctagattacgttatgggtggctgccagatcaactttacggtgggtgttgatttcactggcagcaatggagaccctagttcacctgattcactccactacctctcccccacaggcgtgaatgagtatctgatggccctgtggagtgtcgggagcgtggtacaggactacgactccgacaaactcttccctgcgtttgggttcggagcccaggtcccccccgactggcaagtaagccacgagtttgccctgaatttcaaccctagtaacccttattgcgccggcatacagggcatcgtggatgcctacaggcaggcccttcctcaggtgaggctgtacggcccaactaatttcgctcctatcattaaccatgtggcaaggtttgccgctcaggccgctcaccagggtacagcctcgcaatattttatgctcctcttactgaccgacggcgctgttaccgatgttgaagcaacacgcgaggctgttgtcagagcgtctaatctgcccatgagtgtgatcatcgtgggcgtcggaggtgccgacttcgaggcaatggagcagttggacgccgacggggggccccttcatacaaggtccggtcaggccgccgcgcgggatatcgtccagtttgtgccctatcggcgatttcagaacgcaccccgggaagctctggcccaaaccgtgctggccgaagtgccaactcagttagtaagctacttcagagcccagggctgggctcccctcaagccattaccaccctccgcgaaagatccggctcaggctcctcaagcttag

SEQ ID NO: 28945 - DNA, 1614 bp, Artificial Sequence
  Description of Artificial Sequence: Synthetic coding sequence
atggcgcattgtgtgacattggttcagctgtctattagttgcgaccatctgattgacaaggacattgggtcaaaatccgatccattgtgcgtcctgttgcaagacgttggaggaggctcctgggctgagctcggccgtactgagcgagtcagaaattgctcgagtccagagttctccaagactctacagctggagtatcggtttgagactgttcagaagctgcgcttcggcatttatgacatcgacaacaagacccctgagctgagggatgatgattttcttggcggtgctgagtgttcgctggggcagattgtaagctctcaagtgcttactctcccactgatgcttaagcccggcaagcccgcaggcaggggcactatcacagtctcagcacaggagttgaaagataacagagtagtgacaatggaagtggaggctcgcaatcttgacaaaaaagactttctcggtaaatccgacccttttctggaattcttcagacagggcgatgggaagtggcatctggtgtacagatcagaggtcatcaaaaacaatctcaacccaacctggaagagattcagcgttccagtccagcatttttgtggcggtaatccttcaactcctattcaagtgcaatgctctgactacgactccgatggaagccacgacctcataggcacatttcatactagcctagctcagctgcaggctgttccagcggaatttgaatgcatccacccggaaaaacagcagaaaaaaaaaagctataaaaacagcggcacgattagagtaaagatctgcagagtagagactgagtatagctttctggactatgtcatggggggttgccagattaactttactgttggtgtggacttcacaggcagtaatggagaccccagttcccccgattccctccactacctgtcccccactggagtgaatgagtatctcatggcactttggtccgtgggatctgtcgttcaggactatgattccgataaactgttccctgcttttggcttcggagcacaggtgcctcctgactggcaggtcagtcacgaattcgccttaaattttaatccatccaatccatattgcgccggaattcaggggatcgtggatgcctaccggcaagccttaccccaggtgaggctgtacggccccaccaattttgccccaatcatcaaccatgtagcaaggttcgcggcccaggcggcgcaccaagggacagcatcccagtatttcatgctgctacttttgactgacggcgccgtgaccgacgtggaagctacgcgcgaggcagtcgtgcgcgcctcaaacctcccgatgtctgtgatcatcgtcggcgtggggggcgccgacttcgaggccatggagcaactggatgctgatggtggtcctctccacacacgctccgggcaagcggccgcccgcgacatcgtgcagttcgttccatatcggagattccagaacgcccctcgcgaggcactggctcaaacggtgctggcggaagtccccacacagctggtgtcatactttagagcccagggctgggcccctcttaagcctttacctccatccgctaaagatccggcacaagcaccccaagcttag

SEQ ID NO: 28946 - DNA, 1614 bp, Artificial Sequence
  Description of Artificial Sequence: Synthetic coding sequence
atggcgcattgtgtcactctggtccaacttagcatcagttgtgaccatctgatcgacaaggacatcgggtcaaagtctgaccccctgtgcgtgctcctgcaggatgtgggcggtggctcatgggcagaattagggagaaccgaacgagtgcgcaattgctcaagtccggagttcagtaaaacactccagctggaatatcgcttcgaaaccgtgcagaaactcagattcggcatatatgatatcgataataaaacccctgagctcagggatgacgatttcttggggggggcagagtgtagtttggggcagatagtgtcctctcaagtgcttaccttgcctttgatgctaaagcctggaaagccagcgggaaggggaactatcactgtcagcgcacaggaactgaaggacaatagagtggtgactatggaggtggaagctcgcaacctggacaagaaggacttcctcggtaagagcgaccccttcctcgagttcttccgtcaaggagacgggaagtggcatctcgtttatagatccgaagtgataaaaaacaacctcaacccgacctggaaacgattcagtgtgcccgttcagcacttctgcggcggcaatccctccacgcctatccaggtgcagtgttcagactacgacagcgatggaagccacgatttgattgggacattccatactagcctcgcacaactccaggcggtccctgccgagttcgaatgcatacacccggagaagcaacagaagaaaaaatcctataaaaatagcgggaccatcagagttaaaatctgccgcgtggagacggaatattcctttctggattacgtcatgggtggctgtcagattaactttacagttggagtggatttcaccggttccaacggggatccctcttcccctgacagtcttcattatctgtcgccaactggggtcaacgagtatctgatggccctgtggtcagtagggtcggtggtccaggactatgatagtgacaaattatttcccgccttcggattcggcgcacaagtgccccccgactggcaggtgtcacacgagttcgccctcaatttcaatccttcaaacccctactgtgccggtatccagggcattgttgacgcataccgccaggcccttccccaggtgcgcctgtacggaccaaccaacttcgcccctatcataaatcatgtcgcccgctttgctgcgcaagccgcacatcagggaaccgcttcccaatacttcatgctgctgcttctgacagatggggctgtcaccgatgtcgaggctaccagggaggctgtggtgagggcttcaaatctgcccatgtcagttattatagtgggcgttggcggcgcagatttcgaagccatggagcagctcgacgccgatggcggcccccttcacactcgatccggacaggctgctgctagggatatagtccagtttgttccatatcgcaggtttcagaatgctcccagagaagccctcgctcagaccgtcctcgccgaagtgcccacacagctagtgagttatttccgcgcccaaggatgggcaccgctgaagccgctgccacccagcgcgaaggatcccgcccaggcccctcaggcctag

SEQ ID NO: 28947 - DNA, 1614 bp, Artificial Sequence
  Description of Artificial Sequence: Synthetic coding sequence
atggcccattgtgtgaccctggtccaattatccatctcctgcgaccatctgatagacaaggatatcgggtcgaagagcgaccccttatgcgtgctgctgcaggacgtaggggggggatcatgggctgagctgggtagaacagaaagggtgagaaactgctcatcgccggaattcagcaaaacactccagctggagtacaggtttgagaccgtacagaaactcaggtttgggatctacgatatcgataacaaaacaccagagttgagggatgatgacttcctcggaggggcagaatgctctttaggacaaatcgtttcttcacaagtgctgactctgccattgatgctcaaacccggtaagccagccggccgcggcacaatcacagtgtctgcccaagagcttaaagataatcgggtcgtgactatggaggtggaggctaggaatctagacaaaaaggatttcctggggaagtctgacccctttttagagttctttcgccaaggtgatggcaagtggcatctcgtctacagaagtgaggttattaaaaataatctaaacccaacctggaaaaggttctcagttcctgtacagcacttttgtggtggaaatccctccacaccgatccaggttcagtgctctgactacgatagtgacggttcccacgatcttatagggactttccatacttcacttgcacagctgcaggcggtacccgccgagtttgagtgtatacaccccgaaaaacaacagaagaagaaatcctacaaaaattctggaacgattcgggttaagatttgtcgcgtggaaactgagtattcgttccttgactacgtgatgggtggctgccagattaatttcacggttggtgtggactttaccggaagcaatggagatccaagttcacccgactccctgcactacctttcccctacaggggtcaacgaatacctcatggctttatggtcagtggggagcgtggtgcaagactacgactcagacaagctcttcccagcctttggttttggagcccaggttccaccggactggcaagtgtcacacgaattcgctctcaatttcaatccaagcaatccctattgtgctggcattcaaggaatagtcgacgcttacaggcaagcgttgcctcaggtccgtttatacggcccaacaaacttcgccccgatcattaaccacgtggccaggttcgcggcccaggctgctcaccagggcactgcctcccaatactttatgctgcttctgctgacagatggggcggttacagatgtggaagccactcgcgaagcagtggttcgggcaagtaatctgcctatgagcgtgatcatcgtgggggtcggcggcgccgacttcgaggccatggaacagctggatgcagatggaggccctctccacaccagatctggacaggcagctgctagagacatcgtgcaatttgttccttacaggcggttccagaatgcaccaagagaggcccttgctcagactgtgctcgccgaggtgccgactcagctggtaagttattttcgcgctcagggatgggccccccttaaaccactgcccccatccgccaaagacccagcgcaggccccgcaggcctag

SEQ ID NO: 28948 - DNA, 915 bp, Artificial Sequence
  Description of Artificial Sequence: Synthetic coding sequence
atggcacattgtgtaactctggttcaactcagcatatcttgtgaccatttgattgacaaggacatcggctctaagtccgaccccctgtgcgtactcctgcaggatgtgggagggggaagctgggctgagctgggtagaactgagcgggttcgaaattgcagtagccctgagtttagcaagactctgcaactggaataccgattcgagactgtccagaagctgcggttcggaatttacgacatcgataacaaaacaccggaactgcgcgatgatgactttctgggcggtgcagagtgttccctcgggcaaatcgttagctcacaggtgctgacactacccctcatgcttaagcccggaaagcccgccggaagggggaccatcaccgtcagcgctcaggagcttaaggataacagagtcgtaaccatggaggtggaggcccgtaacttggataagaaggacttcctgggcaaatccgatcccttcctagagttttttaggcaaggagacggaaagtggcaccttgtgtacaggtcagaggtgatcaaaaataacttgaatcctacgtggaaaagatttagtgttcccgtgcagcatttctgcggcggtaatccatcaactcctatccaagtgcagtgcagcgactacgacagcgatgggagccacgaccttattggaaccttccacacaagcctggctcaactacaagcggtgcccgctgagttcgaatgtattcatcccgagaaacagcagaaaaagaaaagctacaagaattctggcactataagagtgaaaatctgccgagtagagaccgaatattcattcctggattatgtgatgggcggttgtcagattaactttacggtaggcgtggatttcaccgggagtaacggcgacccatcaagccctgacagctag

SEQ ID NO: 28949 - DNA, 411 bp, Artificial Sequence
  Description of Artificial Sequence: Synthetic coding sequence
atggcccattgcgtgacacttgtacaactctcaatttcatgtgaccacctcattgacaaagacatcggttccaagagcgatcccctgtgtgttttactacaggacgttggcgggggaagttgggccgagctcggccgaaccgagcgggtgcggaactgctcttcccccgaattctcgaaaaccctacaactggaatacaggttcgaaaccgtgcagaaactgagattcggcatttatgacatcgacaataaaacccccgagctcagggatgacgactttctcggcggggcggaatgcagcctggggcaaatcgtgagcagccaagtcctgacactgccactgatgctgaaaccaggcaaacccgccggacgaggtaccattacagtctctgctcaggagctgaaagattag

SEQ ID NO: 28950 - DNA, 630 bp, Artificial Sequence
  Description of Artificial Sequence: Synthetic coding sequence
atggcccattgtgttacgctggttcaactgtctataagctgtgaccacctgatcgataaagatatcggatcaaagtccgatccgctttgcgtgctgctgcaggacgtcggcggcggcagttgggcggagttgggacggaccgagcgggtgcgcaattgctccagccctgagttctccaagactctgcaactggagtaccgattcgaaacggtgcagaaactcagattcggcatctacgatatcgacaacaagacccccgagctgagggacgatgatttcctgggtggcgccgagtgttctctgggtcagatagtcagctctcaagttctgacactcccactcatgttgaagcccggaaagcctgccggtcgaggtaccatcactgtgagcgctcaggaactcaaagataacagggtagtcacaatggaagttgaagctagaaatttagacaaaaaggactttctggggaagtctgatcctttccttgaattcttccgacagggcgacggcaagtggcacttggtttacagaagtgaggttattaaaaacaatcttaaccctacttggaaacgttttagcgttccagtgcagcatttctgtggtggtaacccaagcacccccatccagtag

SEQ ID NO: 28951 - DNA, 609 bp, Artificial Sequence
  Description of Artificial Sequence: Synthetic coding sequence
atggcgcactgcgtcaccctggtgcagttgagtatctcctgtgaccacctcatcgacaaggacatcggatcaaagagtgaccctttgtgcgtgttgctccaggatgtggggggagggtcctgggcagaacttggaaggaccgagcgtgtgcgcaattgttcatcccctgaatttagcaagacgctgcagttagaataccggttcgaaaccgttcagaagctgcgctttggcatttacgatatcgacaacaagacccccgagctgagagacgacgacttcttgggtggggcagaatgcagcctggggcaaatcgtgtcaagccaggtgcttactttgcctttgatgctgaagcccggcaaacctgccggccggggtacgattaccgtttcggcccaggagctgaaggacaacagagtggtgaccatggaggttgaggcacgcaacctggataagaaggatttcttgggaaaatcagatccttttttagagttcttccgtcaaggggacggtaaatggcatctcgtgtaccggagcgaggtaataaagaacaatctcaaccctacatggaagcgcttttccgtgccagtacagcatttttgtggtggatag

SEQ ID NO: 28952 - DNA, 204 bp, Artificial Sequence
  Description of Artificial Sequence: Synthetic coding sequence
atggcccactgtgtgacccttgtgcaactgtccattagttgcgatcatctcatagacaaagacataggctcaaaaagtgatccgctatgcgtgctcctccaagatgttggcggggggagctgggccgaacttggccgcaccgagcgcgtccggaactgttcaagccccgaattcagtaaaaccctgcaattggagtaccgctag

SEQ ID NO: 28953 - DNA, 459 bp, Artificial Sequence
  Description of Artificial Sequence: Synthetic coding sequence
atggcgcactgcgttactctggtacagctgtcaatttcctgcgatcatctgatcgataaggacattggtagtaaaagcgatccactgtgcgtgcttcttcaagacgtcggggggggttcctgggccgagctgggaaggactgagagggtgcgcaattgtagcagccccgagtttagtaagaccctgcaactggagtacaggttcgagaccgtgcagaagctccgattcgggatatacgatattgataacaaaacgcccgaactccgcgatgatgactttctaggcggcgctgaatgtagtctcgggcagatcgtgagcagtcaggtcctgactctacccctgatgctaaaaccgggcaagccggccgggagaggtactatcactgttagcgcacaagagttgaaagataacagggtggtgaccatggaagtagaggccagaaatcttgacaagaagtag

SEQ ID NO: 28954 - DNA, 696 bp, Artificial Sequence
  Description of Artificial Sequence: Synthetic coding sequence
atggcccactgcgttaccctcgtgcagctgtctatttcctgtgatcatctcatcgataaagatattgggagcaagagtgatcctctgtgtgtcctcctccaagatgtggggggtggctcctgggctgaactgggtcggactgagagagtgagaaactgcagttctcctgagttctccaaaaccctccagcttgagtataggttcgaaaccgttcagaaactccgatttggcatttatgacatagacaacaaaacccccgagcttcgcgatgacgactttctggggggggccgaatgttctctggggcagatagtgagtagtcaagttctgactctgcccctcatgcttaagccgggcaagccagctggccggggcacaataacagtgtccgcacaagaactaaaggacaatagagtggtgactatggaggttgaagcccgtaatttagataagaaagactttctcggtaaaagcgatcccttcctggagttcttccgtcagggtgacgggaagtggcaccttgtgtacagatccgaggtgatcaaaaacaacttgaatcccacatggaagcgtttttctgttcccgtgcagcacttttgcggaggcaacccaagtacgccaatccaggttcagtgcagtgattacgacagcgacggttcccacgatctgattggcaccttccacacgagtctttag

SEQ ID NO: 28955 - DNA, 525 bp, Artificial Sequence
  Description of Artificial Sequence: Synthetic coding sequence
atggcacattgcgtgacactcgtgcagctttctatctcttgcgaccatttgatcgacaaggatattggaagcaagagcgaccccctgtgcgtgctcctgcaagacgtaggaggcggatcttgggcagagctcggtcgtactgagcgggtgaggaactgttcgtcaccggagttctctaaaacactgcaattggagtatcgcttcgaaaccgtacagaagcttaggtttgggatctatgatattgataataagactccagaattgagagatgatgatttcctgggcggggctgaatgttctctcggtcagatcgtgagctctcaggtgctgacattgcctctgatgttaaaacccgggaagccggcgggacgtggcaccatcactgtgagcgctcaagaattgaaagataaccgcgtggtcaccatggaagtcgaagccagaaaccttgacaagaaggactttctgggtaagagtgaccccttcctggaattctttagacagggtgatgggaagtggcatctctag

SEQ ID NO: 28956 - DNA, 1647 bp, Artificial Sequence
  Description of Artificial Sequence: Synthetic coding sequence
atggctcacattccgtctggaggagctccagccgctggcgccgcacctatgggcccacagtactgcgtctgcaaagtagagttatccgtcagcggtcagaatctgctggacagggacgtgaccagtaaaagcgatcccttttgcgttttgtttactgagaacaatggcagatggatagagtatgaccgtactgaaactgccattaacaatctaaacccagcttttagtaagaaattcgttctggactaccactttgaggaagtccagaagctgaaattcgctctgttcgatcaggataagtcatctatgaggttggatgagcacgacttcctagggcagttcagttgctctctgggcacaatcgtgtcctccaaaaaaatcacccggcctttactgctgctgaatgacaagcccgccggaaaagggttaataacaattgctgcccaggagctgtcggataatcgcgtcatcaccctgagcttggccggcagacggttggataaaaaggacctttttggtaagtctgacccgttcctggaattctataaaccaggggacgacggaaagtggatgctcgtgcacagaactgaagtgattaagtataccttggaccccgtttggaaaccatttaccgtacccctggtgagtctttgtgacggtgatatggaaaagcctatccaagtgatgtgttacgattacgacaacgatggtggtcacgacttcattggggaattccagacgtctgtgtcccagatgtgtgaggcgagggatagcgttccactcgagttcgagtgtattaatccaaagaagcagagaaagaagaagaactacaagaactcagggattattatcctcagaagttgtaagataaacagagactacagctttttggactatatcctgggcggctgtcagctgatgttcaccgttggtatcgattttaccgctagcaacgggaacccactcgacccttcctccctccattacataaatccaatgggcaccaacgaatacctgagcgcgatttgggccgtggggcagataatccaagactatgattctgacaagatgttccccgccctcggattcggggctcaactacctcctgattggaaggtttcacacgaatttgccattaattttaatcccacaaatcctttttgtagcggggtggacggaattgcacaggcatacagtgcttgtctgccgcacattcgtttttacggcccaactaacttctcccctattgttaaccatgtagctaggttcgccgcacaggccacccaacagcggacggccacccagtatttcatcctgctaattataacagacggggttatctcagatatggaggagaccagacatgccgtggtccaagcttccaaacttccaatgtcgattatcattgttggggtgggtaacgctgatttcgccgcaatggagttcctcgatggagattctcggatgttacggagtcacaccggggaagaggccgcacgggatatcgttcaattcgtaccattccgtgagtttaggaacgccgccaaagaaaccctggccaaagcagtgttggctgagctaccacaacaggtggtccaatatttcaagcataagaaccttccccccactaattcagagcctgcttag

SEQ ID NO: 28957 - DNA, 1647 bp, Artificial Sequence
  Description of Artificial Sequence: Synthetic coding sequence
atggcacacatcccgtccgggggcgctcctgcagctggtgcggctcccatgggaccccaatactgtgtctgtaaggtcgagttatctgtttcggggcagaacctactcgaccgggacgtaacgagcaagagcgatcctttttgtgtcctgttcactgaaaacaatgggaggtggatcgagtacgataggactgagacagccatcaacaacttaaaccctgctttctcgaaaaaattcgtgctggattaccacttcgaggaagtgcagaaacttaagtttgccctattcgatcaggataaatcctcaatgaggctagatgagcacgattttcttgggcagtttagttgttccctgggaactattgtgtctagtaagaaaatcacacggcccctccttctgttgaacgataaaccagccggtaagggtcttattaccatcgcggcccaagaactgtccgataacagggtgattacgctgtcactcgcaggcaggcgcctggataagaaagacctgtttggcaaatccgatccctttctagaattttataagcccggcgatgacggtaaatggatgttggtgcatcgaacggaagtgataaaatatacacttgatcccgtgtggaaacctttcactgtgccgcttgtctccctgtgtgatggggacatggagaaacccatacaggtcatgtgctatgattacgacaacgacgggggacacgacttcattggcgagtttcagaccagcgtgtcccagatgtgcgaggccagagattccgtgccactcgagtttgagtgtataaaccccaagaagcagaggaaaaagaaaaactacaaaaattccggtatcattattttaaggtcctgtaagattaaccgggactattcctttctggattatatcctcggcgggtgccagctgatgttcaccgtgggtatagacttcaccgcgtccaacggcaacccacttgacccttcatccttgcactacataaaccccatgggcaccaacgaatacctaagcgccatttgggcagtaggacaaattattcaggattacgactcagacaagatgttccccgctttaggtttcggtgcgcagctcccaccggattggaaggtttctcacgagttcgccatcaactttaatcccaccaatccattttgttcaggggttgatggaattgcacaagcttatagcgcctgtcttccgcatattcggttctacggaccaacgaatttctctccgattgtgaatcacgtggcaagatttgcggcacaggcgactcagcaaaggactgcaacgcagtactttattctgctgattattactgatggcgtgatcagcgatatggaggagactaggcacgcggtggtccaggcttcaaaactccccatgtctatcatcatcgtcggagtgggcaatgctgatttcgccgccatggaattcctggatggcgacagtcgaatgctccggtcccataccggggaggaagccgcgagagacatagtgcagtttgtgccttttcgcgaattccgaaatgcggccaaggagaccctagctaaagcagtgttggcagaattacctcagcaagtagtccagtactttaagcataagaaccttcctcccaccaacagcgagcccgcatag

SEQ ID NO: 28958 - DNA, 1341 bp, Artificial Sequence
  Description of Artificial Sequence: Synthetic coding sequence
atgaggctggatgaacatgacttcttggggcagttctcttgctctctgggaacaatcgtgtctagtaaaaaaataacccgacctcttctgcttcttaatgataagcccgccggtaaaggcttgattaccatcgcagcccaggaactctccgataatcgcgttatcacactttccttagccgggcgccgtctggacaagaaggatctatttggaaagtctgatccgttcttggaattctacaaacctggcgatgacggcaaatggatgctggtacaccgtactgaggtcattaagtacaccctggacccagtgtggaagccattcaccgtcccccttgtctcactttgtgacggcgacatggagaaacccatacaggtcatgtgttacgactatgacaatgatggcggccatgatttcattggcgagtttcagacaagtgtatcacagatgtgcgaggcgcgagattctgtgccacttgagtttgagtgcattaacccaaagaaacaaaggaaaaagaaaaattataagaattccggcataattatactgcgtagctgtaagatcaatcgggactacagtttcctggactatatacttggagggtgccagcttatgtttactgttgggatcgattttactgctagtaacggcaaccctctagacccctcctccctccattacattaaccccatgggcaccaatgaatatctgtctgccatatgggccgtgggccagatcatccaagactatgattcagataagatgttccccgccctgggattcggagcacagctgcccccagactggaaggtatctcacgaattcgccataaatttcaaccccacaaacccgttttgttccggcgtggatggtattgcacaggcctattccgcctgtttgccacatatccgattctatggcccaacaaatttctctcctattgtgaaccacgtggcccggttcgctgcgcaagcaacccagcagcgaacagccacccaatactttatattactgataatcaccgacggcgtcatttcagacatggaagaaactcggcatgctgtggttcaggctagtaaactccccatgagcatcataattgttggggttggtaatgcagattttgcagcaatggagttccttgatggcgattctagaatgctgagatctcatacaggggaagaagccgcacgggacatcgtacaattcgtccccttccgtgagtttaggaatgctgccaaggagacactagcgaaggcagtgctggctgagctacctcagcaggtggtgcagtactttaagcataagaatctccctccaacgaatagcgagccagcttag

SEQ ID NO: 28959 - DNA, 1674 bp, Artificial Sequence
  Description of Artificial Sequence: Synthetic coding sequence
atgaagaagatgtctaacatctatgaatccgctgccaataccttgggcattttcaactcaccttgtctgactaaggttgaattgagggtggcgtgcaaaggaataagtgatagggatgctctgagtaagcctgatccttgcgtgatcctcaagatgcaatctcatggtcaatggttcgaagtagatcgaaccgaggtgatccgaacatgcataaacccagtctactctaaattgttcaccgtggacttttacttcgaggaggttcagcgcctacggttcgaagtgcatgatatcagttccaaccacaatggactcaaagaggccgatttcctgggggggatggagtgtacccttggacaaatcgttagtcagagaaagctctcgaaatctctactcaagcacgggaacactgctggaaaatcatcgatcactgtgattgcagaggaactgagcggcaatgacgactacgtggagctggcttttaatgcgcgaaagttagatgataaagacttcttttcaaagtccgaccccttccttgagatttttagaatgaacgacgatgctactcagcaattagtccatcgcacagaagtggtcatgaacaacctctcccctgcctggaagtctttcaaggtaagtgtgaatagcctgtgtagtggggaccctgatagacggctgaagtgtattgtgtgggattgggattcaaacgggaagcacgatttcattggggagttcacgtcaacttttaaggagatgagaggcgccatggagggcaagcaggtgcaatgggagtgcattaaccccaagtataaagcgaagaagaagaactacaagaactcagggaccgttattttgaatctgtgcaaaattcacaaaatgcacagtttcctggattacatcatgggcggttgccagattcagttcaccgtggccatcgattttaccgcctccaacggtgacccacgcaactcttgtagcctccattatatacatccctaccagcccaatgagtaccttaaggccctggtggcagtgggcgagatctgtcaggattacgacagtgacaagatgttccctgcatttggcttcggggctaggattccccctgagtatacagtcagccatgactttgccatcaactttaatgaagacaatccggagtgtgcaggcattcagggcgttgtagaagcttatcagtcttgtctgcccaagctccagttgtatggacctaccaacattgcccccataatccaaaaggtcgcgaagtccgcctcagaggagacaaacacaaaggaggcttctcaatattttattttattaattctgacggatggggtgataacggacatggcggacactcgggaggctattgtgcacgccagccacctccccatgtctgtgattatcgttggggtcggcaacgcagacttcagcgatatgcagatgcttgacggcgacgatgggattttgcgttccccaaaaggggaaccggtgctgcgcgacatcgttcagtttgtcccattccgtaactttaaacacgcatcacccgcggccctcgctaagtcagtgttagctgaagtgccgaatcaggttgttgactattacaacggaaaagggattaaacccaagtgctcatccgaaatgtatgagagcagtagaacactggcaccctag

SEQ ID NO: 28960 - DNA, 1728 bp, Artificial Sequence
  Description of Artificial Sequence: Synthetic coding sequence
atggccgtagaaccttccagctcagaatctataaagaggcgggctggcagaaggatgaaaaagatgagtaatatctatgagtccgcagctaatacactgggaattttcaactccccgtgcctgaccaaggtggagttgcgggtggcttgcaagggcatctctgatcgcgatgctctgtccaagcctgacccttgtgtcattctgaagatgcagtctcacgggcagtggtttgaggtagatcgaactgaggtcatccggacctgtataaacccagtgtactctaagctttttactgtcgacttttacttcgaagaagtgcagaggctgagattcgaagttcacgacatcagctccaatcacaacggactgaaggaagccgacttcctgggagggatggagtgtactctgggacagatcgtatctcagagaaagttgtctaagtccctgcttaaacacggcaacaccgccggaaagagcagtatcaccgttattgctgaggagctctctggaaatgacgactatgtagagctcgcattcaacgcaaggaaactggatgataaggacttctttagcaagagcgaccccttcctcgagatctttcgaatgaatgacgacgccacgcagcagctggtgcatcgcacagaagttgtaatgaataacctatcaccagcttggaagagtttcaaagtgagtgtcaattccctctgcagtggtgatccagaccgcaggctgaagtgcatagtgtgggactgggattcgaatggaaaacacgatttcataggtgagttcacttccacgttcaaggaaatgcgaggagctatggagggcaagcaggtgcagtgggaatgtataaatccaaagtataaagcgaaaaagaagaactacaagaattccggtactgtcattctgaacttatgtaagatccataaaatgcacagctttctcgactatatcatgggcggctgccagatccagtttactgtcgctatcgactttacggccagcaacggagatccccgtaattcatgcagcctccactacatacatccttatcagcccaatgagtacctgaaggccctcgtggccgtaggcgaaatctgtcaggattacgattcggacaaaatgttccccgcgttcggattcggtgcacgaattccccctgagtatactgtttcgcacgatttcgccatcaattttaacgaagataaccctgagtgcgctggtatccagggagtggtggaggcttatcagtcttgcctccctaaacttcagctgtatggacctactaacatcgcccccattatccaaaaggtagctaaaagcgccagtgaggagaccaacactaaagaagcctcccagtattttattctcctcattttgacagacggcgtgataacagacatggccgatacacgcgaagcaattgtgcatgcaagccacctgcccatgtcagtgattattgtgggggttgggaatgccgacttcagcgatatgcagatgcttgacggggacgacggtattctccgttcacccaagggagaaccggtactgagagacatagtacaattcgtccctttccgcaacttcaaacatgcctccccagccgcactggcaaaatcagttctggccgaggtcccaaaccaagtcgtggactattataatggcaaggggattaagcctaagtgctcgagcgaaatgtatgagtcttctcggacactggccccttag

SEQ ID NO: 28961 - DNA, 510 bp, Artificial Sequence
  Description of Artificial Sequence: Synthetic coding sequence
atgaagaaaatgtctaatatatatgagagcgctgctaacaccctggggatctttaactcaccttgtctgaccaaagtagagttacgtgtcgcatgcaaaggcatttctgaccgagatgctctgtccaagcccgatccatgtgtgatcctgaagatgcagagtcacggccaatggtttgaggtggatagaaccgaggtaatccggacatgcattaacccagtctattccaagttattcactgtggatttttacttcgaggaggtgcagagacttcgctttgaggtgcatgatataagctctaaccacaatggactgaaggaagcagatttcttaggtggcatggaatgtaccctggggcagattgtttcacagagaaaactgtctaagtcactgcttaagcatggcaatactgctgggaaatccagcataacagtgatcgccgaagaactgtcagggaacgatgactacgtggagctcgcctttaacgcacggaaacttgatgataaatag

SEQ ID NO: 28962 - DNA, 1674 bp, Artificial Sequence
  Description of Artificial Sequence: Synthetic coding sequence
atgaaaaaaatgtctaacatttacgaaagtgcagctaatacgctaggaatttttaatagtccgtgtttaactaaagtggagttgcgcgtcgcttgtaagggcattagcgatcgggatgcccttagtaagcccgacccgtgcgtgattttgaagatgcagtcccacgggcagtggttcgaagtggatcggaccgaggtgattcgaacctgtataaaccctgtatactctaaactgttcacagtcgatttttatttcgaggaagtgcaacggctgcgctttgaagtccacgacatctcttccaatcataacggtttaaaggaggcagactttttgggcggtatggaatgtacactggggcagatagtttctcaacgcaaattgtcaaagtccctgctgaaacacgggaacacagcaggtaaatcaagtatcacagtgatcgccgaagaactgtccggtaatgatgattatgttgaactggcgttcaacgcacgcaaactcgacgataaagactttttcagcaagagcgatcctttcctggaaattttcagaatgaacgacgacgctacccagcaacttgtccatcgcacagaggtggtaatgaataatctcagccccgcctggaaatctttcaaggtatcagttaactccctgtgctcgggtgatcctgatcggcgtctgaagtgtatcgtctgggactgggacagtaacggaaagcacgattttattggggagttcactagtacctttaaagaaatgcggggtgcaatggaagggaagcaagtgcagtgggagtgtattaaccccaaatataaggccaagaagaagaactataagaatagtggcactgtaattttgaacctgtgcaaaatccataagatgcatagtttcctggactatattatgggcgggtgtcagattcagtttacagttgccatagatttcacagcttccaacggggatcctcgcaactcctgtagtctccactacattcatccataccagcctaacgaatacctaaaggcgttggtggcggtcggcgagatctgccaggattacgactcagacaagatgttcccagcctttgggttcggcgcccgtatcccacccgagtacaccgtcagtcacgactttgcaattaatttcaatgaagataatcctgaatgtgctggcatccagggagtggtggaagcatatcagagctgtctgccgaagcttcagctgtatggtcccacaaacatagccccgattatccaaaaagttgctaaaagcgcctctgaggagaccaacacgaaagaggcatcccagtactttatcctcctgatcctgactgacggagtgattacagacatggctgacacgagggaagccatagtgcacgcaagtcaccttcccatgtccgtaataattgtgggcgtgggcaacgccgatttctctgacatgcaaatgctggatggcgacgatggaatcttgcggagccctaaaggggagccagtgttacgcgatatagtgcaattcgtgccttttaggaattttaagcacgcctctcccgcggctttggctaaatccgtcttggctgaggtgccgaaccaggtggtggattattacaatggcaagggaatcaaaccaaaatgttcaagcgagatgtatgagagttccaggactctggctccatag

SEQ ID NO: 28963 - DNA, 1728 bp, Artificial Sequence
  Description of Artificial Sequence: Synthetic coding sequence
atggctgtggaacctagttcttccgaaagcattaagcgccgggccgggcggcggatgaaaaagatgtccaatatctatgagtccgccgcaaacaccttgggtatctttaatagtccatgtcttactaaagtggaactacgggttgcatgcaaggggatcagtgaccgcgacgcactgtccaaacccgacccttgcgtcatcctgaagatgcagagccacggccaatggttcgaagtcgataggacagaggttataaggacgtgcatcaaccccgtgtactctaaactgttcacagtggacttctattttgaggaagttcagcggctgagatttgaggtgcacgacatctccagcaaccacaacggattgaaagaggctgattttctcggtggcatggaatgcacgttaggccagattgtgtcccagcgtaagttgtctaaatcacttcttaaacacggaaataccgcgggaaagtcatcaattaccgttatcgcggaggaactttcgggaaacgatgattacgttgagcttgccttcaacgcccgaaagctcgacgacaaggatttttttagcaagagtgacccctttctcgagattttccgaatgaatgatgatgccacgcagcagttagtgcaccggacggaagtggtgatgaacaatctgtcaccggcttggaagagctttaaagtgagtgtgaactcactgtgctctggagatcctgacaggcgtcttaagtgcatcgtgtgggactgggatagtaatggtaagcacgactttatcggcgaatttacatctacattcaaagagatgagaggggccatggagggcaagcaggttcagtgggaatgcattaatcctaagtataaggccaaaaaaaaaaactacaaaaattccggcaccgtcatcctgaatctgtgcaaaatacataagatgcactcatttctcgactatattatggggggatgccaaatacagtttacagtggcaatagattttaccgcgtcaaacggcgatcctcggaactcctgttccttgcattacatacacccataccagccaaatgaatatctgaaagccctggtcgctgtgggcgagatctgtcaggattatgactccgacaagatgttccctgcattcggttttggtgctcgtatccctccggaatacactgtttcccatgacttcgctattaatttcaatgaagacaacccagagtgcgctggcatccaaggggtggttgaggcatatcagtcctgtcttcccaagttgcagctatacggccctaccaacatcgctcccataatacagaaggtcgcaaaatctgctagcgaggaaacgaatacaaaagaagcctcccaatattttatcttacttatcctaaccgacggcgttatcactgatatggcagacacccgtgaggcaattgtccacgccagccatctccccatgagcgtgattatagtgggagtcggaaacgccgattttagcgacatgcaaatgcttgacggtgatgatggtattttgcgcagtccaaagggagagcccgttctaagagatatagtacagtttgtgcctttccgcaattttaagcatgctagccccgccgcattggccaagtctgttctcgcggaagtgcccaaccaggttgtggattattacaacggtaaaggcattaaaccaaaatgcagctcagagatgtatgagagctctcgcaccctggccccttag

SEQ ID NO: 28964 - DNA, 1695 bp, Artificial Sequence
  Description of Artificial Sequence: Synthetic coding sequence
atggattctcggtacaattctactgcggggatcggggatctgaatcagttgtcagccgcgatcccagctacgcgggtcgaggtgtcagtatcgtgtaggaatttgcttgacagagatactttctcaaaatcagatccaatatgcgtgctatacgttcagggtgtgggcaataaagagtggagggaattcggaaggaccgaagttatagataatactcttaatcctgacttcgtaagaaagttcattttagactacttctttgaagagagagaaaacctacgctttgacctgtacgatgtggactctaaatctccgaacctaagcaagcacgacttcctcggacaggtcttctgcactctcggagaaatcgtcggctcacaaggctcaaggttagaaaaacccatcgttggcatccccgggaagaaatgcggcactatcatcctcacagcagaggaactgaactgctgcagggatgccgtcctgatgcaattctgtgccaacaagctcgacaagaaggacttctttgggaagagcgatccttttctagtgttttaccggtccaacgaggacggtagtttcacaatctgtcacaaaacagaagtcgttaagaacacactgaatcccgtgtggcaggccttcaagatatcagtacgtgcactctgtaatggcgactacgaccggacgataaaagttgaagtctatgactgggacagggatggttctcatgatttcatcggcgagtttaccacgtcctaccgggagctgagcagaggtcaatctcagttcaacgtctacgaggtggttaacccaaagaagaagggaaagaaaaaaaagtataccaattcaggaacagttacgttactatcctttttggtcgagaccgaggtcagcttcttggactatataaagggcggcacccagatcaacttcacagtggccatcgacttcaccgcaagtaacggcaaccctgcacaacccacctccctacactacatgaacccgtatcagctcaacgcctatggcatggctctgaaggccgtgggcgagattgtgcaggattacgacagtgataaaatgtttcccgctctcggtttcggtgccaaactgccacccgacggtaggattagccacgagttcgccctgaacgggaatccccaaaatccgtactgtgacgggattgagggcgtcatggaggcctactaccgttccctgaagtccgttcagttatacggccccaccaacttcgctcccgtgataaaccacgttgctaggtacgcgtctagtgtgaaggacgggagtcagtattttgtgcttctgatcgtcacagacggggtgatcagtgatatggctcagactaaagaatccatcgtaaatgcctcaaagcttcctatgagcatcatcatcgtcggggtggggccggccgagttcgatgccatggtagaactagacggggacgatgtccgcgtgtcgtccagaggcaaatacgccgagcgagatattgtccagtttgttcccttccgagattacattgatcgatctggtaaccacatactatccatggctcgcctcgcaaaagacgtgctggctgaaatacccgagcagtttctcagctatatgcgggctcggggcattaaaccgagccccgccccacccccgtataccccccctactcacgtgctacagacccaaatatag

SEQ ID NO: 28965 - DNA, 3786 bp, Artificial Sequence
  Description of Artificial Sequence: Synthetic coding sequence
atggatgcgcctcgggcctccgccgccaaaccgccaacaggccgcaagatgaaggctagggctcctccacctcccggcaaggccgccactctgcacgtgcactcggaccagaagccacctcatgacggtgctctcggttcccagcaaaacttggtgcgcatgaaagaagcccttagagcctcaacaatggacgtgaccgtcgttctacctagcggtttagagaaacggagcgtattgaatgggagtcatgctatgatggatctcctagtcgaactctgcctccagaaccacctaaacccatcccaccacgccctggagattagatctagtgagacccagcagccactcagtttcaaaccgaacacacttatcggaacattaaatgtgcatacagtattcctgaaggagaaagtccctgaggaaaaggtcaaaccaggaccgcccaaggttcccgagaagtcagtccgtctcgtggtgaactatctaaggacccagaaggccgtggtgcgggtctcaccggaagtaccattgcagaacattcttccagtcatctgtgctaagtgtgaggtgtccccagagcacgtggttttgctccgggataatattgccggggaggagctggagttaagcaagtccctgaatgaactgggtataaaggaactctatgcctgggacaataggagggaaacgttcaggaagtcatcactcgggaatgacgaaactgacaaagaaaaaaaaaagtttttggggttttttaaagtgaacaaacggtcaaatagcaagggatgtttgaccacccctaattctccctccatgcacagtagatcgttaaccctgggaccgagtctgagccttggttccatcagcggtgtctctgtcaagtctgagatgaaaaagcgccgcgcgccaccaccaccagggagcgggccacccgtgcaggacaaggcgtctgaaaaggtctccttgggcagtcagattgatctgcagaaaaaaaagcgtcgcgctccagcacctccacccccacagcccccaccaccatcaccgctgatacctaatagaaccgaagataaggaagaaaacagaaaaagcaccatggtctcccttccactggggtcaggttcccactgttcacccgacggggcacctcaggtgctttcagaggctgaagagactgtgagtgtgggcagttgttttgctagtgaggataccactgaggactctggggtgatgagttctcctagcgatattgtatctctcgactcgcagcaagactctatgaagtataaggacaagtgggccactgatcaggaggactgttcagaccaggatctggccggtacgcccgatctcggcccacaaaaaagccccctgtgggagaagaatggctctgagaactctcatttgaggactgaaaaagctgtgacggcatcaaacgatgaggaggatttgcttatcgcaggagagtttcgcaaaaccctggccgagctggatgaagatttggaggagatggaggactcctacgaaaccgacacctcgtccctgacctcatccatccacggcgcaagcaaccattgcccccaggatgcaatgattccacatggagacactgacgcaatccctgtgacttttatcggggaagtgagtgacgacccagtggatagcggtctgttctcaaatcgcaataataatgccggctcctttgattccgaaggagtggcatcacgccgggactctctggcacctctccaggccgaacactctcagccgcatgagaaagcccgcgaagaggtccccgcccttcacccagcatcacacgatgtggggaagggcatccgggttgccctgtcaaacattagtaaagatggaaacctgatggagaccgcccccagggtgacaagctttgctagtaatctgcatactgataatctgaacgcaaaggtgaaggacaaggtgtacgggtgcgccgacggggaaaggacacaagctacagagagggtaaatagccagcctgtgaatgaaaaggactcgaatgacaaaaatgcggccctggccccaacatcttggcatcagcgcggtcagaatccagggaaaagttaccgccttaaacacgggctgaccacttacaagattattcctccaaagtctgagatgcggtgctacgatcgggatgtatccctgtccacaggcgcaattaaaatcgacgagctgggcaatcttgtatcacctcacgccactggcatccgaattatctctctctctagttctgtgccagaggctgaatcccagccaatcgggaaagtgagggaattctggcgatgcaattctgttgaaaaacaccttggccgacccagcgagagctccgctcggggtccgccaagcacccccgttcccacccaaactcaaaacccagaatcccgtctgcaggccgatccgaagccaataagcccacagcagaaatctgcacatcacgaaggtcgtaatcctttgggggaaggacgcaaccagcctccgacaatgggaatggggcacgtacgagttcccgccgctcacaccactgaggttacattcttaaagccgcagagaagaacatcaagccagtacgttgcaagcgccatcgccaagcggatcggtgcaccaaaggttcacgcagacgtggttagaccccatggctacgcagaaaagggctacgctgggaaggcaccagtgctggccgccccaccagtaacggtcaaggacgatcggacaagcagtccacacagtgaaacccaggggtggaaggacggggcgcagtggccttgcgtgactccccccaataaccatggggaggacctggctgtcggggccccgcctagaggcgaagtcataggaccacaccgtaagctatcgacacaggataggcccgctgcaattcatcgtagtagctgctttagccttgtgcagtcaagccagagagatagagtgtctgtggggcagtcttgtggattctcgggaaaacaatccacttcgtctcaggaggcttcctccgctagtgaaccccgacgcgctccagacggaaccgatccgccaccaccgcacaccagcgatacacaggcttgtagccgggaactggtcaatggatctgtgagggccccaggtcatggcgagccctcgcatccgcctggaggtagcgggacagaatcacacatcctcctagaaagagaagagaaaccctccgtgttttccactgatgggaatgaaaccgattccatctggcctccatcgatattcggaccgaaaaagaagtttaagcctgtcgtacagcgacccgtgcctaaggatacgtcccttcactcagcactaatggaggcaatccacagtgccggcggcaaagatcgcctgcggaagactgctgaacatacaggagaaggaaggcctgctaagctgtcatacaccgaagcggaaggcgagcgctctgcactgctcgccgctattcgcggtcacagcgggacgtgctccctcagaaaagtggctagttctgcaagtgaggagctgcagtccttcagagacgctgcgctgtccgctcagggcagcgaaagccccctcctggaagatctcggtctcctgtcgccacctgctatccccccgcccccgcccccaccatcacaagcgctgtccgctccacggaccgctagtcggtttagcaccggcacactgagtaacactgctgacgccagacaagccttaatggacgccataagaagtggcactggtgccgcaaggctgagaaaagtaccgctgctggtttag

SEQ ID NO: 28966 - DNA, 1410 bp, Artificial Sequence
  Description of Artificial Sequence: Synthetic coding sequence
atggacgcaccaagggcctccgccgctaagccacctactggcagaaaaatgaaagctagagcccccccacccccaggaaaggccgctacccttcacgtccacagtgatcagaagcctccccatgacggcgcccttggatcacaacagaacctcgtgcggatgaaggaggctctgcgggctagcaccatggacgttacagtggtcctgccatccggactcgagaagagatctgtgctgaacggctcacatgctatgatggatctcctggttgagctctgcctgcagaaccatcttaatccgagtcaccacgccctggaaatccgaagctccgagacccagcagcccctgagtttcaaaccaaataccctaatcggcaccctgaacgtgcacaccgttttcttgaaagaaaaagtgcctgaggagaaggtaaaacccggtccgccgaaagtaccagagaaatccgtccgccttgtagtgaattacctgaggactcaaaaagctgtagttcgggtctctcccgaagtgccccttcagaacatattgccagtgatctgcgcaaagtgtgaagtaagtcccgagcatgtggtcctgctgcgtgacaacatcgctggtgaagaactggagctgtcgaagagcctgaatgagctcgggattaaagagctctacgcctgggacaaccgtcgagagaccttccgaaaaagtagcttaggaaacgatgagacagacaaagagaagaaaaaattccttgggttctttaaggtcaacaagagaagtaatagcaaggggtgcctgactacgccgaattcgccctctatgcatagtagaagcctcaccttggggccctctttgagccttggttctatttctggcgtatcagtaaagagcgaaatgaagaagagaagggcacctccacccccaggctcaggcccgcccgtgcaggacaaagcctccgaaaaggtctcgctcggctcacagatcgacctgcaaaaaaaaaaaagacgagcccccgccccacctcccccacaacccccacccccatcaccactgatacccaacaggaccgaggataaagaggagaatagaaaaagcaccatggtgtacggggcggcagaggccgtgatcagactccttagcttgctgcttaataccaccgcacctgggactgcaaagcccaggaccctctggatgagtgagggcagatcgtctcttcacaatcctgaaatcaagtgtagttgtttttcatcctccagcccatttccacagtcactgttgtctctccttctcggcttgagctccatctgtgaatgcatgtgcacactgcggcacactcatgctcacacacacaatccctcttgtgtcctgcccacctcagagatcctggcattcgggcggcagtctttgatatcttag

SEQ ID NO: 28967 - DNA, 4032 bp, Artificial Sequence
  Description of Artificial Sequence: Synthetic coding sequence
atggatgccccaagggcatccgcagcgaaacccccgactggtaggaaaatgaaggctcgcgcaccaccaccgccgggcaaggccgccacactgcatgtccactctgaccaaaagccaccacatgatggagctcttggcagccagcagaacctggttaggatgaaggaagctctgcgggccagcaccatggatgtgacggtagtcctcccctccggtctggagaagagatcagtgcttaacggtagtcatgccatgatggacctcctcgtggaactgtgccttcagaatcatctcaatccaagtcatcatgccctcgagatacggagcagcgagacccagcaaccactgtcattcaagccaaataccttgatcggtactctgaacgttcacaccgtgtttttgaaggaaaaggtaccagaagagaaagttaaaccagggccacccaaagtcccggaaaagtccgtccgactcgttgtgaattatttgaggactcagaaagctgtcgtgcgagtttctcctgaagtccccctccagaatattctcccggtcatctgcgcaaagtgtgaggttagtccagagcatgtggtgcttctgcgcgacaacatcgccggtgaggaactcgaactgagtaagagtttgaatgaactgggaatcaaggagttgtatgcgtgggacaatcgcagagaaaccttcaggaaatccagtttgggaaatgatgagactgataaggagaaaaaaaagtttctgggcttttttaaagtgaataagcgcagtaactctaaggccgagcaattggtcctaagtggcgccgacagcgacgaagatacttcgagagctgctcccgggcgcggcctaaatggctgcctgaccacgcccaattcaccctccatgcactcacggtcgttgacattaggcccttccctctccttggggtccatctcaggtgtgtccgtcaaatccgagatgaagaaacgaagggctccgcctccccctggttctggcccccctgtgcaggacaaggcctcggagaaggtttccctcggaagccaaattgatctgcagaagaagaagaggagagctccagcgccaccacctcctcaaccaccaccaccctcccctcttattcccaatcggacagaagataaggaggaaaacaggaagtcaaccatggggggaggtaggcaggtgccacagaaaccccctcgcggaaccgcacgcggccccccccaacttgtattgccgcctccccccccctacccaccgccagacaccgatgtcgtggaaccattatcattcccaggtgagggggctggttcagaagcatccgatcccattccaaaactgtctctgcccctaggatctggtagccactgtagccccgacggggccccacaggtcttgtcagaagcggaagaaacggtctccgttggctcttgcttcgccagcgaagatactaccgaggactccggcgtgatgagctcaccttcagacatcgtttcgctcgactcccagcaggatagcatgaagtataaggataaatgggctactgaccaggaggactgttctgaccaagaccttgccgggactcccgatttggggcctcagaagagcccactgtgggagaagaacggatctgaaaattctcacctgagaaccgagaaagccgtaaccgcgtccaacgacgaagaagacctcctgatcgccggcgagtttcgtaagaccctcgccgagctcgacgaagacctggaggaaatggaggactcgtacgagaccgacacatcgtccctgacatctagtatccatggagcctctaatcactgccctcaagacgccatgatcccccatggcgataccgacgccatccccgtgaccttcatcggtgaagtgagcgatgaccctgtggacagcggcttgtttagcaataggaataacaacgccggatcattcgattcagagggcgtggcctcccgccgggactccctggcacccctgcaagcagaacactctcagccgcatgagaaggcacgagaggaggtgcccgcccttcatcctgctagccacgacgtaggtaaaggaattagggtggctctctccaacatttcaaaagatggaaacctaatggaaacagctcctagagtgacaagctttgcatccaatttacataccgacaacttgaatgctaaagtgaaggacaaggtgtatggatgtgcagacggggagcgaactcaggctaccgaacgggtgaattcacaacccgtcaacgagaaggatagcaacgataagaacgcagccctcgcccccacctcatggcatcagcggggccaaaaccctgggaagagttaccggctcaaacacggattgaccacttacaagattatcccccccaagagcgagatgcgttgttatgaccgggacgtcagcttgtccaccggcgctattaaaattgacgagctcggcaacctcgtgtctccccatgctacaggtatcagaattatctctctgagcagctctgtgcccgaggcagagagccaacctattggcaaagttcgggaattctggaggtgtaattccgtggagaaacacctgggccggccttcagaaagctcagctagggggccaccgtctactcctgttccaacacaaactcaaaacccagagtcaagattgcaggccgatcccaaacccatctcgccgcagcagaagtccgcacaccatgaggggcgaaatcccttgggcgagggccggaatcagccaccgactatggggatgggccacgtaagagttcccgccgcccacaccacagaggtgacattcctcaaaccccagcgcagaaccagttctcagtatgtcgcgagcgcgatcgcaaagaggattggggctccgaaggtccatgccgatgtagtccgcccacatggttacgctgagaaaggctatgccggcaaagcacccgtgctggctgcaccaccagtgactgtgaaggatgaccgcacaagcagccctcactccgagacccagggctggaaggacggagcccagtggccctgcgtgactccccccaacaaccacggcgaagacctcgcagtgggagcgcctcctagaggcgaagtgatagggccgcaccgcaaattgagtactcaggatcgccccgctgccattcacagatcatcatgcttctctctggtccaatctagccagcgtgaccgagtttccgttgggcagagctgtggattctcagggaaacagagcaccagttctcaagaagcttcgtcagctagcgagccgcggcgtgcccctgacggtaccgatccgcccccccctcatacaagcgatactcaagcctgcagcagagaattagtgaacggatccgtgcgtgcccctgggcacggtgaaccatcacacccgcctgggggttccggtaccgaatcgcacatactccttgaacgtgaggagaaaccatctgtgttctccactgacgggaatgagaccgacagtatttggcctccgtctatcttcggacccaagaagaagttcaagccggtagttcagcgccccgtacccaaagacacttccctgcatagtgctcttatggaggccattcactcggcggggggaaaagataggctccggaagacagctgaacataccggagaaggaagacctgcgaagctctcttacactgaagctgaaggtgaaaggtcagcgttgttagcagcaattcgaggtcactctgggacttgttcactgcgcaaggttgcctctagcgccagcgaggagctccagagctttcgcgacgcagctctgtctgcacaagggagcgaaagccccctgctcgaggatttagggctcctgtcaccccccgcgatcccacctcctccacctccccctagccaagccctgtccgcgcctcggacggccagtagattctctaccgggaccctgagtaatacagccgacgctcgccaagcgttgatggatgcgattaggagcggaactggagccgctcggttgagaaaggtccctctccttgtttag

SEQ ID NO: 28968 - DNA, 3441 bp, Artificial Sequence
  Description of Artificial Sequence: Synthetic coding sequence
ctgcgggataatatcgcgggcgaggagcttgaattgagcaagtccttaaacgagctggggattaaggagttgtatgcctgggataaccgccgagaaaccttccggaaatcctcactggggaacgatgagacagacaaagaaaaaaagaagtttcttggtttcttcaaggtcaataaaaggtcaaactcaaaagccgagcagttggtattgtctggcgccgactcagacgaagatacaagcagagccgccccgggccgtggtctgaacggatgtctgacaacccctaacagcccatcaatgcacagcaggtcccttacgcttggacctagcttaagtttgggctccatttcgggggtttctgtgaaatccgagatgaagaagaggagagcacccccccctcccggtagcggaccgcctgtgcaagacaaggcaagcgagaaggtgtcattgggttcgcagatcgatctgcagaaaaaaaaaagaagagcacctgctccccctccgccacagcccccaccaccttcacctttaataccaaacaggactgaggataaggaggaaaacagaaagtcgaccatgggaggcggtcgccaggttccacagaagcctcctcggggtacagcaaggggcccaccacaattagttcttccgcccccccccccctacccaccgcccgacaccgatgtggtagagcccctcagctttccaggtgagggcgcggggtcagaggcctctgatcccattccaaaactttcactccccttgggctctgggtctcattgttcccctgatggtgcgccccaggtcctctctgaggcagaggagacggtctccgttggtagctgcttcgcttctgaggacacgacggaggatagcggtgtgatgagttcacccagcgatatcgttagcctcgattcccaacaagactccatgaaatataaagacaagtgggccactgatcaggaggattgcagcgatcaggatttggcaggaacccctgacctggggccccagaagtcaccgctgtgggagaagaatggctcagaaaactctcatctgagaactgagaaagccgtgaccgcctccaatgatgaggaggacctgctgattgctggcgagtttcgcaaaacactggctgagctggatgaggatcttgaggagatggaggatagctacgagacggacacttcatccctgacctcctcaatacacggcgccagcaaccattgtccccaggacgccatgatcccgcatggcgatacggatgccatcccagtgacatttataggggaggtctccgacgaccctgtggacagcgggctcttttccaatcgtaacaataacgccggatcttttgactccgaaggcgtagcaagcagaagagattcacttgctccgcttcaggcggagcactcgcagccgcacgagaaagccagagaggaggtacctgcactccacccagcaagtcatgacgtcggcaagggcattcgggtcgctctgtccaacataagcaaggatgggaatctgatggagactgccccacgggtgactagtttcgcatctaacctgcataccgacaacttaaatgctaaggtgaaagacaaggtctatggttgcgcagatggggagagaacgcaggcgacagagcgcgtcaattcccagccagtcaacgaaaaggacagcaacgacaagaatgcagccttggccccaacgagctggcatcagcgaggccagaaccccggcaagtcctatagattgaaacacggtctgaccacatataagatcatccccccaaaatctgagatgaggtgttatgatagagatgtatccctttcaaccggcgccatcaaaattgacgaactgggaaaccttgttagcccacatgcaacaggtatccgcattatatctcttagttcctcggtgccagaagctgagagccagccgatcggcaaggtgcgcgagttttggcgctgtaacagcgtagaaaagcacctggggaggcccagcgagtcaagcgctcgagggcccccttcaactcctgtccccacacagactcagaaccctgaatcgagacttcaggctgaccctaagcccattagcccccaacagaaatcggcccaccatgaagggcggaaccccctaggtgaaggcagaaatcagccgccaaccatgggcatgggccacgtgagagtcccagccgctcatacgacggaagtgacttttctgaagccacagcgccgaacctcaagccagtacgttgcttccgctatcgccaaaagaattggcgcccccaaggtccacgctgatgttgttaggccccacgggtatgcagagaaggggtacgccgggaaggctcctgtcctggccgctcccccagtgactgtcaaagatgatcgcacaagctctccgcattctgagacccagggctggaaagacggagcccaatggccctgcgtcacccctcccaataaccatggagaagacctggccgttggcgcaccaccaagaggggaggttatcgggcctcaccggaagctcagcacgcaagatcgacccgcagccatccacaggtcctcttgcttttcactcgtgcagagttcccagcgtgatagagtgtctgtgggccagagctgcggcttcagcggaaagcagagtacctcctcacaggaggcatcctcagcgtctgaaccacgtagagcccccgatggcaccgacccgcctcccccacacacttccgacacacaagcctgctctagggaactggtgaatggatctgtgcgcgcccccggccatggggaaccttcacacccacctggaggctctgggaccgaaagccacatattgctcgaaagggaggaaaagccctcagtgttcagcaccgatggcaacgaaaccgatagcatctggccccccagcatctttggacctaagaaaaagttcaaacccgttgttcagcgcccagtcccaaaggacaccagcctccacagtgccctgatggaggcgattcattctgctggaggaaaagatcggcttaggaaaaccgcggaacataccggggaaggtcgacccgcaaaactgtcttatactgaggcggagggcgagcgctctgccctcctggcagccatacggggacactccggcacttgttcattgaggaaggtggcttcatctgcaagcgaagagctgcagtcattccgagatgcagcccttagcgcccaggggagcgaatcaccactgctagaagatctcggtttactgagccccccagccatcccaccacctccccctccgcctagccaggctttgtcagccccaaggaccgctagcagattctccaccggtactttatccaacactgccgatgctcggcaggcactgatggatgccattaggtccggtacaggggccgcacgcctgcggaaagttcctctgctagtgtag

SEQ ID NO: 28969 - DNA, 1140 bp, Artificial Sequence
  Description of Artificial Sequence: Synthetic coding sequence
atggacgcccctcgtgcaagcgcagcaaaaccacccactgggagaaagatgaaagcccgggctcctcccccccctggcaaagcagcaacattacacgttcactctgatcagaaaccaccgcatgatggcgcattggggtcgcagcaaaatctggtgcgaatgaaagaggcactgagggcctccactatggacgttaccgtggtactgccatctggactggaaaaacgctcagtgcttaacgggtctcatgccatgatggacctactagtggagctgtgtctccagaaccatctgaatccctcacatcatgccctcgagatccgtagtagtgagacacagcagcctctgagcttcaaacccaatactctgatcggtactctgaatgtccataccgtcttcctgaaggaaaaggttcccgaggagaaggttaagcccgggcccccaaaggtccccgaaaagagtgtcagattagttgtgaattatctgcgcactcaaaaggccgtggtgagggtttcgcccgaagtccccctgcagaatattctgccagtgatatgtgcgaagtgtgaggtctcccccgaacacgtggttctactaagagacaacatagccggcgaggaactggaattatcaaaatcccttaacgaactgggcatcaaagaactgtatgcatgggataatcgacgagagacgttcaggaaatctagcctggggaatgacgaaaccgacaaggaaaaaaaaaaattccttggattctttaaggtcaataagagatccaactcaaaggggtgcctcaccacaccgaacagcccatccatgcattcacgctctcttactctgggcccaagccttagcctggggtcaatttccggcgttagtgttaagtcagaaatgaaaaagcgccgggcccctcctcctcccggatctggtccccccgtacaggacaaagctagcgaaaaggtcagcctagggtcgcaaattgatctccagaaaaagaaacggcgggctcccgcccctccaccaccccagcctccgcctccttccccgctcattcctaatcgtaccgaagataaagaggagaaccgtaaaagtactatggtttattgttgtgcatcattcccaacgcaggctaagagattctag

SEQ ID NO: 28970 - DNA, 825 bp, Artificial Sequence
  Description of Artificial Sequence: Synthetic coding sequence
atggaagactcatacgaaaccgatacgtcctcgctgacgtcatctatacatggcgccagcaatcactgtcctcaggatgccatgatccctcacggtgacacagatgctatcccagttacctttatcggcgaggtgtctgatgatcctgtcgacagcggactgttctccaataggaataataatgccggcagcttcgacagtgagggggtggcatcacgacgagactctctcgccccattacaagccgagcattctcaaccccacgagaaggcaagggaggaagtgcccgccctccaccccgcgtctcatgatgtcgggaagggcatcagagttgcgctcagcaacatctcgaaggatggcaacttgatggagactgccccgcgggtgactagcttcgccagtaatttacacaccgataatctcaacgctaaggtcaaagacaaggtttacgggtgcgcggacggggagcgcactcaggcaaccgagcgagtcaactcacaaccagttaacgaaaaggattctaacgataagaatgccgccctggctccgaccagttggcaccagaggggacagaacccaggtaaatcttaccgtttaaaacatggcctcaccacctacaaaattattccgcccaagagtgaatcatcaggcggagcgaccttgtggaaaaacacttgggcggacccacaacgtgcattacccggcgatccccccccaccactgtgcccacgcaggcggcgcattcaaagggccgactctaagcagactccctcccagtaccgaccatcccgctccctgccgacaatgcgggctggaactccttag

SEQ ID NO: 28971 - DNA, 2523 bp, Artificial Sequence
  Description of Artificial Sequence: Synthetic coding sequence
atgaatcgcttcagggtgagcaaatttaggcacactgaagccagacctcctcgcagagaaagctggatctccgatattagggctggaacggcgccttcctgtagaaaccacatcaaaagcagctgctcactgatcgccttcaactccgatcgcccgggtgtgctagggatcgtgccactacaggggcaaggagaggataagcggcgcgtagcgcacctgggttgccatagtgaactggccgcgcatggagacctcgttcagagtgcagtttggtcaagagacggtgccctagtggggaccgcgtgcaaagacaagcagctaaggatttttgatccaaggaccaaaccccgagcgagccagtctacccaggctcacgagaactcccgtgattcacggttggcgtggatggggacgtgggagcacctggtgtctacaggcttcaaccagatgcgagaaagagaagtcaaattgtgggacactcggtttttttcctccgcactggcctcactcactctcgatacgtccctgggctgcttggtcccattattagacccggatagtggcctgctggtcctggccggtaagggggaaagacagctgtactgttatgaagtcgtgccacaacaacccgctctttccccagttacacaatgcgtgctcgaatccgtgcttcgcggtgcggcactggtcccaagacaggccctggcggtcatgtcgtgcgaggtgctaagggtccttcaactttctgatacagccatcgtgccaattggctatcacgtccctcgcaaggccgtggaattccacgaggacctcttccctgacaccgcaggatgcgttccggccactgatccccatagctggtgggcaggagacaatcaacaggtccagaaggtctctctgaatccggcctgtagaccacatcccagttttacctcatgtcttgtgcctccagcggaaccacttcctgacactgctcagcccgccgtgatggagacacccgtgggagatgcagacgcatccgaaggtttttcttcccccccatcttcgctcaccagcccttcaacacctagtagcctggggccgtccttatccagcaccagtggaataggcacttctcccagtctccgttctttacagtctctgctcgggcccagttctaaattccgtcacgcacagggcactgtgctgcatagggacagtcacatcacaaacttgaaagggcttaatctgacaacacctggcgaaagtgacgggttttgtgctaataagctgagggtggctgtgccgctactgtcttccggaggccaggtggccgtgctcgaattaagaaagccaggacgcctgccagacacggcacttcctacactgcagaatggagcagcagtaacagatctagcgtgggacccattcgacccccatcgccttgctgtggccggggaggacgctaggatcaggttgtggcgggtgccagctgaagggctggaggaagtgcttacaacccctgagaccgtcctcactggccataccgagaagatttgctccctgaggtttcaccccctggccgcaaatgtcctggcctcctcttcctacgacttaactgtgaggatctgggatctgcaagcaggcgctgatcgcttaaagctgcaggggcaccaggaccagatttttagtctcgcctggagcccggatggccagcagctagcgactgtatgtaaggacggcagagttcgcgtctacagaccccggtctggccctgagccactccaggagggccccgggccaaagggaggcaggggggctcggatcgtatgggtgtgcgatggaagatgccttttggtgtccggcttcgacagccaaagtgagaggcaattgctcctttatgaggccgaagccttggcaggggggccgctcgctgtcctgggactggacgtggcgcccagcaccctcctgcctagctacgatccagacacaggtcttgtgttactgacgggcaaaggggacacacgagtgttcttgtatgagctcctccccgaatccccgttcttcctggaatgtaattcctttacatctccagacccccacaaaggattggtccttcttcccaaaactgaatgcgacgtgcgggaagttgagttgatgcgctgtttgcggctacgccagtcttcgcttgaacctgtagcattccgactgccacgggtgagaaaagaattctttcaggacgacgttttccccgatactgccgttatatgggagccagtcctgtcagctgaggcctggttacagggggctaacggacaaccttggcttctgagcctccagcctcctgatatgtcgccagtgtctcaggcgccacgcgaggcccccgctcgacgcgccccttcatcagcgcaatacctcgaagagaaatcagatcagcaaaagaaggaagaactgttgaatgcaatggtggctaaactcggtaaccgcgaagatcctctgccccaggattcttttgaaggagttgatgaggacgaatgggactag

SEQ ID NO: 28972 - DNA, 246 bp, Artificial Sequence
  Description of Artificial Sequence: Synthetic coding sequence
atgagcagcacatattgcggtaacagttcggccaagatgtccgtgaatgaggtgagtgccttctccctgacacttgaacagaaaaccggctttgcattcgtgggcatcctctgtatatttctcggcttacttatcatacgctgttttaaaatcctgctggatccatattcctctatgccgtcatccacctgggaggacgaagtggaagaatttgataaggggacatttgagtacgcacttgcctag

SEQ ID NO: 28973 - DNA, 246 bp, Artificial Sequence
  Description of Artificial Sequence: Synthetic coding sequence
atgtcctcaacttattgcggaaattctagcgccaagatgtcagtgaacgaggtgagcgcctttagcctgacactggaacagaagacaggattcgctttcgttggcattctgtgcattttcctcggcctgttaataatccggtgctttaagatcctgctcgacccttacagtagtatgcctagcagcacctgggaagatgaagtcgaggaattcgataaagggacattcgaatacgccctcgcttag

SEQ ID NO: 28974 - DNA, 906 bp, Artificial Sequence
  Description of Artificial Sequence: Synthetic coding sequence
atgagctatccaacaaaggagggctccgataccgccggcaacgcccacaagaactcagaaaacgaacccccaaacgactgctctactgatattgagagcccatcggcggaccctaatatgatttatcaggtcgaaaccaacccaattaacagggaaccaggcactgcaacttcccaggaagacgtggtaccgcaagcggccgagaactcagaactggagaccgaaattcagaaggaccagagagaagaggacctgaaagaagaactactcctgctgcaaaccccaataccacggaagctcgtgtctcataagcccttaaatgaccggtcgagatctcattctggcaaggtcgagatgaaggccaataacttccccattaatcataagactcgctttcgcctctccacctcatggcgcgtgccattcatcaattcgcacgagatcaggagtatgatactgcacttgctctgcgatcggtactttagtcaagcagcgggatgtcagaatactatgtgggtaaagagaaaatatatcgcgtgcctgtatcaccccaacagtttcacgcaccacgagagggccatcacttttagacgcccgagtcgagtgcactattacaggcctttaaccgagcgcatgacctctggaaagttttgcaagtctactgatacaaagggaaagtgtcgatttcgggctatagtacgaagcgtgctctttgtgagccagatccagatcgagagtatattcaatataaaaggatttgtcgatatcctgacgtacatccatactatgaacgtcatgatcaccaacactaacaacgggtggaagtacttctgtcctatctgtgggcgactatttaacacatacagtgagctacgtcaacactcctgcagcagtagcgggaactag

SEQ ID NO: 28975 - DNA, 906 bp, Artificial Sequence
  Description of Artificial Sequence: Synthetic coding sequence
atgtcataccctacgaaggaagggtccgacacagctgggaatgcacacaagaattcggagaacgaaccaccaaacgactgctccactgatattgagagtccctccgcggatcctaacatgatttaccaggtggaaacaaaccccataaatcgcgagccaggcactgcaacaagtcaggaggacgtggtgccccaagcagccgagaacagtgagctggagacagaaattcagaaggatcagcgcgaagaagatttgaaagaagagctgctgttgctccaaaccccaatccctcggaaactggtttcgcataagccactcaacgaccgaagcaggagccactcggggaaagttgaaatgaaagcgaataactttcccattaaccataagacccggtttcgccttagtacctcatggcgagtcccatttatcaactcgcacgagattcggtcaatgattttgcatctgctttgcgaccggtatttttcgcaggctgctggctgtcagaatactatgtgggtgaaacgaaagtacatcgcatgcctgtaccatcccaattcatttacccaccatgaaagggcaatcacattccgaaggcctagtcgagtgcactactatagaccactcaccgaacggatgacaagcggaaaattctgtaaatccactgacacaaaaggcaaatgccgatttcgtgctatcgtccgttccgtcttgttcgtgagccagatccagatagagagtatcttcaatataaagggattcgtggacatacttacctatatccacacgatgaatgtgatgattaccaacaccaataacggttggaaatacttttgtcctatttgcggccgcctgttcaacacttattcagagcttagacaacattcttgctcctcctctggcaattag

SEQ ID NO: 28976 - DNA, 1935 bp, Artificial Sequence
  Description of Artificial Sequence: Synthetic coding sequence
atgctgaggacagatgctggcgaggatcttgccgacgcgcctgctgaagaactgcaagagaaaggcagccccgccgggcctccaccctctcagggccagcccgccgctaggcctcccaaagaggttcctgccagccgcctcgcacagcagctccgcgaagagggatggaatctgcagacaagcgagtcgttgaccctcgctgaagtttacctcatgatgggcaagccttcaaagttacagttggaatacgattggctgggccctgggcgacaggaccccaggcctggctctcttcctactgctctgcacaagcagcgattgctgagctgcctgctcaagctgatctcaaccgaagtgaatcccaaattggccttagaagccaacactattagtacggccagcgtacggccagcccaggaggaacagtctatgactcctcctggcaaagtggtgactgtctcatcacggtccccacgatgccctaggaaccaagcttccttgcgatcttccaagactttccctcccagttcagccccgtgctcatctgggctcaggaacccacctcgaccgctcctcgttccgggaccctcgtcgaccggatctaatgactccgatggaggcctgtttgcagtgcccacaacactgccacccaatagtcgacacgggaagcttttttcaccctccaaggaagctgaactgacgttccgacagcaccttaattcaatatcaatgcagtcggactttttcctgccaaaacctcgcaaactgcggaaccgccatctgaggaagccacttgtggtacagaggacacttctcccccgtcctagcgaaaatcagtcccacaatgtatgcagcttctccatcctaagcaattcctccgtaacaggtcgcggatctttcaggccaatccaatcctctcttaccaaagccgccttatctcggccaatcgtgccaaaagtgttgccaccgcaagctacttctcacctcgcctccgccatagacctcgctgcaactagcgccggtatcctgtcaggcaatccccttcctgccttggacactgaggggctgagcgggatctcacccctgtcttctgacgaggtaaccggtgctatatctggccaagattccaccgggacccatcaggatggcgacaccctgccaacagtgggcggtagtgatccattcgtatcaattcccagccggccagagcaggaaccggtcgcagattctttccagggaagttctgtgctctcgctctccgaacttcctaaagcgccactgcagaacggtctatctatcccactgagttctagcgaaagcagttccactaggctgtccccaccagacgtgagcgccttgctggatataagcctgcccggtccccctgaggatgcactaagtcaaggggagccagctacccacatttccgacagtatcattgaaatcgccatctcttccggcgagggcgtgcccctgtcccctgccaagctgaatggctcagatagcagcaagtcgctgccttctcctagctccagccctcagccccattggatcgcttcccccacacacgacccacaatggtatccgagcgactcaactgactcatctctcagctctttgtttgcctcatttatttctccagaaaagtcaaggaaaatgttaccaacaccaatcgggaccaatagcggtaccagtctcttaggtccatcactactggatggtaattccagagacagttttgtgtctcggtcattggccgacgtcgccgaggttgtggattcccagctggtatgcatgatgaatgagaattctatagactacatctccagattcaacgaccttgcgcaagagctgagtatcgcggaaccgggtcgtcgggaagccctgtttgacggtggcgggggtgggcctgcagtgtccgacctgtcacagtag

SEQ ID NO: 28977 - DNA, 3810 bp, Artificial Sequence
  Description of Artificial Sequence: Synthetic coding sequence
atgactgttaagctcggcgatggcgggtctggcgaggatggcctgaaaaagttaggtaagagggcggctgacgaagagtctcttgaaggtgagggcgccggaggggcagacgctgcggaagaaagttccggcactaagcgcgacgagaaaaccccccgtgctggggctgatggtcccccagcccccccaggcgcgccgcaggccccttcgccccctcaggggtcaccccaggaccagcaccacttcctgcgatcttctgtgcggccacagtccaaacgtccccgcaaggacccgccctcagccgtggggagtggaaacgcagggggcagtggcccacggggaaagggtgcggaagggggtggttcgtcttccggaaacgtgagcggggtcgcaccagccgccccggccggtgggagccggtctagttcccgcaatctgggatccagcgggggtgaaaaggaggagggcaagaaagtccgtaggcaatgggagtcatggtccacagaggacaagaatactttctttgaggggctgtacgagcatgggaaggacttcgaagccatccagaacaacatcgccctgaaatataagaagaagggtaagcctgcctctatggtgaaaaacaaagagcaggtgagacacttttattatcgcacgtggcataaaattacaaagtatatagacttcgaccacgtcttcagtcggggactcaagaagtcaagccaagaactttatggcctgatatgctatggtgagttgcggaaaaagataggcgggtgtatggacgataagaacgccacaaagcttaacgaactgattcaggtaggggccaccactgtgagatataaaggaagaaatctccgtatcaaggcccctatgtgccgtgccttgaagaaactgtgtgatcctgatggcctgagcgacgaagaggaccaaaaaccagttagactgccattgaaggtaccgatagagctgcagcccagaaacaaccacgcctgggcacgcgtgcagagtctggcccagaatcctagactaagaatgattgttgagcttcataggaaagtctcatcgctgattgaattcttaaagcagaagtgggctttacatgaagttagagtaaggaaaacccttgaggagaggcagctccaggattcttgtagtgcaccaatgcaagagaaagtgacattgcacttatttcccggagagaattgtacgctcacgccattacccggggtggcaagggtggtacacagcaaggctttttgcaccgttcactggcaggaaggcgggcgctgcaaacaatctgcaaaagacgcacatgtgctccccccggcccagatcctcggtatccagtctggacaggggactgctcgcgggcaggttaaatgccccaggagcggggccgaaggaaaaggcgtcggaaggcccccccccgcagccgacgcgcttcaaagcagtggcgagtccagtccagaaagtgcgccaggagagggagcagccctgagtctttccagtccggatgccccagatcgccctccgcccaggcatcaggataccgggccttgtttggagaagacccctgctgaaggcagagattcgccgacgcgggagcccggggctctcccatgcgcctgtggccaactgcctgacctggaggatgaactgagtctccttgatcccctgccacgttacctgaaaagctgccaggacctgattgtgccagagcagtgcagatgcgcggacacccgaccaggctctgagcaacctccattggggggtgccgcctcccctgaggttcttgcccccgtttcaaaagaagccgccgatttggccccaactgggccaagcccacggcccggccctggcctcctcctggatgtgtgcacgaaagacctggccgacgccccggctgaagagctacaagaaaaaggctcccccgcaggacccccaccatcccagggccagcctgcagccagaccgccaaaggaggtccccgcaagccgcctggcccagcagcttagagaagaggggtggaatctgcagacctccgaaagtttaaccttggccgaagtgtaccttatgatggggaaaccttccaaacttcaacttgaatacgactggctggggcctgggcggcaggaccctcgaccgggctctcttcccacagccttacataaacagaggctactcagttgtctcctgaagctgatcagcactgaggtgaatcccaaactcgctctggaggccaacacaataagtaccgcatctgtgcgacctgcacaggaggagcagtccatgacaccaccaggcaaagtggtcacagtttcctcaaggagcccaaggtgccccagaaaccaggcttcattaaggagttcaaagacatttcctccttcttctgcaccatgttcatctgggctgcgcaatccaccccggcctttgctggtgccagggcctagtagtaccggctcaaacgactctgacggtgggctgttcgcagttccgactacgttaccccccaactcacgccatggcaaactgttttcccctagcaaggaagcagagttaactttccgacagcacttaaactctatctctatgcagagcgattttttcttgcccaaaccccgaaagctgcgaaatcggcatctgcggaagccacttgtggtgcagagaacacttctaccaaggccctccgagaaccagtctcataatgtgtgttcgtttagcatcctcagcaatagttccgtgaccggtcggggttctttcagacccattcagtctagtctgactaaagcggccctgagcagacccatcgtgcctaaggttctcccacctcaggccacgtcccatctggccagcgctatcgatttggcagcgacgtccgctgggattctcagcggcaatccactgcctgctctggacaccgaagggttgagcgggatttcacccctgagtagcgacgaagtgacaggcgccatctccggacaggactcaaccggtacgcaccaagacggagacaccctccccactgtcggcgggtccgacccctttgtttccatcccttctcggcccgaacaagagcctgtggctgatagctttcagggcagctcagtcctctccctcagcgaacttccaaaggcaccgctgcagaacggcctgagcatcccattatcctcatccgagtcctctagtacccgtctatctcccccagatgtgtccgctttgctagacatctctctccccggaccacctgaggacgccctgtctcaaggggagccagccacccacatctccgatagtattattgaaatagctatatccagtggtcagtacggggagggggtgcctttatcccctgccaagttgaatgggagtgactcttccaaatccctcccaagcccctcaagctccccccagccgcactggatagccagtccaacacatgatcctcaatggtatcccagcgacagcacagattcttctctttcttctctgtttgccagctttattagccccgagaaaagccggaagatgcttccaaccccaattggcaccaactctgggacctcactgttagggcccagtctcctggatgggaacagcagggactcctttgtgtctcgatctttggccgatgtcgctgaggtcgtcgactcacagctggtttgcatgatgaatgagaacagtatcgattatatatcacggttcaacgacttggcccaagagttaagcattgcagagcctggtcggcgtgaggccctgttcgatggcggggggggtggtcccgctgtgtcagatctgtcccagtag

SEQ ID NO: 28978 - DNA, 3810 bp, Artificial Sequence
  Description of Artificial Sequence: Synthetic coding sequence
atgactgttaaacttggggacggcgggagcggggaggatgggcttaagaagcttggtaaacgagcagcggacgaggagtctctcgagggagagggggccggaggtgccgacgccgcagaggaaagttctggcacaaagcgagacgaaaagacacctagagcaggtgcagacggacctccagctcctcccggggctccccaggcaccaagccccccccagggaagcccacaggaccagcaccacttcctacgcagcagcgtccgtccccagtctaaacgccctcgcaaggacccacccagtgcagtaggaagtgggaatgcagggggttccggacccagaggtaagggagcagaggggggcggaagttcttctggaaatgtgtccggcgtggccccagctgcccccgctgggggcagtcgatcttcttcccggaacctgggatcttccggcggagagaaggaggagggaaagaaggtacgaagacaatgggaatcatggagtaccgaagacaaaaacaccttcttcgaaggactttacgagcacggcaaagacttcgaagccatccagaacaatatcgccctgaagtacaaaaaaaagggtaaacctgcaagcatggtcaagaacaaggaacaggtgagacacttttactataggacgtggcataagatcaccaaatacatcgattttgaccatgttttcagccgtgggcttaagaaatccagtcaggagttatacgggctaatttgctacggagagctgagaaagaaaataggaggatgcatggatgataagaatgcaacaaagctaaatgagctgatacaggtcggagccactactgtaaggtacaagggccgaaacctgcgaatcaaagctcccatgtgcagggcccttaaaaagctgtgtgatccagacggattgtcagacgaggaagaccagaaaccagttaggctgcccttgaaagttccaatcgaacttcagccaagaaacaaccatgcttgggctcgggtgcaaagtctggcccagaacccacgtctgcgtatgattgtcgaactgcacagaaaagtgagctcattgattgaatttcttaaacagaagtgggcattacatgaggtcagagtccgcaaaaccttggaggagaggcagctgcaggacagttgctctgctccgatgcaggagaaggttactctgcatctgtttcctggcgagaattgcaccctaacccccctccctggtgtggcacgcgtcgttcacagcaaagccttttgcacagtacattggcaagaaggtggaagatgcaaacagtcagctaaggacgctcacgtcctgccccctgctcagatcctggggatccagagtggtcagggtacagcacgtggccaggtcaaatgcccaaggtccggggcagaaggaaagggtgttggccgaccccccccagctgccgatgcactccaatcgagcggcgagtctagccccgaaagtgcccctggcgaaggggcggctctgagtctcagcagccctgatgcgcctgatagacccccgccacggcatcaggatactggcccgtgcctggagaagacaccggcagagggaagggacagtccaacaagagagcccggggcgttaccctgcgcttgcggacagcttccagatttagaggacgagctgagcctcctggaccctttacccaggtacctcaagtcatgccaggatctgatcgtaccagaacagtgtaggtgtgccgatacacgtcccggcagtgagcagccccccttagggggggccgcttcccccgaagtcctcgcaccagtgtctaaggaggccgctgacctggctccaacagggccctctcccaggcccggccccgggctcctgctagacgtctgtacaaaggacctcgccgacgctcccgccgaggaactccaggagaaaggatccccggctggcccacctccatctcagggccagccagcagcacgcccccccaaggaggtccccgcatctcgcttagcccagcagttgcgggaagaaggatggaacctccagacctccgaatctttaaccctcgcagaggtctatctcatgatgggcaagccaagcaaactacagcttgaatatgactggctcggaccagggcgacaggacccaaggcccggctctcttcctacggccctgcacaagcagagattactgagttgccttctaaaacttataagtaccgaggtgaacccaaagcttgccctagaggcaaataccatatctactgcctccgtaagaccggcccaggaagaacagtctatgaccccaccaggcaaggtggttacagtgagctcacggagtccgcgctgtccgcgaaaccaggcctctcttcgaagcagcaaaacattcccacccagttccgcaccatgttcaagcggcctgcgcaaccccccgagacccttgctcgtgcccggaccatccagtacagggtcaaatgactcggatggcggtctgttcgccgttcccaccactctgccgccaaattcgagacacgggaagttgttttcaccttcaaaagaggccgagctgacatttcgacaacacttaaacagcatctcaatgcagagcgacttcttcctccccaaaccgagaaaactccgaaatcggcacctacgtaaaccacttgttgtccaacgcaccttactgcctaggcctagcgagaaccagtctcacaacgtatgtagcttctctatattatctaattcatctgtgacggggaggggatcctttcgccccattcagtcctcactcaccaaggccgctctatcccggccgatcgtccctaaggtgctcccgcctcaggctacatcccatcttgcctccgccattgatctcgcggcaaccagcgccggtattctatctgggaatcccctgcccgctttggataccgaaggtctatcaggaatttctccactgtcgagcgatgaggtgacaggggcaatttccggacaggattccaccggaacccatcaggacggggacacgttgcccacggttggtggatctgatccattcgtgtctattccttctaggcccgaacaggagccggttgcagacagctttcagggatcttcagttcttagcttaagcgaactccctaaggcacccttgcaaaacggcctaagcatccctctctcaagtagtgaatcctctagcactaggcttagtcctccagacgtgtcagccctgcttgatatctctctcccagggccccccgaggatgcactgagtcagggcgaacctgcaacccacattagcgattcaatcatagagatcgctataagctccggacagtatggcgaaggggtgcccttgagccccgccaaactcaatggcagcgacagttcgaagagcctgccttccccttcttcaagtccccaaccccactggatcgcaagcccgacgcatgatcctcaatggtacccatccgattcaaccgacagtagtctcagttccttgttcgcctcatttatatcgcccgagaaatcgagaaagatgctgcctacgcctatcgggacaaattctggaacatctcttctgggcccttcccttcttgatggcaactcacgggattcattcgtgagtcggtcccttgccgacgtggccgaagttgttgattctcagttggtttgtatgatgaatgagaattcaatcgactacatctcacgctttaacgacctagcccaggaactgtccatcgccgaacccggtcgtcgcgaagcccttttcgatggaggaggaggtggtccagctgtgagcgacctctcacagtag

SEQ ID NO: 28979 - DNA, 3801 bp, Artificial Sequence
  Description of Artificial Sequence: Synthetic coding sequence
atgaccgtgaagctgggcgacggcggctccggagaggacgggctgaagaagctgggtaaacgcgcagcagatgaagaaagtttagagggggaaggggcgggaggcgcggatgcagcagaagaatccagtggaacgaagagagatgagaagaccccccgcgccggagctgacgggccccccgctcctccaggcgctcctcaggccccctcgccccctcaggggagtccgcaggatcagcaccacttcttacgcagctctgtcaggccacagtctaagcgaccaaggaaggaccccccaagtgctgtcgggagcggcaatgcaggtgggtcaggtcccagggggaaagaccggcatctgccgaaggcccagctgtggctgtctatctcccgagtcccttttggcggatccagatcatcttctaggaacctcggctcatctgggggtgaaaaagaagagggaaaaaaggtgagaagacaatgggaatcctggtcaactgaggataagaataccttctttgaaggcctgtatgagcacggcaaagacttcgaagcaatccagaacaacatagccttgaagtacaagaagaaaggcaagcctgcctctatggtgaagaacaaggaacaagtccgccatttttactacaggacttggcacaagatcactaaatatattgatttcgaccacgtctttagtcgtggcctaaaaaaatcaagccaggagctttacggactcatctgttacggagagctccggaaaaagatcggaggatgtatggacgataagaatgcaaccaagctgaatgaactgatacaggtaggagccaccactgtcagatacaagggccgcaaccttaggatcaaggcacccatgtgccgcgcactcaaaaagttatgtgatcctgacggactgagcgacgaggaagaccagaaacccgttcgcctacctcttaaggttcccattgaattgcagcctcggaataaccacgcctgggctagggtgcaaagcttagcccagaatccaagactccggatgatcgtggagctgcacaggaaggtatcttcgttgatcgaatttctgaagcagaaatgggcgctacatgaagttagagtccgaaagacactcgaggagagacagctgcaggactcctgcagtgccccaatgcaggaaaaggtgactctgcatctgtttcccggggaaaactgcaccttaacacccctgcccggcgtcgcccgagtagtgcattctaaggcattttgtacggttcactggcaggagggcgggcgctgtaagcagagcgctaaggacgctcacgtcttacccccagcacagatcctgggcatccaatcaggccagggaaccgctaggggacaggtgaaatgtcccagatctggagcagaaggcaaaggagtgggacgcccccctccagctgccgacgcgctccagtcctccggagaatcgtctcccgaaagtgcccctggggaaggagccgcactgtctctcagcagccctgatgctcctgacaggccccccccaaggcatcaggataccggcccatgtctcgaaaagacccccgcagaggggagagatagccctacacgggagcccggggccctgccttgcgcttgcggtcagctaccagaccttgaagatgagttgtctttgctggacccgctgcctagatatttaaagtcatgtcaggatcttatagttcctgaacagtgtaggtgcgccgacactcgccccgggagtgagcagcccccgctggggggcgccgcgagtccggaagtgcttgcacctgtgtctaaagaagcagccgatctggcgcctacaggaccttctccacggcccggaccaggcctcctgctcgatgtgtgcactaaggaccttgcggacgcgcctgcagaggagctgcaagaaaagggatctcccgcaggacccccgccttcacagggccagccagccgcgcgcccaccaaaagaggtccccgccagccggcttgctcagcagctgcgggaagagggctggaatctgcagaccagcgagagcctgaccctggctgaggtatatctgatgatgggcaaaccatccaagctccagctagagtacgactggctgggacctgggagacaggacccacgacctggttctctgccaacggcccttcacaagcagcggctgctgtcatgtttgctaaagctcatatcaaccgaagtgaacccaaagctggccctggaggccaatacaatttccactgcttcagtgcgtccagcccaagaggaacagagtatgactcctcccgggaaagtcgtgacagtttcatccaggagcccccggtgtcccaggaatcaggctagtttgcgcagctcgaagacattccctcccagtagcgcaccatgctccagtgggcttcggaatccaccaaggccccttttggtccctggcccgagcagtaccggcagtaacgacagtgatggcggcctctttgcagtgcccacgacactacctccgaattcacgccatggcaagttgttttcaccctccaaggaggcagaactgactttccggcagcacctgaatagcatcagcatgcagtcagatttcttcctgcccaaacccagaaagctgagaaacagacacttaaggaaacccctagtggtccagcgaaccctactccctaggccctccgaaaaccagagccacaacgtttgtagcttttccatcctttccaattcctccgtgacaggacgcggttcattcagacctatccaatcgtctcttacaaaggccgctctgagcagaccgattgtgccaaaggtccttcccccccaggccacatcacatttagcatctgccattgatctggccgcgacgagcgccgggatactcagtgggaatcccctgcctgcgctggatacagaagggttgagcggcatcagtccactttccagtgatgaggtcacaggcgctataagcgggcaggattccacaggcacccatcaggacggcgacactctccctaccgtgggagggagcgatccattcgtgtccatcccctctcgccctgagcaagagccagtggccgactcgtttcaggggagctcagtgttaagtctaagtgagctgccaaaagccccacttcagaacggcctgagcatccctctgagcagctcagaatccagctcaaccagactgagccccccagatgtcagtgctttgttggatataagcctacccggccctcccgaagacgctctgtcgcagggcgaaccagccacccacatctcagactcgatcatcgaaatcgccatttcaagtgggcagtacggtgaaggggtccccctgagcccggcaaagctcaatggtagcgattcctcgaagagcctgccatcaccctccagcagcccacagccacattggattgcatcgccaacccacgacccccagtggtacccgtcagattccaccgactcctccttaagctctctctttgccagctttatcagtcccgaaaagtcccggaagatgttgccgacccctatcggaaccaacagtggaactagccttcttggccccagcttgctcgatggcaactctcgggactcttttgtaagccggtcacttgccgacgttgctgaagtggtggactcacagctggtatgcatgatgaacgaaaattcaatcgactacatatccagatttaatgaccttgctcaggagctctctatcgcagagcctggtcgcagggaggcacttttcgacggcggaggcggaggcccggccgtgagtgacctgagtcaatag

SEQ ID NO: 28980 - DNA, 528 bp, Artificial Sequence
  Description of Artificial Sequence: Synthetic coding sequence
atggatattgccattcatcatccatggatccggagacctttcttccctttccattctccttctaggctatttgatcagttcttcggcgagcacctcctcgaatccgatctttttcccacctccacgagtcttagtcccttctatttacgccctccgagttttctccgtgcacctagctggttcgatacaggattgagcgagatgagacttgagaaagatcgctttagcgtgaatctcgacgtgaagcatttctctccagaggagttaaaggtgaaggtgctgggcgatgtgattgaggtccacggcaagcatgaggaaagacaagatgagcacggattcatctccagagagtttcatagaaaatacaggatccctgctgacgtagaccctttgacaattacttccagcttaagctcagatggagtgctgactgttaatgggcctaggaagcaggtcagcggaccagagcgaacaattccgataactagagaggaaaaaccagctgtcacagcagctcccaagaagtag

SEQ ID NO: 28981 - DNA, 528 bp, Artificial Sequence
  Description of Artificial Sequence: Synthetic coding sequence
atggacattgcaatacaccacccgtggattcgcaggcccttctttccctttcattctccctctagactcttcgatcaattctttggggaacaccttctcgaaagcgatctgttccctacatccacctcactgtcacctttttatcttcggccgccttcctttctgcgcgccccgagctggttcgatacaggcttaagtgaaatgaggctggagaaggatagattcagcgttaatctagacgtcaaacattttagcccagaggaactgaaggtaaaggttcttggagacgtgattgaggtccacgggaaacacgaagagaggcaggatgaacatggctttatcagtcgagagtttcatcgtaaatacaggatccccgccgatgttgacccattgaccatcacttcctcactcagctctgatggcgtacttaccgtgaacggtccgaggaaacaggtgagcgggccagaaagaactattccaatcactagagaggagaagccagccgttaccgctgcaccaaagaaatag

SEQ ID NO: 28982 - DNA, 528 bp, Artificial Sequence
  Description of Artificial Sequence: Synthetic coding sequence
atggatatcgctatccatcacccttggattcgccggcccttctttcccttccatagcccctcccgcttgtttgaccagttctttggcgagcatttgttagagtctgatctgtttcctacgtcaacatccctttcgcccttttacctgagacccccctcctttctgcgagccccatcctggttcgacacaggcctttctgagatgcgcctggaaaaggacaggtttagcgtcaaccttgatgttaagcatttttcacctgaggagttgaaagttaaagttctcggagacgtcatcgaggtgcacggaaaacatgaggagcgccaggatgaacacgggtttatttccagggaatttcataggaaatacagaataccagcagatgtcgaccccctgacgataacctcatccctctctagtgacggagtacttactgtgaacggccctcgaaaacaggtctctggacctgaaaggacgatcccaattactagagaggagaagcccgccgtgacagccgcgcctaagaaatag

SEQ ID NO: 28983 - DNA, 549 bp, Artificial Sequence
  Description of Artificial Sequence: Synthetic coding sequence
atggcccagcggagcggaaaaataacactgtatgagggcaagcatttcaccggacagaaattggaagtattcggagattgtgacaactttcaagaccgaggttttatgaatcgggtcaattctatccatgtggaatccggggcctgggtttgctttaaccaccccgactttcggggacaacagttcatcctggagcatggagactaccctgatttctttagatggaattcgcattctgatcacatgggcagctgccgacccgtagggatgcacggtgagcacttcaggctagagatctttgagggctgcaacttcacagggcaatgtcttgagtttcttgaagacagcccattcctccagtctcggggttgggtaaagaactgtgttaacacaattaaagtttacggcgacggcgcagcatggagccctcgttcatttggagccgaagattttcagttgagcagctcactgcagagcgatcaggggcctgaggaggccacaactaaaccagcaacaactcaaccaccatttttgacagccaatctgtag

SEQ ID NO: 28984 - DNA, 447 bp, Artificial Sequence
  Description of Artificial Sequence: Synthetic coding sequence
atgggacgggcggggccgagatcaacggcagatacacgccccagggccacagtgatcaccacacgtcgtccgcgaccttggcaaaagcccacgtccccccggagactccaccgcagaagaccgagagggcagcccgccagtgagaatgctgcagagccttcacaggtagctatcagcaaggggaaaagcccggactacgcaaatggcgggaaggcagccatggatagtcgggcaagcgacgccataaacaaaagcaaggtagatacctctgctagtaatccaagccagagacgtccatcgaggctgcgaggtaaacgtagcctggctctccccccacgcctggaatgcctgttcccctcatcatgtggctccaggcgggctactagcagaccaggtttcccaccattggagggctcgcacttgggatgccagctgctgccgctctag

SEQ ID NO: 28985 - DNA, 2415 bp, Artificial Sequence
  Description of Artificial Sequence: Synthetic coding sequence
atggaggagccgggagtaaccccccagccatacctgggtttactgctggaagagctgcgtagagtggtggcagcactgcctgagggcatgcgtcccgacagtaatctatacggtttcccctgggagcttgttatttgtgccgcggtcgtgggcttctttgctgtcctctttttcctgtggcggtcatttaggtccgtccgatcacgcttgtacgtcggtagggaaaagaaactcgctctgatgttgtctggcttgatcgaggagaagtcaaaacttctcgagaagttctccttagttcagaaagagtatgagggctatgaagtagaaagctcgctcaaagatgccagtttcgaaaaagaggcgactgaagcccagtcccttgaagccacctgtgagaagttgaatcgtagcaattctgagcttgaggacgaaatcctctgtttggagaaggagctgaaagaggaaaagtcaaaacattctgagcaggatgagctgatggcggacattagcaagcgaattcagtcactggaggatgaatctaaatctctgaagtcgcaagtggccgaggcgaagatgacattcaaaatcttccagatgaacgaagaaaggctcaaaattgctatcaaggatgcactcaatgagaactcccagcttcaagagagccagaagcaactcctacaggaggctgaggtttggaaagaacaggtgagtgaactgaataaacagaaagtcacattcgaggattccaaggtgcacgccgaacaggtcctcaatgataaggagtcccatattaagactctgaccgaaagactcctgaagatgaaagactgggcggcaatgttaggagaagatattaccgatgatgataacctggagcttgagatgaactccgaatctgagaatggcgcctacttggataaccccccaaagggcgcacttaagaagttaattcatgcagccaagttgaacgcttcgctcaaaacactcgagggcgaacggaaccaaatctacattcaactttctgaggttgacaaaacgaaggaggagctaacagagcacatcaaaaatctccagactgagcaggcatccctgcaatcggaaaacacccactttgagaatgaaaatcagaaacttcagcagaagttgaaagtgatgaccgagctgtatcaggagaatgagatgaaactgcaccggaagttaaccgttgaggagaattacagactagaaaaggaggagaagctgtccaaggtggacgagaagattagccacgccactgaggaactggaaacctacagaaagcgcgcaaaggatctcgaagaagaactggaacggaccatccacagttaccaaggccaaatcattagccacgaaaagaaagcccacgataactggctggcagctaggaatgcggagcgaaacctgaatgaccttcgcaaggaaaatgcccataaccgccagaagttgacagagaccgagttgaagttcgagctgctggaaaaggacccatatgccctcgacgtgcctaacacagcttttggccgggaacactccccatatggaccgagtcccctggggtggccatcttcagagactcgggcatttctctctccacctacccttcttgaaggaccgctcagactgtctcccctgttacctgggggaggcggcagaggttcacgcgggcccgggaatcccttggatcaccagataacaaacgaacgcggggagtcttcctgtgaccgcctgacagaccctcatcgagccccctctgataccgggtccctgtcccctccatgggaccaggaccggagaatgatgtttccacccccagggcagtcatacccagatagtgcactgcctccacaacgtcaggaccgtttttgcagtaactctggacgactgtccggacctgcagagttgaggtccttcaatatgccctccctagacaaaatggacggttccatgccaagcgagatggagagctcaaggaatgatacaaaggacgacctgggcaacctgaatgtacctgactcatccctgccagcagagaacgaggccactggccccgggttcgtgccaccccctctggctccaatccgtggaccactcttccctgtcgatgccagaggacctttcctaaggagaggccctccttttccccctccaccacctggcgcaatgttcggcgcaagccgggattattttcctcctggcgatttcccagggcctccccccgcccctttcgccatgagaaacgtctacccgccgcggggattcccaccgtacttgcccccacggccagggtttttcccacccccaccccactcagaaggccgttctgaattcccgagcgggctaatccctccctctaatgagcctgctaccgagcacccagagccccagcaagagacatag

SEQ ID NO: 28986 - DNA, 2316 bp, Artificial Sequence
  Description of Artificial Sequence: Synthetic coding sequence
atggaggagcccggagtgaccccacaaccttatctaggactgctgttggaagagctgcgaagggtggtggcagccctgcctgaaggaatgagaccagattccaatctgtatgggttcccctgggaactggtgatttgtgccgccgtcgtaggcttttttgctgttttgttcttcctctggcgatcatttcggtctgtgcgcagtagactgtatgtgggtagagaaaagaagctagcactaatgctcagtgggctgatcgaggaaaagtcaaaattactcgaaaaattctccctggtccagaaggaatatgaagggtacgaagtggaatcatcattaaaggatgcaagttttgagaaagaagctacagaagcccagtcgctggaagccacctgcgaaaagctgaaccgcagtaattccgaactcgaagacgagatcctgtgcctggagaaggagctgaaggaggagaaatctaagcatagcgaacaggacgaactgatggccgacatctccaagagaatccagagcctggaagacgagtccaaaagcctaaagtcccaggtggcagaggcaaagatgaccttcaaaatctttcagatgaatgaggagcgattaaagatcgccattaaggatgccctgaatgagaattcccagctgcaggagagccagaaacaacttctgcaggaggccgaggtctggaaagagcaggttagcgaactaaataaacaaaaagtgacctttgaggattcaaaggtgcatgccgagcaagtgctgaacgacaaagaaagccatattaagaccctcaccgagagactgctgaagatgaaggattgggctgctatgctcggagaggacattacggatgacgacaatctagagctggagatgaacagcgaatctgaaaatggcgcctatcttgacaatcctcccaagggggccctgaaaaagctgattcacgcagcaaaactgaacgcttcactgaaaacactcgagggcgagaggaaccagatatatatccagttatccgaggtcgacaaaacaaaggaggagctgacagagcacatcaaaaatctgcaaactgagcaggcgtccctccaatctgagaatacgcactttgaaaacgaaaaccagaaactgcagcagaaactaaaggtcatgaccgagctgtatcaggagaatgagatgaagttacatcgtaagttgacggtagaagaaaactatcggctggaaaaggaggagaaactgagcaaggtcgacgaaaagatctcccatgctacagaggaattagagacctatcgcaagcgagccaaggacttggaagaagagctggaaagaaccatccacagctaccagggccaaatcataagccacgagaaaaaagcacacgataactggctggccgcaaggaacgcggagaggaatttgaacgatctacgtaaagagaacgcacataataggcagaagctgactgagacagagctcaaatttgagctgttggaaaaagatccttacgcactggacgtgcctaacaccgcctttggtagagaacactctccatacggcccctctccccttgggtggccttcttcagaaacccgagcatttctgtcacctcctactttacttgaggggccccttcggctctcaccactgctccctggggggggtggccgtggcagtaggggacccgggaacccgctagatcatcaaattactaacgaaagaggggaatcaagctgcgaccgcctgaccgacccacaccgcgccccatctgacaccggaagcctatcccccccttgggatcaagatcgcaggatgatgtttcctccacccggccaatcctatcctgattccgcgttgcctccacagcgccaggaccgcttttgcagcaatagcggcaggctgagcggtccggctgaactgcgaagttttaatatgcccagcctcgataagatggatgggagtatgccttcagagatggaatcatccagaaacgataccaaagatgatttgggcaatctgaatgtgcccgatagttccctgccggctgaaaatgaagcgaccggacccgggttcgtccctccccccctggctcccatacgcggaccgctttttcccgtagacgccagaggcccattcctcaggcgtggtcctccctttcctccaccaccaccaggtgcaatgttcggggccagtagagactacttccctccaggagattttcctggacccccaccagcaccttttgccagtgcccggtctccaccgggagccggcgcccctgctagcggacgagggctggggggtcctcagaagtag

SEQ ID NO: 28987 - DNA, 2379 bp, Artificial Sequence
  Description of Artificial Sequence: Synthetic coding sequence
atggagctgaaatcacctgaggaagaggttgtggccgctctaccggagggcatgagacctgactctaacctatatggctttccttgggagttggtgatctgtgctgccgtcgtgggatttttcgcggtcctattttttctctggcgttcttttcgctcagtgcggtcacgtctgtatgtcggccgggaaaagaagctagccttaatgttatctggcttgattgaagagaagtccaagttgctggagaagttttcccttgtgcagaaggagtacgagggctatgaggtggaatccagcttaaaggatgccagctttgagaaggaggccactgaagctcagtcactggaggccacctgcgaaaagctcaaccggtcaaacagcgagctggaggacgagatcctgtgtttggaaaaggagctcaaggaagaaaagtctaaacactccgagcaggacgaactcatggcagatatctctaagagaatccagagtctagaagacgagagcaagtcactgaaatcccaagttgccgaagcaaaaatgacattcaaaattttccaaatgaatgaggaaagactgaaaatcgctatcaaagatgcgttgaacgaaaattcccagctgcaggagagccaaaagcagctcctgcaggaagctgaggtttggaaggagcaggtgtctgagctgaacaaacagaaggtaacgtttgaagactcaaaggtgcacgcagaacaagtgctgaacgataaggagagtcatattaagacattgactgagagactgctaaaaatgaaagactgggccgctatgctgggggaagatatcaccgatgacgataatctggagttagagatgaattcagaatccgaaaacggagcgtatctcgataacccccccaagggagcattaaaaaaacttattcatgctgccaaactgaacgcctcgttaaagactctggagggcgagagaaaccagatctacatccaactgtccgaggttgacaaaacgaaagaggagttgaccgaacatatcaaaaatctccaaaccgaacaagccagtcttcagtctgaaaatacacacttcgaaaatgaaaaccaaaagttgcagcagaagctaaaggttatgacagaactctaccaggaaaacgagatgaaactgcaccggaaacttacagtggaggaaaactatcgacttgaaaaggaggagaaactttcgaaggtggatgaaaaaatctcccacgctactgaggaactggagacctacagaaagagagcaaaggatctggaggaggagctggagcgtacgatccatagctaccagggtcagatcatctcccacgagaaaaaggctcacgacaactggctggctgccagaaatgcagaaagaaacttgaacgatctgcgcaaagagaatgcccataataggcagaaactcaccgagacagagcttaagttcgaactcttagagaaagatccttatgccctggacgtgcccaacacagcctttggcagagagcatagcccgtatggccctagcccactcgggtggccatcctccgagacccgggctttcctgtcaccccctaccttgctcgagggtcccctgaggctgtcacccctgctcccaggcgggggcggcaggggctcgagagggccaggtaatccactcgatcatcaaataacaaacgaaagaggagagtcttcatgcgatcgcctgacagacccccacagagcccctagtgataccggttcattgagccctccgtgggatcaggatcggaggatgatgttccccccccccggccagagctaccctgacagtgcattgccacctcagcggcaggatcgtttttgttcaaactcagggagactgagcggccctgccgagctgagatctttcaacatgcccagtttggacaaaatggatgggagcatgccatctgagatggagtcctcaaggaatgatactaaagatgatctagggaatttaaacgttcccgatagttccttgccagcggagaacgaggctacggggcctggcttcgtcccaccacccctcgccccaatccgaggtcctttgtttccggtcgatgcccgcggacctttccttcggcgcgggccgccattccccccacctcctcccggagctatgttcggggctagcagggactactttcctcctggtgattttcctgggcctcctccggctcccttcgccatgcgaaacgtgtatcccccacgcggcttcccaccgtacctacccccccgccccggcttcttccctccgcccccgcatagcgaaggccggagtgaattcccttccggcctcattcctcccagcaatgagccagcaacggaacacccagaaccccaacaggaaacatag

SEQ ID NO: 28988 - DNA, 2286 bp, Artificial Sequence
  Description of Artificial Sequence: Synthetic coding sequence
atggaggaacccggcgtgactccccagccctatctgggcctgctgctcgaggagctgagacgggttgtggctgcactgccagaaggcatgcggcccgacagcaacctctatgggttcccctgggagctggtgatctgtgccgctgtggtgggttttttcgctgtgctcttttttctttggcggagtttccgatctgtgcggtccagactatacgtaggcagggagaaaaaactggcactgatgctgtctggcctcattgaggagaagagcaagctgttggaaaagttttcactggtccagaaagagtacgaaggctatgaggtcgagagcagtttgaaggatgctagcttcgaaaaagaggctaccgaggcccagtcactggaggcgacttgcgaaaagctcaacagatccaattccgaattggaggacgagatcctgtgtctagagaaagagttgaaagaggagaagtcaaaacatagtgaacaagatgagctgatggctgacatctctaaacgcatccagtcattagaagatgaatctaagtcactgaagagccaggttgcagaggctaagatgacttttaagattttccagatgaacgaagaacgtctgaagatagcaattaaagatgctcttaacgagaacagccagctgcaagaaagtcaaaaacagctgctgcaagaagccgaggtgtggaaagaacaggtctccgagctaaataagcagaaggtgaccttcgaagactccaaagttcacgctgaacaggtgctgaacgataaagagagccacataaaaacactgactgaaagactgttaaaaatgaaggattgggctgccatgctgggggaggatatcacggacgatgataaccttgagcttgagatgaattccgaatcagaaaacggagcttacctagataaccctcccaaaggggcgctgaaaaagcttattcacgccgctaaactcaacgcaagcctaaaaaccctggagggggaacggaaccagatttacattcaactgtcagaggtggacaagactaaagaggagctcacagagcatattaaaaacctgcaaaccgaacaggcatccctgcagagcgaaaacacacatttcgaaaacgagaaccagaaactgcagcagaaattgaaggtgatgacagagttgtatcaggagaacgaaatgaaactgcacaggaagcttactgtggaagaaaactataggctcgaaaaagaggaaaagctttcgaaagtagacgagaagatatcacacgcaactgaagaactcgaaacataccgcaagcgcgccaaggacttagaagaggaactggagcggaccattcatagctaccagggacagatcattagccacgaaaaaaaggcccacgacaattggcttgcagcaagaaatgctgaacgcaatctcaacgacctgaggaaggagaatgcccacaacagacaaaagctgaccgagacagagctgaagtttgaactgctggaaaaagacccatacgcccttgatgtgcccaacaccgcatttgggcgaggaagccgcggtccgggcaacccactagatcaccagattaccaacgaacggggtgagagcagctgcgaccgtctgacagaccctcaccgggcaccaagcgatactggtagtctctctcctccgtgggaccaggatcggcgaatgatgtttccaccccccggccaaagctatccagactccgctcttccgccccagcgccaggacaggttctgtagcaactcaggccgactgagtggcccagcggaacttaggagttttaacatgccgtctctggataagatggacggctcgatgccaagtgagatggaatcttctagaaacgacaccaaagatgatctagggaacttgaatgtccctgactcatctctgccagctgagaatgaggcaacaggcccagggtttgtaccgccaccgctggcacccatccgtggacccctattcccggttgacgctcgaggccccttcctcaggagaggaccccccttccctccacccccgcccggggcaatgtttggcgcctctagggattacttccccccaggcgattttccaggcccccccccggctcctttcgccatgcggaacgtctatccaccacgcggatttccaccctacctgcctccccgacctggcttttttcctccgcccccacactctgagggacgatcggagtttccctctggtctgatccccccatcgaacgaaccggctacagagcatcccgaaccccagcaggaaacttag

SEQ ID NO: 28989 - DNA, 2019 bp, Artificial Sequence
  Description of Artificial Sequence: Synthetic coding sequence
atggagttaaaaagccctgaggaggaggtcgttgccgctctcccggagggcatgaggcccgatagtaacctgtacggatttccttgggaacttgtcatctgcgctgcggtcgtagggttttttgcagtgctcttttttctgtggaggagttttaggtctgtgagaagtcggctgtatgtaggtcgtgaaaagaaactcgcactgatgttgtcaggcctaattgaagagaagtccaagttgctcgaaaagttttcgctggtccagaaggaagcaacctgcgaaaagctcaaccgatcgaacagtgagctggaagatgagatcctgtgcctggagaaagagctgaaagaggagaagtctaaacacagcgaacaggacgaattgatggcagatatctcaaagcgtattcagagtctggaagacgagagcaaatccctgaagagccaggtcgcggaagcaaaaatgacattcaagatcttccaaatgaacgaagagcgacttaaaatagcaatcaaggacgccctgaacgaaaacagtcagctgcaggagtcccagaagcagctgttgcaggaagccgaggtgtggaaggagcaagtcagtgaactgaacaagcagaaggtcacttttgaagactctaaggtccacgcagaacaggtacttaacgataaggagtcccatataaaaaccttgaccgagcgccttctgaagatgaaggactgggcagccatgctgggggaggatatcaccgacgacgataatctggagcttgaaatgaactccgagtccgagaacggagcttacttggacaacccccctaaaggagctcttaaaaagttgattcatgctgccaagcttaatgcttctctgaaaaccctcgagggcgaacgaaaccagatatatatacagctgagtgaggtagataaaactaaggaggagcttacagaacacattaagaacctacagacagagcaggcttccttacagtcggagaacacacacttcgagaatgagaatcagaaactccagcagaagctgaaggtcatgaccgagctataccaagaaaatgaaatgaagctccaccggaagttgacagtggaagaaaattaccgtttagagaaagaggaaaaactgtcaaaagtcgatgaaaaaatctctcacgccaccgaagaacttgagacgtacagaaaaagagctaaggacttagaggaagaattggaaagaacaatccactcctaccagggccagataatctctcacgagaaaaaggctcacgataactggctcgccgcccggaatgccgagcgtaacctcaacgacctgcggaaggaaaacgcccacaatcggcagaagttgaccgagacggaactgaaatttgaattattagaaaaagatccttatgcacttgacgtgcccaatacagccttcggccgggagcatagcccctatggacccagtcccctcggatggccatctagtgagacaagagcctttctctcaccaccgacgctcttagaggggcctttaaggttgtcgccactcctgccaggggggggtgggaggggctctcgcggtcccgggaacccacttgaccaccagatcaccaacgagcgcggtgagagtagctgtgaccggcttaccgatccccaccgggccccaagcgataccgggtcactttcccccccgtgggaccaggataggcggatgatgttcccaccccctggacagagctatccagacagcgccctgccgccacagcgtcaggatcggttttgtagcaactcagggcgactgtcagggccagccgaactgcgttcctttaacatgccaccaggaccccccccagctccattcgccatgcgtaatgtgtatcctccccgtggcttcccaccctaccttccccctcgcccaggtttctttccccccccgccccatagcgaaggtcgcagtgaattccccagtgggctcatccccccctccaacgagcccgccactgagcatccagagccacaacaagaaacgtag

SEQ ID NO: 28990 - DNA, 2430 bp, Artificial Sequence
  Description of Artificial Sequence: Synthetic coding sequence
atggaagagccgggtgtgaccccacagccttatctgggcctcttattagaggaactccgccgggtggtggcagcactgcctgaggggatgcgacctgactctaacctttacggcttcccatgggagctcgtgatctgtgctgccgtggttggatttttcgcagtcctcttctttctgtggagaagtttccgctcagtccgctcccgcctatacgtgggcagagagaaaaaactcgcattgatgctgagcggtctcattgaagagaaaagcaagctgctggagaaattcagtctggtccagaaggagtatgagggctacgaagtggaatcctccctgaaagacgcaagttttgagaaagaggctactgaagcacaaagtctggaggttgaaaaccagatggcgacctgcgagaaactgaaccgcagcaacagcgagcttgaagatgagatactttgtctcgagaaagaattgaaagaggaaaagtctaagcattcagaacaggacgagctgatggctgacatctctaagcgcattcaatctctggaagatgagagtaaaagtctgaagtcgcaagtggcagaagcaaagatgactttcaaaattttccagatgaatgaagaaaggttaaagatcgccatcaaggacgcactaaacgaaaactctcagctccaggagtcccaaaaacaacttctgcaggaagccgaagtatggaaagaacaagtctctgaactgaacaaacagaaggtaacctttgaggattccaaggtgcacgctgagcaggtattgaacgacaaagaatctcacatcaagacgctcacagaaagactgctgaaaatgaaggactgggccgcaatgctgggcgaggacatcacagatgatgacaacctcgaactggagatgaacagtgagagcgagaacggagcttatctggacaaccctcccaagggtgcactcaagaagttgatccatgcggcaaagctgaacgcatccctcaaaaccctggagggcgagcgaaaccagatttatatacagctctcagaggtggataaaacaaaagaggagctgactgagcatatcaagaacctccagactgagcaggcctccctgcagagcgagaatacccacttcgagaacgagaatcagaaattgcagcagaaattgaaagttatgactgaactgtatcaggagaacgagatgaagctgcaccgcaagctgactgtagaggagaattatcggctggagaaggaggagaagctgtccaaggtcgatgagaaaattagtcatgctacggaagagctggaaacatataggaaacgggcaaaggatctggaggaggaactggagcgtaccattcattcttatcaggggcagatcatctctcacgagaaaaaggcccacgataattggctggctgccaggaacgccgaaaggaacctgaacgacctgcgaaaggaaaacgctcacaaccggcagaaactcacggagacagagttaaagttcgaattactggaaaaggatccctatgcactagacgtgcccaataccgcattcggtcgagagcattcaccgtatggtccctctcctctcggttggccatcatccgaaacccgcgccttcttgtcaccccccacgttgctagaagggcccctccgtctttctccgctgcttcctggcggaggaggacgtggttccagaggcccaggaaaccctttagaccaccaaatcactaacgaaaggggtgagtcctcatgtgaccggttgacagacccacacagggccccaagcgacacagggagtttgagccctccatgggaccaggacagacgcatgatgttcccgcctcccggtcagtcgtatccggatagcgctttgccaccccagcggcaggacagattttgttccaatagtgggaggctgtctgggcctgcagaactgcggtctttcaatatgccaagtctagacaaaatggacggttcaatgcccagcgaaatggagagtagcagaaacgacaccaaggacgaccttgggaatctcaacgtgcctgacagtagcctcccagccgagaacgaggcgactggacccggtttcgttcctcccccattggcccctatccggggtccgctcttccctgtggatgcccgcggccccttcctgaggaggggcccaccattcccccctcctccacccggagccatgttcggagcttccagggactattttccccctggagatttccctgggccaccgcccgctccgttcgcaatgcgcaatgtctacccccctagagggtttcccccgtatctgccccccagacctgggttttttccacctcctccccactccgagggaagaagcgaattcccctcaggtctgattcccccatcaaacgagcccgctacagaacaccctgagccacagcaagagacgtag

SEQ ID NO: 28991 - DNA, 2328 bp, Artificial Sequence
  Description of Artificial Sequence: Synthetic coding sequence
atgagacctgatagtaacctctatggctttccttgggaattggtgatctgtgcagccgtagtgggatttttcgcagtgttatttttcctgtggcgctcctttagaagtgtaagatcaagattatatgtcggccgcgaaaagaagctggccctgatgctgtcaggcttaatcgaggagaagtcaaagttactagagaagttcagcctggtacagaaggaatacgaaggttatgaggtggagagctctttaaaagacgcaagttttgagaaagaggccacggaggctcaatcactggaggccacatgtgaaaaattaaatcggagtaattctgagctcgaggacgagatactttgcctagaaaaggagctaaaggaggagaagtccaaacacagcgaacaggacgagctgatggctgacatctctaagcgtattcagtctcttgaagacgagtcaaagagcttgaagagccaggttgctgaggccaagatgacctttaagatttttcagatgaatgaagagagattaaaaatcgctatcaaagatgccttgaacgagaattcccaactacaggagagtcagaagcagctgcttcaggaggcagaggtctggaaagagcaggtgtccgaactgaacaaacagaaggtcacgttcgaggactctaaggtgcacgcagaacaagtccttaacgacaaagaatctcacattaagactctgacagaaagactgctgaaaatgaaggattgggccgccatgctgggagaagatattacagacgacgacaatcttgagctggagatgaactccgaaagcgagaatggggcgtatttggacaatcctcctaagggagctctcaagaaactcatccacgctgccaaactgaatgcatctctcaagacactcgaaggagaaaggaatcaaatatacattcagctatcagaagtggacaaaacaaaggaggagcttactgaacatatcaagaacttgcagactgagcaggcgtcacttcaaagtgagaacacccactttgaaaacgaaaaccagaaattgcagcaaaagctgaaggtgatgactgagctgtatcaggagaacgaaatgaagttgcacagaaagttaactgtagaggagaactaccggctagagaaggaggaaaaactttctaaagtggatgagaagattagtcacgccactgaggagcttgagacatatcggaaaagagccaaagatttagaggaggagctggagcggaccatacattcataccaaggtcagatcattagccacgagaaaaaggctcacgacaactggctcgcagcaagaaatgctgagaggaatctcaacgaccttcgaaaagaaaatgctcataatcgccagaaattgacagagaccgagctgaagttcgagcttcttgagaaagatccctacgctttagatgtgcccaacaccgcctttgggcgcgagcattctccctatggcccaagtcccttggggtggccgagcagtgaaaccagagcttttctctcgccgcctacattacttgaaggtcctctgcggctatctcccctcttgccaggcggaggaggtagaggatcacgaggacccggcaatcctcttgatcaccagatcacaaacgaaaggggggaaagcagctgtgatcggttaactgaccctcacagagcaccttcagataccggatctctgagtcccccgtgggaccaggaccggcgtatgatgtttcctcctccaggacagtcatacccagatagtgcactgcctccacaacgacaggataggttctgctctaattctgggaggctgtcgggacccgccgaattgcggtcctttaacatgccaagtcttgacaagatggatggaagcatgccgtccgaaatggagtcctctcggaatgataccaaggatgacctggggaacctcaatgtcccagatagctcgttgccagcagagaacgaagccaccggcccaggctttgtgcctcctcccttagcacccatccggggtccacttttccctgttgacgctcggggcccttttctgaggagaggtccccctttcccacctccgccccctggtgctatgttcggagcatccagagactattttccaccaggtgatttccccggtcccccgcccgcgcctttcgccatgaggaacgtctatccgccgcgaggatttcccccatatttacccccgagacccgggttctttcctcctccaccacactcggaaggaaggtcagagtttcccagcggactgatccccccttcgaatgaacccgccacagaacaccccgaaccccagcaggagacttag

SEQ ID NO: 28992 - DNA, 1401 bp, Artificial Sequence
  Description of Artificial Sequence: Synthetic coding sequence
atgaggctccgtactaggaaagcaagtcaacaatcaaatcaaatccaaacccagcgaactgctcgcgctaagaggaaatattccgaagtggatgattcactgccgagcgggggggagaaaccatctaagaatgagacgggcttactcagcagtattaagaagttcatcaagggaagcaccccaaaggaggagcgagagaatccttctaagagatcccgaattgaaagagatattgacaacaatctgataacatcgacacctcgagctggcgaaaaaccaaataagcaaatctcgcgggttcgccgtaaaagccaagtcaatggagaagctggcagctatgagatgactaaccaacatgtcaaacagaacggcaaactggaggacaatcctagttctggctctcctcctcggacaacactcctcggtacaatcttctccccagtgtttaacttcttctccccagcgaacaagaatggaacaagcggcagcgactctcctggtcaagctgtcgaggctgaggagattgtaaagcaactcgacatggagcaggtggatgagatcaccacctctacaaccacctctacgaatggcgctgcatactctaatcaggccgtccaggtgcggccaagtctcaacaacggtttggaggaggcagaagaaaccgtgaatagggatattccccctctgacagcccccgtgacccccgactccggttatagtagcgcccatgcagaggcgacttatgaagaggactgggaggtgttcgacccttattacttcatcaagcacgtgccccctctgaccgaggaacaactgaaccgaaaacccgctctacccttgaagactcggtccacccctgaattttctctggttctcgacctggatgagacactggttcattgctccctgaatgaactggaggatgccgccctgacctttccagtgctgttccaggacgtcatctaccaggtctatgttcgtttgcggcccttttttagagaatttctggaaagaatgagccaaatgtatgaaattatcctatttactgcctccaaaaaggtgtatgctgataaactgctgaacatactagatcccaaaaagcagctggtccgacatcgcctgttccgcgagcactgtgtgtgtgtgcagggcaattatataaaggacctgaacattctggggagggatctgtccaagaccatcattatagacaacagcccccaagcttttgcttaccagctgtccaacggaatcccgattgaatcctggtttatggataaaaatgataatgaactgcttaagctgattccattcctcgagaaactagtggagttgaacgaggacgtccgccctcatataagagaccggttccggctgcacgacctattgccccccgactag

SEQ ID NO: 28993 - DNA, 1185 bp, Artificial Sequence
  Description of Artificial Sequence: Synthetic coding sequence
atgaggttacgcactagaaaagcgagccagcagtcaaaccagattcagacccaacgcactgctcgagccaagcgaaaatacagtgaggtagacgactccctaccttccggcggagaaaaaccttctaagaacgagactggtctgctctcaagtatcaaaaagttcataaagggatcaacgcccaaggaagagagagaaaaccctagcaagcgctccagaattgaaagagacatcgataacaatctgattacctctacccccagggcaggtgaaaaaccaaacaagcaaatttctcgggtgcgtagaaagtctcaggtaaatggagaggctggttcatacgaaatgactaatcagcacgtcaaacagaatggaaaactggaggataatccaagctccggctccccccccaggacaactttactggggaccatcttttcccccgtttttaacttctttagcccagcaaacaaaaacgcacccgtgaccccagacagcgggtatagtagtgctcacgcagaggcgacttatgaggaagactgggaggtgtttgacccctactacttcatcaagcatgttcccccactaactgaggagcagctgaacaggaagcccgcactcccacttaagacacgcagcactcctgagttcagcttggtgttagatctcgatgagacgttggtacactgttcactaaatgaactggaagacgccgcactcaccttccccgtactgttccaggatgtgatatatcaggtgtatgtaagattgcgacctttcttccgtgagttcctggagcggatgagccaaatgtatgaaatcattctgttcactgccagtaagaaggtctatgccgataagctgttgaacatccttgacccgaaaaagcagctcgtccgccatcgcttattccgtgaacactgtgtttgtgtgcagggtaactatattaaggacctgaacattcttgggagggacctgtccaaaactatcattattgataactcaccccaggccttcgcgtaccagcttagcaatggcattccaatcgaatcatggtttatggataagaatgataatgagctactgaagttgattccttttctggaaaagctggtggagctcaacgaggacgtgaggccgcatattcgagacaggttccgtctgcacgatctgctccctcccgactag

SEQ ID NO: 28994 - DNA, 1185 bp, Artificial Sequence
  Description of Artificial Sequence: Synthetic coding sequence
atgcgcctacggacacgcaaagcctctcagcaaagcaatcagattcagactcagcgaactgctcgtgcgaagcgtaagtactccgaggttgacgatagtttaccatccggaggggagaagccgagtaaaaatgagacaggcttgctgtcttctataaaaaagttcattaagggctcaactcctaaagaggagagggaaaacccctcaaagagaagtcgcatagagagagatatcgacaacaatctgattacatccacgcccagggcaggagaaaagcctaataaacaaatctcaagagtgaggaggaagtcccaggtcaacggcgaggccggctcttatgaaatgaccaaccagcatgtaaagcagaatggcaaactggaggacaatccaagcagtggatctccaccgcggactacattgcttggcaccatcttctcaccagtattcaatttcttctcgcctgccaataagaatgctccagtgactccagatagcggctacagctccgcccacgcagaagctacttacgaagaagactgggaagtattcgacccttactacttcattaaacatgtaccccccctgacggaggagcagttaaatcgcaagcctgcgcttcccctgaagacacggagcacccctgagttttcgctggtcctcgacttagatgagacattggtgcattgttccctgaatgaactggaggatgctgctcttacatttcctgttcttttccaggacgtgatttaccaggtttacgtcaggttgaggcctttcttcagagaatttctggagcggatgagtcagatgtatgagattattttattcaccgcttctaagaaagtgtatgccgacaaactgttaaacatcttagatcctaaaaaacagctcgtgcgacacaggttattccgggagcactgcgtgtgtgtgcagggcaactatataaaggacttgaacattctggggcgagatctctccaagacaatcattattgacaatagcccccaagccttcgcgtaccagttgagtaatggaattcccattgagtcctggttcatggataaaaacgataatgaactgctaaagctcatacctttcctagagaagctggtcgagctgaacgaggacgttcggccacatattagggatagattccgtttgcatgatctgttaccgcctgattag

SEQ ID NO: 28995 - DNA, 498 bp, Artificial Sequence
  Description of Artificial Sequence: Synthetic coding sequence
atgcgtctgaggacgcgcaaagcctcacaacagtctaatcagattcaaacgcagcggacggcacgggccaaaaggaagtattccgaagttgacgacagcctgccatctggtggagagaagccctccaaaaacgaaaccggtctgctgagcagtatcaagaaattcattaaaggttccacgccgaaggaggaacgggagaacccctccaaacggagcagaattgaacgggatatagacaataatttgattacgagcacaccgcgtgctggggaaaagcctaataaacaaatttcacgggtccgccgcaaatcccaggttaatggagaagccggcagctacgaaatgacgaatcagcacgttaagcagaacgggaaattagaggataacccttcatccggttctcctccccggactactttgttgggtacgatattctcacctgtgttcaatttcttttctcccgcaaataaaaatgggacctctgggagcgactcatag

SEQ ID NO: 28996 - DNA, 1401 bp, Artificial Sequence
  Description of Artificial Sequence: Synthetic coding sequence
atgagactgaggactagaaaagcctcgcaacagtctaatcagattcagacgcagagaaccgccagagccaaaaggaaatattctgaggtggacgattccctgccttccggaggggagaaaccgtcaaagaatgagacagggttactgagttcaattaagaaatttatcaaaggtagtacacctaaagaagaacgggagaacccaagcaagagatcaagaatcgaacgggacatagataacaatctgatcacctctacccctcgggcaggtgaaaagcccaataagcagatttcccgcgtgcggcggaaaagtcaggttaatggtgaagccggcagctatgagatgacaaaccaacacgtcaaacagaatggaaagctcgaggacaaccccagctcggggtccccccctaggactaccttgttaggaactatcttttcacctgtttttaacttcttttccccagccaacaagaatggtacatcgggatcggacagtcccgggcaggccgtggaggctgaggagatcgtgaagcagctggatatggagcaggttgacgaaataaccacttccactaccacctcgacaaacggagctgcgtactcaaatcaggcggtgcaagtgagaccatctcttaataatggtcttgaggaggctgaggaaacagttaaccgggacattcccccactgactgcccctgtcactcctgactctgggtattcatccgctcacgcagaagctacatacgaggaggactgggaagtgtttgatccctactacttcattaaacatgtgcctccgctgactgaggagcaacttaatagaaagccggcgctgccgctgaagacgaggagcacgcccgagttttccctggtgttggatctggatgagactctcgtgcactgctctcttaatgaactggaagacgccgctttgacattccccgtgctgttccaggacgtgatttaccaagtgtacgtgcggcttagacctttctttcgagaattcctggaaaggatgtcccagatgtatgagatcatcctgttcaccgccagtaagaaggtttacgctgacaaattactaaatatcttagatccaaagaaacagctggtgagacaccgattgtttagggagcactgcgtgtgtgtgcagggaaactacattaaggatcttaacatcttaggccgagatctcagcaagactatcattattgataactccccgcaggccttcgcataccagttatcaaacggcatcccaatcgaaagctggttcatggataaaaacgataatgagctgctgaagttaatccccttcctggagaagctggtggagctgaatgaggacgtgcgtcctcatattagagacagatttcgcctgcacgatttgcttccgccagattag

SEQ ID NO: 28997 - DNA, 279 bp, Artificial Sequence
  Description of Artificial Sequence: Synthetic coding sequence
atgaggttaagaacacggaaagcatctcaacagtcgaatcagattcagacccagaggactgcaagagccaagaggaaatactcagaagtcgatgattctctcccgagcggaggggagaagccttctaaaaatgaaactggactgctcagcagcataaaaaagtttatcaagggttctacccccaaagaagagcgggagaaccccagcaagcgctcgagaatcgagagagacattgataacaatcttatcacctctacacccagggccggcgagaaatag

SEQ ID NO: 28998 - DNA, 354 bp, Artificial Sequence
  Description of Artificial Sequence: Synthetic coding sequence
atgcggctgcgcacccgtaaagcatcccagcagagcaaccagatacagacccagcgcactgctcgtgccaagcggaagtactcagaggtggacgattcccttccttcaggaggggagaaaccttccaagaatgaaacaggtctactgagcagcatcaagaaatttatcaagggcagcactcccaaggaggagcgcgagaatccgtcaaagcgcagccgcatcgaacgggacattgataataacctcataacctcaactccccgagccggggaaaagccaaataagcagatctcacgcgtgcgtcggaagagccaggtgaatggcgaagcgggctcctatgagatgacgaactag

SEQ ID NO: 28999 - DNA, 522 bp, Artificial Sequence
  Description of Artificial Sequence: Synthetic coding sequence
atgggcgatctgccctgggccccccctgaggcccaggctccatcgaccgcaggagcaggagacgttgccgagcaccaggtggctcctgcaagatttctgcagggtgcgtggaggcaagccgcaggatggctgtgccgcgagacaggcgccgcccccggcagtgctcaggctgggcctccagagacagcccacgcagctgaccctcagccgcggggcccgcaggcaccacctaggctcccaccttccctttcaccggaaagggtccatccagggcagcccgctgctcccgcagagcctgcccccggcgcaccggctctgagatccggcccttctcaacccagaggacttagactgccagtacccgtacctgcttgtgccggatcaagcgcccccggctccccagccgcactgcctgacagctacccatggcccccccccgcaagaaacagacctgctacgctgccacccacatccagggtgtctccgctcgccgcattcctcgcaagcgcacctcagcgttag

SEQ ID NO: 29000 - DNA, 252 bp, Artificial Sequence
  Description of Artificial Sequence: Synthetic coding sequence
atggcctctacccccatgggcaacgagggcgaaaaaaaaagcagctggccgagtcaggcagctccgtccctgcgcggtggtcccgccagtctctccaggtctgaagaatacctgtctcagatatcggcagagctgatggaggaggcattgtgcacggcctgttgccacctcaaccccgtgcctattaaaaagaaacagtcccaggatcaggccactcagattagtaaacgggctttttttaccaaaacctag

SEQ ID NO: 29001 - DNA, 606 bp, Artificial Sequence
  Description of Artificial Sequence: Synthetic coding sequence
atgtttctggttgttgccgtcaattctctgaccctgtatcagccgtctttcaggcccctgttgggggacgcctgttgcctgtgtgtagccgccgctgctggcgcactctgtcgcgaccttggcccacaccacacgcacacccgtgggcctaatgatgggagctgcggcctgtctaggtggaggcatcggcaacacggggactccccggaggacttcttcctagccagaggcgctcatctggcatcaactagagggagaaacgaacatagtccaaaaggctctctccagaagtgtctgttatccatccgagtgcagactacgcgtctatcccaccttcgggcaggtgtcaccctgagatgcgtgcttctgtgcgtgagcgaatcccccgtgggacttagaagcgtcgcatgtagtggggacttgctaggcgaccccttgacggggttcctggcctttctggtgtcttgcctcacgccttcagggacccccggcaacacgagtcttaccaagctctcaccaaccagttcaagccagggactagccctcgggccactgagcccgtctagttgcgatgcggcatccccatccatttcactaggactatag

SEQ ID NO: 29002 - DNA, 645 bp, Artificial Sequence
  Description of Artificial Sequence: Synthetic coding sequence
atggagcctgccagagagccaccatccagagcaagacctcccccgccgctggccgcccgccccgcccctgctccagcagcaccacgccccagatcacctgccgaagcagaggcacgggggcccgagggcctgttacggaggagtgggagcggctacgagggctcaacctcctggaaggccgctctggaggacactactacaagactgctactgggcgcaattgctgtgctgcttttcgccatcctggtcgtaatgtcaattctagcgtccaagggctgtataaagtgcgaggctccctgcccagaggattggctgctgtatgggagaaagtgttatttctttagtgaggagccaagagattggaacactgggcgtcagtactgccacacccacgaagcggtccttgccgtcattcaaagtcagaaagaactggagttcatgtttaagttcacaaggcgggagccctggataggccttcggcgagtcggggatgaatttcactgggtgaatggggaccccttcgatcccgataccttcaccatcgccgggcccggcgaatgcgtgttcgtggagccaactcggctagtatccaccgagtgtcttatgactcggccttgggtatgttcaaaaatggcatacacgtag

SEQ ID NO: 29003 - DNA, 1824 bp, Artificial Sequence
  Description of Artificial Sequence: Synthetic coding sequence
atggagctagtacgccggctgatgcctctaaccctcttgattctgagctgcctggctgagctgaccatggcagaagctgagggtaacgccagttgcaccgtgagcctgggcggggccaatatggcagagacacacaaagccatgattctgcaacttaatccgtctgagaactgtacatggacgatcgaacggccagagaataagtccatcaggatcatcttctcttatgtccagcttgaccctgatgggtcttgtgaaagtgagaatatcaaggtctttgatggcacgagcagtaacggacccttgctcggccaggtttgcagtaagaatgattacgtgccggtctttgagagcagttcgtctaccctcaccttccagattgtcactgactcggctcgcattcagcgcacagtatttgtgttctactacttcttttctccaaacatcagtatcccgaattgtggaggctacttggacacccttgaggggtcttttacttcacctaactacccaaagccacaccctgaactggcatactgcgtgtggcatatccaggttgagaaagattacaagataaagctcaactttaaggagatctttctcgagatcgataaacaatgtaaattcgatttcctggccatttacgatgggcccagtaccaattctggtttgatcgggcaggtttgcgggcgcgtgacccccacatttgaaagttccagtaatagtcttaccgtggtcctctcgactgactatgccaacagctacagaggcttctcagctagctatacatccatctacgctgagaatattaatactactagccttacttgtagctccgaccgaatgcgagtgatcatctctaagagctatcttgaagcttttaattctaatggaaataatctgcagcttaaagatcctacttgccggccgaaactcagtaacgtggttgagtttagtgtccctctgaacgggtgcggtacaatcagaaaagtagaggaccagtctatcacttatacaaacattataaccttcagtgcatctagcacttccgaagtcattacacggcagaagcaactgcagattattgtgaagtgtgagatggggcataattccaccgttgaaataatctatatcacagaggacgacgtcattcagtcccagaacgcactgggtaaatataacactagcatggctttattcgagtccaacagctttgagaagactattctggagagcccctactacgtcgaccttaatcagaccctgttcgtccaggtctccctacacacaagcgacccaaatttggttgtgtttctggatacttgtagagcctccccgaccagcgactttgcttcgcccacttacgatttgattaaatcagggtgctcacgcgacgagacctgcaaagtatatccactcttcggtcactacggtcggtttcagtttaacgctttcaagttcctgcgctccatgtcaagcgtgtatctccaatgcaaggtcctgatatgtgattcatctgatcatcagagccggtgcaatcagggttgcgtctcacgaagtaagagggatatatcctcatacaagtggaagacagattctattatcggtcccatccgccttaagagagacaggtctgcctctgggaatagcggtttccagcatgagactcatgcagaagaaacccccaatcagcctttcaattctgtccaccttttttcatttatggtcctggctctcaacgtagtgactgtagcaacaatcacagtgcgccactttgtaaaccagcgagcagattacaaatatcagaagttgcagaactactag

SEQ ID NO: 29004 - DNA, 1824 bp, Artificial Sequence
  Description of Artificial Sequence: Synthetic coding sequence
atggagctggtacggcgattgatgccgcttacccttcttatcctaagttgcctggcagagctcactatggccgaagcggagggcaacgcgtcttgtaccgtgagccttggcggcgccaacatggccgaaactcataaggctatgatcttgcaacttaatccctcagagaattgcacatggacgattgaacggccagaaaacaaatccataaggattatcttttcatatgtgcaactcgatcccgacgggtcatgcgagtccgaaaacatcaaggtcttcgacgggaccagctccaatgggccgctcctgggccaggtgtgtagcaaaaatgattacgtgcctgtcttcgaatcgtcaagcagcacactgacatttcagattgtcacagattctgctaggatccaacggactgtgtttgtgttttattatttttttagtccaaatatctcaatacctaactgcggaggatatctggacacgttggagggaagcttcaccagtccaaactacccaaagccccaccctgaactcgcatactgtgtttggcacattcaggtggagaaagactataagatcaagctaaatttcaaagagatattcctggaaattgataagcaatgcaagtttgactttctcgcaatctacgatggacctagcacaaattctgggctgatagggcaggtctgtgggcgagtcacacctacctttgaaagctctagtaattcactgacagtcgttctgagtaccgactacgccaattcctacagggggttcagtgcctcttacacttccatctacgctgagaatattaatactaccagccttacctgtagttctgatcgcatgcgagtaattatcagcaagagttacctggaagcgtttaattccaacggcaataacctgcagctgaaggatcccacttgtagacccaaactgtctaatgtcgtggaatttagcgtccccctgaacgggtgcggaacgatccggaaggtcgaggaccaatcgataacttatacaaatatcatcacgtttagcgctagcagcacaagtgaagtgataacacgtcagaagcagcttcaaatcattgtgaagtgcgagatgggacacaacagcaccgtggaaatcatttatataaccgaagacgatgtgatccagagccagaatgccctcggaaagtacaacacatcaatggcgctgttcgaatccaatagcttcgagaagaccatcttggaatccccttactatgttgacctgaaccaaaccctgttcgtgcaggtgagcctccacacctctgaccccaacctggtagttttcttggatacttgtcgggcttctccgacttctgacttcgcatcacctacatacgatctaatcaagtccggctgctccagagatgagacctgcaaggtgtaccccctgtttggacattatggacgattccaattcaatgcatttaagtttttacgctcaatgagcagtgtatacttgcagtgcaaggtcctgatttgcgattcctccgaccatcagtctagatgtaatcaggggtgcgtctcccggtccaaacgcgacatctccagctacaagtggaaaaccgactcaattatagggcctattcgcttgaaaagggataggtctgccagcggcaattctggcttccagcacgaaacacacgcggaagagactccaaaccagcctttcaactccgtgcacttgttctcattcatggtgctggcattgaacgtggtaacagtcgctaccattaccgttcgacactttgttaatcagagagccgactacaagtaccagaagctgcagaattattag

SEQ ID NO: 29005 - DNA, 1161 bp, Artificial Sequence
  Description of Artificial Sequence: Synthetic coding sequence
atgacgagcctgttccgccgcagtagctcaggctccggcggtggtggaacagccggggctcgcggaggaggagggggaactgcagcgccccaggagcttaacaactccaggcctgcccgccaggttcgaaggttagagtttaatcaagctatggatgatttcaagaccatgttccccaacatggactacgacattattgagtgcgtcctgcgtgccaacagcggtgcagttgatgccactatagatcagttactgcagatgaacctcgagggaggagggagttcagggggagtgtatgaagattcttccgattccgaagattccataccacctgaaatcctggagagaacactcgaacctgattcatctgatgaagagcctcctcccgtgtactcaccacccgcttaccatatgcacgtgtttgatcgtccctaccccctggcaccgcccaccccccccccacgaatcgatgcgctggggtctggcgcacctaccagtcagagaaggtatagaaactggaacccccctcttctcggcaacctccctgatgatttcctccgtatcctcccccagcagctagactctatccagggtaacgccggcggccccaaaccagggtcaggggagggctgtcctcccgccatggcaggaccaggccctggagatcaagagagcaggtggaagcaatatctcgaggatgagcggattgcactattcctgcagaacgaagagttcatgaaggagttacagcggaaccgtgatttcctcctggcccttgagagagaccgattgaagtacgaaagccagaagtccaaatccagctctgtagccgtgggaaatgatttcgggttctctagtccggtcccaggaacgggggatgctaaccccgcggtgtctgaggatgccctgtttcgggataagttgaagcacatgggaaaatccactcggaggaagctatttgagcttgcgcgggctttttccgagaagaccaaaatgcgtaagtcaaagagaaagcacctgctgaaacaccaatctcttggcgcggcagcaagtacagccaatctgctggatgatgtcgagggtcacgcctgtgacgaggactttcgaggccgcagacaggaggccccgaaagttgaggaggggctgcgggagggccaatag

SEQ ID NO: 29006 - DNA, 1161 bp, Artificial Sequence
  Description of Artificial Sequence: Synthetic coding sequence
atgacctccctttttcgtcgcagcagttctgggagcggaggcgggggcacagccggagctcgagggggcggcggtggcaccgccgcccctcaggaattaaataattcccggccagcccgtcaagtcaggcgcctggagttcaaccaggccatggacgatttcaaaactatgttcccaaatatggattacgatataattgagtgcgtgctccgggccaattccggagcggtggacgcaaccattgaccagctactacagatgaatctggaaggtggtggctcaagcggtggggtatacgaggattccagcgactccgaggactccataccccccgaaatccttgaaagaacgctggagcccgattccagcgatgaagagcccccaccagtgtattcccctcctgcctatcacatgcacgtattcgatcgcccctaccctctggccccccccaccccccctcctcggattgatgccctcgggtccggcgccccaacctctcagaggcggtaccgaaattggaatcccccgctcctcggtaacttaccagacgattttttgcggattttgccccagcaactggatagtattcagggcaacgccggggggcccaagcctggttccggcgagggctgcccccccgctatggcaggccccggaccaggtgatcaggaaagtcggtggaagcagtacctcgaagacgaacgtattgctctctttctccagaatgaagagttcatgaaggaactgcaaaggaatagagacttcctgttggcgttggagagggatcgactaaagtacgagtcacaaaagagcaaatccagtagcgtggccgtagggaatgatttcggattctccagtcccgtacctgggaccggcgacgccaatccagctgttagcgaggatgccctgtttcgagacaagctcaagcacatgggtaaatcaacaaggaggaagctctttgagctcgccagggcatttagcgaaaaaactaaaatgcgcaaatccaaacgcaagcacttactgaaacaccagtccctgggcgccgcggcttctactgccaatctcttggatgatgtagagggacatgcatgcgatgaggatttccgagggcgaaggcaagaggcacctaaagttgaggaggggttgcgggagggacaatag

SEQ ID NO: 29007 - DNA, 471 bp, Artificial Sequence
  Description of Artificial Sequence: Synthetic coding sequence
atgcccgctcttctgcccgtggcttctcgcctgctcttactgccacgcgtgctgctaacaatggcaagcgggtcccctcctactcaaccgagcccagcctccgattcaggctccgggtacgtgccaggcagcgtgagcgcagcctttgttacatgcccaaacgagaaggttgccaaggagatcgcgcgcgccgtggtcgaaaaacgcctggccgcctgcgttaatttaattccccagattactagcatctacgaatggaaggggaagatagaagaagactctgaagtgttaatgatgattaagacacagagttcacttgtgcccgcacttaccgacttcgttagatctgtgcacccatatgaggtggcagaggtgattgcgctgcccgtggagcagggtaacttcccctatctacagtgggtgcggcaggtcactgagagtgtctctgattctatcaccgtgcttccttag

SEQ ID NO: 29008 - DNA, 597 bp, Artificial Sequence
  Description of Artificial Sequence: Synthetic coding sequence
atgattggatctggtctagcaggatctggaggcgccggtgggccttcctccacagtaacctggtgtgctttattctcaaatcacgttgctgccacccaagcttcgttgctccttagtttcgtctggatgcccgctctgctacccgtagcttctagattgctgctgctgcctagagtgctactgactatggccagcggcagcccacccacacagcccagccccgcctccgacagcggctctggctatgtgccggggtctgtgtctgccgcatttgttacatgtcccaatgaaaaggtggctaaagaaatcgcgcgggccgtggtcgaaaaaagattggctgcttgcgtgaacctgattcctcagattacctcaatctacgagtggaagggaaagatcgaagaggatagtgaggtattaatgatgattaagacccagtcgtcactggtgccagcattgaccgacttcgtacgatccgtgcatccctatgaggtcgctgaggtaatagccctgcccgtagaacaggggaactttccctaccttcagtgggtccgccaagttactgagtctgtgagcgactccataactgtcctcccttag

SEQ ID NO: 29009 - DNA, 471 bp, Artificial Sequence
  Description of Artificial Sequence: Synthetic coding sequence
atgcccgccctgctgccagtggcctcacgcctgctgctcctccccagagtgctactcactatggcctctgggtccccacccacgcagccctcaccggccagcgactctggctccggttacgtgcccggctctgtcagcgccgcattcgtcacgtgtccaaacgagaaggtggccaaggagattgcgagggccgtggtggagaaacgtctggctgcttgcgtgaacctgatcccacagattacctctatttatgaatggaaaggcaaaatagaggaggacagcgaagttctgatgatgatcaagacacaatccagtctcgtgccagctctaacggactttgttcgctctgtgcatccttacgaagtcgcagaggttatagctcttcccgtggaacagggcaatttcccctacttgcagtgggtcagacaggtgacagaatctgttagcgactcaattaccgtcctcccctag

SEQ ID NO: 29010 - DNA, 540 bp, Artificial Sequence
  Description of Artificial Sequence: Synthetic coding sequence
atgagcgggggcagggcccccgcggtgttgttggggggggtcgctagcctcctactctcctttgtttggatgcccgctctgctcccggtcgccagtcggttactgcttctgcctagagttctgctaacaatggcctccggctctcctcctactcaacccagccctgctagcgattcaggcagtggttacgtgccagggagcgtgagcgccgcttttgtcacttgtccaaacgaaaaagtcgccaaggagatagctcgcgctgtcgtagaaaagcgtctggcggcttgcgttaatctcataccacagattacttcaatatatgagtggaaagggaaaatcgaggaggactcagaggtgttaatgatgattaaaacgcaatccagtctggtccccgcccttaccgatttcgtacggtcagtgcacccctacgaagtggcggaagtgatagctttgcccgtcgagcaggggaacttcccctatctgcagtgggtcagacaagtgacagagagcgtgtcggactccatcacggtgctgccttag

SEQ ID NO: 29011 - DNA, 540 bp, Artificial Sequence
  Description of Artificial Sequence: Synthetic coding sequence
atgtcaggtggcagagcaccagcagtgcttcttgggggggtggcttcactccttctttctttcgtgtggatgccagccctccttccagtggcgagccgtctgttgctgctgcctcgggtgctgctcacaatggcctctggcagcccaccaactcagccttcaccggcctccgactctggatccggatatgtgcctgggagcgtgagtgctgcgttcgtgacgtgccccaacgaaaaggtggccaaagagatcgcccgagctgttgtggaaaagaggctcgcagcctgcgtcaacttaatcccccaaattacgagtatttatgagtggaagggcaaaattgaggaagacagcgaggtgctgatgatgatcaagacccagagctccctcgtgccagcacttaccgactttgttcggagcgtgcacccttacgaggtagcggaagtgatcgccttgcctgtcgaacagggcaactttccatatctgcagtgggtgcggcaggtcactgagagcgtgtccgattctattaccgttcttccttag

SEQ ID NO: 29012 - DNA, 129 bp, Artificial Sequence
  Description of Artificial Sequence: Synthetic coding sequence
atgagtgggggacgtgcccccgccgttctgttagggggggtcgtgtctgatagaccaaggcccgctccctctgggcctcgttccttggacagatatccccatcccaagtcacagaggctagcaccgtag

SEQ ID NO: 29013 - DNA, 690 bp, Artificial Sequence
  Description of Artificial Sequence: Synthetic coding sequence
atgactaccgccgcgcggcctacattcgagcctgctagaggcgggcgcggcaaaggtgagggcgacctgtcccagctgagcaagcagtactcatccagagatttacctagccacactaaaattaaatacagacagactacccaggatgcccccgaggaagtgcgaaacagggacttccgcagagaactggaagaacgcgagcgcgcggccgcccgggaaaagaacagagatagacccaccagagaacataccacttcctcgtcagtgagcaaaaagccacgcctggaccagatcccggctgcaaatcttgacgccgacgacccactgaccgatgaggaggatgaggatttcgaagaagagtcagacgacgatgataccgccgctctcctagctgagcttgaaaaaatcaaaaaagaacgagctgaagaacaggctagaaaagagcaagagcagaaggccgaggaggagagaatccgaatggaaaacatcctgtctggaaacccgctactgaacctcactggaccgagtcagcctcaagcaaattttaaggtgaagagacgatgggacgatgacgtagtgttcaagaactgtgccaagggcgtggatgatcagaagaaggacaaaaggttcgttaatgatactcttagatctgaatttcataaaaaatttatggaaaagtacataaagtag

SEQ ID NO: 29014 - DNA, 618 bp, Artificial Sequence
  Description of Artificial Sequence: Synthetic coding sequence
atgagtatcatgtcttacaacgggggagcggtgatggcaatgaaaggtaagaactgcgtggctatcgcagcagaccggcgcttcgggatacaggcacagatggtgacgactgactttcaaaaaatcttccctatgggggacagactctatattgggctggcgggacttgcaacagacgttcaaaccgtcgctcagagactcaagttccgcctcaacctgtatgagttaaaagaaggacgtcagattaagccatacaccctaatgagcatggtggctaatttgctgtacgagaagcgatttggcccttactataccgaacctgtgatagcaggccttgacccgaaaactttcaagccatttatctgtagtctggacctgattggttgtcccatggtcaccgacgatttcgtcgtgagcggcacttgcgccgagcagatgtatggaatgtgcgagagtctctgggagcccaatatggatccggaccacttgtttgagaccatctctcaggctatgctaaatgcagtcgaccgagacgcggtttccggaatgggggtgatagtgcacataatagagaaggacaaaatcactactcgcaccctaaaagctcgaatggactag

SEQ ID NO: 29015 - DNA, 1089 bp, Artificial Sequence
  Description of Artificial Sequence: Synthetic coding sequence
atgaaaaaggaggaaaagctcgactggatgtaccaaggacctggagggatggtaaatcgggatgagtacctgctagggcgacctattgacaaatatgttttcgagaagatggaggaaaaggaggccggatgctccagtgaaaccggcttactgccaggctctatttttgctcctagcggcgctaactccctgctcgatatggcttccaagatccgagaggaccctctgttcattatcagaaaaaaagaagaagagaaaaaacgcgaagttctgaataacccagtgaagatgaagaaaatcaaagaattactccagatgagcctggagaagaaagagaaaaagaaaaagaaagagaaaaaaaagaagcataaaaaacataaacatcgcagctcatcttcggacagatcttccagtgaagatgagcacagcgccggacggtcccagaaaaaaatggcaaattcttcgcccgtgctgtccaaggtgcccggctacgggctgcaggtcagaaatagcgacagaaaccagggtcttcagggcccattgaccgccgaacagaagcggggacacggaatgaagaatcattctcgcagtaggtcgagttctcacagcccaccaaggcacgccagtaaaaagagcacaagggaagctggcagccgggataggcgctcgagaagtctaggtcgccgcagccggagcccgcggccgagcaaactgcacaacagtaaagtcaacaggcgagaaacagggcaaacccgctctccctcacccaagaaggaagtctaccaacgacgccacgcaccaggatacacgaggaagctgtcagctgaggaattggagaggaagcgccaagaaatgatggaaaacgctaagtggcgggaggaggagaggctcaacatccttaaacgtcacgctaaggatgaggaacgcgagcagagacttgagaagctggatagtcgcgacggcaaatttattcaccgcatgaaattagagagcgccagcaccagttcactagaagacagagtgaaacggaatatttacagtcttcagaggacgagcgtggccctggaaaaaaattttatgaagcggtag

SEQ ID NO: 29016 - DNA, 1617 bp, Artificial Sequence
  Description of Artificial Sequence: Synthetic coding sequence
atggctcagaagcctctgcgtctcctcgcctgcggagatgtggagggtaagtttgacatattatttaaccgtgtgcaggctattcagaagaaaagtggaaactttgacctactgctctgcgtgggaaacttcttcgggtccactcaagacgcagaatgggaggaatataagaccggcatcaagaaagcacccatacagacttacgtcctcggtgcaaataatcaagaaacagtgaagtatttccaggacgcagacggatgcgaattagctgaaaatataacctatctcggcaggaaaggtatcttcactggttccagtggtctgcagatcgtgtacctgagcggcaccgagtctctgaatgaaccagtaccaggatattcttttagtccaaaagatgtgtcctcgctccgcatgatgctgtgtaccacctctcaattcaaaggagtggacatcctgctgaccagcccatggcccaagtgcgtagggaattttggcaattcatcaggcgaagtagatacaaagaagtgcgggtccgctttggtaagctcactggcaacaggcctaaaaccaagatatcactttgctgccctagaaaagacctattacgagaggttgccatatcgcaatcatatcatcctgcaggagaatgcacagcacgccaccagatttatagccctagcgaacgtgggcaatcctgaaaaaaagaagtatctgtacgcattttcaatagtccctatgaagttgatggacgccgccgagctcgtgaagcagccgcccgatgtgacggagaacccatacaggaagtccggccaggaagcatccatcggtaaacaaatactggcaccagtggaagagtctgcgtgccagttcttttttgatctcaatgaaaaacaggggaggaagcggtcttccaccgggagagactctaagtcctcaccgcacccgaagcaaccccggaagcccccgcaaccacctggtccatgttggttctgcctggcttctccagaggtggaaaaacatctggtggtgaacatcggtacacattgctacctcgctctggcaaaaggtgggcttagcgatgaccacgtgctgattctgccaataggacactaccagtcagtagtcgaactatccgccgaggtggtcgaagaggtggagaaatacaaggcaacactgaggcgctttttcaaaagcaggggcaaatggtgcgtcgtgtttgaaagaaattacaaatcacaccacctccagcttcaggttattccagtgccgatttcttgcagcactactgacgatattaaggacgcttttatcactcaggctcaggaacagcaaatagagctcttagaaattccggagcatagtgacatcaaacagattgcgcagcctggagctgcttatttttatgtggaactggacactggggaaaaattgtttcaccggattaagaagaacttccccctccagttcggacgcgaagtgttagcctcagaggcgattctcaatgtacccgataaaagcgattggagacagtgccagataagcaaggaagacgaagagacgctggccagacggttccgcaaggacttcgaaccttatgatttcaccctcgatgactag

SEQ ID NO: 29017 - DNA, 762 bp, Artificial Sequence
  Description of Artificial Sequence: Synthetic coding sequence
atgaaactcatggacgctgccgagctcgtcaagcaacccccagacgtgacagaaaatccatacagaaagagcgggcaggaggcaagtatcggcaagcagattctggcacctgtcgaggagtccgcatgccaatttttctttgacctgaatgaaaagcagggcaggaagcgctcatcaaccggtcgggactcaaaaagctccccccatcctaaacagcctaggaagccaccgcagcctccagggccttgttggttttgccttgcttctcccgaggtcgagaaacacctagttgtgaacattggtacccactgttatttggctctggccaagggtggcttaagtgacgaccacgtcctgatcttgccaattggacactatcagagcgttgtggaactctccgctgaagtcgtggaagaggtcgagaagtataaagctactctgagaaggttttttaagtctagggggaagtggtgtgtcgtattcgaacgcaactataagagccaccacctgcaattgcagatcgctcaacccggagccgcctatttttacgtggagctggatacaggtgaaaagctgtttcacaggattaagaaaaactttccactgcagtttggcagggaggtactcgcaagtgaagcgatcctcaatgtgcctgacaaatccgactggaggcaatgccaaattagcaaggaagacgaggagactcttgctagacggtttaggaaagactttgagccatacgattttacgcttgacgattag

SEQ ID NO: 29018 - DNA, 1617 bp, Artificial Sequence
  Description of Artificial Sequence: Synthetic coding sequence
atggcacagaagcctttaagactattagcctgtggcgacgtggagggcaaatttgacatcctgttcaatagggtccaggcaattcagaagaagagtgggaacttcgacctgctgctgtgtgtgggcaacttcttcggcagcacacaggacgccgagtgggaagaatataagactggcatcaagaaagccccaattcagacatatgttcttggcgcaaataatcaggagaccgtaaagtacttccaagacgctgatggctgcgagctcgctgagaacatcacctacctcggaaggaaaggaattttcactggttcctctggacttcagatcgtttacttgtctgggaccgagtctctgaacgagcccgttcccggctatagcttttctccaaaggacgtttcctccctgcgcatgatgctgtgtacaacctcacagttcaagggcgtagacatcctgctgacctccccatggcctaagtgcgtcgggaatttcggtaattcatctggcgaagtggataccaaaaaatgcggttctgcactggtaagctccctagccacaggattgaagcccaggtaccattttgccgcacttgaaaaaacatactatgaaaggcttccttatcggaaccacattattcttcaggaaaatgcccagcacgcaacccgctttattgcactggccaatgttgggaaccccgagaagaagaagtatctgtacgctttctcaattgtgcctatgaagctcatggatgcagcagaattagtaaagcagccgcctgacgtcacagaaaatccataccgcaagagcggccaggaggcgagcattggtaaacagattctggctcccgtggaggaaagcgcctgtcagtttttcttcgacctcaacgagaaacagggtcgaaaacgctcttctacaggcagagactccaaaagcagcccccatcccaaacagccaagaaagccccctcagcctcctggcccctgttggttttgtctggcctctccagaggtggaaaagcacttagtcgtgaacattggtacccactgttacctagccctcgctaaaggaggtttaagcgatgatcacgtgctgatcctgccaatcgggcattaccaatctgtggtcgagttgtcggccgaggtggtggaagaagtggagaagtacaaagccacacttcggcgctttttcaaatctagaggcaaatggtgcgttgtattcgagcggaactacaaatctcatcacctccaactgcaggttatccccgtgccaatttcctgcagtaccactgatgatatcaaggacgctttcatcacgcaagcccaagagcagcagatcgagttgctggaaattcctgagcattcagatatcaagcaaatcgcccagcctggcgccgcctatttttatgtagaacttgatacaggagaaaaattgtttcaccgtataaagaaaaatttccctctgcagttcggcagagaggtgctggcgagcgaagccatcctgaacgtgcccgataaaagtgattggcgccagtgtcagattagtaaagaagacgaggagacactggctcggagatttcgaaaagacttcgagccatatgacttcacactagatgattag

SEQ ID NO: 29019 - DNA, 2685 bp, Artificial Sequence
  Description of Artificial Sequence: Synthetic coding sequence
atggcaacctctatggcagccgcaagtgggcgctttgagtccgcaaaatccatcgaggagagaaaagagcagaccaggaatgccagggccgaggttctgagacaggcaaaggcgaattttgagaaggaggagagacgtaaggagcttaaaaggctgcgtggcgaggacacttggatgctgccagacgtgaacgagcgcattgagcagttttctcaggagcattcggtgaagaaaaaaaaaaagaaagacaagcacagcaagaaagccaagaaggaaaagaagaaaaaaagtaaaaaacaaaagtacgagaagaacaacgaatcctccgatagtagtagcagttccgaggatgagtgggttgaagcggttccatcccagacacccgataaagagaaggcctggaaagttaaagatgagaagagcggaaaggatgatacccagattataaaaagggatgagtggatgaccgtagacttcatgagtgtgaaaactgtctcttccagctctttaaaagcggagaaagaaaccatgcggaaaatcgaacaagagaaaaatcaggccttggagcagtcaaagctgatggagagagagctgaatccatattggaaggacggggggaccggccttccaccagaagactgctcagtgtctagtattacgaaggtttcagttgttgaggacggcggactgagttggctcagaaaatcctacctcagaatgaaggagcaagccgagaaacaatctaggaactttgaagacatcgtggccgaacgatatgggagcatggagatcttccagtccaagctggaagatgctgagaaggccgcgagcactaaagaggactatagacgtgagaggtggagaaagcccacatactccgacaaggctcagaactgtcaagaaagtagagaatccgatttggttaagtacggtaattcctcacgggatcgctacgcgacaacagacaccgcgaaaaattcaaataatgagaagttcataggagacgaaaaagacaaacgccctggctccctggagacttgcagaagggaaagtaatccacgccagaatcaggaattctcctttgggaacctgagagcgaaattccttcgaccgagtgatgatgaagaactgtcctttcatagcaagggaagaaagttcgagcctttgtccagtagttcagccctggtggcccaaggatcactgtgtagcgggtttagaaagcccaccaagaactctgaggagcgactaaccagctggagccggtctgatgggcgcggtgacaagaaacactcaaatcaaaaacccagcgagacttcgactgatgagcatcagcacgtacctgaagacccccgggagaaatcacaggatgaagtactgagagacgatcctcccaaaaaggaacatctgcgggacacaaagagtacattcgccggatcacccgaaagagagtcaattcacatcctgagcgtggacgagaagaataagctgggcgccaaaatcattaaagcagaaatgatgggtaatatggaactggccgaacaactcaaggtccagcttgaaaaagcaaataaattcaaagaaacaatcacacagattcctaagaagtccggcgttgagaatgaagaccagcaagaagtgatcttagttagaactgatcagtcagggagggtgtggcctgtgaatacgccaggtaagagcctggagtcccagggtgggaggaggaaacggcagatggtgtctacccacgaagagcgggagcgggtccggtactttcatgatgacgacaacctctctttaaatgatctcgttaagaatgagaagatggggaccgccgaaaatcagaataaactgttcatgagaatggcttccaagttcatgggcaagacagacggcgactactacaccctggacgatatgtttgtatccaaagccgctgagagagaaaggctcggggaggaagaggaaaatcagagaaaaaaggcaatcgccgagcatagatccctggccgcacagatggagaaatgcctgtattgctttgatagcagccagttccccaagcacctgatcgtggcaattggcgtcaaagtatatctctgtctgcccaatgtaaggtctctcaccgagggccattgtctgattgtaccactacaacaccaccgcgcggcgacgctgctggacgaggacatctgggaagagatccagatgttcagaaagtccctcgtgaaaatgtttgaggataagggccttgattgtattttcctcgaaactaatatgtcgatgaaaaaacagtaccatatggtttatgagtgcatacctctcccaaaggaggtgggcgacatggcacccatttattttaagaaggccatcatggagtctgatgaggaatggtcaatgaataagaaattgatagacctgtcctccaaagatatcaggaaatccgtcccgcggggtctaccatatttttccgtggactttggactgcacggcggcttcgcgcatgttatcgaggaccagcacaaattccctcactactttgggaaggaaataataggcggaatgttggatatcgaacccaggctgtggaggaagggcattagggaatccttcgaggaccagcggaaaaaggcattgcagttcgctcaatggtggaaaccctatgattttaccaaaagtaaaaactactag

SEQ ID NO: 29020 - DNA, 291 bp, Artificial Sequence
  Description of Artificial Sequence: Synthetic coding sequence
atgtttgaggacaaaggtctggattgtatcttcctcgagactaatatgagtatgaagaagcagtatcacatggtctatgagtgcatcccattgcctaaggaagtaggagacatggctccaatttactttaaaaaggccataatggaatctgatgaggaatggtctatgaacaaaaaactgatcgatttgtcttcaaaggacattcgcaaatccgtcccaagaggtctaccgtatttctctgttgactttggtctgcacgggggctttgcgcacgtcattgaggaccaatag

SEQ ID NO: 29021 - DNA, 2229 bp, Artificial Sequence
  Description of Artificial Sequence: Synthetic coding sequence
atggctactagtatggccgcagcttcaggcagattcgagtctgctaagtcaatagaagaaagaaaggaacagaccagaaacgcgcgggcagaggttctaagacaggcaaaagccaattttgagaaggaagagcgtaggaaggaattgaaacgcttacgaggcgaggacacatggatgctccctgacgtgaatgagcggatcgaacagttcagtcaggagcactccgtgaaaaaaaaaaaaaagaaggacaagcattctaaaaaagcaaaaaaggaaaagaagaaaaagagcaagaaacagaagtacgaaaaaaataatgaaagctcagatagcagctcaagtagtgaggacgaatgggtggaggcagttccttcacagacccctgacaaggagaaggcgtggaaggtaaaggatgagaagtcgggcaaggatgatactcagatcatcaaacgtgacgagtggatgaccgtggattttatgagcgttaaaacggtgtccagttcttcactcaaggccgagaaggaaactatgaggaaaatagagcaggaaaagaatcaggctctggaacagagcaaactgatggaacgggaactgaacccatactggaaggatggcggcaccggtcttccgcctgaggactgttctgtgagctcaattaccaaagtcagtgtcgtcgaggatggcggcctgtcatggctgcgtaaatcatatttgcgaatgaaggagcaggcagaaaagcagtcaagaaactttgaagacatcgtggctgagcgttatgggtcaatggaaattttccagagcaaactggaagatgctgaaaaagccgctagcaccaaagaagattacaggagagagcgatggcgtaagcctacatattccgacaaagcccagaattgtcaggagagccgcgagtccgacctggttaagtacggcaactcctctcgagaccgctacgctaccactgatactgctaagaatagcaataatgagaaatttatcggtgatgagaaagacaagagacctgggtcactggagacgtgtcggcgggaaagtaatccgcgccagaatcaggagtttagctttggaaatctgcgggccaagtttctgcgtccttccgatgacgaagaactcagcttccacagcaagggacggaaattcgagcccctgtcatcctcttccgcccttgtcgcccaggggagcctgtgtagtggttttcgtaagcctacaaaaaattctgaggagcgactcacctcttggagcagaagcgatggacgcggcgataagaaacattctaaccagaaaccttcagagacaagcaccgatgaacaccagcacgtccccgaggatccccgcgagaaatcacaggacgaggtgctgagggacgatcctcctaagaaagagcatttacgcgacacaaagagcactttcgccggctctcctgagcgagaaagtattcacatattgtccgttgacgagaagaacaagctgggggcaaaaataatcaaggccgagatgatggggaacatggaactagctgagcaactgaaggtgcagttggaaaaagccaacaagtttaaggaaactatcacccagatccccaaaaagtcaggggtggaaaatgaggatcagcaagaagttattctcgttagaaccgaccagagcggcagagtatggcctgttaataccccggggaagagtttggaatcacaaggcggtcggagaaagagacaaatggtgtctacccacgaggaacgagaacgtgtgcgttacttccacgatgatgacaatctgagtctcaacgacctggtgaaaaacgagaaaatggggactgcagagaatcaaaataagctgttcatgcggatggcctcaaagttcatgggaaagacagatggggattactacaccttagacgatatgttcgtctctaaggctgccgaaagggaaagacttggcgaagaggaggaaaatcagagaaagaaggcaattgcagagcaccgcagcctagccgcacagatggaaaagtgcctgtactgcttcgatagctctcagttccctaagcacctgatcgtggcaataggagtgaaagtttatttgtgtttaccaaatgttaggagcctcaccgaaggccattgtctgatcgtaccactgcagcatcacagggcagccacacttctcgatgaggacatctgggaagagatccagattaagagccgaacagtcatacagtag

SEQ ID NO: 29022 - DNA, 207 bp, Artificial Sequence
  Description of Artificial Sequence: Synthetic coding sequence
atgccccagaaagacccatgtcagaaacaagcctgtgaaatacagaagtgtttgcaggctaactcctacatggaaagtaaatgccaggccgttatacaggaactcaggaagtgctgcgcccaatatcccaaaggacggtcagtagtgtgctccggattcgagaaggaggaagaagaaaatctgacacgcaagagtgcgtcgaaatag

SEQ ID NO: 29023 - DNA, 1311 bp, Artificial Sequence
  Description of Artificial Sequence: Synthetic coding sequence
atgcctatgtctagtttgcctgccgcgattttgagccacatgacagccataaacaacgtgccaccccccccacttcactctattcccaacctgaagaagtccaagcacattaactacggtcagttgaacgccctctgccatatacgaggccaacacagccgatcaatgtcgaatatcctatcagcccatgatacgtttatgaagcaataccctaaggtgttcctgcaccagaaacccagactcccaaagttgttcaaacaggaggaacaaagagagctgaacgaaggaaaggaagaatctcagcatcagcagccggatgatagcaacaatattgccgtacacgtccagagggcccatggcggtcacatcctgtaccggccaaagagggccacagagaaattcgaggaatttctggccattctgaagaaactgcccatccaccggacgccctacgagcataagacggtgtggaaattcctcaaaaccatccccgacctgacttttcagttgaatgataaacatctgaagacgctgagtaaaaccgtcttcagcgaaacttggctgaaaggttcaacagttgtggcgaatgacggcttctatgtgatcctaaaaggcctggcccgcccccagacgaacgtgtataaaaatcttattgaaggatccgatagtccagacagtttcattagccaatcttttcacagcttcatctggtccgaagagttcaaaaattccaccctggccgaaatgtatctccccagctacgacagcatgttgagcaagtggagcaccttcggtactctggaagtgatgccacagaacgaatccgagacacagatgttctcggttgttaccgaggacgactgcgaaatcctcaagatccccgctaaagggtatgctaaaattaaggaagagaaaatcaagctcgaaaatatgcagaaactgaagttaattcggatgtgtccctactatgaagagtggcccacattgagcatttatgagctcattgccctccttaagtggaaaaaatttccccccggacacgtgattgtagagtccggtaacattatctcctttgtagggtatataaactctggctgttgcaatatttacaggtccataattggattcgtgaagctgcgcagtaataaagtgaagagaagtcaaaaactcgtgtacatggggaaactgaaggagaaagagtccttcggggagatcagcgtgttgcttcaggtcccattcacatgtaccatcattacaaagaaagaagtggaaatggcaattattgaggacaaggacctgttcgtggcatag

SEQ ID NO: 29024 - DNA, 876 bp, Artificial Sequence
  Description of Artificial Sequence: Synthetic coding sequence
atgctgttgccacttcctccccagtcgtctaaacctgtcccaaaaaagtcacagagctcgaagatagtcccctcccatcacgacccgtccgaaaaaacgggcgagaattgccaaacgaaaataagcccatcttccctccaagaaagtccatcttccctccaaggtgccctgaagaagcggagcgcattcgaggacctcacaaatgtaagttttgaaatgacccatgagacactctatctggcagtgaagctggtggacctctatttaatgaaagctgtctgtaaaaaagataaactacagctcttgggagcgacagcctttatgatagccgcgaaattcgaagaacacaactcaccccgggttgatgatttcgtttacatttgcgatgacaattaccagcgttccgaagttctgtccatggagatcaacatactcaatgttctgaaatgcgatataaacatcccaatcgcgtatcactttctgcgtaggtacgcacggtgtatccacaccaacatgaaaacgctgacactctccagatatatttgcgagatgactttgcaagaataccactatgtccaagagaaggccagcaaacttgcagccgcgtctctgctgttggccctttatatgaagaagttagggtattgggtcccatttttagagcattactcgggctacagcatttcagaattacaccccttggttcgccaactgaacaagctactaactttcagctcatacgactctttgaaagccgtgtactacaagtattctcatcccgtgttctttgaggtcgctaagatccccgctctcgacatgctgaaactcgaggagatcctgaactgcgattgcgaggcccagggactggtgttgtag

SEQ ID NO: 29025 - DNA, 4188 bp, Artificial Sequence
  Description of Artificial Sequence: Synthetic coding sequence
atgctgctgcctcttcccccccagtctagcaaacccgtgcctaaaaagagtcagtcctctaaaatcgtgccatcacatcatgatcccagcgagaagactggcgagaactgccaaaccaagatcagcccaagtagtctgcaagagtccccttcctcccttcagggcgctctgaaaaagcgaagtgcattcgaggatctcacgaacgccagccagtgtcagccagtgcaacctaaaaaagaggccaataaggaattcgtgaaagtggtaagcaaaaagattaacaggaatacccacgcgctgggcttggctaaaaaaaacaaacgcaatctcaaatggcacaagctggaggtcacccccgtggtggccagcacaaccgtcgtcccaaatatcatggagaagcctctgatcctcgatatttccaccacttccaaaactccaaataccgaagaagcatcgctgtttcggaagccactggtgctgaaagaggaacccacgatcgaggacgagaccctcattaataaatcattgtccctaaagaaatgttcaaaccacgaggaagtgtctctgcttgaaaaactccagccattgcaggaggagtccgacagtgacgacgcattcgtgatcgagcctatgacctttaagaaaacgcacaagaccgaggaggcggctataaccaagaaaactctgagcctgaagaagaaaatgtgcgcctcccagcgcaagcaaagctgtcaagaagaatccctagctgttcaggatgtcaacatggaggaagattccttcttcatggagtcgatgtcgtttaaaaaaaagccaaaaacagaggagagtatcccgacacacaagctgtcatctctcaagaaaaagtgcacaatctatgggaagatctgtcattttcgtaaacctcctgtgttgcagacaacaatctgcggcgctatgtcttccattaaaaaacccacaacggagaaagaaaccctcttccaagagctgtctgttttacaggagaagcatactacagaacacgagatgtctatcctgaagaagtccctcgctcttcagaagaccaattttaaagaagactccctcgtcaaggaatctttggcgttcaagaaaaagcccagtacagaggaagccatcatgatgccagtcatcctcaaagaacagtgtatgaccgaaggcaagcgatctcggctcaagccactcgtcttgcaagagataacctctggggaaaaaagcctgattatgaaacctctgagtattaaggagaaacccagcactgagaaggaatcctttagtcaggagccatccgcgctccagaaaaagcatacaacgcaggaagaggtctcaatactcaaggagccatcctctctgctaaagtctccgaccgaggagagtccttttgacgaggctctggcctttactaagaagtgtactatcgaggaggctccccccaccaaaaagccactgatcctcaaaagaaagcatgccactcagggcaccatgtctcatttgaagaagccactaattttgcaaactacgagtggggagaagtcgcttatcaaggagcccttgcccttcaaagaagagaaagtgtccctgaaaaaaaaatgtactactcaggaaatgatgtcaatctgccctgagctcctcgatttccaggatatgattggagaggacaaaaactctttcttcatggagccgatgagcttccgcaagaacccaaccacagaggagaccgttctgaccaagacgtccctgtccctccaagaaaagaagatcactcagggaaagatgtcccatttaaaaaagccactagtgctccaaaagataacatcagaggaagagagcttctacaagaagctgctaccgttcaagatgaagtctactaccgaagagaagttcctgtctcaagagcccagcgccctgaaggaaaagcacacaactctgcaggaggtaagcctctccaaagaatcccttgccatccaagagaaagctaccacagaggaagagttcagccaggaattgttttccctgcatgtcaagcatactaataagagcggcagcttatttcaggaggctctagtcctccaggagaagacagacgccgaggaggatagcctcaaaaaccttctcgcgctgcaggaaaagagtacaatggaggaggagtctctgataaataagttactcgccctgaaagaggagcttagtgcggaagctgctactaatattcagactcagctcagtctcaagaaaaaatcaacttcccatggaaaggtgttctttctgaagaaacagcttgcgcttaacgaaaccatcaacgaggaagagttcctgaacaaacagcccctcgccctggaaggctatccaagtatcgctgagggggagaccctgtttaaaaagctgctcgccatgcaagaagagccatccattgaaaaggaagctgtacttaaggaaccaactatagatacggaggcccacttcaaggagcccctggctctgcaagaagaacctagcaccgaaaaagaggccgtgctgaaggagccaagtgtcgacacagaggcacacttcaaagagacccttgcactgcaggagaaacccagcattgaacaggaggctctgttcaagcgccattcggcactgtgggagaagcccagcactgagaaggagaccattttcaaggagtcgctggacctgcaggagaagccctccattaagaaagagaccctcctgaagaagcctctcgcgctgaaaatgtctacaataaacgaagctgtcctcttcgaggatatgatcgctctcaacgaaaagccgacaactggtaaagaacttagcttcaaggaacccttggccttgcaggagagtcctacctataaggaggacactttcctaaaaacactgctcgtgccccaggtaggaaccagccctaacgtgtctagcacggctcctgaatccatcacatcgaagtctagtattgccactatgaccagcgtgggcaaatctgggaccatcaatgaggcttttctctttgaggatatgatcaccctgaacgagaagccaaccacaggcaaggagctgagcttcaaggagccccttgctcttcaagaaagcccaacctgcaaggaagataccttcttagagaccttcctcatccctcaaataggcacaagcccttatgtattctccaccactcccgagagcataactgaaaaaagctcaatcgcgaccatgaccagcgtgggcaaaagtcgcactaccacagaatcatctgcttgcgaatccgccagcgataaacccgtgtcgccccaggcgaagggaacaccgaaggagataactcctcgagaagacatcgacgaagactcatctgatccgagttttaatccaatgtacgcgaaggaaatctttagctacatgaaagaacgggaagaacagttcatcctcaccgattacatgaataggcagatcgagatcacgtctgatatgcgtgcaatactggtcgattggttggtagaggtccaagtcagtttcgagatgacacacgagacactctatctggctgtaaaattagtggacctctatcttatgaaggccgtgtgcaagaaagataaattacagcttttgggtgccaccgctttcatgattgccgccaagttcgaggaacacaattctcccagggtggatgattttgtgtatatatgcgacgacaactatcaaagaagcgaggtgctctctatggagattaatatactgaacgtgcttaagtgcgacattaacatacctatcgcctaccatttcttacgcaggtacgctaggtgtattcacaccaacatgaagacgctgaccctgtctaggtatatttgcgaaatgacactccaggagtaccactatgttcaggagaaggctagtaagctcgcggccgcgagcctgcttcttgcgttatacatgaagaagttgggttattgggtacccttcctggaacactattctggatactcaatttctgagctgcaccccctggtgcgtcagctcaataagctgcttaccttcagttcatatgattctctaaaagctgtgtattataaatattctcaccccgtcttttttgaggtggccaagattccggccctggacatgttaaagctcgaggagatcctcaactgtgactgtgaagcacagggcttggttctttag

SEQ ID NO: 29026 - DNA, 4188 bp, Artificial Sequence
  Description of Artificial Sequence: Synthetic coding sequence
atgcttctgcccctgcccccgcaaagctctaagcctgtgccaaaaaagagccagagcagtaagatcgtcccctctcatcacgatccttcagaaaagacgggcgagaattgtcaaacaaaaatatctccttcaagtctgcaagagtctccatcttccttgcagggcgcacttaagaaacgcagcgcctttgaggacctgacaaacgctagtcagtgtcagcccgtacagcccaagaaagaagccaataaggaattcgttaaggtggtgagcaagaaaatcaaccgaaatacacacgccctgggactggccaagaagaataaacggaacttgaagtggcataagctggaggtcacaccagtcgtggctagcacaacggtggtgcctaatataatggaaaaaccactgatactcgacatctccactacatccaagacccccaacacggaggaggcctcattgttccgcaagccactagtgctaaaagaagaaccgacgattgaagatgagacgttgatcaataagtctctcagtcttaaaaaatgtagcaaccacgaagaagtctcacttctggagaagctccagcctctgcaggaggagtctgattcagacgacgcttttgtgatcgagccaatgacatttaagaaaacccacaaaactgaagaggcagcgattaccaagaagacgctgtccttgaaaaagaaaatgtgcgcatcgcagcgtaagcaaagctgccaggaggagagtctggcagtgcaggacgtgaacatggaggaggatagtttctttatggagagcatgagcttcaagaaaaagcccaaaacagaggaatcaattcccacgcataagctaagctccctcaagaaaaagtgtactatatacggcaagatctgtcactttagaaagcctcctgtgctacagacaacaatatgcggcgccatgtcttctattaaaaaacctactaccgagaaagaaaccctgttccaggagttgtccgtactgcaagagaaacacacgaccgagcacgaaatgtccatactcaaaaaaagtctcgccctgcagaagaccaattttaaagaggactctttggtgaaggagagcctggccttcaaaaagaaaccaagtaccgaagaagccataatgatgcctgtgatcctgaaggaacagtgtatgaccgagggaaagcgaagtagactgaagccactggtgcttcaagaaatcacttctggtgagaagtcactgatcatgaaacctctgagtattaaggagaagccctccaccgaaaaggaatccttctcacaggaacccagcgctctgcagaagaaacacacgacgcaagaagaggtttccatcctgaaagaacctagctctcttcttaaatctcctacggaggagtcacccttcgacgaggctctggcctttactaaaaagtgcacaattgaggaagcacccccaacaaagaagcccctaatattgaagagaaaacacgcgacccagggtaccatgagccacctgaaaaaacccttgattctgcagacgacctccggggagaaaagtctgattaaagaaccattaccattcaaagaggaaaaagtgtcattaaagaagaaatgtacaactcaggagatgatgtcaatctgtcccgagttgctggacttccaggatatgatcggggaagataagaattcattcttcatggaaccaatgtccttccggaagaaccctaccacggaggaaactgtcctcacaaagacaagcctcagtctccaggagaagaaaatcactcagggtaaaatgtcacatctaaaaaaacccctggttctgcaaaagataacctccgaggaggaatctttttacaaaaaactgcttccttttaagatgaagagcaccacagaagagaagttcctgtcacaggaaccatccgcacttaaagagaagcacactactctccaggaagtgtcactcagcaaggagagtttggcaatccaggaaaaagccacgacagaagaggaattctctcaggaattgttctccttgcacgtcaagcacactaataaatccggaagcctgttccaggaggcattagtgttacaagaaaagacggatgccgaggaggactccctgaaaaatttgctggccctgcaggagaaatccactatggaggaagagagcctaatcaataaactcctggccttgaaggaggaactgagcgccgaggcagccaccaacatccagactcagttgtccttgaagaagaaaagcacatcacacggaaaggtctttttcctcaaaaagcagctagccctgaacgagactatcaacgaagaagaatttcttaacaaacagccattggcactggagggatatccctctatagcagaaggcgagacattatttaaaaagttgcttgctatgcaggaagagccgtctatcgagaaagaagccgtgttgaaagaaccaacaattgatacagaagctcactttaaagagcctttggcactccaggaggaacctagtaccgagaaggaggccgtactcaaagagccctcagtggatacggaagcccattttaaggaaacactcgccctccaagagaagcccagcatagagcaggaggccctgttcaaaagacacagcgctctttgggaaaagccatcaaccgaaaaggaaacaatctttaaagaaagtttggatcttcaggagaaaccttccatcaagaaggagaccctgctgaagaaacctctcgctctcaagatgtccaccataaacgaggctgtactgtttgaggacatgattgcactcaacgagaaacctacaacaggaaaagagttgagttttaaggagcctctggccctccaggaatcacctacctataaggaggacaccttcctgaaaacactccttgtacctcaagtgggtacatctcctaacgtcagttccaccgcccccgagtctatcacatccaaaagttcaattgccacaatgacttccgtgggcaaatcagggactattaacgaggctttcttgtttgaagatatgatcacacttaacgagaaacccacgaccgggaaggagctgtcattcaaagagcccctggccctccaggaaagcccaacttgcaaagaggacaccttcctcgagaccttcctcattcctcagatcggaacctccccttacgtgtttagcaccacaccagagtcaatcacggagaagagctcaatagcaactatgacaagtgtgggaaagagccgcacaaccaccgaatcatcagcttgtgaaagcgccagtgataagcccgtgtcaccacaggcaaaaggtacacccaaggaaatcacaccgcgagaagatatagatgaagatagcagcgaccccagttttaacccaatgtatgctaaggagatcttctcatatatgaaagaaagagaagaacaattcatcttgacagactacatgaacagacagatcgagattacaagcgacatgcgcgcaatcctggtcgactggctggttgaagtccaagtcagcttcgagatgacccacgaaaccctgtatcttgccgtgaaactcgtagacctgtacctgatgaaggcagtgtgcaagaaggacaagttacaactgctgggtgcgactgcctttatgatcgcggcaaagttcgaagaacacaatagcccgcgggtcgacgatttcgtgtatatttgcgacgacaattaccagagatcagaggtgttgtccatggagattaacatcctcaacgtcctaaaatgcgacattaacatcccgatagcttatcactttttgcggcgttacgcccggtgtattcataccaatatgaaaaccctgacactttcgcgatacatctgcgaaatgacactgcaggaataccactatgtccaggagaaagcatcaaaattagccgctgcatctctcctcctcgccctgtatatgaagaaactgggatactgggtcccctttttagagcattacagcggctactccattagcgaattgcaccctcttgtcagacagctgaacaagctgctcaccttctcttcttacgattctctgaaggctgtctattataagtacagccacccagtgttttttgaagtggccaagatcccggcactggacatgctaaagctcgaagagattttgaactgcgactgtgaagcccagggtctggtgctctag

SEQ ID NO: 29027 - DNA, 4188 bp, Artificial Sequence
  Description of Artificial Sequence: Synthetic coding sequence
atgctcctgcctctccccccacagtcatccaaacccgtgcctaaaaagtcccagagcagcaagatcgtgccctcccatcacgatccatccgaaaaaactggtgagaattgccagaccaaaatttctccaagctccctccaggagagcccctcttcactgcagggcgctctcaagaagcgttcagccttcgaggacttgaccaacgcctcccagtgtcagcctgtccagcccaagaaggaggctaataaagaattcgtgaaagtggtctctaaaaagattaacagaaacacacatgccctgggattagccaaaaaaaacaagcgcaacctgaagtggcataagctggaggtgacgcccgtagtagcctccacaacagttgtgcccaacatcatggagaagccattgatccttgacatttcgacaacctccaagactcctaatacagaggaggcatctcttttccggaaacctctcgtacttaaggaggagcccaccattgaggacgagaccctgatcaacaagagtctaagcctgaaaaagtgtagcaatcacgaggaggtcagcctgctggaaaaactgcagccgctccaagaggagtccgattccgacgacgctttcgtgattgaacctatgactttcaagaagactcacaagacagaggaggctgctataacgaagaagacattaagcttgaaaaagaaaatgtgcgcatcccagcgaaaacaaagctgccaggaggaaagtctggccgtccaggacgtaaacatggaggaagattcgttctttatggagagcatgtcattcaagaaaaaaccaaaaaccgaagagagtatccctacccataaactctcaagcttaaagaaaaaatgtacgatatatgggaaaatttgccactttaggaaacccccagttctgcagacaaccatctgcggggcgatgagcagtattaagaaaccgacgaccgaaaaagaaactctgtttcaggaactgagcgtgctgcaagagaaacatactacggagcacgagatgtctatcctgaagaaatctttagctctccagaagacgaacttcaaggaggacagtctggtaaaggagagcctggcatttaagaaaaaacccagcacagaggaagctatcatgatgccagtaatccttaaggagcagtgcatgacagagggcaagcgctcacgattaaaacctctggtgcttcaggagataacctctggcgagaaatcccttatcatgaaacctttatccatcaaggagaagccatctacagagaaagaaagcttctcccaagagccctcagccctgcaaaaaaaacacaccacccaggaagaggtgtcaattctcaaggagccttcctccttgttgaaatctcccactgaggagagcccttttgacgaagctctcgcctttactaagaaatgcacaatagaggaagcccctcctactaaaaagcccctcatccttaagcggaagcatgccacccaaggtactatgtcgcatttaaagaagcccttaatccttcagacaacgtctggtgagaagtcacttataaaggagccattgccttttaaggaggagaaagttagtctgaaaaaaaagtgtaccacacaggaaatgatgtcgatttgccccgagctgttggacttccaagatatgatcggtgaggataagaactcctttttcatggagcctatgtcattccggaaaaatcccaccaccgaggaaaccgtgctaactaaaaccagcctctcactgcaagagaagaagatcacccagggcaagatgtctcacctgaagaaaccacttgttctgcaaaagataaccagtgaagaggagtctttttataaaaaactgctgccatttaagatgaagagtacaaccgaggagaaattcctcagccaggaaccgagtgctttaaaggaaaaacacacaacgcttcaggaagtgtctctgtccaaggaatctctcgctatccaggagaaggctacgaccgaggaggaattttcacaggagttgtttagtctgcacgtcaagcacacaaacaagagtggcagcctttttcaggaggccttggtcctgcaggaaaagacggacgcagaggaggacagtctaaagaacctcctggcgctccaggagaagtccaccatggaggaagagagtttaatcaacaaattattagctctgaaagaggaactctcggctgaggctgctacaaatattcagacccagctctctctgaaaaaaaagtctaccagtcatgggaaagtctttttcctgaagaaacaactggcccttaatgaaaccatcaacgaggaggaatttctgaacaagcagcctctggcccttgaaggatatcccagcattgctgaaggtgaaaccctttttaagaaactccttgctatgcaggaagaacccagcattgaaaaggaagccgtgttgaaggagccaactattgatactgaggcccacttcaaggagccgttggccctccaggaggagccgagtactgaaaaggaggctgtactcaaggagccgagtgtggacactgaagctcacttcaaagagacactcgccttgcaggaaaaaccatcgatagagcaggaggctttattcaaacggcacagcgcattgtgggagaaaccgtcgactgagaaggagacaatcttcaaagagtctctcgacctccaggagaagccctcaatcaaaaaggagactctgttgaagaaacctctggccttgaagatgtccacaatcaacgaagctgtgctcttcgaggacatgatcgcccttaacgaaaagccaacaaccggaaaggagttgagttttaaagaacccctggctttgcaagagtctccaacttataaggaagacactttcctgaagactttgctcgtcccacaggtgggcacgagccccaatgtctcatcaaccgccccagaaagtattacgagtaaatcatcaattgccaccatgaccagcgtgggaaagagcggtaccattaacgaagccttcctgttcgaggatatgataactcttaatgagaagcccacgaccgggaaagagctcagctttaaggaacctctggccctgcaggagtctccaacttgcaaagaagacacattcttggaaactttcctgatcccgcaaatcggtacttcaccatacgtgtttagtaccaccccagaatctataaccgagaagagctcaattgcaacaatgacctccgtcggcaaaagtagaacaaccactgaaagctccgcttgcgagtccgcaagcgacaagcccgtttctccgcaagccaaaggaacacccaaggaaattacgccccgcgaagatatcgatgaagactcttcagatccaagctttaatcccatgtatgccaaagagattttctcctacatgaaagagcgcgaagagcaatttatcctgacagattacatgaatcgccagattgagatcaccagtgatatgagggcgatacttgttgactggttggtcgaggttcaggttagctttgaaatgactcacgagacactgtaccttgccgtaaagctggtcgatttgtacttgatgaaagctgtatgcaaaaaagacaagcttcagctgttaggtgctactgcattcatgattgccgctaaatttgaagagcataacagccccagagtggacgattttgtgtacatctgtgatgacaactaccagaggtccgaagtgctgtcaatggaaattaacatactgaacgtccttaaatgtgacatcaacattcccattgcctaccactttctgcgtcggtacgcaaggtgtattcacaccaatatgaaaacactcacactcagcaggtatatctgcgaaatgacactgcaggagtaccactatgtgcaagagaaggccagtaagctagcagccgcttcgctgctgttggcattgtacatgaagaaattggggtattgggtccctttccttgagcactattctggttactccatctccgaactccacccactcgtgcgacagctaaataaattgttgaccttctcatcctacgactcgcttaaggctgtatactataagtactcccaccccgtcttctttgaagtggctaagattcccgcactggacatgctaaaactagaggagatcctgaattgcgactgtgaagcgcaaggtctggttctgtag

SEQ ID NO: 29028 - DNA, 876 bp, Artificial Sequence
  Description of Artificial Sequence: Synthetic coding sequence
atgctcctcccactccctccgcaatcatccaagcccgtgccaaaaaagagccagtccagcaaaattgtaccgtcccaccacgacccatccgagaagacaggagagaactgtcaaaccaaaatttcacccagttcgctacaggagtccccctcgagtcttcaaggcgccctgaaaaaaaggtccgcttttgaggatctcacaaacgtttcttttgagatgacacacgagaccctctacctggccgttaaactggtggacttgtacctaatgaaggccgtctgtaagaaggacaaacttcaattgttgggagcgaccgccttcatgattgccgccaagtttgaggaacataacagtcctcgagtcgacgacttcgtctacatttgtgatgacaactaccagaggtccgaggtcctgtctatggaaattaacatcctcaatgttcttaagtgcgacatcaacattcccattgcatatcactttctccgccggtatgcccgatgcatccatacaaacatgaaaactctaaccctgagtcgctacatctgcgagatgaccctccaggaatatcattatgtccaggaaaaagcttctaagctggctgctgccagtctgctgctggcgctgtatatgaagaagctggggtattgggtccctttcctggagcattactcagggtatagcatctccgagcttcacccactcgtgcgtcaactcaataaactgcttacgttctcctcatatgattctttgaaggcagtgtattataagtatagccatccagtcttcttcgaagtggctaagattcccgcattggatatgttgaagctagaggagatcttaaactgcgattgtgaggcccaagggttggttctgtag

SEQ ID NO: 29029 - DNA, 4188 bp, Artificial Sequence
  Description of Artificial Sequence: Synthetic coding sequence
atgctgctcccactccctccacaatcatccaaaccggtgcctaaaaaaagccagtcctcaaaaattgtgccctcccaccacgaccctagtgagaaaacaggagagaactgtcagaccaagatttctccttctagtctacaggaatccccctccagcctgcagggcgctcttaaaaagaggtctgcttttgaggatttaacaaatgcaagccagtgccagcccgttcagcctaaaaaggaagccaataaggagttcgtgaaggtggttagcaaaaagataaaccgtaacacgcacgccctggggctggcaaagaagaacaaaaggaatctcaagtggcacaagcttgaggttaccccagtggttgcctccacaactgtggttcctaacatcatggagaagcccctgatactcgatatcagtactacgagcaaaacccccaacaccgaggaggcatccctgtttagaaaacctcttgtgttgaaggaggagccgacgatcgaggatgaaactctcatcaataaaagcttaagtctgaagaagtgtagcaaccacgaggaggtgtccctgctagagaagcttcagcctctgcaggaagagtcggattcagatgatgcattcgtgattgaacctatgacctttaaaaaaacacacaaaactgaggaggccgccatcaccaagaaaactctgtctctgaagaaaaaaatgtgcgcgtcacaaagaaagcaaagttgccaggaagagtccctggccgtccaggacgtgaacatggaagaggattcctttttcatggaatcaatgtcttttaagaaaaagcccaaaaccgaagagagcattccgactcacaaactctccagtctgaaaaaaaagtgtacaatatacggcaagatctgtcactttcggaagccacccgtcctgcagactactatttgtggagccatgtcctccatcaagaaacccactacagagaaggaaactctgttccaggaactgtctgtgctccaagagaagcacaccaccgagcacgagatgagcattctgaaaaagagtctggccctgcaaaaaacgaatttcaaagaagatagccttgtgaaggagagtttagcctttaagaagaagcccagtactgaagaagctatcatgatgcccgtaatccttaaggagcaatgcatgacagagggaaagagaagccgcttaaagccactcgtgctgcaggagattacctccggcgagaaatctttgatcatgaaacccctctccatcaaagagaaaccatccacggagaaagagtcattctctcaggaacccagcgccctccagaaaaaacacaccacacaagaggaggtgagcatcctgaaggagcccagctccctgctgaagtccccgacagaagagagtccttttgatgaggccctggcttttacgaaaaagtgcacaattgaggaggcccctccgacgaagaagccacttattctgaagcggaagcacgctacccagggcaccatgagtcacctgaaaaagcccctgatccttcagacaacaagcggggaaaaatccctcatcaaggagcctctgccattcaaggaagagaaggtcagcctgaagaaaaagtgtaccacacaggagatgatgagcatttgtccagagttactggacttccaggatatgatcggcgaggataaaaattcattcttcatggaacctatgtcgttcaggaagaaccccactacagaggagaccgtgctcacgaaaaccagcttgagtctccaggaaaaaaagatcacccagggaaaaatgagtcacctgaagaagccactggtcctgcagaagattacgagcgaggaggaatctttctacaaaaaactgctacctttcaagatgaagtccactactgaagagaagtttctaagccaggagcctagtgccctgaaggagaaacataccaccctgcaggaggtaagcctcagcaaggaatccttagcgattcaagagaaagccacgactgaggaagagttctctcaggaactcttctcactccacgtgaagcatactaataaatcaggtagcctctttcaagaggctttagttctgcaggaaaaaaccgacgcggaggaggactccctgaaaaacctgctggcccttcaagagaaatctacaatggaggaagaatcgttaatcaataaactgcttgcactaaaagaagagctgagcgccgaagccgcaaccaacatacagactcaactgtccctcaagaagaagtctacgtctcatggcaaggtgttttttttgaaaaagcagctggccctcaatgaaactataaacgaggaggagtttctgaacaagcagcctctggccttggagggctatccttctatcgctgaaggggaaacattgttcaagaagctgctggcaatgcaggaggaaccgtcaattgagaaggaagctgtcctcaaggagccaacgattgataccgaggctcactttaaagaaccactggccttgcaagaggaaccttctaccgaaaaagaagcagttcttaaggagccatccgttgacactgaagcgcattttaaggagactctggcacttcaagaaaaaccttctattgaacaagaggctcttttcaaacggcattctgcactgtgggaaaaacctagcacagaaaaagaaactatctttaaggaatcgcttgatctgcaggaaaagcctagcatcaagaaagagacactgcttaaaaagcccctcgccttgaaaatgagtacgatcaacgaggcagtgctctttgaggacatgatcgccctgaatgagaagccgactaccgggaaggagctctctttcaaggaaccgctagccctccaggagtccccaacttacaaagaggataccttcctgaagacattgttggtgcctcaggtcgggactagtccgaacgtgtcatccactgcgcctgagagtataacatcaaagtcaagtatagccacaatgacctctgtgggaaagtcaggtaccattaatgaggcctttctgttcgaggacatgattactctgaatgaaaagccaaccactgggaaagaattgtccttcaaagaaccactggcacttcaggagagccctacatgcaaagaggacacctttctggagacattcctcattcctcagattggcacaagcccatacgtatttagcacaactcccgagtctatcaccgaaaagagctccatagcgaccatgacctcagtaggtaagagtcgtacaactaccgaatcaagcgcctgtgaatctgctagcgataagcctgtatccccacaggcaaaaggcacaccaaaagagatcactcctcgggaggacatcgacgaggacagctccgatcccagcttcaatcccatgtacgctaaagaaattttttcttatatgaaagaaagagaggagcagtttatactgaccgattatatgaacagacaaattgagataacttccgacatgcgggccatacttgtggactggttggtggaggttcaggtctcatttgagatgactcacgaaacgctctacctggccgtaaagctggtagatctctatctgatgaaggccgtgtgcaagaaggataagttgcagctcctcggggcgaccgccttcatgatcgccgctaagttcgaggaacacaattcgcctagggtggatgacttcgtctatatatgtgatgacaattaccagcgctctgaagtcctgtccatggagatcaacattttaaatgtcctgaagtgtgatatcaacatccccatagcctaccacttcctcaggcgttatgcaaggtgtatacatacaaatatgaagactctgacattgagcagatacatatgtgaaatgacccttcaggagtatcattatgtccaggagaaagcatctaagctggccgccgctagtctcttgctggcgctttacatgaagaaactggggtattgggtgccatttctggaacactattccggttacagtatctctgaactgcatccgctggtgcggcagttgaataagctgcttacattttcatcttatgactctttaaaggctgtatattacaagtattcccatccggttttcttcgaggtggctaaaattcctgctttggatatgctgaagctggaggagatcctcaactgcgattgcgaagcccagggcctggtgctctag

SEQ ID NO: 29030 - DNA, 876 bp, Artificial Sequence
  Description of Artificial Sequence: Synthetic coding sequence
atgcttcttccgctccctccacaaagcagcaagccagtgcccaagaagagccagtccagtaagattgtgccttcccaccatgaccccagtgagaagacaggggaaaactgccagacaaaaatatctccctcaagcctacaagagagcccctcatccttacaaggagctttgaagaaacggagcgcctttgaggaccttacgaacgtgagtttcgagatgacacacgagacattgtatctggcagtcaagctggtcgatctgtacctaatgaaagccgtctgcaaaaaagacaagctgcaactgctgggagctacggctttcatgatcgcggctaagtttgaggaacataactccccaagagtcgacgatttcgtgtacatttgcgatgacaattaccagaggtccgaagtactatcgatggagattaatatactcaacgttctcaaatgtgatattaacatccctattgcctatcatttcctccgcagatacgccagatgtatccacactaatatgaagacactgacactgagccgctatatctgcgagatgacccttcaggagtaccactatgtccaagagaaagcaagtaagctggcagcagcgtcccttctgctcgccttgtacatgaaaaaactggggtattgggttcctttcctcgagcactattcaggctattccattagcgagcttcatcctctggtgcggcagctcaacaaacttttgactttcagttcctacgactccctcaaggctgtgtactacaaatactcccatcctgtattcttcgaggtcgctaagattcccgctctagacatgttaaagctggaagaaatcctcaattgcgactgtgaggcccagggactggtcctgtag

SEQ ID NO: 29031 - DNA, 876 bp, Artificial Sequence
  Description of Artificial Sequence: Synthetic coding sequence
atgcttctgcctctgcccccccagtcaagcaagccagtccccaagaaatctcaatctagcaaaattgtcccttcgcatcacgacccatcagagaaaactggcgagaactgccagactaagatctcgccctcctcccttcaagagtcaccttcctcactgcaaggggccttgaaaaaaagaagcgcgttcgaggatctgacaaacgtgagcttcgaaatgacccatgaaaccctgtacctggctgttaaactagtggatttgtaccttatgaaagccgtgtgcaagaaagacaagcttcaattgctgggagctacagcgttcatgatagctgctaaattcgaagagcacaactcaccacgcgtcgacgacttcgtgtatatctgtgatgacaactatcagagaagcgaagtgctgtccatggagatcaacattttaaatgtgttaaaatgcgatatcaatatcccaatcgcctatcacttcctgaggagatacgccagatgcatacatacgaatatgaaaaccttgacactcagtcgctatatctgcgagatgaccctccaggaatatcattacgtgcaggaaaaagcatccaaattggccgcggcttctttgcttctagcgctgtacatgaaaaagctgggctattgggtccctttcttagaacattactcaggttatagtatctccgagttgcacccccttgtgagacagttgaataaactgttgacgtttagctcgtacgatagcctgaaggccgtgtattacaaatacagccatccggtattctttgaagtagccaaaattccagctctggacatgcttaaactggaggaaattttgaattgcgattgcgaggcgcaggggctggtgttgtag

SEQ ID NO: 29032 - DNA, 1215 bp, Artificial Sequence
  Description of Artificial Sequence: Synthetic coding sequence
atgagcaggagaagtagccgcttacaggctaagcagcagcctcagccctcccaaaccgaatctccgcaggaggcccagataattcaggcaaaaaagaggaagaccacgcaggacgtgaagaagcggcgggaggaagtgaccaaaaaacaccagtacgagatccgtaattgttggcctcctgttctctcgggaggcatctccccctgtattattatagaaacccctcacaaggaaatcggcacaagcgatttctctcgttttaccaattataggtttaagaacctcttcattaatcctagccctttacctgatctgtcgtgggggtgtagcaaggaggtgtggctcaacatgctgaagaaggaatcaaggtacgtgcatgacaaacacttcgaagtgctccactccgacttggagccccaaatgcgctcaatacttcttgattggcttcttgaggtgtgtgaagtttacacgttgcacagagaaactttttacctcgcgcaggacttttttgatcgcttcatgcttacacagaaagacatcaataagaacatgctgcagctgattggtatcacatcactgttcatcgccagtaaactggaggaaatctatgctccaaaactacaagaattcgcttacgtaaccgatggagcatgctccgaggaagacattcttaggatggagctgatcattctgaaggccctgaagtgggaactttgtccagtgacaatcatcagctggctgaacttgttcctgcaagtggatgctctgaaggatgccccaaaggtgctgctgccacagtactcccaggaaacgtttattcagattgctcaactattggatctttgcattctggccatagactctctcgagttccaataccgtatactcacagccgctgccctctgccatttcacaagcattgaggttgtgaaaaaggcgtcggggcttgaatgggatagtatctccgaatgtgtggactggatggtgccattcgttaatgtcgtgaagtcaaccagtccagtcaaattgaagaccttcaaaaagatccccatggaagaccggcacaacatacagacgcatacaaactacctggccatgctggaagaagtgaattacattaacaccttccgaaagggaggacagctctccccggtatgtaacggcggaattatgacaccccccaaatcgaccgagaaacctccaggtaagcattag

SEQ ID NO: 29033 - DNA, 1125 bp, Artificial Sequence
  Description of Artificial Sequence: Synthetic coding sequence
atgagcagaagaagctcccgcttgcaggcaaagcagcagccccaaccgtcacaaaccgagtctccacaggaagcccagatcatccaggccaagaagagaaaaaccacgcaagatgtgaaaaagcggagggaagaggtcacaaaaaagcatcagtatgaaatcaggaactgctggccaccagttctgagcgggggcatttcaccctgcattattatcgaaaccccccacaaagagataggcacatctgacttcagccgatttaccaactaccgatttaagaacctctttatcaacccttcgcccctccccgacctatcctggggctgctctaaagaggtctggttaaacatgctgaagaaagagtctcgttatgtgcatgataaacacttcgaagtgctccactctgatttagagccacagatgagatcaatactgcttgactggttgcttgaggtgtgtgaggtgtatacattgcaccgggagacgttttacctcgctcaggacttttttgaccggtttatgcttactcagaaggacatcaataaaaacatgctccagttgatcggcattacatccctgttcatcgcctcgaaacttgaagaaatatacgctcctaagctgcaagaatttgcttatgtgaccgatggagcgtgtagcgaagaagacatactcagaatggaactgattatcctgaaagcattgaagtgggagctatgcccggtaacaataataagttggctaaatctgtttctccaggttgacgcgcttaaagacgcgccgaaagtcttactaccccagtatagccaggagaccttcatccagattgcccagctcctcgacctgtgcatcctggccatcgactcccttgagtttcaataccggatactcaccgcagccgccctttgccattttactagcattgaggtggtcaaaaaggcctctggactcgaatgggatagcatctctgagtgtgttgactggatggtgccttttgtcaatgtggtgaaatctactagcccggtcaagttgaagacatttaaaaaaattccaatggaagatagacacaacattcagacccacacaaattatctcgctatgctctgtatgatttcgagccatgtttag

SEQ ID NO: 29034 - DNA, 1215 bp, Artificial Sequence
  Description of Artificial Sequence: Synthetic coding sequence
atgtctcgcagaagtagccgcctgcaggcaaaacaacagccgcagcctagccagacagagagcccccaggaggcccagatcatccaggctaaaaagcggaagactacgcaggacgtaaaaaaaagaagggaagaagtcacaaagaaacatcagtatgagatccggaattgttggcctcctgtgctgtctgggggaatctccccttgtataattattgaaaccccccacaaggaaattggcaccagtgacttcagtaggtttacaaattacagatttaagaatctgttcataaacccgagccctcttcccgatctgagttgggggtgttccaaggaagtgtggcttaacatgctgaagaaggagagtcgctacgtccacgacaagcattttgaggtcctccacagcgaccttgaacctcagatgcgcagcatcctgttggattggctgctggaggtctgcgaagtgtacacccttcaccgcgagacgttttaccttgctcaggatttttttgatagatttatgttaactcagaaagatattaataaaaacatgcttcagctgataggaattacaagccttttcatcgcttccaaactcgaagagatttatgctcctaaactgcaggaattcgcctatgtcacagatggcgcatgcagcgaggaggatattcttcggatggaactcattatcctgaaagcactgaagtgggagctgtgcccagtgactatcattagttggctcaatctgttcctgcaggtcgacgccctgaaagacgctccaaaggtattgcttcctcagtacagccaggagacattcatacagatcgcccagcttctggatctatgtattctcgccatcgacagccttgagtttcagtaccggatcctcaccgcagctgccctttgccattttacttctatcgaagtcgttaaaaaagccagcgggctggaatgggactccattagtgagtgtgtcgattggatggttccatttgttaatgttgtcaagagcacaagcccagtgaagttaaaaacattcaagaaaatccccatggaagaccgccataatattcagactcacactaactatctggcaatgctcgaggaggttaactatatcaacacttttaggaagggaggacagttatcgccggtgtgcaacggcgggataatgacaccacccaagagtaccgaaaaacccccaggaaagcactag

SEQ ID NO: 29035 - DNA, 891 bp, Artificial Sequence
  Description of Artificial Sequence: Synthetic coding sequence
atgtccaaggaagtgtggctcaacatgctgaaaaaggaaagccgctacgtgcatgataaacattttgaagtactccacagtgatctagagccccagatgcggagcatcctgctcgactggctgcttgaggtctgtgaagtttacactttgcaccgcgaaactttttacctcgcccaggacttttttgaccgcttcatgctgacgcaaaaggacattaacaagaacatgctgcaacttatagggataaccagcctttttatagcctctaaactggaggaaatctacgcccctaaactgcaagagtttgcctacgtcactgacggggcttgttcagaggaggacattctgcgaatggaactgataattctcaaagcactgaagtgggagttatgtcccgtgacaatcatctcctggctcaatttatttttacaagtggacgccctgaaggatgcccctaaagtgctgttaccacagtacagccaagagaccttcatccagatcgctcagctcctggacctctgtatactggctattgactcgctggagttccagtacagaattctgacagcggctgctctgtgtcatttcacctcaattgaggttgtgaagaaggcgtcaggccttgaatgggatagtataagtgagtgcgtggactggatggtgcctttcgtgaatgtggtgaaaagcacctctcccgtgaaactcaaaacctttaagaagattccaatggaggataggcacaatattcagacccacactaattatcttgccatgctggaggaagtcaactacataaacacatttcgtaaagggggtcagctctctcccgtttgcaatggcgggataatgaccccacccaaatccacagaaaaaccccctggcaaacactag

SEQ ID NO: 29036 - DNA, 1134 bp, Artificial Sequence
  Description of Artificial Sequence: Synthetic coding sequence
atgaagttcccaggcccactggaaaatcagaggctgagttttctgctcgaaaaggcaatcacccgggaggcacaaatgtggaaagttaatgttagaaaaatgccttctaatcaaaacgtgtcaccatcacagcgcgatgaggtgatacagtggctggcaaaacttaagtaccaattcaacctctatcccgaaaccttcgctctggcatcctccttgctagatcgttttctggctactgtcaaggcacatccaaaatacttgtcatgtatagcaatctcatgtttcttcctcgctgctaagacagtggaagaggacgaaaggattcccgtgctgaaagtgctggctcgagactccttttgtgggtgtagtagctccgaaatcctgagaatggagaggattatcctggataaactgaattgggatttacacaccgccacccctctggactttctccatatcttccatgctattgcagtgagtacgcggccacagctgttgttctcactgccgaaacttagcccatctcaacacttggctgtgctcaccaaacagttactccactgcatggcctgcaatcagttgcttcagttccgaggaagcatgcttgccttagctatggtctcattagagatggagaaactaatcccagactggctgagcctaacaatcgagttgctgcagaaagcccagatggattcttcccaacttatccactgccgagagctggtggcccaccatctttctactctgcaaagtagcttaccgctgaatagcgtttatgtgtacaggccattgaagcacacgttggtgacatgcgacaaaggagtattcaggttgcacccttccagcgtacccggcccggacttcagcaaggataattctaaacccgaagtgcccgtccgaggcactgcagctttttatcatcatctgcctgccgctagcgggtgtaagcaaacatctacaaagagaaaggtggaagagatggaggtggatgacttctacgatggaatcaagcgtttgtacaatgaggataatgtgtctgagaacgtggggtctgtctgtggcacagaccttagcagacaggaaggacatgcttcaccctgtcctccccttcagcctgtgtctgtcatgtag

SEQ ID NO: 29037 - DNA, 378 bp, Artificial Sequence
  Description of Artificial Sequence: Synthetic coding sequence
atgaagttccccgggccattagagaaccagcggttgagttttctgttggagaaggccattacccgggaggcacagatgtggaaggttaacgtgcgcaaaatgccctctaatcagaacgtcagccctagtcagagggatgaagttatccagtggcttgctaagcttaaatatcagtttaatctctatccagaaaccttcgccctcgcctctagcctcctggaccgcttccttgctacagtcaaggctcaccccaagtatctatcctgcatagcgatttcttgtttctttctggcagccaaaaccgtggaagaagatgagagaatccctgttctgaaggtgctggcccgggatagtttctgtggatgcagtagtagttag

SEQ ID NO: 29038 - DNA, 243 bp, Artificial Sequence
  Description of Artificial Sequence: Synthetic coding sequence
atgaaatttcctggccctctggaaaatcagagactctcctttcttcttgaaaaagccatcacacgcgaggcgcagatgtggaaagtaaacgtacgtaagatgcctagcaaccagaacgtgtccccatcccagagagatgaggtcattcaatggttggccaagctgaagtatcaattcaacctatatcccgaaactttcgcactggccagcagtttgctggaccgttttctcgctacagtctag

SEQ ID NO: 29039 - DNA, 1092 bp, Artificial Sequence
  Description of Artificial Sequence: Synthetic coding sequence
atgaccccaaggcatcactgcgaagcttatagctcggccggcgaggaagaggaagaggaagaggaggaaaagaacgtgagcccttcccagagggatgaagttatccagtggcttgccaaactcaagtatcagttcaatctctaccctgagacatttgccctggcttcatcattactcgaccggttcctcgcaaccgtcaaagcccatccaaaatacctgtcctgtattgccatctcctgcttctttctggccgctaagactgtcgaggaagatgagagaatcccggtactgaaggtcttagcacgcgactctttctgtggctgcagttcctctgagattcttagaatggagagaatcattcttgacaaactgaactgggatttacatacagcaacacccttggattttctgcacattttccatgccatcgctgtgtccactagaccccagttgctgttttctctacccaaattgtctccatcacagcatctggccgtgctcaccaaacagcttctccattgtatggcatgtaatcagcttctgcagtttaggggttctatgctggcacttgcaatggtgtcactggagatggagaaacttatcccagattggctctctctgactatcgaactgctccagaaagcgcagatggactcctcgcaactaatccactgtagagagcttgtggcccaccacctctcaactctgcagagcagcctcccgttaaattctgtttatgtatatcgaccactgaaacatacccttgtcacttgcgacaagggggttttccgtctccacccctcatctgtgccaggccctgatttcagcaaggacaacagtaagcctgaggtgccggtgagaggcactgcagctttctatcaccatcttccggcagcatccggctgtaagcagacatctacaaagcggaaggtcgaagagatggaggttgatgatttctatgacggaattaaaagactgtacaatgaggataacgtttctgaaaatgtgggcagcgtgtgcggcacagacctttccagacaagagggacacgcatccccatgtcctcccctccaaccggtgagtgtcatgtag

SEQ ID NO: 29040 - DNA, 1110 bp, Artificial Sequence
  Description of Artificial Sequence: Synthetic coding sequence
atggcatccggagcccagcttcccccacaaccaagttccagtgaagtcagcgctgtacaatcacctggaggcagaccaggcgctggcttggaggaaacagctctgggagttccactgccaccgtctcccggggaagctcccctgcctcgcagtaatcggagtagatgtcctgggacacgccagcccggagcagcatccctgcacgcggcaagtgcagcagtgcccgtccgaccccggagaggtaccgcccctgccggcaaaacagccgacgccgtgcctgccgccgctcctgagcaagcccccaggccagcaccccagagccgaaaaccccgcaatctggagggcgaccttgacgagcggcggttgttgtgccacctacaattagcccaggacagggaggcccgactgtggaggggtggaaaaccgcaagacgagatttgcgacgccttcgaagaggtcgtactctggttactgcgcttgcagaacaccttctacttcagccagagcacatttaacttggccctgaccatttttggacggcttcttatatcagtgaaggtgaaggaaaaatacctgcattgcgccaccattaccagcctgagactggctgcaaaagtcaacgaagaagaagagttcattcctcaggtcaaagacttcaccaagcactatggatccgattactcccccaacgagctgctgaggatggagctagctatcctggaccgactgcattgggacctgtatatcggcacaccacttgacttcctcactatctttcacgctttggtcgtcctgtcttggccccatgtcctggaactgttacctcagcggaatccatctcttcacgttgcgtcactgacacgccaactgcagcactgtatggctgggcatcagctgctgcaatttaagggctcaaccctcgccttggtgatcattaccctggagttagaacgtttgatgccagggtggtgcgcacccataagtgacctgctcaaaaaggcccaggtcggcgacatgcaatacagctgttgtaaagaattggtgatgcagcaactaagaagtctgcagtcttcatcctgcactgacaacttcgtgtctcccgccaactag

SEQ ID NO: 29041 - DNA, 993 bp, Artificial Sequence
  Description of Artificial Sequence: Synthetic coding sequence
atggacggccccatgagaccccgctccgcaagccttgtggatttccaatttggcgttgtggcaactgaaaccatcgaagatgcactgcttcacctggcccagcaaaatgagcaggccgtgagagaggccagtgggaggctgggacgattccgggagccgcagattgtcgaatttgtcttcttgctatcagagcagtggtgtttagaaaaatccgtctcgtatcaggcggtcgaaattctcgaaagattcatggtaaagcaggccgagaacatctgccgacaggcgacaatacagcctcgggacaacaagagagaatcacaaaactggcgggcactaaagcagcagctggtcaataagtttaccctgcgattggtttcctgtgtccaactcgcttctaagctatcctttcgcaataagattatctccaacattacagtgctgaactttcttcaggctctcggatatctgcacacaaaggaggagcttttggagtccgagctcgatgtcctcaaatctctgaacttcagaataaatctgcccacccccttggcgtacgtcgaaactctgttggaggtactcggttacaacggttgcctggttcctgccatgagacttcacgcaacttgcttaactctgctagacctcgtctacctcctgcatgagcctatttacgaatctctattaagagcctctatcgaaaattccactccaagtcagttgcagggggaaaagtttacctctgttaaggaagactttatgttgttagccgtcggaattatcgccgcctccgcttttatccagaatcacgagtgttggtcccaagtggtcggacatctgcagagcattacaggaattgcacttgcttccatcgctgaattttcttacgccatactcacacatggagtcggagcaaacacacctggccgtcagcagagcattccgccccatctggccgctcgggcgcttaaaacagttgcatcctctaacacctag

SEQ ID NO: 29042 - DNA, 993 bp, Artificial Sequence
  Description of Artificial Sequence: Synthetic coding sequence
atggatggtcccatgagaccacgaagtgcctccctggtggacttccagttcggggtcgtagccactgagacaatagaggatgcactcctgcatctggctcagcagaacgagcaagcggtgagagaagcatctggaagactggggagatttagggaaccacagatcgtcgagttcgtctttctcctgagtgagcagtggtgcctcgagaagagtgtaagctaccaggctgttgagatcctggaacgcttcatggtgaaacaagccgaaaatatctgcagacaggctaccatccaacccagagataataaaagagagtcacagaactggcgcgccctgaagcagcagcttgttaataaatttacactgcgcctcgtctcgtgcgtgcagctggcttctaaacttagttttaggaacaagattatttctaacatcactgtgctcaatttcctccaagccttggggtaccttcacactaaggaagagctgctggaaagcgaattggatgtcctgaaatcactgaattttcgtattaatctgccaactccacttgcgtacgtggagacgttgttggaagtgctgggatacaacggctgtctcgtccctgcgatgcgactgcacgcaacttgtcttacattgctggatctggtgtatctgctccatgaacctatttacgagtctctgctgagagccagcatcgagaattccacaccttcacagctgcaaggggaaaaatttaccagcgtaaaggaggacttcatgttgctggctgtcggaattatcgcggcttccgccttcattcagaaccatgagtgttggagccaggtggtcggacatctacagagcattaccggtatcgcactcgccagcattgccgaattttcttatgccatacttacccatggcgtgggagctaacacacctgggcgccagcagtctatcccaccacaccttgcagcccgggccctgaagactgtcgccagttctaatacatag

SEQ ID NO: 29043 - DNA, 924 bp, Artificial Sequence
  Description of Artificial Sequence: Synthetic coding sequence
atgctggtaaggggtagagatcagggcagcggcagtcggctggggcctattgtgcgacggtgggcccccaggccaagcccacttcagagcttggccgcctcgctggacgccgagccctcttcggctgcggtcccagatggcttcccagcaggcccaacggttagccccagaagattggcgcgtccccctggactggaggaagccctgtctgctttggggctgcagggcgaacgcgaatacgctggagacatctttgctgaggtgatggtttgcagggtgttgccattaagagcactgccacgtgctgtgacaccagaaatgcgggctctggtcgtcgattggctcgtgcaggttcacgaatatcttggccttgccggcgacacgctgtacctcgctgttcacctgctggactcctatctgagcgccggtagggtgcggctccataggcttcagctgttgggcgtggcttgcctgttcgtggcatgtaagatggaggagtgtgttctgccggaaccggccttcctctgtctcctgagcgccgactccttttctagggcagaactgctgagggcggaacgccgcatcctcagcagactggacttccgcctgcatcatccaggcccgctcctttgcctggggctgttagccgcgctggctggcagttcaccacaggtcatgctcctagccacatatttcctggaactgtccctgctggaggcagaggctgccgggtgggaaccgggaagaagagcagccgcagctctgtctctcgcacataggcttcttgatggggccgggagcaggctgcaaccagagctctaccgctgtagcctggggggcggatccgtctggggccacaggtcttttagagaccttccctcatggtctttcctgaggagtaggagaatgagggataactattag

SEQ ID NO: 29044 - DNA, 468 bp, Artificial Sequence
  Description of Artificial Sequence: Synthetic coding sequence
atgctggtgcgtggtcgggaccagggaagcggctcgaggctcggccccatagtgaggaggtgggcacctaggcctagtcctctgcagagcctcgcggcctctctcgacgccgaaccctctagcgccgcagtccccgatggattccccgccggcccgactgtgagccctagacgtctcgcaagaccaccaggcttagaagaggccttgtcagcccttggtctccagggggagcgcgagtacgctggagatatcttcgccgaggttatggaatacctgggattagccggagatacactgtacctcgccgttcaccttctagacagctatctgtctgccgggagagtgcgactgcatcgtctgcaacttcttggcgtagcttgcctgtttgtggcctgcaagatggaggagtgtgtgctgcccgaagagacggaggttagaaacttgggcccgtttcaggggagagagtag

SEQ ID NO: 29045 - DNA, 1080 bp, Artificial Sequence
  Description of Artificial Sequence: Synthetic coding sequence
atgggaaatacgctgacctgttgcgtcagccctaatgcatctcccaagctgggccggcgggccggatcggccgagttatactgtgcttccgacatctatgaggcagtaagcggtgacgctgttgcggtggcccccgcggttgtggagcccgcagagctcgattttggggaaggtgaaggccatcatcttcagcacataagtgatagagaaatgccagaggacttggctcttgaaagtaacccatccgatcatcccagggcgtccaccatcttcctatcaaaatcccagacagatgtgagggaaaagcgcaagagcaaccacctcaatcacgtgtctcctggacaactgacaaaaaagtattcctcctgctcaactattttcctggacgacagtacggtgagccaacccaatctccggaccacagtaaaatgtgtcacccttgctatttattatcacataaagaaccgggacgcaaacagatcgctggatatttttgatgaacggtcccatccactgacccgcgaaaaggtgccggaggagtactttaaacatgaccccgaacataaattcatttataggttcgtcagaacgctgttcagcgcggctcagctcacagccgagtgcgctatcgttacactggtatatcttgagcgcctgctcacatacgcagagattgacatatgtcctactaactggaagcgcatcgttctgggggccattctcctggcttcaaaagtatgggacgaccaggctgtttggaatgtggattattgccagatcctcaaggatatcacagtggaggacatgaatgaaatggagcgtcacttcctcgagctcctgcaatttaacattaatgtacccgcatccgtttatgctaagtattacttcgacctcagatcacttgcagatgataacaaccttaacttcctcttcgcccccctcagcaaggaacgcgcacagaatttagaagccatctcccgcttgtgtgaagacaaagatttatgcagagccgctatgaggagatcattttcagctgataactttatcggcattcagcggtctaaagccatcctgtcctag

SEQ ID NO: 29046 - DNA, 927 bp, Artificial Sequence
  Description of Artificial Sequence: Synthetic coding sequence
atggggaacactcttacttgttgtgtgagccccaacgcatctcccaagctggggcgtcgggcaggctctgccgagctttactgcgcatcagatatttatgaagctgtgagcggcgacgccgtggcggtagcccccgccgtagtcgaaccagcagaattggactttggcgagggtgaaggccaccacctgcagcacattagtgaccgagagatgcctgaggatctcgcactggagagtaatccaagcgaccacccccgcgcctcaaccatttttctaagtaagtctcagacagatgtgagagaaaagcgtaagtctaaccacttaaatcattgcgacctctcaaacatcctgccacacaaagagcagcgagaaaaagtccccgaggaatattttaagcatgaccctgaacacaagtttatctatcgcttcgtgagaaccctcttctctgcggcccagcttaccgccgagtgtgccattgtgaccctagtctacttagagcgcttgcttacttatgctgaaatcgacatctgccctacaaattggaagcggattgtattgggggccattctgttggcatccaaagtatgggatgatcaggccgtgtggaacgttgactactgtcagatcctcaaggatataacagtcgaggatatgaacgagatggaaaggcactttttagagttgttgcagtttaatatcaatgtgcctgcaagtgtctacgctaagtactattttgacctgaggtcactcgccgatgacaataatctgaatttcctgtttgcaccgttgtccaaagaaagagcgcagaacttagaggccatatcaaggctgtgtgaagacaaagatctttgccgggccgctatgcggaggagtttctccgcggataatttcatcggtatccaaaggtcaaaagccattctcagctag

SEQ ID NO: 29047 - DNA, 870 bp, Artificial Sequence
  Description of Artificial Sequence: Synthetic coding sequence
atgcccgaggacctagcactcgaatccaatccatccgaccacccccgcgcctccaccatctttttatccaagagtcagacagatgtcagggaaaaaaggaagtctaaccacctgaatcatgtgagcccgggtcagcttaccaagaagtactcctcttgttcgactatcttcctagatgattcaactgtatcccaaccgaatcttcggacgaccgtgaaatgcgtcactcttgcaatatactaccatattaagaatcgggacgcgaataggagcctggatatattcgacgaaagatctcaccctctgactagggagaaggttcccgaggagtatttcaagcacgacccggaacataagtttatctacaggtttgtgcgcacccttttttctgctgcacagttgactgccgaatgtgctatcgttacccttgtgtatttagagagactgctcacgtacgccgaaatcgatatttgtccaaccaattggaagcgcatcgtgctcggggcaattctgttggctagcaaggtatgggatgatcaggccgtctggaacgtagattactgtcagatcctcaaggatatcactgttgaggacatgaatgagatggaaagacacttccttgaactgctccagttcaatattaacgtgccagccagcgtgtatgcaaagtactacttcgatctcagaagtctagcagacgacaataatctcaattttctctttgcgccccttagcaaagagcgagcccagaacttggaggccataagtagattgtgtgaagacaaagacttatgccgcgccgctatgaggcggtctttctctgctgacaactttatcggaattcagcgcagcaaagctattctgagctag

SEQ ID NO: 29048 - DNA, 1086 bp, Artificial Sequence
  Description of Artificial Sequence: Synthetic coding sequence
atgggtaacattttgacatgctgcgtctgccccagagcctctccagggctccatcaacatcagggcctggtctgtcactgcgagagcgaaatttacgaggctgctgcgggcgacctgatcgcaggagtcccggtggcagctgccgtagagcctggggaggttacgttcgtggctggcgagggtttgcatatgcaccatatttgcgagagagagatgccagaagacattcctctcgaacccaaccctagcgaccatcccaaggcatccactatatttctgcgaaaatcccagacagatgtacaagagaaaaagaagaagcaactgtgcaaagttagtactgaacactttacacagcagtactcttcatgtagcaccatctttctcgatgattcgattgccagccagccgcatctgactatgacactgaagtcatgtgatctgggtacgatcttgtcataccaggctaagagggatgctcacaggtccctgggtatttttgacgaacagctgcacccacttaccgtacggaaggaggttcttgaagagtattttaaatatgaccctgagcacaaactgatctttaggtttgtgcgaactttattcaaggccatgagattgaccgctgagttcgcgatcgtttcccttatttatatcgagcgcctagtcagctacgctgatatagacatttgtcccactaactggaagcgcatcgtcctaggagccattctcttagccagcaaggtctggtccgacatggctgtgtggaacgaggactattgcaagctgttcaagaacatcaccgtggaagaaatgaacgaactagagagacaatttctgaagctaataaactacaacaattcaattaccaacagcgtgtactctaggttctatttcgatctaaggacacttgcacacaataacggcctgtattcgcctgtgtacttgctcgatagggaacgagcatggaaactggaggccttctcccgcatggagcaggacaaggttttctattcagccgcaaagaatggctccctatctgccgacgacttaatccacctgcagcgtgccaaggctatactgttttag

SEQ ID NO: 29049 - DNA, 864 bp, Artificial Sequence
  Description of Artificial Sequence: Synthetic coding sequence
tgaattccattggaacctaatccgtctgatcacccaaaagcgtctaccatttttcttaggaagtcccagacagatgtacaggaaaaaaaaaagaaacagctgtgtaaggtttctaccgagcatttcacgcagcagtacagcagttgctcaaccatattcctcgatgacagcattgcatctcagcctcatctgacaatgacactcaaatcctgcgatctaggcacaattctcagttaccaagctaaacgtgatgcccaccgctcgctagggattttcgacgagcagctgcaccccctcaccgtgagaaaagaagtactggaggagtacttcaaatatgaccctgaacataaactgatttttcggttcgtgcggacgctcttcaaggccatgcgcctcaccgccgagttcgctatcgtctccttaatttatatcgaacgtttggtctcttatgctgatatagatatttgtcccactaactggaagagaatagtcttgggggccatactgttggcttccaaggtgtggtccgatatggctgtttggaacgaagattactgcaagttatttaaaaatatcaccgtagaggagatgaacgaattggagaggcagtttctcaaactcatcaactataataactctatcactaatagcgtatatagtcgtttttacttcgacctccgcactctggctcacaacaatggcctctactccccagtgtatcttcttgaccgagagcgtgcctggaagcttgaagccttctctcggatggaacaagacaaggtgttttactctgccgcgaagaacggaagtttgagtgcagacgacttaatccacttgcagcgagcaaaggcaatcctgttctag

SEQ ID NO: 29050 - DNA, 1032 bp, Artificial Sequence
  Description of Artificial Sequence: Synthetic coding sequence
tcctgtgttgtcattcagattccaccttggcatctggaccgcaaatatggctcatgctccaccatactgctggacaatagcactgcctctcagcctgatctgaggcatactctcgagcgttacgcgaatcgttctttggccattttcgaggaacctgtgcaccctttacctcaagagaagctccccggcaagagtttcaaacacgatcccaaacggaattgtatattccgccacttttgtacattgttccaggttattaagctaacggccccttgcgctatcgttgccttagtttacatcaagaggctgctcacatccgctaacatagacttatgccccactaattggaagaagattgtcctgggcacaatgctactggcctccaaggtgtggaggaatcatgggctgtggtccgtggacgattcacagaattccaaagatacagcagtggagaatatgtctaaaatggaaaagtgcttcctggagctacttgaatttaacatccacgtgtcagcctccgtttatgctaaatattacttcgacctctgcgctctggcgaacgaccacgacttgtactttctgttctcctttttgcataaagataaggcacagaaattggagggacatacatcccaacacagtctgagtctgggtccctgccgagtgggcatggaaaactacgccacatattcgcctctttctagtcagcctgtcctgggcgccctctctctcgccgaagttttaccgcaggaaatcaagcaggagatccatcaggtcctgatggaccacggagtgccctgccactacacctgctttctcttgcatcccgaggattccaccctggagaggttcctcgtgcttcatagtattcagggcctgcaggaagattcagtcctctgcaaagtggagatccatggattgagtccacagccacaaacctatcaatctcattttagaagcccatctcttgctgagctgctgaataggatttccggcacatgtcgaaatcattttgccgggatgcaaaagtag

SEQ ID NO: 29051 - DNA, 1155 bp, Artificial Sequence
  Description of Artificial Sequence: Synthetic coding sequence
atgacctcttttcacccccgtggcttacaagctgctagggcgcagaaattcaaatcaaagcgaccacggagtaattcagactgctttcaggaggaggatctgcgccagggcttccaatggagaaaatctctgccatttggcgctgctagttcgtatctgaatctggagaaactgggggagggctcatacgccacggtgtacaagggaatcagtaggatcaacgggcagctggtggctctcaaagtgatatcaatgaacgccgaagagggagtgccttttactgctatccgggaggctagcttattgaagggcctgaagcatgcaaacattgtactgttacatgatataattcatacgaaagaaacactgaccttcgtgtttgagtatatgcacactgatctggctcaatatatgtctcagcatcccgggggcttacacccccacaacgttaggctgttcatgttccagctcctgagaggcctggcatacatccatcatcagcacgtgctgcatcgcgacttaaagccccagaatctgcttattagccatttgggggagctgaagctggccgacttcggtctggccagggcaaaatctattccatcacagacctatagcagcgaggtggttacgctatggtatagaccccccgatgcccttcttggagcaacagagtactctagcgaacttgacatctggggtgcaggttgcatctttattgaaatgtttcagggtcagcccctgtttcctggcgtgtcaaacatattagaacagctggaaaaaatatgggaagtgctcggggtacccacagaggacacctggcccggcgtctcgaaactgccaaattacaacccagaatggtttccgctccccactccaaggtcattacacgtcgtctggaatcgtctgggaagggtcccggaagcggaagatcttgctagtcaaatgctgaaaggctttccgcgggaccgtgtgtctgcgcaggaggcattagtacacgactatttttcagctctcccatcacagctctatcagctacccgacgaagagagcctgtttacagtttcgggggttcgactcaaaccggagatgtgtgacctgctggcttcataccaaaagggccatcaccccgcacaattttccaagtgctggtag

SEQ ID NO: 29052 - DNA, 1308 bp, Artificial Sequence
  Description of Artificial Sequence: Synthetic coding sequence
atgggccaggagctgtgcgctaagactgtccagccaggctgttcttgctatcactgcagcgagggaggagaggcgcattcctgtcggaggtcccagcccgaaaccaccgaggcagcctttaagctgacagatctgaaagaggcttcatgctccatgaccagttttcacccaaggggtctgcaggccgctagagcccagaaatttaagagtaagcgtccaagatcgaactctgactgttttcaggaagaggaccttcgtcagggcttccaatggcggaagagcctgcccttcggggctgcatcgtcttacttaaacctcgagaaactgggggagggctcatatgctacagtctataagggcatctctcgcattaatgggcagctagtcgcactgaaagttatttcaatgaacgctgaagagggcgttccgttcacagctatccgggaggcctcactgttgaaggggcttaagcatgcgaatattgtcctgttgcatgacataatacacacaaaggagacactgacattcgtcttcgagtacatgcatacggacctggctcaatatatgagccaacatcccggcggactccaccctcataatgtgagactgttcatgtttcaactgctgagaggcctcgcctatatccaccaccagcacgtcctgcatagggatctcaaaccccagaacctgctgatctcacacctcggagagctcaaacttgcagacttcggtctggctcgggctaagtccattccatcgcaaacctactcatctgaggtggtgacactgtggtaccgtccccccgacgccctgctgggtgccacagaatattcaagcgagctggatatctggggggccggctgcattttcattgagatgttccagggacagccactgtttcctggagtgtcaaatattttggagcagctagagaagatctgggaggtgttaggggttccgacagaagatacctggcccggagtgagcaaacttcccaattataatccggagtggttcccactacctactcccagatcactccatgtggtgtggaatagacttgggagagtgcccgaggctgaggacctggccagtcagatgctaaagggcttcccgcgcgacagggtcagcgcccaagaagctctggtccacgattacttttctgccttgccaagccagttgtaccagttgcctgatgaggagtccctgttcactgtgtctggtgtgagactcaagcctgagatgtgcgatctgttagcgagctaccaaaaaggtcaccatccagctcagttttcgaaatgctggtag

SEQ ID NO: 29053 - DNA, 1155 bp, Artificial Sequence
  Description of Artificial Sequence: Synthetic coding sequence
atgaccagcttccacccccgcggcttacaggctgctagggcacagaaatttaagtccaagcgaccccgcagcaattccgattgctttcaggaagaggatctcaggcaggggttccagtggcgcaaatcactaccattcggcgccgcgagttcttacctcaacctggaaaagttgggagaaggctcttatgccaccgtctataaaggtatatcccgcataaacggtcaattggttgcactcaaggttatcagcatgaacgctgaagagggggttccattcactgcaattcgtgaagccagtctcctgaagggactgaagcacgccaatatagtgcttctgcatgatatcattcataccaaggagacactaacatttgtattcgagtatatgcatacggatctggcgcagtacatgtctcaacacccaggcggcctgcacccccataacgtgcgtctgtttatgtttcagcttcttagggggttagcttatatccatcatcagcacgtcctccatcgcgacctaaaaccacagaatctgctcatcagccacctcggcgagttgaaactggctgattttggattggcgcgagccaagagcattccctcgcagacatacagctctgaagtggtaaccctgtggtaccgccctccagatgctctgttgggcgcaacagagtatagcagtgagctcgacatatggggggccggctgtatctttattgagatgttccagggccagcctctgtttccgggtgtgtcaaatatccttgaacaactggagaagatttgggaggttctgggcgttcctaccgaggacacttggccaggcgtgtcgaaattgcctaactacaacccagagtggtttccactccccactccgcgctcattgcacgtggtgtggaatagactcggacgggtgccggaagcggaagacttagcctcccaaatgctgaaaggattccctagggaccgcgtgagtgcccaggaagccctggtgcacgactacttctcagcccttccaagtcagctatatcagcttcccgacgaagaaagtctgtttacggtgagtggagtccgtctcaaaccagagatgtgtgacctgcttgccagctaccagaaaggtcatcacccagctcagttctccaaatgttggtag

SEQ ID NO: 29054 - DNA, 1203 bp, Artificial Sequence
  Description of Artificial Sequence: Synthetic coding sequence
atggggcaagagctgtgtgcgaagaccgtgcaacccggatgttcttgttaccactgtagcgaaggtggcgaggcccattcttgccgcaggtcacagccggaaacgacagaagcagcctttaaactgacagacctgaaggaggcctcttgtagtatgacatcatttcaccctcgcggtctgcaagcagcccgagcccagaagttcaaatcaaagcggcctcggtccaacagcgactgcttccaggaagaagacctgaggcaaggcttccagtggagaaaatcattgccttttggcgcggcttcctcctacctgaatttagaaaagttgggagagggctcctacgccacagtctacaagggcatatctcggattaatggacagttagtcgcattgaaagtgatttccatgaatgcagaggagggcgtgccatttaccgctatacgcgaggcttcacttctcaaggggttgaaacatgccaacatcgtgcttctgcacgacatcatccacaccaaagagactttgacattcgtatttgagtatatgcatacagacttagctcaatacatgtcgcagcaccccgggggcctacatccccacaacgtccgtttatttatgttccagcttctcaggggcttggcctatatccatcaccagcatgtattgcacagggacctcaagccccagaatcttctaatcagtcatttgggggaattaaagttagcagatttcggactcgctcgggcgaagagcatcccatcccaaacctactcctctgaggtggtgaccctctggtacaggcctcctgatgctctactgggggcaactgagtactcatctgaactggatatatggggggcgggatgtatcttcattgagatgtttcagggccagcctctttttcctggggttagtaacatactcgaacaacttgagaagatctgggaggtgctgggagttccaactgaggacacttggcccggagtaagtaaactgcccaattataaccctgaatggttccctctacccactccaagaagtcttcatgtggtctggaacagactgggtagagtccccgaggccgaggacctggcttcccagatgttgaaaggctttccgcgtgatcgtgtctccgcacaagaagccctcgtgcacgactacttctcggctcttccttcccagctctaccagctgcccgatgagtag

SEQ ID NO: 29055 - DNA, 1290 bp, Artificial Sequence
  Description of Artificial Sequence: Synthetic coding sequence
atgggtcaggaattatgtgctaagacagttcagcccggatgctcctgctatcattgttcagaagggggtgaggcgcactcgtgtcgtagaagccaacccgaaacgacagaggcagcgtttaaactaaccgatttaaaggaggcctcctgtagcatgacttcgtttcatcccagaggcttacaggccgctcgggcccagaaatttaagagtaaaagaccaagatctaactctgactgtttccaggaggaagaccttagacaaggtttccagtggagaaagagcctgccgtttggcgcagcttcatcgtacctgaatctggaaaagcttggggagggatcttacgccacagtgtacaagggaataagtcgcatcaatgggcagttggttgccctcaaagtgattagtatgaatgctgaagagggcgtacccttcacggctatcagagaagccagcctcttgaaaggtctcaagcatgccaacatagtgctgctgcacgatatcatacacactaaggaaactcttaccttcgtatttgaatacatgcataccgacttggctcaatatatgtctcaacatccaggcggtcttcacccacataacgttcgactgttcatgttccagcttctcaggggtcttgcctacatacaccatcaacacgtgttgcaccgggatttaaagcctcagaacctcctgatcagtcatttgggggagcttaagctggccgacttcgggctagcccgcgccaaaagtatcccttcacaaacctatagtagtgaggtagtgactttatggtacaggcctcccgacgctctgttaggcgccacagagtattcctccgagctggatatctggggtgcagggtgcatcttcatcgagatgttccagggtcagccactattccccggtgtgagtaatattctcgagcagctcgagaagatctgggaagtgctcggggttcccacagaggacacatggcctggcgtgagtaagctccctaattataacccagaatggttccctctgccaactcccagatccctgcacgtggtgtggaataggctgggtcgagttccagaagcagaggatttggcgtcacagatgctcaaaggattccctcgagatcgcgtgtcggctcaggaagcattggtgcacgactattttagtgcactccccagccagttataccagctccccgacgtcagcggtgttaggctgaaaccggagatgtgcgacttactggcatcgtaccagaaaggacaccacccagcacagttctctaaatgttggtag

SEQ ID NO: 29056 - DNA, 1713 bp, Artificial Sequence
  Description of Artificial Sequence: Synthetic coding sequence
atgcctctctatgggagggcacgtgaccacgtgactcatccttctatccttggaactagaccaggtcgcccgatggccggacctattaccgcggcggttcccgaaaagatttgtaacggcgctttttgtagttgttccggagccttccccctggacccaaacaatcctagcctggggccccttcctagtataagccacttgaacctccgcactcagatagcgatggacaggatgaaaaaaatcaagcggcaattgtctatgacccttcggggcggccggggaatcgacaagaccaacggggcccccgagcagatcggcctcgacgaaagcggcggagggggaggtagcgatcctggagaggcacctactcgagctgcgccaggcgaactgcggagtgcgcgtggacccctgtcatcagctcccgagattgttcacgaagatttgaaaatgggcagcgacggcgagtccgaccaggcctccgccacctccagcgacgaagtacagtcaccagtaagggtccggatgaggaaccatccacccaggaagatctcaacagaggatataaataagcgactatctctgcccgcagatataaggttgccggaaggatatttggaaaagctcacacttaactctcccatcttcgataagccattaagcagacgcttaaggagggtttctctgtcagagattggctttgggaagttggagacttatataaaacttgacaaactcggcgagggcacatatgccacagtgtataagggcaagagcaaattgacagataatctcgtggctctcaaggagatccgtctcgaacacgaagaaggggcaccatgtactgcaatcagagaggtttccctgctgaaggacctgaagcacgcaaatattgtgactctccacgacatcattcacaccgaaaaatctctgacacttgtgtttgagtacttagacaaggacctgaagcagtaccttgacgactgtggaaacatcatcaatatgcacaatgtgaaactcttcttatttcaattattgaggggattggcatattgccaccgacagaaggtgctacatcgggatctaaaaccgcagaaccttcttattaatgagcgaggggaactgaagttagccgactttgggttagccagagccaaaagcataccaacgaaaacatatagtaatgaggtcgtcaccttgtggtaccgcccccccgatatcttactcggatcgacagactactccacgcagattgatatgtggggtgttggttgcatcttttatgagatggccaccggcagacctctgtttcctggcagtacggtggaggagcagctacatttcatatttaggattcttggcactcccactgaggaaacttggcccggaatcttatcaaacgaggagttcaaaacctacaattatcccaaatacagggctgaagctctactgagccatgccccccggcttgactcggacggcgctgatcttctgactaaacttctgcagttcgaagggaggaataggatatcggcagaagatgcaatgaagcaccccttctttctgtccctaggagagcgcatccataaactcccggacacaactagcatattcgcacttaaggaaattcagctgcagaaagaagcctccctgagaagctcctccatgcctgatagcgggcgccctgccttccgcgtggtagacaccgaattctag

SEQ ID NO: 29057 - DNA, 1491 bp, Artificial Sequence
  Description of Artificial Sequence: Synthetic coding sequence
atggatagaatgaagaagataaaacggcagctgagtatgaccctgagaggcggacgaggaatcgataagaccaatggagctccagagcagattggccttgacgaatcaggagggggagggggttccgaccctggcgaagcgccaacccgagctgctccaggcgagctccgttctgcccgggggcccctctcctctgctcccgaaattgtgcatgaggacttgaagatggggtctgacggcgaatcagaccaggccagcgctacatccagcgacgaagtacagtcccctgtgcgggtgcgaatgaggaatcatccccctcgcaagatcagtaccgaagacataaataagcggctttctctccccgctgacatcaggctcccagaaggctatttagaaaagttgactctcaattcgccaattttcgataagccactgtcgaggcggctgcgaagagtatccctcagcgagattggatttggaaaattggagacatatattaagctcgacaaactaggagagggcacatacgcaactgtctacaaagggaaaagcaaattgaccgataatctcgtggcattgaaagagatcaggcttgagcatgaagagggcgccccctgcactgccatccgagaagtcagtctgctcaaggacttaaagcatgcgaacattgtgacattgcacgacattatccataccgaaaagagcctgacactcgtgtttgaatacctggataaagacctcaagcaatatcttgacgattgtggaaatatcatcaatatgcacaacgtcaagctcttcttattccagttgcttcggggcctcgcctactgccaccggcagaaagtactccacagagacttgaagccacagaatctgttgattaacgagcgcggggagctcaagctggccgacttcggtttagcacgcgccaagtctatccccacgaagacctattcgaatgaggttgtgacactgtggtaccgccctcccgatattctcttgggatcaactgattactcaactcagatcgacatgtggggtgtgggatgtattttctacgagatggccacaggacggcccctgtttcccgggtctaccgtggaggagcagctgcatttcatcttccggattctgggcactcccacggaagaaacctggccaggaattctcagcaacgaagaatttaagacctataactaccctaaatatagagcggaagctctcttgtcccacgctccacggctcgactccgacggggctgatttgctgactaaacttctgcaattcgaagggagaaaccgtatttcagctgaagacgctatgaaacaccctttctttctgtccctcggcgaaaggattcataagctcccagatactacttccatctttgctctgaaagaaatccagctgcaaaaagaagcatctttaaggtccagttctatgccagactcaggccggccagccttcagggttgtcgataccgaattctag

SEQ ID NO: 29058 - DNA, 1509 bp, Artificial Sequence
  Description of Artificial Sequence: Synthetic coding sequence
atgcagtcagaaatcgcaatggatagaatgaagaagatcaagcgacaactctccatgactctgagaggaggccgtggcattgataaaacaaatggggcgccagagcagattggcttggacgagtctgggggcggaggaggcagtgatcccggcgaggcaccaacaagagcagcgcctggagagctcagatctgctagggggccgctatcctccgcacccgagattgtgcacgaggacttaaagatgggctccgacggggagagtgaccaggcctccgccacttcttcggatgaggttcagtccccagtgagagtgagaatgcggaatcacccaccgaggaagatcagtacggaagatatcaataagcggttgtcgcttcccgccgacatccgactgccggagggctacctggaaaagctgactctgaactcccctatctttgataagccactctcgcgccgcttgcgcagagtgagtctcagtgaaatcggtttcgggaaactagagacttatattaaattggacaagctgggagaggggacctatgccacagtgtataaaggtaagagcaagttaaccgacaaccttgtcgccctgaaagagatcaggctggaacatgaggagggagccccttgtaccgcaatccgcgaagtatctctcctgaaagatctcaaacatgccaacattgttacactccacgacattatccatacagaaaagagtctaactctcgtattcgaatatcttgacaaagacctaaaacagtacctggatgactgtggcaacattattaatatgcataacgtaaaactgtttctgtttcagctgctccgcggactggcatactgtcataggcaaaaggttcttcatcgcgaccttaagccccaaaacctgttaattaacgagagaggcgaactgaagctcgccgactttggtctggccagggcaaagtccattccgaccaaaacttacagtaacgaagtcgtcacactttggtacaggccacccgacattcttctcggctctacggactacagtactcagattgacatgtggggagtgggttgcatcttctacgaaatggccactggcaggcccctgttccccggaagtacagtggaagagcagctacatttcatatttcggatcctgggtacccctacagaagaaacgtggccaggcattctgtccaacgaagaattcaaaacttacaactaccctaagtatcgggccgaagcgcttctctcccatgcacccaggcttgacagtgatggtgcagacctgttaacaaagctgttgcagtttgagggccgaaatcgaatctctgccgaagatgcaatgaaacatcccttcttcctatctttgggcgagcggatccacaagttgccagacacgacctccattttcgccctaaaagagattcagttgcaaaaggaggctagcctgaggagttcgtcaatgccagatagtggtagacccgccttccgggttgtcgacacagaattctag

SEQ ID NO: 29059 - DNA, 1491 bp, Artificial Sequence
  Description of Artificial Sequence: Synthetic coding sequence
atggaccgaatgaaaaagatcaaaaggcagctgagtatgactttaaggggcggccggggaatcgataagactaacggtgcccctgagcagattggactggacgagtctgggggcgggggcgggtccgaccccggagaggcacccactagagccgccccaggggaattacgcagcgcgcgtggcccactcagcagtgctcctgaaatcgtgcacgaagatttaaaaatgggctccgacggggagtccgaccaggccagtgctacttccagcgatgaggtgcagtcccctgtacgggtccgtatgcgcaaccacccaccccggaagatcagcaccgaagacattaacaagagattaagtttgccggcggacatccggctgccagagggctacctggagaaactgaccttgaatagccccatttttgataaacctctgtctaggcgcctgcgacgtgtaagcttaagtgagatcggctttggtaaactggagacctacatcaaattagacaaacttggcgaaggcacctacgcaacagtgtacaagggcaagtccaaattgactgacaacttagtggccctcaaagaaatccgactagagcatgaggaaggcgcaccatgcaccgctatccgggaggtctcccttttgaaggacctgaagcatgccaacatagtgacgttacacgatattatccacacagagaagagtttgaccctcgtgtttgaatatctggataaagacctaaaacagtatctagatgactgtgggaacatcatcaatatgcacaacgttaagctgttcctgtttcagctgctgcggggcctggcctactgccatcggcagaaggtgctccatagagacctaaagcctcagaacctcctcatcaacgagagaggagagctaaaactagcagacttcggccttgctagggccaaatctattcctactaagacttactcaaacgaagtggtcaccctgtggtatagacctcccgatatcctcctgggctcaacggactactctactcaaatcgacatgtggggcgtgggatgtatcttctacgagatggcgaccggaagacctttgtttcccggttccaccgtcgaggagcagttgcacttcatctttagaatcctggggacacctacagaggagacttggcctggcattctgagtaacgaagagttcaagacgtacaattacccgaaataccgtgcagaggcccttctctctcacgctcctcgcctggattctgatggagctgatcttctgaccaaacttttacagttcgaaggtagaaaccggattagtgccgaggacgccatgaaacatcctttcttcctctcactgggagaacgaattcacaagctcccagacactacgagcatatttgccctcaaagaaatccaactgcagaaggaagcaagcttgagatctagttcaatgccggactctggcaggcctgccttccgcgttgtggacactgaattctag

SEQ ID NO: 29060 - DNA, 570 bp, Artificial Sequence
  Description of Artificial Sequence: Synthetic coding sequence
atggacaggatgaaaaagatcaagcgtcagcttagtatgacattgcggggcggaaggggcattgataagactaacggggcgcctgaacagattggcctcgatgaatccggcgggggaggcggctctgaccctggagaagcgcccacgcgagccgccccaggtgagcttcgtagtgcccgcggccccctcagctcagcccctgaaatcgtgcacgaggatcttaagatggggagcgacggagagtctgatcaggccagcgctacctcctcagacgaggtccagtctccagtgagggtgaggatgcgcaaccaccccccgcgcaaaatttctactgaggacatcaacaaaagactgagtcttccggctgatattcgattacccgaagggtaccttgagaagctaactctcaactcgcccatctttgacaagcctctgtctcgacgactgcgccgtgtctcgcttagcgagattggctttggcaaactggaaacatacattaaactcgacaagctcggggaaggaacctacgcgacggtgtataagggaaaaagtaagctgaccgataactag

SEQ ID NO: 29061 - DNA, 453 bp, Artificial Sequence
  Description of Artificial Sequence: Synthetic coding sequence
atggaccgaatgaaaaagatcaaaaggcaactctctatgactctccgcggggggagaggcatcgataagactaacggagctcctgaacagataggactcgacgaatccggtgggggaggggggtcggatcccggcgaagctccaacacgcgcagcccctggtgagcttaggagcgcccgaggccccctgtcatccgctccagaaattgtccatgaggatctaaagatgggcagcgacggagagtcagaccaggctagcgctacctcctcggacgaggtgcagagtcctgtgcgggtgcggatgaggaatcacccaccgaggaagatcagcacagaagacatcaacaaaaggctgtcactccctgcagatatccgactgcccgaaggatatctggagaaactcactctcaattcccccatctttgacaaaccactctcacggaggctccgctag

SEQ ID NO: 29062 - DNA, 462 bp, Artificial Sequence
  Description of Artificial Sequence: Synthetic coding sequence
atggatagaatgaagaagataaagcgtcaattgtctatgaccctaagaggtgggagaggcattgataaaactaacggcgcccctgagcaaataggcctggatgaaagcggtggtggaggggggtcagacccgggcgaggctccaactcgggcagcacctggtgagctccgaagcgccaggggacccttatcctcggcccccgaaatcgttcacgaagacctgaagatgggtagcgacggggagagcgaccaggcatcggccacttcttctgacgaagtgcagtctcccgtgagggtccgaatgcgcaaccatccacctagaaagataagtaccgaggacattaacaagcgcctgtctctgccagcggacattagactcccagaaggctacttggaaaagctgactctgaactcccctatttttgacaaacccctgagccgccggctgcggcgggtttcatag

SEQ ID NO: 29063 - DNA, 174 bp, Artificial Sequence
  Description of Artificial Sequence: Synthetic coding sequence
atggatcgaatgaaaaagattaagaggcagttgagcatgacactgcgcggcggacgaggtatcgataagaccaatggtgcgcctgagcagatcggcctggacgagtcgggaggtggcggaggatccgatcccggagaggcccctacgagagcggcccccggtgagttgcgctag

SEQ ID NO: 29064 - DNA, 1347 bp, Artificial Sequence
  Description of Artificial Sequence: Synthetic coding sequence
atggaccgcatgaagaagattaaacggcagctatctatgacactgcgcagtgcaccagagatcgtccacgaagaccttaagatggggagtgacggcgagtccgatcaagcatcagctacctcttctgatgaggtccagagccccgtccgggtgaggatgcgcaaccatcctccgcggaagatctcaaccgaagatattaacaaaagattgagcttgcccgctgatattcgcttgcccgaaggttacctggagaagctgacgctcaatagccctatctttgacaagcctctttccaggcgcctgcgacgcgtgtcacttagcgaaattggcttcgggaaattagagacatacattaaactcgataagctcggggaggggacatatgcaaccgtctataagggtaagagcaagctgactgataatctcgtggccctgaaggagattcggctggagcacgaagagggcgctccttgtacagccatccgcgaggtcagcctcctcaaagatctcaagcacgccaacattgtgacgctgcacgacatcatccatacagaaaagtccttgacattggtgttcgaatatctcgacaaagaccttaagcagtatctcgatgattgcggcaacatcattaacatgcataacgtgaagctctttctgtttcaactgctccggggtcttgcctattgtcaccgccagaaagtcctacacagagatcttaaaccgcagaacctgctgattaatgaacgtggggagctcaagttggctgactttggtctcgctcgtgcgaagtccatcccaaccaaaacttacagcaacgaggttgtgactctgtggtatcgccctcccgatatcctgctgggaagtactgattactctacccagatcgacatgtggggagtggggtgcatcttttacgaaatggcaaccggcagaccgttattccctggatccaccgtcgaggagcagctgcactttatctttcgaatacttggtactccaacggaggagacatggccaggtatactgagcaacgaggagttcaaaacatacaactaccctaagtacagggccgaggcgttgttatcccatgctccacggttggattccgatggcgccgatctgctcactaagcttctgcagtttgagggacggaaccgcatctcagctgaggatgctatgaaacatcccttctttctgtccctaggcgagcggatccacaaactaccggatactacttcaatatttgctttaaaggagatccagctccagaaagaagccagcctaagaagtagttctatgccagactctggccggcccgccttcagggtcgtagacaccgagttttag

SEQ ID NO: 29065 - DNA, 1806 bp, Artificial Sequence
  Description of Artificial Sequence: Synthetic coding sequence
atgagaggggccaggcgcgcacggcgactcggcagatggctgttcggtcccggcatcaggcgccacagcgcaatcaggcctctttgcgcagcttcacgcagggagcattccgactcttcgagaagacagagggtgcgtggtcataggccccagcgcccgagctcgtggccggcggaaagagacgctgcgagtgcatcagctaccgcggccgccgctgcatccagctctagcgctgggggaggacccggcccagcaaccatggccgaggtcgccagagctccgccaccaatcgcgatggatcgcatgaaaaagatcaaaaggcagctttctatgaccttgcggggtggtaggggaatcgataagacgaacggtgctccggagcaaatcgggttagacgaatccggtggcggcggcgggtcagaccccggcgaagctcccacgcgagccgctcccggagagttacgctcagcgcgcggacccttatcgagcgctccagagatcgtgcacgaagacctgaagatgggaagtgatggcgagtctgatcaggccagtgctactagttctgatgaggtgcagagtccggtaagagtcagaatgaggaaccaccccccacggaaaatctcaactgaagacataaacaagcggttatccctcccagctgacattagactccctgaaggctacctggagaagctaacactgaactcaccaatcttcgacaagcctctgtcccgacgccttaggagagtgtcgctgtccgagatcggatttgggaagctggagacttatattaagctggacaagctcggtgagggcacatacgcaactgtctacaagggcaagtctaagctgaccgacaacctggtcgccttaaaagagataaggctggaacacgaggagggagctccttgcaccgctatccgcgaagtctctcttcttaaggaccttaaacacgcaaatatagttaccctccatgatatcatccatacagagaaatcgctaacactcgtgttcgagtacttggacaaggacctcaagcagtacctcgatgactgcggaaatataataaatatgcacaatgtaaaacttttcctgtttcaactccttaggggactggcttactgccatcgccagaaggtcctgcatagagatcttaagccccagaatctcctgatcaacgaacgcggggagcttaaattagccgacttcggcttggccagagctaagagcatccccaccaagacctacagcaatgaggttgttacattgtggtacaggcctcccgacatactgctagggtcaacagattactctactcaaatcgacatgtggggtgtgggttgcatcttttacgagatggctaccgggagacctctgttcccggggagtacagtagaggaacagctgcattttattttccgaattttgggtacaccaacagaggaaacttggccggggatactgtctaatgaagagtttaagacctacaactacccaaaatatcgagctgaagccctgctgtctcacgcccctcggagcctgtgcccatgcggaagactcgactctgatggggctgatctgttgaccaagcttctccagtttgagggccgcaataggatttcagcggaggacgccatgaaacatcccttttttctatcgctcggtgagaggatccataaactgccggatacaacttctatctttgcacttaaggagattcaactccaaaaggaagcatcgctccgatcttccagcatgcccgactccgggagacccgccttcagggtggtggacactgagttctag

SEQ ID NO: 29066 - DNA, 1572 bp, Artificial Sequence
  Description of Artificial Sequence: Synthetic coding sequence
atgaagaagttcaagaggcggctctcactcactctgcgaggaagtcagaccattgatgaatctctcagcgaactggctgaacagatgaccattgaggagaacagttccaaagataatgagcctatcgtcaagaatggcagacctccaacctctcatagcatgcatagctttttgcaccagtataccggctcatttaagaaaccaccgctgagacgcccgcactcagtcattggcggttccctggggagcttcatggctatgccaagaaacgggtcaaggctcgacatcgttcacgagaatctgaagatgggatctgatggtgagagtgaccaggcgagtggaacctccagtgacgaggtgcagagccccactggcgtttgcttgcgaaataggatccacaggaggatttcaatggaggatctgaacaaacggctgtcattgccagcagatatcagaatccctgacggatacctggagaaactgcagattaatagtcctccttttgatcaaccgatgtcaagacgctcacgaagggcaagcctgagcgagatcggattcgggaaaatggagacatacattaaactcgagaaactgggtgaaggaacatacgccactgtgtacaagggtcgctccaagttgaccgagaacctggttgccttgaaggaaattcgtttagaacatgaggagggcgctccatgcaccgccattcgcgaagtcagcctgttaaaagacctgaaacacgccaacattgttactctgcatgacatcgttcatacggataagagcctcaccctagtattcgagtatctggataaagatctcaaacaatacatggacgactgcggaaatatcatgagcatgcataacgtgaagctgttcttgtatcagatcttgcggggtttggcctactgtcacagaaggaaagtcttgcatcgggatctgaaaccccagaatctgttgatcaatgaaaagggcgaactcaagttggccgactttggtctcgcccgggcaaaaagcgtgcctaccaagacctacagtaatgaagtagtgacactatggtaccgtccacccgacgtcctgctgggctccagcgaatatagcactcaaatagacatgtggggggtgggatgcatctttttcgagatggcctccggaagacccctattcccagggtctaccgtggaggatgaactacatcttatttttcggctgctcgggacccctagtcaggaaacttggccaggtatcagctctaatgaggaattcaaaaactacaatttcccaaagtacaagccgcagccactaatcaaccacgctccacggctggacagcgaaggcatcgaactgattaccaagttcctacagtatgaatcgaagaaacgtgtgtccgccgaagaagcaatgaaacatgtctactttagaagccttgggccacggatccacgcacttcctgaaagtgtttctatcttttcactgaaggagatccagctgcagaaagaccctggctttagaaattccagttacccagagacagggcatggaaaaaaccgccgacagtctatgctgttctag

SEQ ID NO: 29067 - DNA, 1572 bp, Artificial Sequence
  Description of Artificial Sequence: Synthetic coding sequence
atgaaaaagtttaagcggcggctcagcctgacgctgcgaggctctcagaccatcgacgaatccctatccgagcttgcggagcagatgacgatcgaggagaatagtagtaaagataatgagccgatagtgaagaatggccgcccccctacctctcactccatgcattcttttcttcatcaatacactggcagttttaagaaacctccattgcggaggccccactctgtgatcggcggtagtctggggtcctttatggctatgcccaggaatggctcccggcttgacatagttcacgaaaacctgaagatggggtccgacggcgagagcgatcaggcctctggaacatccagcgacgaagtgcagtcacccacgggcgtctgtctgcggaacaggattcacaggaggatctccatggaggatctcaacaagcggctgtcactgcctgctgatattagaattcctgatggatatttggaaaagctgcagatcaactctccacctttcgaccagcccatgagtagacggtccagacgggcctccctgtccgagatcggatttggtaagatggagacatatatcaaattggaaaagctaggagaaggtacttatgcaaccgtctacaagggacggtcaaagctcactgagaatcttgtagccttgaaggaaatccgcctggaacatgaggagggcgctccttgtacggctattcgcgaagtgagtcttctgaaagacctcaagcacgctaatattgtgacgcttcatgacatcgtgcacacagacaagtccctgacactggtctttgagtatcttgataaagacctcaaacagtacatggatgattgtggcaacataatgagcatgcataatgtgaaactgtttctgtatcagatccttaggggcctagcctactgccatcggcggaaagtgttacaccgcgatcttaaaccccagaacttgctgatcaacgagaaaggcgagctgaagctggccgactttggactggcacgtgcaaagtcagttcccacaaagacttactccaacgaggtggtgacattatggtatcgccccccagacgtgctgctgggatccagcgagtatagcactcagatcgatatgtggggtgtgggctgtatcttcttcgagatggccagcggtcggccgctgtttcctggaagcacagtggaagacgagctgcacctgatcttccgactgctcggcacgccctcccaagagacgtggccagggatcagttccaacgaggagttcaagaactacaactttcctaagtataaaccacagccacttatcaaccatgcccctagattagacagtgaaggaatcgagctgattactaagtttctgcagtacgaaagtaagaagcgcgtatccgctgaagaagctatgaagcatgtctacttcagatcattgggtccccgaatccacgccctcccggagtctgtgtccatttttagcttgaaagaaattcagctgcaaaaggaccccggattccgtaacagctcatatcctgagacaggcgtcttcgtaattaaccactttacctgtcgctcatag

SEQ ID NO: 29068 - DNA, 540 bp, Artificial Sequence
  Description of Artificial Sequence: Synthetic coding sequence
atgaaaaagtttaagaggcgcctatcactgactcttcgtggcagccagacaattgacgagtcactttcagagctcgctgagcagatgacaatagaggaaaacagttcaaaagacaatgagccgattgttaaaaacgggagaccccccacgtcccactctatgcactcgtttctgcaccagtacacaggatctttcaaaaaaccccccttacgacgaccccacagcgttatcggcggttccctggggagctttatggcgatgccaaggaatgggagtcgattggatatcgttcatgagaacctcaagatgggcagtgacggagaaagcgatcaggctagcggaaccagtagtgatgaagtacagagcccgacgggagtgtgtctgaggaaccggatccaccgaaggatttccatggaagatcttaacaagagactgtcccttcctgcagatatcagaatccctgatggatacctggagaagttgcagatcaattcccctcctttcgatcagcccatgtctcgtcgaagcaggcgtgcatag

SEQ ID NO: 29069 - DNA, 267 bp, Artificial Sequence
  Description of Artificial Sequence: Synthetic coding sequence
atgaaaaaatttaaacggcgcctgtctctcaccttacggggttcgcaaaccatcgatgaatctcttagtgaacttgcggagcagatgaccatagaggaaaatagtagtaaggacaatgaaccaattgtgaaaaatggccgccccccaacaagccacagcatgcacagcttcttacatcaatatacaggtagctttaaaaagccaccacttcgccgcccacattccgttataggaggatcccttggatcattcatggccatgccatag

SEQ ID NO: 29070 - DNA, 486 bp, Artificial Sequence
  Description of Artificial Sequence: Synthetic coding sequence
atgaagaaatttaaacgacgcctgagtttaacactccggggaagccagacgatcgatgagagcttgtctgagctggccgagcagatgacgatagaggaaaactcatccaaggataatgaacctatagtcaagaatgggaggccacctacatctcactccatgcactcctttctgcatcagtatactggctcttttaaaaagccacctttgagacggcctcactccgtaattggcggttcattgggtagtttcatggctatgccgcggaatgggtctcgcttggacatcgtccatgaaaacctgaaaatgggtagcgacggcgagtccgaccaagcctcgggaacttccagtgacgaagtccagtcccccacaggggtctgcctcaggaaccgaatacatagaagaataagtatggaggatctcaacaaaaggttgagcctgccagcggatatccgaatccctgacggctacctcgaaaaattgtag

SEQ ID NO: 29071 - DNA, 1425 bp, Artificial Sequence
  Description of Artificial Sequence: Synthetic coding sequence
atgattatgaataaaatgaaaaactttaaacgcaggttctccctgagcgtgccacggactgaaaccattgaagagtccctggcagagttcaccgaacagtttaatcagctgcacaatcgcaggaacgaaaacctgcaacttggccccctgggacgggacccgccacaggaatgctcgaccttttcacccacggattctggagaggaacccggacagttgtccccgggcgtgcagtttcagcggagacaaaaccagagacgtttctcgatggaggatgtaagtaaaaggctctcactgcctatggatatcagacttccccaggaattccttcagaagctgcagatggaatccccagatttgccgaaaccgttatcaaggatgtccagaagggcgtccctgagcgacatcgggtttggaaagttagagacctacgtgaagctggataaattgggcgagggcacttacgcgaccgtcttcaaaggtcgctccaaactgaccgagaacctggttgccctgaaagaaatccggctggagcacgaggagggcgccccctgcacagccattcgggaggtgtccttgctcaaaaatctcaaacatgcaaatattgttaccctgcatgatctgatccacacagatcgcagcctgacattggtctttgagtaccttgacagtgacctgaagcagtacctcgatcattgtggaaacctcatgtctatgcataatgtaaaaatcttcatgtttcagctcctgagagggttggcatactgtcaccatagaaaaatcctccaccgggatctgaaaccacaaaacttattgatcaatgaaaggggcgagctcaagctcgccgattttgggctggcccgggccaagagcgtgcccaccaagacatattccaacgaagttgttactctttggtatagaccccccgacgtcctcttagggagcacagagtacagtactccaattgacatgtggggggttggttgtatccattacgaaatggctactggaagacctctctttcccggaagtactgtgaaggaagagctgcatttaatttttcgtctgctaggcacccccaccgaagagacctggcccggggttactgccttctctgagttccgcacatattcgttcccctgttacctgccccagcccctcattaaccacgcgccacgcctggatacagatgggatccacctgctaagttccctgctgctttacgaatccaagtctaggatgagcgccgaggctgcgctgagtcactcctatttccgctctctgggagagcgggttcatcaactcgaggatacagcctcgatcttctccttaaaggaaattcaattacagaaggacccggggtatagagggttggcattccagcagccgggacggggaaagaatcggcgacagagtattttttag

SEQ ID NO: 29072 - DNA, 855 bp, Artificial Sequence
  Description of Artificial Sequence: Synthetic coding sequence
atgatcatgaataagatgaaaaactttaagcgcagatttagcctcagtgtcccgaggaccgagacaatcgaggagagcttggccgagttcacagagcagtttaatcaactccataatcgccgcaacgagaacctccaacttgggccacttgggagagatcccccgcaagaatgttctactttcagcccaacagattccggcgaggaacccggccagttgtcacccggcgtacaatttcagcgccgccagaaccaacgtcggttttcaatggaagttcgcgcctccggcgctctgccccgccaggtcgccggctgcacccataaaggagttcaccgccgtgccgccgctctgcagcccgactttgacgtgtccaaaagactgtcattgccaatggatatccggctgccccaagagtttctgcaaaaactgcaaatggaaagccccgacctccctaaaccattaagccggatgagccgccgcgcatccctgtctgacatcgggtttgggaaattggaaacatacgtgaagctcgataagttaggcgagggtacctatgccaccgtgttcaagggccgcagcaaactcaccgaaaatctggtggccctaaaggagattaggttggagcatgaggagggagccccatgcacagccattagagaagtgtcgcttctcaagaatctgaaacatgccaacatcgtaaccctgcatgatctaatacatacagaccggtccctcacactggtttttgagtatcttgacagcgacctgaaacagtacttagatcattgtgggaatctaatgtcaatgcataatgtcaagatctttatgttccagctgctgagaggcctggcctag

SEQ ID NO: 29073 - DNA, 1425 bp, Artificial Sequence
  Description of Artificial Sequence: Synthetic coding sequence
atgattatgaataagatgaagaatttcaaacggaggttttcactgagcgtgccacgaactgagacaattgaagaaagcctggcggagtttacagagcaatttaaccagctgcacaatcgacggaatgagaatttacagctcggtccactgggtcgagaccctccccaggagtgcagtacgttctcacccaccgattctggcgaagaaccgggacagttaagccccggagtgcaatttcagcgtagacagaaccagcggcgcttcagtatggaggatgtttctaagagattgagcctgcccatggatatacgactcccccaggaattcttgcagaagcttcagatggaaagccccgatttaccaaagccgctgtcccggatgtccagacgcgcatctctttcagatattgggttcgggaaactcgagacctacgtgaaattggacaaattgggcgaaggcacatacgccacggtcttcaagggacgctctaagctgacagagaacctcgtggccctgaaggagatccgcctcgagcatgaggaaggcgccccatgtaccgcaatacgggaggtgtcacttcttaaaaacctgaagcatgcgaatatcgtaactctccacgaccttatccatacagacaggagcttgacactggtgttcgaatacctggactcggaccttaaacagtacctggaccattgtgggaatctaatgtctatgcacaacgtcaagatctttatgtttcagctcctgcgcggcctggcgtactgtcaccatcgtaaaattctgcaccgcgacctcaagccccagaaccttttaattaacgagaggggcgagctgaagcttgccgactttggtcttgcaagagccaaatccgtgcctactaagacgtattctaatgaagtcgttaccctctggtaccgcccgcctgatgtgctcttgggaagcactgagtacagtacccccatcgatatgtggggcgtggggtgcattcactacgagatggccactggcaggccactctttcctggtagtaccgtgaaggaagaactccatctgatctttagacttttgggaactccaaccgaagaaacctggcctggggtgacagccttttccgagtttagaacttatagctttccttgttatctgccccaacccctaatcaaccatgccccccgccttgacaccgatggtattcacttgctcagcagtctgctcctgtacgaaagtaagagtcggatgagtgcagaagccgcccttagccacagttactttcggtctctgggcgagcgagtacatcagttggaggatacggccagcatcttctctctaaaagaaatccagctgcaaaaagatcccggatacaggggcctcgccttccaacagccgggcaggggcaagaacagacggcagagcattttctag

SEQ ID NO: 29074 - DNA, 474 bp, Artificial Sequence
  Description of Artificial Sequence: Synthetic coding sequence
atgagtatgcataacgtgaagatcttcatgttccagctgctgcggggattagcttactgccatcaccgtaagatattacacagggatttgaagccccagaacctcctcattaatgagcgtggcgagcttaaactcgccgactttggcttagcacgggctaagtcagttccaactaagacatatagtaacgaggtggtgactctgtggtataggcccccagacgttctgctcggcagtactgagtacagtacccccattgatatgtggggagtgggctgcatacactacgagatggccacgggacgacccctatttcctgggtcaaccgtcaaggaagagctgcacttgatatttcgtctcctggggactcccaccgaggaaacctggcccggggtgaccgctttttccgagttcaggacatattccttcccttgttacttgccacagcctctcataaatcatgccccaagatag

SEQ ID NO: 29075 - DNA, 1515 bp, Artificial Sequence
  Description of Artificial Sequence: Synthetic coding sequence
atgattatgaacaaaatgaaaaatttcaaaaggaggttctccctctctgtgcccagaaccgagactattgaggagtcacttgctgagttcacagaacaatttaaccaactgcacaataggcgtaacgagaacctgcaactggggcctttggggagggacccaccccaggagtgcagtacattcagccccaccgatagcggtgaagagcccggtcagctgtcaccaggggttcagttccagcgacgccaaaatcagcgccggttttccatggaggtgagggcgagcggcgcactgcctcgacaagtcgcagggtgtacacataagggagtgcatagaagagccgccgccttacaacctgacttcgatgtgtccaaacggctctccttacccatggacatacgcctgccacaggagtttctgcaaaagctccagatggaaagcccggacctgcctaagccgttgtctaggatgtcgaggcgcgcttccctgtcagacattggattcgggaaattggagacctacgttaaactggataaacttggtgaaggaacttacgctaccgtgtttaaaggacggagcaaattgacagaaaatctggttgctctaaaagagatccgtctggaacacgaagagggggcgccctgtaccgctattcgggaggtctcgctgcttaagaatctgaagcatgccaacattgtaaccctacatgatctgatccacactgaccgctctctgaccctggttttcgaatacttggatagtgatttgaaacaatacctcgaccattgtggtaacttgatgtctatgcacaacgtaaagatcttcatgtttcagctattgagggggctcgcctattgccaccatcggaaaattttgcaccgagacctgaaaccccagaatctattaatcaatgaaaggggcgagttaaagctcgccgacttcgggctagcgcgggccaaatcagtacccacgaaaacctatagcaacgaagtggtgacactgtggtaccgtccccctgacgtcctgctggggagcacagaatacagcacccccatcgatatgtggggggtgggctgcattcactacgagatggccaccggccgcccactgttccctggaagcactgtcaaggaggagttacatctcatcttccggttgcttggtacaccaacagaggagacctggccaggggtgacagccttctccgagttccggacttattctttcccatgctacctgccccagccactgatcaaccacgccccaagactggacacggacggtatacatcttctgagctccttgctgctgtatgagtccaagagcaggatgtctgccgaggccgcgctgtcccattcttattttaggagccttggggaacgtgtgcaccaattggaagatacagcaagcattttttcactgaaagaaatccaactgcagaaggatcctggataccgtggactagctttccagcaaccaggacgagggaagaaccggaggcaatccatcttctag

SEQ ID NO: 29076 - DNA, 1329 bp, Artificial Sequence
  Description of Artificial Sequence: Synthetic coding sequence
atgtccgcttgccgggaaattgcattactccgtgagctcaaacacccaaatgtgatagctctccaaaaagtattcctgagtcattctgatcggaaagtgtggctcctttttgactacgctgagcacgacctgtggcatatcatcaaattccacagagcatcaaaggctaacaaaaagccaatgcagttgcccaggagcatggtcaagagcttgttgtatcagatattggacggtattcactacctacatgccaattgggtgctgcatcgagatttgaaacccgctaatatcctcgtcatgggggaaggccctgagcgcggtcgggtaaaaatcgcggacatgggatttgcacgcctatttaacagtccactgaagcctctagctgacctcgacccagtcgtcgtcacgttttggtaccgtgcccccgaacttctccttggcgcgcgccattacaccaaagccatcgacatttgggctatcggttgtatttttgccgaacttctgacatcagagccaatattccactgtcggcaagaggatatcaagacatctaacccctttcaccacgatcagttagatcgcattttttcagtcatgggcttccctgcagacaaggactgggaagatattagaaaaatgcctgagtaccctacactccaaaaagactttcggagaacaacatacgctaacagcagcctgatcaaatacatggaaaagcacaaagttaaacctgattctaaagtcttcttactgctccagaaactgctgaccatggatcccacaaagcgtattacctctgagcaggccctgcaagatccctatttccaggaagatccgcttcccacactggacgttttcgccgggtgtcagatcccatacccaaaaagagagtttcttaacgaagacgatccggaggagaaaggcgataagaatcagcagcagcagcaaaaccagcaccaacaacctactgctccacctcagcaggctgccgcaccacctcaagcgccccccccccagcagaactccacccagactaatggcaccgcaggcggcgcgggggcgggtgtcgggggaacgggtgctgggcttcagcatagtcaggactcatctctgaatcaagtgcctccaaataagaaaccgcgtctggggccctccggagcaaactctgggggccccgttatgccatctgactaccagcatagtagctcccgtctgaactaccaatcatccgttcagggctcttctcagagtcagtcaaccctcgggtactccagcagctctcagcaaagctctcaataccatcccagtcaccaagcccatcggtactag

SEQ ID NO: 29077 - DNA, 1509 bp, Artificial Sequence
  Description of Artificial Sequence: Synthetic coding sequence
atggattatgactttaaagctaaactggctgcagaacgggagagggtggaagatttgttcgaatacgagggatgtaaagttggaagagggacttacgggcacgtctataaggcacggcgcaaagatggtaaagacgagaaggagtatgcactgaaacaaatcgaaggcaccgggatttctatgtctgcgtgccgggagatcgccctgcttcgcgaactgaaacatccaaacgtgattgctctccagaaggtttttctaagtcacagcgatcgaaaagtgtggctactcttcgattacgctgagcatgacctctggcatattatcaagttccatagggcctctaaggctaacaaaaaacctatgcagctgccaagatccatggtcaagagcctgttatatcaaatactcgatggcatacactatctgcatgcaaattgggtgctacaccgggacttaaagcctgcaaatattcttgtgatgggagaaggccccgagagagggcgggtcaagattgctgacatggggttcgcccggctattcaattctcccctgaaaccacttgcagacttagaccccgtcgtcgttaccttctggtatagggccccagagctgttgttaggcgctcgccattataccaaggccatcgatatctgggccattggatgcatctttgcagagcttctgacctccgagcccattttccattgtcgacaagaggacatcaagaccagtaatccattccatcatgaccagctggatcgtatcttttcagtgatggggtttcctgcagataaagactgggaggatattcgaaaaatgcctgaatatcccacccttcagaaggacttccgccgtaccacgtacgcaaactcttccctgattaagtatatggagaagcacaaggtcaaaccagatagtaaagtctttcttcttcttcagaagctgcttaccatggatcccaccaaacgaatcacctcagagcaagccttacaggatccctacttccaggaggacccactgcctaccttagacgtgtttgcaggatgccagatcccgtatcccaaaagggaattcctgaacgaggacgacccagaggagaaaggcgacaaaaatcaacagcagcagcagaaccagcaccagcagccaacagctcctccacagcaggcagcagccccaccccaggctccccctccccagcagaatagtacccaaactaatggcaccgcaggcggcgccggcgcaggtgttggtggtacaggtgccgggcttcaacacagtcaggacagcagtctcaaccaagtgccccctaataagaaaccacgcctgggcccttctggcgctaatagcgggggccctgtgatgcccagtgattaccagcacagctcaagcaggcttaactatcagtcgagtgttcagggctcctcccaatcacagtccacgcttggctattcatcttccagtcagcagtcctcgcagtaccatccctcacaccaggctcatagatactag

SEQ ID NO: 29078 - DNA, 1326 bp, Artificial Sequence
  Description of Artificial Sequence: Synthetic coding sequence
agcctaacgaggaatatacaactccttcgagaactcaaacaccctaacgtgattgcgctgcaaaaggtgttcctttcacatagcgatcggaaagtctggttgttgttcgattacgccgagcacgatctgtggcacatcataaagtttcatcgggcctcaaaggctaacaagaagcctatgcaactccctaggtctatggtgaaatcacttttgtaccagattctggatggaatccattatcttcatgcaaactgggtgctccaccgtgatttaaaacccgccaatatcctcgtcatgggggaagggcccgagcgcggtcgcgtcaagatcgctgacatgggatttgcacgcctttttaactctcccctgaaacccttggctgacctggaccccgtggtggtcacattctggtacagggctccagagctccttctcggcgctcggcattacaccaaagcaattgacatttgggcaatcggctgcatattcgctgagctcctcaccagcgaacctatcttccactgccggcaggaagatatcaagaccagtaacccgttccaccatgatcagttagaccgcatcttctctgtcatggggtttcccgcggataaagattgggaagacattcgtaagatgccagaatatcccaccctgcagaaggactttcggagaacgacgtatgccaactctagtctcattaagtacatggagaaacacaaagtgaagcctgactccaaggtgtttctccttctgcagaagctgttaaccatggaccccaccaagcgcattacatccgaacaggcactacaggacccctacttccaggaagatcctttgcctaccctggatgtgttcgcaggctgtcagatcccataccctaagcgggagtttttgaacgaggacgatcctgaggaaaaaggtgacaagaatcagcagcagcaacagaatcagcaccagcagcccaccgctccaccacagcaagcggcggctccacctcaagcaccacctccccaacagaatagtacgcagaccaacggcacagccgggggggcgggggctggcgtaggagggaccggtgccggcctgcagcactcccaggactccagtctgaatcaggtgccaccaaataaaaagccccgactcgggccgagcggggccaacagtggtggcccggttatgccaagcgactaccagcattcttcctccaggttaaattatcaaagctctgtacaaggcagttcacaatcccagtctactcttggctacagtagttcgtcacagcaatcctctcagtatcatcctagtcaccaagcccacagatactag

SEQ ID NO: 29079 - DNA, 1137 bp, Artificial Sequence
  Description of Artificial Sequence: Synthetic coding sequence
atggattttgtgtttaatcctctgtggaaatacttatgccttctggccggcaagtgtattgtgctccttgtgaggccaaaactgaagccagcaaatattcttgtgatgggagaaggccctgagcgcgggcgtgttaaaatagccgatatggggtttgcccggttatttaactcccctctcaaacccttagccgatctcgaccccgtggtcgtgacgttctggtaccgtgctccagagctcttgctgggcgctaggcactacacaaaggccatagatatatgggccatcggatgtattttcgccgaattgctgacctcggaaccaatctttcactgcagacaggaggacattaagacgtccaatcccttccaccacgatcagctcgatcgtattttttctgttatggggtttcccgctgacaaggactgggaagacatccgaaaaatgcccgagtaccctactctccagaaagactttcggaggaccacatacgctaactctagtctgattaaatacatggagaaacataaagtcaagcctgactcaaaagtgtttctcctccttcagaagctgttaaccatggatccaacaaagcgaatcactagcgagcaggcattgcaggacccatactttcaggaagatcctcttccaaccctggatgtttttgcggggtgccagattccgtaccctaaaagagagtttctaaatgaggatgaccctgaggaaaagggggataagaaccagcaacagcagcagaaccagcatcagcaaccaacagcacccccccaacaagcagcggcgccaccacaagccccgcccccgcagcagaatagcacacaaactaatggcactgctggaggagcaggggctggagtgggaggaactggcgccggcctccaacactcacaggactccagtctgaaccaagtacctcctaataagaaacccagactggggccctccggtgctaactcaggaggcccagtgatgccaagcgactatcagcattcctcctctcgcctgaattaccaatcttctgtgcagggaagctcacagtctcagagtacccttggctactcctcctcctctcagcagtcatcgcaatatcatccatctcaccaagctcatcgctattag

SEQ ID NO: 29080 - DNA, 756 bp, Artificial Sequence
  Description of Artificial Sequence: Synthetic coding sequence
atgtccgcctgtagagaaattgcacttctacgggagctgaagcaccccaatgtgattgctctgcagaaggtcttcttgtcccactctgaccggaaggtatggctgctgtttgactatgccgagcatgacctgtggcacatcatcaagtttcatcgagcctccaaggcaaataagaaacccatgcaacttccccggtcgatggtcaaatctctactatatcagattctggacggaattcactatctccacgctaattgggtactccaccgcgatcttaaacccgccaatattcttgtcatgggggaagggcctgaacgcggacgcgttaaaatcgccgacatggggtttgccagactgttcaacagccccttaaagcctctagccgacctcgaccctgtggtggtgactttttggtacagagcaccagaactgttgttgggcgcccgccactatacaaaagccatcgacatctgggcaattgggtgtatctttgcagaactactcacatccgagcccatctttcattgcaggcaggaagacatcaaaacttccaatcctttccaccatgaccagctggaccgaatcttttcagtcatgggctttcctgcagacaaggattgggaggacattcgaaaaatgccagagtacccaaccctgcagaaggacttccgacggaccacgtacgcgaactcgtccttgatcaaatacatggaaaaacacaaggttaagccagatagcaaagtctttctgctctag

SEQ ID NO: 29081 - DNA, 381 bp, Artificial Sequence
  Description of Artificial Sequence: Synthetic coding sequence
atgtcttataagcccatcgcaccggctccctcctcaacaccaggaagctctacaccagggccaggcactccagtacccaccgggtcggtaccgtccccctccggaagcgtccctggtgcaggagccccctttagacctctgttcaacgacttcggcccccccagcatggggtacgtacaggcaatgaaaccaccaggagctcagggttcacaatccacctatactgacctgctcagtgtcatagaggaaatgggtaaagaaatccgaccgacctacgccggcagtaagtcggctatggagaggctgaaacgcggcattatacacgcgagggcacttgtgagggagtgcctggcagaaacagagcgtaacgctcggacgtag

SEQ ID NO: 29082 - DNA, 1077 bp, Artificial Sequence
  Description of Artificial Sequence: Synthetic coding sequence
atgatggaaaaatacgagaaaattggcaaaataggggagggaagttatggcgtcgtgtttaaatgccgcaacagggataccggtcaaatagttgctatcaagaagttcctggaatcagaggacgatcctgttatcaagaagattgcacttagagagatcaggatgctcaagcaacttaagcatccaaatctggtaaacctgctggaggtcttccgccgcaagcggcgccttcacttggtattcgagtattgtgatcacaccgttctgcatgagctggaccggtaccaacgaggagtcccagagcatctggtgaaatccataacctggcagactctgcaggcggtgaatttctgtcacaagcacaactgtatccacagagatgtgaaaccggaaaacatcctgattaccaaacatagtgtgattaagctgtgcgacttcggctttgcaagactacttactggccctagtgattactacacggactatgtagctacgaggtggtacagaagtccagaattgcttgtgggcgacacacaatacgggcctccagtcgacgtctgggctatcggatgcgttttcgccgagctcctgagcggggtgcccttgtggcctggaaaaagtgacgtcgaccaactgtatctgattcgtaaaaccctgggggatctgattccccgccaccaacaggtatttagcacaaaccaatacttctcaggtgtcaaaatcccagacccggaggatatggagccgctggaattgaagtttcctaatattagttacccagccctcgggctgctgaagggatgcctgcacatggaccctacccagcgtcttacctgtgagcagctactgcaccatccctactttgagaacatacgcgagatagaagatttagctaaggagcacaacaagcctaccagaaaaacactgagaaaatcccgtaaacaccactgtttcaccgagacgtccaaactacaatacctgccacagcttaccgggagttctattctcccggcgctcgataataagaaatattactgcgatactaaaaagctcaattacagatttccaaacatttag

SEQ ID NO: 29083 - DNA, 747 bp, Artificial Sequence
  Description of Artificial Sequence: Synthetic coding sequence
atggaggcccctgaaggcggtggaggagggccagctgccagaggacccgaagggcagcctgccccagaggcacgcgtgcatttcagagtggccaggttcattatggaggcaggagtaaagcttggcatgcgttccatccccatcgccaccgcctgtactatttaccacaagtttttctgcgagacaaatctggatgcttacgatccgtatctgattgctatgtcttctatctatctggcaggtaaagtggaggagcagcacctgagaactcgggatataataaatgtgtctaaccgctactttaacccatctggagaaccactggagctcgactcccgcttttgggagttgcgggactcaattgtgcagtgcgaacttcttatgcttagagtgctgaggttccaagtcagcttccaacatcctcataaatacctcctccactatttggtatcactgcagaattggttgaataggcactcttggcagcgcacccctgtggcagttaccgcctgggcgctgcttagagacagttaccatggcgctctctgcctccggtttcaggcacagcacatagctgtcgccgtactgtacctggcactccaggtttacggcgtagaggtgcccgcagaagtcgaagcagagaagccttggtggcaggtgtttaatgatgatttaacaaagcccatcattgacaacatcgtgagcgatctcattcaaatctacacaatggacaccgaaatcccttag

SEQ ID NO: 29084 - DNA, 1134 bp, Artificial Sequence
  Description of Artificial Sequence: Synthetic coding sequence
atggagctgtcagtgctcctgttcttagcactattgaccggactgttacttcttctagtccaaagacacccaaattcacacgggaccctcccacctggccctcgccctctgcccttgcttggaaacctccttcaaatggacagacgcggtttactcaaaagctttttacgctttcgcgagaaatatggtgatgtttttaccgttcatctgggccctagaccggtcgttatgctgtgcggtgtggaagccattcgtgaggctctggtcgataacgcggaggccttttccgggcggggaaagatcgtaatcatggatcccgtgtatcaggggtacgggatgctctttgccaacggtaaccggtggaaggtgttgaggcggttcagtgttaccactatgagagatttcggcatgggtaaacggagcgtggaagagaggattcaagatgaagcacaatgtctaatcgaggaattacgtaagtccaaaggagcgctcgtcgatcccactttcctctttcatagcattacagccaatattatttgttcaatcatattcgggaagaggtttcactaccaggatcaggagtttttgaagacgctgaacctattctgtcagtcctttctgttaatatcttccatatcctcccagctgtttgagctgttctcagggttcctcaaatattttccaggagctcatagacaagtctacaagaaccttcaagagatcaacgcctacatcggacactctgtcgagaagcaccgcgagaccctggatccatccgctccgcgtgatctcatcgatacctatctgttacacatggaaaaagagaagagcaacccacattcagagttctcccaccagaacctgattatcaatactctttctctgtttttcgcaggcaccgaaaccacctcaactactctgagatatgggtttctccttatgcttaaatatccacacgtggccgaacgagtctacaaggagatagagcaggtggtgggaccccatcggccccctgcgttggacgatcgggccaagatgccttatactgaggcagtgatccgcgaaatccagagattcgccgatttattgccgatgggcgtgccacatatagttactcaacatacgtcattctag

SEQ ID NO: 29085 - DNA, 999 bp, Artificial Sequence
  Description of Artificial Sequence: Synthetic coding sequence
atggctctgctctgctataaccgagggtgtgggcagcggttcgacccagaaaccaattccgatgacgcctgtacctaccatcccggggtgccagtatttcatgatgccctcaaaggttggtcttgttgtaagcggcggaccaccgatttttccgattttctgagtatcgtgggatgcacgaagggtcgccacaactccgaaaagcccccagagcctgttaagcctgaagtcaaaaccacggagaagaaagaactgtgcgagttgaaacccaaatttcaggagcatatcatccaggcgccaaaacccgtcgaagctatcaagcgtcctagccccgatgagcccatgaccaatctcgaattgaagatttcagcaagccttaagcaggctctggacaagctgaaactctcctctggcaatgaggaaaacaagaaagaggaggacaacgacgagatcaagatagggacaagttgcaagaacggggggtgtagcaagacataccaaggtttagaatctctggaagaagtttgcgtgtaccactccggtgtccccatcttccacgaagggatgaagtactggtcctgctgtagaaggaagacttccgatttcaacactttcctagcacaggaggggtgtaccaaagggaagcacatgtggaccaaaaaggatgctggcaaaaaggtcgttccctgtcgccatgactggcaccaaacagggggcgaggtgacgatctcagtctatgctaagaattctctcccagagctttccagagttgaggccaactccacacttctgaacgtgcacatagtctttgagggagagaaggagttcgaccagaatgtgaaactgtggggggttatcgacgtgaagaggtcttatgtcacaatgaccgcgaccaaaatcgaaataacaatgaggaaagccgagcccatgcaatgggcctccctggagctgcccgccgcaaagaagcaggagaagcaaaaggacgccaccaccgattag

SEQ ID NO: 29086 - DNA, 942 bp, Artificial Sequence
  Description of Artificial Sequence: Synthetic coding sequence
atggctctgctgtgttacaacaggggctgtgggcagaggtttgatccggaaacgaacagtgacgacgcatgcacataccacccaggggttcctgtcttccacgatgctctgaagggctgtactaaaggtaggcataactctgagaagccccccgagcctgtgaagcctgaggtcaagactaccgagaaaaaagaactttgcgagctgaagcctaaatttcaagagcatatcatccaggctccaaagcccgtggaagccattaagcgcccatcacccgatgagccgatgacgaacctggaactgaagatatcagccagccttaagcaagcgttggataagctgaaattatcatcagggaatgaggaaaataagaaagaggaggataacgatgaaataaagattggaacatcttgcaaaaacggggggtgcagcaagacttaccagggtctcgagtccctcgaggaggtgtgtgtctatcatagtggagtgcctatcttccacgaagggatgaaatactggtcctgttgtcggagaaaaacaagcgactttaacacattcctggctcaggagggctgtaccaaggggaagcacatgtggaccaagaaggatgccgggaagaaagtggtcccttgccggcatgattggcatcagacaggaggtgaagttaccatttctgtatacgcaaaaaacagcctccccgagctgtccagggtagaagccaactcaaccctgctgaacgtacatatcgtttttgagggcgaaaaggaatttgatcagaatgtgaaactctggggcgtaatcgacgtcaaacgaagctatgtcactatgacagcgactaagatcgaaattacaatgcgtaaagctgaacccatgcagtgggccagtctggagttaccggctgcgaagaagcaggagaagcagaaagacgccacaactgactag

SEQ ID NO: 29087 - DNA, 1563 bp, Artificial Sequence
  Description of Artificial Sequence: Synthetic coding sequence
atgtccattccgctgaaaagctcctttttgttgtcctacctttgcaccttacctccggctctgttgtctcgcgaaatcctgatggcagattccgaggcattaccaagcctagctggcgacccagtggcagtggaagcgctattacgcgccgtgtttggggtcgtagtggacgaagcaattcagaaggggacctccgtgtcccagaaagtttgcgaatggaaagagccagaagagctcaagcagctcctggatcttgagctgcgcagtcagggagagtcgcagaaacaaatcctcgagcgctgtcgagctgtgatcagatacagcgtgaaaacaggacatccacgattttttaatcagcttttcagtgggctagacccccacgctcttgccgggcgaatcattaccgagtccctcaacactagtcagtacacttacgaaatcgcgcctgttttcgtgttgatggaggaggaagtgcttaggaaactccgggctctcgtcgggtggtcttcaggcgacggaatcttttgtccaggcgggtctatcagcaatatgtatgccgtcaatttagcccgctatcagcggtaccccgactgtaaacagaggggcctgagaactttacccccacttgccctgttcactagcaaagagtgccactatagcattcagaaaggtgccgcttttctgggactaggaaccgactcggtgagggtggtgaaagcagacgagcgcggaaaaatggtacctgaggacctagagcgacagatcggcatggctgaagccgagggggcagttccattccttgttagcgccaccagtggtactaccgtcctcggcgccttcgaccctcttgaggctatcgcagacgtgtgccagagacacggcctttggctgcatgttgacgcggcatggggaggaagtgtgttactcagccaaacgcaccggcatctgctggacggaatacaacgcgccgacagtgtagcttggaatcctcataagcttcttgcggccggactacagtgttctgccctcctcctacaggatacaagcaatcttttgaaaaggtgccacggatctcaggctagctacttattccaacaggacaagttctatgatgtcgcactggacaccggggacaaagtcgtccagtgcgggcggcgcgtcgattgcctgaagctttggttaatgtggaaagcacagggcgatcagggtctagaacgcaggatagaccaagcctttgtgctggccagatatttggtagaggaaatgaagaaaagagaggggttcgagctggtgatggagccagagtttgtgaatgtttgcttttggttcgtgccacctagcctgcgcggcaaacaagaatcaccagactaccatgagcgactgagcaaagtcgctcctgttttgaaagaacgaatggtgaaagaaggtagcatgatgatcgggtaccagccacatggaaccagagggaattttttcagagtggtggtcgcgaattcggctttgacttgtgccgatatggatttcctccttaacgaattagagaggctgggacaggatttatag

SEQ ID NO: 29088 - DNA, 1749 bp, Artificial Sequence
  Description of Artificial Sequence: Synthetic coding sequence
cacggccttagggccactgaagcgctgccaagtgttcggaccacccttaggtctctgggactcgcccctacctgccaagcgaggccccccgccggctcactggcggcgaggaggctactccaggcgcccgcccacccagctaaccccactgctgctgccgcccccacggggaccgaggcgacatctcagatgtgggccacccactcaggtcggccaagatcctacttatgcaccctgcctcccgccctccttagcagggagatattgatggcagacagcgaggccctgcccagcctggctggcgatccagtagccgtcgaagcactgcttcgcgccgtgttcggcgtcgttgtcgatgaggccatacaaaaaggcacgtctgtgagccagaaggtctgcgaatggaaggagccagaagagcttaagcagttactcgatctggaactgaggtcccagggagaatcacagaaacagattttggaaagatgccgcgccgtcatacggtacagtgtgaaaaccgggcatccaagattctttaatcaactgttcagcggactggacccacatgcactcgccggccgtatcattacagagtctttgaatacctcacagtatacctatgagatcgctcccgtgtttgtactgatggaagaggaagtcttgcgcaagttgcgggccctggttggatggtcttccggggacggtattttctgcccaggaggctccatttcaaacatgtatgctgtaaatctggctcgatatcagcgttatcccgattgcaaacaacgcggcctgcgcacattaccccccctggcgctgttcactagtaaagagtgccattattccattcaaaagggagccgcatttctgggcttgggtaccgactcagttagggtcgttaaagcagacgaacggggcaagatggtaccagaagacctggagcggcagatcggaatggctgaagctgagggcgccgtgcccttcttagtgtcagctacttcaggtactacagtgctgggagcttttgatccgctagaggccattgctgatgtctgtcaacgccatgggctttggctgcacgttgatgccgcctggggtggttctgtcctgctgagccagacccatcgtcacctgttggatgggatacagcgggcagacagcgtggcctggaatccccacaaactgctggcagctggactacagtgcagtgcactgttattgcaagatacctctaatctactgaaaaggtgccatggcagtcaggccagctatctgtttcaacaggacaaattttatgatgtggccctggacaccggcgataaggtcgtgcagtgtggcagaagggtggattgcttgaaattgtggttgatgtggaaagcccagggtgaccaagggctggagaggcggattgaccaggcctttgtcttggctcgctatctggtggaggaaatgaagaagagagaaggctttgagctggtaatggagcctgagttcgtgaatgtgtgtttctggtttgtgcctcccagtctgagagggaagcaggaatctcctgactaccatgaaaggcttagtaaagtggcacctgtgttgaaagagcgcatggttaaggaggggagtatgatgattggataccagccacatgggactagaggaaattttttccgagtcgtcgtcgcaaattctgctctgacatgtgcagacatggattttctgttaaacgagttagaaagactcggacaagacctctag

SEQ ID NO: 29089 - DNA, 1041 bp, Artificial Sequence
  Description of Artificial Sequence: Synthetic coding sequence
atggctgactccgaggccttacccagtctcgcaggagatccggtagcagtagaagccctgctcagggctgtcttcggggtcgtggtggacgaggcaatccagaaagggacctcagtatcgcagaagtgccactatagcatacagaagggggccgctttcttgggactgggcaccgattccgtcagagtggtaaaggcagacgagcggggcaaaatggtccccgaagatttggagcgccaaatcgggatggccgaggccgaaggagcagtcccatttcttgtgtctgcaacatccgggacgactgtattaggagcattcgatcccttggaagccatcgcagacgtgtgccagaggcacgggctctggctgcacgtggacgcagcatggggcgggagcgtgttgctttcccagacccaccgacatttactggacggcatccaaagggcggattccgtggcctggaatccacacaaattactggcggccggccttcagtgtagcgcactgttgcttcaagacacttcaaatcttctgaagcggtgccatgggagtcaggccagctacctgtttcagcaggacaagttttacgatgtggcacttgacactggtgacaaggttgttcagtgcggaaggagagtcgattgtctgaagttgtggcttatgtggaaagcgcagggtgaccaaggtttggaaagaaggatagaccaggcctttgtcctggcgagatacctagtggaggaaatgaaaaaacgggaagggtttgagctggtcatggagcccgaatttgtcaacgtgtgtttttggtttgtccccccctctctgagaggaaaacaggaatcccctgattaccacgagcgtctgtcaaaagtagcgcccgttcttaaggaacggatggttaaagagggctctatgatgattggctaccagccacatggcactcggggcaatttctttagagtggttgtggcaaatagcgcgttgacatgcgccgacatggatttcctgctgaatgagctggaaagattggggcaggatttgtag

SEQ ID NO: 29090 - DNA, 1041 bp, Artificial Sequence
  Description of Artificial Sequence: Synthetic coding sequence
atggccgacagcgaagccctcccctccttggccggggatccagtcgccgtagaggctctgctcagggctgtgttcggagtggtggtcgatgaagctattcaaaaggggacgtccgtgtcacagaaatgtcactactctatccagaagggcgctgcctttttaggcctgggcaccgatagcgtcagggtggtcaaagctgacgagcgaggcaagatggtacctgaagatctggaaaggcaaataggcatggctgaggccgagggagctgtgccttttctggtgtccgccacatcaggaacaaccgtcctgggcgcctttgacccattggaggccattgccgacgtatgccaaaggcatggtctctggctgcacgtggacgctgcctggggcggttcagtcttactgtctcagactcatcgccaccttttggatgggatccaaagagcagatagcgtggcctggaacccccacaagctgcttgccgctggtctccagtgcagcgctctgttactccaggacacttccaatctccttaagcggtgccacggcagccaagccagctacctgtttcagcaggataagttttatgatgtggccctagacacaggggacaaggtagttcagtgcgggcggcgggtcgattgcttgaagctctggctcatgtggaaggcccagggcgatcagggattagaacgtcgaatcgaccaggcttttgttctggcgcgctatttagtggaagaaatgaagaagcgagaggggtttgagctggttatggagcccgagttcgtaaatgtctgtttctggttcgtgccacctagcctgcgcggcaaacaggagagccccgactaccacgagagactgagcaaggtcgcaccagtactgaaggagcggatggtcaaagaagggagcatgatgatcgggtatcaaccacatgggacacgaggcaattttttcagagttgtggtcgccaactctgccctcacgtgtgcagacatggacttcttattaaatgaactagagaggctggggcaggacctgtag

SEQ ID NO: 29091 - DNA, 1365 bp, Artificial Sequence
  Description of Artificial Sequence: Synthetic coding sequence
atggccgattccgaggcacttccttcgttggccggggaccccgttgccgtggaggcactcctccgggccgtttttggagtggtggtcgatgaggccattcagaaaggaacctccgtctcccagaaagtctgtgagtggaaagagcctgaagaactgaaacagctgctggatctggagctacgtagccagggggaatctcagaaacagatcctggagcgctgtcgtgccgtgattagatactccgtaaagaccggtcatccccgtttcttcaatcaactcttttctggactggatccgcatgctttggcagggcgtataatcacggagagtctgaacacttcccagtatacttatgagattgcccccgtcttcgtattgatggaggaggaggtgctgcgcaagctgcgtgctcttgtcggttggtcaagtggagatgggatcagcgccctctgccattactccatccagaaaggagccgccttccttggtctcggaacggattcagtgagagtggttaaggccgacgaacgggggaaaatggtccctgaagaccttgaacgacagattggcatggcggaagcagaaggcgcggtacccttcttggtcagtgcgaccagcggtactactgtgctgggggctttcgaccccctggaagctatcgctgacgtgtgtcaacggcatggcttgtggctgcatgtggatgctgcatggggcggatcagtcctgcttagccagacacacaggcacctcttagatgggatccagcgtgcagactcagttgcctggaatcctcataaattgcttgcagctggactacaatgctccgccctcctgttgcaggatacaagcaacctactcaaacgctgccacgggtcccaggcgagctacttgttccagcaggataagttttatgacgtcgcactggacacaggcgataaggtagttcaatgtgggagaagggtcgattgtctgaaattgtggctaatgtggaaagctcagggcgatcagggactcgaacgcagaatagaccaagccttcgtgctcgctcgatatctggttgaggaaatgaagaagagagagggcttcgagctggtgatggagcctgagtttgtaaacgtctgcttctggtttgtccctccaagccttagaggtaaacaggagtccccagattatcatgagcgcctgagtaaagtcgcacccgtcttgaaagaaagaatggtaaaagagggatctatgatgattggctaccaacctcacggaacccggggtaattttttcagagtcgtcgtcgcaaattccgctctcacctgcgctgatatggacttcttgttgaatgaactagagagattaggacaagatctctag

SEQ ID NO: 29092 - DNA, 1482 bp, Artificial Sequence
  Description of Artificial Sequence: Synthetic coding sequence
atggctgacagtgaggcccttccctcattagccggagatcctgtcgccgttgaggccctcctccgcgcagtattcggggtggtggttgatgaagcgatccagaagggcacatctgtgagtcagaaggtctgcgaatggaaggagcccgaggaattaaagcagttgctggacctggagttgcggtctcagggcgagtcacaaaagcagatattggaaagatgcagagctgtaattcggtatagtgtgaagacgggccatcctaggttctttaaccaattattttccggactggacccacatgcactcgccggacgtatcatcaccgagtccctgaatacctcacagtatacctacgagatcgcccccgtgttcgtgctgatggaggaagaagtcctccggaagttgagggcgctcgttggctggagtagcggagatggaatcttttgccctggcggcagcattagtaacatgtacgccgtgaatctcgcacgctaccagaggtacccggactgcaaacagcggggcctaaggacattgccaccccttgctctctttacctccaaagagtgtcactattccatccaaaaaggtgccgcattcctgggtctaggaaccgatagcgtacgggtggtgaaagcagatgaacgcggcaaaatggtgcctgaggatctggaaaggcaaatcggaatggcggaggccgaaggagctgtccccttccttgtctccgcaaccagtggcaccaccgttctcggcgcttttgatcccctggaggctatagccgacgtgtgccagaggcacgggctctggctccacgtggatgctgcatggggtggttcagtcctgctgtctcagacacacaggcacttattagacggcatccagagggcggactctgtagcgtggaaccctcataaactgctagcggcagggctgcaatgctcagctctgctgctgcaagatacctcaaacctgctgaagagatgccacggcagccaggcgtcttatctgtttcagcaggataagttttatgacgtggcattggataccggcgataaggtggtccagtgcggaaggagagtggattgcctcaaactttggctgatgtggaaggcccagggagatcagggcctggagaggagaatcgatcaggcctttgttcttgcccgatacctggtcgaagagatgaaaaagcgggagggttttgagttagtgatggagccagaatttgtgaatgtatgcttctggtttgtccctccttcactgagaggcaagcaggagagcccagactaccatgagcgactctcaaaggtcgcgccagttctcaaagagcggatggtcaaagaaggcagcatgatgatcggttatcaaccgcatggtactcgaggcaactttttcagggtggtcgtggcgaactctgccttgacctgtgcagacatggatttcctgctgaacgaactggagcggctgggccaggacctgtag

SEQ ID NO: 29093 - DNA, 459 bp, Artificial Sequence
  Description of Artificial Sequence: Synthetic coding sequence
atggccgactctgaagctctgccaagcctggcaggcgaccccgttgctgtcgaggctctgcttagggctgtgttcggagtggtggtcgacgaggccatacaaaaagggactagtgttagccagaaggtttgcgaatggaaagaacctgaagagctcaagcagctgctggatttagagctgaggtcccaaggggaatctcagaagcagatcttagagaggtgtagggcagtcatacgatatagcgtcaagacgggtcacccaagattctttaatcagctgttctccggcctggatccgcatgcgctcgccggtcggatcataacagagtcactgaatacctcccaatacacatatgaaattgcaccagtcttcgtgttaatggaagaggaggtgctgagaaaactgcgggctcttgtgggatggtcctccggagacgggatattctgtccaggcttgtag

SEQ ID NO: 29094 - DNA, 804 bp, Artificial Sequence
  Description of Artificial Sequence: Synthetic coding sequence
atggcagattccgaggcattgcctagcctggctggagaccctgtagcggttgaagcactgctgagggccgtgttcggggtggtggttgacgaagccattcagaaggggacctcagtctctcagaaggtttgtgagtggaaggagccggaggaactcaaacaactccttgatcttgaactgaggagccagggagaatctcagaaacagattctggagcggtgcagagcagtgatcagatactcagtgaaaaccgggcacccaaggttttttaatcagctgttttccggcttggacccccatgccctggcaggtcggattattaccgagtccctgaatacttcccagtacacctatgagatcgccccggttttcgtgcttatggaggaggaagtacttcggaaactacgggctcttgtggggtggagttccggcgacggtattttctgccccggcggaagcatctctaacatgtatgccgtgaaccttgctcgctaccagcgatatcccgactgcaaacagcgaggactgagaactcttccacctctggctctgttcacaagtaaggaggtcggaaaaagacacaggccgaaccctgggttattgatccttatctcctcacacgttacgactcctagtaggagggagttgagattttgggatcttgccccgaccgtctctgagtggagtcgactgatgcgggaggggaaatggtctcctcgcatttggaggggacggttagtctggcccagattgcgggtcctttgcaggtcttggagtgtccctcctctggcccccctgtgttag

SEQ ID NO: 29095 - DNA, 300 bp, Artificial Sequence
  Description of Artificial Sequence: Synthetic coding sequence
atgtcaagtcaacagtccgctgtgtccgccaaggggttttcaaaggggagcagccagggccctgcaccttgtcctgccccagcgcctacacctgcccccgccagcagtagctcttgttgcgggtccggcagaggctgttgcggcgattcgggctgttgcgggtccagcagcacaagctgctgttgttttcctcgccgccggcgaaggcagcgctcaagcggatgttgttgctgcggcggaggcagccagaggtcccaaaggagcaacaacagaagctctgggtgctgcagcggatgttag

SEQ ID NO: 29096 - DNA, 372 bp, Artificial Sequence
  Description of Artificial Sequence: Synthetic coding sequence
atggcctcgcacgtcgaatgtaggcctcttggggtttttgaatgcgaactgtgtaccctgactgcaccttactcttacgtgggccagaagccacccaatacacagagcatggtgctcctggaagaatcttacgtgatgaaagatcctttcacttctgacaaggacaggttcctagtgctgggtagttgctgctctctctgttctcgactggtatgcgttgggcctgaatgctctcttttttacagtaagaggttttgccttccctgcgtgagagaaaatatcaatgccttcccccaggaaatccgacaggacctagaaaaacggaaagccccttccaagcgcactccatcacagcccgggtcacgtacctag

SEQ ID NO: 29097 - DNA, 1545 bp, Artificial Sequence
  Description of Artificial Sequence: Synthetic coding sequence
atgaaggaagccggccaaatgcaaaaccttgaatcagcccgggccggccgaagcgtgagcacacagacggggtcgatgacgggtcagattcctaggctctctaaagtgaaccttttcaccttgctgagcctgtggatggagctgttccctgccgaagctcagcgccaaaagtcgcagaagaatgaagaggggaagcatggacctctgggggataatgaggagcggacacgggtctctactgataagcgacaggtgaagagaaccggactcgtggtcgtgaagaacatgaagattgtcgggcttcattgctcaagtgaggacctgcatgccggccagatcgccctgataaagcacgggtcaaggctgaaaaattgtgatctttattttagcagaaaaccctgttccgcatgtttaaaaatgattgtgaacgccggggtgaacagaatatcctactggcctgcagatccggaaataagtcttctaaccgaggcttctagcagtgaagacgccaagctggatgcaaaggctgtcgaaaggctgaagtctaacagcagggcacacgtgtgcgtgttgctccagcccctggtgtgttacatggttcagttcgtggaagagacatcctacaaatgcgactttatccaaaagatcactaaaacccttcctgatgcaaataccgacttctactatgagtgtaaacaggagcgaattaaagagtatgagatgttattcctggtaagcaacgaagaaatgcacaagcagattctcatgacgattgggttagaaaacctttgtgagaatccttacttctccaatttacgacagaacatgaaagatcttattttactcctggctaccgtggcttctagcgtacctaacttcaaacacttcggcttctacagatcaaaccccgaacagattaacgaaatccacaaccaaagcctgccccaggaaatcgctcggcattgcatggtccaggccagactacttgcctaccgcaccgaggatcacaaaacaggcgtgggtgccgtcatttgggctgagggtaaatctcgcagctgcgatggcactggtgccatgtattttgtgggctgtggttataatgccttccccgttgggagtgaatatgcagacttcccacacatggacgacaaacaaaaggaccgagaaattaggaaattccgctatatcatacacgctgagcaaaatgccctgaccttcaggtgccaggagatcaaacccgaagaaaggtcaatgatctttgtgaccaaatgtccatgtgacgagtgcgtgcctttaataaagggcgctggaattaaacagatttacgccggggacgtagacgtcggcaaaaagaaagccgacatttcctacatgaggtttggagaactcgagggcgtcagtaaatttacctggcagctgaatccttctggagcatacgggttagagcagaatgaacccgagcggagagaaaacggagttctgaggcctgtgcctcaaaaggaagagcagcatcaggataagaaactgcggctgggaattcactag

SEQ ID NO: 29098 - DNA, 951 bp, Artificial Sequence
  Description of Artificial Sequence: Synthetic coding sequence
atggtgcagtttgttgaggagacatcatataagtgtgactttatccagaaaatcactaaaacccttccagatgccaacactgacttctactacgagtgcaaacaggagaggatcaaggagtacgagatgttgttcttagtttctaacgaagagatgcataagcaaattcttatgaccattggcctggaaaatctctgcgaaaacccctattttagtaaccttcggcagaacatgaaggacttgatcctgctgttggccacagtggcctcctccgtcccgaatttcaagcactttggattttatagatccaacccagagcagattaacgagattcacaatcagtctctcccacaggaaattgcccggcactgcatggttcaggcgcggctgctggcttaccgtacggaagaccacaagacaggagtgggtgctgtcatttgggccgaggggaagtcacggtcctgcgacggaactggggctatgtactttgttggttgcgggtacaacgcctttcctgtgggcagcgaatacgccgacttccctcacatggacgacaagcagaaggaccgcgagatcaggaagttcaggtacatcatccacgcagaacagaatgccttgacgtttcgatgccaggagattaaacccgaggaacgctctatgatttttgttaccaaatgcccatgtgatgagtgtgtgccattgattaaaggggccggaattaagcagatctatgctggagacgtggatgtggggaaaaaaaaggccgatatctcatatatgagatttggggaactagagggggtcagcaaattcacatggcagctgaatccaagtggcgcttatggattggagcagaatgagcctgagagacgtgaaaacggcgtcctccggcccgttccacagaaagaggagcaacaccaggacaaaaagctcagactcggcattcattag

SEQ ID NO: 29099 - DNA, 462 bp, Artificial Sequence
  Description of Artificial Sequence: Synthetic coding sequence
atgaaggaagccggacaaatgcagaatcttgagtccgcacgggccggcagatccgtctccactcagaccggctccatgacaggacaaatacctcggctgtcgaaagtgaacctgtttaccttgctgtctctctggatggagctcttccccgccgaggcacagcgacagaaatcccaaaagaatgaggagggtaaacacggacccctaggagataatgaagagagaacacgggtgagcaccgataaacgccaggttaagcggacaggtttggtggttgtcaaaaatatgaaaatcgtcggtctgcactgttcttctgaggacttgcacgccgggcagatcgctctgatcaagcatggtagcagactaaaaaactgcgacctatacttttcaagaaagccctgcagtgcttgcctgaaaatgatagtgaacggactgctggaagccgccaaaatgccaagatag

SEQ ID NO: 29100 - DNA, 1506 bp, Artificial Sequence
  Description of Artificial Sequence: Synthetic coding sequence
atggatgaaaacaatggcctgctattgctggagttaaatccacctaacccttgggacctgcagccgagatcgccagaggagctcgcgttcggcgaggtgcagataacctacctcacgcacgcatgcatggacttgaaactcggggataagagaatggtgtttgacccctggctaatcggaccagcctttgctcggggatggtggctcctccacgagcctccgagcgattggttggagcgtctgtgtcaggccgatttgatctatatcagccacctgcattccgatcatctgtcttatccaacacttaaaaaactggccggacggcgtcctgatatcccgatctatgtcggcaatacggagcggccagtcttctggaacttgaaccaaagcggggtgcaacttaccaacataaatgtagtgcccttcgggatatggcaacaagtcgacaaaaacctgcggttcatgattctgatggatggtgttcaccctgaaatggatacttgtatcattgtggagtataagggacacaagatcttgaatattgttgattgtacgcgtccaaatgggggaagactacccatgaaagtcgccctaatgatgagtgacttcgcaggtggagcatccgggttcccaatgactttcagtggagggaagtttacggaagagtggaaggcccagttcattaagacggaacgcaagaagctgctgaattataaggctagactcgtgaaaaatctccagccccggatatattgtcccttcgctggctacttcgtggagtcccatcccagcgataagtatatcaaggaaacaaatactaaaaacgaccccaacgaactcaataacctgatcaagaagaattcagatgtgataacctggacaccgagaccgggtgccacccttgatcttgggcggatgctgaaggaccgcacggacagcaagggaattatcgaacctcctgagggtaccaagatttacaaggactcctgggacttcgagccctatcttgagattctgaacgcggctctcggggacgaaatatttctacattcctcatggattaaagaatactttacatgggccggatttaaagattacaatctggtggtgcggatgattgagaccgacgaagacttcaaccccttcccaggtggctacgattatctggtagactttctcgacctgagcttccctaaagaacgcccccagagagaacatccctatgaggaaatccactccagagttgacgtcatccgccacgtggtgaagaatggacttctctgggatgagctttacattggattccaaacccggttgcaacgggatccggatatttatcaccacctattttggaaccatttccaaatcaagctaccgctcaccccaccgaattggaagtcttttttgatgtgctgcgagcaaaacgggcctgtgatactgcagtttagcacagaaagaaccaacgagccgaatagaaataaattttctgtggagaataaagcatag

SEQ ID NO: 29101 - DNA, 1461 bp, Artificial Sequence
  Description of Artificial Sequence: Synthetic coding sequence
atggacgagaataacgggttgctcttgctggagttaaacccccctaatccctgggatcttcagccccgtagcccggaggaactggcttttggcgaggtccaaataacatatctgacccacgcatgcatggacctcaagttgggcgacaaaagaatggtgtttgacccttggctgattgggcccgcgttcgcacgggggtggtggttgctgcacgagcctccctccgactggcttgaacggctctgccaggcggacctcatttacatcagtcatttgcacagtgaccacctcagttatccaaccctgaagaagctggccggcaggcgccccgatataccgatttacgtcggaaacacagagagacctgtcttctggaacctcaaccagtctggtgtacagcttaccaatattaacgtcgtacccttcggcatctggcagcaggtggacaagaatctgagattcatgatcctgatggatggtgtgcatccagagatggatacttgtatcatcgtagagtacaagggccataaaattctaaatatagtagactgcaccaggccgaacggcggcaggttgcccatgaaagtggcccttatgatgagcgattttgctggaggagcctccgggttccccatgacatttagcgggggcaaattcactgaggagtggaaagcacaattcatcaagacagagcggaaaaagcttctgaactacaaagccagactcgtcaaaaacttgcaacctaggatttactgtccctttgcgggttacttcgtggaaagccatcccagcgataagtatataaaggagacgaacaccaaaaacgaccccaacgagctaaataaccttattaagaagaattctgacgtgataacctggactccccgcccaggggcaactcttgatttaggccggatgttgaaagacagaaccgactctaaaggcattatagagccaccagaaggtaccaagatttacaaggacagctgggatttcgagccttatttggagatcctgaacgcggcactgggcgacgagatattcttacacagctcttggatcaaagagtatttcacatgggctgggtttaaagattataacctggtggttcggatgattgagacagacgaagacttcaaccctttccccggcgggtatgactacctggttgatttcctggatctgtcctttcccaaagaacgaccgcaaagggaacacccttatgaggagattcacagtagggtggacgttatccggcacgtggtaaaaaacgggctcctttgggacgaactctacattggattccaaaccaggcttcagagagaccccgatatctaccaccatctgttttggaaccatttccagatcaaattgccactgacaccccccaattggaagtcattcttaatgtgttgtgagcaaaacggacctgtgattttacaagaatgtaagaccacctag

SEQ ID NO: 29102 - DNA, 663 bp, Artificial Sequence
  Description of Artificial Sequence: Synthetic coding sequence
atggacgagaacaatggcctgctgctgctggagctgaaccctccaaatccatgggacctacagccaagaagtcccgaggagttggcctttggggaagtccaaatcacatacctaacgcacgcatgtatggatttgaaactgggtgacaagaggatggtgtttgacccgtggttgatcggcccagcgttcgcccgcggatggtggctgctgcatgagcctccatctgactggctggagaggctctgccaggcagacctgatctacatttcccatctacactctgatcatctatcttaccccactctcaagaaacttgccggccgccgacctgatatccctatttatgtggggaatactgagagacctgtcttttggaatctgaaccagagcggagtccaattaacgaatattaacgtggtgccattcgggatatggcaacaggtggacaaaaacctgaggttcatgattctcatggatggagtccaccccgaaatggacacctgcatcattgtggagtacaaaggacacaagattctgaatatagtggactgtaccaggcctaatggagggcgcctacccatgaaggtcgccctaatgatgagtgactttgctgggggagcaagcggctttcctatgacattttccggcggcaagttcacgtag

SEQ ID NO: 29103 - DNA, 681 bp, Artificial Sequence
  Description of Artificial Sequence: Synthetic coding sequence
atggatgaaaacaatggcctacttctgctcgaacttaacccccccaatccctgggatttgcagcccagaagccctgaggagctcgcttttggcgaggtccaaattacatacttgacacatgcctgcatggacctcaaactgggcgataaaaggatggtgttcgacccctggttaatcggacccgcgttcgctagagggtggtggctgcttcacgagcccccctcagattggttggagcggttatgtcaagcggacctcatctatattagtcatctgcacagcgatcacctgagctatccaaccctgaagaagcttgccggcagaagaccagatattccaatatacgtcggaaataccgaaaggcccgtgttttggaatttaaatcagtccggtgtgcagctgacgaatataaatgtcgtgcctttcggtatctggcagcaggtcgacaagaatttgagattcatgattttgatggatggggtccatccagaaatggacacatgcattatcgtggaatataaaggacacaagatcctgaatatagttgactgtacccgccccaacggcggaaggctccctatgaaggtggcactcatgatgtcagactttgcaggtggcgcttctggcttccccatgactttttccggcgggaagtttacagccgaggaaacattaatttag

SEQ ID NO: 29104 - DNA, 1506 bp, Artificial Sequence
  Description of Artificial Sequence: Synthetic coding sequence
atggacgagaataacggactgctgctgctggagcttaacccaccaaacccctgggatttacaaccacgttcacctgaagaactcgcattcggagaagtacaaatcacttatctgactcacgcgtgcatggacctgaagctcggggataagcgcatggtgtttgacccctggctgattggtcctgccttcgcccgcggatggtggctcctgcacgagcctccatctgactggttggagaggctgtgtcaagctgatctaatctatatatcgcacctccacagtgatcacttaagctaccctaccttaaagaagctggccggaaggcgccccgacatacccatttacgttggcaatactgagcggcctgtcttctggaatcttaatcagagcggggtgcagctcactaatattaacgtcgtcccttttggtatatggcagcaggtggataaaaatctgagattcatgattcttatggacggagtgcatccggagatggatacctgtataattgtcgaatacaagggccataaaatactgaacatcgtggattgcacacgccctaatggcggtcgactgcccatgaaagtggccctcatgatgtcagatttcgccggtggtgcttcgggatttccaatgacattcagtgggggcaaatttaccgaagagtggaaggcccaatttattaaaaccgaacgaaagaaactgcttaattacaaggccagactggtgaaaaatcttcagcccagaatctactgtccatttgcaggttatttcgtggagtctcacccgtccgacaagtacattaaagaaacaaatacaaagaatgatccgaacgagttaaataacttgataaaaaaaaactctgatgtgattacctggacaccacggcccggcgccacccttgatctgggccgtatgcttaaggatcggaccgattctaaggggattatcgagcccccagaggggaccaagatttataaggacagctgggatttcgagccatacctcgaaatactgaatgccgcccttggagacgaaatatttctgcacagctcatggataaaggaatatttcacatgggctggcttcaaggactacaatctggtcgtccgcatgattgagaccgacgaagattttaatccgttccctggcggctatgattatctcgtggatttccttgacctcagctttcccaaagagcgtcctcaacgtgaacatccctatgaggagatccactcgagagttgacgtgattaggcacgtggtgaagaacggactgctgtgggatgagctttatatcggttttcagactcggctgcaacgcgaccctgacatttaccatcacctgttttggaatcactttcagattaaattacccctaacacctcccaactggaagtcttttctgatgtgttgtgagcagaatggccctgtcattctgcagttcagcactgaacgcactaacgagcccaatagaaataaattcagcgttgagaacaaggcgtag

SEQ ID NO: 29105 - DNA, 522 bp, Artificial Sequence
  Description of Artificial Sequence: Synthetic coding sequence
atggatgaaaataatggccttctgctgctggaattaaatccgccaaatccctgggatctgcagccgcgaagtccagaagagctggcgttcggcgaagtccaaatcacatacctgactcatgcgtgtatggacctgaagctaggagataaacggatggtcttcgatccttggctcattggcccagcctttgctcgggggtggtggctcttacacgaacccccttcagactggttagagaggctgtgccaggccgacttgatctatataagccacctgcatagcgatcacttgagctaccctaccctgaaaaaactggctggaaggcgccctgatatccccatctatgtgggcaacaccgagagacccgtgttctggaatctaaaccagagcggcgtccaactgaccaacatcaatgtggtgcccttcggaatttggcagcaggtggataaaaatctgagatttatgattctcatggatggggtgcatccagagatggatacatgcataattgtcgaatactag

SEQ ID NO: 29106 - DNA, 687 bp, Artificial Sequence
  Description of Artificial Sequence: Synthetic coding sequence
atgcccaggcgcgggctagtcgctgggcctgacctcgagtactttcagcgccgatatttcacaccagctgaagtggctcaacacaaccgtccagaagatctttgggtgtcttaccttgggcgagtgtatgacttaacttcccttgctcaggagtacaaaggcaatcttctgctgaagcctatcgttgaggtcgccggacaggacatttctcactggttcgacccaaaaactagagatataagaaagcacattgaccctctgaccgggtgcttacgctactgcacccctcggggacgattcgtgcacgtgcctccacagctaccgtgcagcgattgggccaatgacttcgggaaaccttggtggcagggaagctactacgaggttggacgattgtccgccaagacacgcagcataagaataatcaataccctgacttcccaagagcataccctggaggtgggcgtcttagagtcgatatgggagatcttacacaggtacctgccttataatagccatgccgcttcctacacctggaaatatgaagggaaaaatctgaatatggattttactctggaggagaacgggataagagacgaggaggaggagttcgattacctctctatggatggcactctgcacacccccgctatcctactgtattttaacgatgaccttactgagctttag

SEQ ID NO: 29107 - DNA, 474 bp, Artificial Sequence
  Description of Artificial Sequence: Synthetic coding sequence
atgccacggcggggcctggtggctggccccgatttagaatactttcaacgacgatattttactccagccgaagtagctcagcacaaccggcctgaagatctctgggtgtcttacttgggtcgggtttacgaccttacatctctagcccaggaatacaagggtaatctgcttcttaagccgatcgttgaggtggcagggcaggacatttctcattggtttgaccctaaaacgagggacattaggaaacacatcgacccactgacaggttgccttcggtattgcactcctagaggccggtttgtacacgtgccccctcagctgccttgtagtgactgggctaatgactttggcaagccctggtggcaggggagttactacgaagtgggcagacttagtgcaaagacccggagcatccggatcatcaacacccttacaagtcaggagcacaccctggagatccatgaggaactgtag

SEQ ID NO: 29108 - DNA, 744 bp, Artificial Sequence
  Description of Artificial Sequence: Synthetic coding sequence
atgatggctgaacgcgaggaggacgatgacacggaagaagcttggatgcagctacgtcccacggagcccttaccatcgcagtgctgcggctctgggtgcagtccatgcgtgttcgatctctaccaccgcgaccttgctcgttgggaggccgcacaggcctccaaagacaggagtctgctgcgcggccccgagtctcaatcctgtcctagcaagcttaatccagagacctttgtggcattctgcataattgctatggaccgactgaccaaggatacttaccgagtcaggttcgccctgcctggcaatagccagctgggactgaggccaggacaacatttgattttgaggggcatagtagacgaccttgaaattcaacgcgcttacaccccgatctctccggccaacgcagaaggatacttcgaagttttgataaaatgctatcagatgggattgatgtcccgctacgtcgagtcttggcgcgtgggcgacacggcgttttggcggggaccgtttggagattttttctacaagcccaaccaggagtcatcttctgaacagttgccttggtcctaccaggagaaaactcactttgggcacctcggccaggatctaatcaaagaactggttagctgctgtcggagaaaacctttcgccctagtatgcgggtctgctgaatttacaaaggatatcgcacggtgcttgctttgcgcaggcttaaccgaggactcctatttcctcttctag

SEQ ID NO: 29109 - DNA, 504 bp, Artificial Sequence
  Description of Artificial Sequence: Synthetic coding sequence
atgggcctgatgagtaggtacgtcgaaagctggcgggtcggagatacagcgttctggagaggaccttttggggatttcttttacaagcctaatcagtacggcgaactgttgcttctggctgcaggcacaggcctggcacctatggtgcccattctgcagtctatcacagacaacgaaaacgacgaaaccttcgtgacactcgtgggatgttttaaaactttcgaaagtatctacttaaagactttcctgcaagagcaggctagattctggaatgttagaacattcttcgttctctcacaggagtctagctcagaacaactgccatggagttaccaggagaaaacgcacttcgggcacctgggccaggacctgattaaggaactcgtgagctgttgtcggcggaaaccattcgccctcgtgtgcggcagcgccgagttcaccaaggacatcgcacggtgtcttctctgtgctgggctgactgaggacagctattttctcttttag

SEQ ID NO: 29110 - DNA, 948 bp, Artificial Sequence
  Description of Artificial Sequence: Synthetic coding sequence
atgatggcagagcgtgaggaggatgacgatacagaagaagcctggatgcagctccgaccaaccgagcctctaccttcgcagtgctgcgggagcggctgctccccttgcgtattcgacctgtatcaccgggacctggcaagatgggaagccgcgcaggcatctaaggaccgctcacttctccgtgggcccgaaagccaatcttgcccctcaaaacttaatcccgaaacttttgtcgcgttctgcatcattgccatggatcgactgacgaaggacacataccgtgttagattcgccttgcctggaaacagccagctaggactcagaccaggtcaacacttgatcctgaggggcatcgtcgatgatctggagatacagcgcgcttatacgccaattagtcccgctaacgcggagggttattttgaagtcttgatcaagtgttaccagatgggcttaatgagtcgctacgtcgaatcttggagggtcggcgatacagcattttggaggggcccttttggcgacttcttttataaaccgaatcagtacggggagcttcttcttctcgccgctggtaccggcttggctccaatggtgccaatactccagtctattactgacaatgagaatgatgaaacgttcgtgaccttggtggggtgtttcaaaacctttgaaagcatctacctgaagaccttcttgcaggagcaggcccgattctggaatgtcagaacattttttgtgttgtcccaggagagctcctccgaacagcttccatggtcttatcaggagaagacacacttcgggcatctgggccaggatctgattaaggaacttgtctcctgttgccggaggaaaccttttgctctcgtctgcggctcagctgaatttaccaaggacatcgctaggtgccttctttgcgcaggactgactgaggacagctattttctgttctag

SEQ ID NO: 29111 - DNA, 417 bp, Artificial Sequence
  Description of Artificial Sequence: Synthetic coding sequence
atgatggccgagcgggaggaggatgatgatacagaggaggcctggatgcagttgaggcccactgagcctctgcccagccaatgctgtggcagtggctgctctccttgtgtatttgacctgtaccaccgagatctggcacgctgggaagccgcacaggcctctaaagataggtccttattacgcggtccggaatcacagtcttgtccatctaagttgaatcctgaaacattcgtggctttctgcattatcgcaatggacaggctgacaaaggacacttacagggtgcgattcgcactgccgggaaacagtcagctgggcctgaggcccggacaacacctcattcttcgctatacccaggtggctggcgggccaaaactccattcaccagccctcctgttcgctagttgctggccttag

SEQ ID NO: 29112 - DNA, 948 bp, Artificial Sequence
  Description of Artificial Sequence: Synthetic coding sequence
atgatggcagagagagaggaagatgacgatactgaggaagcctggatgcagctgcggcctacagaaccactgccgtcccagtgctgcgggtctggctgtagtccttgtgtgttcgatctctaccaccgggatcttgcacggtgggaggccgcccaggcttccaaagaccgaagcttgctacgcggccctgaatctcagtcctgcccttccaaactaaaccctgaaacctttgtggccttttgcatcattgccatggacaggctgaccaaggacacatatcgcgtgaggtttgctctaccgggaaactctcaactggggctgcggcctgggcaacacctgattctgagaggcattgtggacgacctggaaattcagcgagcatacacaccaatctcgccagccaatgccgaaggttactttgaagtgttaattaagtgttatcagatggggctcatgtcccgctacgtggagagctggagggttggagacactgcattctggcgggggccattcggggactttttctacaagccaaaccagtatggcgaacttctgctgctggccgccggcaccggacttgcccctatggtgccgattctgcagtcaataacagacaatgaaaacgatgaaacttttgtcacgttagtggggtgctttaagaccttcgaatctatctatctgaagacttttctgcaggaacaggctaggttctggaatgtaagaaccttcttcgtgttgtctcaggaatcaagctcagaacagttgccctggtcctatcaagagaagacacacttcgggcacctggggcaggatcttataaaagaactggtcagttgctgcagaaggaagccgttcgccctggtatgcggctcagctgagtttacgaaagacatagccagatgtcttttatgcgcagggttgacagaagattcctatttccttttctag

SEQ ID NO: 29113 - DNA, 744 bp, Artificial Sequence
  Description of Artificial Sequence: Synthetic coding sequence
atgatggccgagcgagaggaagatgatgataccgaagaggcatggatgcaactacgccccaccgaacctttaccaagccagtgctgtgggagtggctgctctccctgcgtgttcgatctgtatcatcgagacttggcaaggtgggaagctgcccaggccagcaaggaccgaagccttctgcgcgggcccgagtcacaaagctgtccgtctaaactgaatcccgagacatttgtagccttttgtatcatagctatggaccgtttgactaaagacacgtatcgcgtgagatttgctttacccgggaactctcaactcggcctgagaccagggcagcacctgatccttagggggattgtggatgacttggagatccagagggcctatacacctataagtcctgctaacgccgaaggctacttcgaagttctcatcaagtgctaccaaatgggccttatgagccgttacgtggaatcgtggagagttggcgataccgccttctggcggggtccttttggcgactttttctacaaacctaatcaagaaagctcttctgaacagctgccctggagctaccaagaaaagacacattttggccacctagggcaggacctgatcaaggagctggtgtcttgctgccgccggaaaccgtttgcactggtgtgtgggtccgctgagttcaccaaagacattgcgcgctgtctgctctgcgccggattaaccgaggactcttattttctattctag

SEQ ID NO: 29114 - DNA, 948 bp, Artificial Sequence
  Description of Artificial Sequence: Synthetic coding sequence
atgatggccgaacgggaagaggacgatgataccgaagaagcatggatgcagctgaggcctactgagccgctgccttcccagtgctgcggtagcggttgcagcccttgcgttttcgacttgtaccacagagacctcgctaggtgggaagccgcacaggcctccaaagaccgcagcctgctcaggggcccagaatctcagtcttgccccagcaaacttaatcccgagacattcgtggcattttgcatcatcgcaatggacaggctcacgaaggatacatatcgagttagattcgccctccctggcaatagccaactcgggctgagacccggacagcacctaattcttcgcggtatagtggacgatttagagatacagcgggcgtatacccccatctcccccgccaatgccgagggatactttgaggtcctcatcaaatgttaccaaatgggactcatgtccagatacgtagagagttggcgagtcggtgataccgctttttggcgcggtccattcggagatttcttttataagcctaaccagtacggagagcttctgctattggcagcagggactggtctggctcctatggtccctatcctccagagtatcactgataatgaaaacgacgaaacatttgttactcttgtggggtgtttcaaaaccttcgagtctatatacctgaaaacgttcctgcaggagcaggctaggttttggaacgtacgaaccttcttcgtcctgagccaggagtcttcctcagagcagctgccctggagctatcaggagaaaacccacttcggccatctcggacaagatctgatcaaagaactcgtaagctgctgtaggcggaagcctttcgccctggtctgcggctcggcagaattcaccaaagacattgcgcggtgccttctatgcgccggcctaactgaggattcttacttccttttttag

SEQ ID NO: 29115 - DNA, 246 bp, Artificial Sequence
  Description of Artificial Sequence: Synthetic coding sequence
atgagcaggagtagtaaggtggttttgggtttaagtgttctgctaactgctgctacagtggcaggagtccatgtcaagcagcaatgggaccagcaacggcttcgtgacggcgtaatacgagacattgaaaggcaaatcaggaaaaaagagaacatccgactactcggcgaacaaatcattctgacagaacagctggaggctgagcgcgagaagatgttgctggctaagggctcgcagaagtcctag

SEQ ID NO: 29116 - DNA, 810 bp, Artificial Sequence
  Description of Artificial Sequence: Synthetic coding sequence
gggctgttacttgtggcactgctagcctctttaacagtgatggtcctgatgagcgtttggcagcagcgaaagtcacgagggaagctgcccctgggtcctacgcctctgctgttcatcggtaattatctgcagctgaatacagaacacatttgcgattctatcatgaaaatctccgaaaggtatggccccgtgttcactatccatctgggccctcggcgggtcgtggttctctgcggccacgatgcagtgaaggaggcactggtggatcaagctgaggagttctccggaagaggggaacaggcgacctttgattggctctttaagggatatggtgttacctgtaggacctgggagagaactaaaccactgagacggttcagcatcgcaaccctgagagatttcggcgtcggcaaaagaggtattaaagagattcaggagaaggcagggttcctcattaaagcccaccagagctctgatagctctatttatccaaccttttttttgagtagaaccacttccaatgtaatttcaagtatagtgttcggggatcgattcgactatgaggacaaatttctgagcttgttgtgtatgatgctcgagagtttccagttcaccgcccccagtactggacagctttacgaaatgttttcctcggtcatgaagcacttgccgggaccccagcaacaggcgttcaaagaactgcagggccttgaagattttatcgcaaagaaagtggagcataatcagtgcactcttgatccaaatagtcctcgtgactttatcgatagcttcctaatcagaatgcaatag

SEQ ID NO: 29117 - DNA, 1338 bp, Artificial Sequence
  Description of Artificial Sequence: Synthetic coding sequence
atgggactcgaagcgctcgtacccttggcaatgatagtcgcgatttttttgttactggtggatctgatgcacaggcaccagcgttgggccgctagataccctcctggccctctgcccctgccaggcctgggcaatctgcacgttgatttccaaaacactccatactgcttcgatcaacttagacggaggtttggggatgtcttttccctacaattagcctggaccccagtggtagtgctgaacgggctagctgcagtgagagaggcgatggtgactcgaggcgaggacactgccgatcgaccccccgcccctatttatcaagtgctaggcttcgggcctagatcgcaaggtaggccgttcaggcccaatgggcttctcgacaaagccgtgtctaacgtgatcgcctcgctgacctgtggtaggaggttcgagtatgacgatccacgctttcttagattattggaccttgcccaggagggccttaaggaagagtctggcttcctgcgggaggtgcttaatgccgtgcccgtgctgcttcacatacctgcacttgctggaaaggtgctgcgcttccaaaaggcatttttgactcagctcgatgagctgctgaccgaacaccggatgacgtgggatcccgcgcagccaccacgggatctcacagaagcctttctcgccaagaaggaaaaggctaagggctctccggagagttctttcaacgatgagaatctacgcatcgttgtggggaatctctttctcgctgggatggttaccaccctgacgacgctcgcttggggcctgctcttgatgatattgcatctagacgtgcagttgagagtacagcaagaaatcgatgatgtaatcggccaggtgagaagacccgagatgggtgatcaggcacatatgccttacaccaccgctgtcatccacgaggtccagcgtttcggagacattattccgctgtccgtgacccacatgacctcccacgacatagaagtgcaggggtttagaattccaaaggggaccactcttatcacgaatctatcctcagttctgaaagacgaggccgtgtggaagaaacccttccgattccatccagagcactttttagacgctcagggccatttcgttaaacccgaagcttttctcccgttttctgccggcaggcgagcttgcctcggagaacctttggccagaatggagctctttctgttctttactagtcttctgcagcatttcagcttctcagtcgccgcaggtcagcctagaccctcacattcacgcgtggtgtcttttctggtgactcctagtccctatgagctgtgtgccgtcccacgttag

SEQ ID NO: 29118 - DNA, 1332 bp, Artificial Sequence
  Description of Artificial Sequence: Synthetic coding sequence
caggaagctctaaccctgccactccaactgcgccgcagattcggcgatgtcttttcacttcagctggcatggacgcctgtggtcgtgttgaatgggctggcggccgtaagggaggccatggtgacacggggtgaggacacagccgaccggccacctgcgcctatctatcaggtcctcggcttcgggccccgtgagcaatgggttttcctctcccggtacgggcctgcgtggagagagcagcggcgattcagcgtgtccacactccgaaatctgggactgggcaagaaatcccttgaacagtgggtcacagaggaggctgcctgcctatgcgccgcttttgcagaccaggatgccccgtttgctccgaccgtctcctggacaaaaccgaatgtgatagcctcactgacatgtggaaggcgcttcgagtacgacgatcctcgctttttacgcctgcttgacttggcccaggaggggttgaaggaagagagcggctttcttcgcgaggtgctaaatgcagtacctgtgttactgcatattcctgccctcgccggaaaggttctgaggtttcaaaaggcatttctgacccaactggatgagcttctgacagaacatagaatgacatgggaccctgctcaacctcctcgggatctgactgaagcctttttagcaaagaaagagaaggccaaaggatctccagaatcaagcttcaatgacgagaatttgcgcattgtggtcgggaacctgttcctggcaggaatggtgaccacgctgactacactggcatggggcctgttacttatgattctccatctggatgtccagctgcgggtgcagcaggagattgatgacgtgatcggccaggtgcgcaggccggagatgggagatcaggcccatatgccgtacacaactgcagtaatacacgaagtgcagagattcggcgacatcattccgttaagcgtcactcacatgacctcacacgacattgaagtgcaaggattccgcatcccaaagggcactaccctgattaccaatctgtctagcgtgctgaaggacgaggccgtttggaaaaagcccttccggttccacccggaacattttctagacgcccagggccacttcgtcaaaccagaggcttttctcccctttagcgccgggagaagagcctgcctgggcgaaccattagcccggatggagcttttcctgtttttcaccagcctgctgcagcactttagtttctctgttgccgcgggccagccccggccctctcacagccgtgtggtatcatttctggtcactcccagtccatacgagctgtgtgctgtccccagatag

SEQ ID NO: 29119 - DNA, 1491 bp, Artificial Sequence
  Description of Artificial Sequence: Synthetic coding sequence
atggggctggaggccctcgtgccgctcgctatgatcgtagcgatctttcttctcctggtggatctgatgcacaggcaccagcggtgggccgctaggtaccctccaggacctctgccgctgcctggactgggcaatctgcacgtggattttcagaataccccgtattgctttgatcagctgagacggcgttttggggatgtatttagcctgcagctggcctggactccagttgtggtgctgaatgggctggcagcggtacgggaggctatggttacacggggagaagacaccgcagacaggcctcctgctcctatctaccaggtgcttggctttggcccaagggaacaatgggtctttctgagcagatatggcccggcttggagggagcaacggagattctccgtgagcacactgcgaaacctggggcttggcaagaaaagcttagagcaatgggtcaccgaggaggcagcttgcctgtgtgcggctttcgcagatcaggctggtcggccctttcggccgaacggcctactggataaggccgtctcaaatgtcatcgcttctcttacttgcgggcggaggtttgaatatgacgaccctcgatttctgcggctgctcgatttggcacaggaggggcttaaagaagagtcaggattcctgcgtgaagtgctaaacgctgtgcctgtcctgttgcacattcctgcactagccggaaaagttctaagatttcagaaggccttcttgacgcagctcgacgaattgctcactgaacatcgcatgacatgggatcccgcgcaaccgcccagagatttaaccgaggcctttttagccaagaaagagaaagccaaaggctctccagagtcttcctttaatgatgagaacctgaggatagttgtggggaacctgttcctcgcaggcatggtcacgaccctcacgacactggcttgggggctgttgcttatgattctacaccttgatgtgcagcttagggtccaacaagagatcgatgatgtaatcggtcaggtgaggcgccctgagatgggcgaccaagcccatatgccctacaccacagcagtgatacacgaagtgcaaaggttcggggacataattccactgtctgtcacgcacatgacgagccatgacattgaagtccaggggtttcgcatccccaaaggcacaacccttatcacaaacctgtcctctgtcttgaaagatgaagcggtatggaagaagccattcagattccaccccgaacacttcttagatgcccaggggcatttcgtgaagcccgaggctttccttccattctctgcaggcaggagagcctgtctgggagaacctttagcccggatggaattgttcctcttctttactagcctcctgcagcatttcagtttcagtgttgcagccggtcagccccggccttctcattcccgggttgtatcatttcttgtaacaccaagcccttatgaactctgcgccgtgccaagatag

SEQ ID NO: 29120 - DNA, 1224 bp, Artificial Sequence
  Description of Artificial Sequence: Synthetic coding sequence
atggtcaccagaggagaggacacggccgatcgtcctcccgctccaatttaccaggtgcttggctttggtcccaggagtcaaggagtgtttctgagtagatatgggcctgcatggagagagcagcggcgcttctccgtatccaccctgagaaacctgggcctgggcaaaaaaagcttagaacagtgggtcaccgaggaggcggcctgtctgtgtgctgcttttgctgatcaagcaggtcgcccttttagaccgaatggcttactggataaagccgtctccaacgtgatagcctcactgacgtgcggtagacgattcgagtatgatgatccccgatttttgagactgcttgatttggcccaggaggggctgaaggaggagagcggcttcttgagagaggttctgaatgccgtgccggtgttgcttcacatcccagcactcgcaggcaaagtgctccgttttcagaaggcctttttgacacagctggacgagctcctgacggaacatcggatgacatgggacccggcccagcctccacgggacctgaccgaagcctttctggccaaaaaggagaaagccaagggatccccagagagttccttcaacgatgagaatttgagaattgtcgtaggcaatctgttccttgcagggatggtcacaacactgactacactggcatggggcctgctgctaatgattctacatctggacgttcagctgagagttcaacaggagatcgatgatgtgatcggccaagtgaggaggcccgagatgggtgaccaggcacatatgccgtatactaccgcagtcatccacgaggtgcagcgatttggcgatatcatcccactaagtgttacacatatgacctcccatgatatagaggtccagggcttcagaatcccaaaagggacaactcttattacgaatctttcatcagtgcttaaagacgaggccgtgtggaagaaaccctttaggtttcacccagaacattttctcgatgcgcaaggacatttcgtgaaacccgaagcttttctccctttttctgctgggagacgcgcctgtctcggggaacctcttgctaggatggaactgtttttgttctttaccagtctgctccaacatttcagtttctcagtcgcagccgggcagcctcgaccttcccactctcgggtggtttctttcttggtgacaccttccccatacgaactgtgcgcagtaccccggtag

SEQ ID NO: 29121 - DNA, 429 bp, Artificial Sequence
  Description of Artificial Sequence: Synthetic coding sequence
cagttgagacgcagattcggtgatgtgtttagcctccagcttgcttggacccccgttgtggttcagtgggccggcgggcgtgccagaggcgatggagacccccggagaggccatggacgccctcccgcctgcgcgcacctgccaggcgaccccctgcccgcttcacccacaccaagaacacccctgagcccccagcgaagcctcgggcagtcacgagaacagagagatcgccttccccatctgcgcgctcctctaagggtgcgacggcctagcctccctcaggcagcagggcctagttccggcggaactgaaggaggtgtcggtctccccgcaagaggggcagagtgctgtccccgtccccccgcccacccaagtgcgggatggcagggacccactttacctaagggatttcctgatcctgccggctag

SEQ ID NO: 29122 - DNA, 510 bp, Artificial Sequence
  Description of Artificial Sequence: Synthetic coding sequence
aagatccatgaggagattaaccaggtcatcggtccgcatcgacttccaagggtggacgaccgcgtgaaaatgccttataccgatgtcgtgatacatgaaattcagcgcctcgtcgacatcgtcccaatgggagtcccacacaatatcattcaggacacccagtttcgtggatacctcctgccgaagggaacagacgtgttcccactgttgggatccgtcctgaaggaccccaaatacttccgttaccccgacgccttctatcctcagcacttcctagacgagcagggccggttcaagaaaaacgaggcctttgtgcccttctcttcgggaaaacggatctgtctgggggaagctatggcgcggatggagctgttcctttattttaccagtaccctgcagaacttttccctctgcagcttagtgcctctggtagatatcgatatcacccctaagcttagcgggttcggtaacataacccctacatacgagctatgtcttgtggctcgctag

SEQ ID NO: 29123 - DNA, 1119 bp, Artificial Sequence
  Description of Artificial Sequence: Synthetic coding sequence
atgcggagtgtgttgcgtcagagaatcttaaagcccaaggatgtggccatttacagcggcgaggtcaaccaggtcattgctgatcttataaagaggatttatctgcttcgctctcaagccgaagacggtgagactgttactaacgttaatgaccttttctttaagtattccatggaaggcgtggctacgattctgtacgaatcccggttagggtgtctggagaacagcattccacagcttaccgtggagtatattgaggcgctggagctcatgttctcaatgttcaaaacatcgatgtacgcaggcgcgataccgcgctggctcagaccttttatcccaaaaccttggagggagttttgcaggagctgggatggcttattcaaattttctcaaattcacgtggacaacaagctgcgggatatacagtaccagatggaccgcggtcggagggtgtcgggggggctgctgacatacctgtttcttagtcaggcccttaccttacaggaaatctacgctaacgtaacagaaatgctgcttgctggggtggacacaacctcctttactctgagttggactgtctacctccttgcgcggcaccccgaggtacagcagacagtctatcgtgaaatcgtaaagaacctgggcgagaggcacgtgcccacagctgccgacgtgcctaaagtgccccttgttagggcactactcaaagaaacactgcgtctgtttccagtgctaccaggcaatggacgcgtgacccaagaagatctcgtgataggtggctatttgattcccaagggtacccagctggcactgtgccactatgcaacgtcttatcaggatgaaaattttcccagagctaaagagtttcgccccgaaagatggctaaggaagggcgacttagacagagtggacaactttggctcaatacctttcggacacggcgtccgctcatgcatcggacgcaggattgctgagctggagatccaccttgttgtgattcagttactccagcacttcgaaatcaaaaccagctctcagacaaacgccgtacatgcaaagacgcacggcctcctcacgccgggcggccccatacatgtgaggtttgtaaacagaaagtag

SEQ ID NO: 29124 - DNA, 1119 bp, Artificial Sequence
  Description of Artificial Sequence: Synthetic coding sequence
atgagatcagttttacggcagagaatcctgaagccaaaagacgtcgctatttatagtggcgaggtgaaccaggtaattgccgacctaatcaagcggatctacctgcttaggagccaggctgaggacggagagacggtcacaaacgttaatgatctgttcttcaaatacagtatggagggagtggccactattctgtatgagtctcgcctgggctgcctcgaaaatagtattcctcagctaactgtggaatatatcgaagccctggagctcatgttctcaatgtttaagaccagcatgtatgcaggcgcaattccacggtggctcagaccatttatcccaaagccgtggagggagttttgtaggtcatgggacggtctctttaagttttcacagatccatgtcgacaataagttacgcgatattcagtatcagatggaccgcgggcggagggtttccggcgggttactgacctatctgttcctatcccaagccctgaccctccaggagatttacgccaacgttaccgaaatgctgttagcaggcgtggataccacctctttcacattgtcatggacagtctatctcttggcccgccaccctgaggtgcagcagactgtgtatcgtgagattgtcaagaacctgggagagaggcacgtcccaaccgcagctgatgtgcccaaagtgccccttgtcagggccctcttaaaggaaactctgcgccttttccccgtgctaccaggcaatgggagagtcacccaagaagatctggttatcgggggttacctgatacctaaaggcacacaattggccctctgccactatgccacctcatatcaggatgaaaattttccaagagccaaagagttcaggcccgagaggtggttgcgcaagggggacctagatagagtggacaactttggatctatccccttcggccatggagttcgctcgtgcattgggaggaggatcgcagagttagagattcacctggttgtgatccaactgctacaacacttcgaaatcaaaacctcttctcagactaatgcagtgcatgctaaaacccacggccttctcacgccaggagggccgattcatgtgaggttcgtgaatcgcaagtag

SEQ ID NO: 29125 - DNA, 357 bp, Artificial Sequence
  Description of Artificial Sequence: Synthetic coding sequence
atggtgaccccagccggctgcctgggtgggaggaaccagggcccacgcgagatcccaggaactgcatttccaagatccagtagggctggtcagacagggcaagccgtgagcggcgcacaagtcagcagttggcgagagcgccaaccgtgttctggcagtagagggcctctgcacatactgggaactgacggcaatgtggatacgacaggtaagctggggctggtccctactcccccacggatacagaaggagacaaagcagggagccctgtgtggaatgaaacccccatttctcccagaggccttgctcattgtgtggtggctgcccttcgtggcagtcagcccctgcctgttttag

SEQ ID NO: 29126 - DNA, 1194 bp, Artificial Sequence
  Description of Artificial Sequence: Synthetic coding sequence
atggaagaagatgatagctacgtgccttcagacctgaccgccgaagaacgacaggagttggaaaatattcggcggaggaagcaggaacttttagctgatattcaacgtctaaaagacgagatcgcagaagtggctaatgaaatcgagaaccttggatcaactgaggaaaggaagaacatgcagcgcaataagcaagtcgctatgggtcgcaagaaattcaacatggatccaaagaaagggattcaatttctgattgagaacgatctgctcaagaacacatgtgaagatatcgctcagtttctgtataaaggggaaggtttgaataaaactgctatcggagactacttgggcgagcgggatgagtttaatatccaggtgctgcacgcgttcgtggagttgcacgagttcacagaccttaacctggtgcaggcacttcgacagtttctttggtcttttagacttcctggggaggcacaaaaaatcgatcgcatgatggaagcctttgcccagcgctactgccagtgtaataacggtgtctttcagtccacagatacgtgctacgttctgtctttcgccatcattatgctgaatacctccctgcacaacccaaatgtcaaggataagcccactgtggaaagattcatcgccatgaaccgaggcatcaacgatggaggggatcttcccgaggaactgttgagaaacctctacgagtcaataaaaaacgagcccttcaaaattccagaggacgacggtaatgatttgactcatacattcttcaaccctgaccgagagggttggctgctcaagttgggcgggcgcgtgaagacctggaaacggcgatggtttattctcactgacaactgtttatactactttgaatatacaacagataaagaaccaagaggcattataccattggagaacttatcaattagggaggtagaggacagtaagaagccaaattgtttcgaattatatatcccggataacaaggatcaggttattaaggcttgcaaaaccgaggccgacgggagggttgtcgaggggaatcacactgtttatcgcatctctgcgcctactcccgaggagaaagaagagtggattaagtgcattaaagccgcaattagcagggatcctttctacgaaatgctggccgcccgcaaaaagaaagtgtcaagcaccaaaaggcattag

SEQ ID NO: 29127 - DNA, 465 bp, Artificial Sequence
  Description of Artificial Sequence: Synthetic coding sequence
atggacctgtgtcacccggaacctgccgagttgtccagcggcgaaacagaggaattgcagcgcatcaagtggcatcgtaagcagcttttggaagacattcagaagctgaaagatgaaatagccgacgtctttgctcaaatcgattgctttgaatcggcggaggaatctagaatggcccagaaagaaaaggaactctgcataggacgcaagaagtttaacatggatccggcgaaaggcatccagtatttcatcgagcacaaattacttaccccggatgtgcaggacatcgcccgcttcctttacaagggcgaaggattgaacaagaccgccattgggacttatcttggggaaagggacccaatcaatctgcaggttctgcaggcattcgtcgattgccacgaattcgctaacctgaatctggtccaggctctcagggttgtgaaaactaagtgggaatccgtgtag

SEQ ID NO: 29128 - DNA, 777 bp, Artificial Sequence
  Description of Artificial Sequence: Synthetic coding sequence
atggctgaatactcctacgtgaagtcgaccaagttggtgctgaagggtaccaaaaccaagagtaagaagaaaaagagcaaggataagaagcgtaaaagggaggaggacgaggaaacacagcttgacatagttggcatatggtggacagttacaaatttcggagaaatctcaggaacaatcgctatcgagatggataaaggaacatacattcatgctcttgacaacggactcttcaccctgggcgcccctcacaaggaagtggacgaaggtccttctccccctgagcaatttacagctgttaaactcagtgactctaggattgcactgaaaagcgggtacggcaaatacctgggaatcaactcagacggactggtggtggggcggagtgatgcaatagggcccagggagcaatgggaacctgtctttcaaaacgggaaaatggccctgttagcctccaatagctgtttcattagatgtaacgaagccggtgacatagaggccaaatcaaagacagccggcgaagaagaaatgataaaaatacgcagttgtgccgaacgagagaccaagaagaaagacgatatccctgaagaggataagggaaatgttaagcagtgcgagatcaactacgtgaagaaatttcagtcattccaggaccataagctaaagatcagcaaagaggactccaagatactcaagaaggccaggaaagacgggttccttcatgaaacgttgctggacagacgcgccaagctaaaggctgaccggtactgcaaatag

SEQ ID NO: 29129 - DNA, 1179 bp, Artificial Sequence
  Description of Artificial Sequence: Synthetic coding sequence
atgaaccctcggggcaataggaaaaccacaaaagagggctccaacgatttgaagtttcagaatttttccttacccaaaaacaggagctggcctcgtatcaattccgccacaggccagtatcagcggatgaacaaaccactgctcgactgggaaaggaactttgccgcggtgttggacggcgccaagggccattcagatgacgactacgatgacccagaacttagaatggaggaaacttggcagtctattaaaattcttccagcccgaccaattaaagagtctgagtacgctgatacacattacttcaaggtggctatggacactcctttaccgctggacacgagaacgagtatcagtatcgggcaaccaacctggaatacccagaccagactggagcgcgtcgacaagcctatcagtaaggatgtgcgctcccagaacatccggcctcctctgtctcagagacataccttccccgaggtccagaggatgccctctcaaatcagcttgcgggatctttccgagagcctggaggcaaaaaaggtgccacacaaccagagaaaacctgagtccactcatcttctcgagaaccaaaacacccaggagatccctctggccatatcctctagtagctttaccacctccaatcactcggtacagaaccgcgaccaccgcggtggtatgcagccatgttcacctcagcgctgccagccccccgccagttgctcccctcacgaaaatatactgccatataaatatacgtcgtggcggccccccttcccaaagcgaagcgacaggaaggacgtgcagcacaatgagtggtacatcggtgaatattcccgccaggcggtcgaagaagcattcatgaaggagaataaagatggtagtttcctggtgagggactgttccaccaagagtaaggaggaaccctacgtgctggccgtcttttatgagaataaggtgtataatgtcaaaatccgcttcctggaacgcaaccagcaattcgccttaggaacaggcctcagaggcgatgagaagttcgattctgtcgaggacatcatcgagcattacaagaactttcctatcattctcatcgatgggaaagataagacgggggtgcacaggaagcagtgccacctgactcagcccctgccactcactcgccatctgcttcctctgtag

SEQ ID NO: 29130 - DNA, 510 bp, Artificial Sequence
  Description of Artificial Sequence: Synthetic coding sequence
atgaacaaacccttgctcgactgggaacggaattttgccgccgttctagacggtgctaaaggccattccgatgacgattacgatgatccagaattgagaatggaagagacgtggcaatctataaagatcctgcccgctagaccgattaaggagtctgagtacgctgacacgcactactttaaagtagccatggatacacccctgcccttggacaccagaaccagcataagtatcggacagccaacctggaacacacaaacaagactagaaagagtggacaagccaatcagcaaagatgtgcgctcacagaatattaaaggcgacgccagcgtgagaaagaataaaattcctctccctcctccacgaccattgattaccctgcccaaaaaataccaaccgctgcctcccgagccggaaagtagcagacccccgctgtctcagcgtcataccttccccgaggtacagcggatgccttctcagatctctctgcgggatctgagcgagccttag

SEQ ID NO: 29131 - DNA, 510 bp, Artificial Sequence
  Description of Artificial Sequence: Synthetic coding sequence
atgaataaacctctcctggattgggagcgaaacttcgctgccgtcttagatggcgcaaaaggccattcggatgatgattatgatgatcccgagctgcggatggaagaaacctggcaatccattaaaatcctgccagcgagaccaattaaagagagcgaatacgccgacactcactactttaaagtggcgatggacactcccctccctctcgacacgcgaacttcaatatctatcggacagcctacatggaacacacagacccggctcgaacgggttgacaaaccaatttctaaagatgttagatctcagaacataaagggagacgccagcgtgagaaagaacaagatcccactaccgccccccaggcctttaatcacactgcccaagaaataccagcccctccctcctgaaccagaatccagcaggccaccactgtcccagcgacacactttccccgaggtgcagcgcatgccctctcagattagtctcagagacctgagcgaaccgtag

SEQ ID NO: 29132 - DNA, 1695 bp, Artificial Sequence
  Description of Artificial Sequence: Synthetic coding sequence
atgcctgagtgcttgtggacccagggcgtattgcaggaggttctaaactcctacttttgcggatccatcatcctcagcacgctgccctgggaggttccaggtggacacgcctcaaggatctgtctcctccttttagctacaggcgagaacaaacaggtagaatgctaccaattgtctccggggctgtcttctctgcctgacttccaggatagcgaagagaccgttacgagcagaatgctgtttcctaccagtgcccaggaatcctcaaggggcctgcctgatgccaacgacctgtgtttgggccttcaaagtctgtccctgactggttgggatcgaccttggagcactcaagattcggacagttcagcgcagtcttccacacactcagtattgtctatgctgcacaaccctctcgggaacgtcttaggtaagccaccactgagctttttaccgctggacccactcggatctgacctagtcgataagttccctgctccaagtgtaagaggctcacgcttggacacccggcccatcctggattccaggtcctcgagtccaagcgatagtgacactagcggttttagctccgggagcgaccatctcagcgacttgattagcagtctgcgcatctctcctccgctgccgttcttgtcactgtcgggtggagggcctagagacccactgaaaatgggggtcggcagtcgcatggatcaggaacaggccgctttagccgccgtgacaccctcaccaacgtctgccagtaaaagatggcctggggcctcagtgtggccatcctgggacctgttagaggcccctaaggaccccttttctatcgagcgtgaggctcggctgcaccggcaagcagcagctgtcaacgaagccacttgcacctggtctggccagctgccaccaagaaactacaagaaccccatctacagttgtaaggtatttttgggaggtgtaccctgggacataacggaagccggcctagtgaatactttccgagtcttcggaagtctgtccgtggaatggcctggaaaggatggcaagcacccgaggtgcccgccgaaagggtacgtgtacctcgtgttcgagttggagaaatccgtgaggtctttattgcaggcctgctcccacgatcccctcagcccagacggtttgagcgagtactacttcaagatgtcatctagacgcatgcgatgcaaagaggtgcaggtgattccctgggtcctggcagatagcaacttcgtccgtagtccttcccagcgcctggacccaagtcgcacggtatttgtgggggctttacatgggatgctcaatgcagaggccttggcagccatcttgaacgacctattcgggggtgtagtgtatgctggtatcgatacagacaagcataaataccctataggatccggacgagtgacatttaacaaccaaagatcctacctgaaagccgtcagtgccgcgtttgtggagatcaaaaccactaagttcaccaagaaagtccagattgacccatacttagaagacagcttatgtcacatctgttcatcacagccaggccctttcttttgtcgtgatcaggtttgttttaaatacttctgtcggagctgttggcactggaggcattccatggaaggcctccgacaccatagcccccttatgcgtaaccagaaaaatcgagacagctcatag

SEQ ID NO: 29133 - DNA, 1476 bp, Artificial Sequence
  Description of Artificial Sequence: Synthetic coding sequence
atgctgttcccaacaagcgcccaagagtctagccgtggtctgccagacgcgaacgacctctgtctaggtctacaaagcttgtccctcaccgggtgggaccgcccctggtccacccaggattctgatagcagcgcccagtcaagcacacattccgtgctatctatgctgcacaaccccctcggcaatgtgttaggcaagccccccctcagctttctaccactggaccctttaggcagtgacctcgttgacaagtttcccgccccaagtgtccggggctctagacttgatacacgaccaatcctcgactcccggtcttcctccccatcagactctgacacttccggcttctcctccgggtctgatcacctgagcgacctcatttcaagcctgcgcattagtcccccactcccattcttgagcctgtccggaggcggcccccgggatccactgaaaatgggggtcggtagtcgaatggaccaagaacaggccgccctggctgcagttactccttcaccaaccagtgcctcaaagaggtggccaggcgcttctgtttggccatcctgggatttactggaagcccccaaagacccattttccatcgagcgggaggcccgactgcacagacaggcagccgcagttaacgaagctacttgtacatggtccggacaattgcccccccggaattacaaaaaccccatctattcatgtaaggtgttcctcgggggggtcccctgggacatcacagaggcaggccttgtgaacacctttagggtgttcggtagtttgtctgtggagtggcctgggaaggatggcaaacaccccagatgcccacccaaagggaacatgcctaagggttacgtgtatctagtgtttgaactggaaaagagtgtgcggtcactgctacaggcctgcagccacgaccccttatcccccgatggtcttagcgaatattactttaaaatgagctctaggcgcatgcggtgcaaggaggtccaagtgatcccctgggttctggccgattccaacttcgtccgctcaccctcgcagcgccttgaccccagtagaaccgtgtttgtgggggccctgcacggtatgttaaatgccgaggccctcgcagccattctgaacgacttatttggcggcgtggtgtatgccggtatcgatactgacaagcacaaataccctattggctcaggccgcgttacctttaataatcagagatcctacttgaaagcggtcagcgccgcgtttgtcgaaatcaaaactactaaatttaccaaaaaggtccagattgatccctacctcgaagactcactgtgtcatatatgctcttctcagcccggcccctttttctgcagagatcaggtgtgtttcaaatacttttgtaggtcttgttggcactggagacattctatggaggggctgaggcatcactctcccctcatgcgcaaccagaaaaatagggattcctcctag

SEQ ID NO: 29134 - DNA, 1008 bp, Artificial Sequence
  Description of Artificial Sequence: Synthetic coding sequence
atgggagtcggatcccggatggaccaggaacaggcagccctagccgccgtcacaccatctcccacgagtgccagtaaacgatggcccggagcatcagtttggcccagctgggacttgctcgaggcccccaaggatcccttcagtattgaaagggaagccagactgcataggcaggccgccgccgtgaacgaggccacgtgcacatggagtggacagctgccaccaagaaactacaagaatccaatttactcttgtaaggtattccttgggggcgtcccttgggacattacggaggcaggtcttgtgaatactttccgcgtctttggcagtctttctgtggaatggccgggaaaagacgggaagcatcccaggtgcccgccaaaaggctatgtgtacctggtctttgaattggagaagagtgttagatcattgctccaagcctgcagtcatgaccccctgagccccgacggcctgtcggagtattacttcaagatgagctctagacggatgcggtgtaaggaggtccaggtcattccttgggttctggctgatagtaatttcgtgcgctcaccttcacagcgccttgaccccagccgaaccgtctttgtaggcgcactccatggaatgttaaatgccgaagccctggctgctatcctcaacgacctctttgggggtgtagtgtacgccggtattgacacggacaagcacaaatacccaatcggcagtggaagggtcactttcaacaaccaacggtcctacctgaaggctgtgtctgcagcgtttgtcgagattaaaacaaccaagtttaccaagaaagtgcagattgatccatacctcgaagacagtctttgccacatttgctcctcacaaccagggccttttttctgtagagaccaggtttgcttcaaatacttctgccggtcttgttggcactggcggcacagtatggagggccttagacatcactcacctcttatgcgcaatcagaaaaatagagatagttcttag

SEQ ID NO: 29135 - DNA, 1686 bp, Artificial Sequence
  Description of Artificial Sequence: Synthetic coding sequence
atgagcatgccgctggaagaggaagctggccggattaaggactgttgggacaaccaagaagcgccagcgctgagtacctgttcaaacgcgaatatcttcaggcggattaacgctatacttgacaactcactagatttcagcagggtgtgcacaacgccaataaaccgtggcatccacgaccatctgccggactttcaggacagtgaagagacagtgacatcccgtatgctctttcctaccagtgctcaagaatctagtcgtggacttccagatgcaaatgacttgtgtttgggcttgcagagcctgtccctgacaggatgggataggccttggtccacccaggacagtgacagctccgctcaatccagtacacacagcgtgctaagtatgctgcacaaccctttaggaaatgttctgggaaagcccccgctgtcttttctgcctctcgatccactgggctctgatctggtggacaaatttcccgccccatcagtgcggggctcccggctagatacccgccccattctggacagtagatccagttccccatctgattctgacacgtctgggttcagcagcggcagcgatcacctcagcgatctgatctccagcctgagaatttctcccccgctgccgtttctgagcttgtcaggaggcggaccacgagatccactgaagatgggcgtgggaagccgtatggatcaggagcaagcagccctcgctgccgttacgccttcgccaacttccgcgagtaaaagatggcctggagcctccgtttggcccagttgggatctcctcgaggctccaaaggacccttttagtatagaacgggaggcccgcctccatcgtcaggctgccgctgtcaacgaggccacatgcacctggagcgggcagttgccccctaggaattataaaaatcccatctactcctgcaaggtctttttggggggggttccttgggacatcaccgaggccgggctggtcaacacatttcgagtgttcggaagtcttagcgtggaatggcccggcaaggatgggaaacaccccaggtgccctcccaaagggtacgtgtacctggtgtttgaattggagaaatccgtcagatctctcctgcaagcctgctcccacgatccgctcagtcctgatggactgagtgagtactattttaaaatgagtagccgccgcatgcgatgtaaagaggtacaggtgatcccctgggtcctggcggacagcaattttgtgagaagcccaagtcagaggctggaccctagccgaactgtcttcgtcggcgccctgcacgggatgctgaacgccgaagctctggctgccatcctaaatgaccttttcggcggcgtggtgtacgcaggcattgatactgataagcacaagtatcctatcgggagcgggagagtcacgttcaacaaccagcgatcttaccttaaagctgtgagcgcggctttcgtagagataaagacaaccaaatttacaaaaaaggttcagattgacccatatctcgaggattccctgtgtcatatctgttctagtcagcctggtccctttttctgtcgggatcaggtgtgctttaaatacttctgccgctcctgctggcattggcgccacagcatggaaggtctgcgccatcactcccccctcatgaggaaccaaaaaaaccgcgattctagctag

SEQ ID NO: 29136 - DNA, 1461 bp, Artificial Sequence
  Description of Artificial Sequence: Synthetic coding sequence
atgttgttcccaaccagtgctcaggaaagttctcgcggtctcccagacgccaacgacctctgcctaggtctgcagagcctgagcttgacggggtgggatcgcccctggtcaacccaggactctgattcgagtgctcaatcgagcacccactccgtgttgtccatgcttcacaaccctctgggcaacgtactggggaaacctccacttagttttctgccactggatccgctgggctcggatttggtagataaatttccagcccctagcgttaggggatcgcgattggacactcgcccaatactggatagccggagcagctcacccagcgatagcgataccagtggattctccagtggctctgatcacctttcagacctgatttccagcctgagaatctcccccccgctgcctttcctgtcactatctggcgggggcccgagagatccactgaaaatgggtgtcggatcccggatggaccaggagcaggcggccctcgccgcagtgacgccgagccccacttctgccagtaagcggtggccaggggcctccgtgtggccctcttgggatctgctggaagctcctaaagaccccttttctatcgaacgggaagcccgcttacaccgtcaggctgccgccgtgaacgaagccacatgtacttggtctggccagctgcctccccgtaattataaaaacccaatatattcttgcaaagtatttctggggggagtgccctgggacattaccgaagctggtctggtgaacacttttagagtcttcggaagtctatctgtggaatggcctggtaaagacggtaaacacccgaggtgcccacccaaaggctatgtgtatttagtgtttgagttagagaaatcagtcaggtctctactacaggcatgctcgcatgaccctctgagcccagacggcctaagcgagtactactttaaaatgagctctcggagaatgcgctgtaaggaagtacaggtcatcccttgggtcctggcagactctaactttgtccgatccccaagccagagactggacccctccagaacagtgtttgtcggcgcactgcatggcatgctgaacgctgaggctctagccgccatcttgaacgacctgttcggaggtgtggtgtatgctggaatagacactgataaacataaatatcccattggatcaggccgtgtaacctttaataaccagagatcatatctgaaagccgtgagcgcagctttcgtggaaatcaaaaccacgaaatttacaaaaaaagtgcagatagatccctaccttgaagacagcctctgtcacatttgctcatcccagcctggaccctttttctgcagagatcaggtgtgttttaaatacttctgccggtcctgctggcattggcggcatagtatggaagggctgaggcaccactcccctctgatgcggaatcagaaaaacagagactcatcctag

SEQ ID NO: 29137 - DNA, 1686 bp, Artificial Sequence
  Description of Artificial Sequence: Synthetic coding sequence
atggccttccctctggaggaggaggcaggccgtattaaggattgctgggataaccaggaagcccctgcattgtcaacatgctcaaatgccaacatctttcgccgaatcaacgcaattcttgataactcactggacttctcaagggtctgcaccacacctatcaaccgaggaatccacgaccatctgcccgattttcaggactctgaggagaccgtgaccagccgaatgctcttcccgacttcggctcaggagagctcgcgaggactcccggacgccaatgatctatgtctgggtcttcagtccttaagcctgaccgggtgggacagaccctggagtacccaggacagtgattcatctgcgcagtccagcacgcacagcgtgctctcaatgctgcacaatccgctgggaaatgtgttgggaaaaccaccactgtcgtttttacccctcgaccccttggggtcagaccttgttgacaaattcccagccccctcagtacgaggcagtcggctcgacaccagacccattctcgactcaaggagttcttccccgtctgacagcgatacaagtggattttcatcaggttccgatcatctgtcagacctcatatccagtcttcgcatttccccacctttacctttcctgagcctctccggcggtggcccaagggaccctctcaaaatgggtgttggctctcgcatggaccaggaacaagcagctctagctgccgtaaccccctctccgacaagcgcctcgaagagatggcccggtgcatctgtgtggcccagttgggacctgctggaggcccccaaggacccatttagcatagagcgagaagcacggctgcatcgccaagccgcagccgtcaatgaagccacctgcacctggtcggggcaactgccccccaggaattacaaaaatcccatttactcatgtaaggtttttctgggaggagtcccctgggacataacggaggcgggattagttaacaccttcagggtgtttggctcacttagcgtggagtggccgggtaaggacggcaaacaccctagatgtcctcccaaggggtatgtgtacctggtctttgagctagagaaatctgtgcgcagtctcctccaggcgtgttcacacgatccgttgtcgccagacggactgagcgagtactattttaagatgagctctcggcggatgcggtgtaaggaagtgcaagttataccttgggttttagctgattcaaactttgtgaggtctccgagccagagactcgacccatcacgtacggttttcgttggggcattgcacggcatgctaaatgcagaagcactggctgccattcttaacgatctgtttggtggtgtagtctacgctggaatagacaccgacaaacataaatacccaatcggcagtgggcgcgtcacttttaacaaccaaaggagctacctgaaagccgtctcagctgcttttgtggagataaagacaactaaattcaccaaaaaagtgcagatagatccatatctggaagactctctgtgtcacatttgtagctcacaaccaggtccttttttctgtagagaccaagtgtgcttcaagtatttctgccgcagctgttggcactggcgccattcgatggaaggcctcagacatcactccccgctgatgcgtaatcagaagaatcgggacagctcctag

SEQ ID NO: 29138 - DNA, 1686 bp, Artificial Sequence
  Description of Artificial Sequence: Synthetic coding sequence
atggcctttcctctggaggaggaagctgggcggattaaggactgctgggacaatcaggaagccccagcactgagcacctgttctaatgctaacatctttagaaggatcaacgctattctggataacagcctcgacttcagtagggtgtgcaccactcctattaacagaggcatccatgaccatctgccggatttccaggattcagaagagacagttacatctcggatgctattccccacttcagcccaagaaagctcccgcggcttaccagatgccaatgatctctgtcttggactgcagtcgctatctctaacggggtgggacaggccgtggtccacacaggattccgattcatctgcccagtcgtctacacattcagtgttgtctatgcttcacaatccattaggtaacgtgctgggaaaaccccccctttcattcttacctctcgatcctctcggctctgatttagtagacaagtttccagcaccctcagttagaggcagcaggctcgatactcgccctatcctggattccaggagctcgtccccctctgattccgacacatccggtttcagctcggggagcgatcacctgagtgatctgattagttcccttcgcatatccccacctctgcccttcctctccctgtctggcggggggccccgcgatcctctgaagatgggcgtcggatcacggatggaccaagagcaggcagctcttgcggctgtcacaccctcgcccactagcgcctccaaaagatggcccggcgccagcgtctggccctcatgggacctccttgaggctccaaaggacccattttctattgagcgggaggctcgcttgcaccgtcaggccgcagccgtgaacgaagccacctgcacatggtccggtcagctgcccccacggaactacaaaaacccaatttactcttgcaaagtgttcttgggtggagtgccttgggatattaccgaagcagggctcgttaatacatttagggttttcggcagtttatctgtggagtggcctgggaaggatggcaagcatccgcggtgtccaccgaaaggctacgtctatctggtttttgaacttgagaaaagcgtgcggtccttgctccaagcttgctctcatgaccccctgagcccggacggactcagtgaatattattttaaaatgtccagtcggcggatgaggtgcaaggaagtgcaggtgatcccatgggtgttggctgattctaacttcgttcgttccccaagtcagcgcctggaccctagtaggacagtgttcgtaggcgctctgcacggaatgctgaacgcggaggcactggccgcaatcttgaatgatctgttcggcggggttgtttatgcaggcatcgacacggacaaacataaataccctattggctctgggcgagtcaccttcaataatcagagatcctatcttaaagccgtttcagcggctttcgtggagatcaaaacaactaagtttaccaagaaagttcaaatcgatccttacctggaggattcgctctgtcatatttgcagttcacagcccggtccatttttctgtcgtgaccaggtttgttttaagtacttttgccggtcttgttggcattggcggcacagtatggaaggactgcggcatcattccccgctcatgcggaaccagaagaatagagactcttcatag

SEQ ID NO: 29139 - DNA, 1131 bp, Artificial Sequence
  Description of Artificial Sequence: Synthetic coding sequence
atgttgacgtttcttcagcaactgcgtgtggactggccggcggccagtgaacgcgcttcctcacatacacttcggagccatgcactcgaagagcttacatcggccaacgatgggagaactctgtctccagggatactgggaagattatgcctcaaagaactggtggaagagcagggtcgcactgccggatacgatccaaacctggataactgtctggtgacagaggatttgctgtctgtgttggcagaactgcaggaggccttgtggcactggcccgaggactctcaccccggcttggcgggagcaagcgacaccggcaccggcggatgcctagtggttcatgtggtctcatgtgaagaggagttccagcagcaaaaactggatttgttatggcagaaactagtagataaggccccactgcgccagaagcacttaatttgtggtccagtcaaggtggccggtgctcccgggacacttatgacagccccagaatactatgagtttcggcacacccaagtctgcaaggcctcggccctaaaacatgggggagatctcgcgcaggatcccgcctggactgagatcttcggagtcctttccgtcgccaccattaagttcgaaatgctgtctaccgcgcctcagagccagctgtttctggccctggccgatagctcaatatccacgaagggtacgaagagtggcaccttcgtcatgtataattgtgcccgactggcaaccttatttgagtcgtacaagtgttcgatggaacaagggctgtaccccacatttcctccagtatcctcgctggacttttcactcctccacgacgaaggagagtggcttctcttgttcaatagcattctgcccttcccagacctgctctctaggacagccgtcctcgattgcactgcaccagggctgcacatcgcggttcggactgagatgatctgtaaatttctggttcagctgtctatggatttcagctcttactacaatcgagtgcacattctcggagagcctcggcctcacctgtttggacaaatgttcgtccgtttgcagctcctgagggcagtgagggaggtgttgcacaccggactggccatgctgggtctgcctccactttcacatatctag

SEQ ID NO: 29140 - DNA, 1551 bp, Artificial Sequence
  Description of Artificial Sequence: Synthetic coding sequence
atggcgactcgccgcttaggagttggagaaacccttggcgcactgaacgccgcccttggacctggaggccccgtttggattaaagagacgaggacacggcacttgcgaagcagagacttcctggctcctcacagagctctgcaagcacgattcgatgacggacaggtacctgaacatctcctgcacgctctcgcgtgtttgcaaggacccggagtggcacccgtcctgcgctgtgctccaactcccgccggcctgagtttgcaactccagaggtcagctgtttttgaacgagtgctgtcagcagtagccgcatacgccacccccgcgagccctgctagtctgggacagcgcgtcctgctccactgtcctgctctacgctcttctccatgcgccctccggctctctcagttgcgaactgtgctggtggccgaccacttagctcgcgctctgagagctcacggggtatgcgtgaggctggtgcccgctgtccgcgatccccatatgctaactttcttgcagcaattgcgggtggactggcccgcagcatctgaacgggcctctagccacacacttcgcagccatgcactggaagagcttacatccgccaacgacggccgaactctgagtcctgggatcttggggagattgtgtctgaaggaactggtcgaagagcagggccgcaccgccggttatgatcccaatctcgacaattgccttgttactgaagacctgctctctgttctggctgagctccaagaggccttatggcattggcccgaggactcacaccccggattagctggcgcctctgatacgggtacaggcgggtgtctcgtcgtgcatgttgtgtcctgtgaggaagagttccagcagcaaaagctggaccttctgtggcagaagctggtggataaggcccctttaagacagaagcatctcatctgcggccctgtgaaggtcgcaggagcacctggaacactgatgacagcaccagagtattacgagtttaggcacactcaggtatgcaaggcctccgcacttaaacatgggggcgacttggcccaagatcctgcatggacggagattttcggagtactctctgtggcaaccataaagttcgagatgctctcgactgcacctcagtcacaacttttcctggccctggcagactcttctatctccacaaagggaacgaagagtgggacttttgtcatgtataactgtgctcggctcgccaccttgttcgagtcatataagtgcagcatggagcaaggcttatatccaacctttcctccagtttccagcctcgacttctcattactccatgacgaatatccacctctctccgggtctgctgagcccgactccagcgcaggcctgcattcacctggcgcgcctcactgttgtactcaccgtgacgacatgcaagtccccggcacagcccagcacggttttcagttgctcctgcagccagggacccatcccgggggggcctcaactactccactttggtccgatgttcgcccacctgcagcttcagaatcgtgcgcatag

SEQ ID NO: 29141 - DNA, 507 bp, Artificial Sequence
  Description of Artificial Sequence: Synthetic coding sequence
atgaactcaaaaggtcaataccccacacagccgacttatccggttcagccgccagggaaccctgtctaccctcagaccctacacctgccacaagcgccaccatatacagatgctcctcctgcctactcagagctgtatcgccctagcttcgttcatccaggcgccgcaacagttccaactatgagcgccgctttcccaggggcctctctgtacctgcctatggcccaatccgtggccgtgggcccactgggatccacaatccctatggcatattatccagtgggcccgatttatccacctggctcaaccgttctcgttgaggggggatatgacgccggtgctaggtttggcgctggtgcgaccgccggaaacataccaccgccgccccccgggtgtccccctaatgccgctcagctagcagtaatgcagggagccaatgttctggttacccaacgcaaaggtaacttcttcatgggcgggtccgacggtggatatactatctggtag

SEQ ID NO: 29142 - DNA, 462 bp, Artificial Sequence
  Description of Artificial Sequence: Synthetic coding sequence
atgaatagcaaaggtcagtatcctacgcaacccacttatccagtgcagccaccaggaaaccctgtttatccgcaaaccctacacctcccgcaggcaccaccttacactgatgccccccccgcatatagcgaactctatcgccctagcttcgtgcatccaggggcagccaccgtaccaaccatgtctgccgcgttccccggcgcgtctctctacttgcccatggcacagtctgtggcagttggacccttgggttccacaatccctatggcctactacccagtgggacctatttacccacccggttccactgtcttggttgaggggggttatgacgcaggcgcgaggttcggcgctggtgccactgccggtaatattccagtgaaagaggatcaggatcacgatagagaacaaggcgaagaggataatggcgacaataaccttgagagacgcggaaaaatgtag

SEQ ID NO: 29143 - DNA, 261 bp, Artificial Sequence
  Description of Artificial Sequence: Synthetic coding sequence
atgaacagcaagggccagtatccaacccagcccacataccctgttcaacctcccgggaatccggtgtaccctcagacactgcacttgccacaggccccaccttacactgacgcaccccctgcttactcagagccacctcctcctggatgcccccccaatgccgctcagctggcagttatgcagggcgccaacgtcctggtgacacaacgcaaggggaatttcttcatgggtgggtctgatggcggttataccatatggtag

SEQ ID NO: 29144 - DNA, 441 bp, Artificial Sequence
  Description of Artificial Sequence: Synthetic coding sequence
atgaactccaagggccagtatccgacccagccaacctacccggtccaacctccagggaatccggtgtacccccagactctacacctcccccaagctcccccatacactgacgcacctcccgcttattccgagctgtaccggccatcattcgtgcatccaggagccgcgacagtacctacgatgagcgctgccatcccaatggcttactaccctgttggcccaatatatcctcccggctcaacagtgctcgttgaaggcggctacgatgcgggtgcacggttcggggcaggcgcaacagcgggtaacatacccccacctccgcctggctgccctccaaacgccgctcagctggccgtgatgcaaggtgccaacgtcctggtgactcagaggaaggggaactttttcatgggcgggtctgatggaggttacacgatctggtag

SEQ ID NO: 29145 - DNA, 624 bp, Artificial Sequence
  Description of Artificial Sequence: Synthetic coding sequence
atgaactcaaaagggcagtacccgactcagcccacgtatcccgtccagccgcccgggaatccagtttatccccagacactccacctgccacaagcaccaccatacaccgacgctccacccgcatattctgagctgtaccgcccgtccttcgtgcaccccggtgctgcgaccgttcctactatgagtgcagccttccctggagcaagcttgtacctgcctatggcccagtcggtcgccgtgggaccattggggtccaccattcccatggcctattatcccgttggacccatttatcccccagcttcaactagctggatgccctcacagtgctgcagcgcctgtagtcatgccggctcacagcggcccagaaatagcgcggaaggagaacttctccatggatggttcagatggtggcttcaccatttggtgaggaaccagggccatctgtgtgccggtaaagacattacttacttacaacacttctctcagtgcaattgtttttctcatattaatctgaaactccagttcagacacatgctactgggctgtcttagcggggcccagacatttaggcacttcagcaatctaattcggaaccacgtgatggtcgccgtaccaccctag

SEQ ID NO: 29146 - DNA, 411 bp, Artificial Sequence
  Description of Artificial Sequence: Synthetic coding sequence
atgaacagtaagggtcagtacccaacacaacccacataccctgtgcagccccctgggaatccggtgtatccacaaacactgcatctgccacaggcaccaccctatacagacgcacccccagcttacagtgagtccgtggctgtcggccctttgggatctactattccgatggcctattaccccgtgggacctatttatccgcccgggtccaccgtgctggtggagggggggtatgacgctggcgcgcgctttggtgctggcgccaccgccggcaatattccccctcccccaccggggtgtcctcccaacgctgcccaactggcggtcatgcaaggagctaacgtgcttgtcactcagcggaaaggcaatttcttcatgggaggatcagacggtgggtatacgatatggtag

SEQ ID NO: 29147 - DNA, 2304 bp, Artificial Sequence
  Description of Artificial Sequence: Synthetic coding sequence
atgcagtcccccgccgccacagccgagggcctcagtggccccctattcggcgcttatacgttccccacttttaaattccagcctaggcatgacagtatggactggcggaggatctccacactggatgtcgaccgagtggcacgcgagcttgacgtggccacacttcaggagaacatagcaggaattacgttttgcaacctcgatagagaggtctgctctagatgcggccagccagttgatccagccctcttaaaagtgctgagactggcgcagctgatcatcgagtatctgctccactgccaagactgtctctctgcttcagttgcacagttagaagcccgcttgcagacaagcctaggccagcaacagagaggtcagcaggaactcggtcgccaggctgatgaactcaaaggcgttcgagaggagtctcggcgacggcggaaaatgatctccacactgcaacagttgctcatgcagacggggacacactcctaccacacatgtcacctgtgtgataagacattcatgaacgccaccttccttcgagggcacatacagcggcgacatgctggagtggctgagggcggtaagcaaaagaagcaagagcagccggtggaggaagttctggaggagcttcgcgctaaactgaagtggactcaaggtgaactggaagctcagcgcgaagccgaacggcagcgccagttgcaggaggccgagctgatccaccagagagaaatagaagcaaaaaaggagttcgacaaatggaaagaacaggaatggacaaaactgtatggagagatcgacaagctgaagaaactgttttgggatgagttcaaaaatgtagccaagcagaactcgaccctcgaggagaaactgagagcgttgcagtctcattctgtgatggagtccaagttaggatcactgcgggacgaggagagcgaggagtggctgaggcaggcacgggaactgcaggctcttagggagaagactgaaatccaaaagaccgaatggaagagaaaagtcaaggagttgcacgaggagcacatggctgagaagaaagagctccaggaagagaaccaaagactgcaggccagcctaagtcaggaccagaagaaagccgcagcacagtctcaatgccagatttcaacactgagagcgcagcttcaagagcaggcccgaatcattgcgtcccaggaagagatgatccagtctctttccctgcgcaaagtagaggggattcataaagtgccgaaagctgtcgacacggaggaagactcaccggaagaggaaatggaagacagccaagatgagcaacacaaggtgctggccgccttgagaaggaaccccacgctccttaagcatttcagaccaattctcgaggacactctggaggagaagttggagtccatggggatacgaaaagacgcaaaaggcatttcgatccagacactgaggcacttagaaagccttctgcgagtgcagagagaacagaaagcccggaaatttagcgaattcctatccctgagggggaagttagttaaggaggtgacctcccgcgccaaggaacgccaggagaatggtgccgtagtcagccagcctgacggtcagccttctgtcaagagccagcagtccactctcgttactagggaagctcagcccaagacccgcactcttcaagtggccctgccatcaacaccggccgagccgccaccacccactaggcagtcccatggcagccatggctcttccctgactcaggtgtccgcccccgcccctcgtcccgggctgcacggtccctcttctacccctccttccagtgggccggggatgagcacaccaccgttctcgtctgaagaagattctgagggtgaccgcgtccaacgggtaagtttgcagcccccaaaggtgccctccaggatggtgccccgccctaaagacgactgggattggtccgacaccgagaccagcgaggaaaacgcgcagcctcctggacagggcagtgggaccctggtgcagagcatggtcaaaaaccttgaaaaacaacttgaggcgcccgcgaagaaacctgctgggggcgtctccctgttttttatgcccaacgctggtccacagagggccgctaccccaggccggaaaccccagctgtctgaagacgagtctgacctggaaatctcctctctggaggacttgcctcttgatctggatcagagagagaagcctaagccgttgagtcggtccaagctcccagaaaaattcggaacggggcctcaatctagcgggcagcccagagtccccgcctggtag

SEQ ID NO: 29148 - DNA, 204 bp, Artificial Sequence
  Description of Artificial Sequence: Synthetic coding sequence
atgcagagcccagccgccacggcagaggggttgtccgggccattgtttggcgcctatacctttccaactttcaagtttcagccgcgacatgactcaatggactggcggagaatcagcactctggatgtggatcgcgtggccagagagctggacgttgccactctgcaggagaatatcgcggggatcaccttttgtaacctgtag

SEQ ID NO: 29149 - DNA, 1620 bp, Artificial Sequence
  Description of Artificial Sequence: Synthetic coding sequence
atgcagtcaccagccgccactgccgaagggctgtctggcccactgttcggtgcctacacattccctacattcaaattccaaccaaggcatgatagtatggactggcggaggatctcaacactggacgtcgacagggtggcccgcgagttagatgtggctacactccaggaaaacatcgctggaattactttctgtaatctggaccgcgaggtgtgtagccggtgtggtcaacctgtggacccagcactactgaaagtgctgcggctggcccagctgatcattgagtaccttctgcattgccaagactgcttatccgcctcagttgcccagctggaagctcgactccagaccagcctcggtcaacagcagcgcggccagcaggagctgggacgccaggccgacgaactgaagggagtacgagaggagagccgccgccggaggaaaatgatatcaacccttcagcagcttttaatgcagacagggacgcactcttaccacacctgtcatctttgtgacaagactttcatgaatgccacgtttctccgcggccatatccagcggagacacgctggagtggccgaaggcggcaaacaaaagaagcaggaacaaccagtcgaggaggtgctggaagagctgcgcgctaagctcaagtggacccaaggcgagctggaggctcagcgcgaggcagagagacaacgccagctccaggaggccgagcttatccatcagagggagatcgaggctaagaaagagtttgacaagtggaaggagcaggaatggacaaaattgtacggagagattgacaagctcaaaaaactcttttgggacgaatttaaaaatgtggccaagcagaactcaaccctggaggagaagctcagggccctacagagccattctgtcatggaaagtaagctgggatcgctgcgggacgaagagtccgaagagtggctgcgtcaagctagagagttgcaggcattgcgagaaaagactgaaattcagaagacagagtggaaacgaaaagtgaaggaactgcacgaggaacatatggccgaaaaaaaggaactccaggaggagaatcagcgactccaggcaagtctgtcgcaggatcaaaagaaggccgccgcccaatcacagtgtcaaatcagcacactcagggctcagctccaggaacaggccaggattatcgcctcccaagaggagatgattcagtcgttgagcctccgcaaggtcgaggggattcataaagtccctaaagccgtggacactgaggaggattctcccgaagaggaaatggaggacagccaggatgagcagcataaggtacttgccgctttacggagaaacccaactctgctgaaacacttcaggcccatacttgaagataccctcgaagagaaactggagagtatgggcattcgcaaggacgccaagggaatctccattcagactttacgccacctggaatcgttactgcgggtacagcgagaacaaaaagcgcgtaagttctccgaattcctgagtctgagaggcaagttggtcaaggaggtcacgagtcgggctaaggaacgacaggaaaacggggcagttgtgtcccaacccgatgggcagccctccggctag

SEQ ID NO: 29150 - DNA, 120 bp, Artificial Sequence
  Description of Artificial Sequence: Synthetic coding sequence
atgcagtcccccgccgcaaccgccgagggactgtctggacccctgttcggagcatacaccttccccaccttcaagttccagccaaggcacgattctatggactggagacgaataagttag

SEQ ID NO: 29151 - DNA, 1620 bp, Artificial Sequence
  Description of Artificial Sequence: Synthetic coding sequence
atgcagtcccccgctgcaactgctgagggtttatctgggcccctctttggagcttacacatttcccacctttaagttccagccaagacacgattccatggactggcgccggatttcaaccttagatgttgatagggtagcgcgagaattggacgttgctacattgcaggagaacatcgctgggattacattctgtaacctcgatagagaggtgtgttccagatgcggtcagcccgtcgacccagctcttctcaaagtgctccgcctggctcagttaatcatcgaatacctgttgcattgccaggattgtctcagcgctagtgtagctcaattggaggcaaggcttcaaacctctctgggccagcaacagaggggccaacaggagctgggccgacaggccgacgaactgaaaggagttcgagaggagagccggcggcggcggaaaatgatatctacacttcaacagttgctgatgcagaccggcacccattcctaccacacctgtcacctctgtgacaagacctttatgaatgccactttcttgcgcggccatatccagcgccggcacgccggagtcgcagaaggaggcaaacagaaaaagcaagaacaacccgtcgaggaggtgctggaggaactgcgggccaagttgaaatggacacaaggtgaactagaggctcagagagaggctgagcggcagcggcagttacaggaggccgagctgatccatcagagggagattgaagcgaaaaaagagtttgacaagtggaaggaacaggagtggacgaaattgtatggcgagatcgacaaactcaaaaagctgttctgggacgaatttaagaacgtggccaagcagaactctacactcgaagaaaaactgcgggcccttcagtctcattccgtgatggaaagcaagctgggcagtctgagggatgaagaatccgaggagtggttgcgtcaggcacgagagttgcaggcacttagggagaagactgagattcagaaaacagaatggaagagaaaggtgaaggagctccacgaggaacatatggctgaaaagaaagagctgcaagaagaaaaccagagactgcaggcaagcctctctcaagatcagaaaaaggctgccgcacagtcccaatgtcaaatttctactctgcgagctcagctgcaggaacaagcaagaatcattgcgtcccaggaggagatgatacagagcctgtccctgagaaaagttgaagggatccacaaagtccctaaggccgttgatacagaagaggatagccctgaggaagagatggaggattctcaagatgagcagcataaggtactggccgctctgaggcgcaaccctaccttgctcaagcactttcggcctatccttgaggacaccctggaggagaaactggagtcaatgggcatccggaaggacgccaagggcattagcatccagacactccgccacttagaatcgctgctccgcgtgcaaagggagcagaaggcaagaaaattctccgagtttctgagccttaggggcaaactggtgaaggaggtgacttcacgcgccaaggaaaggcaggaaaatggagccgtggtgagtcagcccgacggtcaaccgtctggatag

SEQ ID NO: 29152 - DNA, 561 bp, Artificial Sequence
  Description of Artificial Sequence: Synthetic coding sequence
atgcataaactcaagtcaagccagaaggacaaggtgcggcagttcatggcctgcacccaggccggtgaacgaactgccatttattgtctgacccagaatgagtggcgattggacgaggccactgatagcttcttccagaatcccgactccttacaccgcgagagtatgagaaatgccgtagataaaaagaagcttgaacggctatacggacgatataaggacccccaagacgaaaataaaatcggagtggatgggatccaacaattctgcgatgatctgtcacttgatcccgccagcatttctgtactggtgatcgcctggaagtttcgagcggcaacgcagtgtgagttctcccggaaagagttcctggacggcatgacggaactgggctgtgactcaatggagaagttaaaagccctgctcccgcgactcgagcaggagcttaaagataccgccaaattcaaggacttttaccagttcacattcacattcgctaagaaccccggccagaaggggctcgggtccccgccttttctcaatgtgaaggctctgcaccattag

SEQ ID NO: 29153 - DNA, 780 bp, Artificial Sequence
  Description of Artificial Sequence: Synthetic coding sequence
atgcacaagctgaagtcctcccaaaaggataaggtgaggcagtttatggcctgtacacaggccggtgagcggacagccatctactgcttgacacagaacgagtggaggctcgacgaggctactgattcgtttttccagaatcccgatagcctgcatagagagtctatgcggaatgccgtcgataagaaaaagctggagcggttatatggcagatataaggacccccaggatgagaacaaaataggcgtagacggtatccagcagttctgtgacgacctgtcacttgatcccgcttcgatcagtgttctggtcatagcatggaagttccgagcggctactcagtgcgaattctccagaaaagagtttctggacggcatgaccgaactgggctgtgacagcatggagaagctgaaggcgctattacccaggctggaacaggaactaaaggataccgccaaattcaaggacttttatcagttcacattcacatttgccaagaatccagggcagaaaggactggacctagagatggccgtggcatactggaaactggttcttagtggccggttcaagttcctcgatctgtggaacacatttctgatggagcatcataagaggtctattccgcgcgacacctggaaccttcttctggacttcggtaacatgattgcagatgatatgagcaactatgatgaggaaggcgcctggcccgttctcatagacgattttgtcgagtacgcccggcctgtcgtcactggaggcaagagaagcttgttttag

SEQ ID NO: 29154 - DNA, 714 bp, Artificial Sequence
  Description of Artificial Sequence: Synthetic coding sequence
atgcctgtgaagaagaagcgaaaatccccaggcgtggccgccgccgtagctgaagatggcggcttaaagaaatgcaagatttctagctattgtcggtcccagccccctgccagattgatctcgggcgaggagcatttttcctctaaaaagtgcctggcctggttctacgagtatgcaggtccggacgaagttgtggggcccgaagggatggagaaattctgcgaggacataggcgtggaacccgagaacatcataatgttggtcctagcttggaagctcgaagctgaatcaatgggattttttacaaaggaagaatggctgaaaggtatgaccagcttacagtgcgactgtacggaaaagcttcagaacaaattcgatttcctccgctctcagctgaacgatatttcgtcttttaagaacatttaccggtacgccttcgatttcgctagagataaggaccagcggtcactggacatcgacacagctaagagtatgctggctctgctgctgggccgaacttggcccctgttcagcgtgttttatcagtacctcgagcaatctaagtatagggttatgaacaaagatcagtggtacaacgtcctcgaattctcccggacagttcatgcggatctgtctaactatgatgaagacggcgcatggcctgtgctgcttgatgagttcgtggaatggcagaaagtgaggcagacctcatag

SEQ ID NO: 29155 - DNA, 1749 bp, Artificial Sequence
  Description of Artificial Sequence: Synthetic coding sequence
atggaggccttgtcccgggccgggcaagagatgagtctggcagcgctaaaacagcatgatccttacattacgagcatagccgacctgaccggccaggtggctctttatactttctgtcccaaggctaatcaatgggaaaagactgacatagagggcactctgttcgtgtaccggcggtccgcgtccccctaccatgggtttaccatcgtgaatagattgaacatgcacaacctggtggagcccgtgaacaaggacttggagttccaattacatgaacctttcctgctctacaggaacgccagtctttcaatctacagcatttggttttacgacaagaatgattgtcacaggatcgcaaaactcatggcagacgtcgtagaggaggagacacgccgttcccagcaggccgccagagacaaacagagcccatcccaagctaatggatgtagtgaccacaggcctatcgatatcctcgaaatgcttagcagagctaaagacgaatacgaacgcaatcagatgggtgactctaacattagcagtccgggcctgcaaccgtctacccaactgtctaacctcgggtccaccgaaacattggaggagatgccttcaggatctcaggacaaatcagcgccctctggccacaagcaccttacagtggaggaactgttcggaacgtctctgcccaaagagcagcctgcagtagtaggtctagactctgaggagatggagagactccctggcgatgccagtcagaaagagccaaactccttcttgccgttccccttcgagcaactgggcggtgcgccccagtctgagacactgggcgttcctagtgcagctcaccatagcgttcaaccagaaatcacgacgcccgttcttatcacccccgcctctattactcagtctaacgaaaagcacgctcctacatacacgatcccactcagtccggtactcagtccaaccctcccagcggaggcccctactgcccaggtgcctcccagcctccccaggaacagcactatgatgcaggctgttaagacaacccctcgtcagcgctccccgcttcttaaccagccagtgcccgaattaagccacgcctcccttatcgcaaatcagtctcccttccgcgcgccactgaacgtgactaacacagctggcactagtctgccttccgtagacttgcttcaaaaactccgcctgaccccacaacatgaccagattcagacgcagccgctgggaaagggagcgatggtggccagtttctctccggccgccggccagttggctacaccagaaagcttcatcgagcctccgtctaaaacagccgctgcacgcgtggctgcaagtgcctctctgagcaacatggtgttggctccgctacagtctatgcaacagaatcaggatcccgaggtgttcgttcagcccaaggtactgtcatccgccaagagggtggcaggggcacccctagtgaccgcaacaaccacggccgtgagcagcgtactgctcgccccctcagtgttccagcagactgttacacgatcttccgatctggaaaggaaagcctcatcgccctctccactaacaataggcacccctgaatctcagcggaagccttcaatcatcctgtccaagtctcagcttcaggataccctgatccacctgattaagaatgattcctcatttcttagtaccctgcatgaggtgtacctccaggtgctcacaaagaacaaggacaatcataatttgtag

SEQ ID NO: 29156 - DNA, 1569 bp, Artificial Sequence
  Description of Artificial Sequence: Synthetic coding sequence
atgttcccattcggaccccactctcctggtggggatgggagtgctggagccggagccgaggagccaacaccacacgaaggacaggccgcggccaccgggcccccatctccactgcaccccggcgccgatgcgacccaccctccccctccagctagaagcccacgcagaccaggtgcacccagtctaagtccggccccacgctctggcgagctcggcctgcctggtgccccagagagctctacggcctccgcaccaggggagccttccccaccctcccccccctgcagaaggcctgggcctgactgccgcgctaaatccaggggcagacacggcctcggcgccggcctggggggtccaggcgcccggctctttgggtggctgaaggagcgctccctaggacgcggccttttcgtggaccctgctagagacaattttcggactatgaccagcttgtacgggagcattcaccccgcagatagcgtgtatttgtccaccagaacacatggggccgttttcaacctggaatacagcccagacgggtccgttctcacggtcgcttgcgagcagactgaggtactgttgtttgacccaatcagtagcaaacatattaagacactgtcagaagcacatgaggactgcgtgaacaacattcgattcctcgacaacagattgtttgcgacttgctcagatgacacaaccatcgccctgtgggacctgagaaaactgaacacaaaagtctgtactttgcacggacacacctcatgggttaaaaacatagaatatgacacaaataccaggctgttagttacttcgggatttgatggcaatgtgatcatctgggacaccaaccggtacaccgaggatggctgtccccataaaaagttctttcatacgagatttcttatgcgtatgaggcttacacctgactgctctaaaatgcttatttcgacatcctccggatacctgttaatcctgcatgacctcgaccttacaaaatccctggaggtcggcagttacccaatcttaagggctcggcgtacaactagctcctccggcgtttcgcctcgaaatagtctggaggtggtcacacccgaggtgctgggtgaatctgaccacggtaattgcattaccagcttacagctgcatcctaagggatgggctaccctgttaaggtgtagcagcaactctgacgatgaggaatgtacatgcgtctacgagtttcaggagggagcccccgtgcgcccagtctcaccacgctgttcacttaggctcacccactatattgaggaagctaatgtcggcagagggtatatcaaagagctgtgcttcagtcccgatggaagaatgattagcagcccacatggatatggcatccggctgctgggctttgacaagcagtgtagcgagctggttgattgccttccaaaggaagcctctcctctgagagttatccgcagtttgtattcccataatgacgtggtactgacaactaaattctctccaactcactgccagattgccagcggttgtttgtctggtcgtgtatccctctaccagcccaagttttag

SEQ ID NO: 29157 - DNA, 1680 bp, Artificial Sequence
  Description of Artificial Sequence: Synthetic coding sequence
atgtttccttttggacctcacagccccggcggcgacggctcagcaggagctggcgcagaagagccaacacctcatgagggacaggctgccgcaaccggacctccttcacccctccaccccggagctgatgccacccacccacctcccccagcaaggagccctaggagacccggtgcccctagtctgtctccagcccctcggtctggagaactaggtctccctggcgcccctgagagcagcactgcctcagcccccggcgaaccctctccccccagcccgccatgtaggcgccccgggcccgattgtcgggctaagagccggggaagacatgggttgggcgccgggctcggtggcccaggcgccagactatttggatggctaaaggaacgcagcctggggagaggactcttcgtggatccagctcgggacaattttcgtactatgacgagcctctacggttcaatacacccggctgattctgtctacttatccaccaggactcatggcgccgtgtttaatctagagtattcccctgatggtagcgtcctaacagtggcatgtgaacaaactgaggttttgctcttcgatcctatctcatcaaaacacattaaaaccttgagcgaagctcacgaggattgcgtgaacaatattcgcttcctcgataacagacttttcgccacctgtagtgatgacacaaccatcgcgctctgggacttgaggaagctcaatacaaaagtatgcaccctgcatggtcatacttcttgggtgaagaacattgaatatgatactaacacaagactcctggttaccagtggcttcgacgggaacgtcatcatttgggatacaaatcggtacaccgaggacggttgtccacacaagaaattttttcacacacggtttttgatgcgtatgcgcctcacgccagattgcagcaagatgctgatcagtacatcctcaggttatctgcttatcctgcatgatcttgacctcaccaaatcactggaagtgggctcatacccaattctccgcgccaggcgtaccacctcttcttccgatcttacaacctccagtagttcctctggcccaagggtaagcgggagcccatgccaccacagcgactctaactcaagtgagaaacatatgtcccgcgcctcgcagagagagggtgtaagccctaggaactcccttgaggtggtgacacccgaggtactcggtgagtctgatcatgggaattgtataaccagcctccagttacatccaaaggggtgggcaacactgcttagatgttcgagtaattcagatgacgaagagtgtacttgtgtgtatgagttccaggaaggggcacctgtacgccctgtttcacccagatgttctctgcggcttacccactacattgaggaggcaaatgtggggaggggatacattaaagaactctgcttttctccagatgggcgcatgatatcctccccacatgggtatggtatccgcctgctgggcttcgataagcaatgctctgaactcgtcgattgtctgccaaaagaggcttctccgcttagggttattagaagcctatactctcataatgatgttgtgctcaccaccaaattctctccaacacattgtcagattgcttcgggctgcctcagtggacgggtcagcttatatcagccaaagttctag

SEQ ID NO: 29158 - DNA, 1392 bp, Artificial Sequence
  Description of Artificial Sequence: Synthetic coding sequence
atggctcagcaacaaaccggctctcgaaaaaggaaggctccagcagttgaagcagacgcagagtctagcccttcgcaaggcctggctgcagcggacggagaaggacctcttttgcttaagcgtcagaggaggccagccacgtataggtctatggctcactacctgaaggtacgggaggttggcgggtgggggccagcacgcttgcagggatttgacggcgaactgagaggctatgccgttcagcggctgcctgagctgctgacggaacggcagttggaactgggcacagtgaacaaggtgtttgccagtcagtggttaaactccaggcaggtagtgtgcggaaccaagtgcaatactctgttcgtggtcgacgtggaatccggccacatcgcgcgaatcccccttcttagagactcagaagcacggctggcccaggatcagcaaggatgtggcatccacgcaattgagctcaatccttccaagactctcctcgcgaccgggggtgagaacccgaatagtcttgccatttatcaactgccgtccctcgatcctctgtgtctgggtgatagacatggacataaggactggatctttgccgtggcttggctgtcagatactgtagccgtttctggttccagagatggaaccgtggctctctggcggatggatccagataaattcgacgatactgtcgcatggcattctgaagtgggcctaccagtgtacgctcatattaggccccgtgatgtggaggctatccctagagccatcatcaatccttccaatagaaaggtacgcgccctggcctgtggaggcaagaaccaagagctgggagccgtgtccctggatggatattttcacctgtggaaagccggcagcgccttgtcgaggctgcttagcattcgtctgccatactttagggacaatgtatgcctcacctactgcgacgacatgtcggtttatgctgttggaagtcactcccacgtgtcatttctggacctacgacaggaccaacagaatattaggcccctgtgtagccgtgagggtggcactggcgtacgcagcctttccttttaccgtcatatcatcaccgtgggcactggacaaggatcattgttgttctatgatgtgagagcgcagaagtttcttgaggagagagcttcagccaccctagaatcctcctctggccctgcaagacggaagctacgactcgcctgtggaaggggctggttaaaccacaacgatttctgggtgaactattttgggggcatggaggtgttccccaatgccttgtatactcactgctataactggcctgagatgaagctgtttgtggctggcggccctcttccagctggtctgcacgggaactatgcagggttgtggtcttag

SEQ ID NO: 29159 - DNA, 1392 bp, Artificial Sequence
  Description of Artificial Sequence: Synthetic coding sequence
atggcgcaacagcagactggaagccgtaaaagaaaagcgcccgcagttgaggccggcgctggttcctcctcatcgcagggactcgcagccgctgatggtgaaggtcctctcctcccaaaaaaacagaaacggcctgctacaagaaggaggctggtacattatctgaaagggagagaagtgggagcccgcggaccagctgggctgcagggctttgaaggggagctccgggggtacgctgtgcagcgcttgcccgaactgcttacggagagacagctggaccttggcacgcttaacaaggttttcgcttcacagtggttgaatgcccgacaagtcgtctgtgggacaaagtgtaatacccttttcgtcgttgatgtccagtccggtcatattacacggattcctctgatgagagacaaggaagcagggctggcccaagcacaccaaggatgtggtattcacgctatagaattgaatcctagcaaaacgcttctggccacaggaggtgaaaacccgaatagcttagcgatctaccagctacctaccctcgaccccctgtgtcttggtgaccggcatggtcacaaagattggatcttcgctgtcgcctggctatctgacaccgtcgcagtgagcggatctcgtgacggcacggtggcgctttggagaatggacccggacatgtttaacggatccattgcctggcactctgaggtaggtctgcctgtgtacgctcacatccggccaagggacgtggaagccatcccccgcgccagcaccaaccccagtaaccgaaaggtacgcgcgctggctttttcagggaagaatcaggaactgggcgccgtgtctctagatggctacttccacctatggaaggccagatccaccctatctaggctgttgtctatccggttgccatattgtcgagagaatgtctgccttacgtattgtgacgagctgagcctatacgccgtggggtcccagtcacatgtatcctttctggatcctcggcagagacagcagaatatccgcccgttatgcagcagggagggaggcactggcgtccgctccttaagcttctaccaacacataattactgtgggaaccggccacggttcacttctgttttacgacattcgtgcgcagaagtttctcgaggagagggcatccagctcgctcgactccatgccaggacctgccggaagaaaattgaagcttgcctgtggccggggatggttgaatcaagacgatgtctgggtcaactacttcggcgggatgggagaatttcctaacgcactgtatactcactgttacaattggccagagatgaagctttttgtcgcgggcggccccttgcctagcggtctccacggcaactacgccgggctgtggagctag

SEQ ID NO: 29160 - DNA, 1392 bp, Artificial Sequence
  Description of Artificial Sequence: Synthetic coding sequence
atggctcagcaacaaactggctcgagaaaaaggaaagcaccagccgtagaagccggggccggaagctcttcaagccaaggactggctgctgccgacggcgaggggccattgctgccaaagaagcaaaaaaggccagccacacggcgacgtctggtccattacctgaagggtcgcgaagtgggcgcgcgcggacccgccggactgcaggggtttgagggggagcttcggggctacgctgtacagcgcctgcctgagttgctgaccgaacggcagttagacctcggcactctgaataaggtgttcgcctcccaatggctgaatgcacgccaggttgtctgcggaaccaagtgtaatactctgtttgtcgtcgatgtgcagtccgggcatattacccgcataccattgatgcgagacaaagaggcaggactggcgcaagcccaccagggctgtgggatccatgcaattgaactgaaccccagtaaaacacttctcgccaccggaggcgagaaccccaattctctggccatctaccagctaccaacattagacccgttgtgcctgggggatcggcacggacataaggactggattttcgccgtggcttggctctcggatactgtagcggtgagcggatctagggatggtacagtggcactgtggcgcatggaccccgacatgttcaacggatccattgcctggcattctgaggtgggcttgccagtgtacgcccatatacgcccaagggatgtcgaagctatcccacgcgcctctaccaacccaagcaaccggaaagttagggccctggcattttcaggtaagaatcaggaactcggtgccgtgtcactggatggctacttccacttgtggaaagcgcgctcaactctaagcagactgctatccatcaggttaccatactgcagagaaaacgtttgtttgacatactgtgacgagctatccctttatgccgtgggaagccaaagccacgtttcatttttggatccacgccagaggcagcagaatatccgccccctctgcagcagagaaggtgggaccggcgtgcggtcactaagcttttaccagcacataataaccgtgggcaccgggcacggaagtttactgttctacgacatccgcgcacagaaattccttgaggagcgggcgagcagttccctggattctatgcccggcccagcagggaggaagctcaaactcgcctgcggtagaggatggctgaatcaagacgatgtctgggtgaactactttggcgggatgggcgagtttcccaatgccttgtatacccattgctataactggcctgagatgaagctattcgtcgccggtggccccctgccatccgggctccacggaaactacgctggactgtggtcttag

SEQ ID NO: 29161 - DNA, 1803 bp, Artificial Sequence
  Description of Artificial Sequence: Synthetic coding sequence
atggcacccagcagcaagtctgaaaggaatagcggagcaggcagtgggggcggagggcctggtggcgcaggcgggaaacgcgccgccggccgcaggagggaacatgtcttaaaacagttggagcgagtgaagatcagtggacagttaagtccaaggctgtttagaaagctgccgccacgagtgtgtgtatctctgaagaatatcgtggacgaggattttttgtacgcaggacacattttcctgggcttttcaaagtgtggccggtatgtgttaagttatacttcttcctccggcgacgacgacttctcgttctatatttaccacttgtattggtgggaattcaatgtacactctaagctcaaactggttagacaagtgcgcttgttccaggatgaggagatctacagtgatctttatcttactgtgtgtgagtggccttctgatgccagcaaagtgatcgtatttggttttaatactcgctccgccaatggaatgctcatgaatatgatgatgatgtccgatgagaaccatcgcgatatatatgtctccacagtcgcagtcccacccccaggacggtgcgctgcctgccaggacgcatcaagagcacatcccggcgaccccaacgctcagtgtctccggcacggtttcatgctccatacgaagtatcaggttgtgtatccctttccaactttccagcccgccttccagctcaagaaggaccaggtagttctgttaaacacatcatatagtttggtggcctgtgccgtgagcgtccacagtgcaggtgataggtctttttgtcagatcctgtacgaccacagcacttgtcccctggctcctgcctcccctcccgagccgcagagccctgagctacccccagcccttcctagtttttgccccgaagctgccccagcccgctctagcggctccccagagcctagccccgccattgcaaaggcaaaagagtttgtggctgatatctttagacgtgcaaaggaagctaaaggtggcgttcccgaggaggctagacctgcactctgcccagggccatcaggaagccgctgcagagcccatagcgagcccctcgccttgtgtggcgagaccgcccccagggactctccacctgccagcgaggcgcctgcgtccgaacccggctacgttaactatacgaagttatattatgttctggagtccggtgaaggaacagagcccgaggacgagttggaggacgacaagatatcacttccctttgttgttactgatcttcgcgggagaaatctccggcctatgcgggaaagaaccgccgtgcagggccagtatctgacagtggaacaactcacgctcgacttcgaatatgtgattaatgaagttataaggcacgacgccacttgggggcatcagttttgcagcttctcagattatgatattgttatccttgaggtttgccccgagaccaaccaggtcctaattaacatcggactgctcctccttgctttcccatctcccacagaagaggggcagctacggcccaagacatatcacacaagcttgaaggtcgcgtgggacctgaacactggaatatttgaaacagtctccgtaggagatttgaccgaggtcaaaggccagaccagcggttccgtgtggagctcataccgcaaaagttgtgtcgatatggtcatgaagtggctcgtgccagagagttccggccgatacgtaaatcgaatgacaaacgaggcgctgcataaggggtgtagcctgaaagtgctggccgacagtgagcgctacacttggatcgtgctgtag

SEQ ID NO: 29162 - DNA, 651 bp, Artificial Sequence
  Description of Artificial Sequence: Synthetic coding sequence
atggggccccggaatccgtcaccggatcacctctctgagagtgagtcagaggaagaagaaaatatatcgtacctgaacgagtcctccggtgaggaatgggactcatctgaggaagaagactctatggttcccaatctgtcccccttggaatccctggcctggcaggtgaaatgcctcctgaagtactctacaacatggaagccacttaatcctaactcctggctttaccatgccaaactgctggaccccagtaccccagtacatattctgcgggagattgggttacggctatcccactgctcccattgcgtgcccaaactggagcctatccctgagtggccaccactagcatcttgcggagttccaccattccagaaaccactgacctccccatcacggctgagtagagaccatgccactctgaacggggcgctacagtttgccaccaagcagctgtccagaaccctcagccgcgcaacccccattccagagtacctaaagcaaatcccaaattcctgcgtgtctgggtgctgttgcggctggcttactaaaactgtcaaagagactaccagaacagaacctatcaataccacatactcctacacagactttcagaaagctgtgaacaaactgctaacagcatcactctag

SEQ ID NO: 29163 - DNA, 651 bp, Artificial Sequence
  Description of Artificial Sequence: Synthetic coding sequence
atgggtccaaggaatcccagtccagatcacctgtctgaatccgagtccgaagaggaggaaaatatttcatacctcaacgaaagctcgggggaagagtgggatagttccgaggaggaggactccatggtcccaaacctgagcccccttgaatccctcgcatggcaggttaaatgtctgctgaagtacagcacaacttggaaaccacttaaccctaattcctggctgtatcatgccaagctgctagacccgagtactcctgtccacatcctgcgggagatcggcctccggctgagtcactgtagccactgcgtaccaaaactggagcctatcccagaatggcctccactggcatcttgcggagtccctccatttcagaaaccccttactagtccgagccgcttgtccagagatcacgccaccctcaacggagcgctgcagttcgcaaccaaacagctgagtcggaccctctcccgcgcaacccccataccagaatatctgaagcagatccctaactcctgtgtgtctgggtgctgctgcggttggctcacgaaaaccgttaaagagactacccgaaccgaaccgattaacaccacttattcctatacggacttccagaaagctgttaataaactcctcacggctagtctgtag

SEQ ID NO: 29164 - DNA, 1488 bp, Artificial Sequence
  Description of Artificial Sequence: Synthetic coding sequence
atgaataagtcgagatggcagagcaggcggagacacggacgccggtctcaccaacagaatccatggtttcgcctacgtgatagcgaggaccgaagcgattccagagccgcacagcctgctcacgactcaggacatggtgacgacgaatctccctcaacatccagcggtaccgccggaacctcatcagttcccgagcttccgggtttttacttcgacccggaaaagaaaaggtacttccgcctactgccaggacacaataactgcaacccgctaacgaaagagtcaattcgacagaaagaaatggaatcgaagagattaaggctcctgcaggaggaggataggaggaaaaaaatcgccagaatggggtttaacgccagtagcatgttacgcaagtcccagctgggtttcctgaatgttaccaactattgtcatctggcacatgaactcaggctgtcctgtatggagcgcaagaaggtccagattaggagcatggacccctccgccctggctagcgatcgcttcaaccttattctcgccgataccaactctgaccgactcttcaccgtgaatgatgttaaggttggcggctccaaatacggaattattaatctgcagtccctgaagacccctacccttaaggtgtttatgcatgaaaatctttattttacaaatcgaaaggtgaactccgtgtgttgggccagcctgaaccatcttgatagccacatacttctctgcctcatgggtctggccgagactccaggatgtgctaccctcctgcccgcatctttatttgtcaactcccacccaggcatcgaccggccagggatgctctgcagttttcgtattccgggtgcctggtcatgtgcatggtctctcaacattcaggccaacaattgcttctcgaccggcctcagtcgacgtgtcctgttaactaatgtcgttaccggccaccgtcagtcatttgggacaaattccgatgtgctcgcccagcaatttgcccttatggcacctctgctttttaatggatgtcgctcaggagagattttcgccatagatttaagatgtgggaaccaggggaagggctggaaggccacacggctctttcatgattccgccgttacatcagttcgtattttgcaagatgaacagtacctgatggcatctgacatggctggaaaaatcaaactgtgggacctgagaacaaccaaatgcgtgcgacagtacgagggacatgtgaacgaatatgcttacctgccccttcacgttcacgaggaggagggaatacttgtcgccgtgggacaagactgttatacccgaatctggagtcttcacgacgctcggctcctcaggactattccctccccttacccagccagcaaagctgatatcccctcagtggccttcagtagtcggcttggaggcagtaggggcgcacctgggctgttaatggcggtcgggcaggacctctactgttattcgtatagctag

SEQ ID NO: 29165 - DNA, 1188 bp, Artificial Sequence
  Description of Artificial Sequence: Synthetic coding sequence
atggagtctaagcgcctgcggctgctgcaggaagaggaccggaggaagaaaatcgcacggatggggttcaatgcttcctcaatgctcaggaagagtcagcttggctttttaaatgttacaaattactgccacctcgcacacgaactccgactctcctgtatggaacgcaaaaaggtccagatccgctctatggacccatcagccctggcctcagaccggtttaatcttattctggctgacacaaattcggataggctgtttactgtgaacgacgtgaaagtagggggatccaaatacggcattataaacttgcagagcctcaaaacgcctacactcaaggtgttcatgcacgaaaatctttactttactaatcgaaaggtcaatagtgtgtgctgggcctccctaaatcacctcgactcccacattctcctatgtctgatgggactggcagaaacacccggatgtgccacactgttgcctgcttccttgtttgtgaatagccatccgggcattgacagacccggcatgctatgctcttttagaatcccaggggcatggtcttgtgcttggtcattgaacattcaagccaacaactgtttttctacagggctcagtcgacgagttctgctcactaatgtggtgactggccacagacaaagcttcggcaccaatagcgatgtgttggcccagcagtttgcccttatggctccccttctctttaatggatgtaggtcgggggagatctttgctatagatctgcgctgcggaaatcaggggaagggttggaaagccacacgtctctttcacgactctgctgtaacaagcgtgagaatattacaggacgagcagtacctgatggctagcgatatggctggaaagatcaagctgtgggacctgcgaaccactaagtgtgtccggcaatatgagggccacgtcaatgaatacgcatatttgcccctgcacgtgcatgaggaagaagggatccttgtggcagtgggtcaggactgctacaccagaatttggagcctgcacgacgccagactgctgcgcaccattcccagtccttaccctgcttccaaggccgacattccaagcgttgcctttagctctagactgggggggtctaggggtgctccggggctgctgatggccgtgggccaggatttgtactgctactcgtactcctag

SEQ ID NO: 29166 - DNA, 1308 bp, Artificial Sequence
  Description of Artificial Sequence: Synthetic coding sequence
atgaacaagtcacggtggcagagccgtcggcggcacggccgcagaagccatcaacaaaacccatggtttaggttacgggattcagaagatcggagcgacagccgagctgctcaacccgcccacgatagcggacacggggacgatgagtccccttccactagtagtgggacagctggaacctcgagtgtgccggagcttcccggcttttatttcgaccccgaaaagaagaggtattttcggttactgccaggccacaacaattgtaatccacttacaaaggaatccataaggcagaaggagatggagtctaagcgcttgcgtctgctgcaggaggaagatcgccgcaaaaaagccgatacgaactccgaccgcctcttcacagtgaatgacgtgaaggtgggaggctcgaagtatggaattattaacctccagtcgctgaagactccaactttaaaagtgttcatgcatgagaatctttattttacaaaccgcaaggtaaatagtgtttgctgggcttcacttaatcatctcgacagccacatactgctttgtctgatggggctcgccgagacacccggctgtgctacactgttgcccgcctcccttttcgtgaactcgcatcctgctggaattgatagaccaggtatgttatgcagcttccggataccgggagcgtggagctgcgcatggagcttaaatattcaggccaacaattgctttagcaccggcctgagtcgccgagttctcttgactaacgttgtgaccggccacaggcaaagcttcggcacaaattcagacgtgctggcacaacagtttgctctcatggcccccctgctgtttaatggatgccgttctggcgagatctttgcgatagatctgagatgtgggaaccagggcaagggctggaaagccactagactatttcacgactctgctgtgacctcagtccggatcctgcaggatgaacaatacctcatggcctcagacatggctggcaaaatcaagctttgggatcttaggaccaccaaatgcgtcagacagtacgagggtcatgtcaatgaatatgcctacttgcctttacatgttcacgaggaagagggcatactagtggctgttgggcaagactgctatacacgcatttggtcactgcacgatgctcgcctcctcaggacgatccctagcccataccctgcttccaaggctgacatcccttccgtggcctttagctctaggctggggggcagccgcggggcacccgggttactcatggctgtaggtcaagatctatactgctactcctatagttag

SEQ ID NO: 29167 - DNA, 1470 bp, Artificial Sequence
  Description of Artificial Sequence: Synthetic coding sequence
atgaacaagtcccgctggcagtcccgccgacggcacgggcgtagatcccaccagcagaacccgtggttccgcttacgtgactctgaggatcgctctgactcccgcgccgctcagcccgcccatgactcgggacacggagatgatgaaagtccgtccacgtcttctggcacagccggaacgtcctcggttcctgaactgccgggtttctactttgatcccgaaaagaagcgttacttccgcctcctgccagggcataataactgtaacccattgacgaaggagagcattaggcagaaggagatggagtcaaagcggctgcggctcctgcaggaggaggacagaaggaaaaaaattgcaaggatggggttcaatgccagtagcatgttgcgaaagagtcagttaggcttcctgaatgtgactaactattgtcatctcgcccatgaacttcgcctgtcctgcatggagcgcaaaaaagtgcagatccgttcgatggatcccagcgcactggccagcgaccggttcaatctgatcctggccgacacaaatagtgacagattgttcaccgtcaacgatgtgaaggtggggggctctaagtacggcatcataaacctacaatctctgaaaaccccaactctaaaggtcttcatgcatgagaatctctactttaccaatagaaaggtcaacagcgtctgttgggctagcctgaaccacctagattcccacattcttctgtgccttatgggactggctgagacgcctggctgtgctacccttttgcccgcttcactgttcgtgaacagccaccccgctgggattgataggcccgggatgctgtgtagttttcgcattcctggagcctggtcctgcgcgtggtccctcaatatccaggctaataattgtttctccactggactgtcacgcagagttctgctgacaaacgtcgtaacgggccatcgacagtccttcggcactaacagtgacgtgctcgccccattgctgtttaacgggtgcaggagtggcgagatttttgctattgatctacgatgtggaaaccagggaaaagggtggaaggccaccagactctttcacgattcggctgtaaccagcgtgagaattctgcaggatgagcagtacctaatggcatctgatatggctggaaaaattaaactttgggacctgcgcacgacgaagtgcgtccgtcagtacgaggggcacgttaacgaatacgcttacctgccacttcacgtccacgaagaggagggcattctcgtggctgtgggccaggattgttacaccagaatttggtctctgcacgatgctcggctgctcagaacaattccaagtccgtatccggcgtcaaaagccgacataccgagtgttgcattttcttccagactcgggggctcgcgtggggcacctggcctgcttatggcagtgggacaggacctgtactgttactcctatagttag

SEQ ID NO: 29168 - DNA, 1191 bp, Artificial Sequence
  Description of Artificial Sequence: Synthetic coding sequence
atggaagctgagaggctcagactgcttgaggaggaggcaaagctcaagaaagtcgcgcgtatgggtttcaatgctagcagcatgttgaggaagtctcagctggggtttctcaatgttacaagttatagcaggctggctaatgagctgcgcgtctcatgtatggagcgtaagaaagtgcagattagatccctcgatccctcctctctggcttctgaccgctttaactttatcttagcctccactaacagcgaccagctgttcgttgtcaaccaggtagaggtggagggctccaagtatgggattatatccctgcgtaccctaaagataccttccttccatgtgtatgtgctgaggaatctctatgtacctaacagaaaagtcaagtcactgtgctgggcgtcactgaaccagctggactcacatgtgctgctgtgtttcgaaggcatcacggatgccccatcctgcgccgtgttgctgccagcatcccgatttctgtctgtgcacacccgggtaaatcaaccaggcatgctttgcagttttcagatacccgaggcctggagttgcgcttggagtctcaacactagggcttaccattgcttctccgccgggttatcacagcaggtcctgttaacatccgtcgcgacaggccaccaacagagtttcgacactagcagcgacgttctggcccagcagttcgcttccaccgctcccttgcttttcaacggctgtaggagtggcgaaatatttgcaattgatctgcggtgccgcaaccgggggaagggctggcgcgcaacgcgattgtttcacgactcagcagtgacctcagtccagatcctgcaagaagagcagtgtttgatggcctcagatatgacaggaaagatcaagctgtgggacctgcgcgctacaaagtgtgtcagacagtacgagggtcatgtcaacgaaagcgcctacctccccttgcacgtgcatgaggaggaaggtatcgtggtagctgtcggacaggactgttatacaagaatctggtcactccacgacgcgcacctcctcagaacgataccaagcccatattctgcctcagaagacgacatccctagcgtggctttcgcaagccggctcggcggcattaggggcgcggcacccgggctgctgatggcagttagacaggatctgtattgctttccctttagctag

SEQ ID NO: 29169 - DNA, 1188 bp, Artificial Sequence
  Description of Artificial Sequence: Synthetic coding sequence
atggaaagcaagagacccaggctgctggaggaggctgataagcaaaaaaaaactgtccgcgttgggttgaatgcacctagcatgttacgcaaaaatcagctggggtttttgagattcgcgaattattgcagaatagccagagaactgcgcgtgagttgtatgcagaggaaaaaagtacagatccacagttgggatccctcctctcttgcctcagataggttcaaccggattctggcgaatacgaatacagaccagctgtttacagtgaatcaagtcgaggccgggggaagcaaatacggtatcatcactatgcgagggctgaccaccccagaactccgagtgtacccacataaaaccctctacgttcccaacagaaaggtcaactcaatgtgttgggcttctctcaatcacctcgatagccatttgttgctgtgttttgtgggcttggcggatacaccaagctgcgccgtcttgctgccagcctcgcttttcatcggtagctttcccgggatgcgccgaccaggtatgctatgtagctttcagattcctgacgcgtggagctgcgcttggagcctgtcaattcatgcataccactccttttccacaggactgagtcagcaggtgttgctgacaaacgttgtaacagggcaccagcagtctttcggcactagttcagacgtcttggctcagcagttcgcaatcatgacccccctgttgtttaacgggtgccgcagtggggagatctttggtattgacctacggtgcggcaaccagggctcgggttggaaggcaatttgcctctcccacgattccgcagttacctccctgcagatcctccaggatggacaattcctcgtctctagcgatatgacgggcacaataaagttgtgggacctcagagctaccaagtgcgtcacccagtatgagggccatgtcaataactcagcctaccttcccgttcacgtgaatgaggaagaaggcgtggttgctgctgtgggacaggattgttacacccggatttggtctttgcgtcatggacacttgcttactactattccttctccttatcccgcttcagagaatgatattcccagcgtagcattcagctcccggctgggaggttttagaggagcaccaggccttctcatggcggtcagggaagatctgtattgcttctcatacgggtag

SEQ ID NO: 29170 - DNA, 1803 bp, Artificial Sequence
  Description of Artificial Sequence: Synthetic coding sequence
atgtcccaccaggagggctccacgggaggtctgcccgacctagtcacagaaagcctgttttcgtctcctgaggagcagagtggggtggccgctgttacagccgcctcatccgacatcgagatggccgcaaccgaacccagtacaggagatggaggagacactagagacggcggattcctgaacgacgctagcactgaaaatcagaacactgattccgagtcatcttctgaggacgttgaactggaatctatgggggagggtctgtttgggtatccgctggtgggagaggagaccgaacgagaggaggaagaggaagaaatggaagaggagggggaggaagaggaacagccgaggatgtgtccaagatgtggtggaacgaatcacgaccagtgtctacttgatgaggaccaggcactcgaggagtggatttcctcggaaaccagtgctcttccaaggagcagatggcaagtcttgaccgccctccgccaacgtcagttaggcagttccgccagattcgtatatgaagcctgcggtgctcgaaccttcgtgcaacgcttccgcctgcagtatctcctggggagccatgccgggtccgtttccaccattcacttcaatcaacgaggaactcgtttagcctcatctggcgacgacctcagggtgatcgtgtgggattgggtcaggcaaaagccggttctaaattttgagtccggccatgatattaatgtcatacaagccaagtttttccccaactgtggcgattcgaccctcgccatgtgcgggcacgatgggcaggttagggttgctgaactgatcaacgcttcgtactgtgagaacactaagagggtggcaaagcaccgaggcccagcccatgagttagcactggagccggacagcccctacaagttcctaacaagcggcgaagatgctgtggtgtttaccatcgacctgcgtcaggaccggcccgctagcaaagtagtggtaacacgtgagaacgacaagaaagtaggactctacacgatttccatgaacccagcgaacatctaccagttcgccgttggaggccacgaccagttcgtgagaatttatgaccagcgaaggatagacaaaaaggaaaataatggagtcctcaagaagtttacccctcaccatcttgtgtactgtgacttccctaccaatatcacatgtgtggtttattcccatgatggcaccgaactcttagcctcttataacgacgaagatatttacctgtttaacagttccctaagtgatggagcacagtacgttaaaagatacaaggggcacaggaataatgataccattaaatgtgtgaatttctacgggcctaggtcagaatttgtggtgtctgggtctgactgcggtcatgtgttcttctgggagaagagcagctctcagattatccagttcatggaaggggatcgtggagatattgtgaactgtcttgagccgcatccctacttacccgttttggctactagcggcctggatcagcacgttaggatctggacaccgaccgcaaagaccgccaccgaattaacagggttgaaggacgtgattaagaaaaataaacaggagcgcgacgaggacaacttgaattatactgacagtttcgataaccggatgctccgctttttcgttaggcacctgctgcagagggctcaccagcccgggtggagggatcacggcgccgagttcccagacgaagaggagttagacgaatcttcaagcacctccgacaccagcgaagaggaaggacaggacagggttcagtgtatcccgtcgtag

SEQ ID NO: 29171 - DNA, 1896 bp, Artificial Sequence
  Description of Artificial Sequence: Synthetic coding sequence
atgtcacatcaggaggggagcaccgacggcctgcccgacctcggcaccgagtcattgttttctagcccggaggagcagtcaggtgccgtcgcagcaaccgaggccagttcagacatcgacattgccacctctgaactttccgttaccgtcacgggtgacggaagtgactcccgggacgggggatttccaaacgacgcgagcaccgagaatcgcagtagtgaccaggagagcgcgtccgaggacatagaactcgaaagcctggaagacttcgaacactttctaatgagcggagaatctctctttcattacccactcgtgggagaggaggagaccgagcgcgaagaagaagatgaagaaattcaggaggaaggcggtgaggaagaggaagaagaagaggaagaggaggaggaggaggaagaagaagaggaggaagaagaggagcagcccagggccggaccccagggcagtggaggaaaccacgaacaatacagtttggaggaagatcaggcactagaagagtgggttagctctgaaaccagcgcgttgcccagaccgcggtggcaagtcgtgacagccctccaccagaggcaactggggtcccgaccgcggtttgtgtacgaggcttgtggcgcccgggctttcgtccaacgcttccggcttcaataccggcttgctgaccacgtgggttgtgtaaataccgtccacttcaatcagcgaggtacgaggttagcttctagcggtgatgaccttaaggtaatcgtctgggattgggtgcggcagagaccagtactgaattttgaatcgggtcacactaataatgtcttccaggccaaatttttgccaaactgtggcgacagcacactggccatgtgtgctcgcgacggccaggtgcgggtggccgaactcatcaacgccagctactttaacaacaccaagtgcgttgcccaacaccggggcccggcccataagctggcccttgagcccgattctccctacaagttcttgacctctggcgaggatgccgtggtttttaccatagatctgcgtcaggatcgacccgcttccaaagtagttgtgacccgcgagaatgacaaaaaggttggcctgtatacgatcacagtgaacccagccaatacttaccaattcgccgtcggaggacaggaccagttcgtccggatctacgatcagcgcaaaatcgataagaaagagaacaatggcgtccttaagaaatttacaccccaccacctcgtcaattgtgattttcccacgaatataacgtgcgttgtgtactcccatgatggaactgagctgctggcctcctataatgatgatgacatctacctgttcaatagctcacactccgacggggctcagtattcaaaacggtttaaaggacacaggaacaacactaccgtcaagggagttaacttctacggcccccgaagcgaatttgtcgtctctggctccgattgcggacatatcttcttctgggagaagtccagctgccaaatcattcagtttttgaaaggtagtcgagaaggaactatcaattgccttgaaccccacccctacttgcctgtgctggcgtgcagtggcctcgatcatgacgtcaaaatctggacacccacagctaaggccgcaacagagttgacagggttgaagaaggtgataaaaaaaaacaaatgggagcgtgacgaggactccctgcatcatgggagcctgttcgaccagtatatgctgtggtttctgctccgacatgtcacacaacgaggacggcaccaggattggcggtcaggcgaggctgagttcccagacgaggagagtgacgagtccagctccaccagtgagacgagcgaagaggaggttcaagatcgggtacagtgtatgccatcttag

SEQ ID NO: 29172 - DNA, 1452 bp, Artificial Sequence
  Description of Artificial Sequence: Synthetic coding sequence
atgtccaccgcccggacagaaaatccagtcattatgggcctgtcatctcaaaatgggcagcttcggggtcctgttaaacccacaggaggacccggtggaggcgggacgcagactcaacaacagatgaatcagttgaaaaacaccaatacgataaataatggaacacagcagcaggcacaaagtatgactactacaatcaaacctggtgacgactggaagaaaaccttgaagctccctcccaaagacctccgaatcaagacttcagacgtgacctcaacaaagggaaacgaatttgaggactactgcttgaagcgcgagctattgatggggatcttcgaaatgggatgggagaagcctagccccattcaggaggagagcattcctattgctctgagcggcagagatatcctggctagagcgaagaatggaaccggcaaaagcggcgcatacctaatccctcttctggagcggctagatttaaagaaggacaacatacaggcaatggtgatcgtgcctaccagagagttagccctccaagtgagccagatttgtatccaggtttcaaaacacatgggcggagctaaagtgatggctactaccggcggtacaaacctgagagacgacatcatgcggctcgacgacacagtacacgtggtgattgccacaccaggtcggatcctcgacctgattaagaagggggtcgcgaaggtggatcacgtgcaaatgattgtgttggacgaagctgacaagcttctgagccaggattttgtgcagatcatggaagatatcattttaacattgcccaagaacagacaaatcctgctttattcagctacgttcccactgagcgtacagaagtttatgaattcgcatctgcagaagccctacgaaataaacctcatggaagagttaaccttaaaaggcgtaacgcagtactacgcctatgtaaccgagcgccagaaggtccattgcctaaatactctgttcagcaggctccaaataaatcagtctataatcttttgtaactcatcccaacgcgttgagcttcttgccaagaagatcagtcagctgggctactcttgtttctatatacacgctaaaatgcggcaagagcacaggaaccgggtgtttcacgatttcagaaatggcctctgcagaaacttggtatgcaccgatttatttacaaggggcatcgatattcaggctgtgaacgtggttatcaactttgatttccccaagctggctgaaacgtacctgcacagaataggccgcagcggccgatttggccacttgggactagccatcaatctgatcacttatgacgaccgcttcaatctgaaaagcattgaagaacagctcgggaccgaaattaagccaattccgtcaaatattgacaagtctctatatgtggccgaataccacagtgagcccgttgaagacgaaaaaccatag

SEQ ID NO: 29173 - DNA, 1452 bp, Artificial Sequence
  Description of Artificial Sequence: Synthetic coding sequence
atggctggattcgcggaactcgggctgtcaagctggttagttgaacagtgtaggcagctgggactgaaacagcctaccccagtgcaactgggttgtattcccgccatcctagaggggagggactgcctgggctgcgccaagaccgggagcggcaaaactgccgcttttgtactcccaatattacagaagctcagcgaagacccttatgggattttctgtctggtcctgactccaacaagagaattagcgtaccagatcgccgagcaatttagagtgctcggaaagccccttggactaaaggattgtatcatagtgggcggcatggacatggtcgcccaggctttggagctctcaaggaagcctcacgtggtgatagccacgcccggccggctcgccgaccacctccggtccagcaataccttctctatcaaaaagattagatttctcgttatggatgaggcggacaggctgcttgagcaaggatgtaccgattttaccgtggatctcgaagctatcctcgcagctgtgcccgccagaaggcagactctattgtttagcgcaacactcactgatactctgagagagctgcaggggctggccaccaatcagccctttttctgggaagcacaagcaccagtcagcaccgtggaacagttggaccagaggtacctcttagtccccgaaaaggttaaggacgcctacctcgtccacctaatccagcgtttccaggatgagcacgaggactggagcatcatcattttcaccaacacctgtaaaacttgccagattctgtgcatgatgctcaggaagttctctttccctactgtagccctccactctatgatgaaacaaaaggaacgattcgcagccttagcaaagtttaaaagctctatctatcggattctgattgcaaccgacgtcgcaagtagaggcctggacataccaacagtacaggtggtgatcaatcacaacactcctgggctgcccaaaatttacattcacagagtggggcggaccgctagggccggcagacaagggcaggccattactctcgttacacaatacgatatccacctcgtgcacgccattgaggaacagatcaagaaaaagttagaggaattttccgtggaggaggccgaagtactgcagatcctgacccaggtgaacgtcgtgagacgcgagtgcgaaataaaactagaagccgcacactttgacgagaaaaaagaaattaataagagaaaacagcttattctagaggggaaggatcctgatctcgaggctaaaaggaaggccgaactggccaaaattaagcagaagaaccgcaggttcaaagagaaggttgaggagacgctcaagcgtcaaaaggcagggagagctggacataagggaagaccacctcggaccccgtccggatctcattctgggcccgttcctagtcagggcttagtgtag

SEQ ID NO: 29174 - DNA, 765 bp, Artificial Sequence
  Description of Artificial Sequence: Synthetic coding sequence
atggatatggtcgcccaagcactggaactgtctaggaaaccccacgtagtgatcgccactccaggccgcttggccgatcacctgcgcagctccaacacgttttctatcaaaaaaattaggttccttgtgatggacgaggccgatcgtctgctagaacagggctgcactgattttacagtggatctggaagctattctagccgccgttccagcccgtcgtcagacactcctcttttctgctaccttaactgatacgctccgtgagctgcaaggcttggctacaaatcagccgttcttctgggaagctcaggcacctgtgagcactgtggagcagctggaccaacggtatctactggtgccggagaaagtgaaggacgcttatctggtgcatctgattcagaggttccaagacgaacacgaggattggtccattatcatttttacgaacacgtgcaaaacatgtcagatcctctgcatgatgctccgtaaattcagctttcctaccgtggcactccatagcatgatgaaacagaaagaaagatttgccgctttggccaagttcaaatcctcaatctatcgcatattgatagcgacagatgtggcgagcagaggggcagatcaaccccccctcccccctggggcttggacaagcctgaggtataggtggagtagcactactactcctccgggaagtccccgctctaccagcacggagtcagcaggccgcccggttcagggggggcgagtgcgcccgagtcgatggtag

SEQ ID NO: 29175 - DNA, 1803 bp, Artificial Sequence
  Description of Artificial Sequence: Synthetic coding sequence
atggaacatgtcactgaaggttcttgggaatctctgcccgtgcctttgcatccgcaggtcctaggggctttgcgcgagctcggatttccctatatgacacctgtgcagagtgcaaccatacctctatttatgaggaacaaggacgtcgccgccgaggccgtgacgggatcggggaagacgctagcattcgtgatccccatcctcgagatccttctccgacgagaggagaagctcaagaagtcccaggtcggagcgatcattataacccctacgcgagaactggccatccagattgacgaagtcctgtcccattttaccaagcatttccccgagttttcccagattctatggatcgggggaagaaatcctggcgaagacgtggaaagatttaaacagcagggcggcaacataatcgtcgccacccccgggcgcctcgaggacatgtttcgacggaaggcagagggtctcgatttggcatcttgtgtaagaagcctggacgtgctcgtcctcgacgaagccgacaggctgctagacatgggtttcgaagcttcgataaacaccatacttgaatttctgccgaaacagaggcggacgggcctattctctgctacccagacacaggaagtggaaaacctggtgagagctggcctcaggaaccctgtccgagttagtgtcaaagaaaagggggttgccgctagctctgctcaaaaaactccatcgcggctcgaaaattactacatggtatgcaaggccgacgagaagttcaaccagctggtgcatttccttagaaaccataaacaggaaaagcatctggtatttttcagtacttgcgcttgcgtcgaatactacggaaaggcgttggaggtgctggtaaagggggtgaagatcatgtgcattcatgggaagatgaagtataaacggaacaaaatctttatggagtttcgcaagctgcagagcgggatcctggtgtgcaccgatgtaatggcacgaggtatcgacattcccgaagtgaattgggtccttcagtacgaccccccatccaatgcctcagcatttgtacatcgttgtggacgaacggcacggatcggccacggcgggtccgctctggtgttcctgctccccatggaggaaagctacattaacttccttgctatcaatcagaagtgcccactgcaagaaatgaagccgcagcgcaacacagctgacctgctgccaaaactgaaatcaatggccctggcagatagagccgtcttcgagaagggtatgaaggcgtttgtaagctatgtgcaggcctacgctaagcacgaatgtaatctgattttccgcctgaaggacctggacttcgcgtctctggcccggggcttcgcattacttcgaatgcctaagatgcccgagctccggggtaagcagttccctgactttgtaccagtggacgtgaatactgacacaatcccatttaaggataagatccgtgagaaacagcgtcagaaactcctggagcagcagcgaagggagaaaactgagaacgaggggcgcagaaaattcatcaaaaataaggcctggtcaaagcagaaagccaagaaagaaaagaagaaaaagatgaatgaaaagcggaagagggaggaaggctccgacatcgaggacgaagatatggaggaactgctgaatgacacccgcctgttaaagaagcttaaaaaggggaagatcacggaagaagaatttgagaagggtctccttaccaccggcaaacgcaccataaaaactgtggatctgggcatcagcgatttagaagacgattgctag

SEQ ID NO: 29176 - DNA, 1062 bp, Artificial Sequence
  Description of Artificial Sequence: Synthetic coding sequence
atggaacacgtgacggaggggtcttgggagagcttaccagtccctctgcatccccaagtgctgggagctctacgtgagttgggtttcccatatatgacaccagtgcagagcgccaccattccattgtttatgcgtaataaggatgttgcggccgaagcagtgaccggcagtggcaagacactggcctttgtgattccaatcttggaaatcctgctgaggcgtgaggagaaacttaagaaatcgcaggtgggagccataatcatcaccccaacaagagaattagccatccaaattgatgaagttctatcccacttcacaaagcactttccggagttctcccagatcctctggatcggcggacgcaacccaggagaagacgttgaacgtttcaagcagcaggggggcaacatcatcgtcgcaactcccggtcggctggaggatatgttccgtcgaaaggccgagggtcttgatctcgccagttgtgtgcggtcactcgatgtactagtcctggacgaagcagatcggttgttggacatgggcttcgaggccagtattaatacaatcttggagttcttgcccaaacagcggagaaccggcctttttagcgcgactcaaacacaagaagtagaaaatttagtgagggccggtctccggaacccagtgcgagtcagcgtgaaagaaaagggggtcgccgcaagtagcgctcagaagaccccctctaggctggagaattattacatggtttgcaaagcagatgagaaatttaaccaactggtgcactttctcagaaatcacaagcaggaaaaacacttggtctttttctctacttgcgcctgtgtggagtactacggtaaagcactggaggtattagtcaagggtgttaagattatgtgcatccacggtaaaatgaaatataaacggaacaagatctttatggagtttcgcaaactgcagtctggcattctggtgtgtactgatgtgatggcccgcggcattgatatccctgaggtcaattgggtactgcagtacgatccaccttctaatgcggtgctcccctgttag

SEQ ID NO: 29177 - DNA, 1860 bp, Artificial Sequence
  Description of Artificial Sequence: Synthetic coding sequence
atgtttgtgccacgtagtctgaaaatcaagcgcaatgctaatgacgatggtaagtcatgtgtcgctaagatcattaaaccagaccccgaggacctacaacttgacaaaagtcgtgatgtgccggtggatgctgtggccactgaggcagctaccatcgataggcatatttctgagagctgccctttcccctcacccggaggacagctggcggaggttcattcagtcagccccgaacagggtgcaaaggactcccacccatcggaggaaccagtgaagtcttttagtaagactcaacgttgggcagagcccggcgagccaatatgcgtagtctgtggacggtatggtgaatacatttgcgataagactgacgaagatgtctgctccttggagtgtaaagcaaagcatctgctgcaggtgaaagagaaggaggaaaagagcaaattgagcaatccccagaaggccgattcagaaccagagagccccctcaatgccagttacgtttacaaggagcatcccttcattttgaatcttcaggaagaccaaattgagaatctaaagcaacaactgggcatcctggtacagggccaggaggtgacccgcccgataattgactttgaacattgtagtctgccagaagtgctgaatcacaacttaaagaaaagtggatacgaagtgccaacgccaatacagatgcagatgatccccgtggggctgctgggcagggacatactcgctagtgcggacacaggcagcggaaaaacagccgctttccttctgccagtaattatgcgtgccctgttcgaaagcaaaaccccctccgccttgatcttgacccctacccgcgaactcgcaatccagatagagcgccaggctaaagaactgatgagcggactcccaaggatgaaaacagttctgctagtcggcggcctgccacttcctccccagttatacagactgcagcagcatgtgaaggtgatcattgctacaccgggccgtttgcttgatattataaagcagagtagcgtagagttgtgtggggtgaagatcgttgttgtagacgaggccgacacaatgcttaagatgggctttcagcagcaggtgctcgatatcctggaaaacatccccaacgactgtcagactatcctggtatcggctaccatccctacatctatagagcagctggcatctcagctgctccataatcctgtgcgcattattaccggtgaaaagaatctgccgtgtgctaatgtcagacagatcatactctgggttgaggatccggccaagaaaaaaaagctgtttgaaatcctaaatgacaagaagctcttcaagccccccgtgctggttttcgttgactgtaaactgggcgccgatcttctgtccgaggctgttcagaagatcaccggactcaagtctatcagtatccactcggagaagagtcagatagagcgcaaaaacatactcaagggactgttagagggtgactatgaggttgtcgtctccaccggcgtgctggggcgtgggctagatctaattagtgtcaggctggtcgtcaactttgatatgccatccagcatggacgaatatgttcatcaaatcggtcgggtgggacggttaggccagaacgggacggcaataacatttatcaacaataactcaaaaagactcttttgggacattgcgaagagagtgaagcctaccggatccattctgccacctcagctcctgaatagcccttatttgcacgaccaaaagagaaaagagcagcagaaagataagcagacacagaacgatctggtcacaggggcgaacctcatggatatcattagaaagcacgacaaatctaatagccagaaatag

SEQ ID NO: 29178 - DNA, 618 bp, Artificial Sequence
  Description of Artificial Sequence: Synthetic coding sequence
atgaaaaccgttctgctggttgggggccttccattgccccctcagctctaccgtttacagcagcacgtgaaggacaagaaactgtttaaacctccagtgcttgtgtttgtagactgtaagctcggggcagacctgctgtcagaagccgtgcaaaaaatcacaggcttgaagagtatcagcatccatagcgagaaaagccagatcgaacggaagaatatcctgaaagggctgttggaaggcgattatgaggtggtggtgagcacgggtgtccttggtaggggactggacctcatctccgtgagactggtggttaactttgatatgccttctagtatggacgagtatgtgcaccagatcggtcgagtaggccgcctgggtcagaatggaactgccattacctttatcaataacaactcaaaaaggcttttttgggatatcgcgaagcgtgtcaagcccaccggctccattctgcccccacagctgttaaattctccataccttcacgaccagaaacggaaggagcagcagaaggacaaacagacccagaatgacctcgttaccggagcaaacctgatggatatcatccgcaaacacgacaagtccaactcccagaaatag

SEQ ID NO: 29179 - DNA, 1704 bp, Artificial Sequence
  Description of Artificial Sequence: Synthetic coding sequence
atgttcgtccctcgctctcttaagatcaagcgcaatgcgaacgacgatgggaagtcttgtgtcgccaaaatcatcaaaccagatccagaggatcttcagctggataagtctcgagatgtccccgtagacgctgtggccacggaagcagctacaatcgatagacatatctctgagtcatgtccatttccctctccaggggggcagctagccgaggtccactccgtctctcccgagcagggcgccaaagattcacatcctagtgaggaacccgtcaagtcctttagtaagacccagcgttgggctgagcctggggagcccatctgcgtggtgtgtggacgttatggcgagtacatctgtgacaagaccgatgaggacgtctgcagccttgagtgcaaggccaagcatcttctgcaggtcaaggagaaagaagagaagagcaaactgagcaaccctcagaaggcagactccgagccagaatcccccctgaacgccagttatgtgtataaagaacatcccttcatactgaatttgcaagaggaccagatcgagaatctgaagcaacaactggggatactcgtgcagggccaagaggtcacaagacccataattgatttcgagcactgttcgcttccagaggtcttgaaccacaatcttaagaaatccggatacgaggtaccgactcccatccagatgcagatgataccagtgggtcttctaggaagggatattctggcgtcagccgatacaggatcgggaaagacggctgcattcttgctgcccgtgattatgcgtgctctctttgaatctaaaaccccaagcgcccttatcctcaccccaacaagggagctggctattcagatcgagcggcaagctaaagagctgatgagtggcctcccccgcatgaagaccgtcttgctcgtgggcggactccccctacctccccagctgtaccgacttcagcaacacgttaaagtcattattgcaacgccaggcaggctactggacataattaaacagtccagtgtggaattgtgcggagtgaagattgtggtggtcgacgaagcagacacaatgctgaagatgggatttcaacagcaggtgctggatattctggagaacattccaaacgattgccaaacaatcctggtgtccgctactattcctactagcatagagcagttggctagccagctgctgcacaaccccgtgaggatcatcacaggcgagaaaaatctgccatgcgctaacgtgagacagataatactatgggtcgaagaccccgctaagaagaagaagttgttcgaaattctgaatgacaaaaagctgttcaaaccacccgtcctcgtcttcgttgactgcaagcttggcgccgacctcctgtcagaagccgtacagaaaatcacgggcttgaaatcgatctcaattcatagtgagaagtcacagatcgagagaaaaaacatcctcaaaggactactagagggggactatgaggtggtcgtgtccacaggcgttctgggccgcggtttggacctgatctctgttcgcttagtggtgaactttgatatgccttctagcatggatgagtacgttcatcagctcaatattatttgggtcgtgccattctcagggataaacatcaatgctagcctgatcgccctactgtactctttactcacaacaatcaatatgaaattcaccccctag

SEQ ID NO: 29180 - DNA, 486 bp, Artificial Sequence
  Description of Artificial Sequence: Synthetic coding sequence
atgttcgtgcccaggagtctcaaaattaaacgcaatgctaacgacgacggaaaatcttgcgtggctaaaatcataaagcccgatcccgaggacttgcagcttgacaaatccagggatgtacctgtggatgctgttgccactgaggcagctacaattgataggcacatttctgagagttgccccttccccagccctggaggccagctcgcggaggtccactccgtgagcccagagcaaggcgccaaagactcccatccatccgaggagcctgtgaagagcttcagtaagactcagcgatgggcagagccaggtgaaccgatctgtgtggtttgcggacgctatggggagtacatctgtgacaaaaccgatgaggatgtctgctcattggagtgcaaggctaagcatctgctacaggtgaaagagaaagaagagaagagtaagttgagcaatccccagaaggcggactctgagcctgagagcccttag

SEQ ID NO: 29181 - DNA, 1743 bp, Artificial Sequence
  Description of Artificial Sequence: Synthetic coding sequence
atgtttgtacctcgttccctgaagattaaacggaatgccaatgatgatggcaagagttgtgtggcgaaaatcataaagcccgatccggaggacctacaactggataaatcccgcgacgtgcccgtcgacgctgtggcgacggaggcagcaaccattgataggcacatctccgaaagctgcccttttccttcacccggcggacaacttgctgaagtccattcagtctcacctgagcaaggggccaaggattcccacccatcagaggaaccagtgaagtccttttcaaaaactcagcggtgggcagagcccggagagcccatttgtgtggtctgtggccggtacggtgagtatatctgtgacaagacggacgaggacgtctgcagtttggagtgcaaggcaaagcacctgcttcaggtgaaagagaaggaggagaagtcaaaattgagtaacccacagaaggcagacagcgaacctgagtcccccctgaacgcctcctacgtctacaaggagcacccttttatactcaatctacaggaagatcagatagaaaacctgaaacagcagcttggcatactcgttcaaggacaggaagtgaccaggcctattattgacttcgaacactgttcactaccggaggtactcaatcataacctcaagaagagcgggtacgaggtgcctacccctatccagatgcaaatgattccagtcgggcttctcggcagagacatcctggccagtgcagacactggatctggaaagactgcagcttttctgctgccggtaatcatgcgagctcttttcgagtcaaaaactcccagtgccctgatattgactcctacgcgggaactggctatccaaatcgagcgccaggcaaaggagctgatgagcggcctcccgagaatgaagacggtcctgttggtggggggcttaccgcttccgccgcagctgtaccgtctgcagcagcacgttaaagttatcatcgcaacacccggtagactcctcgatatcatcaagcaatcctccgtcgagctctgcggagtgaaaatcgtggtcgtggatgaggccgatactatgctcaagatggggttccagcagcaggtgctcgatatattggagaacatacctaatgattgccagaccatcctcgtgtccgctaccatccctacgtctattgagcaacttgccagccagcttctgcacaacccagtgcgcattatcacaggagagaaaaacctcccctgcgcgaacgtccggcaaattattctctgggttgaggatcctgctaagaagaaaaaattgttcgaaattctaaacgacaaaaaactcttcaagccccctgttctggtgttcgttgactgcaagctgggagcggacctgttatcagaggctgttcagaaaattacagggttgaagagcatttcaatacacagcgagaaatcccaaatcgagcgcaaaaatatacttaaaggactcctagagggggattacgaggtggtggtgagtaccggcgtgcttggaagaggtctggacctcatttccgttcggctggtggtcaacttcgacatgccctccagtatggatgagtatgtgcaccaggagaatacctacaagtctacatggcgcaacccccaacacttccagcaggatgtcagaatgactttggggtatgtgggtaaggcccagtgggaagaagataaccagctaaaggtgaagctgggtctgaagaaaaactgtagtagttag

SEQ ID NO: 29182 - DNA, 5121 bp, Artificial Sequence
  Description of Artificial Sequence: Synthetic coding sequence
atgggaagtaaggatcacgctgtgttttttcgtgagatgacacagctgatcctgaatgagatgccgaaagcaggatactctagcattttgaacgactttgttgagagtaatttcttcgtgattgacggtgacagcctgctagtcacatgtctgggggtaaagagcttcaagtgggggcagaacctgcactttttctatctcgtcgagtgttatctcgttgatcttttatcgaatggcgggcagtttaccatcgtgttcttcaaggatgcggaatacgcatactttgattttcccgagttgttgagtttgcgcaccgccttaatcttgcatttgcagcataacacgaatatcgatgtgcagactgaattttcagggtgcctcagccaggactggaaactttttctcgagcagcactacccttactttttgatcgtcagcgaggaaggactttccgacctgcagacatacctgttcaacttcctcattatccactcttgggggatgaaggtgaacgtagtcttgtcctccggccatgagagtgacacacttcgattctacgcgtatacaatggagagcactgacaggaaccagaccttctccaaggagaatgagaccgtaatccagtcagcttataagagtctaattcagcacctggaagaaatccgagttcttgtcttggccacacactttgagcatctgaaatggaatgacatgatggaggaggcataccagacactttttttgttgcagcacctatggtcagagggctccgatatccaaagagtcctgtgcgtcacttcctgcagcttgagtctcaggatgtaccacagagtgctcgtgcattctaattgcctctccctccaggaagtggaagatttctgtagactccgctgtctgtgcgtagcgttccaactacacctccctctttcccaaagagcttgttctagagtgattacctgctcttggattcggaattccgacagttttttgaaaatgaacaagtggtgtgagtactttatcctgagcaacctcaatgtctttggatgttggaaccttaatctcaatcatgtgtccgacttatatgacgagcagcttctaaagaatatcgccttttattatgagtttgaatccacccaggagccccacctgaacctgggggactccatacggcgagattacgaggacctctggaacgttgtctcccatctggtgaaggaatttaacgtaggaaaatccttccctctccgcacgacccgacgccatttcctgagacaggagaagagcgtgattcaggagatttccctggagaaaatgccctctgtgggatttatcccaatgacttccgccgttattgatgagttcgtcggcgacatgatgaaagacctcccgattttgaaatctgacgatccggtcgtaccttctttgttcaagcaaaaaacatccgacgaactgctccactggcatgcgcagcgattactgtctgacgattacgaccgtatcaaatgccatgtcgatgagcagtccagagatccccacgtgcttgattttctcaagaagatccaggattaccagcagttctatgggaaaagcctggaaagcatcagcaccaaggtgattgttactcaaacgactaggcctaaagaggactcaagcggagcctctggggagattcttcagaacacaaagccccatcagattaccaagaaatctaaaaaaaagtccttcttaaaggaagatcagaacaaggcccaacagaacgacgatctactatttagcatcgaagaggagatgaagaacaatttgcatagcggaattcggaaactggaagattacttgacatcttgcgctagcaattccgttaaatttggagtcgaaatgttgggccttattgcctgctttaaggcctggaagaagcactgtagaggcgagggcaaaatttccaaagacctctctattgcggtgcagatgatgaagcgtattcattccctgctagaaaggtacccagaaatacttgaagcagagcaccatcagtacattgctaaatgtttaaagtacctcgggtttaatgaccttgccaatagtctggatccaacactaatcggcgacgacaaaaataaaaagaaatacagcattgatataggtcccgcacgatttcagctgcagtacatgggacactacctgattcgggacgagcggaaggatcgggacccacgtgtgcaggatttcatccctaacgcgtggcagcaagaacttttagatgtggtggacaagaatgagtcagccgtaatagtagcacccaccagtagcggtaagacatacgcctcttactactgcatggagaaggttctaagagagagcgacgtgggtgtcgtagtgtatgttgcccccgcaaagagcctggtgggacaggtcgccgccactgtcgaaaatagattcacaaaaacattgccggctggcagaaccctctgcggggcgttcacaagggattactgtcacaatgtcctgaattgccaggtgttgattactgttccggagtgttttgagattctcctactggcacctcaccggcagaagtgggtcgaacgcatccgctacgtgatcttcgacgaagtacattatctcggccgtgaggtgggggccaaattttgggagttactgctggtgattatccgctgcccctttctggtactgagtgcgacgattaataatcctaatctcctcactaaatggctgcaaagtgtcaagcagtactggaaacaagccgacaagataatggaagagaagtgtatttctgagaagcaggccgataaatgcctgaatttcctgcaagaccattcttataaaaaccaatcttacgaggtcaggttggttctatacggggagcgctacaacgatctggaaaagcacatctgcagtgtcaagcatgacgatgtgtactttgaccatttccatccttgtgcggcactcactacggatatcattgagaagtatgggttcccaccagatctcactctaactccacaggagagcatccaactctacgataccatggcccaggtgtgggagacatggccaagggcccaagaactatgtccagaagaatttatcctcttcaaaaataaaatcgtcataaagaagctggacgctcgaaaatacgaagaaaatttgaaggccgaactcaccaactggatcaaaaacggccaagttaagaaggtgaaacgtgtcctgaagaatttatcccccgatagcctaagctccagcaaagatatggtaaagatgttcccattgctggtcgagaaattgagacagatggataagcttcccgcgatcttttttctgtttaaaaatgacgacgtagggaaaagagcgggcagtgtgtgcacctttctcgagaaaaccgagaccaagagccatccgcataccgagtgtcactcatatgtgttcgcaattgacgaggttttggaaaaagttcggaaaacacagaagaggattacaaagaagaatccgaagaaggccgagaagctggaacgaaaaaaagtctatagagccgagtatattaatttcttggagaacctgaaaatcctcgagatctccgaagattgcacatacgcagacgtgaaagctctccacactgagattacacgtaataaagattcaacactggagcgggttctcccccgcgtgcgatttaccaggcacggtaaggagttaaaagccctggctcagaggggcatcggctaccaccacagcagcatgtatttcaaggagaaggagtttgtggaaatactctttgtgaaagggctgattagagtggtgacggctacagaaactctggcgctcggaatccatatgccatgtaaatctgttgtatttgctcaggacagcgtgtaccttgacgcccttaattaccgacagatgtctgggcgcgccggccggcgtgggcaggacctgctaggtaatgtgtactttttcgacatcccgcttcccaaaattaagcgactactggctagctcagtgcctgaattaagagggcagtttccactgtcaatcaccttggtgctgcgcctgatgttgctggcctccaagggagacgatccagaggacgccaaggcaaaagtactgtccgttctgaaacattccctcttgtctttcaagagacggcgcgcaatggagaccttaaagctgtactttctcttctctctgcagctgttgatcaaagaggactatctgaacaagaagggaaatcctaagaagtttgctggattggcttcttacctccacgggcacgaaccaagtaatcttgtgtttgttaatttcctgaagagagggctcttccacaatctctgtaagcccgcttggaaagggtcccagcagttcagccaggatgtgatggaaaaactggtgctggtgctggctaacctctttggccggaaatacataccagccaagttccagaatgcaaacctttccttcagccaaagtaaagtcatcctggccgagttacctgaagatttcaaagctgcactgtatgagtataacttagccgttatgaaggacttcgcttcctttttattaatcgccagcaagtctgtgaatatgaagaaggagcatcagttacctctgtccagaatcaagttcaccggtaaagaatgtgaagacagtcagctggtatcgcaccttatgtcctgcaagaagggtagggtcgcaatttccccttttgtctgtttatcggggaatacagataatgatttgttacgccctgagactatcaaccaggtgatccttcgcacagtgggtgtaagcggaacgcaggcccccctgctttggccgtggaagcttgataaccgtggccggaggatgcccctaaacgcatatgtgctcaacttctacaaacacaactgtctaaccagactcgatcaaaagaatggcatgagaatgggacagctgcttaagtgtctgaaggattttgcttttaacatccaggccatctcggatagtctcagcgaactctgcgagaacaaacgcgacaatgtggtgttggctttcaaacagctttcacagacattctatgaaaaattgcaagaaatgcaaatacagatgtcccagaatcacctggaatag

SEQ ID NO: 29183 - DNA, 378 bp, Artificial Sequence
  Description of Artificial Sequence: Synthetic coding sequence
atgggaagcaaagaccatgccgtgttcttccgtgagatgacgcagttgatactaaacgaaatgcctaaagccgggtacagcagcatacttaacgatttcgtggagagtaatttctttgtgatcgacggggatagtctgctcgtaacttgtttaggggtgaagtcctttaagtggggtcagaacctccatttcttctatctggtggaatgctatctggtcgacctgctcagcaacggggggcaattcaccattgtcttcttcaaggatgcggagtacgcttatttcgattttcccgagcttctctcgctgagaacagcattgattcttcatctacaacacaataccaatatcgacgtgcagaccgagttctctggatag

SEQ ID NO: 29184 - DNA, 3927 bp, Artificial Sequence
  Description of Artificial Sequence: Synthetic coding sequence
atgggatccaaagaccacgctgtgttctttcgggagatgactcagttaattcttaatgagatgcccaaagcgggatactccagtattctcaacgattttgtggagtccaacttctttgtcatcgatggagattcattgttagtgacatgtttaggggtcaagtcctttaaatggggccagaatctgcatttcttctaccttgtggaatgctaccttgtggatttgctgtcaaatgggggacaattcaccattgtgttcttcaaggacgctgagtacgcctactttgactttcccgagcttttatcactgagaaccgctctcatcttgcacttgcagcacaatacaaatattgacgtgcagacggaatttagcggctgcctctctcaggattggaaactgttcctcgagcagcattatccctatttcctgattgtgtctgaggagggcctgtcggatctgcagacttatctgtttaattttttaatcatacatagttggggcatgaaagtgaacgttgtgctatcatccggccacgagagcgatactttaagattctacgcatatactatggaatccacggataggaatcaaaccttttctaaggaaaacgagaccgtgattcagtccgcctacaaatccctgatacagcacctggaggagattcgcgttcttgtgctagcaacacacttcgagcacctgaagtggaacgatatgatggaggaagcctatcagactctgttccttctgcagcatctttggagtgaggggtcagatattcagcgagtcctctgcgtgacctcctgctcactatctctccgcatgtatcatagagttctggttcacagcaattgtctgagccttcaggaggtggaagatttctgtcgcctccggtgtctgtgcgtggcgttccaactgcaccttccacttagccaaagggcgtgtagtcgggtgattacgtgttcctggattcggaactctgacagtttcctcaagatgaacaaatggtgcgaatacttcatattgtccaatctgaatgtttttggctgctggaacctcaatttgaaccatgtttctgacctgtacgacgaacagctcttgaaaaatatcgccttttactacgaatttgagagcacccaggaacctcatctcaacctcggagactccattcgacgggactacgaagacctgtggaacgtcgtgagccacttggtgaaggaatttaatgttggcaagtcattcccactcagaacaacaaggaggcacttcctccgacaggaaaagtctgtaatccaggaaatatcacttgagaaaatgcccagcgtcggattcatcccaatgacttccgcagtcatcgacgaattcgttggggacatgatgaaagacctgcccatcctgaaatccgatgatccagtcgtgcctagtcttttcaaacaaaaaaccagcgatgaactgctccattggcacgctcagcgactactgagcgatgactacgatagaataaagtgtcacgtggacgagcagagtcgtgacccacacgtcctggacttcctgaaaaaaatacaggactaccagcagttctacggcaagtctctagagagcatctccacaaaagttatcgtgacccaaacaacaagaccaaaggaggactcctctggtgccagtggcgagatcctgcagaatacaaagccacaccagataactaaaaagtctaagaagaaaagcttcctgaaagaagaccaaaataaagctcagcagaatgacgatcttctctttagcattgaggaggagatgaagaacaatctccactccggcatccgcaagctagaagactacctgacctcctgtgctagtaattccgtgaagtttggggtggagatgctgggcctgattgcctgctttaaagcatggaagaaacactgtcggggagagggcaagatctccaaggacctgagtatcgcagtgcagatgatgaagagaattcattcattgctagagcgctacccggaaattcttgaggccgagcaccaccagtatattgcaaaatgtctcaagtatctggggttcaatgatctggccaatagcctggatcctactctaattggggacgataagaataagaaaaagtattcgatcgacatcggtccggccagattccagctgcagtacatgggccactacctgattagagatgagcgcaaggacagagatccgagagttcaggactttataccaaatgcttggcaacaggagctcctggacgtggtcgataaaaatgagtcagccgtcatcgtggccccaaccagcagtggaaagacatacgcctcttactattgtatggaaaaggtgctgcgcgagtctgatgtgggggtggtggtttatgtggcacctgcgaaaagccttgttggacaggtggcggccacagtggaaaaccgttttaccaaaaccctacctgctggccgcactttatgcggcgcttttactcgggactattgccataacgtcttgaattgccaggtactcatcaccgtgccagagtgtttcgaaattcttcttctggcaccccataggcagaaatgggtggagagaatacggtacgtgatattcgacgaagtgcattacttgggccgcgaggtgggggcgaagttctgggagctccttctggttattattcgttgtcccttcctggtactgagtgctaccatcaataaccccaatttgctgactaagtggctccagtcagtgaagcaatactggaaacaggccgataaaatcatggaggagaaatgtatctcagaaaaacaggcagataagtgtctaaattttctacaagaccattcatataagaaccagtcctacgaggtgaggctggtgctgtacggcgagaggtacaatgatctcgagaagcatatttgcagtgtcaaacacgacgacgtttactttgatcatttccacccttgtgccgccctgaccactgatattattgagaagtacgggtttcctcctgacctcacacttaccccccaggaatccattcagctgtatgatactatggctcaggtttgggaaacgtggcctcgggcacaagagctgtgtcccgaagagtttattctgtttaaaaataagatcgtgataaagaagctggacgccagaaagtatgaggaaaacctgaaggccgagctcactaattggattaagaacggtcaggtgaaaaaggttaagagggtattaaagaacctgtctccagattcactgagcagcagtaaagatatggttaagatgttcccgttactggtggaaaaactgcgccagatggacaagttacccgccatcttttttcttttcaagaatgatgatgtggggaagcgcgccgggagcgtttgcacatttctggagaagactgagacgaagtctcacccacacactgagtgtcactcctacgtgtttgctatcgacgaggtgttggagaaagtgcgcaagactcagaaaaggatctcaaccaagaaaaatcccaaaaaggcggagaagctcgaaaggaagaaagtgtatcgggcagagtatattaacttcttggaaaacctcaagatattagagatcagtgaagactgtacttacgcagatgtcaaagcactgcacacggagatcacgcgaaacaaagattcgacacttgagagagtgcttcctcgcgttagatttacccgccatggcaaagagctaaaggcgttagcccaacgtgggatcggctaccaccacagctcaatgtacttcaaggaaaaagagttcgtcgaaattctgtttgtcaagggccttattagagtggtgacggctaccgagactctagccctggggattcacatgccgtgtaagtctgtagtgtttgcccaggatagcgtttatctggatgctctgaactacaggcagatcatgtag

SEQ ID NO: 29185 - DNA, 5121 bp, Artificial Sequence
  Description of Artificial Sequence: Synthetic coding sequence
atggggtcaaaggaccacgccgtatttttccgcgaaatgacccagctgatcctgaacgaaatgcctaaggccggatatagctctattcttaacgactttgttgagagtaacttcttcgtcatcgacggggattctctgttagtaacttgtttaggagtgaaatcgtttaagtggggacagaacttacattttttttatctcgtggaatgctatctcgtcgatctcttgtccaatggaggtcagttcacgatagtttttttcaaggacgctgaatatgcctactttgacttccctgagctgctgagccttagaacggccctgattctacacctgcaacacaataccaatatcgatgtccagacagagttctcagggtgccttagccaggattggaaactttttttagaacaacactacccttactttctaatagtcagcgaagaaggactgtcagatttgcagacatacctgttcaattttctcattatccactcctggggtatgaaagtcaatgtagtgctgagcagcggccatgagagcgatacacttaggttctacgcttatacaatggaatctacagacagaaatcagaccttctcaaaggaaaacgaaacggtgattcagtccgcttataaaagtctgattcagcatctggaagagattagggtgctggttctggccacacatttcgagcatctcaagtggaatgatatgatggaagaagcatatcagacattgtttctgctgcaacacctctggtccgaaggctcagacatccaacgcgtactctgtgtcactagctgctccttatccttaagaatgtatcatcgtgtgctggttcactccaactgcttgtccctccaggaagttgaggatttttgccgcttgaggtgtctgtgtgtggcgttccaacttcacctgcccctgtctcagcgggcttgctctcgtgttataacatgctcatggataagaaactcagattcgtttttgaagatgaataagtggtgtgagtacttcattctcagcaatcttaatgtgtttggttgctggaatctgaacttgaaccacgttagtgatctgtatgatgagcagttgttgaagaatatcgcgttctactacgagttcgaatcaactcaggaaccccaccttaatctcggcgattctatacgcagagactatgaggacctgtggaacgtcgtctctcatctggtcaaagagttcaatgtcgggaagtctttcccactgcgcaccacgcggcggcattttttaaggcaggaaaaatctgtcattcaggagatatccctggagaaaatgccttccgtagggttcatacccatgaccagcgcggtcatcgatgaattcgttggtgacatgatgaaggacctgccaattttgaaatctgacgatccagtagtgccttctctctttaaacagaagacatcggacgagctccttcactggcatgctcagcgcctactgtcagacgactatgatcgaatcaagtgtcacgtggatgagcagagcagagatccacatgtcctggacttcctcaaaaagatccaggattaccaacagttctatggaaagtccctagagtctatctccacgaaggttatcgtaacacagaccacccggcctaaggaagacagcagtggggctagtggcgagatattgcagaataccaaacctcaccagatcactaagaagagcaagaaaaagtcttttctcaaagaggatcaaaacaaggcgcaacaaaatgacgatttgttgttcagcatcgaagaggaaatgaaaaataacctccactctggcatccgaaagctagaagactaccttacgtcttgcgcttccaactccgtcaagttcggcgttgagatgttgggccttattgcctgtttcaaggcttggaagaagcattgccgtggggaaggcaagattagcaaagatctgtccatagccgtccagatgatgaagcgcattcactcactcttagaaaggtacccggaaattcttgaggccgagcaccatcaatatatagctaaatgcttaaagtacttggggttcaacgatcttgcaaattcgttggatcccacccttattggcgacgacaagaacaagaagaaatattcaatcgacattggcccagccaggttccaactgcagtacatgggacactacctgatccgggacgagagaaaagaccgcgatccacgagtccaggacttcatccctaatgcttggcaacaagagcttctggatgtggtcgacaagaatgagtctgccgtcattgtcgcacctacatcttccggaaagacttatgctagctactactgcatggaaaaggtcctaagggaatcagatgtaggcgtggtcgtttatgtggcacccgctaagtctctggtgggccaagtggccgcaaccgtagaaaacaggtttacaaaaacactgccggcaggtagaactttgtgcggtgccttcacacgagattattgtcataacgttctgaactgccaggtgctgattacggtccccgagtgttttgaaatcctccttctggcaccccacagacagaaatgggtggagcggattagatacgtcatcttcgatgaggttcattacctggggagagaggtgggggctaagttttgggagctactgctggtgatcattcgatgtccattcttggtgctcagtgccaccatcaacaatccaaacctgctaaccaagtggcttcagtcagtgaaacaatattggaaacaggctgataaaatcatggaggagaagtgtatctcggagaagcaagccgacaagtgtctgaactttttacaggaccacagctataagaaccaaagttatgaggtgcgtttggtcctttacggggagcgttataatgacctcgaaaaacacatttgtagcgtgaagcacgacgatgtctacttcgatcattttcatccttgtgccgccctgaccaccgacattatcgagaaatatggctttcctccagatctgacactcacgccccaggaatccattcaactttatgatactatggcgcaggtttgggaaacctggccccgcgcccaggaactgtgcccagaggagtttatcctgttcaagaataagattgtaatcaaaaaattggatgccaggaaatacgaggagaatctgaaagccgagctgaccaattggatcaaaaatggtcaggtcaagaaggtgaagcgtgttcttaaaaacctaagtcctgacagcctgtcttcatccaaggacatggttaagatgtttccactgctggttgaaaagctcaggcagatggataagctgccagccatctttttcctgtttaagaacgatgatgttggcaaacgggccggctccgtatgtactttcttagaaaaaacggagacaaagtcgcacccccatacagagtgtcactcatatgtgttcgcgattgacgaagtcctggagaaagtgcggaaaacccagaaacgcataacaaaaaagaatcccaagaaggccgaaaagctggaaagaaagaaagtctatagggcagagtatatcaacttcctggagaatctgaaaatcctggagatttcagaggattgcacatatgccgacgtgaaggctctccacacggagatcactcggaataaggatagcactctggagagggtgctcccacgcgtccggttcacgagacacggcaaagaactcaaagccctggcgcaaagggggatcggctatcaccacagcagcatgtacttcaaggagaaagaattcgtggagatcctattcgtgaaaggactcattcgagtcgtgacggccaccgaaacactcgcgctgggcatccatatgccctgtaagtccgtggtattcgcccaggattccgtgtacttagatgcgctgaattaccggcagatgtcaggaagggccgggcgtcgcggacaagatttactcgggaatgtgtatttctttgacattccgttacctaagataaaacgcctcctcgcctcgagtgtgccagaactgcgtggacagttcccgctttccataaccctggtcctgaggctgatgctcctggcctccaagggtgacgatcctgaagacgctaaagctaaagtgctaagcgttctcaaacactcgctcctcagcttcaaacgacgtcgggcaatggagactctgaagctgtattttctgttctcgctgcagctgttgatcaaggaggattatctaaacaagaagggcaatccgaagaaatttgccggcctcgcatcttacctgcacggacacgaacccagcaatctcgttttcgtaaactttcttaaacgaggactgtttcataatctgtgtaagcccgcttggaaaggcagtcagcagttctctcaggacgtcatggaaaagcttgtcctggtgctggctaacctatttggcaggaaatatatcccggcgaagtttcagaatgctaaccttagtttctcccagtccaaagtgattctggccgagttgcccgaggacttcaaggcagctctctacgagtataaccttgccgtgatgaaagatttcgccagcttcttattgatcgctagcaaatctgtgaatatgaaaaaggaacaccagctgccgctttccagaattaagttcaccggcaaagaatgcgaggattcccagctcgtatcacacttgatgtcatgtaagaaggggcgagtggcgatctcacctttcgtctgcttatccgggaacactgacaatgatctgttgagacctgaaactatcaatcaggtaattctgcgcacagtcggcgtcagcggaactcaggctccactgctatggccttggaagttggacaaccgaggcaggagaatgcccttgaacgcatacgtgcttaatttctacaaacacaattgcttgacacggttagatcagaagaatggcatgaggatgggacagctcttgaaatgtctaaaggacttcgcttttaacattcaggccattagcgacagtctcagcgagttatgtgagaataaaagagataatgtcgtgctcgctttcaaacagttgtcacagaccttttatgaaaagctgcaggaaatgcagatacagatgagtcagaaccacctcgagtag

SEQ ID NO: 29186 - DNA, 234 bp, Artificial Sequence
  Description of Artificial Sequence: Synthetic coding sequence
atgggctcaaaagaccacgcagtattctttagggagatgacccagttgatcttaaacgagatgcctaaagccggctactcttccatcctgaacgactttgtggaaagtaacttctttgttatcgatggggattcattgctggttacctgcttgggcgtaaaatcattcaagtggggccaaaatctccactttttctatctcgtggaatgttaccttgtcgatctcctgtcttag

SEQ ID NO: 29187 - DNA, 297 bp, Artificial Sequence
  Description of Artificial Sequence: Synthetic coding sequence
atgggctccaaagaccacgccgttttctttagggagatgacccagctgatcctgaacgaaatgcctaaggccggttatagtagtatcctgaacgactttgttgagtccaatttttttgtgattgatggcgactctttactggtgacctgcttgggggtcaagagcttcaaatggggccagaacctccactttttttatctggtagagtgctatctcgtggaccttctgtcaaacggtggtcagttcactattgtctttttcaaggacgctgaatacgcatacttcgacttcccctag

SEQ ID NO: 29188 - DNA, 2586 bp, Artificial Sequence
  Description of Artificial Sequence: Synthetic coding sequence
atgcctatactcttgtttctgattgatacatccgcaagcatgaaccagcgcaccgatctgggtacctcttacctcgacatcgcgaagggggccgtggagctctttctaaagctgcgcgcccgcgatcctgcttcaaggggggatcgttatatgcttgtgacttacgatgagcctccatattgcattaaagcgggttggaaagaaaatcacgcaacatttatgagtgagctgaagaatctacaggcttctgggttgaccacactaggtcaggccctgaggagctcattcgatttgcttaacctgaaccggctcattagcggcatagacaactacggacaaggacgaaaccccttcttcttggagccctcaatcctcatcactatcaccgacggaaacaagctgaccagcacagccggcgttcaggaggaactccatctccccctaaatagtccattgccggggtctgaactgacgaaagagcccttcagatgggaccagagattgttcgcactcgtccttaggctccccggcgttgcctcgaccgagccagagcagttaggcagcgttcccacggatgagagcgctattacccagatgtgtgaggtcaccggaggacgctcatactgtgtcagaacccaaagaatgctcaatcagtgcttagaatccctggtgcaaaaagtgcagagtggcgtagtaataaattttgaaaagaccggccctgaccccctacccattggggaggatgggcttatggactccagccggccaagcaactcgttcgcagcacagccctggcactcatgccataagctgatttatgtccggccaaattcaaaaacaggagtccccgtcggccattggcccataccagagtcattctggcccgatcaaaatttgcccagcttgcctcctcggacttctcatccagtggtcagatttagctgcgtcgactgcgagcctatggtcattgacaaactgccttttgataagtacgagcttgagccttcccccttaactcagtatatacttgagagaaagtccccgcacacttgctggcaggttttcgtaactagctctgggaaatataacgagctaggataccccttcggttatcttaaagcaagcacgaccctaacgtgtgtgaacttgtttgtcatgccttacaattacccggtgctcctgccccttctggatgatttatttaaagtacataagttgaagcctaatctcaaatggaggcaagcgtttgatagctatctgaaaaccctgccgccctactacctgttgacgaagcttgagtctgaacgcattctcgccagcgtgggaaaaaaaccaccccaggagataggtatcaaagtgaagaatcacagtggaggggggatgagcttgacccacaataagaacttcagaaagctattgaaagagatcacaggcgagacagcccttcggttgactgagttgaacaccaaagagttcgctggctttcagattggcctgctgaataaagaccttaagcctcaaacctacaggaacgcttacgacatccctaggagaggactgcttgaccagctcactcggatgcgatctaacctgctgaaaacacacaagttcatcgtggggcaggacgaggatagtctgcacagtgtgccagtggcccagatggggaattaccaagaatatctaaagaccctggcttcccccttaagggagatagaccccgaccagcccaaaaggctccacacgtttgggaacccatttaagcaggataagaagggtatgatgatagacgaagcagatgaattcgtcgccgggcctcaaaacaaggttaagcgcccgggagaacccaactcccctatgtcttcgaaacggaggcggagcatgagcttgctgttgagaaagccacaaacacccccaaccgtgacgaaccatgtgggtggcaagggtcctcccagcgcgagctggtttccatcataccctaatctgatcaaaccaacactggtacatacagacgccaccataatccacgacggccacgaagaaaagatggagaacggccaaataacccccgacgggtttttaagcaagtcggctcctagcgagctgattaacatgacaggggatctcatgcctcccaatcaggtggacagcttgtcggatgacttcacatcacttagtaaggacggcttgatacaaaagcccgggtctaacgcatttgtaggaggcgctaagaactgttctctgagtgtcgacgatcagaaagacccagttgcgagcacactgggagctatgcccaacaccctgcagatcactccagccatggcacagggcattaacgcggacatcaagcatcaattgatgaaggaagtgagaaagttcggccgcaaatacgaaaggatattcatactgctggaagaggtacagggaccactggagatgaaaaagcaatttgtggagtttactatcaaggaagctgcgcgtttcaagcgccgggtgctgatacagtacctcgagaaggtccttgagaaaatcaacagccaccacttacataacaatattagtcatataaattctcgtagcagttgctag

SEQ ID NO: 29189 - DNA, 4161 bp, Artificial Sequence
  Description of Artificial Sequence: Synthetic coding sequence
atgagctcaagcgtcaggcgaaaaggaaagcctggcaaaggtggtggcaaggggtcatccagaggaggccggggtggtaggtcacatgcctcaaagagccacggcagcggaggcggtggagggggcggagggggcggaggcggagggaacagaaaggcaagctcccgaatctgggatgacggggatgacttttgtattttctccgaaagcagacggccatctcgcccaagcaattccaatattagcaaaggagaatctcgacctaaatggaagcctaaggccaaggtccccttgcagactttgcacatgacatccgaaaaccaggaaaaagtaaaagctctcctgcgcgacttgcaggagcaggatgctgacgccgggagcgagcgcggcctatcgggtgaggaagaagacgacgagcccgattgctgcaatgatgaacgatactggccagcgggacaagagccatcactcgtaccagatctcgatccgctggagtacgcgggtctagcatctgtggaaccttacgttccagagttcacggtttcgcccttcgctgtacaaaaactatcacgctacggcttcaataccgagagatgccaagcagttctgcgtatgtgcgatggcgatgtcggcgcttccctggaacaccttttgacacagtgcttcagcgaaaccttcggcgaaagaatgaagatctcagaggcagtgaatcaaatcagcctagacgagtgcatggaacagagacaggaagaggcctttgctttgaagtccatttgtggagagaaattcatcgaaagaattcagaatcgcgtttggacaatcgggcttgaacttgaatacctcacttcacgcttccggaagtctaaacctaaggagtctacaaaaaacgtgcaggagaactctctggagatttgcaaattctatctcaaagggaattgtaaatttggcagtaaatgccgcttcaaacatgaggtgccgcctaatcagatcgttggccgcatcgagcggtctgtagatgactcccatctgaacgccatcgaggatgcaagctttctgtacgagctggaaatcaggttttctaaagaccacaaatatccataccaggcgccactggttgcgttctactccacgaacgaaaatctacccctggcctgccggctgcacatctctgagtttttgtatgacaaagctctgaccttcgctgagacttctgagccagtcgtttacagcttgattactttattggaggaggaatccgaaatcgtcaagctgctgaccaatactcaccataaatatagtgacccgcccgttaatttcctaccagtaccttcccgaacccgaatcaacaatcccgcctgccacaaaacagttatccctaacaactccttcgtctcgaatcagattccagaggtcgaaaaagcctccgagagtgaagagtctgacgaagacgatggacccgcgcctgtgatcgtggagaacgagagttatgtcaacctcaaaaaaaaaatctctaaacggtacgattggcaggctaaatccgtccacgcggaaaatgggaagatatgcaagcagttccgtatgaaacaggcctccagacagtttcagtcaatcttacaggagcggcaatctttacctgcttgggaggagagggaaactatcctgaacctgctgcgaaagcatcaagtcgttgtgatatccggcatgaccggatgtggtaagaccacacagatcccccagttcatcctcgatgacagccttaacggccctccagagaaggtcgccaacatcatctgtacacagcctaggcggatttccgccatttctgtggctgagcgggtggccaaggagcgggcagagagagtggggttgactgtgggatatcagatacgcctggagtccgtaaaatcctccgctacccgcttattgtactgcactactggggttctcctgcgacgtctagaaggtgacactgcattacagggggtttcccacataattgttgacgaagtacacgagagaactgaggagagcgacttcctgctcctagttctcaaggatatcgtgtctcagaggcccggactacaagttattttgatgagcgcaacccttaacgccgaactcttttccgattatttcaatagctgccccgtgataacaataccagggaggacatttcctgtggaccagttcttcctggaggatgccatcgcagtcacaagatatgtcttacaggatggctccccctacatgcggagtatgaagcaaatcagtaaagaaaagctgaaggcgcgaagaaatcgcactgcattcgaggaagtcgaagaggatcttcgactcagcctccatctccaggaccaggattcggtaaaagatgccgtgcccgatcagcaattggatttcaagcagctgttggcacgatataagggagtgagcaaatccgtgattaaaacaatgagcattatggatttcgagaaagtaaacctggagctgattgaagcccttttagaatggatcgtggacggaaaacactcctaccctccgggtgctattttggtttttctgcctggcctcgcggaaataaaaatgctgtacgagcaactccagtctaacagcttgtttaataatcgtcggtccaataggtgcgtgatccatccactgcatagctctttgagctcagaagaacaacaggccgtgtttgtgaagcctcctgccggcgttacgaaaattatcataagcaccaatattgcggagacatccataacaattgatgatgttgtctacgtgattgacagcgggaagatgaaggagaaacgctacgacgcgagtaaaggaatggagtcgctcgaagataccttcgtgagccaggccaatgcgctacagaggaagggccgggccggcagagtggctagtggagtatgcttccatttgttcacctcccaccattataaccaccagctcttaaaacagcagctgcctgagatccaacgtgtgccactggagcagttgtgtctccgaataaagattcttgagatgtttagcgcccacaatttacagtcagtcttctcgagactgattgagccgccccacacagactccttacgcgcttccaaaattaggctacgcgatctaggggcccttactccagacgagcggcttacacctttgggataccacctggccagtctgcccgtcgacgtcaggattggcaagctcatgctcttcggaagtatctttaggtgtttggacccagccctgacaatagctgcctcgttggccttcaagtccccgttcgtctccccttgggacaagaaggaggaggctaaccagaaaaagctagagtttgcttttgcaaattccgactatctggctctgttacaggcctacaagggctggcagctgtccacaaaggagggggtgagagcttcctataattactgccgtcaaaattttctttctggacgagttttgcaggagatggcttctttaaaacggcagttcactgaattactctcagacattgggttcgcccgcgaaggcctgcgggcaagggaaatcgaaaagagagctcagggcggcgatggagtgctggatgctactggagaagaggcgaactccaacgccgagaacccgaagcttatatctgcgatgctttgtgccgcactatatcccaatgtcgtgcaagtgaagagtccagagggaaaattccagaagacgagtaccggtgcagtgaggatgcaaccaaagtccgccgaactaaaatttgtgactaaaaatgatggatacgtccacattcatccttctagcgtgaactaccaggtgcgtcactttgatagcccttatcttttgtaccacgaaaagatcaagactagcagagttttcataagggactgcagcatggtcagcgtttaccctctcgtgctctttgggggaggccaggttaacgtgcaattgcagcggggagagttcgttgtgagtttagacgatggctggatcaggtttgtcgccgcctctcaccaagtggctgagctggtgaaggaacttcggtgcgaattagatcagctcctgcaggacaagatcaagaatccatctattgatctttgcacctgtccccgggggtcaaggattatctccaccatagtgaaattggtgacaacgcagtag

SEQ ID NO: 29190 - DNA, 1302 bp, Artificial Sequence
  Description of Artificial Sequence: Synthetic coding sequence
atgacgtcagagaatcaggagaaagtgaaagcactacttcgggatttgcaggaacaagatgcagatgctggctcagagaggggcctgtcgggcgaggaagaagacgatgagccagattgctgcaatgacgagaggtactggcccgccggccaggagccatccctcgttcctgatctcgacccgcttgaatacgcgggactcgcgtcggtcgagccatatgtgccagaattcacagtatccccattcgccgtccagaagctatcgcgttatggctttaataccgaacgttgccaggccgtgctgaggatgtgcgatggcgacgtgggagctagcctagagcatctactaacccagtgtttctcagagacctttggcgagaggatgaagattagtgaagcggtaaaccaaatctcattggacgaatgtatggaacagcgccaggaggaagcttttgcgctcaaatccatctgcggagagaaatttattgaacggattcagaacagggtgtggacaatcggcctggagctggagtacctgacctcccggttccggaaatctaagcccaaggaatcaaccaaaaacgtacaggagaacagtctggaaatctgcaagttctatctgaaaggcaattgcaaattcggctctaaatgcaggtttaaacacgaggtacctccaaatcagatagtgggcaggatcgagcggtccgtggatgacagccacctaaacgccatcgaagacgcaagtttcttatacgaactggagatccgcttctctaaggatcacaagtatccgtaccaggctcccctggttgccttctacagtacaaatgagaatctgcctctggcatgcaggctgcacatcagcgaattcctgtatgataaagcactgacatttgccgaaacaagcgagcccgtcgtgtattcattaatcaccctgctcgaggaagaatcagagattgtgaagctgctgactaacacacatcacaagtattctgatccaccagtgaactttctgcctgtgccttcgagaacacggattaataaccccgcctgtcataaaacagtgatccctaacaatagcttcgtgagcaaccaaatccctgaagtagagaaggcctccgagtccgaggagagtgatgaggacgacggaccagcgcctgtgatcgtggaaaacgaatcatatgtgaaccttaagaagaaaatctctaaaaggtacgactggcaggctaagagcgtgcatgcggaaaatgggaaaatctgcaaacagtttcgcatgaagcagattctccagagccatctttag

SEQ ID NO: 29191 - DNA, 1731 bp, Artificial Sequence
  Description of Artificial Sequence: Synthetic coding sequence
atgcctccccctaggactcgcgaaggacgcgatcgaagagaccatcatagagcaccaagtgaagaggaggcactcgaaaagtgggattggaattgcccagaaaccagaagactgcttgaagatgccttcttcagagaagaggattacatccgacaagggtcagaagagtgccagaaattctggacattcttcgaacgactgcagaggttccagaatctgaagacctctagaaaggaggagaaagatcctggacagcctaaacattccatccctgctctggccgacctcccacgtacatatgacccccgttaccggatcaatctgagtgtgcttggacccgcaacccggggaagccaggggttggggagacacctgcctgcggagagggtggcggaattcagacgtgccctcttacactacttggattttgggcagaaacaggccttcggtcggctcgccaaactgcagcgggagagagctgccttgccaatagcccagtacggaaacagaatcctgcagaccctgaaagaacaccaggtagtggtagtggccggggacacgggttgtgggaaatcgacccaggtaccccagtatctgctagctgccggcttctcccacgtggcttgtacacaaccccgaagaatcgcttgtatctctctggcaaagcgtgtgggtttcgagagtcttagccagtatgggtctcaagttggctaccaaatacggttcgaatctacccgctcagcggccacaaagattgtgtttttgacggtaggactcctcctacgccagatccagcgagagcccagccttccacaatacgaggtcctgattgtcgacgaagtacacgaaaggcacctgcataacgactttttattgggggtattgcagaggctcctgccgacccgcccagacctgaaggttattttaatgtccgccacaattaacatcagcctgttttcatcatacttttccaatgccccagtggtgcaggtgcccggacgtttgtttcctattaccgtgttcgatgtggccccgccaggggtgcgcaagtgcatcctcagcaccaatattgctgagacatccgtgacaatcgacgggatcaggtttgtcgttgatagtggcaaggtgaaggagatgagctacgacccccaggcgaagctgcaacggttgcaagagttttggatttcccaggcatccgctgaacagcgaaagggccgagctggcaggactgggcccggagtatgctttagactgtacgctgagtcagactacgacgccttcgctccttaccccgttcccgagatccgtagggtggccctcgactctctggtacttcagatgaaatccatgtctgtcggagatcctcgaaccttccctttcatagagccgcccccgccagcctcactggaaacagcgattctgtatctgagagatcaaggcgccctggactcatccgaggccctgacacccatcggttccctgctggcacagctccccgtggatgttgtgatcggaaaaatgttaatcctgggatccatgttctccctagtggaaccagttctgacgatcgccgccgccctgtccgtgcaatcgcctttcaccaggagcgctcagtctagccctgaatgttgtacgccgcctgccagcagcctagccgctccacggtgttgtacgcaccggtcttggcggccggcaacagccactgaggcagaaaccacacggacgagatag

SEQ ID NO: 29192 - DNA, 3432 bp, Artificial Sequence
  Description of Artificial Sequence: Synthetic coding sequence
atgcccccaccaaggacacgggaggggagggatcgtagagaccatcacagggcaccttcagaggaagaagccttggaaaaatgggattggaattgcccggagactcggagactgttggaggacgcattttttcgggaagaggattatattaggcagggcagcgaggagtgccagaaattctggaccttctttgaaaggctccagagattccagaatcttaaaacaagtcgtaaagaggagaaagacccaggccagcccaagcatagcatccccgctctggccgacttaccacgaacttacgacccccgataccgaattaacctgtctgttctaggccccgccaccagggggtcccaggggctcggcaggcacctgccagctgaacgtgtggctgaatttcgacgggctctgctgcattacctggactttggccagaagcaggcgtttggaagactcgccaagttgcaacgagagagagctgcattaccgatcgctcagtatgggaaccgcattttgcagactctgaaggagcaccaggtggtggtggtggctggagacactggatgtggaaaatctacacaggtgccgcagtacttgctagccgcaggtttcagccatgtcgcctgtacacaaccccgacgaatagcttgcatatcactggccaaacgcgtcgggttcgaaagcctctcgcagtacggcagtcaagttggttatcagatcaggttcgaatccactagaagtgcagccacaaagattgtcttcctcacagtcggattactccttcgccagatccagcgggagcccagcctgccacagtacgaagtactgatagtagacgaggtccacgagcggcacctccacaacgactttctgttgggagtgctccagaggctgctccctacacggcccgatctgaaggtgatcctaatgagcgccacaatcaatatctctctgttcagttcatatttttccaacgcccccgtggttcaggtaccaggaaggctttttcccattactgtcgtctatcagccgcaggaggccgagccaactaccagcaagtctgaaaaattagatccgaggcccttcctgagggtgctcgaaagcatcgaccacaaatacccacccgaggaaaggggggaccttctagtcttcctttccggtatggcggagatttcagctgttttagaagcagcacagacttatgcctcccatactcaaaggtgggtagtcctgcccttgcattcggcccttagtgttgccgaccaggacaaggtgtttgatgtggccccaccaggcgtacgcaaatgcattctcagtactaacattgcagaaacaagtgtgacgatcgatggtattaggttcgtagtagattctggcaaggtgaaagagatgtcatacgacccgcaggcaaagttgcagagactgcaggagttttggattagccaggcttcagccgagcagaggaaaggcagggcagggcgcaccggacccggagtgtgtttcagactttacgcagaaagtgactatgatgcattcgctccatacccagtcccggagataagacgggtggccttggattccctggtgttacagatgaagtctatgtcagtgggcgatccaagaaccttcccattcattgaacccccgccacctgcctctctggaaactgcaatcctataccttcgcgatcaaggcgccttagattcaagcgaggccctcactccaataggctcgttgctggcccaactgccggtggatgttgtgatcggtaaaatgttaatccttggatctatgttttccctggtagaacctgtgttgacaatagccgccgccctatcggtccagtcgcctttcacccggagcgcccagagtagtcctgaatgtgctgctgcacggaggccactcgaaagcgaccagggggatcctttcactctattcaatgtgtttaacgcatgggtgcaggtgaagtccgagagaagccggaacagtcggaaatggtgcaggagacgggggattgaagaacacagactgtacgaaatggcaaacctgcgacgccagtttaaggagttactcgaagaccacgggcttttagcaggtgcacaggccgcccaagtcggggacagctatagcaggttgcagcaacgcagagagagacgggccctacatcagctgaaaagacagcacgaggaaggggctggccgcaggaggaaagtcctgcggcttcaggaagaacaggatggagggtcttctgacgaagacagagctggccccgcaccgccgggagcatccgacggcgtagacatccaggacgtaaagttcaagctgaggcatgatctggcacagcttcaggccgcagcttcatccgcccaggacctatctcgcgagcaactcgcattacttaagctggtcttgggcagaggtctgtaccctcagttagccgtccctgacgcgttcaactcctcaagaaaggactctgatcaaatatttcatactcaagccaagcagggagccgtcttacatcccacctgtgttttcgccggctcccccgaggtcttgcacgcccaggaactcgaggcgtctaactgtgacggcagtcgagacgataaagataaaatgtcgtctaagcaccagctgctgtcctttgtctctttactagagacaaataaaccatacttggttaactgtgtgaggatcccagccctccaatccttactcctgttttctcgcagccttgacaccaacggagactgcagcaggctggtggcagacggctggttagagctccagcttgcggacagcgaatccgccattcgtctgcttgccgcgagcctgcggcttagagcgcgctgggaatcggctttagatcggcaactggcccaccaggcccagcaacagctggaggaggaggaggaagatacccctgtgtcccccaaggaagtggccaccctctctaaagagctgctgcaatttaccgcgagcaagataccatattccctgcggagactgacaggactagaggtccagaacatgtatgtcggtcctcagactatcccagctacaccacacctgcctggcctctttggatccagtaccctgagcccgcaccctacaaaggggggctacgccgttacagattttctgacgtataattgcctgacaaatgatacagatctatacagcgactgtttaaggacgttctggacctgcccacattgtggactacatgcccctctgacaccactggagaggatcgcacatgaaaatacctgcccacaggcgccacaggacggacctccgggcgcagaggaggccgccctggaaacactccagaagacatctgtcctccagaggccgtatcattgcgaagcttgcggcaaagactttctttttactccgactgaagttctcagacaccggaaacaacacgtgtag

SEQ ID NO: 29193 - DNA, 3474 bp, Artificial Sequence
  Description of Artificial Sequence: Synthetic coding sequence
atgggaaaactccggcgtaggtataacattaaaggccggcagcaggccggtccaggtccctcaaaagggccacccgaaccccctcccgtgcagctggaattggaggacaaggacaccttgaaaggcgtcgacgccagtaatgccctcgtgctcccggggaaaaagaaaaagaagactaaagcaccacctctgagcaagaaggaaaagaaaccgctaacgaaaaaagaaaaaaaggtgctgcagaaaattttggagcagaaggaaaaaaagtcccagagagcagaaatgctccagaaactgtccgaagtgcaggcctccgaggcagagatgaggctgttctacactacatctaaacttggtacgggcaacagaatgtatcatactaaagagaaggctgatgaggtggtggcacccgggcaagaaaagatctcctccttgtctggtgctcacagaaagaggcggaggtggcctagcgctgaagaggaagaagaggaggaggaggagtcagaaagcgagcttgaggaagaatccgagcttgatgaggaccccgccgccgagccagccgaagcaggcgttgggactacagtggcccccctgcctccagccccagcccctagcagccagccagtaccagctggcatgacagtgccgccacctcccgcggcagcaccaccactgccacgggccctggccaaacctgctgtgtttatccccgtgaataggagcccagagatgcaagaagagcgcctgaagttgcctattctttcagaggagcaggtcatcatggaagcagtggcagaacatcctattgtcattgtgtgcggtgaaacagggagcggaaagactacccaagtcccacagtttctgtatgaggccggcttcagctccgaagattctatcataggagtgaccgagcctcggcgcgtggcagccgtcgcaatgagccagcgggtggccaaagaaatgaacttgtcccaaagggtcgtgtcctaccaaatccgatacgaaggtaatgtgacagaggagacccgcatcaaatttatgaccgatggagtgcttttgaaggagatccagaaagactttctcctcctgagatataaggttgtgattatcgacgaggcccatgaaagatcagtatacaccgatatcctgattggcctgctatctaggatcgtgacactgagggctaaaagaaacctcccactcaagctgctgatcatgtccgcaacacttcgggtggaagatttcacacagaatcctcgattatttgccaagcccccgcctgtcatcaaagtggaatccagacagttccccgtcacagtgcatttcaataagcgcacgcccctggaagactattccggagagtgttttagaaaagtgtgcaagatccaccgtatgctcccagctggtgggatcctcgtgtttctcaccggtcaggccgaagtgcacgccctttgccgccgcctacgcaaggcctttccaccttctcgggcgcgccctcaggaaaaggacgatgatcagaaagactcagtggaagaaatgaggaaattcaaaaagagccgggcgcgtgcgaagaaggcccgcgctgaagtcctccctcaaatcaacctggatcattacagtgtcctcccggcgggagaaggcgacgaggaccgggaagccgaagtcgacgaggaggagggggctttggactcagatctcgatttggatttaggggacggaggacaagatgggggcgagcagcctgatgccagtctgccattgcacgttttacccctgtacagcctcctggctccagagaaacaggcccaagttttcaagccacctccggaaggcacgcgcctctgtgttgtcgcaacaaacgtggctgagaccagtctcacgattcctggcattaagtacgtcgttgactgcgggaaggttaaaaaaagatattatgatcgagtgaccggggtcagctctttccgtgttacctgggtgtcccaggcgagtgccgaccaacgcgccggcagagctggaaggacagagcctggacactgctaccgactctattcttctgctgtgtttggtgactttgagcagtttcccccgcctgaaattacccggcggcctgttgaagacctgattttacagatgaaagccctcaatgtagagaaagtgataaacttccccttcccaacccctccctctgtcgaagctttgctggctgctgaggagctacttattgccctgggcgctttgcaacccccacagaaagctgaacgcgtaaaacagttgcaggagaatagactcagttgtcctataacagctctggggcgaaccatggcgacattccccgttgctcccaggtacgccaagatgctcgcactttcacggcagcatggatgtctcccatacgccatcacaatagtcgctagcatgacagtcagagagttattcgaggaactggaccgtcccgcagcatccgacgaagagctgactaggctgaaatctaagcgagcaagagtagcccagatgaagcggacatgggcgggccagggggctagcctcaagctcggggacctaatggtacttcttggggccgtcggggcatgtgagtacgccagctgcaccccacagttttgcgaggcaaacggactgagatacaaagctatgatggagatcaggcggctgagaggtcagctcactacggcagtgaacgctgtgtgcccagaagcggaactttttgtggacccgaagatgcagccacctaccgagtctcaggtgacatacctgagacagatcgtgacagccgggctgggtgatcacttagctcggagagtccagtcggaggagatgctggaggacaagtggaggaacgcttacaaaaccccacttctggacgatcccgtttttatccacccatctagcgtcctgtttaaggaactgcctgaattcgtggtgtaccaagaaatcgtagagaccaccaagatgtacatgaagggcgtaagttcagtagaagtacagtggattcctgctctgctgccctcatattgccagttcgacaaacccttggaagaacccgcccccacctattgcccggagcgtgggcgggtcctatgtcatcgcgcatcagtgttctaccgcgttggatggccacttcccgcaatcgaggttgacttccctgagggcatcgaccgttataaacacttcgcacgatttttactcgagggccaagtcttcaggaagctggccagctaccgatcctgccttttgagtagccccggcacaatgctcaagacatgggccagattgcagcctcggaccgagagtctgctcagggccctagtggctgagaaggcggactgccacgaagcattactcgccgcgtggaagaagaatcctaagtacctactggccgagtattgtgaatggctgccccaggccatgcaccccgatatagagaaggcttggcctcccacaaccgtgcactag

SEQ ID NO: 29194 - DNA, 1851 bp, Artificial Sequence
  Description of Artificial Sequence: Synthetic coding sequence
atgtgtttagaaaagaggtatctggacgttctcagcgatgttacggggccacaggtttcatgctatatcactgctccatcgtatgtgctgcagcagctagagtgccgtataatcaaccacatgtcttccctcatcgtcggcgataatgaggaacttgtgtctaacgtcattaccattgaatgtagtgataaagagaagagagttcctttcccgattggaatagcaatccccttcactgctaggtatcgtggaaactacagagacatcatggtgaaagtctgtgacatcaaccttcagtcgagctatctcaaccccaatagcttggagggaatgaagggggggtataagggcacatgtgcctccgtaaaggtgtacaaactcggcatttttagtgttgtgtcctgcctcaagaaagaatctttcactgtgactaagaaagggctggccttgaagtcaagcatggattccaggatttcactgaactaccccccaggggtcttcacaagcccggtcctggtccaactcaagatccagcctgttgacccagcactggtggcccacctgaaggctcagcaggacacgttctatagcgtgcaaagtacctctccattaattcacatacagcacccatccacgtacccttttcaaaagcctgtcaccctgtttctcccttgttcgccataccttgataagaataatctgggaagcgaaatagaccacaaaaggcgggcctcagccacaattaatcgaatcacacctagttacttcaaccgaaccaaaattgcgtctattaggaagcccaggaagaatgctagcgagtgtctgaagttactgggatttcgcagtcaggattccggctggtgcggcttggatgacgtcgtgaagaccattcagagcggtttggttagtgttgagctgtacgagcacctggaacgattcatcgtcttgcatctgagttcaactatggataattcgcatttggtcacattcgtcaagtctctggaagaagctatgcttagcaccacagcttgcatcgttctgagccaccagaaggacaatccacaccgcatagcggtcttagtagtgccctcgaaggatctgtctcaggtgctgaaagatttgcacctggagggtttcggcggcccccctgagccatctcggcactttcaggtacgggagggagaacagctgctactgagatttaccgggaatattttcgcatcctcgaatggtaaggactatggcaaagattatactcttattttccacctccagaggaaacccaggctggaactccagattaaggaggtagacgaatttggaaactactcctgcccccattataaagggaccatagtggtatataaagtgcccaagggcaaaatcgtgcccaacctcaatcaaagcctcgttattaatgagaatcactcccaacttccgatttgcaaattaccgctaaagcttccaaaacacaagaagctgattaatcgccctcagtcaaccaagagggtgtccaaagatccagttgaggctctgtgggacaatcttctccactggctcgccgaagagctgtcagaggagaacgccgagtctttgtcctccactcttccccttcgaaggagtaccattcagttgataaagctgaaaaatccagacgaccttactgagcaaatccacgagttcctgtgcttctggaaaaagagccttccgacttttaccgataaactgcgactgctggcccgccatctgcgaaagatcggacgcagcgacctcgccgaggagctgaagtttaagtgggagaacaaggtctttactgagccccagcagtgtttcgacgtcgcccccgagtag

SEQ ID NO: 29195 - DNA, 2346 bp, Artificial Sequence
  Description of Artificial Sequence: Synthetic coding sequence
atgcacgacgaatgcacccctcaacagacaatgtcttctattcaggacaccaaagccgccgatatcgctgccaggggagaattgaatgtaatcgagacagccaccgtgtctcctactaacggcgaagaaagtcactatacaaatcaggtgcaactcgagaaaaacaaaacccatatgtccagcgcacttgtggagaaggagaacaacaccagccttaacggaagggtcctggggcaggaagagtcccaaaataagatgttccctgacaatgccgagaatgaagacgataaacagatcgaacatatgacggtcgagaatattaatggtaatagggaagaaactcacggcataattcagactacagagactgagattcaggaaacctccgagtccccacgggaagaaatgaccacatcctctattatttgcgacatatcgaaaaaatatatcaacagcacacttcccaacgactcagagaacatcaagcacaagaacaacatcatggaaaaggagtacctagacgtgctatccgatgtgaccggcccccaggtatcatgctacataaccgctcctagctacgtgttgcaacaattggaatgccgtattatcaaccatatgtcctccctgattgttggcgacaatgaggaattagtttcaaacgtcatcacaattgagtgtagcgacaaagaaaagagggttccgtttccgattggcattgcaatcccttttacagcccggtataggggtaattatagggatattatggtgaaagtgtgtgatatcaatcttcagtcctcatatctgaaccccaattctctcgaaggcatgaaaggcgggtataagggaacttgcgccagcgtgaaggtttacaaactcgggattttcagcgtggtctcctgtctgaagaaggagtctttcacagtaactaagaaggggctcgcattgaaatcctctatggattcacgcataagtttaaattatcccccaggagtgtttacctcccctgtgctggtgcagctcaagattcagcctgtcgatcccgcactcgtggctcacttgaaggcccaacaggacactttctattcagtgcaaagtactagccccctaatccacatccagcatccttctacgtacccattccagaaacccgttaccttgtttctgccgtgctcaccctatcttgacaagaacaatctgggttccgagatagaccacaaacggagagcctcagccactatcaataggataacccccagttacttcaacagaactaagattgcatcaataaggaagcctcgtaaaaatgccagcgaatgcctgaaactcctgggattccggtcccaagactccggctggtgcggactagatgatgtcgtcaaaactatccagtccggcctggtttctgtggaattatatgagcacctcgagaggtttatagtactccacctgagctccacgatggataactctcacctggttactttcgttaaatcactggaagaggctatgctttcgaccaccgcatgtattgtacttagccatcagaaggacaaccctcataggattgctgtactggtcgtgccttcaaaagacctttcacaggtgctgaaagatctgcatctggaaggatttggcgggccccctgaaccatcccggcattttcaagttcgtgagggagagcagctgctgctccgtttcacgggaaacattttcgcaagcagcaacggtaaagattacggcaaggactacaccctgatctttcatcttcagcgcaagcctaggttggaactgcagatcaaggaggtcgacgaatttgggaactacagctgcccacactataagggcaccattgtcgtctataaggtaccaaaggggaagatcgttcccaacttgaaccagtctctcgttatcaatgaaaaccactcccagcttcctatatgcaaactgccactaaagctacccaagcataagaagctgatcaacaggcctcaaagcacgaagagagtgagcaaagatccagtggaagcactctgggataatctcctccactggcttgccgaggaactgagcgaggagaatgccgaaagtctgtccagcaccctgcctctgaggcgatccaccatacagttaattaaactcaagaatcctgatgatcttaccgagcaaattcacgagtttctctgcttttggaagaaatctcttcccacatttacagacaagcttcgtcttctggcccgacacctgcgaaagataggccgcagcgatctggcagaggaattaaaatttaagtgggagaataaagtgttcaccgagcctcagcaatgtttcgatgtggctccggaatag

SEQ ID NO: 29196 - DNA, 6390 bp, Artificial Sequence
  Description of Artificial Sequence: Synthetic coding sequence
atggccgaacggcgggcgttcgcccagaaaatttctaggacagtcgctgcagaagtgaggaagcaaataagcggccagtattctgggtccccacaactgttgaagaacctaaacatcgtgggaaacatctcacaccataccaccgtaccactaaccgaagccgtggatccggtcgacctggaagactacctgatcactcacccgttggcggtagactccggacccctgcgggatttaatcgaatttcccccggacgatattgaagtggtctactccccaagagattgcaggactctggtctccgcagtgcctgaggagagtgagatggatccccatgtgcgtgattgtattcgtagctatacagaagactgggctatcgtgatcagaaaataccacaaacttggtacaggcttcaacccgaatacactggacaaacagaaggagaggcagaagggcctgccaaaacaagtgtttgaaagtgacgaagctcctgatggaaactcctaccaggatgatcaagatgatctcaagcgccgttccatgagcattgatgatacacctagagggtcatgggcttgctccatttttgatttgaagaattccttacccgatgccctgctgccaaacctactagatagaacccccaacgaggagatcgataggcagaacgacgatcagcggaagtcgaacagacataaagagctttttgccctgcatccttccccagatgaggaagagcccatcgaacgcctctcagttcctgatatccctaaggaacacttcggacaacggttgcttgtgaagtgcctcagcctcaagttcgagatcgaaatcgagcctattttcgcatcattagcactatacgacgtgaaagagaagaaaaaaatttccgagaacttctacttcgatcttaacagcgagcaaatgaagggtctgcttagaccacacgtgccccctgcagctatcacgacgctggctcgttccgctattttctctatcacatacccttctcaagatgttttcttggtcatcaaactggaaaaggtgcttcagcagggtgatatcggcgaatgtgcagaaccttacatgatttttaaagaagcggacgctacaaagaacaaggaaaagcttgaaaagcttaaatcccaagccgaccagttctgtcagaggctcggcaaatatcgcatgccgtttgcctggacagccattcatctcatgaacatcgtgagttctgctggttccttggagcgcgattccaccgaagtcgaaatttcaactggagagcggaagggcagttggtccgaaagacgcaacagcagtatcgttgggaggaggagcctagagcgaaccacttctggagacgacgcgtgcaaccttacctcattcagaccagcaacgttgacggtgacgaatttttttaagcaagaaggcgaccgcctctccgacgaggatctgtataaatttctcgctgatatgaggaggcccagttcagtcctacgtcgacttcgtcctatcactgcacagctcaagatcgatatctccccagccccagaaaacccacactactgcctcaccccagaattgctccaggtgaagctctacccggattcgcgtgtcaggcctacacgagaaattctggaattcccagccagagacgtttacgtccctaacactacctacaggaacctgctgtacatctacccccagtccctcaacttcgccaacagacaaggtagcgccagaaatattactgtgaaggtacagtttatgtacggagaggacccttccaatgccatgcctgtgatcttcggaaagtccagctgcagcgagttcagtaaagaggcatacacagctgtggtttaccacaatcgctcacctgacttccatgaagagatcaaagtcaagcttccagcaacactgactgaccatcaccatctcttgttcacattttaccatgtaagttgtcaacagaagcaaaatacccctctggagaccccagtggggtatacttggattcccatgctccagaacggcaggctgaagaccggccagttctgcttaccagttagtctcgagaaaccacctcaagcatactctgtgctatcacctgaggtgcctctgccagggatgaagtgggttgataaccacaagggggtgttcaatgtggaggttgtagccgtgtcaagtatccacacgcaggatccctacctagacaaattcttcgctctggtgaacgctctagacgagcacctctttcccgtccggatcggggacatgagaataatggagaacaatctggaaaatgagctgaaatctagcatctctgctctaaattcaagccaattggagccagtggtccgtttcctgcatcttctgttggataagttgattctgctggtgattcggcctcccgtgatcgccggccagatcgttaatttagggcaggctagctttgaagcaatggctagcattatcaatcggctgcacaagaacctggaggggaatcatgaccagcacggcagaaactccctgctggcatcctacattcactacgtttttaggctcccgaacacataccctaattcctcctcccccggtcctggaggactgggcggatcagtgcattatgcgacgatggcgagatccgcagtgagaccagcctctttaaacttgaacaggtccaggtccttgtcgaacagtaaccccgatatctccggcacacctacctcccctgatgatgaagttcgcagcataattggttcaaaaggtttggatagatcgaattcttgggttaataccggcggcccaaaggcagcaccttggggttctaatccaagcccgtcagcagagtccactcaggcaatggaccgctcctgcaaccgcatgagctcccatacggagacgtcatcttttctgcaaactttgactgggagactccctaccaagaagttgtttcatgaagaattagccctgcaatgggtcgtttgttctggcagtgtccgcgaatccgcactgcagcaggcctggttctttttcgaacttatggtcaagagtatggtacatcacttgtactttaacgacaaactcgaagccccccgaaagagccggttcccggagaggttcatggatgacattgccgccctggtatccacaattgcttccgacatagtatcgaggttccaaaaggacacggaaatggttgagagactgaacactagtctggctttctttttgaatgacttactgtctgtgatggaccgcgggtttgtgttctctctcattaagagctgctataaacaagtgtccagcaaattatatagcctaccaaatccatccgtgctggtctccctgcggctggatttcctgcgcattatttgtagccacgaacactacgtgactctgaacttaccctgctctctgctgactccaccggcatccccaagtccaagtgtgtcttccgccacaagtcagagcagcggctttagtaccaatgtgcaggaccagaagatagctaatatgttcgagctctcagtgccatttcgtcagcagcactacttggctggcttagtcctgacagagctggcagtaatcctcgacccagacgctgagggtctcttcggccttcacaagaaggtgatcaacatggttcacaatttgctttccagccacgatagtgatccgcgctactctgacccccagattaaggcgagagtcgccatgttgtatctcccacttataggaataataatggaaacggtgccacagctctacgatttcaccgaaacccacaatcaaagagggaggcctatttgcatcgctactgatgactacgaaagtgagtcaggctctatgattagtcagacggttgcaatggcaatcgccggcaccagcgtgcctcagttgactcgtcccgggtcctttttgttaacatccacatcagggcggcagcatactacattttcggcggagagctctaggagcctgctgatttgccttctgtgggttctgaagaatgccgatgaaactgtactgcagaagtggttcactgacctgagtgtcctgcagctgaatagactactggatctcctttatctgtgtgttagctgctttgagtataaggggaaaaaagtgttcgagcggatgaactccctgacatttaaaaagtccaaagacatgagagcaaagttggaggaagctattctcgggtccatcggagcccgtcaggagatggtgcgaagatctcggggacaattggagcgttcaccgtcaggaagcgcctttggctcccaggagaaccttaggtggcgcaaggacatgacacattggaggcagaacaccgaaaagctcgataagtccagggctgaaatcgagcacgaagcactgatcgacgggaatctagccacagaggccaacctcatcatcttggacaccctggaaattgtggtccagaccgttagcgtgacagagtccaaagagagtatacttggcggcgtgctcaaagtgctgctgcattccatggcctgcaatcagtccgcggtctacctgcagcattgcttcgccacgcagagagccctggtgagtaaattcccagagctactgttcgaggaggaaacagaacaatgcgcagacctctgtcttaggctactaaggcactgtagcagttctatcggtactatcagatcacacgcctctgcctctctgtacctgttaatgcgacaaaatttcgagatcggcaataactttgccagggtgaaaatgcaagtcacgatgtctttatcctcacttgtgggcacatctcagaactttaacgaagaattcttgcgaagaagcctcaagacaattttaacctacgcggaagaagacctggagctgagggagacaacctttcctgaccaggtccaggatctggtcttcaatctgcacatgatcctgtctgacaccgtgaagatgaaggagcaccaggaagatcccgagatgctgatcgatctcatgtaccgcatcgccaaaggctatcagacgagccccgacctcagactcacgtggctccagaacatggctggtaagcacagcgagagatccaatcacgccgaggcagcgcagtgtctggtgcacagcgccgctctggtagcagagtatttgtctatgctggaagacagaaaatacctgcccgttgggtgtgtaacctttcaaaacatcagtagtaacgttttagaagagtctgctgtgtcggatgatgtagttagccccgatgaggagggtatctgtagcgggaaatacttcaccgagtctggcttagtgggactcctcgaacaagcggcagccagcttttccatggccggcatgtatgaggctgtgaatgaagtgtataaggtgctgataccaatccacgaggcaaaccgggacgcgaagaaactgtctactatccacgggaagctgcaggaggccttcagcaagatcgtacaccaggacggcaagcgcatgtttgggacctacttcagggtcggcttctatggcaccaaatttggcgacttagacgaacaggaattcgtttacaaagagcctgctatcaccaaactggctgaaatctcccaccgattagaggggttttatggcgagagattcggtgaggacgtggttgaggtgattaaggattccaacccagttgacaagtgcaagctggaccccaacaaagcctacatccagatcacatacgtggagccttacttcgacacctatgaaatgaaagacaggattacctacttcgacaagaactacaatctgcgaaggtttatgtactgtactccattcacgctcgacggcagagcccatggggagttacacgagcagtttaagcggaagacgattctgacaacatcacacgcatttccatacatcaaaacacgggtgaacgtgacccacaaggaggagatcattttgactcctatcgaggttgccatcgaggacatgcagaaaaagacacaggagctggcctttgcgactcaccaagaccctgctgatccaaagatgttacagatggtcttacagggttccgtgggcacaacagtgaatcagggtcctctggaggtcgcacaagtgtttctgtctgaaattccttccgaccctaaactgttcaggcaccataataaactgaggctgtgttttaaggatttcaccaaacgctgtgaagatgcgctgaggaagaataagtccctgattgggcccgatcagaaagagtaccagcgggaattggagcgcaactatcaccgtctgaaagaagcgcttcaacctcttatcaaccgcaaaatcccgcagctctacaaggctgtcttgcccgtaacatgccaccgggattcattctctcgaatgtcactcagaaaaatggatctgtag

SEQ ID NO: 29197 - DNA, 6330 bp, Artificial Sequence
  Description of Artificial Sequence: Synthetic coding sequence
atggcggaaagacgagccttcgcccagaagatctctaggacagtcgcggccgaagtccgcaagcagattagcggccaatacagcggcagtccacaactcttaaagaaccttaacattgtgggcaatatttcccatcacacaacagttccactgaccgaggcggtggatccagtggatctcgaagactatcttatcacacacccactcgccgtggacagtggccctctcagggacttgatagagtttcccccagacgacatagaggttgtttactctcccagggattgcagaacattagtgagcgccgtacctgaggagagcgagatggatccccacgtccgagactgtatccgcagttacacagaggattgggcaattgtgattcgaaaatatcacaagctgggcaccggattcaacccaaacaccttggataagcagaaagaacgccaaaaggggttgcccaagcaagtctttgagagtgatgaggcccccgatggtaatagctatcaggatgaccaggacgacctgaagcgcagatcgatgtcaattgacgatactccccgaggatcatgggcatgcagcatcttcgacctgaaaaatagtcttccggacgcgctcctgccaaatctgctcgataggacaccgaatgaagagattgacaggcaaaacgatgaccagaggaaatctaatcggcacaaggagctgtttgccctgcaccccagccctgatgaggaggagcctatcgagaggctatcagtgcctgatatccctaaggagcatttcgggcagaggctgcttgtgaagtgcctatcactgaaattcgagattgagattgagcctatatttgcctcactggcattgtacgacgtgaaagaaaagaagaaaatctccgagaacttctactttgacctcaatagtgagcagatgaaaggtcttctaaggcctcatgtgcctccagctgccattactaccttagcccgaagtgccatcttttctattacctaccccagccaggatgttttcctcgtcatcaagctggagaaggtgcttcagcaaggcgacatcggcgagtgcgctgaaccctacatgatcttcaaagaagccgacgcaaccaaaaacaaagagaagctggaaaagctgaagtctcaggccgatcagttctgccagagactcggtaaatatcgcatgccctttgcttggaccgccatccacctgatgaacatcgtgagctccgcaggctcactggagcgtgattcaacagaggtagaaatatctaccggcgaacggaagggctcttggtcagagcgacggaactcctccattgtgggccggagatcactggaacgtacgacgagcggcgacgatgcttgcaaccttacaagcttccggcccgcaacactcactgtgaccaacttttttaaacaggaaggggacaggctaagtgacgaagatttgtataaattccttgcagacatgcggcgaccttcctcagtcctccggcggctgcggcccatcacagcccagctgaaaatcgacatcagccctgcccctgaaaaccctcattactgtctgacccccgagctgctccaggtgaaactctaccctgatagtcgtgtccgtccaacaagggaaatacttgagtttccagcacgcgatgtttacgttcccaatacaacttaccgcaacttactctacatttacccacaatcactgaactttgctaaccgacagggcagtgctagaaacatcacggttaaggttcagttcatgtatggggaggacccctcaaacgccatgcctgtgattttcggcaagtcttcttgctccgagtttagtaaagaggcatacacggctgtagtataccataaccgttcccctgattttcatgaggaaatcaaggtgaaactgcctgccactctgaccgatcatcatcatctgctgttcaccttttaccacgttagctgccagcaaaagcagaacaccccgttagagacacctgtgggatatacatggatccccatgctccaaaatgggagattgaaaactgggcaattttgcctgcccgtgtctctggagaagcccccccaggcttatagtgtactgtctccggaggtccctctgcctggaatgaaatgggtcgataaccataaaggggtcttcaacgttgaggttgtcgccgtcagtagcatccacactcaggacccttaccttgacaagttctttgctctggttaacgcattagatgagcacctgttccctgtacggataggggatatgcgcatcatggaaaataacctcgaaaacgagctcaagtccagcattagtgcattaaattcatcccaactggaacccgtggttcggttcctacaccttttactggacaagcttatattgttagtgatcaggccccctgttatcgccggccaaattgtgaatctcggacaagcctcttttgaggctatggcaagcattatcaataggctgcataaaaacctggagggcaaccacgatcagcacgggcgtaacagcttacttgcctcctatattcattatgtgttccgcctgcccaatacctatcccaactcatccagcccaggacctggagggctgggcgggagcgtccactatgcgacgatggctagaagcgccgttcgaccggcctctcttaatctgaatcgctcaaggagtttgtctaactccaaccccgatatctctggtacacccacgagcccagacgatgaagtgcgaagcataatcgggagcaaagcaatggaccggtcctgcaaccggatgtcatctcacacggagacttcatcatttttgcaaacactgaccggccggttgcctaccaagaagctctttcacgaagagctagccctacaatgggttgtctgttctggttctgtaagagagtcggccctccaacaggcatggttctttttcgagttgatggttaaatctatggttcaccacctgtatttcaatgataagctggaggcgcctcggaagagccgcttccctgaacggttcatggatgatatcgctgcactggtctcaaccatcgcctccgacatcgtcagccgctttcagaaagacactgagatggtggaaaggctaaacacttcactggcatttttccttaacgacctactttcggttatggatcgcggtttcgtcttctccctgattaagagttgttacaagcaggtttctagcaaactgtactcactcccaaacccatccgtgctcgtcagcctccggttggacttcctgagaatcatctgtagtcacgaacactacgtcaccctgaacctgccgtgcagcctgctgacaccacccgcttctcccagtcccagcgtgtccagcgctacgagccagtcgagtggcttctcaactaatgtgcaagaccaaaagatagctaatatgttcgaactgtccgtcccgtttagacagcagcattacctggcaggtcttgtgctcactgagctggctgttatccttgatcccgacgcagagggcctttttggtctgcacaagaaggtcattaacatggttcacaacctgctcagtagtcatgactcagacccaaggtactctgatccacagatcaaggcaagggtggctatgttataccttccactgatcgggatcataatggaaaccgttccccaactgtatgatttcactgaaacccacaatcaacgtgggagacctatctgcatcgcgacggacgattatgagtcagaatcagggtccatgatcagccaaaccgttgctatggccattgctggcactagtgtgccgcagttgacccgcccaggctcctttctgctgacctcaacgtccggacgacaacacactacgttttccgcagagtctagccggtctctattaatttgtctcctatgggtgcttaagaacgccgacgagacggtgctccagaaatggttcacagatctgagtgtgctgcagctcaatagactactggacctgttatacttgtgtgtatcatgttttgagtataaaggtaagaaggtcttcgaaaggatgaacagtttgaccttcaaaaagtccaaggatatgcgggcaaagctcgaagaggccatccttgggtccattggcgcccggcaggagatggtccgcagatctagaggccagctagggacttataccattgcatcccctcccgaacggagcccttcgggatcagcatttggctctcaggaaaatctccggtggcgcaaggacatgactcattggagacagaatacagagaagctcgacaagtctcgcgctgagattgaacatgaggccttgattgacggtaaccttgccaccgaagcaaacttgatcatcctggacacactggaaatcgtggtgcagacggtatctgtgacagagtccaaggagagcatcctgggtggcgtactgaaggtgctgctgcattcaatggcctgtaatcagtcagctgtatatctccaacactgtttcgccacccaacgggctcttgtatcaaagttcccagagctgctgttcgaagaggagacagaacaatgcgctgacctttgcctacgtttactgaggcactgttccagctcgataggcaccatccgctctcatgcttctgcctcgctctatttgcttatgaggcaaaatttcgagattggcaataacttcgctcgcgtcaagatgcaggtaacaatgtctctgagtagcctggttggcacgagtcagaacttcaatgaggaatttctgcgtcgatctttaaagacaattctgacctacgccgaagaggaccttgagctccgcgagacaaccttccctgatcaagtacaggatttggtatttaatctccacatgatcctgtccgacactgtcaaaatgaaggagcatcaggaggaccccgagatgctgatcgacctcatgtaccgaatcgctaagggttatcagacaagccccgacctgaggctcacctggctgcagaacatggccggcaagcacagcgagagatcgaaccatgctgaggcagcacagtgtctcgtgcacagtgccgctctagtcgctgaatacctgtctatgctggaggacagaaaataccttcctgttggctgcgtgacgttccagaatatatcatctaatgttcttgaagagagcgctgtgtccgacgatgtggtctctcctgacgaagagggaatctgctctgggaaatatttcaccgagagtgggctggtcggcttgctcgaacaggccgcagcaagtttctcaatggcggggatgtacgaggccgtcaacgaagtctataaggtgctaatacctatccacgaggcgaatcgggacgcaaaaaaacttagcactatccacggtaagttgcaagaagcgtttagcaagatcgttcaccaatcgacaggctgggagcggatgttcgggacgtacttccgagtgggattttacggaactaagtttggtgacttagacgaacaggagttcgtgtataaggaacctgcaatcaccaagctggccgaaataagccaccgtctggaaggattttacggagagcgcttcggggaagatgtggtcgaggtaattaaggattcaaatcccgtggataagtgtaaacttgacccgaacaaagcatatatccaaatcacatatgtcgagccgtacttcgatacatatgagatgaaagatcgcattacctattttgacaagaactataatctaaggcggttcatgtactgtacacctttcaccctggacggccgagcccacggcgagctgcacgagcagttcaagcgaaagacaatcctaaccactagtcacgcattcccgtacataaaaacaagggtcaatgtcacccacaaggaggaaattattctcacaccaatcgaggtggcaattgaagatatgcagaagaaaacgcaggagttggcctttgcgacccaccaggacccggccgaccctaaaatgcttcaaatggtactgcaggggtccgtcgggaccaccgtcaaccaggggccactggaggtggctcaggttttcctgtccgaaataccttctgacccaaagctgttcaggcaccataacaaactaaggctatgctttaaggactttactaagaggtgcgaggacgccctgcgcaaaaataaaagccttatcggccctgaccagaaagagtatcaacgcgagctggagcggaattatcatcggctgaaagaggcactgcagcccctgatcaaccgcaagataccccagctctacaaagcagttctgcctgttacctgccaccgcgatagcttctcccggatgtctctgaggaagatggacctgtag

SEQ ID NO: 29198 - DNA, 6423 bp, Artificial Sequence
  Description of Artificial Sequence: Synthetic coding sequence
atggctgagcggagagcgtttgcacagaaaatttctaggacagtcgccgccgaagttaggaagcagatcagcggccaatactccggttcgccccagctgctcaagaatcttaacatcgttggtaacatttcccaccataccaccgtgccgctgaccgaggcagtcgacccagtggatctggaagactacctgatcacacatccactggccgtggactcagggccactgagggatctaatcgaatttccccctgatgatattgaggtcgtgtactcaccacgggattgcagaacgctggtgtcggccgtacccgaagaatccgagatggatccccacgtacgtgattgtatccgatcctataccgaagactgggccatcgtgatccgaaaataccataagctaggcactggcttcaacccaaacacactcgacaagcagaaggaacggcagaaaggcttgccgaagcaggtgtttgagtcagacgaagctccagacggtaatagctaccaggatgatcaggacgacctgaagagacgctctatgagtatcgacgacaccccaagaggaagttgggcatgttccatcttcgacctgaaaaacagccttcctgacgccttgctgcctaaccttctagatcgtacccccaatgaggagattgatcgccagaatgacgaccagcggaaatcaaaccgccataaggaattgttcgcactgcatcctagcccggatgaagaagaaccgatagaaagactgtccgtacctgatatacccaaagaacatttcgggcaaaggctgctggtcaaatgcctgagcctcaagtttgagatagagatcgagcccatcttcgcgtccctggcactctatgatgttaaagagaagaaaaaaatcagtgaaaatttctacttcgatctgaactctgaacagatgaaaggcttgctgagacctcacgttccgccagctgccatcacgacccttgctaggtccgcaatcttttccattacttacccctcacaggacgtcttcctcgtgattaagttagaaaaggtgctgcagcaaggagatataggtgagtgcgccgagccctatatgatatttaaggaggcagatgcaaccaaaaacaaagagaagttggagaaactgaaatctcaggcggatcagttctgtcagagactgggaaagtatcgcatgccattcgcctggacagcgatccaccttatgaatatcgtaagttctgctggatcattagaacgagactctactgaagtggaaatcagcacaggggaaaggaagggctcctggtccgagcggcggaacagctctatcgtgggtcgcaggagcctcgagagaactacatccggggatgatgcttgcaacctaacctcgtttagacctgctacattgaccgtgacgaatttctttaagcaggagggtgaccggctaagcgacgaagatctgtacaagttcctggccgatatgcgaaggccttcttccgtgctgaggcggttgcgtcctatcaccgcccaactgaaaattgatatcagccctgcaccagagaatccacattactgtctcacccccgaactcttgcaagtgaaattataccccgattctcgggtgaggcctacccgtgagatactggaattccccgcacgcgacgtgtatgtgcctaatactacgtaccgcaacctcctatatatttatcctcaatcactcaactttgctaaccgacagggatccgcccggaacatcaccgtgaaggtacaatttatgtacggagaggacccctcgaatgctatgcctgtgatcttcggcaagtcgagttgctctgaattttctaaagaagcctacacagctgtcgtgtaccacaatcggtctcccgattttcacgaggaaatcaaagtcaaactccctgctaccctgaccgaccaccatcaccttcttttcacattctatcatgtgtcatgccagcagaaacagaatacaccactggaaacccctgttggctatacgtggataccgatgttacagaacggcaggctcaaaaccgggcagttttgtctgccagtttccttggagaaaccaccccaagcctacagcgtactgagtcctgaagtgcccctccctggtatgaagtgggtagacaatcataagggagtgttcaacgttgaagtggtggcggtgagctctatccacacccaggacccatacctggataaatttttcgccctggtcaacgcactcgatgaacacctgttccctgtccgaattggtgacatgcgcattatggaaaacaacctggagaacgagctgaaatcttccatttcagcactgaactcaagccagctcgagcccgtggtccgctttctccacctgctgctagataagcttatcctgctggtgatcagaccaccggtgatcgcaggccagatcgtaaacctggggcaggcttccttcgaggccatggcaagcattatcaatcgcctgcataaaaacctggaagggaatcacgatcagcatggacggaacagcctgcttgctagttatattcattatgtttttagactgcctaatacctatcccaactccagctcacccgggcccggtggcctgggagggtccgtacactacgccactatggcacggtcagccgtgagacctgcgtccctgaatctcaaccgcagccgctcgctaagtaactcaaaccctgacatctctggtactcccacaagtcccgacgacgaggtgcgaagcatcattggctcaaaaggtctggaccggagcaactcctgggtgaacacaggggggcctaaggccgccccttgggggtcaaacccatcccctagcgccgagtctacccaggccatggaccgcagttgtaatcgtatgagctctcatactgaaaccagtagtttcctgcaaactttgactggccgcctgccgacgaagaaactcttccacgaagagctcgcactgcagtgggtcgtctgcagtggatctgttagggagtctgctctccagcaggcgtggttcttttttgagctgatggtcaagtctatggtgcaccacttgtactttaacgataagctggaagcacctaggaagagcagattccccgagagattcatggatgacatcgcagctctggtgagcactatcgcatcagatatcgtgtcaaggttccagaaagatacagagatggttgagcggctgaacacatccctcgcatttttcctaaacgacctgctaagcgtcatggacaggggctttgtgtttagtttgatcaaatcatgttacaaacaggtgtcaagtaagttatactccctgcctaacccaagcgtgcttgtttctttgcggctggattttctacggataatatgctctcatgaacattacgtcacactaaacctgccctgcagcctcctgactccaccagcttccccaagtccttccgtctcaagtgcaacgtcccaaagcagtgggttctcaacgaatgtgcaggaccagaagatcgcaaacatgttcgaactcagcgttcccttccgccagcagcattacctggctggacttgtccttacagaattagccgtcattctggatcccgatgctgaggggctttttggcctgcataagaaggtgattaacatggtccataaccttctctctagccacgattcagacccccgttactctgacccccagatcaaagcgagagttgcgatgctgtacctgccattgatcggtataatcatggagaccgtcccacagctctacgacttcaccgagacccacaaccaacgcggcaggccaatatgcatcgcgacagatgactacgagagcgagagcgggtctatgatcagccaaaccgttgcgatggcaattgcaggcactagcgttccccaactcacccggcctgggtccttcctactgacctctacatcagggcgtcagcatactactttctcagctgaatcatcccgatcactgctcatctgtctactctgggtcttaaagaacgcagatgagacagtgctgcagaaatggttcaccgatctgagtgtgttacagctgaatcggttattggatctcctgtacctctgcgtgtcatgtttcgaatataaggggaagaaggtgttcgagcgaatgaactccctaacatttaagaaatccaaggatatgcgtgccaaactcgaggaagccattttagggagtattggtgctaggcaagaaatggtacgcagatctagaggtcagctcgggacttacacaatcgccagtcctcccgagagatccccaagcgggtctgctttcggtagccaggaaaatttaaggtggcggaaggatatgacacactggcgtcagaataccgaaaaactggacaagagcagggctgaaatcgaacacgaagctctgatcgatggcaacctagcaacagaagccaacctcatcatcctagacaccctcgaaatcgtggttcagaccgtgtcagtgacagaaagcaaagaaagcatcctgggaggcgttttaaaggtgctgctgcattcaatggcctgcaaccagagcgccgtatacctccaacactgtttcgccacccagcgggccctggtgtcgaaatttccggaactccttttcgaagaagagaccgaacagtgtgcagacctgtgcctgagattgctgaggcattgcagtagttctatcggaaccatacggtcacatgcatctgcctctctgtacttactgatgagacagaacttcgaaattggaaacaactttgctagggtgaaaatgcaggtgactatgtcactgtcctcactcgtaggaacaagccagaattttaacgaggagtttcttagaagatctttgaagacaatcctgacctacgctgaagaagacctcgaacttagagaaacaactttcccagaccaggttcaggacttggtcttcaacttgcatatgatcctgtccgacacggttaaaatgaaggaacatcaggaggaccctgaaatgttgattgatttaatgtatcggatcgccaagggctaccagaccagccctgacctgcggctgacatggctgcaaaatatggccggcaagcatagcgaaagatcaaaccatgctgaggccgcccagtgcctggtccacagcgctgcattggtagcagaatatctcagcatgctagaagatcgtaagtatcttccagtgggttgtgtcacttttcagaacatcagcagtaatgtcctggaggaaagtgccgtgagcgatgatgtggtctcgccggacgaagagggcatttgctcaggtaaatattttacagaatcaggactggtaggacttctggagcaggccgcggcttcctttagcatggctggcatgtatgaggccgtgaatgaggtgtataaagtacttattcctattcatgaggcgaaccgagatgccaagaaactcagcacaattcatggcaaattacaagaggctttttccaaaattgtccaccagaccaccatatggaaaagaatgttcggcacttacttcagagtcggcttctacggaaccaaattcggggatctggacgagcaagagtttgtttacaaggaacccgccatcacgaaattggccgagatcagtcaccggctggaaggcttttatggagagcggtttggagaggatgtggttgaggtgatcaaggactctaatcctgtggataaatgcaagctcgaccccaacaaggcatacattcagatcacatatgtggagccctacttcgacacctatgaaatgaaggaccgaatcacgtactttgacaaaaattataatttaaggcggttcatgtattgtacaccttttaccctcgatggccgggcacacggggagctgcacgaacagttcaaacggaagactatcctgacaacctctcacgcattcccttatattaaaactagggtaaatgtaacccataaagaggaaatcatattgactccgatcgaggtggccatcgaggacatgcagaagaagacccaggagctggcttttgccacacaccaagacccggcagatcctaaaatgctgcagatggtcctccagggttccgtggggaccacggtcaatcaagggccgcttgaggtagcccaggtgttcctgagcgagattccttctgacccaaagctcttccgccaccacaataagctgagactgtgtttcaaggatttcacaaagagatgtgaagacgccctgcgcaagaataaatcattgataggtcctgatcagaaggagtaccagcgagagctcgagcgtaactatcaccgacttaaggaagcattacagcctctcattaacaggaagattcctcaactctataaggctgtcctgcccgttacatgccaccgtgactcatttagcaggatgtcactccgcaagatggacctctag

SEQ ID NO: 29199 - DNA, 2799 bp, Artificial Sequence
  Description of Artificial Sequence: Synthetic coding sequence
atgttcgagttgtctgtgcccttcagacagcagcactatctagcaggtctggtgctgactgagctggccgtcatcttggacccggacgcagagggcctatttgggctgcacaaaaaggttattaatatggtgcataacttgttatcatcacatgactctgatccgcggtacagtgacccccaaataaaggctagagttgccatgttgtaccttcccttgatcggaattatcatggaaacagtcccacagctctacgacttcaccgacctgagcgtcttgcaactgaaccgccttctggatctgctttacttgtgtgtttcttgtttcgaatataaaggcaagaaagtctttgaaagaatgaactcactcaccttcaagaaatccaaagatatgagggcgaaactagaggaagccatcctgggttcaatcggcgcccgccaagagatggtgcggcgtagcaggggtcaactcgagcgaagtccaagcggcagcgcctttggcagccaagaaaaccttaggtggcgaaaagacatgacgcattggcgtcagaatactgaaaaactcgacaagtcacgggcagagatcgaacatgaggcactgatcgacggcaatttagccaccgaagcaaacctgattattcttgacactctagaaatcgtagtccaaaccgtttcagtaaccgagagtaaggagagtattttggggggggtgttgaaggttctcttgcacagcatggcctgtaatcagagcgctgtttacttacagcactgctttgccacacagagagctcttgtttcaaagttccctgagttgctgttcgaggaagaaactgaacaatgcgccgacttgtgcctgcgcttgcttcgacattgcagtagctctataggcacaatcaggtctcatgcaagtgcctcactctatctgctgatgaggcagaatttcgagatcggtaataatttcgcaagagtcaagatgcaggtgactatgtcactttcctctcttgtggggacatcccaaaattttaatgaagagtttttaaggaggagtctgaagacaatccttacctatgctgaggaggacttggaattacgtgagaccacatttccagaccaggtacaggatcttgtgtttaacttgcatatgatactgtctgatacagtgaaaatgaaggagcaccaggaagatcctgagatgctgattgacctgatgtatcggatagctaaaggctatcagacgagcccggatctgaggctcacctggctccagaacatggcgggtaagcactcagagcggagcaatcatgctgaagcagcacagtgtttagtgcactcagccgcactggtggccgagtacctgagcatgcttgaggatagaaaatatctgcctgtaggttgtgtgacttttcagaacatttccagtaatgttttagaagaaagtgcggttagcgatgatgtggtgtctccggatgaggagggaatctgttcagggaaatacttcaccgagagcggtctggtcggtctcttggagcaggcagcagcttcgttttctatggctggaatgtacgaggccgttaacgaggtatacaaggtccttatcccgatccatgaggcaaatcgggacgcgaagaaactgtctacaatacacgggaagctgcaggaggcgttctctaaaattgtacaccaaagtacagggtgggagagaatgttcggtacatacttccgcgtcgggttttacggcaccaaatttggcgacctggatgagcaagagttcgtgtacaaggaaccagctatcacaaaattagcggaaatcagccacaggttagagggtttctacggtgaacgcttcggcgaggatgtggtcgaggtgatcaaggattccaatcctgtcgacaagtgcaagttggaccctaacaaggcctatatccagatcacctacgtcgaaccctacttcgatacgtacgagatgaaagacagaattacctattttgataagaactacaatttaaggagattcatgtattgcactccctttaccctggacggtcgagcacatggagaactgcatgaacaattcaagcggaagaccatcctgactaccagccacgccttcccctacatcaagacccgagtcaatgtcacccataaggaggagatcattctgaccccaatcgaagtggccattgaggacatgcagaagaagacgcaagagctggcgttcgccacacaccaggatcccgccgaccccaagatgctccagatggttctgcaggggtctgtggggacgactgtgaaccagggtcctctggaggtcgcgcaagtcttcctttctgagataccctccgatccaaaactcttccggcaccacaataaactgagactgtgttttaaggattttactaaacgttgcgaggacgccctgcgaaagaataagtcgctgattggacccgatcagaaagagtatcagcgggagctggagcggaactaccatcggctgaaagaggctctccagcccctcatcaacaggaaaatcccacagctgtacaaggctaccaactacgttttgtcattcttctctcaacgcttccttcaatctaacgaaccatctcagaacggatcattggagtgtacctgctttatccatctgcagagagcgatgtactcaacaagcagcgtaaaaagatccatcgggaagcagcacgggatggaattttggaagctgctgttcatcgaagagtgcagtggccaggagaatatcaaatgtagactgctaactcttgaaaaccatggctacggattctag

SEQ ID NO: 29200 - DNA, 1899 bp, Artificial Sequence
  Description of Artificial Sequence: Synthetic coding sequence
atggcagaaagacgagctttcgctcagaagatctcacggactgtggcggcagaagttaggaaacagatttccggacaatactcggggtccccccagctcctgaagaacctgaatattgtaggcaacatctctcaccatactactgtccctcttacagaagcggtggacccagtcgatctggaggactatcttatcacccatccattagccgtcgatagtggcccactgcgcgacttaatcgaatttcctccggacgacatcgaggtggtgtattcacccagggactgtcgcacactcgtcagtgctgttccagaagaatctgagatggacccccatgtcagggattgtatcagaagctacacagaagattgggccattgttataaggaagtaccataagttggggaccggattcaacccaaacacccttgacaagcagaaggaacgccagaagggtctcccaaagcaagtgttcgagagtgatgaggccccagatggcaacagctaccaagatgaccaggatgacctgaaaaggcggtctatgagcattgacgacaccccaagaggatcctgggcctgttcaatttttgacctcaagaattccctgcctgacgcactgctgccaaacctgctggaccgaacaccaaatgaggagatcgacagacaaaacgacgaccagagaaagtcgaatcgtcataaggagctcttcgctctgcatcccagtcccgacgaggaagagcctatcgagaggttgagcgtccctgatataccaaaagagcattttggccaacgcctgcttgtcaagtgtttatctctgaagttcgagatcgagatagagccgatttttgccagcttggctctctatgacgttaaggagaaaaagaagatttcagagaacttctatttcgatctcaactccgaacaaatgaagggtctgctaagacctcatgtccctcccgccgccattaccactttggctagatccgctatctttagcatcacctatccaagccaagacgtattcctggtgattaaactggagaaagtcttgcaacaaggagatataggagaatgcgccgaaccttacatgatttttaaagaggctgatgccacaaaaaacaaagaaaagttagagaagctgaaatcccaggctgatcaattctgtcaacgcctcggtaaataccggatgccttttgcctggactgcaatccacctgatgaatattgtgtcctctgccgggagtctggagagggacagtactgaagtggaaatttctaccggggagcgtaaagggagctggagcgagaggagaaatagctcaatcgtcggcaggaggtcccttgagaggacaacttccggtgatgacgcctgtaatctcacatccttcagacctgctaccttaacagtcactaacttctttaaacaagagggggatcgtctgtcggacgaggatttgtataaatttcttgctgatatgaggcgaccatcctccgttctgcggcggctgagaccgattaccgctcaattgaagattgacatctcccccgcgcctgaaaatccccactattgcttgactcctgaactgcttcaggttaagctgtatccagattcaagggtaagacctactagggaaatcctggaatttcccgcacgagatgtttacgtgccaaacacaacctaccgcaatttactgtatatatatcctcaatctcttaactttgccaatcgccagggctcagctaggaacatcaccgtgaaggtccagttcatgtatggagaagacccatccaatgccatgcctagtcctagctgtacacaccctatccccacggtgcggccattacccctgtggtgttaccactcgattttttctctcctgtcctgggactttatcacctag

SEQ ID NO: 29201 - DNA, 3912 bp, Artificial Sequence
  Description of Artificial Sequence: Synthetic coding sequence
tgaaagaatttagaagggaatcacgaccaacatggacgcaattcgctcctggcctcctacatccactacgtgttccgccttcctaacacgtacccgaatagctccagccctggtcctggcgggctcggcggctcagtccactatgccactatggcccgtagcgcagttaggccagcctcattgaatcttaatagaagtaggtcattgtctaacagtaacccagatatctcagggacacccacctcgccagacgacgaagtgcggtccatcatagggagcaaggggctcgaccggtctaatagttgggtcaatacgggtgggcccaaggcagcaccatggggctctaatccatcaccctctgccgagtctacccaagctatggaccgctcttgtaaccggatgtcttctcacactgagacctcctcttttcttcagacactgaccgggagactccccactaaaaagctctttcacgaagaactggcgctgcagtgggtcgtctgtagcggctcagtgcgggaaagcgcgctgcagcaggcctggttcttcttcgagctcatggtgaaaagcatggtgcaccacctatatttcaacgataagcttgaggccccacgcaaatcgcggttcccggaacgatttatggatgacatagcggccctggttagtactatcgctagcgatattgtgtccagatttcagaaggacactgaaatggtggaacggttgaacacgtcccttgccttcttcctcaatgatctcctcagcgttatggaccggggatttgtgttcagtctgattaaaagttgttacaagcaggtgtcttccaagctttattcactgcccaatcctagtgtgctggtatccttgcggctcgattttctccggatcatttgttcgcatgagcattacgttactctaaaccttccttgctctctgctaaccccccccgcctcaccgagtccgtccgtttcaagtgctacatctcagagttccggcttctctacaaatgtccaggaccaaaaaattgcaaatatgtttgagctgagtgttccatttcggcagcagcattacctcgctggcctcgtgttaactgagctggcggtgatacttgacccagacgcagagggactgtttggtctgcataagaaggtcatcaacatggtccataacctgcttagttcccacgacagtgacccacgctatagcgatcctcagatcaaagctcgggtagcaatgctgtacctacctttgatcggaatcataatggagacagtgcctcagctgtacgactttactgagacacacaaccagagaggacgccccatatgcatagctaccgatgactacgagagtgaatcaggctctatgatcagccagactgtcgcaatggccattgccgggacatcagtccctcagctgacccgccctggcagctttttactcacctcaacatctggacgccaacatacaaccttcagcgccgaaagctccaggtcactcttgatatgcctcttgtgggtgctgaaaaatgcagatgagacggtgctgcagaagtggttcacagatctgagcgtgctacaactgaaccgccttcttgacctcctttatctttgtgtaagttgcttcgaatataagggcaaaaaagtgttcgaaagaatgaattcccttacgttcaagaagagtaaggatatgcgagctaaactggaggaggccatcctgggcagcatcggagcccgccaggagatggtacgtcgcagccggggtcagctggaacgcagcccatccggcagtgcattcgggtcacaggagaatttgagatggcggaaggacatgacccactggagacagaacactgaaaaactcgacaagagcagggccgagatcgaacatgaagccctcatcgacggcaatctcgccacagaagcaaatttgataattctagataccctggagatagtggtccagaccgtgagcgtgactgagagcaaagagtccatactggggggagttctgaaagtattgctccattctatggcctgtaaccaatccgccgtctatcttcaacactgtttcgcaacccagagggcattagtgagtaaattccccgagctgcttttcgaagaagagacagagcaatgcgccgacctatgcttgaggctgctcagacactgcagctctagcattggtaccattcggtcacatgccagcgcaagcttgtatctgctgatgcgccagaactttgagattgggaacaacttcgccagggtcaagatgcaagttaccatgtctttaagctctctggtagggaccagtcagaacttcaatgaggagtttctgaggaggagtcttaagaccatcctgacttatgcagaagaagatctggaactaagagagactaccttcccagaccaagtgcaagatttagtgttcaatctccacatgattctgtccgacacagttaaaatgaaggaacaccaggaagatcccgagatgctgattgaccttatgtatcgcatcgccaagggctatcagacctctcctgatcttcgtctgacctggctgcagaatatggctggcaagcattcagagcgttctaaccatgctgaggccgcccaatgtctcgtccattctgctgctctcgtggccgagtacctctctatgctggaagatcgcaagtatctccctgtgggatgcgtgacgtttcaaaacataagcagcaatgtccttgaagaatcagccgtgagtgatgatgtcgtcagtccagacgaggaaggaatctgctctgggaaatattttacagagagcggtctcgtagggctcctagagcaggctgcagctagtttcagtatggccggtatgtatgaggccgtgaatgaggtgtataaagtcctcatcccaatacatgaggcaaacagggacgcaaagaaactgagcacgatccacggaaagctgcaagaggccttttcaaaaattgtccaccagtccacaggttgggaaaggatgttcggaacttactttcgggtgggcttttatgggacaaaatttggtgatctcgatgaacaggagttcgtttacaaggaacccgcgattactaagctcgcggaaatctcacaccgcctggaaggattttacggcgagaggtttggcgaggacgtggtggaggtcattaaggactccaaccccgtggataagtgtaagctcgaccccaataaggcttacatccagatcacatatgtagaaccgtatttcgatacatacgagatgaaggaccgtattacttattttgacaagaattacaaccttcgcagattcatgtattgcacaccattcaccctggatggtagagcacatggggagcttcatgagcagttcaagcgcaagacaatcctgacgaccagccacgcctttccctacattaaaactcgcgtgaacgttacacacaaagaagagatcatcctcacaccaattgaagtcgcgatcgaagacatgcagaaaaagacacaggagctcgcttttgcgactcatcaggatccagctgatcctaaaatgctgcaaatggtcctccaaggctcagttggaacgacggttaatcaaggtcctctggaagtagcccaggtattcctgagcgaaataccgagcgacccaaaactgttccgtcatcataataaactcagactgtgctttaaggattttaccaagcggtgcgaagacgcattgaggaaaaataaatccttgattgggccagatcaaaaggaataccagagagaactggagagaaactaccataggctaaaggaggctttacagcccctgattaaccgaaaaataccgcagctctataaggctgtcttacccgtaacctgccaccgggattctttcagtaggatgtctctgcgcaagatggatttgtag

SEQ ID NO: 29202 - DNA, 6282 bp, Artificial Sequence
  Description of Artificial Sequence: Synthetic coding sequence
atgagccaacctccacttctgccagccagcgcagaaactcgtaaatttacaagagcgctctcaaagcctggaactgccgccgagctgagacaaagcgtctctgaggttgtaaggggaagcgtgctcctcgccaagcctaaactgattgaacctcttgattacgaaaacgtcattgttcaaaaaaaaacccagattctaaatgactgcctccgtgaaatgctccttttcccgtacgatgatttccaaaccgccatcctcagaagacaggggcgctacatctgcagtactgtccctgcgaaggccgaggaggaggcacagagcctgtttgtcaccgagtgtatcaagacctataatagcgactggcatctggtgaactataaatacgaggactactccggtgagttccgacagctgcccaataaagtggttaaactcgacaagcttccggtgcacgtgtacgaagtagatgaagaggtggacaaagatgaggatgcagctagcctagggagtcagaaaggaggtatcacaaaacatggatggttatacaaaggaaacatgaatagcgcaattagcgttacaatgagatcttttaaacggcgcttcttccacctcattcagctgggtgatgggtcatataacctcaacttctataaagacgagaagatttctaaagaaccaaagggctcaatcttcttagactcatgcatgggggttgttcaaaacaacaaagtcaggcgcttcgcgttcgaacttaagatgcaggataaatcaagttatctgctggcagcggactctgaggtcgaaatggaggaatggattactatcctgaataagatcttacagctgaactttgaggccgctatgcaggagaaaaggaacggcgacagtcacgaagacgacgagcagtcgaagctggaaggtagcggcagcggcctcgattcataccttcctgagctagctaagagcgcaagagaggcggagattaagcttaagagcgaatcccgtgtaaaactcttttacctggatcccgacgcacagaagctggacttcagctcagcagagcccgaagtaaaatcttttgaggagaaattcggaaaacgaatcctggttaagtgcaacgatctgagctttaatttgcagtgttgcgtggcagaaaacgaagaaggaccaacaaccaatgttgaacctttctttgtgacactttctctgttcgacatcaagtacaaccgcaaaattagcgctgatttccacgtagaccttaaccatttcagtgttaggcaaatgctagccaccacatcaccggctcttatgaacgggtctgggcagtccccatccgtgctcaagggcattctccatgaagctgccatgcaataccccaagcagggcatcttttcagtgacgtgcccacacccagacatcttcctggtcgcccgtatcgaaaaggttctccagggtagcattacacattgcgccgagccttatatgaaatcatcagacagcagtaaagtggctcagaaagtccttaagaacgcaaaacaggcgtgtcagagactgggccagtatagaatgccattcgcctgggccgcaaggaccctctttaaggacgcatccggcaatctcgataaaaacgccagattctcagcaatttaccgtcaggacagtaataagctaagcaacgatgacatgttgaaactgcttgcagacttcaggaagcctgaaaagatggccaagttacctgtgatacttggtaacctggatatcacgatagacaatgtcagctccgatttccccaactatgtaaacagcagttacattcccactaaacaatttgaaacatgcagcaagacccccatcacatttgaggtggaggaattcgtgccctgtattcccaaacatacccagccttataccatttatactaaccacctgtacgtgtacccaaagtacttaaagtatgactcccagaagtcattcgccaaggcgcgcaatattgctatctgcatcgaattcaaggattccgatgaggaggactcacaaccactgaagtgtatatacgggagacctgggggccctgtttttactcggtctgccttcgcagctgtactgcatcaccatcagaacccagaattctatgacgagatcaagattgagctacctacccaactccatgaaaagcatcacctgttactgacctttttccatgtctcctgtgataattctagcaaggggtcaacaaaaaagcgtgatgtggtggagacccaggttggatactcctggctgcccctgctgaaagatggcagagttgtcactagtgaacagcatatccctgtgagtgctaatctcccgagtgggtacctgggatatcaggaactggggatggggagacattacggccccgagatcaagtgggttgatgggggcaaacccttgcttaagattagtacccatttggtctccaccgtatatacccaggatcagcatcttcataattttttccagtattgtcagaaaactgagtctggggcccaggctttgggcaatgaattggtaaagtacttgaagagccttcatgcaatggagggtcacgtgatgattgcttttctgcccacaatactcaatcagctgttccgagtcctgacacgcgccacacaggaagaggtagccgtcaatgtgacaagggtaatcattcatgtcgtcgcccaatgccatgaggaaggattggagagtcatttgaggagctacgtgaaatacgcgtataaggcagagccctacgtggcttcagagtacaaaacggtccacgaagaactcaccaagagtatgacaaccatattaaagccatccgccgatttcctcaccagcaacaagttactcaagtactcctggtttttctttgacgtcctgattaagagtatggcccaacaccttatagaaaattctaaagtcaagctacttcggaatcagagattcccagcctcttatcaccacgccgtagagactgttgtcaatatgctgatgccccatataacacagaaattccgcgacaaccctgaagcttctaagaatgcgaaccacagcctggccgtgtttatcaagcgctgctttacgttcatggacagaggtttcgtgttcaagcagattaacaattacattagttgcttcgcccctggtgatccaaaaactctgttcgagtacaagtttgaatttttgagagttgtctgcaatcatgagcactatatccccctgaaccttccaatgccttttggtaagggaagaatacagcgctatcaagatttacagctcgactatagtctgacagatgagttttgtaggaaccactttttggtgggactgctgctgcgcgaagtaggaacagccctgcaggaattcagggaggtgcgacttatagctatcagcgttctcaaaaatctgttgattaaacactctttcgacgacagatatgcgtctcgatctcaccaagccaggatagccaccctgtaccttcctttgtttgggctgcttattgagaatgttcaacgcataaacgtgcgggacgtttcgcctttccccgtaaacgctgggatgactgtgaaagatgagtccctggcacttcccgccgttaatcctctggtaacaccacagaagggctcaaccttagataattctctacataaagacctgctcggcgccatctccggcattgctagcccatatacaacgtccacgcccaacataaattccgtgcgtaacgccgacagtcgcggtagtctaattagcacagatagtggaaatagcctccctgagcggaactctgagaagtcgaacagcctggataagcaccagcaatcttcgaccttgggcaactccgtcgtaaggtgtgataagctggatcagtctgagatcaagagcctgttgatgtgcttcctctacattctcaagtccatgtctgacgacgctctcttcacctattggaacaaggcttcaaccagtgaactgatggacttttttactatcagtgaggtgtgtcttcaccagtttcagtacatgggcaaacgatacattgcaaggacaggaatgatgcacgcgcgtctgcagcaactcgggtctttggataattctttaacattcaatcacagctacggccactcagatgctgacgtgctgcaccagagtctgctggaggcaaatatcgcaactgaggtgtgcctgacagccctggacaccctaagcctttttaccctagcatttaagaaccagctgcttgcggatcatggtcataaccctctaatgaaaaaagtttttgacgtgtacctgtgttttctgcagaagcatcagtcggaaacagccctgaagaacgtgttcacagctctgagatcactcatctataagttccccagtactttctacgagggcagagctgatatgtgcgcagcactatgttacgaaattttaaaatgttgtaactctaaactgtcctccatacggacggaggcctctcagctcctgtattttcttatgcgaaataacttcgattacaccggcaaaaagagcttcgtaagaacgcatctccaggtcattatatctgtgagccagctcatcgcagacgtcgtaggtataggtgggacgcgctttcagcagagcctgtcaatcatcaataactgcgctaactctgacaggctgataaaacacacaagcttttcctccgacgtgaaagacctgacgaaaagaatacgcactgtactaatggctactgcacaaatgaaggagcatgaaaatgatcctgaaatgttagtggatctccagtacagcctggccaagagttatgcctctacacccgagctgagaaaaacctggcttgactccatggctaggattcatgtgaagaacggggacttgagcgaggccgcaatgtgttacgtgcacgtgactgccctcgtagctgaatacctgaccagaaaggaggcagtgcagtgggaacctcccctgcttccccactcgcacagcgcctgtctgcggcgatcacgcggaggggtgttccgccagggatgcaccgcatttcgtgtcatcactcctaatattgatgaggaggcgagcatgatggaggacgttggcatgcaggatgttcatttcaatgaagatgtgctcatggagcttctagagcagtgtgctgacgggctgtggaaagcggaacgttatgagctgattgctgatatctacaagcttattattcccatatacgaaaaacgtcgggactttgagcggctggcacacctgtatgacactctgcacagggcatattcgaaagtgactgaggtcatgcactccggcaggcgactgcttggaacttactttcgggttgctttcttcggccagggattcttcgaggacgaggacggaaaggaatatatctataaagagcccaagctgactcccctgagtgaaatctctcagaggctgctcaaactttatagcgataagttcggttccgagaatgtcaaaatgatccaggattcggggaaagttaatccaaaagatctggacagcaaatacgcttatattcaagttacgcatgtcatcccattttttgacgaaaaggaactccaggaacggaaaacagagttcgagcgcagccacaatatcaggagatttatgtttgagatgcctttcactcagaccgggaagaggcaggggggggtggaggagcaatgcaagaggaggactattctgaccgccatacattgtttcccttatgtcaagaaacgcattccagtgatgtaccagcatcacaccgacctgaatcctattgaagtggctatcgatgagatgagcaaaaaagtggcggaattacgacagttgtgttcctctgctgaggtggacatgatcaaattgcaactgaaactgcaaggctccgttagcgttcaggtgaatgctgggcctcttgcttatgctcgcgcttttctcgatgacacaaatactaagagatatccagataataaagtgaaactccttaaggaggtttttaggcagttcgtggaagcttgcggccaggcgctagccgtcaacgagagactcattaaggaagaccagcttgaataccaagaggagatgaaagccaactatcgtgagatggcaaaagaactgtccgagatcatgcatgagcagatttgcccacttgaggaaaagacatcggtcctgcccaactcgctccatattttcaacgccattagcggaacaccgacaagcactatggtgcatgggatgacctcttcttccagtgttgtctag

SEQ ID NO: 29203 - DNA, 1275 bp, Artificial Sequence
  Description of Artificial Sequence: Synthetic coding sequence
atgatgcatgctcgcctacagcagctgggtagcctggataatagtttgacttttaatcatagctatggtcatagcgatgccgacgtcctgcatcagtccctgctggaggctaatattgccaccgaggtgtgtctcactgccctggatactctctcgttattcacccttgcatttaagaatcagttgctggccgaccacggacacaacccgttgatgaaaaaagtattcgatgtctacttatgtttcttgcagaagcatcaatcagaaacagcccttaagaacgtttttaccgctttgaggtctctcatttacaagttcccttcaacattttacgagggtagagccgacatgtgcgccgctctgtgttatgagattctcaaatgctgcaattccaagctgtcctccattaggaccgaggcctctcaacttttgtatttcctgatgcgcaacaacttcgactacactggtaagaagagctttgtgcgaacacaccttcaggttataatctctgtttcacagctaattgctgatgtggtgggcatcggggggacccggtttcagcaatccctgagcattataaacaactgtgctaattctgacaggctaatcaagcacaccagcttttcttctgatgtgaaggaccttactaaaaggatcaggactgtgcttatggcaaccgcccaaatgaaggagcatgaaaacgaccccgagatgctggtcgacttacagtattccttggccaagtcttacgcgtcaaccccagaactgagaaaaacctggttagacagcatggctaggatccacgttaagaacggggacctctccgaagccgccatgtgctacgtccacgttacagcacttgtggctgaatacctgacaagaaaaggcgtgttcagacaggggtgtacagcattcagagtgattacccctaatattgacgaagaggcttccatgatggaagacgtgggaatgcaggatgtgcacttcaacgaagacgtcctcatggagttgctagagcaatgtgccgatgggttgtggaaagccgaacggtatgaacttattgcggacatatacaagctgattatacctatatacgagaagaggcgcgacttcgagcgattggcccacctttacgacacattgcaccgggcatattctaaggtgaccgaagtaatgcactccggaagacgtctgctcggcacttattttcgtgtggccttcttcggccaggtgtctttattatcgattctacagaccgtgctgtcacccctgtag

SEQ ID NO: 29204 - DNA, 6309 bp, Artificial Sequence
  Description of Artificial Sequence: Synthetic coding sequence
atgagccagcccccccttttgcctgcctcagccgaaacgcgcaaatttacccgcgcgctgtcaaagcctggaacagcggccgagctgcgacagtccgtatccgaggtggttaggggctcagttctcctggccaagcccaaattaatagagcccctggactatgaaaatgttatagtgcaaaagaagacgcaaatcctgaatgattgtctgcgcgagatgctgctcttcccctacgatgacttccagaccgccatcctgaggcgacaaggcagatacatctgctcaaccgtgcccgccaaggctgaagaggaggcgcagagcttatttgtgactgagtgtatcaaaacctataactctgactggcatctggtgaactacaagtacgaggactactctggcgaatttcgtcagctgcccaacaaggtggttaagttggacaaactgcccgtacacgtgtacgaagttgacgaggaggttgacaaagacgaggatgcagcttccctgggaagccagaagggtggaataacaaaacatgggtggctttacaagggaaacatgaatagtgcgatctccgtcacaatgagatcattcaagcggcggttcttccatctgatacaactgggagacggcagctacaatctgaacttctacaaggatgaaaagatttcaaaagagccaaaaggatcaatattcctggactcttgcatgggggtggtgcagaataataaggtgcgccgattcgctttcgagttaaagatgcaggataagtctagctacctgctggcggccgacagcgaggtggaaatggaggagtggattaccatattgaataaaatcttgcagctgaatttcgaggctgctatgcaggagaaaaggaacggggactcccacgaagacgacgagcagtcaaaactcgaaggctctgggtctggactggattcttacctccctgagctcgcgaaaagcgcccgcgaggccgaaatcaaactgaaaagtgaatctagagtgaagctgttctatttggacccagacgctcagaagctggatttttcaagcgccgagcctgaggtgaagtcattcgaagagaaattcggcaaacggatcttggtaaagtgtaatgatctgagttttaacctgcagtgttgcgttgcagaaaatgaagagggcccaaccaccaatgttgagccctttttcgtcacgctgagtttgttcgacatcaagtataaccgaaagatttccgcagattttcacgtggatttaaaccatttttccgttagacagatgctagccacgacttcgccagctcttatgaacggaagcggtcaaagcccgtccgtattaaagggcatccttcatgaggccgctatgcagtatccaaagcaaggcatattcagcgtcacctgtccccatcctgatatttttctcgtggcaagaatcgagaaggtactgcagggaagcatcacacactgcgctgaaccttacatgaagtcctctgactcatctaaagtcgcacaaaaagtgctcaagaatgcgaagcaggcttgtcagcggcttggtcagtatcggatgccattcgcctgggcagcaaggaccttatttaaagatgccagcgggaacttggacaagaacgctcggtttagcgccatctatcgccaggattcgaacaagctctccaacgacgacatgctcaaactactggccgatttccgtaagcccgaaaagatggccaaattgcctgtgatcctgggcaatttggatatcaccatcgataatgtctccagcgatttcccgaattatgtcaactccagttatatccctactaaacaattcgagacttgtagcaaaacgccaatcaccttcgaggtggaagagtttgttccctgtattcctaagcatacccagccctatacaatatatacgaaccatctgtatgtgtatcctaagtatctcaagtacgactctcagaagagctttgcgaaggcgagaaatatagcgatatgcatcgaatttaaagactcagacgaagaagattcacagcccctgaagtgtatctacggacgccccggggggccagtttttacacgctccgcgtttgcagccgtgctccatcaccaccagaatccagaattctatgacgagattaagatcgagctccctacccaactccatgaaaaacaccacctgctgctgacattctttcacgtgtcatgtgacaacagctctaaagggtctaccaagaagagggatgtcgtcgagacacaggtgggttatagttggctacccttactgaaggatgggcgcgtcgttacctccgaacaacatattcctgtctctgctaatttgccaagtggctatttaggctatcaggagctgggcatggggcgacactatggtcccgaaatcaaatgggtggacgggggtaaaccactgctgaagatctccactcacttggtgagcacagtgtatactcaggaccagcacctccataacttcttccagtattgccaaaagaccgagtccggagcgcaagccctggggaacgagttagtgaaatacctcaagtcccttcatgccatggagggccacgtgatgatcgccttcctgccaacaatcctgaaccagctgtttcgggtattaacacgggccacacaggaggaggtagcagtaaacgtgactagagtcataatccatgtggttgcccaatgccatgaggagggtctcgagtcacatctccgctcatatgtgaagtatgcatacaaggccgagccatacgtggcctctgagtataagaccgtgcacgaagagttaacaaagagcatgactactattctcaaacctagcgccgattttttgaccagtaataagctgctcaaatatagctggttcttcttcgacgtgctgatcaagagcatggcccaacacttaatcgaaaatagcaaggttaagctcctgagaaaccagagatttcccgcatcatatcaccacgcagtcgagaccgtggtgaacatgctcatgccacacattacacagaagttcagggataaccctgaggcgagcaaaaatgctaatcactccctcgccgtgttcatcaaacggtgcttcacattcatggacagaggctttgtgtttaaacaaattaacaattatataagttgttttgccccaggggaccctaaaaccctgtttgagtacaaattcgagttcctgcgagtggtgtgcaatcacgagcactatattccgttgaatctgcccatgcctttcggtaagggcaggatacaaaggtaccaggacctccagctggactactccttaacagatgagttttgccgcaatcactttctcgtgggactgctgctgcgggaggtggggactgccttgcaggagttcagggaagttaggctgatcgctatttcagtgttgaagaatctgctcattaagcactcttttgacgaccggtacgccagcaggagccatcaggcccgaatcgccaccctgtacctgccactgtttggtctgctcattgagaacgtgcagagaattaatgtgcgagatgtgagccccttccctgtgaatgccgggatgactgtcaaggacgagagcttggccctccctgccgtgaacccactcgtcactccccagaaagggtcaacactagacaacagtcttcacaaggatctgctgggcgccatttcaggaatcgcgtctccctacacaacttcaaccccgaacattaactccgtgaggaatgcggactctcgcggcagtctgatttccacagacagtggcaatagtctccccgagcgcaattcggaaaagtccaacagcctggataaacaccaacagtcatcaacactggggaatagtgtagttaggtgcgacaaattggatcaatctgaaataaagtcactgctgatgtgtttcctgtacatactcaaatccatgagcgacgacgctctgtttacctattggaacaaggcatccacaagcgagctgatggactttttcacaatttcagaggtatgtcttcaccaattccaatacatgggcaaaagatacattgcaagaaccgggatgatgcatgcgcgtctgcaacaactgggctctctggataattctttaacgtttaaccattcgtacgggcattccgatgcagacgtcttgcaccagagcctgttagaagccaacatcgcaaccgaggtgtgtcttaccgcactggatacactgtcccttttcaccttagcattcaaaaaccagctgttagccgaccacggccataaccctctgatgaagaaggtatttgacgtctatttatgttttctccaaaaacaccagagcgaaaccgcccttaaaaatgtgtttacagccctaagaagcctgatctacaaattcccaagtacattttatgaaggacgggccgacatgtgtgccgcactgtgttatgagatcctgaaatgctgtaactctaagctgtcatccatacgcactgaagcatctcagctattgtatttcttgatgcgaaacaatttcgattacacagggaagaaatcatttgtcaggacccacctccaggtaataatatcagtgtcgcagttgattgcagatgtggttggaattggcggaacacggttccagcagtcactgtctattattaataactgcgcaaatagtgaccggttaattaagcacacatccttctcctcggatgtgaaggatttgactaaaaggattaggacggtacttatggccaccgcacaaatgaaggaacacgagaatgatccggagatgcttgtggatctacaatactcactcgctaaatcttatgcctccacccctgaactgagaaaaacctggttggactcgatggcacggatccacgtcaagaatggagacctttctgaggcagcaatgtgctatgtgcacgtaacagcacttgttgctgagtacttgactcgaaaggaagccgtccaatgggaaccacccctgctgccacattcgcattccgcctgcctgagacgctccagaggcggtgtattcagacaggggtgtaccgcctttagggttatcacgcctaacatcgatgaggaggcttccatgatggaggacgtggggatgcaggatgttcattttaacgaagatgtgcttatggaactgttggaacaatgcgccgatgggctctggaaggcggagcgatacgaattgattgctgatatttacaagctgattattccaatttacgaaaagcgcagggattttgaacgcctcgcccatctttacgacacactgcatcgtgcatacagcaaagttacagaggttatgcactctgggcgccgcttactgggcacatacttccgcgttgcattcttcggacaggctgcccaatatcagtttactgacagcgagacagatgtggagggcttctttgaagatgaagacggtaaagagtatatctacaaggagccaaaactcacccctctgtccgagatttctcaaagacttttgaagttatatagcgacaagttcggctcggagaatgtaaagatgatccaggactctgggaaggtcaatcccaaagatctggacagtaaatacgcttacatccaggttacccacgtgatcccattctttgatgagaaagaactgcaggaacgcaaaactgaattcgagagatcccataatatcagacgctttatgttcgagatgccatttactcagacaggcaaaaggcaaggtggagtggaagagcagtgtaaaagaaggacaattctaacagcaatccattgttttccatatgtcaagaagcggatccctgtgatgtaccaacaccacaccgacctcaacccaatagaagttgcaattgatgaaatgagtaaaaaggtcgcggagctccgtcagctgtgttcttctgctgaggtggatatgattaagttacaattaaagttacaggggtctgtcagcgtccaggtaaatgcgggtccgctcgcgtacgcccgagccttcctggatgatacgaacactaagcgttacccagataataaggttaaactcctgaaagaggtgttccgccagtttgtggaggcatgtggacaggcattagccgttaatgagagactgataaaggaggaccagctggaatatcaagaagaaatgaaagctaactaccgggaaatggctaaagagctttctgagattatgcacgagcaagtgcggcgctcagctccttggcggaggcgcagagcctcttaccgcatcccctttacctctagcacgccaagtgtggggctccagcaggctcagtggttcacagggtag

SEQ ID NO: 29205 - DNA, 2175 bp, Artificial Sequence
  Description of Artificial Sequence: Synthetic coding sequence
atgcatgcgaggctacagcagttgggatctctggacaactctctcaccttcaatcatagttatggacactctgacgccgatgttttacaccagagtctgttagaagccaacattgccaccgaggtgtgtttgaccgccctcgacacgctgagcctctttaccctggctttcaagaaccagctgctggcagaccacggtcataaccctctcatgaagaaggtgttcgatgtctatctttgcttcctccagaaacaccagtctgaaactgctcttaagaacgtattcactgccctgcggagtctcatttacaagttcccttcgactttctatgaggggagagcagatatgtgcgccgccctgtgctacgaaattctgaagtgttgcaacagcaagctctctagcatcaggactgaggcctcgcagcttctctactttctcatgcgtaacaacttcgactacacagggaagaagtcttttgtgcgaactcacctgcaggtgatcatctccgtctctcaactcattgcagatgtagtggggatcggcggtacccggtttcagcagtccttatccatcatcaacaattgtgccaatagtgaccgtctgattaagcatacatcttttagttctgatgtgaaggacctgaccaaaaggataaggaccgttttgatggcaacagcccagatgaaggagcacgagaacgaccccgaaatgctggtcgacctgcagtactcactcgcaaagtcctacgcttctacaccagaactaaggaagacatggctcgactccatggccaggattcacgtcaagaatggagacctctcagaggcagcaatgtgctacgtccacgtgaccgcacttgtggcagaatacctgacccgaaagggggttttccgccagggctgcacagccttccgtgtaattactcctaatatagatgaagaagcatcaatgatggaggacgttggtatgcaagacgtgcattttaatgaagatgtattgatggaactgctcgagcagtgtgccgatgggctctggaaggctgaaagatacgaactaattgcggatatctacaaactgataatccccatttacgagaaaaggagagatttcgaacgattggcccacctgtacgataccctccatcgagcctactctaaagtgacagaggttatgcattccgggcgcaggttgcttggtacatatttcagggttgcattcttcggccagcagtaccagtttacagactccgagaccgacgtggaaggatttttcgaagatgaggacggcaaggaatacatttataaagaacctaagctcacacccctgagcgaaatcagtcaacgacttttgaagttgtattcagacaaatttgggagtgagaatgtgaaaatgatccaggattcaggcaaggtgaaccccaaagatctggacagcaagtacgcctatatacaggttacccatgtgattccgttctttgatgagaaagaactccaggagagaaaaacggagttcgagcggagccataatattagacgcttcatgtttgagatgccctttacccagacgggcaagcgccagggtggggtggaagaacagtgcaaacgccggaccatcctgactgccattcattgctttccttatgttaaaaagcgtatccccgtgatgtaccagcaccacaccgacctgaacccgatagaagttgctatcgatgagatgtcaaagaaagtggctgagttgaggcagctctgtagcagtgcagaagttgacatgatcaagctccagctcaaactgcaaggctctgtctcagtgcaggtcaacgctgggccgctcgcatatgccagagcctttttggatgacaccaacaccaaaagatacccagataataaggtgaaactgctgaaggaagtcttccgccagtttgtcgaggcttgtgggcaagcactggcagtgaacgagagactcattaaagaagaccagttggagtatcaggaagagatgaaggcgaactaccgagagatggccaaggaattgtctgaaattatgcatgaacaaatctgtcccctggaagaaaaaacctctgtactccctaattctctgcacattttcaacgccatttccggcactcccacctcaactatggtacatgggatgacctctagctcaagcgttgtgtag

SEQ ID NO: 29206 - DNA, 6285 bp, Artificial Sequence
  Description of Artificial Sequence: Synthetic coding sequence
atgtctcagcctccattgttgccagcctcagcagagactagaaaattcacccgcgccctctccaaaccaggcaccgctgccgaattaagacagtctgtgtcagaggtggtgcgaggctccgtgcttcttgcaaaacccaaactgattgagcccctcgactacgagaacgtgattgttcagaagaaaacacagatcctgaatgattgcttgcgcgagatgcttctgttcccctacgacgacttccagaccgctatcctgcgcagacagggtagatacatatgtagcacagtccccgctaaagcagaggaggaagcccagagcctatttgtgactgagtgtataaaaacatataacagtgactggcacctcgttaattacaagtatgaggactacagtggtgaattcagacagcttcctaacaaagtagttaagctggataagctgcccgtccacgtgtatgaagtggacgaagaggttgacaaagacgaggacgcagcgagtctgggttcccagaagggaggcatcaccaaacatgggtggctctacaaaggaaacatgaactccgcaatttctgtgacaatgcgctcatttaagaggagattttttcacctgattcagctcggcgatgggagttataacctcaacttttacaaggatgagaaaatctctaaagaacctaaggggagcattttcttagattcttgcatgggtgtggtgcagaacaataaggtgaggcgctttgctttcgaactaaagatgcaggataaaagctcataccttctcgctgctgactcagaagtggaaatggaggaatggattaccattctcaacaagatactgcaactgaattttgaagcggcgatgcaggagaaaagaaacggggactcacacgaagacgacgagcagagtaagctggagggcagcggcagcgggctggactcatatctcccagaactggctaagtcagcgagagaagctgagatcaagctgaagagcgaaagcagggtcaaactgttctatctcgatcccgacgcacagaaactggatttcagcagtgcagaacctgaggttaaaagtttcgaggaaaaatttggcaagcggatcttagtaaaatgcaatgacctctcctttaatctgcaatgttgcgtggccgaaaacgaagagggcccaaccacaaacgtggagcctttctttgtcacactgagtctctttgacataaagtacaatcgtaagattagtgcggatttccatgtggatctgaaccatttctccgtgagacagatgctcgctaccaccagtccggcgctgatgaatggatccggacagtctcccagcgtcctgaagggtattcttcacgaagccgccatgcagtatccaaaacagggaatcttcagcgtgacgtgtccccacccggatatcttcctagtggcgcgaatcgagaaagtgctccagggaagcatcacgcactgcgccgagccatacatgaagtctagcgactcgtcaaaggtggcccaaaaggttctgaagaatgcgaagcaggcttgccaaagactcggccagtatcgaatgccattcgcatgggccgctagaacgttgtttaaagacgcttcaggcaatctggataagaatgcaagattcagtgctatttacagacaggatagtaacaagctcagcaatgatgacatgctgaagcttctggcagatttccgcaagccagaaaaaatggcgaaactgcctgtgatcctggggaacctggacattactatagacaatgtaagctcagactttcctaactacgtaaactcctcctacattcccactaagcaatttgaaacctgctctaaaacccccatcaccttcgaggtggaagagttcgtcccctgtatccccaaacacacccagccatatacaatctacacaaaccatctttacgtttaccccaagtatctaaagtatgattctcagaagtcttttgccaaggcaaggaatatcgccatttgcatcgagtttaaagattcagatgaagaggacagtcagccattaaaatgcatttacggccgacccggcggacccgtgtttactcgatctgctttcgctgccgtcctacaccaccaccagaaccctgagttttacgacgagatcaaaatcgagcttcctacccagctccacgagaaacatcacctcctgctgacattcttccatgtatcctgtgacaacagctctaaagggagcacaaaaaaaagagacgttgtggaaacacaggttggatattcctggctccccctgctcaaggacggccgcgtggtcacgtctgagcagcacatccccgtatcagcaaatctgcctagcgggtatctgggctatcaggagctgggtatgggtaggcactacggccctgaaatcaagtgggtggatggggggaagcccctcctgaagatcagcacgcatttagtgtccaccgtgtacacacaagaccaacatctccacaacttttttcagtactgtcagaagaccgagtcaggggcccaggccctgggcaatgaactggtcaaataccttaaatctctgcatgcaatggagggccatgtaatgattgcctttttacctacaattctcaatcagctttttagggttttaacgcgagctacacaagaggaagttgccgtcaacgtgacccgcgtgattatccacgtggtcgctcagtgtcatgaagaaggcctggaatcacacctgcgatcatacgtcaagtacgcctacaaggcagagccctatgtggcaagcgaatacaaaaccgtccatgaggagcttaccaaatctatgactacaatcctgaaaccttcagcagacttcctgacatcaaataaactgttgaagtactcctggttctttttcgatgtgctgattaaaagcatggctcagcacctaattgagaattcgaaagtaaagcttctgagaaaccagcgttttccagcttcctaccatcatgccgtggagacagttgtgaatatgctcatgcctcacatcacgcaaaagtttcgcgacaacccagaagcaagcaaaaatgccaaccacagcctggcagtgtttatcaagagatgttttacgttcatggacagagggtttgtctttaagcagatcaataactatataagctgctttgcccctggcgatcccaagactttgtttgagtataagttcgagttcctgcgcgttgtttgcaaccacgaacactacatccctttgaacctgccaatgccatttggcaagggccgcattcagcgctaccaggatttacagctggactactcactcacggatgaattctgccgaaaccactttttagttggtctgcttctcagggaggtcggcaccgcactgcaggaattccgggaagtcaggctgatcgccatctcagtgctcaagaacttactgattaagcactcttttgacgaccggtacgcctctcgctcccaccaggctcgcatcgcaactctgtatcttccattgtttggattgcttatcgagaatgtacagaggattaacgtccgagacgtgtctcctttcccagtaaatgccggaatgaccgttaaagatgaatctctcgcactccccgccgtgaatccactggtaactcctcagaaggggagtacccttgacaactcgctgcacaaagacttacttggcgctatatctggaatcgcctccccctatacaaccagcacacctaatatcaattctgtacgcaacgctgattctagaggcagccttatctcaaccgactccgggaattcactccctgagagaaactccgagaagagcaacagcctcgacaagcaccagcagagctccacccttggcaattccgttgttaggtgtgataagctcgatcagagcgagataaaatcccttcttatgtgttttctatacattctgaagagcatgagcgatgacgccctgtttacatattggaacaaagcttctactagcgaactgatggatttcttcactatttccgaggtctgcctacaccagttccagtacatggggaagcggtatattgcttcggtgcgcaagattagtagtgttttaggtatctcggtggacaatgggtatgggcattccgacgccgatgttctgcatcagtccctgctggaggctaacatcgccaccgaggtctgcttgaccgcgctagataccctgtcactttttaccctcgcattcaagaatcagctgctggccgaccacggccacaaccctttgatgaaaaaagttttcgacgtctacctctgtttcttgcagaaacaccagtcggagacagccctgaaaaatgtgtttacggccttgcgttcattaatctacaagtttccaagtactttttacgaaggtagagcagatatgtgcgccgctttatgttacgagatcttgaagtgttgtaacagcaagcttagttcaatccgtaccgaagcttcccaactgctatatttcctcatgcgcaataactttgactacaccgggaagaaatctttcgtgcgcacccacctacaagtgatcattagcgtaagccagctgatcgccgatgtcgtaggcattggtggaacgcgatttcagcagtctcttagtattattaataactgcgcaaactctgaccgcctaataaagcataccagcttctcttcagacgtgaaggatctgacgaagcggattcgcactgtgcttatggcaacagcccagatgaaggaacacgaaaacgaccccgagatgctggtggatctacaatacagccttgccaaatcctatgcatctacacccgagcttagaaagacatggctggatagcatggccaggattcatgtgaagaatggagatctaagtgaagcggccatgtgctacgtgcacgtgactgctctggtggctgagtatctgactcggaaggaggcagtccagtgggaaccccctctgctaccacactctcattctgcatgcctgaggaggagccggggcggagtgtttcggcagggctgtaccgcatttagggtgataaccccaaatatcgatgaggaagcctccatgatggaggacgttggcatgcaggatgtgcattttaatgaggatgttttaatggaacttcttgagcagtgcgccgacgggttatggaaggctgagagatacgagctgattgctgatatttataaactcatcattccaatttacgagaaaagacgcgacttcgaaagactggcacacctgtatgataccctgcacagagcttattctaaagtcaccgaggtgatgcattccggcaggaggttactggggacctattttcgcgtagccttctttgggcaagccgcccaatatcagtttacagatagtgaaactgacgtggagggtttcttcgaagatgaggatgggaaagaatacatttacaaagaacccaaactgaccccattgtctgagatttcgcaacgactcctgaagttgtattctgacaagtttggatccgaaaatgtaaaaatgatccaggactctgggaaagttaaccctaaggacctggactcaaagtacgcgtacatacaggtgacacacgtgattcccttttttgacgagaaggagctccaggaaaggaaaactgagtttgagcggagtcacaacatccgccgctttatgttcgagatgccttttacacagaccggaaaacgccagggaggcgtggaggagcagtgcaagcgtcgcacaatactgacagccatccactgtttcccctatgttaaaaagcggattcctgtcatgtaccaacatcacacagatctcaaccccatagaggttgctattgacgagatgtcaaagaaggttgctgagcttcgacaactttgttccagcgccgaagtggacatgattaaactacaactgaagctgcaaggcagcgtgtctgtgcaggtgaacgctggcccactagcctacgccagagcattcctggacgataccaatacaaaaaggtaccctgacaacaaagttaaattgcttaaggaggtgtttcgtcagtttgtagaggcttgcgggcaagcactggccgtgaacgagagactcattaaggaagaccagctagaataccaggaagagatgaaagctaactaccgggaaatggccaaggagctttcagagattatgcatgagcaggttcggcgctcggccccatggagacgtcggcgtgcttcttatcgcatccctttcacatcctccacgccaagcgtgggtctccagcaggcgcaatggtttactggctag

SEQ ID NO: 29207 - DNA, 6207 bp, Artificial Sequence
  Description of Artificial Sequence: Synthetic coding sequence
atgcaagccgacaagtgtcgcaccagttcccgaagcgtcaagaaagagcttgtcatcgaaagtcccctgcaatacaaggacgcagcccaaggtgaagtggaagcggagtcccccgggccggttccggctaagcctaaactcatcgagccgctggactacgaaaacgtgattgtgcagaagaaaacacagattctcaacgattgcctgcgagagatgttactttttccctacgacgacttccagaccgctattctccgcagacagggcaggtacatctgctctaccgtccccgcaaaggctgaagaagaagcgcagagtctttttgtaactgagtgtatcaagacatataactctgattggcacttggtcaattataagtacgaagattatagcggcgagttcaggcaattacccaataaagtcgtgaagcttgataaactgccagttcacgtgtacgaggtggatgaagaggtggataaagacgaagacgccgcatcgcttggcagtcaaaaagggggcatcactaagcatggttggctgtacaaggggaatatgaactccgccatcagcgtaaccatgagatcatttaagcggcgcttcttccatttgattcagctaggagatggatcctacaacctcaatttttataaagatgagaagatttccaaagagccaaaaggctccatcttcctggattcctgtatgggcgtggtgcagaacaacaaagtgcgcaggtttgccttcgagcttaagatgcaggacaagtcgtcttacctgctggcagccgattcagaggttgagatggaggaatggatcacaattttgaacaaaattttgcagcttaatttcgaggcagccatgcaagaaaaacgtaatggagactcccatgaggatgacgagcagtccaagctggagggcagcggaagcgggctcgacagctacttaccggaactcgctaagtcggctcgagaggctgagatcaaactgaagtccgagtcccgcgtgaagctgttttacctggacccagacgcgcagaagctcgatttctcctcagcagagccggaagtcaagagctttgaggagaaatttggaaagaggatccttgtcaaatgtaacgacctctcctttaacctccagtgttgtgttgctgagaacgaagagggccccactacgaacgtggagccatttttcgtgaccctgtcattatttgacatcaaatataaccgcaagatcagtgctgattttcacgtcgatctcaaccatttcagtgtaagacagatgctggccacaacgtcacccgccctgatgaacggctccggtcaatcaccgtctgtgctgaagggtatcctgcatgaggctgcgatgcagtaccctaagcagggaattttctccgtcacttgccctcatcccgatatttttcttgtggcgagaatcgaaaaggtattgcagggctcgatcacgcactgtgccgaaccttacatgaagagcagcgattcctctaaggtggcacagaaggtgctgaagaacgcgaaacaggcttgtcagaggctgggccagtacaggatgcctttcgcttgggccgcccgcacgctttttaaggatgcttcggggaacctggacaagaatgcacgattcagcgccatttaccgccaggattccaataaattatcaaacgatgacatgttgaagctccttgccgattttcggaagcctgaaaagatggccaagctccccgtgatcctcggcaatctggacataacgatagacaacgttagctctgactttcccaactacgtaaactctagctacatcccgaccaagcaattcgagacttgtagtaaaacacctatcacgttcgaagttgaggagttcgtcccatgtataccgaagcacactcaaccttacaccatttatacaaatcatctctacgtctaccctaagtatctgaagtacgatagccagaaatcctttgctaaggcgcgcaacattgctatctgcatagaattcaaggacagcgatgaagaagattcccaacctctgaaatgcatttatggaagacctggcggtcctgtcttcacgaggtccgcgtttgccgccgtacttcaccatcatcagaaccctgaattttatgacgagataaagatcgagcttcccacccagttgcacgagaagcaccatctcctcctgacatttttccatgtaagctgcgacaacagctcaaaaggaagcacaaagaaacgagatgttgtcgagacccaagtgggttactcctggctgccactcctgaaagatgggagagtggtaaccagcgagcagcacattcctgtatccgccaacctccccagcgggtacctgggataccaagagctggggatgggccggcattatgggcccgaaatcaagtgggtggacggcggcaagcccttgctgaagatcagcacccacctggtgtccacagtgtatactcaagatcaacatttgcataacttcttccagtattgccagaaaacggagagtggagcgcaggcacttggaaacgaactggtaaagtacctcaagtccctacatgcgatggaaggacacgtgatgatcgcgttcctgccaacgattctgaaccagctgttccgagtcctgaccagagccacacaggaggaagtcgcagtcaacgtgacacgcgtcatcatccacgtggtagctcaatgccatgaggaaggcctggaaagccatctgagaagttacgttaaatatgcttataaagcggaaccttacgtcgcctcagaatataagaccgtccatgaggaactcactaagtcaatgacaactatcttgaaaccctccgcagacttcctaacaagcaataagctcctgaagtacagctggttttttttcgacgtgctcataaagagcatggcccaacacttgatcgagaactctaaggtgaaactgctgcggaaccagcgattcccagctagctatcaccacgccgttgaaacagtggttaacatgctgatgccgcacataacacagaagtttcgggacaatcccgaagccagtaaaaacgctaatcattcccttgcagttttcatcaaaagatgtttcaccttcatggatcgcggcttcgtgtttaaacagatcaacaattatatctcgtgctttgccccaggcgacccgaagactttatttgagtataaatttgagttcctgagagtggtgtgcaaccacgagcactatatcccacttaacctgccgatgccgtttggaaaaggacgcatccagcggtaccaggatctgcagcttgactattccctgacagacgagttctgtagaaaccacttcctggtgggcctcctccttcgagaggtgggcacggctctgcaagagttcagggaagtacggctgatagccatctcagtactgaagaatctcctgatcaaacacagctttgacgatcggtacgcgtctaggtcccaccaagccagaattgcaacattgtatctcccacttttcgggctgttaatagagaatgtgcaacgtatcaacgtgcgagatgtcagcccatttcctgttaatgctgggatgactgtaaaagatgaatccctcgccctgcctgcagtcaaccctttagtgaccccgcagaagggctccacactggataattcacttcataaggatctgttgggtgcaatatccggtatcgctagcccctacaccacttccaccccaaatatcaactctgttcgaaatgccgattccaggggttctcttatatctacagacagcggcaactctctaccagagcgcaattcagaaaaaagtaactctctcgacaaacaccagcaatctagtacactcggcaattccgtggtgcggtgtgataagctagaccagagcgaaattaaaagcttgctgatgtgtttcctctatatccttaaatccatgagtgacgatgccctctttacatactggaacaaggcctcaaccagtgagttaatggacttctttaccatttcggaagtctgcctgcaccagtttcagtacatgggcaagcggtatattgcccggactggaatgatgcatgcccggctccagcagctcggaagtctcgataatagtttgacatttaatcattcgtatggtcattccgatgccgatgtgcttcaccaaagccttctcgaagctaatatagcgactgaggtgtgcttaacagctttggatactctgagcctgttcacccttgcctttaagaaccagctgttagctgaccatgggcacaaccccttgatgaagaaggtgtttgatgtttacctctgctttctgcagaagcatcagagcgaaacagctctgaagaatgtgtttaccgcgttgcggagcctcatttacaaattccccagtaccttctacgagggaagggccgatatgtgtgcagcattgtgctacgaaatcctcaaatgttgcaatagtaaactaagtagtattagaaccgaagctagtcagctgctatacttcctgatgcggaacaattttgactacactggaaaaaagtcatttgtccgcacacatctgcaggtgattatttccgtgagccaactgattgctgacgttgtcggcataggcggcaccaggttccagcagagtctgagtatcataaataactgcgctaactctgatcgactcattaagcacaccagtttcagctcggacgttaaggatctcacaaagcggataagaaccgtcctcatggctacggcccagatgaaggagcacgagaatgatcctgaaatgctggtggatttgcaatattccctggccaagtcttacgcatcgacccccgaactgaggaagacctggttggactccatggcccgcatccatgtcaagaacggagacttgtcagaggcagccatgtgctatgtacacgtgacagcactggtggccgaataccttacaaggaaagaagctgtccagtgggagcctccactcctcccgcactcccatagcgcctgtctcaggagaagccgcggaggggtctttcgacaaggctgcaccgcgtttcgagtcatcaccccaaatatcgatgaagaggcttcgatgatggaggatgtggggatgcaagatgttcacttcaatgaggacgtgcttatggaactcctcgaacagtgtgcggatggtctgtggaaagcggaacgctacgaattgattgccgacatttacaagctgattatccccatttatgaaaagaggagagattttgaacggctcgcccatctgtacgacaccctgcaccgtgcatattccaaggtcacagaggtaatgcactcaggacggaggctcctgggtacctactttagggttgcattctttgggcaggcagcccaataccagttcacggacagcgaaactgatgtagaggggttctttgaagatgaggacggtaaggagtatatttacaaagaaccaaaactgacacccctgtccgaaataagccagagactgctgaaactctattccgacaaatttggatccgaaaacgttaagatgattcaggattcggggaaagtcaatcccaaagacctcgatagcaaatacgcatatatccaggtcacccatgtaatcccatttttcgatgaaaaggagctacaggagcggaagaccgaattcgaaagatcccataacattcggcggttcatgtttgaaatgccatttacacaaaccggtaagcggcaggggggagtggaggaacagtgcaaacgccgtacaatcctcaccgctatccattgttttccctatgtaaagaaaagaatccccgtgatgtaccagcatcataccgatctgaatccgatcgaagtggctatagacgaaatgtcaaagaaggtggcggaactgcggcagctgtgtagtagcgcagaggtcgacatgataaagctccagctgaagctacaggggtcagtgagtgtgcaggttaatgccggaccactggcctatgcccgcgccttccttgatgataccaacaccaagaggtacccagacaacaaagtgaaacttcttaaggaagtctttcgccagttcgtagaggcttgtgggcaagccttggctgtgaacgaacgactgattaaggaagaccagctggagtaccaggaggagatgaaggcaaactaccgcgaaatggcaaaagagctcagtgagattatgcacgagcagttgggctag

SEQ ID NO: 29208 - DNA, 3030 bp, Artificial Sequence
  Description of Artificial Sequence: Synthetic coding sequence
atgccgtttggtaagggacgcatacagcgttatcaagcatttctgagtccaactgtcgagtcaaacgacacaccagtggatctgcagctggattactccttgaccgatgagttttgcaggaatcatttcctggttggattacttctgcgggaggtaggcaccgcactgcaggagttcagagaggtgaggttgattgcaatttctgtcctcaaaaatttactgattaagcattccttcgatgatcgatacgcctcccggtctcaccaagccaggattgcgaccctgtacctgcctctgtttgggctcctcattgagaatgtgcagcggattaacgttagggacgtgtccccctttccagtgaacgcaggtatgacagtcaaggatgaatcactcgctttaccagcagtcaatccccttgtcactccccagaaaggctcaaccttggacaattcccttcacaaggacctcctgggagcaatctccggtatagcctctccatacacaacttccacgccaaatataaactcagtgagaaatgcggatagtcgagggagtctgatctccacagattcaggcaactctctgccggagcgaaacagcgaaaagtccaactctttggataagcaccaacagtccagcacactggggaattccgtggtgaggtgcgataagctcgaccaatcggaaattaagtcactccttatgtgttttttatacatcttaaagagcatgagcgacgacgccctgtttacatactggaataaggcctccacaagcgagctgatggacttcttcactattagcgaggtgtgcctgcaccagtttcagtacatgggcaagcggtacatcgctaggacagggatgatgcatgcgcggcttcaacaacttggttcactggacaacagcttaacattcaatcatagctatggccactctgatgcagacgtgctgcatcagtcattattagaggctaacatcgctaccgaagtgtgtctgacagccctggatacattgagcctttttacactggctttcaaaaaccagttgctcgcagatcacgggcataatccactgatgaagaaggtttttgacgtctacctgtgttttctgcagaaacatcagtccgagacagccctgaaaaacgtgttcaccgcactccgctctctcatttacaaatttccatctaccttctatgagggccgtgctgacatgtgtgcggccctttgctatgagatcttaaagtgttgcaattctaagctgtcctccatcaggactgaggcttctcaactactgtatttccttatgcggaacaacttcgactatacgggcaaaaaaagcttcgtgcgtacccacctgcaggtgatcatcagcgtgtctcagctgattgctgacgttgtgggaatcggtggtactcgatttcagcagtcactgagcatcatcaacaactgtgcgaattctgacagattgattaagcatacttcattcagttccgacgtcaaagatttaacaaaacggattaggactgtgctgatggctaccgcccagatgaaggagcacgagaatgatccagagatgctcgtggacctccaatatagtctggccaagagctacgcatcaactccagagctgaggaaaacgtggctcgatagcatggctagaattcacgtaaaaaatggcgacctgtcggaagccgcgatgtgctacgtacatgtcaccgctctcgtggcagagtacctgaccagaaaaggagtgtttcgccagggctgtactgccttccgcgtgatcacgcccaacattgacgaggaagcctcgatgatggaggacgtcggcatgcaggacgttcatttcaacgaggacgtcctgatggagctcttagagcagtgcgctgatggcttgtggaaagctgaaagatatgagctgattgctgatatatataaactaataattcccatttatgaaaaaagacgggacttcgaacgcctcgcccacctgtatgataccctgcacagagcctattcgaaggtgactgaagtgatgcacagtgggagacggctgttgggaacatactttcgcgtcgccttcttcggccaggccgctcagtatcagtttaccgactcggaaactgatgtggaaggattttttgaggacgaggatggcaaagaatacatttacaaggagccaaaactgactcctctcagtgagatctcgcagagacttctgaagctgtattctgacaagtttggctcagagaacgttaagatgattcaggacagtggcaaggtcaatccaaaagatcttgattctaaatatgcctatattcaggtcactcacgtaattccattcttcgatgaaaaggagcttcaggagcggaagactgaatttgagagaagtcacaatatcaggaggttcatgtttgaaatgccgtttactcagaccggcaagcggcagggaggagtggaagagcaatgcaagcgaagaactattttaacagccatccattgctttccatacgttaaaaaacgtattccagtaatgtatcagcatcacacagacctgaatcccattgaagtggccattgacgagatgtcaaagaaagtcgccgaactcaggcaactgtgtagcagcgccgaggtggatatgattaagctacagttgaaactgcaaggatctgtgagtgtgcaggtgaacgctggtcctttggcgtacgcacgggcgttcttagacgacaccaataccaagcggtaccctgataacaaggtgaagttactcaaagaggtttttcgccagttcgttgaagcttgcggacaggccctcgcggttaacgagcgcctcatcaaggaagaccagctagagtatcaggaggaaatgaaggcaaattaccgagaaatggccaaggagcttagcgaaatcatgcacgagcaggttcgaagaagcgcaccgtggcggagaaggcgggcctcttacaggatcccattcacttcttcaaccccgtcggtgggactgcagcaagcacagtggtttacagggtag

SEQ ID NO: 29209 - DNA, 2010 bp, Artificial Sequence
  Description of Artificial Sequence: Synthetic coding sequence
tagtttaaaaaccagctcctcgccgaccatggccacaatcctctgatgaagaaagtcttcgacgtatatctgtgtttcctgcagaagcaccagtccgaaacagcccttaaaaatgttttcactgccttgcgctccctgatctataagttcccttccacattctatgaaggcagggctgacatgtgtgccgccctatgttacgagattctgaagtgctgcaattctaaattgtcttccatccggaccgaagcaagtcagctactatattttctgatgagaaacaactttgactatacaggcaaaaaaagttttgtccggacacacctccaggtaatcatctctgtatctcagctgatcgcagatgtggttggaattgggggtaccagatttcagcagtctcttagcattatcaataactgtgcaaattccgatcggctgattaaacacacgtccttttctagcgatgtgaaagacctaaccaagcgcataagaacagtgctgatggccactgcccagatgaaggaacatgaaaatgatcctgagatgttagtcgacctgcagtactctctggcgaagagctacgctagcacacctgagttgcgtaaaacttggctggatagtatggccaggattcacgttaaaaacggagacctgagcgaggcagccatgtgctacgtccacgtgactgccctggtggcggagtaccttacccgcaagggagtgtttagacaaggatgcacagcattccgcgtgatcacccctaacattgatgaggaagcttctatgatggaggatgtcgggatgcaggatgtccattttaatgaagacgtcctaatggaactgctggagcaatgtgctgacggcttgtggaaagcagagcgttacgagctaatagccgatatatacaagctgattatccctatctatgaaaaaagacgcgattttgagcggctggcacacctgtacgatacacttcacagggcttacagcaaagtgacagaggtgatgcacagtggccgccggcttctaggaacttattttcgtgtggcttttttcgggcagcagtaccaattcaccgactccgaaacggatgtcgaagggttcttcgaggacgaggacggaaaggaatacatctacaaggagccaaaattgacccctctctctgagatctctcagcgtctcctgaaactatacagcgacaagttcgggtcagaaaacgtgaagatgatccaagactccggaaaggttaaccctaaagatttagacagtaagtacgcctacattcaggtcacacacgttatacccttctttgatgagaaagaactgcaagagcggaagacagagttcgaaagatcacacaacatcaggcgatttatgtttgaaatgccgtttacccagacaggcaaacggcaggggggtgttgaggagcagtgtaagcggaggactattctcacggccatacactgtttcccctatgtgaagaagagaattcctgttatgtaccagcaccacacggacttaaatccaatcgaggtagccattgacgagatgtctaagaaagtggccgagttgcgccagctgtgttccagtgctgaggttgacatgatcaaattgcagctcaagctgcaaggctcagtttcggtccaggttaatgctggcccccttgcctacgctcgagcgtttctggatgatactaacacaaaacgctaccccgataacaaggtaaagctgttgaaagaagtgtttaggcagtttgtggaggcatgtggccaggctctagcagtaaatgaaagattgatcaaggaggaccagttggagtatcaggaagagatgaaggcgaattaccgcgagatggcgaaggagctgagtgagattatgcacgagcagatctgccctctagaggagaaaacaagcgttctgcccaatagcttacacattttcaatgctatctccggtactccaacttcaactatggtgcatgggatgaccagcagctcatctgtggtgtag

SEQ ID NO: 29210 - DNA, 6240 bp, Artificial Sequence
  Description of Artificial Sequence: Synthetic coding sequence
atgtcccagccccctctgctccccgcgtcagccgaaactcggaaatttacaagagccctttcaaaacccggcactgctgctgaactgcgccagtcagtttctgaggtggtgagaggctcggtgctgctggctaagcccaaattaatagagcccttagattacgaaaatgtgattgtgcagaagaagacccaaattttgaatgactgcctacgcgagatgcttttgttcccttacgacgactttcagactgccatcctgcgtcgacagggacggtatatctgcagcaccgtgcccgccaaagctgaggaggaggctcagagcctgtttgtgacagaatgcatcaagacttacaactccgactggcatttggtgaattacaagtacgaggattattctggtgagttcaggcagctgcccaacaaggtcgtcaaactggacaaactgcccgtgcacgtttacgaggtggacgaagaggttgataaggacgaagacgccgcttctctgggatcacaaaagggtggcataacgaagcacggatggttatacaaaggcaacatgaactctgccatatccgtgaccatgcgctcttttaagcgaaggttcttccacttaatccaacttggggatggctcgtacaatctcaacttctataaagatgaaaagatttcaaaagaacccaaaggctcaatctttctggatagttgtatgggagtcgtgcaaaataataaggtgaggcggttcgcgttcgagctcaagatgcaggataagtctagctatctactggccgccgactccgaggtggagatggaggagtggattacaatcctgaacaagatcttgcaactgaacttcgaggctgctatgcaggagaagaggaatggcgactcgcacgaggatgacgaacagagcaaactggagggatccggcagcggactagattcttacctgcccgaattggccaagtctgctagagaagcagagattaagctcaagtctgagtcaagggtcaaactcttctacctcgatcccgacgctcagaagctcgatttcagctccgccgagcctgaggtcaaatcattcgaagaaaagtttgggaagaggattcttgtgaaatgcaatgacttgagcttcaaccttcagtgctgcgtagccgagaatgaggagggcccgacaaccaacgtggagccattctttgtgacactgagcctcttcgacatcaaatataatcgcaagataagcgccgactttcacgttgatctgaaccacttctcggtgcgacagatgcttgccaccacatctcctgccctcatgaatgggtctggtcagagtccctccgtgctcaaaggcattctgcatgaggcagccatgcagtacccaaagcagggcattttttccgtcacctgcccgcaccccgatatttttctggttgcacggatcgaaaaggtgctgcagggttccattacccactgtgcagaaccttatatgaagtcctcagactcctcaaaggtcgcccagaaggtactgaagaacgctaagcaggcctgtcagcgacttggacagtaccggatgccctttgcatgggcggcacggacactgtttaaagatgcgagtgggaacttggataaaaatgcgaggttctccgccatttatcgtcaagacagcaacaagttgagcaatgatgatatgctcaagctgctggccgacttccgcaaacccgagaagatggcgaagctgcccgtaattcttggcaacttggacatcaccatcgacaacgtgtcttctgacttcccaaactacgtcaactcgtcctacattcctactaaacagttcgaaacttgcagtaaaacgcccattacttttgaagtcgaggaatttgtcccttgtatacccaagcatactcagccctatacaatctatactaaccatctgtacgtctaccctaaatacttgaagtacgattcccagaagtcatttgctaaagcccggaacatcgccatttgtattgaattcaaggactcagacgaagaggattcacaacccctgaaatgcatttacggcaggcccggaggccccgtgttcactcgatccgctttcgcagcagtgctgcatcaccaccagaacccagaattctacgatgaaatcaaaattgaattaccaactcaattgcacgagaaacaccacctgctcctgacattctttcacgtctcctgtgacaactcttcgaagggatcaacaaagaagcgggacgtggtggaaactcaagttggttacagctggcttcctctgctcaaggatggccgtgtggttacctctgagcagcatattccagtctctgctaacctgccatcaggatacctagggtaccaggaactcggcatggggcggcattatgggcctgagatcaaatgggtcgacggcggcaaacccttgctgaagatctcgacccatttggtgagtactgtttatacgcaggaccagcacctgcacaacttctttcagtattgccagaagacagagtcaggagcccaggccctgggaaatgagctcgtgaagtacctcaagtctctacacgcaatggagggccatgtcatgatagcattcctgccaactattctgaatcagttgttcagggttctaacacgtgcaacacaggaagaagtggcagtgaacgtgacacgcgttattatacatgtggttgcccagtgccacgaagagggacttgagagccatcttcgctcttacgtcaagtatgcatacaaagccgagccctacgtggcgagcgaatacaaaacggtgcacgaggaactcaccaaaagcatgaccaccatcttgaagccgagtgccgactttttaacctctaataagctgttgaaatattcatggttctttttcgacgtgctcattaaaagcatggcacagcacttaatcgaaaacagcaaggtaaagctgctcaggaaccagcgcttcccagcttcataccatcatgccgtggagaccgtcgtgaatatgctgatgccacatattacgcaaaagttcagagacaatcctgaggcctctaaaaatgctaatcatagcctggccgttttcataaagagatgttttaccttcatggaccgtggatttgtgttcaagcagatcaacaattatattagttgctttgctcccggcgacccaaagactctctttgagtacaaattcgagtttctccgggtggtttgtaaccatgagcactacatccctctgaacctgcccatgcctttcggaaagggccggattcagcggtaccaggacctgcagctggactatagtttgacggatgagttttgtcgaaaccacttccttgtggggctgttactgcgtgaggtgggtacagccctgcaggaatttcgtgaagtacgtctgatcgctatttcagtgctgaagaatcttttgatcaaacacagctttgatgatcggtatgccagcagatcccaccaggcccgaattgccacactgtacttgcctttgttcggactgctcatcgagaatgtccaaagaataaatgtacgcgacgtctcccctttccccgtcaacgcaggaatgactgtaaaggacgaatctctggccctccctgcagtcaatccactagtcacgccacagaagggcagcactctcgacaactccttgcacaaggatctgctgggagctatttctggtatcgcttctccctacaccacgtccacgcccaacatcaacagcgtcaggaatgccgactcccgggggagcctgatcagcaccgactccggcaatagccttccagagcgtaattctgagaagtcaaactccctggataagcaccagcaatcctcgactttgggaaattccgtggttcggtgtgacaaacttgaccagtcggaaattaagtctctgctcatgtgcttcttatatattctgaaatcgatgtctgacgatgcactgtttacttactggaataaggctagtactagtgaactcatggacttttttacaatatccgaggtctgtctgcaccagttccaatacatgggcaaaaggtacatcgcccggaccggcatgatgcatgcgcggctccagcagctggggtccctggacaactcgttgacattcaatcactcctatggtcactccgacgcagacgtactccatcagagcttgctggaagcaaacatagccaccgaagtgtgtctcacggccctcgatacgttgagccttttcacactggcctttaaaaatcaactactggctgaccacggtcataacccactcatgaagaaggtgttcgacgtgtacctctgctttttacagaaacatcagtccgaaactgccctcaagaacgtgttcacggccctgagatctttgatttacaagttcccgagcacattctatgaggggagagccgacatgtgcgcagctctctgttacgagatcctcaagtgctgcaactctaagctgtcaagtatacgcaccgaagctagccagttgctctattttcttatgcgtaacaattttgattatactgggaaaaagtcttttgtcagaacccacctccaggtgatcatcagcgtgagccagcttatagccgacgtagttggaattgggggaacgaggtttcagcagagcctgagtataataaacaattgtgctaactcagacaggctaattaaacacaccagcttctctagcgacgtgaaagatttgaccaaacggatccggaccgtcctaatggctacagcccagatgaaagagcacgaaaacgacccagagatgctagtggacctccagtactcgcttgctaagagctacgcctccactccagaactcagaaagacctggctggacagcatggccaggattcacgtgaaaaacggcgacctgagtgaggccgccatgtgttacgtacacgttactgccttagtggctgagtacttaaccagaaaaggggtcttccgtcagggttgtaccgccttcagggtcatcacaccgaatatagatgaagaggcatccatgatggaggacgttggtatgcaggatgtgcacttcaacgaagatgttctgatggaactgctagagcagtgtgcagacgggctgtggaaggccgagagatatgaactcatcgcagatatatacaagttgatcatccccatttacgaaaaaaggcgcgattttgaacgcctcgcccacttgtatgacacacttcaccgggcttactccaaggtgactgaagtgatgcacagcgggcgacggctcttggggacctactttcgcgttgccttctttgggcaggccgcgcaataccagttcaccgactctgagacagacgttgagggtttcttcgaggacgaggatggtaaggagtacatatataaggaacctaagctaaccccgctctctgaaatcagtcagcgcctcctcaaactgtactcagataagttcggctccgaaaatgtgaagatgatacaggattccggaaaggtgaacccgaaggatttggactccaagtatgcttacatccaggtgacacatgtcattcccttttttgatgaaaaggaactgcaagaacgcaaaactgagtttgaaagatcacacaacattaggcgttttatgtttgagatgcccttcacgcagaccggcaaaagacaggggggagtagaagagcagtgtaagagacgcacgatcctcaccgctatccattgtttcccatatgtaaagaagagaattccagtgatgtaccaacaccacactgacttgaatccaattgaggtagccattgatgagatgtcaaagaaagtcgccgaactccgccagttatgcagcagcgccgaggtcgatatgattaagctgcagctcaaacttcaagggtctgtgagcgtgcaagtcaacgccggacccctcgcctatgcacgcgcattcctcgatgataccaacactaagcgctacccagataacaaggtgaagctgctgaaagaagtgtttcgtcagtttgtggaggcctgcggacaggctctggccgtcaacgaacgattgataaaggaggaccagctcgagtatcaagaggagatgaaggccaattaccgggaaatggccaaggagctctctgaaattatgcacgagcaggtaaggaggagtgcaccctggcggaggcgccgggccagctacaggatccctttcacatcctccactccttcggtggggctgcaacaggctcagtggtttacaggttag

SEQ ID NO: 29211 - DNA, 1173 bp, Artificial Sequence
  Description of Artificial Sequence: Synthetic coding sequence
tagcagatgaaagagcacgagaacgaccccgagatgcttgtggatcttcagtactctctggccaagtcctatgcaagcacaccagaactccgcaagacatggttggactccatggctagaatccacgtgaagaacggtgacctgagtgaggctgccatgtgctacgtgcatgtcaccgctctggtagccgagtacttgactcgcaaggaggccgtgcaatgggagccccctctgctccctcactcccacagcgcctgtctgagaagatcacgtgggggagtcttccggcaaggctgcacagcattccgggtaatcacccctaacatcgatgaagaagccagtatgatggaggacgtgggcatgcaggatgtccatttcaatgaggatgtgctgatggaattactggagcaatgtgccgatggtttatggaaggcagaaaggtacgagcttatagccgatatatataaactgatcattccaatctatgagaaacgtcgagattttgaaagactggcccacctgtacgacaccctccatagagcttattctaaggtaacagaagtgatgcactcaggccgtaggcttctgggaacatactttagagtggctttctttggccagggctttttcgaagatgaagatggcaaggagtacatctacaaagaacccaagttgaccccgttaagcgagatctcccagaggctgctgaagttgtactccgacaagtttgggtcagaaaatgttaaaatgatacaggactcggggaaggtcaaccctaaggacctggactcaaaatacgcttacatccaggtgacacatgtaattcctttttttgatgaaaaagagctgcaagaacgaaaaaccgagtttgagcggtcacataacatcaggcggttcatgttcgaaatgcccttcactcaaacaggtaagcgtcaggggggtgtcgaggaacagtgtaagaggcgtacgatcttaaccgctattcactgtttcccttacgtgaagaagaggattccagtgatgtatcagcaccacaccgaccttaacccaatcgaggtggccattgatgagatgtctaagaaggtggctgaactccggcagctttgttcatccgcagaagtcgacatgattaaactccaattaaagctgcagggcagcgttagcgtccagtag

SEQ ID NO: 29212 - DNA, 588 bp, Artificial Sequence
  Description of Artificial Sequence: Synthetic coding sequence
atgagccaaccccctctgttgccagcatctgctgaaacgcggaagtttacccgagctcttagcaaaccaggcactgctgcagagcttagacagagtgttagcgaagtcgtccgcggatccgtactgctcgcaaaacccaagctaattgaacccctggactatgaaaatgtgatcgttcagaaaaaaacacagatcttgaatgactgcttgcgcgaaatgcttctttttccctacgacgatttccaaaccgccatcctgaggcggcaggggcggtatatttgctcaactgtcccagctaaggcagaggaggaagctcagtctctgtttgtcactgaatgcattaagacatataattccgattggcacctggtcaattataagtatgaagattactctggcgaattcagacaactgcccaataaggtagtcaagctcgacaagctgcccgtgcatgtttacgaggtggatgaggaagttgataaggatgaagacgccgcctcactgggaagtcagaagggcggtatcacaaaacatgggtggctgtataagggcaatatgaactcagctattagcgtgacaatgcgctag

SEQ ID NO: 29213 - DNA, 6306 bp, Artificial Sequence
  Description of Artificial Sequence: Synthetic coding sequence
atgcaagcagacaagtgcaggacatcgtctcgcagcgtaaagaaggagctagtgatcgaatctcctctccagtacaaggatgccgcacagggtgaggtcgaagcagaaagccccggcccagtgcctgctaaacctaagctgatagagccgttagactatgaaaacgtcatagtgcaaaaaaagactcaaatccttaacgattgtctcagagaaatgctgctgtttccctatgatgactttcagaccgcaattctccgtcggcagggcaggtatatctgctcaactgtgcctgccaaagctgaggaagaggcccagtccctgttcgtgacagagtgcattaagacttacaatagcgattggcacttggttaattacaagtacgaagattacagtggagaattcagacagttgccaaataaggtggtgaagttggacaaactgccagtgcatgtctacgaagtcgatgaagaggtggacaaagatgaagacgcagcttcactagggtcccagaagggcggcataacaaagcatggatggttgtacaagggaaatatgaactcagctatttctgttacaatgcgctctttcaaacggagattcttccatctcatccagttaggcgatgggtcttacaacctgaatttctacaaagatgagaaaatttctaaggagccgaaaggctccatctttctggactcatgtatgggagttgtgcagaataataaggtgcgccgcttcgctttcgaactcaaaatgcaggacaagtctagctatcttctggcagccgattcagaggtcgagatggaggaatggattacgatactcaacaagatactccaactgaactttgaggccgctatgcaagagaaaaggaatggtgatagccatgaagacgacgagcaatccaaactcgaaggatcaggatccggactggactcctacctccccgaactggccaagagcgcccgggaggccgaaatcaagcttaagtctgagagtagggtcaaactcttctacctggatccagatgcccaaaagctggacttctcgtcagcagaaccagaagtcaaatccttcgaagagaagtttggcaagcgaattctggtgaaatgtaacgatctttcgttcaatttacagtgttgtgtcgcagaaaacgaggaggggccaaccaccaacgtggagccttttttcgtgaccttgtcattatttgacatcaaatacaaccgaaagatttcagcagatttccatgtggacctgaaccacttctccgttagacagatgctcgcaacaacaagcccggcactcatgaatggcagcggtcaaagcccctcagttctgaagggcattctccacgaggccgccatgcagtatccaaagcagggtatattttcagtgacatgcccccatcccgatatctttctggttgccagaatcgaaaaggtgcttcaaggctccatcacacactgtgctgagccttacatgaaatcctctgacagctcaaaggtggcacagaaggtgcttaagaacgcaaagcaagcctgccagcggctgggccagtaccgcatgccattcgcctgggcagcccgaacgctattcaaagatgcaagcggcaacttggataagaatgccagattctccgccatctacagacaagacagtaataagctttccaatgacgatatgctgaaactgcttgcggatttcagaaagccggagaagatggccaaacttcccgttatcttgggaaacctcgatatcacaatcgacaatgtgagcagcgacttcccgaactacgtgaattcctcctacattcctacaaaacagtttgaaacttgttctaaaactccaatcaccttcgaagtagaggagtttgtgccctgcatccccaaacacacacagccctacactatctacacgaaccatttgtatgtgtaccccaaatatctcaaatacgattcccagaagtcattcgccaaggcccgaaacatcgcaatttgcattgagttcaaggactcagacgaggaagattcacaacctctcaaatgtatttacgggagaccaggcggacccgtcttcactaggtctgcctttgctgccgtcttgcatcaccaccagaatcctgagttttatgatgaaattaagattgaactccctactcagttgcatgagaaacatcacctgctgctaacgttttttcatgtgtcctgtgataattcatccaagggctcaactaaaaagcgggatgtggtagagactcaggtagggtattcttggttacctttgctgaaggacggacgggttgttacaagcgagcagcatatcccagtatctgcaaacctaccctctggctacttgggatatcaggaactgggcatggggaggcattacggaccagagattaagtgggttgacggagggaagcccctgttaaaaatcagtacacacttggtttctactgtgtatactcaggatcagcacctccataacttcttccagtactgccaaaagaccgagtcaggcgcgcaggcactcggaaacgagctggtgaaatacctgaagtcattgcatgccatggagggacatgttatgatcgccttcctgccaacaatattgaaccagttattccgggtgctgacccgggccacccaggaggaagtggctgtcaatgtgacaagagtgatcatccacgtggtggctcagtgtcacgaagagggccttgagagccacctcagaagttatgtgaagtatgcttacaaggcagaaccatatgtggccagtgaatataagacagtgcacgaggaactgactaagtcaatgacaacgatcttaaagcctagtgcagatttcctgacttcaaataaactgttgaaatattcttggttcttttttgacgttttgattaagtctatggctcagcatttgattgaaaatagcaaagtgaagctactgcgtaaccagcggtttcctgcctcatatcaccacgcggtcgagaccgtcgttaacatgcttatgcctcatattactcaaaaatttcgggacaacccggaggctagcaagaacgctaaccacagcctggccgtctttataaaacgatgcttcacatttatggatcgcggattcgtattcaagcagattaacaactacatatcctgtttcgccccaggcgatccaaaaactctgtttgagtacaagttcgagtttctgagagtggtgtgcaatcatgagcactatattccattaaacctacccatgcctttcggcaaagggcgcatacagaggtatcaggatctgcaactggattactcactcactgacgagttttgtaggaatcacttcctggttgggctgctgttgagagaggtcgggactgctcttcaggagttccgcgaggtacgccttattgccatttcagtattgaagaacctgctgattaagcatagctttgacgatcgctacgcatcccggagtcaccaggcccggattgccaccctttatctgcccctgtttggcttactcattgagaatgtgcaacggattaacgtgagggacgtgagccccttccctgtgaatgcgggcatgacagtgaaagatgaaagtctggcactgccggccgtgaatcccctggttacccctcaaaagggatccaccctggataactcactccataaagatcttctgggtgcaatcagtggcatcgcctccccttatactacatccaccccaaatatcaactcagtgcgcaacgcggactcaagggggagtctgatttccactgattccggcaatagcttgccagaaaggaactccgagaagagcaacagtctcgacaagcatcaacagagttccactctgggaaactcagtcgtgaggtgcgacaaacttgatcaatcagaaattaaatcactgctaatgtgtttcctgtacatactcaaatcaatgtccgacgatgctttgttcacctactggaataaggcttccaccagtgagttgatggatttcttcacaatttctgaggtgtgtctccaccagtttcagtacatgggtaagcgttatattgccaggactggaatgatgcatgctcggcttcagcagctgggatccctagacaattccctgacatttaatcattcttacggccatagcgatgctgatgtactgcaccagagtctgctggaggccaatattgcgacagaagtgtgtctgactgccctggataccctgtcactttttacattggctttcaaaaaccagctgctggccgatcatggacataaccccctaatgaaaaaagtattcgacgtttatctttgttttctgcaaaagcatcagtccgagactgccttgaagaatgtgtttactgcgttgaggtctctgatctacaaattcccgtcaaccttttacgaaggacgagccgatatgtgtgccgctttgtgctacgagattctcaagtgttgcaatagcaagctttcatccatccggaccgaggcgtctcagctactgtatttcttaatgcgtaataactttgactacactggcaaaaaatcctttgttcgaactcacctccaggtgataatctccgtgtcccagctaattgccgacgtggtcgggatcggaggcaccagattccagcaatccctaagcatcataaataactgcgcgaacagcgatcgtcttataaagcacacctccttttcgagcgatgttaaggacctaaccaagagaatccggacagtcctgatggcaactgcccagatgaaagagcacgaaaatgatccagagatgttggtcgacttgcagtactccctggccaagagttatgcctctaccccagagttgagaaaaacatggttggatagcatggcacggatccacgtcaagaatggggacctttcagaggccgccatgtgctacgtccacgtgacagctttggtggcagaatatctaaccagaaaggaggccgtccaatgggagccgcctctgctgccccacagccactccgcgtgcttacgaagatctcgcggtggcgtctttagacagggatgcacagcattccgggtaatcacccccaatatcgatgaggaagcctctatgatggaggacgtcggcatgcaagatgtgcacttcaacgaggacgtgctgatggaacttctggagcagtgcgcggacggactgtggaaggccgagcgctacgaactgatcgctgacatctacaagctgattatcccgatttacgagaagcgacgggatttcgagcggcttgcacatttgtatgatacactacatagagcctactctaaagtgaccgaggtcatgcattctggccgccggctgctgggcacatactttagagtcgccttcttcggacaagctgcacagtatcagttcaccgacagcgaaaccgacgttgaggggttctttgaggatgaagacggcaaagaatacatctacaaggaacccaagctcacacccctgtctgaaatctcccaaagactcctgaagctgtattcagacaaatttggcagcgagaacgtaaaaatgattcaggattccggcaaggtgaaccccaaagatctggattcaaagtatgcgtatattcaagtcacgcatgtgattcccttcttcgacgaaaaagaactgcaggagagaaagaccgagttcgagcgttcccacaatattcgccgctttatgttcgagatgccatttacacagactggcaaacgccaggggggggtggaggaacagtgtaaaaggaggactatactcactgccatccattgctttccttacgtcaagaaacgaatacccgtaatgtaccagcaccatactgacctgaatccgattgaggtcgccatcgatgaaatgtcaaagaaagtggctgaactgcggcagctttgctcatctgccgaagtagatatgattaagttgcaactgaagctccagggctccgtgtcagtgcaggtgaatgcagggcccctggcttacgcacgcgccttcctggatgatacaaatacaaaaaggtatccggacaataaagtaaagctgctcaaggaggtgttcagacagtttgtagaagcctgcggacaggccctagctgtcaacgagagattaatcaaagaggaccagttggagtatcaggaggagatgaaggcaaactatagagagatggccaaggaactttccgaaatcatgcatgagcaggtaagacggtctgcgccgtggagacgtcgcagagcgtcctaccggattccctttacaagttccacccctagtgttggcctacagcaagcgcagtggttcacaggctag

SEQ ID NO: 29214 - DNA, 3762 bp, Artificial Sequence
  Description of Artificial Sequence: Synthetic coding sequence
atgcaggctgacaaatgtcggacctctagccgatccgttaaaaaagagttggtgattgaaagcccactccagtacaaagacgccgctcagggtgaagtggaagccgaaagtccagggccggtgccagccaagccaaaacttatcgagcctctggactacgaaaacgtcattgtccagaaaaagacacaaattttaaacgactgccttcgagagatgcttctgtttccctacgatgactttcagactgctatcctgcgccgacaggggagatatatctgttctaccgtcccagccaaggctgaagaagaagcccagagtctatttgtcactgagtgcattaaaacctacaactcagattggcatctcgtgaattacaagtatgaggactatagtggcgagttccgccagcttcctaataaggtggttaaactggacaagttaccagtacacgtttacgaagtcgacgaagaggtcgataaagacgaggatgccgctagtctcggatctcaaaagggaggaatcactaaacatgggtggctttacaaaggtaatatgaatagcgccattagtgtgaccatgcggagttttaaacgaaggtttttccacctgatccaactgggggacggcagctacaatttaaatttttacaaggatgaaaaaatatccaaggagccgaaggggtctatctttcttgattcgtgtatgggcgtcgtccagaataacaaggtgcgacggtttgcctttgaacttaaaatgcaagacaagtcatcttaccttctggccgcggatagtgaggtggagatggaggagtggataaccatcctgaacaagatcctgcagctgaattttgaggcagccatgcaggaaaagcggaacggagactctcacgaagacgacgaacagagcaaactagagggcagcggtagtgggctggactcttacctccccgaacttgccaagagcgctcgggaggctgaaatcaagttaaagtccgagtcacgtgtgaagttattttatctggatcccgacgctcaaaagctggatttcagttcagccgaacctgaagtgaagagttttgaggagaagtttggcaaaaggattctcgtgaagtgcaacgacctgtcttttaacctgcagtgttgtgtagcggagaacgaggaggggcccaccacaaatgtggagcccttctttgtgacactctccctgtttgatatcaaatataaccggaaaatatccgccgattttcatgttgatttaaaccactttagcgtccgccagatgttagccactacttctcctgcactgatgaatggctctgggcagagcccaagtgtcttaaaaggcattttgcacgaagccgccatgcagtacccaaaacagggaatcttttcagtgacatgcccacaccctgatatcttccttgtggccagaattgagaaagtgctccagggctcaattacccattgtgcagaaccatacatgaagtccagcgattcctcgaaagttgcacagaaggtattgaagaatgctaagcaagcatgtcaaaggctgggccagtatcgtatgcccttcgcctgggccgctcgaactttgttcaaagacgcatcagggaacctggataaaaacgctagattctccgctatctacaggcaggacagcaacaagctgtcaaatgacgacatgctgaagctgcttgctgactttcgtaaaccagaaaaaatggctaaactgcctgttattctggggaacctggatataactatcgataacgtgagcagtgattttcccaattacgtgaacagtagttacatccctaccaagcagttcgagacctgctctaagacgccaatcacattcgaagtcgaggagtttgtgccttgtatccctaaacacacccagccgtacacgatttacacgaaccacctctacgtatatcccaaatacctgaagtacgattcgcagaagtcattcgctaaggcgcggaacatagctatttgtatagagttcaaggattcagatgaagaagactctcagcctctgaaatgtatttatggacgccctggcggacccgtcttcacccgctccgcatttgcagcagttttgcaccatcaccagaatcccgaattctatgatgagatcaagatagagctgcccactcagctgcatgagaaacatcacttactgctgacctttttccacgtgtcttgcgacaattctagtaaaggcagcaccaaaaagcgagacgtcgtggagacacaggtgggatacagctggttgcccctgctgaaagatggtcgggtcgtgactagtgagcaacacatcccagtttcagccaacctgccaagcggttatttggggtaccaggagttggggatgggccgccattatgggccagaaataaagtgggtggacggcggcaagccacttctcaaaatttctacacatctcgtctccacggtgtatacacaggatcaacatctgcacaatttttttcagtactgtcaaaaaaccgaaagtggcgcacaggccctgggcaacgagctcgtcaagtacctcaagtctctgcatgccatggaggggcatgtgatgatcgcgttcctgccaaccatactgaatcagctcttcagggttttaaccagagccacccaggaggaagtagcggtgaacgtgacacgcgtcattattcatgtggttgcacagtgccacgaagaggggctcgagtcgcacttacgcagttatgtgaaatatgcgtacaaagccgaaccatacgtggcctccgagtacaaaacggtacatgaggaactgaccaaaagcatgacaacaatcctgaaaccctctgctgattttctcacgagcaataagctgctgaaatacagttggttcttcttcgatgttctgataaagagcatggcgcaacacctcatcgagaacagcaaggtaaagcttctcaggaaccagagattcccagccagttatcaccacgctgtagagaccgtggtcaatatgcttatgccacacatcactcaaaagtttagggataatccagaagccagcaaaaatgcaaaccactcgttggccgtctttattaagaggtgcttcaccttcatggatcgcggatttgtgtttaagcagatcaataactacatttcgtgtttcgcgcccggcgacccaaagaccctgtttgagtataaattcgagtttcttcgggttgtttgtaaccacgagcactacatccccctcaatctccccatgccattcggcaaaggaaggatccaacggtatcaggatctgcaattggactatagcctgactgatgagttttgtagaaatcactttctggtgggtctcctccttagggaagtcggtaccgccttacaagaatttcgtgaagtacggctgattgcgatttccgtgctgaagaatttactgattaaacactcatttgacgaccgctacgcctcccgatcccaccaagcaaggattgctacattgtatctacctctcttcggccttctgattgaaaacgtgcagcggattaatgtccgcgacgtctcaccatttcctgtgaatgctggcatgacagtgaaggacgaatcactagcactcccagcagtcaacccactcgttacaccccagaagggtagcactctggacaactctctccataaggacttacttggcgcaatcagtgggatcggtaatgctccctgctcctgtggcctgttatccactataacccttaaggtctcttggtcccagtag

SEQ ID NO: 29215 - DNA, 4182 bp, Artificial Sequence
  Description of Artificial Sequence: Synthetic coding sequence
atgggttgcaccacaagcgtgatcctgtttaaaggaattcgaacagttttcgaaagaaattgcgcctatatgtgcaaacagcaaggtgagaacaacgccctcgaatatactgcctacaattggaccaaggaggattctgagttgcttatctcaagctggctggctaagccaaaactgattgaaccactggactatgagaacgtgattgtgcagaagaaaacccaaatcttgaacgattgtttgagagaaatgctcctcttcccatacgatgatttccagactgctatcctgaggcgccaaggccggtacatatgttccacagtgcctgctaaggctgaagaggaggcccagtctctgttcgttacagagtgtatcaaaacttataactcagactggcacctggtgaattataaatatgaggattacagcggagagttcagacagctaccgaataaagtggtgaagcttgacaaacttcccgtccatgtctacgaagtcgatgaagaagttgataaagacgaagatgctgcttctctcgggtcacagaaaggcggaatcactaagcacgggtggctgtacaaaggcaacatgaattctgcgattagtgttaccatgcgctctttcaaacgtagattcttccacctcatccaactgggggatggatcttataacttaaatttttacaaagacgagaaaatctccaaggagcccaagggtagcatcttcctggattcctgtatgggtgtggtgcagaacaataaggttaggcggttcgcgttcgagttaaaaatgcaggacaagtcctcctacctcctggccgccgacagtgaagttgaaatggaagaatggataactatcctgaacaagattctgcagctcaactttgaggctgcaatgcaggaaaaacggaacggtgattcacacgaggacgacgagcaaagcaaactagaaggttctggctcaggtctggactcctacttacccgaattagctaagagtgctcgtgaagccgaaatcaagctgaagagcgagagccgggtgaaattattttacctggatccggatgcacagaagttggacttttcttccgcagaaccagaagtaaagtcgttcgaggagaaattcgggaaacgaattctcgtaaagtgcaatgatctgagtttcaatttgcaatgctgcgtggccgagaacgaagaagggcccaccacaaacgttgaacctttttttgtcacattaagtctgtttgacatcaagtacaacaggaaaatttcagccgactttcacgtggacttaaatcatttcagcgtgcgccagatgctggctactactagccccgcgttgatgaatgggtcaggacagagtccaagtgtcctcaaggggattttgcacgaggctgccatgcagtatcccaaacaaggtatcttcagtgttacatgcccacatccagatatattcctagtggctcggattgagaaggtgctgcagggctctataacccactgcgcggaaccctatatgaaaagctcagacagctctaaggttgcacagaaggtgttgaagaatgcaaagcaggcctgtcagcgtctgggtcagtacaggatgccattcgcgtgggccgcacgcaccctgttcaaagacgcctctggcaatcttgataagaatgctcgtttctcagctatctaccggcaggattcaaacaaactgagtaatgacgatatgctcaaactgttggctgactttcgaaaacccgaaaaaatggcgaagctgccagtcattctcggcaatttggatatcacaatagacaatgtctcttcagattttcctaactacgtgaacagctcctacattcctactaagcaattcgagacttgcagcaagactcccattacctttgaggtcgaagagttcgtgccttgtatccctaaacacactcaaccctacaccatatataccaaccatctatatgtgtaccccaaataccttaaatacgatagtcagaagtcgtttgccaaggcccggaatatcgcgatatgcatcgagttcaaggacagcgacgaggaggattcacagcctcttaagtgtatctacggcagacccggtggccctgtgttcacccggtccgcttttgcggcagtgctgcaccatcatcagaatccggaattttacgatgaaattaagatcgaactaccgacccaacttcacgagaagcaccaccttctgctcacgttctttcacgtgagctgcgataattcctcaaaaggctcaaccaaaaagcgagacgtggtggagactcaggtggggtatagttggctacctcttcttaaagacggccgggtcgtcacctccgagcagcacatcccggtgtcagccaatctcccttctggatatctgggctatcaggagctgggaatgggacgacactacggccctgaaataaagtgggtcgacggtggtaaacccttgctgaaaatctccacccacctggtcagcaccgtttatacccaggaccagcacctgcacaacttcttccaatactgccagaaaactgagtcaggtgcacaggcactgggcaacgagttggttaagtatctcaagtctctccatgccatggagggtcacgttatgattgcctttttgcccaccatcctgaaccaactgtttcgagttcttacgcgtgccacccaggaggaggttgctgtgaacgtgaccagagtcataatccatgtggtcgcccagtgccatgaagaaggcctggagagccacctccggtcctatgtcaagtacgcatacaaagctgagccgtatgttgccagtgagtacaaaacagtacatgaagaactcactaaaagtatgactactatactgaagccatcagcagacttcctgaccagtaacaaactactgaaatactcttggttcttcttcgacgtcttaattaagagcatggcacaacatctgattgaaaactctaaagttaaacttctgagaaaccagcgattcccagcctcttaccaccacgctgtggaaacagtggtgaatatgcttatgccacacatcacccagaagtttcgggacaatccagaagcctctaaaaacgccaaccacagcctggctgtgttcattaagaggtgcttcaccttcatggatcgtggatttgtgttcaaacagatcaataattatatctcatgttttgctcctggagatccgaaaaccctcttcgagtacaaattcgagtttcttcgggtggtgtgtaatcacgaacattacattccgctcaacctgccaatgccctttggtaaggggagaattcaacgatatcaggatttgcagctggattattcgttgaccgacgagttctgtcggaaccattttctcgttggactcctactgcgggaagtcggaacggctcttcaggagttcagggaggtccggctgatagccatctctgtcctgaagaacctactaatcaagcacagcttcgacgaccggtacgccagtcgatcccaccaggcccggattgcaactctttatctgcctctgtttgggctactcattgagaatgtccagagaataaacgtgagagacgtgagcccattccctgtgaacgcgggtatgacggttaaagacgagtcgctggccctgcccgctgtcaaccccctcgttactccgcaaaaagggagcacactagacaattcattgcataaggacctcctgggggccatcagtggaatagcatccccatatacaactagcacaccgaatataaacagcgtgcggaacgccgattcccgcggctcccttattagtactgactctgggaatagcctcccagaaaggaacagtgagaagtcaaattctctggataaacaccagcagtcctcaacgctggggaattcagtggtgcgctgcgacaagctggatcagtcagagatcaagtccctgctgatgtgtttcttatacatattaaagtcaatgtctgacgacgccttgtttacatattggaacaaagcatctactagcgaactaatggacttttttactataagtgaagtgtgtctgcatcagtttcagtacatggggaaaagatacatagcctcactaacgaaatgtgttgctctcctgctgccagcctggaacaggaatgatgcttgccagatcgctgccgccggtcaacctgggtag

SEQ ID NO: 29216 - DNA, 753 bp, Artificial Sequence
  Description of Artificial Sequence: Synthetic coding sequence
gccgatagccgcgggtctcttattagtactgactccggtaactccctgccagaacgtaactccgagaagagtaattcactggacaagcaccagcagtcttctaccctaggcaatagtgtcgtccggtgcgataaactggatcaaagtgagatcaaatccttacttatgtgcttcctctacatcctcaaatctatgtccgacgatgcattatttacctattggaacaaagcatcaacctcagagctgatggacttcttcacaattagtgaggtctgccttcatcagtttcagtatatgggcaaacgatatatcgctagcgtgcgcaaaatctcttcagtgctgggtatatcagtcgataacggttacggccactcagatgccgacgtgcttcaccagtcacttcttgaggcaaatatcgccactgaggtgtgtttgacagcgctggataccttaagcctgttcactcttgccttcaaaaaccagttactggccgaccacggccacaaccccctgatgaagaaggtatttgatgtctacctgtgttttctgcagaagcatcagagcgaaaccgccctgaaaaatgtttttacggcgctgagatctctaatttataagttcccttccacattttacgagggtcgcgccgacatgtgcgcagccctgtgctatgaaattttgaagtgctgcaactcgaagctaagctccatcagaactgaagcatcacagttactctactttttgatgagaaattag

SEQ ID NO: 29217 - DNA, 351 bp, Artificial Sequence
  Description of Artificial Sequence: Synthetic coding sequence
tgatcagaattgatggacttcttcaccatcagcgaggtttgcctgcaccaattccagtatatgggcaagcgatacatcgcaagaaatcaagaaggcctgggccccatcgtacatgatagaaaaagccaaaccctccctgtgtccagaaacaggaccgggatgatgcatgcccgtctgcaacaactgggtagtttggataacagcttaaccttcaaccacagttatggccattcagatgccgatgtgctgcatcagtcactgctcgaggccaatatcgcgacagaggtttgcttaactgccctggatactctatccctgttcaccctggcatttaaaaaccagctcttgtag

SEQ ID NO: 29218 - DNA, 612 bp, Artificial Sequence
  Description of Artificial Sequence: Synthetic coding sequence
aggaaaacgtggctcgactccatggccagaattcacgtgaagaatggtgacctgtccgaggcagcgatgtgctacgttcatgtgaccgcactcgtagccgaatacctgacgcgcaagggggtattccgacagggctgtacagctttccgcgtgataactcctaacatagacgaggaggcttctatgatggaagatgtcggcatgcaggacgtccactttaatgaagatgtgctaatggagctactcgagcaatgtgctgacggtttatggaaggccgaaaggtacgagttgatagccgacatttacaaattaataattccgatttacgagaagcggcgcgacttcgagaggttagcacatctctatgacactctgcaccgggcctacagcaaagtgactgaagtgatgcatagtgggcgaaggctgcttgggacctatttcagagtggcgttcttcggccaggggttctttgaggatgaggacgggaaagagtatatctacaaggaacccaaactgacgcctttatccgagatatcacaacggttgctgaaactttactctgataagttcgggagtgaaaacgtgaagatgattcaggacagcggtaaatag

SEQ ID NO: 29219 - DNA, 1122 bp, Artificial Sequence
  Description of Artificial Sequence: Synthetic coding sequence
atggccgagacgagggaggaggagaccgtttcagcagaagcgagcggctttagcgatctgagcgactctgaatttctggagttcctggatttggaagatgcccaggagtccaaggccctagtgaatatgccggggccctcctccgaaagtcttggcaaagatgataagcccatcagtctccaaaactggaagcgtggactcgacatcctctcacccatggaacggtttcatctgaagtacctctacgtcaccgatctcgctacccagaactggtgtgagttacagactgcgtacggtaaagagctccctgggttcttggctccagaaaaggccgcggtcctggatactggtgcatctattcacctggcccgcgagctcgaactgcatgatctggtcactgtacccgtgaccaccaaggaggatgcttgggctatcaagtttttgaacatcctgctgctgatacctaccctgcagagtgagggccacatacgcgagtttcctgtattcggcgagggagaaggcgtgctgttggtgggcgtgatcgacgagctgcactacaccgccaagggggagctggaactggctgagttaaagactagacgaaggcctatgttacccctggaagcccagaaaaaaaaagattgctttcaggtgtctctttacaaatacatttttgacgcgatggtgcagggcaaagtgactccagcaagcttaatccatcacacaaaattatgtctggaaaaaccactgggaccgtctgtgctgcggcacgcgcagcagggaggcttttcagtgaagtccttgggtgacctcatggagctggtgttcttgtctctgaccctgagtgatcttcctgtcattgatattctgaaaatcgagtacatccaccaggaaactgcgaccgtgctcggaacggaaatcgtggccttcaaggagaaggaagttcgcgctaaggtacagcactatatggcctattggatgggtcatagagagccccagggggtggacgtcgaagaggcttggaagtgtcggacatgcacatacgccgacatttgtgaatggcggaaagggtcgggggttctctccagcacactggctccccaggtgaagaaggccaaatag

SEQ ID NO: 29220 - DNA, 1122 bp, Artificial Sequence
  Description of Artificial Sequence: Synthetic coding sequence
atggccgagactagagaggaggagaccgtgtcggctgaggccagtgggttcagtgacctgtctgatagcgaatttttggaatttctggatttggaggacgcccaggagagcaaagccctagtcaacatgcctgggccttcctccgagagtctcggtaaagacgacaagcctatttctctgcagaactggaagagaggattggatatactctcccctatggagagattccatctgaaatacctatacgtcacagatcttgccacgcagaactggtgcgagcttcagaccgcttacggcaaagagctcccaggattcctcgcacctgagaaggccgccgtgcttgatactggcgccagcatccaccttgccagggaactggaactccacgatttggtgacagtgcctgttacgaccaaagaggacgcctgggccatcaagttcttaaatatcttactgctgattcctacgcttcagtcggagggccacatcagagagtttcctgtctttggagaaggagagggtgtgctgctggtgggcgtcattgacgagctgcactatactgcgaaaggagaactcgaactggctgagctcaagaccaggcgacgtcctatgttacctctggaagctcagaaaaaaaaggattgcttccaggtgagcctatacaaatacattttcgatgccatggtgcagggtaaggtgacccctgcctccctgattcaccatacgaagttgtgtctggaaaaacccctggggccctctgttctccgccacgctcagcaggggggcttctcagtgaaatctctgggagacctaatggagctggtttttctctcactgacactcagcgatctgcctgttatcgatattctcaagattgagtatattcatcaggaaacggcaacggtcctggggaccgaaatagttgcgttcaaggaaaaggaggtgcgcgctaaagtacagcactatatggcctattggatgggacaccgagagcctcaaggagtcgatgttgaggaggcttggaaatgcagaacctgtacctacgctgacatatgcgagtggcggaaagggtctggcgtcttatcttccaccctcgcccctcaggtgaagaaggccaagtag

SEQ ID NO: 29221 - DNA, 1122 bp, Artificial Sequence
  Description of Artificial Sequence: Synthetic coding sequence
atggctgaaacacgcgaagaagagaccgtaagcgctgaggcgtccgggttttccgacctatcagacagcgagtttctggaatttttagacttggaggatgctcaggagagtaaagctctggttaatatgcccggaccttcgtccgagtcactcggaaaagacgacaaacccatcagcctgcagaattggaagcgcggtctcgacatattgtctccaatggaacggtttcatttaaaatacctctacgtcaccgatctcgccacacagaactggtgtgagcttcagactgcctacggcaaggagctgcctggtttcctggcccctgaaaaggcagcagttctggatacaggtgcctctatacacctggccagggagctcgagctgcatgatcttgtgaccgtgccagtcacaaccaaggaagacgcctgggccatcaagtttctgaacatacttctgctgatacccacccttcagagcgaaggccatatacgcgagttccctgtcttcggtgagggcgagggtgtattgctggtgggggtgattgatgagcttcattacacagctaaaggagagctcgagctcgctgagctgaagacccgaagacgccctatgctacctctcgaggcgcaaaaaaaaaaggattgtttccaggtatctttgtataagtacatttttgatgccatggtgcagggcaaggtcactccagcaagtcttatccatcataccaaattgtgtctcgagaagccactcgggcccagtgtcctgagacacgctcagcaaggtgggttcagtgtcaagagtctgggagatttgatggagcttgttttcctgtcactgacactatctgacctgcctgtgatcgacatcctcaagatcgaatacatccatcaagagacggccactgtccttggcacggaaatagtggctttcaaagaaaaagaagtgcgtgctaaggtccagcattacatggcttattggatgggccacagggaaccacagggcgtggatgtcgaagaggcctggaagtgcaggacttgtacttatgccgacatctgcgaatggaggaaggggagcggggtgttatcgagtaccctggcacctcaggtgaaaaaggcaaagtag

SEQ ID NO: 29222 - DNA, 486 bp, Artificial Sequence
  Description of Artificial Sequence: Synthetic coding sequence
atggcagagactcgagaggaagagactgttagcgcagaggctagtggctttagcgacctcagtgattctgagttcctcgaattcctggacctcgaggacgcccaggagtccaaagctctggtaaacatgcccggaccctcaagtgagagtttagggaaagatgataagcccatctcgctgcagaattggaaacgcggcctggatattctgtcaccaatggagaggtttcacctgaaatacctttacgtcacagaccttgccactcagaattggtgtgaattgcagacggcttacggaaaagagctacccgggttcctcgcacctgaaaaggcggcggtgcttgacaccggtgcctcaatacatttggctagagagttagagcttcacgacctggtaaccgttcctgtgacaactaaggaagatgcttgggccatcaaatttctgaatattctcctgttgattcccactcttcagagcgagggttag

SEQ ID NO: 29223 - DNA, 675 bp, Artificial Sequence
  Description of Artificial Sequence: Synthetic coding sequence
atggctgaaacaagggaggaggaaaccgttagcgccgaggcatcagggttttcggacctgtctgatagcgaatttcttgagttcttggatctcgaagacgctcaggaaagcaaagccctggtcaatatgccaggtccgagtagtgagagccttggtaaggatgacaaacccatttccttacagaattggaaaagagggctggacatcctatctccgatggaacggtttcatctgaagtatctgtacgtgaccgatttagctactcagaattggtgcgaactgcagactgcttacggtaaggagttacctggattcttggctccagagaaagcagcggtgctggatactggtgcttccatccacctcgcccgtgaactggagcttcacgacctggttaccgttccagtgacaaccaaggaagatgcctgggcaatcaagttcctaaacatcttgctgctcatccccacacttcagtcggaagggcacatcagggagttccccgtgtttggagagggcgagggggtcctcctggtgggagtaatagatgaactgcattacacagcaaaaggcgaattggagcttgctgaactaaaaacaaggcgccggcccatgctgccgttggaggcgcaaaaaaagaaagattgcttccaggtctcgctctataaatacatttag

SEQ ID NO: 29224 - DNA, 744 bp, Artificial Sequence
  Description of Artificial Sequence: Synthetic coding sequence
atggcggaaaccagggaggaggagacagtgtctgccgaggcctcaggtttctccgatctgtctgactcagaatttctggaatttttagatctcgaggatgcccaggaatctaaagctctggtgaatatgccaggaccctccagcgaatcgcttggaaaagacgataagcccatttctttacaaaattggaaacgaggcctggacatactgagccctatggaacgattccacctaaaatacctgtatgtgacggacctcgcgacccagaactggtgcgaactccagaccgcctatggtaaggagcttccaggcttcctcgcccccgagaaggccgcggtgttagatactggagcatctatccaccttgctcgcgaactggagctgcatgacttggtcacagtgcctgttaccaccaaagaagacgcctgggccattaagttcttgaacattctccttctcatccccaccctccagagcgagggacacatccgggagtttccggtatttggcgagggagagggcgtgctgctagtcggcgtgatcgatgagctgcactacaccgctaagggtgaactggagcttgccgagctcaagacacgacggcgtcctatgttgcccctagaggcccagaagaaaaaggactgttttcaggtgtcactctacaagtatatcttcgatgcgatggtgcaaggcaaagtaaccccagcgtctcttatccaccacactaagttgtgtctggagtag

SEQ ID NO: 29225 - DNA, 681 bp, Artificial Sequence
  Description of Artificial Sequence: Synthetic coding sequence
atggcagaaacgcgcgaggaggaaaccgtgtccgccgaggcctcgggattttccgacctcagtgacagtgagttccttgagtttctagaccttgaagacgcgcaggagagcaaggcactggtcaatatgccaggcccctcaagcgagagtctggggaaagatgataaacccataagtctgcagaattggaaaaggggactggacatcctctcacccatggagagattccaccttaagtatctctatgttacagatcttgctacacagaactggtgcgagctacagacagcttacgggaaggaactccccggcttcctggcgcctgagaaggcagccgtactcgacacaggagccagcatccatttggcccgggagctggaactgcatgatctggtcacagtccccgtcactacgaaagaggatgcatgggccatcaagtttttaaacatacttctgttgattcctaccctccagagtgaagggcatatcagagagtttccggtcttcggcgagggcgaaggcgtgctattggttggtgtcatcgatgagctccactataccgccaagggtgagctggagttagcagaactgaaaactcgtcgcagaccaatgcttccgctggaagcccaaaagaagaaagactgcttccaggtgtccctttataaatacatcttcgattag

SEQ ID NO: 29226 - DNA, 303 bp, Artificial Sequence
  Description of Artificial Sequence: Synthetic coding sequence
atggcagagacccgcgaggaagaaaccgtctctgccgaggccagcggattttctgacctgagcgacagcgagtttctggagtttcttgatttagaagatgcgcaggaatccaaggcactggtgaacatgccgggtcccagttcagaatcgctcggtaaagatgataagcctatctccctgcagaactggaagcgcggcctcgacattctctctcccatggaacgctttcacctcaaatatctgtatgttactgatctggctactcagaactggtgcgaattacaaacagcctacggtaagtag

SEQ ID NO: 29227 - DNA, 744 bp, Artificial Sequence
  Description of Artificial Sequence: Synthetic coding sequence
atggccgaaacccgggaggaggaaacagtgtctgccgaagcctccggattttccgacctgtccgattcagagttcctcgagtttctcgatctggaagatgcgcaggagagtaaagccctggtgaatatgcctgggccttcatccgagtccctgggcaaggacgacaagcctattagcctccagaactggaaacgtgggctggacatactgagccctatggaacggttccacctgaaatacttgtacgtgactgatctcgccacccagaattggtgtgaattgcagaccgcctacggaaaggagctaccaggattcctggccccagagaaggctgcggttctagataccggcgcatcaatccacttggctcgcgagcttgagcttcatgatctggtgactgttcctgtcactacaaaggaagatgcctgggcgattaaattcctcaatatactcctgctaatcccgactcttcagagtgaagggcacatccgagaattccccgtctttggggagggcgaaggagtgctgctggtgggtgtcatagacgagctccattacaccgccaagggagagttggagctggccgaattaaagaccaggaggagacccatgttgcccttggaggcacaaaagaaaaaagattgttttcaggtgtctttatataagtacatctttgatgctatggtacagggaaaagtgaccccagcctctcttatacaccacaccaaactgtgcttggaatag

SEQ ID NO: 29228 - DNA, 129 bp, Artificial Sequence
  Description of Artificial Sequence: Synthetic coding sequence
tgcagatcccaaaagtcttgctggattattaaggggcactgtcgaaaaaattgtaaacctggggagcaggtgaagaagccctgcaaaaatggtgactactgttgcattccctcgaatactgacagttag

SEQ ID NO: 29229 - DNA, 876 bp, Artificial Sequence
  Description of Artificial Sequence: Synthetic coding sequence
atggtgcgcgaacaatacacaaccgctaccgaaggcatctgcattgagcgaccggagaaccagtatgtatataagatcggcatctacggctggcggaagagatgtctatatttgttcgtcctcctgctgcttattatcctggtcgttaatctagctctgaccatctggatcttaaaagtaatgtggttttctccagccggcatgggccatctctgcgtgaccaaagacggcctgcgactggagggtgagtctgagttcctattcccactgtatgctaaggagattcattcaagggtagactccagtctcctgctccagagtacacagaatgtgacggtgaacgctaggaatagcgaaggtgaggtcactggaagactgaaagtgggacccaagatggtggaggtccaaaaccagcaatttcagataaattccaatgacggtaagcccttatttactgtggatgagaaagaggtggttgttggcaccgacaagctgcgcgtcaccgggccagaaggggccctctttgaacacagcgtggaaaccccgttggtaagggctgatcctttccaggatctgcgcctcgaaagtcctaccaggtcactgtcgatggatgcacccaggggcgtacacatacaagctcatgcagggaagatagaggcgctgtcacagatggatatcctcttccacagcagtgacggaatgctggtgctcgacgctgaaactgtctgtcttccaaaacttgtgcagggtacgtggggtccatccggaagctcccagtcgttgtacgagatatgcgtgtgtccagacggcaaactttacctcagcgtggcaggtgtctcgacgacctgtcaggagcacaatcacatttgtttatag

SEQ ID NO: 29230 - DNA, 816 bp, Artificial Sequence
  Description of Artificial Sequence: Synthetic coding sequence
atgaacctgcacgtaaagacattaagtctgatgacttggcgcagcagattcctggaagagagtttttggtccctagaagagacagccgcgttggcgaagcagttacccctgaaatctccttctgagaacatcttcttgcatatcgtggatctatctgacccaaaacaaatctggaaattcgtcgagaatttcaaacaagaacacaagctgcacgttctgattaataatgccgggtgtatggtgaataaacgtgaactgacggaggacggtctggaaaaaaattttgctgccaacactttgggggtgtacatcctcactactggactgattcccgttcttgagaaggagcacgaccccagagtcattaccgtgtcaagtggaggcatgctggtgcagaaactcaacaccaatgatttgcagtctgaaaggaccccattcgacgggacaatggtgtacgctcaaaacaagaggcaacaggtggtcctgaccgaacgctgggcacaaggtcatccggcaattcatttctcttcgatgcacccaggctgggccgacacgccagaccgcaatgaacaagagctaagaaaggtggtcggcgaagcacagacagcctcccctctcccccgtttcctggagattatgatgcacgagggaaaatgccaaccccaaggccatagttccaacgacctggaagcatgctggtcgtcaggcggtggcgaacagaattcacttcctgattggccgcaccagttgcacgacctgaggcagctgacatgggcactctgcagcagttttctgctttataaacaagggaactag

SEQ ID NO: 29231 - DNA, 954 bp, Artificial Sequence
  Description of Artificial Sequence: Synthetic coding sequence
atgtcgttgtatcgcagtgtggtgtggttcgccaaaggcctgcgagagtacacaaaatctgggtacgaatcagcttgcaaagatttcgtgccgcatgacctggaagtgcagatccctggacgtgtgtttctcgtgactggcggaaactctggaattgggaaggccacagccttggagattgcaaagcgggggggtaccgtgcatttggtttgccgcgaccaggccccagccgaggatgctagaggcgagatcattcgggagtctggcaatcaaaatatcttcctgcatatcgtcgatctatccgaccctaagcagatctggaagtttgtagagaattttaaacaggagcacaagcttcatgtgttgatcaacaatgccggttgcatggtgaacaaacgagagttgactgaagacggcctagaaaaaaactttgctgccaatacactaggagtctacattctcaccaccgggttgattcccgtgctggagaaggaacacgacccaagagtgataactgtgtctagcggcggcatgctggtgcagaaactgaacacaaacgacctgcaaagtgagcggacacctttcgacggcacaatggtgtacgcacagaacaaacgacagcaagtagttcttactgagcgctgggctcagggtcaccccgcgatccacttctcctctatgcatcccgggtgggccgatacacctggagttcggcaggcaatgcccgggttccacgcgagattcggcgatcgactgcgctcagaggctcagggcgccgatacgatgctttggttggccctttcttctgccgccgccgctcaaccttccgggaggtttttccaggatcgtaagcctgtgagcacacatttgcccctggctactgcctccagctccccagcagaggaggaaaagctgatagagatcctggagcagttggctcagacattcaagtag

SEQ ID NO: 29232 - DNA, 699 bp, Artificial Sequence
  Description of Artificial Sequence: Synthetic coding sequence
atgcagatggcgaggttgctggggctctgcgcctgggccagaaagtcagtccgcatggccagcagtcgcatgactcgccgagatcccctgaccaataaagtggccctcgtgaccgccagcaccgatggtattgggttcgcgatagctcgcaggttggcccaagatagagctcatgtggtggtgtcttccaggaagcagcagaatgtcgaccaggccgttgctaccttgcagggcgagggattgtccgtgacagggactgtttgtcatgtgggcaaggcggaagatagagaacggctcgtcgccatggccgtgaagttacacggcgggatcgatatcctggtttcaaacgccgcggtgaatccattctttggatccctgatggatgtaaccgaggaggtgtgggataaaacactcgatattaatgttaaggccccggccctcatgacaaaagctgttgtaccggaaatggagaaacgcgggggggggtctgtggtcatcgtttcaagtatagccgctttttctccatcacctggattttcaccttataatgtttctaaaaccgccctgttaggcctaaacaataccctggccatagagctggcaccccggaacataagagtgaattgcctgcatctcgatctatctaggcttgccagtgccggttgctctggctggacaagaaaaaagcgtaaggcatag

SEQ ID NO: 29233 - DNA, 648 bp, Artificial Sequence
  Description of Artificial Sequence: Synthetic coding sequence
atgcccttcccgtgtctgagcctgcctagctcctgggactacaggatcggatttgcgattgcacgcaggctagcccaggacagagcgcatgtcgtggtgagcagtaggaagcagcagaatgtggaccaggcggttgccacactgcagggtgagggcctatccgtcacgggaacagtatgtcatgtggggaaggccgaggatcgggagcgcctggtcgccatgactcttgacattaacgtgaaagctccagcactgatgacaaaggcagttgtccctgagatggaaaagcgagggggaggcagtgttgtgatcgtatcttccatagcagccttcagccccagcccaggcttttccccttacaatgtctctaagaccgccctgctcggacttaataataccttagcaattgaactggcaccccggaacatcagagttaactgcctgcccggactgattaaaaccagcttttcacgcatgctgtggatggacaaggagaaggaagagtcaatgaaggagacactgcgcatccggcgacttggcgagcctgaagattgtgccggaattgtgtccttcctttgctctgaagatgcctcctatatcaccggggagactgttgttgtaggggggggcaccccgtctcgcttgtag

SEQ ID NO: 29234 - DNA, 774 bp, Artificial Sequence
  Description of Artificial Sequence: Synthetic coding sequence
atggccagattacttgggttgtgtgcctgggcacggaagtctgtccggatggccagttctcgtatgactcgcagagaccccttaacaaataaggtggcgctggtgaccgcgagtactgatggaattgggtttgccatcgccagaaggctcgcccaggaccgcgcacatgtggtagtgagctcccgtaaacagcagaacgtggaccaggccgtggctaccttgcagggcgagggcctgtccgtaaccggcactgtgtgccacgtggggaaagctgaggatcgcgagcgcttggttgctatggcagtgaaactccacgggggaatagatatacttgtcagtaacgccgccgtgaatccattttttggcagcctgatggacgtgacagaggaggtgtgggacaagacattagacatcaacgttaaggcaccggcactcatgaccaaagccgtggtgcccgagatggagaagcgaggaggaggttctgtcgtcatcgtctcctctatcgctgccttttcaccatccccagggttcagtccctacaacgtctccaagaccgcattgctgggcctgaataataccctggcgattgagctggctccccgcaatatacgagtgaattgtctgcacttagatctcagcagactcgcctcagctgggtggctgggtgagccagaagattgcgcaggtatcgtgtcttttctgtgctcagaggacgccagctatatcacaggagagactgtggtggtaggaggtggcacaccttcccgcctttag

SEQ ID NO: 29235 - DNA, 276 bp, Artificial Sequence
  Description of Artificial Sequence: Synthetic coding sequence
atggccgttaaactgcacgggggcattgacatattggtaagcaatgccgccgtaaacccttttttcggttctttgatggacgtaaccgaagaggtttgggataaactctggatggataaggagaaagaggagagtatgaaagaaactctccgtatccgtaggctcggcgaaccagaggactgcgcaggcatcgtttcatttttatgctcagaggatgcctcgtatattaccggagaaactgtggttgtggggggagggactccttctaggctgtag

SEQ ID NO: 29236 - DNA, 174 bp, Artificial Sequence
  Description of Artificial Sequence: Synthetic coding sequence
atgctgtggatggataaggagaaggaagaatctatgaaagagaccctccgtattcgacgactgggggagcctgaggactgtgccggaatcgtatcttttctgtgcagcgaggacgcttcttacattacaggagagacagtggtcgttggaggggggactccctcccgactctag

SEQ ID NO: 29237 - DNA, 468 bp, Artificial Sequence
  Description of Artificial Sequence: Synthetic coding sequence
atgcagatggcaagacttctgggtctgtgcgcctgggcccgaaagagcgtgcgtatggcaagcagccgtatgactaggagggacccactgacaaataaagtggccttggttactgcttctaccgatggtatcgggtttgctatagcgagaagactcgcccaggatcgagcccatgtagtagttagtagccgaaaacaacaaaatgtggatcaggctgtcgctactctccagggtgagggtctgtcggtcacagggactgtatgccatgtaggtaaggccgaagatagggaaaggctggtggccatggccgtcaagctgcacggcggaatcgatatattggtgagcaatgcagctgtgaatccattctttgggtccctgatggacgttacagaggaggtgtgggataagctatggatggataaggagaaagaggagtccatgaaggaaacactccgcatcagaagatag

SEQ ID NO: 29238 - DNA, 993 bp, Artificial Sequence
  Description of Artificial Sequence: Synthetic coding sequence
atgtcgccgctgtcggccgctcgagcagcgctccgagtgtacgcggttggcgccgctgtgatcctggctcaactgctgaggcggtgccggggcggattccttgagccagtgtttccgccccgcccggatagggtcgctattgtcactgggggtacagatggtatcgggtactctacagcaaagcacctagcacggctggggatgcacgtaatcattgcaggcaacaatgactcaaaggccaaacaagtggtatccaaaattaaagaggagacactcaatgataaagtggagtttctgtactgtgatctggctagcatgacttctatccgccagtttgttcagaaattcaaaatgaagaagatccctttacacgtgctgatcaataacgctggtgtgatgatggtccctcagaggaagactagagacggcttcgaggaacattttggcctgaattacttgggccacttcctgctcactaatttactcctggacacgcttaaagaatcaggcagccctggacactctgccagagttgtgaccgtgtcatctgctacacattatgtggcggagcttaacatggacgatctgcagagcagcgcttgctactccccccatgctgcctacgcgcaatcaaagctagcccttgttctgtttacctatcacctccagagactgctagctgctgaaggctcacatgtaacagccaacgtcgttgacccaggagtagtcaacaccgatgtgtataagcatgtgttctgggctacccgcctggccaagaaactgctgggatggcttctgtttaagacccccgatgagggggcatggaccagcatctacgctgctgtcacacccgagctcgaaggtgtgggcgggcattacctgtacaacgaaaaggaaacgaaatcccttcacgtaacctataatcaaaagctgcagcagcaactctggtccaaaagttgtgaaatgacgggcgtgctagacgtaaccctgtag

SEQ ID NO: 29239 - DNA, 168 bp, Artificial Sequence
  Description of Artificial Sequence: Synthetic coding sequence
atgaagatgtcttttgaacgctgcacagcccggaataagatgttcgtcaattccgccttcaccaaggtcgataattattgcacttttctcatggagaaggtcctgttcaaagtcctcttcctggtcgaatattaccagaaaggcaaaaagaacgacttaaacttttag

SEQ ID NO: 29240 - DNA, 168 bp, Artificial Sequence
  Description of Artificial Sequence: Synthetic coding sequence
atgaaaatgagcttcgagcggtgtaccgcaaggaataagatgttcgtaaattcggcttttacaaaggtggataactactgtacttttctgatggaaaaagttctatttaaggtgctcttcctggtggaatactaccagaaaggaaaaaaaaacgacttgaatttctag

SEQ ID NO: 29241 - DNA, 483 bp, Artificial Sequence
  Description of Artificial Sequence: Synthetic coding sequence
atggcttctcccgcgcccctcgtggcgtctatttcccaccagatggtggccttacagacactccagctcctgcagcaagagtgggggtggggcgatggccccgtggcccccggaaacccaagagacccagaccacgtgtccactgcacctgctaggagaagcgggcctcctagagcccgacccggcccgggaagggaggagaggggcggaggagtcggcacacgctcccggagaaccgctgcaagggcgaacagccccgaagaggaggtcgtgaggggagccgaaggaggagctgagcttcttccatttcctagagaccgcgggccctgtaccttagctcagatggccatgagaagtgccctcgcccgtgttgtcgactctacctctgaactcgtaagcgtggagcagacactgttaggaccgctgcagcaagagcggtctttcccaatacaccttaagctgcaactgttagccaatgaatag

SEQ ID NO: 29242 - DNA, 525 bp, Artificial Sequence
  Description of Artificial Sequence: Synthetic coding sequence
atggcaagcccagctccccttgtggccagcatctcacatcagatggtggctctgcaaaccctccagttgttgcagcaggagtgggggtggggcgatgctgctcgtgccaattcccccgaggaggaggtggtacggggcgcagaagggggggccgaattactgccatttccaagagaccgcgggccttgtacactggcccaaatggcaatgcggtctgcccttgctcgagtggtggactccactagtgagttggtctcagtagagcagactctgctagggccccttcagcaggaacgctcgtttcccatccatttgaaggattccgtggagttccgcaacatttgttcacatttagccctccaaatcgaaggccagcagttcgaccgagacctcaatgctgctcatcaatgcctaaagaccatcgtgaaaaaactgatccagtccctggcaaattttccatccgacgcgcacatggtggcatgtgctagcctcagacagatcttgcagaacctgcccgacatctag

SEQ ID NO: 29243 - DNA, 666 bp, Artificial Sequence
  Description of Artificial Sequence: Synthetic coding sequence
atggcttctcctgccccccttgtggcctccattagtcatcagatggtggctctccaaactttacagcttctgcagcaggagtggggatggggcgatggccctgtcgcaccagggaaccccagagaccccgatcatgtcagcactgccccagctaggaggtccgggcctccaagggctcgccctggtccaggacgcgaagagagaggcggaggcgtagggacaaggagcagacgtaccgccgcccgcgccaactcccctgaggaagaggtggtacgtggcgccgagggaggggccgagttactgccctttccgcgggacagaggcccatgcactctcgcacagatggctatgaggtctgccctggcaagagtagttgactcaacgtctgagcttgtgtctgtggagcaaaccctgctcggaccactgcaacaggagagatccttccctatccacctcaaagacagtgtcgaatttaggaacatctgtagccacctcgcgctgcagatcgagggacagcagttcgatcgagaccttaacgccgcccaccaatgcttgaaaactattgttaagaagctgatacagtctctggctaatttccctagtgatgcccacatggtcgcctgcgcttccctaaggcagattctgcagaatctacccgatatttag

SEQ ID NO: 29244 - DNA, 513 bp, Artificial Sequence
  Description of Artificial Sequence: Synthetic coding sequence
atggcagtgactgggtggctggagtccctgagaacagcccagaaaacagcacttctgcaggatggtcgccggaaagtacattacttgtttcctgacggaaaggagatggccgaggagtacgatgaaaaaacatccgagctcctggtgcggaagtggcgggtaaagagcgctttgggcgccatgggccagtggcagctagaggtaggggaccctgcacctcttggtgcaggaaacctggggccagagctcataaaggaatctaacgctaatccgatcttcatgagaaaggacaccaaaatgagcttccaatggcgtattaggaacctaccttatcctaaggatgtgtactccgtttccgtggaccagaaagagcgctgcataatcgtgcgcacaacaaataaaaaacgtacgggctggaggttgctttggactcccttggcaatgaggtgtgctggggttcacggcacccctagtgagattgacacctcctacctgtggatgaccccctgttag

SEQ ID NO: 29245 - DNA, 513 bp, Artificial Sequence
  Description of Artificial Sequence: Synthetic coding sequence
atggcagtcaccggctggctcgaatccctgagaacggcccagaagacggccctgttacaggacggccggaggaaagtccattacctgttccctgacggcaaagagatggctgaggaatacgatgaaaaaacttccgagttactcgtaaggaaatggcgggtcaagtccgcactgggcgccatggggcagtggcagctggaagtgggtgacccagcgcctttgggagctggcaatctcggccctgagcttataaaggagagtaatgctaaccccatcttcatgcggaaagacaccaaaatgtcatttcagtggcgtatcagaaatctcccttatcctaaagacgtgtacagcgtatcagtggatcagaaagagagatgcatcattgttaggactacaaataagaagagaaccggttggaggttgctgtggacccccctggctatgcggtgcgcaggggtccatgggactcccagcgagatcgacacttcatatctgtggatgaccccatgttag

SEQ ID NO: 29246 - DNA, 354 bp, Artificial Sequence
  Description of Artificial Sequence: Synthetic coding sequence
atggcagaagagtatgacgagaagactagtgagctgctcgtacggaagtggagagtgaaatcagcgctgggggcaatggggcagtggcagctcgaggtgggcgacccagcccccctcggagccggaaaccttggcccggaactgatcaaagagtctaacgctaatcccattttcatgcgcaaagacacgaaaatgtcctttcaatggagaattagaaatctgccttatccaaaggacgtgtatagtgtgtccgtagatcagaaggaacgctgcataatcgtcagaactaccaataagaacactcggagccaaaggaggctgtggtggccttccttgagttatcgtcgcaactag

SEQ ID NO: 29247 - DNA, 612 bp, Artificial Sequence
  Description of Artificial Sequence: Synthetic coding sequence
atggcagtaaccggttggctcgagtccctccggactgctcaaaagaccgccctgctgcaggatggcagaagaaaagtccactatttattcccagacgggaaagaaatggctgaggagtatgatgaaaagacatcagaactcttggtgagaaagtggcgtgttaaatctgcactgggagccatgggtcagtggcagttagaggtcggggaccccgcccctctgggggccgggaatctgggcccagaacttataaaggaatctaacgccaaccctatattcatgcgcaaagataccaagatgagcttccagtggagaatccggaatctgccatacccaaaagatgtctactcagtgtccgtcgaccaaaaggaacgctgtatcattgtgaggacaacgaataaaaagtattataaaaagttcagcataccggaccttgacagacaccagctccccctggacgacgccctactttcattcgcacacgcaaattgcactctgatcatttcttatcaaaaaccaaaggaagtggtcgtggcggagtcggagctgcagaaagagctcaaaaaggtgaagacagcccactctaacgatggcgactgtaaaacccagtag

SEQ ID NO: 29248 - DNA, 741 bp, Artificial Sequence
  Description of Artificial Sequence: Synthetic coding sequence
atggaaactagaagaggccggagaaggacgtttggaggcgagtgggagaggcccgcaccagtgctggtgtctgcatcccggcatggaggagctcagagacggagctgtggggaaatggggcatgggcgtagtcgctgcggcgagccatcgggtaatggtggagtgtcccagcttagggtgaagtctagggccggggcagtctattctccgtgtacacagttagctcaggcacgcgaatcacagctcggggctcggcgaaagctggaatgccctaccccagctccacgtgtgtccccaactcccagagtcggcccacgggtgggcagcacaaccggtcaggctagtcaccctggcgtaggcagaaaccgtccccttacatcccgggccaatgagtccgggcgacgaggagaggggggccagatggctcgcattgcctccgagtccgccgggagcgaccctctggagcgtctgccctggcagagactgggggttctcctcagccgtggaaaaatggccgttaccggatggctggagagtttacgcacggcccagaagaccgcactgctccaagatggcaatagccgtgtccccacaggcagcttcgtgttttttccccaaggacccgcactgcgggaaggaccgcaaggcttgggaaggcaaagctggaaaggtctgggtggccagcctggtcaggttctccatctgcagatgcgacgccttcggttcaccgagatgacctag

SEQ ID NO: 29249 - DNA, 351 bp, Artificial Sequence
  Description of Artificial Sequence: Synthetic coding sequence
gcagaggagtacgacgaaaagacctctgagctgttggtacggaaatggagggtcaaatccgccttaggtgccatgggacagtggcagctggaggtgggcgaccccgcgccactgggtgctggcaacctgggtcctgagctgatcaaagagagtaatgcgaaccctattttcatgaggaaggacaccaagatgtctttccagtggcggatccgaaacctgccctaccctaaagacgtatatagcgtctccgtggatcagaaggaacggtgcatcatagtgcgcacaacaaacaagaacactagatcgcagagaaggctgtggtggcctagcctttcctacaggcgaaactag

SEQ ID NO: 29250 - DNA, 3030 bp, Artificial Sequence
  Description of Artificial Sequence: Synthetic coding sequence
atggatatgttcagcctggacatgattatctcggaccctgccgctgaagccagcagagccggcaaaaaacagctccgtggcgtccaaaacccatgtccctcagctagggccaggcctcgtcataaaagcttgaatataaaggataagatatctgagtgggaagggaaaaaagaggttcccaccccagccccaagccggcgcgcagacggtcaggaggattatctccctagttcaaccgtcgagagacggagtagcgacggagtgaggacccaggtgaccgaagctaaaaatggcatgcggcctggaaccgagagcaccgagaaggagcgaaataagggagcagtcaacgtaggtggccaagatcctgaacccgggcaagatctgagtcagccagagcgcgaggtggatccatcatggggcagagggcgagagccaagactcggaaagctgcggttccagaacgaccctctttccgttctaaagcaggttaagaagctggagcaggccctcaaagatggaagtgctggcctggacccccaactacccgggacttgttattcccctcactgccctccagacaaagccgaggcagggagcactttgcctgagaatctcggcggggggagcgggtctgaagtgtcacagcgggtccacccttcagacctggagggccgcgaaccaacgcccgagctggtggaggatcggaagggctcatgtcgtaggccctgggatagatctctggaaaatgtctaccggggatcagaaggctcacccactaagcccttcatcaacccattgccgaaacctagaagaacgtttaagcacgccggggagggagataaggatggcaagcccggaatcgggttccgcaaggagaagagaaatctgcctcccctgccttcactgccaccaccacctcttccctcttcacctccgccatcctccgtgaacaggcgcttgtggactggtcgccagaagtcttccgcggatcacagaaaatcgtatgagtttgaggacctgctgcagagctcaagcgagtcctcccgcgtggactggtatgcacagaccaaactgggactgacaagaaccctaagcgaggagaatgtgtacgaagacatccttgaccccccgatgaaggaaaatccctacgaggacattgagctccatgggagatgtctgggtaaaaaatgtgtattgaatttcccggccagtcccacatcatccatcccagatacgctgacaaagcagtccctgtctaagccggccttctttagacagaattccgagcggaggaattttaagcttctggacactaggaagctgagtagggacgggacaggaagtccatccaaaatttctccaccttctaccccatctagccctgatgatatcttctttaatctaggcgacccccagaatggccggaagaaacggaagatccccaagcttgtcctacgtataaacgccatctacgaagtgcgaaggggtaaaaagcgggtaaagcgcctctcacagtctatggagtcaaactccggcaaagttacagacgagaatagcgagagcgactccgacactgaggaaaagttgaaggcccatagccagagactggtaaatgtgaagtcacgactgaaacaagctcccaggtatcctagcctggctcgcgagcttatcgaataccaggagcgtcagctctttgaatactttgtggtggtgagtctgcacaagaagcaggcaggggccgcatatgtccctgagctgactcaacagtttcctttgaaactcgagaggtcctttaagttcatgagggaagccgaggaccaactgaaggcaatcccccaattctgttttcctgacgcgaaggactgggttcccgtgcaacagtttacaagcgaaaccttctctttcgttctcaccggcgaggacggctcccgccgatttgggtactgccggagactgttgcccggagggaaaggcaaaagactgcctgaggtctattgcatcgtgtcgaggctgggctgcttctctctgttcagccgcattctggatgaagtagagaagcggagagggattagtcctgcgttagtgcagcctctaatgcgctcagtgatggaagctccctttcctgccttggggaagacaatccttgtcaaaaatttcctcccaggctcaggcacagaggtgatcgaactttgtcgccctctggactctagactggagcatgtcgacttcgagagcctcttttcgagcctgtctgttagacacttggtgtgcgtatttgcttccttgctgctagaaaggagagtcattttcatcgcggataagttatccattctgagcaaatgctgtcacgccatggtggcactgatttacccattcgcatggcagcatacatatatccccgtgctgccacctgctatggtcgacattgtatgtagcccaaccccatttctaatcggcttgttgtcttccagcctgccccttctccgagagctccctctggaggaggtattagtcgtcgacctggtgaacagtcgctttcttaggcaaatggatgatgaagactcaatcctcccacgtaagctccaagttgccctggagcacattctggagcagaggaacgagctggcctgcgagcaggacgaggggccccttgatgggcgccatggacctgaaagcagcccactcaacgaagtggtcagcgaggcgtttgtgaggttctttgtggagatcgtggggcattattctctgttcctgacctccggcgaaagggaagagagaacattacagcgggaggcgtttaggaaggcagtgagcagcaagtccttaaggcacttcttggaggtatttatggaaacccagatgttccgcggctttatccaagagcgagagctccggagacaggatgcaaaaggtctgtttgaggtgcgcgcccaggaatacctggagaccttgccgtcaggcgagcacagcggggtaaataaatttttaaagggcctggggaataaaatgaagtttctgcacaaaaagtag

SEQ ID NO: 29251 - DNA, 240 bp, Artificial Sequence
  Description of Artificial Sequence: Synthetic coding sequence
atggacatgttctcactcgatatgataatctcagatccagctgctgaggcttcaagagcaggtaaaaaacaattaagaggggtgcaaaacccttgtccttcagcccgagcgagacccaggcataaatctctgaacattaaggacaagatcagtgaatgggaaggcaaaaaggaggtcccaacacccgcccccagcaggcgggccgatggtcaagaggactacctgccttcatccacttag

SEQ ID NO: 29252 - DNA, 273 bp, Artificial Sequence
  Description of Artificial Sequence: Synthetic coding sequence
atggatatgtttagccttgacatgatcatttccgaccctgcagccgaagcatccagggctggaaaaaaacagctgagaggcgttcagaacccctgcccatctgccagggctcggcccaggcataagagtcttaatattaaagataagataagcgagtgggagggcaaaaaggaagttcccacaccggctcccagtcgtcgggcggacggccaggaggattacttgccaagttccactgtggaacggcgcagtagcgatggggtgagaacttag

SEQ ID NO: 29253 - DNA, 477 bp, Artificial Sequence
  Description of Artificial Sequence: Synthetic coding sequence
atggatatgttttccctagacatgattattagcgacccagcggcagaagcttcacgcgccggaaagaagcaattgcgcggcgttcagaacccttgcccatcagccagagctcgccccagacacaagtccctgaacattaaagacaaaatatccgagtgggagggcaagaaagaggttcccacgcctgcaccttcacggagagcagacgggcaagaagattacctccctagctcaactgtggaacgaagaagcagcgatggagtgaggacacaggtgactgaggcgaagaatgggatgagaccaggtaccgaaagcaccgagaaagaacggaacaagggcgcagtaaacgtgggtggccaggaccctgagcccggccaggatctgagccaacccgagagagaggtggacccttcatgggggcgggggcgcgaaccacggctgggtaaactcagatttcagaacgaccctctgtcctag

SEQ ID NO: 29254 - DNA, 2388 bp, Artificial Sequence
  Description of Artificial Sequence: Synthetic coding sequence
atggatatgttctcccttgatatgattatttctgacccagccgcagaagcctctagagcgggcaaaaaacagctgaggggagtccagaatccatgccctagtgcccgggcaagaccccgccataagtctctgaacatcaaagataagatctccgagtgggagggaaagaaagaggtccccacccctgcaccttcccgacgcgccgatggacaggaagattatttaccgtcttctactgtggagcggcggagtagcgatggtgtaaggacacaggtgacagaggcaaaaaatgggatgcggcccgggaccgaatcaaccgagaaagagcgcaataagggcgccgtgaacgtcggtggtcaagacccagaaccgggacaggacctatcccagccagaaagagaggtggacccatcttggggtagaggccgcgagccccggctgggtaaattgagatttcagaatgatcccctgtctgttttaaaacaggttaagaagctggaacaagcgctcaaagacggttctgccggcttagacccacagctgccgggcacatgctacagcccccattgtcctcccgataaagccgaagctgggtccacactgcctgaaaacctgggtggcgggtcgggctccgaagtgtctcaacgcgtgcatcccagcgatctggaaggacgcgagccaaccccagaactcgtggaggataggaaggggtcttgtcgccgtccgtgggaccgttccttggagaatgtgtacaggggttctgagggcagcccaaccaaaccatttataaacccactccccaaaccaagaaggacgtttaaacacgcaggcgagggggataaggatggcaagcccggcatcggctttagaaaggaaaagcgcaatctaccacctttacctagcctccctccacctcctctgccaagttctcccccaccatccagtgtgaatcgccgactatggactggccgtcagaaaagcagtgctgaccaccgaaagagctacgagtttgaagacctgctacagtcgtcttcagagtcgtcccgcgtggactggtacgcccagaccaagctggggctgactaggaccctgagtgaggaaaatgtgtacgaggacattctggacccccccatgaaggagaatccctatgaagatatagagctgcacggtcgatgcctgggcaagaagtgcgtcctgaactttcccgcctcgcccacctcctccattccggatactctgaccaagcagtcattgtcaaaaccagctttcttccgccaaaactctgagagaaggaactttaagctgctcgacaccagaaagctcagcagagacggcactggaagtccatcaaagatttcccccccctcaacacctagttctcccgacgacattttttttaatcttggtgatccacagaacggtcgcaaaaaacgcaaaattcccaagctcgtattgagaatcaatgcaatctacgaagtccgtagaggcaagaagcgggtgaaacgactgagtcagtctatggagagcaacagtgggaaagtgaccgacgaaaatagcgaatctgactccgacacagaggagaaactgaaggctcattcccagcggctagtgaacgtgaagtccaggctgaagcaggcacccagatacccaagtctggctagggagttaattgagtaccaggagcgtcagttatttgagtactttgtagtggtgtccctacacaaaaaacaggcaggcgccgcttatgtgcctgagctaacacagcagttccctctcaaactcgaaaggagcttcaaattcatgagagaagcggaagatcagctgaaagctatcccacagttctgcttccccgatgcaaaagattgggtgcctgtgcaacaattcacctccgagactttctctttcgtactcactggggaagacgggagccgtaggtttggatactgcagaagactgcttccaggaggcaaaggtaagcggctgccagaggtgtactgtattgtgtcaaggttgggttgcttttcccttttcagcagaatcctggacgaggtggaaaaacgccgtgggatttcacctgccctggttcaacccttgatgagaagcgtcatggaggccccatttccagctctcggaaaaactattctggttaaaaactttctccccgggagcggaaccgaagtcatcgagctctgtagacctcttgactctagactggagcacgttgatttcgaaagcctcttctcctctttatcggtgcggcatttggtgtgtgtgtttgcctcccttctgctggaacggagagtcatcttcatcgcagacaaattgcggtacccaccctggcttctgcttctgaaacgacttaacgattctagatcttggaccctgtag

SEQ ID NO: 29255 - DNA, 3030 bp, Artificial Sequence
  Description of Artificial Sequence: Synthetic coding sequence
atggatatgttttctttggacatgatcattagcgaccccgctgccgaggcaagcagggcgggcaaaaagcaactgcgcggtgtccagaacccctgcccgtccgctcgcgcacgaccacgccacaagagtctaaatattaaagataagatcagcgaatgggaggggaagaaagaggtgcccacacccgccccatccagacgcgctgacggccaagaggactaccttccaagttccacagttgagcgaagatcgagcgacggagtgaggacccaggtgaccgaggctaagaatgggatgcgaccaggcactgaatctacggagaaagaaagaaataaaggcgccgttaacgtgggtggtcaggacccggaacctggtcaagacctatcccaacccgagagggaggtggacccatcttgggggagggggcgagagcctcggttaggaaaactgcgcttccagaacgaccctctaagtgtcctgaaacaagtgaaaaagctggagcaggcactcaaggacggatctgccgggttggatccgcagctgcccggcacctgttattccccacactgccccccggacaaagcagaagcaggatccacactgccagagaatctgggcggagggtcggggtcagaggtgagccaaagagtacatccaagcgatctcgagggacgagagcctactcctgagttggtagaagacaggaagggcagctgccgcagaccctgggataggtctttggaaaatgtatacagggggtctgagggtagccccactaaacccttcattaatcccctgcccaaacctcgtagaacctttaagcatgctggggaaggcgataaagacggtaagcccgggattgggttcaggaaagagaaacggaacctgcctccactccctagcttaccccctccccctctcccttcatcacccccaccatctagcgtgaacagacggctgtggacaggcaggcaaaagagtagcgccgaccacaggaagagctatgaatttgaggatctgctgcaatcaagtagcgaatcttcccgcgtggactggtacgcccagaccaagctgggcctcacccgcactctctctgaggagaacgtctatgaggatattctcgacccacccatgaaagagaacccttatgaggacatcgaactgcacggacgctgcttgggtaagaagtgcgtgctcaattttccagcaagcccaacctcatctattccagacactctcaccaaacagagcctgtcgaaacccgcattctttcgacagaattcggaacgcagaaacttcaagctcctcgatacacggaagctgtcccgcgacgggacaggaagtccgagtaaaatttcgcccccatcaacaccttccagccctgatgatatcttctttaaccttggcgatccacaaaacggccgcaagaagaggaagattcccaagctggtgctgagaatcaacgccatctacgaagtgcggaggggtaagaagagggtgaaacgactctcacaatcgatggagagtaactctggcaaggtgacagatgagaattctgaaagtgactctgatacagaagaaaagctcaaagctcactcccagcgtctcgtaaatgttaaatcacggctgaaacaggccccccgctatcccagtttggcccgggagctgatagaatatcaggagaggcagctcttcgaatatttcgttgtggtgtctctgcataagaaacaagccggagcagcttatgtgccggagctgacccagcagttcccactaaagctcgagagatcctttaagttcatgagagaagcggaggaccagctgaaggcgatcccacagttctgtttcccagatgctaaagattgggtgcctgtacaacaattcacatctgagacgttctcctttgtgcttacaggcgaagatggttctcgccggttcggctactgcagaagattgctccccggcgggaaaggaaaaaggctgcccgaagtgtattgtatcgttagcaggctgggttgcttcagcctgtttagtcggatcctcgatgaagtggaaaaacgtagagggatctcacccgccttggtgcaaccactgatgagaagtgttatggaagctccgttccccgcactagggaaaactattctcgtgaaaaactttttgccgggatccggcacggaggttattgaactatgtcggcctttagactcgcgcttggaacacgttgacttcgaatcccttttttcctccttaagcgttaggcatttggtctgcgtgttcgcctccttgctgctggagcggagagtgatttttatcgcagacaagcttagtatattaagtaagtgctgtcacgcgatggtagctttgatctaccctttcgcgtggcagcacacctacatccctgtccttccacccgcgatggtcgatatcgtctgttctcctaccccatttctcatcggcctgttgtctagcagtctccccttgttacgggagctgccgctcgaagaggtgcttgtcgtggacctggtaaactcaagatttctaagacagatggacgatgaagactccattttgcccagaaagttgcaggtggcccttgagcatattcttgagcagcgcaacgagctagcttgtgaacaggatgaagggccactggatgggagacacggcccagaaagcagcccgctgaatgaagtagttagcgaagctttcgtgcgctttttcgtggagatcgtgggtcactattccttattcctcacctctggcgagcgtgaggagcggacactgcagcgtgaagcgtttcggaaagctgtcagctccaagtctttgaggcacttcctggaggtgtttatggagacccagatgttccgtggcttcatacaggagcgcgaactgagacgccaagacgcgaaaggtctctttgaggtgcgggcacaggaatatctggagactcttccgagtggcgagcacagcggcgtgaataaattcttaaaaggactgggcaataaaatgaaatttctgcacaaaaagtag

SEQ ID NO: 29256 - DNA, 3030 bp, Artificial Sequence
  Description of Artificial Sequence: Synthetic coding sequence
atggacatgttttctctggacatgattatctcagatccagccgccgaagcctccagagcgggaaagaagcaattgcgcggagtccaaaacccttgtccttctgcgcgggcgcgcccaaggcacaaatcacttaacatcaaggataagatctcggagtgggagggaaagaaagaggtgcccactcctgccccctctcggagagcagatggacaagaagattatttaccttcatctaccgtagagcggaggagcagtgatggagtacggactcaggtgaccgaagccaaaaacgggatgagaccagggactgaaagcactgaaaaggagcggaacaagggcgcagtaaacgtcggcggccaggatcctgagccgggccaggatctcagccagcccgaaagggaggtggacccctcgtggggcagaggacgagaaccacgtctggggaaactgcgcttccaaaacgaccccttgagtgtcctaaaacaggtgaagaagctggaacaggcactgaaagatggatcagccggcctggaccctcagttaccaggaacttgctatagcccacactgtccacccgataaagctgaagcagggagcacacttccggagaacttggggggcggttccggatccgaggtgtctcagagagtgcaccctagcgatctggaaggcagagaaccaacaccagaacttgtagaggaccgtaagggctcatgtcgccgtccctgggataggtcccttgagaacgtttatcgcggcagcgaaggatcacctacgaagcccttcattaacccgctgccaaagcccaggcgtacattcaaacatgccggggaaggcgataaagacgggaaacctggcatcgggtttagaaaagagaaaaggaatctgcctccgctccccagcctccctcctcctcccctaccgtcctctccaccccctagctccgttaatcgacgattatggacaggccggcagaaatcatctgctgaccataggaagtcttatgagtttgaggacctgctacagtcatcaagcgaatcctcaagggtggactggtatgcacagactaagctggggctgacacgcacgctgtcggaggaaaacgtttatgaggatatactggacccacccatgaaagaaaacccatacgaggatattgaactgcacggcaggtgtctgggaaagaagtgtgtactcaacttccctgcctcaccaacgtcaagcattcctgacacacttaccaagcagtctttgagcaagcctgcatttttcaggcagaattccgaaagacggaactttaaactgctggacacaaggaaattaagtcgggatggaaccgggagtccctctaagatcagtccaccaagcaccccctccagtcctgatgacatcttctttaacctgggagatccacagaacgggaggaaaaaacgtaagattcccaagctggtgctgcggattaacgcaatttatgaagtccgaagaggcaagaagagagttaaacgcctcagccagtccatggagagcaacagcggaaaggtgacggatgaaaacagtgagagtgacagtgatactgaggaaaagttgaaagcccactcccagcgtttggtcaacgtcaagtcgagactgaagcaagcaccccgatatccttcacttgctcgggaactaatagagtaccaggagcgtcagctatttgaatacttcgttgtggtgagtcttcataaaaagcaggctggcgccgcatacgtccctgaacttactcagcagtttccactgaagttggaaaggtccttcaagtttatgcgcgaggctgaggatcagttgaaggccattccccagttttgtttccctgacgccaaggactgggtccctgtgcagcagtttacttctgagacatttagcttcgtcctgacaggggaagatggttcacggcggttcggatattgcagacgactgttgcccggcgggaaaggaaagcgtctacccgaagtgtattgcatcgtgtcaagactcggatgctttagtctgttttccagaattctggatgaggtggaaaaacgcagaggaatcagtcctgcccttgtgcaacccctgatgcgttcggtgatggaggcaccatttccagcactgggaaagaccatcttggtgaagaatttcctacccggctctggaaccgaggtcatcgagttgtgcagaccactcgattcgcggcttgaacacgtagacttcgaatctctgttcagctccttgagtgtgagacacctagtctgtgtgttcgccagcttgctgctggagagaagggtgatattcattgcggataaactgtccattttgtctaaatgctgtcatgccatggtggcccttatctacccttttgcatggcagcacacttatatcccagttctgcctcctgccatggtggacatagtgtgtagtccaactccgtttttgattggcctgctctcctcttctctgcccctgttaagagaacttcctctggaagaggtgctcgtcgtcgacctcgtcaatagcaggtttctgcgacaaatggacgacgaagacagcatcttgccccggaagttacaggtggctctggaacatatcctcgagcagcggaacgagctggcttgtgagcaggatgagggacccctggatgggcgccacggtccagagagctcacctctgaacgaggtggtgagcgaggcctttgtaagatttttcgttgagattgtcggccactatagcctttttctgacatcgggggaacgagaggaaaggacgcttcagcgggaggccttcagaaaagccgttagttcaaagtccctccggcattttctggaagtgtttatggagacccaaatgttcaggggctttatccaggagagggagctgaggcgccaagatgccaagggtctatttgaggttcgtgcccaggagtatctggagaccctgccatctggcgagcatagtggtgtgaacaagttcctgaaaggcttgggaaataagatgaagttcctgcacaagaagtag

SEQ ID NO: 29257 - DNA, 2787 bp, Artificial Sequence
  Description of Artificial Sequence: Synthetic coding sequence
atggatgtaggattcagccggacgacggtgcagaccttgtctcgctctcattgcaaaaacatcaaacagaagatctctcagtgggaaggacgggccaatggaatttcgaatccagaaaaatggtgcccaaaagactttggcgttcgatacaattgccaccaagagatccgactgaaaaagaatcctatcgccgaacggaagagcaagaatttggatgtgacctcccgggaaaacgtgggtctcgacattaacgagaacactaagagccatgaccagagcgaaaacgaaaataagaagcacgaatatgatgacactcacttctttaagaatgagtctgagagcaactgggtgtgctcaagggtcaaagaaatcgagtcttgcaaggaagacgtcttggacccagagacctccttaccaccaggtaatttctatacctcacagatactttggaaaaagatcgaagccttgcctcccgataaacttctcaatctggccctggaacattgcgactccagtgaaaaggaacttaatttccgggtcctggacagttcttatggcatcactaagagcctcgaaaacatatattccgagccagagggacaggagtgtggcccatcaataaatccgctaccaaagcctaggaggacatttcgctacctgagtgagtccggagtcactccatacaaggagaggaactgcgacaagaagtactgtgagaacaatagctgcgcccaatctagcttagcctcttcacaagagcccgagcccaagaagtacggcggcaagatacgcggaaggtctaaacgtaaatccttcgagttcgaggacatccagcactttaggaatagaaatagtcagacaattcgggaggagctgggcagaaactcgggcagcgcgctctactacacgcagtccgaagacaacatttatgaagatatcatctatcccaccaaggagaatccatatgaagacatccccgtccagccactgcccatgtggcggtccccgtccgcttggaagctgcctcctgcgaagagcgcattcaaggctcccaaactccccccaaaaccccaattccttcatcgaaagaccatggaggttaagaactcccaggcttacttgaggtccaagctcactaaggacaccacgctccccgtgacactgacggaatggaagctctttcgggcaggagaagtggccaacactaagagaaaaaaccttccacggctggtgctcaaaattgacgacattttcgagagcaagcgcggcaaaaagaaggtcaagctgcacagttacaccggcaaggaactgccacccactaagggcgaaacttctggcaatgagagtgacgccgaatatctgcctaagaatcgacacaagaggctggcccagctgcagccatcatcaaagcgaaacccgcactatcagactctggaacgggatctgattgaactgcaggagcaacagttgttcgagctgttcgtagtcgtgtccctccaaaagaaaccctccggcattagttacatccctcaggtgatacaacagtttccagggaaagacgaccacggttataaacagtctaaggacatggaggaaaggctgaaagtgatcccaaaattctgtttccccgactctaaagattggatgcctacatcagagctcaagagcgaaacattttcatttgtgttgacaggggaagacggcagtcggtggtttggctattgcaagaagttactcccggtgggtaaaggaaagcgactccccgaagtctactgtatggtgagccggcttggatgcttcaacctgttttccaaaattctggatgaggtggagaagagaagagagatgagcccagcactcgtttatcctttcatgagatccgtcatggaggcccccttccccgcgcctggacggaccatcactgttaagtcctacctacccggcgctggcgatgaatcaatcgaactgtgcaggccactcgattcacgcctggaacacgtggactttaagtgtttattcaagtgcctgtctgtgtgccacctcataagggtgtgtgccagcttgttactggaacggcgagtgatcttcgtggcaaatagcctgtcaaccctttccaagtgcggacatgccgtggtggctaccctctacccattcacttggcagcacacctatatacccgtgctgcccgcgtctatgattgacatcgtatgcagccctaccccatttctgattggtatcctttcttgctcattaccacagttacaggacttacccatagaggaagtgctgattgtcgacctgtgcgccgacaaattcctccaggaggtgagtgatgaagacgaaatcctacccccaaagctgcaggcggcgctgatgcagattctggaggagcgaaatgagattctcactcaagaacagaatttctcacaggatgtcacactgaacagtctcgtttccgaggcatttgtgcgcttctttgtggagctcgttggtcattatagtctgaatatgactgtgactgagcgcggcgaacgggtcttccagagggagcccttccggaagagccacaccagtagaagcgtgcggcactttctggatctctttatggaaacccagatgtttgccgggttcatccaggaccgcgaactcagaaagtctggcgttaagggactgtttgagataagagccattcagtatctggaaactatcccggagtccgagccctcaggcatgaaccgcattctgcggagcctgggaagtaagatgaagtttttgcagaaaaagtag

SEQ ID NO: 29258 - DNA, 2787 bp, Artificial Sequence
  Description of Artificial Sequence: Synthetic coding sequence
atggacgtgggctttagcaggaccactgtccaaaccctgtctcgcagtcactgtaagaatatcaagcagaaaattagccagtgggagggtcgggcaaacgggatcagtaaccccgagaagtggtgtccgaaggatttcggagtgaggtacaactgtcatcaggaaattaggctaaagaagaatcccattgccgagaggaaatccaagaatctggatgtcaccagccgggagaatgtcggcctggacatcaatgaaaacaccaagtcacacgaccagtcagaaaacgagaataaaaaacacgagtatgacgatactcactttttcaaaaacgaaagtgaaagcaactgggtgtgttctcgcgtgaaagagattgaaagttgtaaagaggacgtattagaccctgagacaagtctacctcctggaaatttttacacatcacagatcctgtggaagaaaatcgaagctttgcctcccgataaactccttaacctagctcttgaacattgcgatagcagtgaaaaggagttgaacttcagagttctagatagcagttacggcatcacaaagagcttggagaacatctattctgaacccgagggacaggaatgcgggccatctatcaatccattgcccaagccccgacggacctttcgctacctgtctgagagtggcgttacgccctataaggagcggaactgcgataaaaagtactgtgagaataactcctgcgctcaatcatcactcgcatctagccaggaacccgaacctaagaaatacggcggaaaaatcagagggcgtagcaaacgcaagagctttgagtttgaggatattcagcactttcgcaatcgcaattcacagacaatcagggaagaattaggtcgtaattcaggaagtgccctgtattatacccaatctgaggataatatctacgaggacatcatctacccaaccaaagagaatccttatgaggatataccagtacagccactccccatgtggagatctcctagcgcttggaagctcccccctgcaaagagcgcctttaaggccccaaaactcccgcccaaaccccagttccttcataggaaaaccatggaagttaaaaattcccaggcctacctcaggtccaagctgaccaaggacaccactcttcccgtgactttgaccgagtggaagttgtttcgggcaggggaggtggccaacacaaaaaggaagaacctcccacgcctggtgctcaagattgacgatattttcgagagcaaacggggcaaaaaaaaggtcaagcttcacagctatactggtaaggagcttccaccgaccaaaggtgaaactagcggaaacgaatctgatgcggagtacctgccgaaaaacagacacaagcgcctggcacaactccaacctagttccaaacgaaacccacactaccagactctggagagagacttaattgagctgcaagaacaacaactgttcgaattgtttgtggtcgtgagtctacaaaagaaaccctccggcatctcttacattccccaggtgatacagcaattcccaggtaaggacgatcatggatataagcaatctaaggatatggaagaaagactgaaagtcattcctaagttttgtttccccgacagcaaagactggatgcccacttcagagctgaagtcagaaacattctcttttgttctgacgggcgaggacggcagccgatggttcggttactgcaaaaagctgctgcccgttggaaaggggaaaagactccctgaagtgtattgtatggtgagtaggctgggctgcttcaacctattttctaaaatactcgatgaggtggagaagaggcgggagatgagcccagccctcgtgtaccccttcatgcgttctgtaatggaggccccgttcccggctcctggaagaacaatcaccgtgaagagctaccttcccggagctggagacgaatccattgaactgtgtaggcccctggactctcggctggagcacgtggactttaagtgcttgttcaagtgcctgagcgtctgccatctgattcgtgtgtgcgccagccttctcctcgagcgacgggtgatctttgttgcgaattcgctctccacccttagcaaatgtggccacgcggtggtggcgacactgtaccccttcacctggcaacacacatacatcccagttctgccggcctcgatgatcgacattgtatgtagcccaacgcccttcctcatcgggatcctgtcctgcagcctgccccaattgcaggacctaccgatcgaagaggtgttgatcgttgacctttgtgctgataaatttctgcaggaagtatcagacgaggacgaaatcctcccccccaagctacaagccgcgctgatgcagatccttgaagaacgtaacgaaatactgactcaggagcaaaatttctctcaggacgtcactctgaactctctcgtttccgaggcatttgtgagattcttcgtggagctggtgggacactactctctcaatatgaccgtgacagaacgaggtgagcgggtcttccagcgcgagccctttagaaaatcgcatactagtcggtcagtgagacatttcttggatctttttatggaaacccagatgttcgccggattcattcaagatcgagaacttaggaagtctggagtgaagggcctgttcgagattagagcgatccaatatctcgaaaccattcccgaaagcgaacccagcggtatgaaccggatattaaggagcctcggaagcaagatgaaattcctccaaaagaagtag

SEQ ID NO: 29259 - DNA, 2616 bp, Artificial Sequence
  Description of Artificial Sequence: Synthetic coding sequence
atggatgtggggttcagtcggactactgtgcagaccttgtctcgttctcactgcaagaatatcaaacaaaaaattagtcagtgggaaggtagggcgaacggcatcagcaatcccgaaaagtggtgcccgaaggactttggtgtgagatataattgccatcaggagataaggttgaaaaagaacccaattgctgagagaaagagtaagaatctcgacgtgactagccgggagaatgttggcttggacatcaatgaaaataccaagtctcacgatcaatccgaaaacgaaaataagaagcatgaatacgatgatacacacttcttcaagaacgagtcagagtccaactgggtctgcagtcgagttaaggagatcgagagctgcaaggaggacgtgctggaccccgaaacttccctcccgccaggaaacttttacactagccagatcctttggaaaaagatcgaggccttgccgcccgataaactgctgaacctggcgctggaacactgtgatagcagtgagaaagagctcaacttccgagtcttggacagcagctatggaatcaccaaaagtctcgaaaacatttatagcgagcccgagggccaagaatgcggccccagcatcaaccccctgcctaagcctcggagaacatttcgctatctctcagaatccggggtgactccatataaagaacgaaactgcgataaaaagtattgcgagaacaattcatgcgctcagagctctctggccagttcgcaggagcccgagcccaaaaaatacggaggaaaaatccgcggcagatcaaaacggaaatcatttgagttcgaagatatccagcacttccggaaccgaaattcccagacaatccgggaggagctaggacgaaactcagggtcagcactttactacactcagagcgaggataatatttacgaggatatcatctaccccacgaaggaaaatccatacgaggacatccccgttcagccacttcctatgtggcgttcacccagcgcctggaaattgccgccagctaagtcagcctttaaggccccgaaactggtgcttaagatagacgacatattcgagtcaaagaggggcaaaaaaaaagtgaagttacacagttatacaggtaaggaactccctcccacaaaaggcgagacaagcggtaacgagtctgacgcagaatacctcccaaagaaccggcacaagagattggctcagcttcagccttccagcaagagaaacccacactatcagacccttgaacgggacttgatagaactccaggagcaacagctgtttgagctcttcgtcgtggtgtctctacagaagaagccctcggggatcagttatatacctcaggttatccagcaattccctggcaaggatgaccacggctacaagcaatcaaaagatatggaggagcggctgaaggtcatcccgaaattctgttttccagactccaaggattggatgccaacgtctgaactgaagagcgagacattttctttcgtcttaaccggcgaggatggatcccggtggttcggttactgcaaaaagctgctccccgtaggtaaaggtaaacgccttccggaagtatactgcatggtaagccgactcggctgcttcaatctgttttccaagattcttgacgaagtggaaaaaaggcgtgaaatgagccctgctctggtatatcccttcatgaggtcagtcatggaagctccttttcccgccccaggacgtaccatcactgtaaaaagttacctccccggggccggtgacgaatcaatcgagctctgcagacctttggattctcgccttgagcacgtggactttaagtgcctgtttaaatgtctatccgtgtgccatctgattagggtgtgtgcaagtctgctcttggaacgccgggtgatttttgtcgccaatagcctcagcacactctccaagtgcggacacgctgtcgtggctactctgtacccatttacctggcagcatacttatattcctgtgctgcccgcttcgatgatcgatattgtgtgctccccgacacctttcctcatcggaatcttatcatgctcgttgccacagcttcaagacttgcctatcgaggaggtcctgattgtggacctatgtgccgacaaatttctgcaggaggtctccgacgaggatgagatcctcccccccaagctgcaggcggccctgatgcaaatcctggaggaacggaacgaaattttaacccaggaacaaaacttctctcaagacgtgacgctgaactccctggtgtcagaggctttcgtacggttctttgtcgagctcgtaggacactacagtctgaatatgacagtgaccgaaagaggcgaaagggtcttccaacgcgagcctttccgaaaatctcatacttccaggtcagtaaggcacttcctggacctatttatggagacccagatgttcgcaggttttattcaggatcgagagcttagaaagagcggagttaaggggctgtttgagattagagccatacaatatttggaaaccatccctgaaagcgaaccttccggcatgaatcggattttaaggtccctaggaagtaaaatgaaatttttacaaaagaagtag

SEQ ID NO: 29260 - DNA, 2451 bp, Artificial Sequence
  Description of Artificial Sequence: Synthetic coding sequence
atggatgtggggttctcacgcactacagtgcagacattatcgcggagtcattgtaaaaatatcaagcagaagatcagtcagtgggaaggccgtgcgaacgggatcagcaatcctgagaaatggtgcccaaaggacttcggagtgcggtataactgccatcaggagatccggcttaagaaaaaccccattgctgagcgaaagagtaagaatttggacgtgacgagcagggagaatgtgggactcgatattaatgagaacactaaaagccacgatcagtccgaaaatgagaacaaaaagcatgagtacgatgatactcatttcttcaagaacgagtctgagagtaattgggtgtgttctcgcgtcaaggaaatagaatcatgtaaggaggatgtcctggatcctgaaaccagtttgcctccaggcaacttttacacaagtcagatcctgtggaagaagatcgaggctctgcccccagacaagctcttgaatctcgcgctcgaacattgcgactcatcagagaaagagctgaacttccgcgttctggactcctcttatggtatcaccaaaagtcttgagaatatctactccgagccggagggccaggagtgtggccctagcattaatccactccctaaaccgaggaggactttcagatatctgtccgagtctggcgtgacgccgtacaaggagcggaattgcgacaagaagtattgcgaaaacaactcttgcgctcagagctctcttgcctcgagccaggaaccagagcccaagaagtatggcggcaagattagaggaagatccaagcgcaagtccttcgaattcgaagatatacagcacttccggaacagaaattcgcagaccatccgcgaggagctggggcggaacagcggctctgcactttactatacccagtctgaagacaatatttatgaagacatcatataccccacaaaggaaaacccctatgaagacattcccgtgcagcctttgcctatgtggcgcagcccaagtgcatggaaactgccgcctgcaaaatctgcattcaaggcacctaaactgcctcctaaaccccaatttctccatcggaaaactatggaagtcaagaactcccaagcttacctacgatctaaattgaccaaggacaccacgttgccggttaccctgacagagtggaagctgttccgtgctggggaggtagctaatacaaagcggaagaatctgcccaggctcgttctgaaaatagacgacatatttgagtctaaacgcggaaaaaaaaaggtcaaactgcacagctataccggtaaagaactgcccccaacgaagggggaaacctcagggaacgaaagcgatgccgaatatctacccaaaaaccgccataagagactggcccagcttcagccctcctctaaaaggaatcctcactatcagacacttgagcgagatctaattgaactccaagaacaacagctgtttgagctttttgttgtggtctctttgcaaaaaaaacctagcgggatatcctacatcccgcaagttatccagcagttccccgggaaggacgaccacggatacaagcagagcaaagacatggaggagagactgaaagtgatcccaaaattttgcttcccggactccaaagactggatgccaacatccgaactcaagagtgagacattcagttttgtgctgacaggtgaagacgggagccggtggttcgggtattgcaaaaaacttttaccagtcggaaaaggtaagcgactgcctgaagtttactgcatggtgtcaagactcgggtgtttcaacctattttcaaagatactcgacgaggttgaaaagcgaagagagatgagccccgccctcgtctatccgttcatgcgatcggttatggaagcccctttcccggcaccaggccggaccatcacattgcaagacctccccatcgaggaggtgctgattgtggatctgtgcgctgataagtttctgcaggaagttagcgacgaagatgagatcctacctcccaagctgcaggccgcacttatgcagattctggaagagcgaaatgagattttaacacaggaacagaacttttcccaggatgtcactctgaactccctggtgtcagaggcattcgtaagattctttgtggagctggtcggccattactccctcaatatgactgtgaccgagcggggcgagcgggtctttcagagggagccttttagaaagagccacacgagccgcagcgtccgacacttcttggatctatttatggagacacagatgtttgccggattcatccaggacagggagctgaggaagtccggcgtgaaggggctcttcgaaatcagggccatccagtacctcgagacgattcccgagtccgagccctccggcatgaacaggatccttcgttcactagggtataagatgaagttcctgcagaaaaaatag

SEQ ID NO: 29261 - DNA, 1416 bp, Artificial Sequence
  Description of Artificial Sequence: Synthetic coding sequence
atggaaggtcaagtggttgggcgagtgttccgcttgtttcagcggagactgctccagttgcgcgcggggcccccacaagataactccggcgaagcattaaaagaacctgaaagagcccaggaacactctcttccaaacttcgccggcggtcagcatttctttgagtacttgcttgtagtgtcccttaagaaaaagagaagcgaggatgattacgaacctatcatcacctaccagttccctaagagagagaatctgcttagaggccaacaagaagaggaggagcgattacttaaggctattcccttgttctgcttcccagacgggaacgagtgggcaagcctcactgagtacccccgcgagaccttcagctttgtcctgacgaatgtggacggaagccgcaagattggatattgccgccgcctgttacctgccggcccggggccacgcctccccaaagtttactgtattatctcttgtataggttgcttcggcctctttagtaagatcttggatgaagtggagaagcggcaccagatctcaatggccgtgatttatccattcatgcaaggcctgcgggaagccgccttccctgctcccgggaagaccgtgacccttaaatcatttatccctgactccggcaccgagtttatctccctgaccaggccccttgattcccatctagagcacgttgacttcagctccctgctgcattgtctgtctttcgaacagatcctccagatttttgcatccgcagtgttagaaagaaaaatcatatttcttgctgaggggctgtctactttgtcccagtgtattcacgcagccgctgcgttgctatacccattctcctgggctcacacatatattccagtggttccagaatcccttctggcaactgtttgctgtccgacccccttcatggttggggtacagatgagattccagcaggaggtgatggacagtcccatggaagaggtgcttctggtgaatctttgtgaaggcacattcctgatgtctgtcggtgacgagaaggacattctgcctcctaagctccaggacgatatccttgacagcctgggccagggaattaatgagctgaaaaccgctgagcagatcaacgagcacgtttcaggcccctttgtccaattcttcgtgaaaatcgttggccattatgcctcctacatcaaaagagaggccaatggtcagggacacttccaggaacgttcgttctgcaaggcgctgacaagcaaaactaaccggcggttcgtcaaaaagttcgtcaagacccaacttttttctttgttcatacaggaggctgagaaaagcaaaaaccccccagccggatactttcagcaaaagattttggaatacgaggagcagaagaaacagaagaaaccgcgagagaagactgtgaagtag

SEQ ID NO: 29262 - DNA, 1407 bp, Artificial Sequence
  Description of Artificial Sequence: Synthetic coding sequence
atggatgggctcggacgccgacttagagcttctctcaggttaaagcggggccacggggggcctccccaagacaacagcggggaggcactgaaggaacctgaaagagcgcaggagcattccctgcctaattttgcagggggccaacatttctttgagtatctgctggtcgtctccctgaaaaagaagaggagtgaggacgactatgagcccattatcacctaccagtttcctaaacgggaaaacctcctgaggggtcagcaagaagaggaagaacgcttactgaaggccattcctctgttctgttttccagacggcaatgagtgggcgagcctcactgaatacccacgcgagacctttagtttcgtgctgaccaacgtagacgggtcccgaaaaattggctactgtcggcgcctgctgccggccggaccaggcccaaggctccccaaggtttactgcatcataagttgcatcggatgttttggtctgttctctaaaatattagacgaggtggaaaaacgtcaccagatttcaatggctgtgatctacccattcatgcaaggactgagagaggcagcgttccccgcgcccgggaaaacggtgactctgaagtccttcatccctgattccggcaccgagttcataagtttgaccagacccctggattctcatctggaacatgtcgacttcagctccctactgcattgccttagcttcgaacagatcctccagatttttgcctccgcagtgttggagcggaagattatcttcctagcagagggcctgtcaaccctgtcgcagtgcatccatgctgcagccgccctgctttatccatttagctgggctcacacttatatccccgtggtgcctgaatccctgctggctacagtgtgctgcccgacaccattcatggttggtgtccagatgcggttccagcaggaagtgatggatagcccaatggaggaagttttgttggtcaatttatgcgaaggcacctttttgatgtctgtaggcgacgagaaggacatactgccacctaagttgcaggacgatatactggactctctgggacaaggcatcaatgagctgaagacagcagagcagataaacgaacacgttagcggaccctttgttcagtttttcgtgaaaatcgtcggccattacgctagttatataaagagagaggctaacggtcaaggacattttcaggagcggtcattctgtaaggccctgacctcaaagactaacagaaggtttgttaagaaatttgttaagactcagctattcagcctgttcatccaggaagctgagaaatccaagaatccccccgcaggctacttccagcaaaagattctggagtacgaagagcagaaaaaacagaaaaaacccagggagaaaacggttaaatag

SEQ ID NO: 29263 - DNA, 3597 bp, Artificial Sequence
  Description of Artificial Sequence: Synthetic coding sequence
atgcgctcactgaggaaaaagagagaaaagcccagacccgagcagtggaagggccttcctggacccccccgagctcccgaaccagaggacgtggctgtgccaggcggcgtggatttgctgaccttaccccaactatgctttcccggaggagtgtgcgttgctaccgagcccaaggaggactgtgtacattttctggtactgactgatgtctgcggtaaccggacttacggagttgtggcccagtactacaggccgttacacgacgagtactgcttctataatggcaaaacacacagggaatgtcccggatgcttcgtgccatttgcagtgtgtgtagtgagtcgcttcccgtactataatagcctcaaagactgcctcagctgtctgctggctctcctgaaaccttgtaaagactttgaggtcgattcccatattaaggattttgccgccaaactatcgctgataccgtcacccccccctggtccgctgcatttggtgtttaacatgaaatctctgcagattgttctccccgcccgggccgatcccgagagtccaatcctggacttagaccttcatctgccacttctatgctttaggcctgagaaggttctccagatcctgacctgcatcctaactgagcaacggattgtcttctttagtagcgactgggcccttctgacactcgtcaccgagtgttttatggcctatctgtatcccctccagtggcagcaccctttcgtgccaatcctcagcgatcagatgctagatttcgtgatggcgccaacctctttcctcatgggctgtcacctggaccattttgaggaggtttcaaaggaagcggacggactcgttttaattaatattgatcatggaagcattacatattctaagtccacagacgataacgtggacatcccagacgtgcctctactggccgcgcagacattcatccagcgtgtgcagagtttgcagctgcatcatgagttgcacgccgctcacctcctcagttccacagacctgaaggaaggcagggcacacagacggagctggcaacagaaactcaattgtcaaatccaacaaactactctgcagctcctggtctctatatttcgggatgtgaagaatcaccttaactacgaacatcgggtgttcaattccgaagaatttcttaagacaagggcccccggtgaccaccagttttataagcaggttctggacacttatatgtttcacagctttctgaaggctagactgaacaggaggatggatgcatttgcccagatggacctagacacccaaagcgaagaagatcggatcaatggcatgctactctctccgagaagaccaactgtagagaaacgcgccagcaggaagtcttcccacttgcatgttactcaccgtcgaatggtggtgagcatgcctaacctacaggacatagccatgcccgagctggcgcctagaaacagcagcttacgactgacagacacagccggatgtagggggagttctgccgtgctgaacgtcacgccaaaaagtccctacaccttcaaaatccctgagattcacttcccactagagagcaagtgcgtacaggcctaccacgcccattttgtttccatgctcagcgaggccatgtgttttctcgccccagataactctctgcttttagccagatatctgtatctgcgtggcctggtatatctcatgcaggggcaactgctgaacgccttgctggacttccagaatctgtataagaccgatatcaggatctttcctaccgacctggtcaagcggaccgtggagagcatgtcagccccagaatgggagggcgccgagcaggctccagagctcatgaggctcatctcagagatactggataaaccacacgaggcctcaaaactcgacgaccatgtcaaaaaatttaagttgcctaaaaaacacatgcagctgggtgactttatgaagcgtgttcaggaatccggaatcgtgaaggatgcttccatcatccatcggctgtttgaagcattgacggtgggccaggagaaacaaatcgatcccgaaaccttcaaggatttttacaattgctggaaagagactgaagctgaagcgcaagaggtttccctcccctggctcgtcatggaacatctcgataaaaatgaatgtgtgtgcaagttaagcagctctgtgaagaccaatctcggggtgggcaaaattgccatgacacagaagaggttgttccttctgacagaaggtcggcctggatacctggaaatttcaacgtttcgcaatattgaggaagtcaggagaaccacaacgacatttctgctaagacgcattcccacactaaagattagagtagcttcaaagaaagaagtgttcgaggctaacctcaagactgagtgcgacttgtggcatctgatggtcaaggagatgtgggcaggcaagaaactggcagacgatcacaaggatcctcattatgtacaacaggccttgacaaatgtgctcttgatggacgctgtagtgggcaccctacaatcacccggcgccatctacgctgcttccaaactgagctattttgataagatgtctaatgaaatgcccatgacccttcccgagacaaccttggaaacactgaagcacaagattaaccctagcgcaggggaggcttttccccaggcagtagatgtgttgctgtacacccctggacacctcgacccggcagagaaggttgaggacgcccaccccaagttatggtgtgcactctccgaagggaaggtaaccgtgtttaacgcgagcagttggacaatacaccagcattccttcaaggtgggtacggcaaaggtgaactgtatggtcatggcggaccagaatcaggtctgggtgggcagtgaggactccgttatttatatcatcaatgtgcactcaatgtcatgcaacaaacaacttaccgcccactgcagtagtgttaccgatctgatagttcaggatgggcaagaggcaccttcaaacgtctacagctgctcaatggatggcatggtgctcgtatggaatgtgtcaaccctccaggtcactagccggttccagttaccacggggcggtcttacttcaatccgtttgcacggagggcggctttggtgctgcaccggtaattcaatcatggtcatgaagatgaatggatccctccaccaggagctaaaaattgaagagaatttcaaagacacttctacatcgttcctagcttttcagctgttacccgaggaggagcagctctgggcagcgtgcgcaggaagaagtgaggtgtatatttggtccctgaaagatttggctcagccgccacagagggtgccactggaggattgttctgaaattaattgtatgatacgagtgaaaaagcaggtatgggtggggtcccggggcctgggtcagggcacccctaaaggaaagatttatgttatcgacgctgagagaaagacagtggagaaggagctcgtcgcacatatggacactgtcaggaccctttgctctgccgaagaccgttatgtactttctggaagtgggcgcgaagaaggaaaagtcgcaatctggaaaggggaatag

SEQ ID NO: 29264 - DNA, 3441 bp, Artificial Sequence
  Description of Artificial Sequence: Synthetic coding sequence
atgagaagcctccgtaaaaaaagagagaagccgagacctgagcagtggaaaggattacctgggccacccagagcacccgagccagaagacgtggctgtcccggggggggtggacttgctcaccctcccgcagctgtgttttcccggaggtgtgtgcgtggccaccgagccaaaggaggactgcgtgcatttcttggtgctcacagatgtttgtggtaatcggacatatggtgtggtggcccagtactacagaccactgcacgatgagtattgtttctacaacggaaaaactcacagagaatgtcctggatgcttcgtcccctttgcggtttgcgtggtctcccgcttcccctactataactctctgaaagactgtctgtcatgtcttctcgccttgctcaaaccttgtaaagattttgaagtggatagccatataaaagattttgcagccaagctttctctaataccaagccctccgcccgggcctctgcatctcgtgttcaatatgaagtccctgcagatcgttctgcctgctcgagccgatcctgaatctcctattttggatttagacctgcatttgcccttgctctgcttccggccagagaaggtacttcagatactcacttgtatcctcacagaacagagaattgtgtttttttcctctgattgggccctgttgacccttgtgaccgagtgctttatggcctacctgtaccctctgcagtggcagcaccccttcgtgcctatattgtccgatcagatgctcgacttcgtaatggcccccacttccttcctgatgggctgtcacctagaccacttcgaagaggtctccaaggaagccgatgggctggtgctcatcaatattgatcacggaagtatcacatactccaagtccaccgacgacaatgtcgatatcccagacgtccccctccttgccgcccaaacattcatccagagagatgtgaagaaccatctgaattacgagcatcgcgtattcaacagcgaagaattcctaaagacacgagcaccgggggatcaccagttttataagcaggtacttgatacctatatgttccactcatttctcaaagctcgtttgaatcggcgtatggacgccttcgcccagatggatctcgatactcagtctgaggaggatcgcattaatgggatgcttttgagcccgcgaagacccaccgttgaaaagcgtgcttcccgtaaaagtagtcatctgcatgttactcaccggcgaatggtggttagcatgccaaaccttcaggatattgctatgcccgaactggcgccaagaaactccagcctccgtttgacggacacagccggatgccggggaagctctgcagtgctgaatgtgacacctaaatctccttacacatttaaaatcccagaaattcacttcccactggagtccaagtgtgtgcaggcttaccacgctcattttgtgagtatgctctcagaggccatgtgctttctcgcgcctgacaattcactgctcttagcccggtacctctatctgcgggggctggtttatctgatgcagggtcagctgttgaacgcattgcttgacttccagaatctctataagaccgatattcgcatattccctactgacctggtaaagcgcaccgttgaatccatgtctgcccctgagtgggagggggcagagcaggctcctgaattgatgagactgatttcagagatactggataagcctcatgaggcctccaagctggatgatcacgtgaagaagtttaagcttcccaagaagcacatgcagcttggggatttcatgaaaagagttcaggaatctggaattgtcaaggacgccagtattatccatcgcctgttcgaggccttaacagtgggccaagagaaacaaatcgacccggagactttcaaagatttctataattgttggaaggaaacagaagctgaagcacaggaggtgtccctgccatggcttgtcatggagcacttggataaaaacgagtgtgtctgtaagctgtcctcatctgtgaaaaccaatttaggcgttggaaaaatcgcaatgacacagaagaggttgtttctcctcactgaaggaagaccagggtatctggaaatctcaaccttccggaacattgaggaggtgaggcggacaacaaccaccttcctgctaaggcgcattcccacactcaaaatcagggtggcttccaagaaggaggtgttcgaggctaatctgaagactgaatgcgatctttggcatctgatggtgaaggaaatgtgggccggcaagaaacttgccgacgatcacaaggaccctcactatgtacagcaggccttgactaacgtcctgctgatggacgctgtggtgggaaccttgcaaagtcctggggccatttacgccgccagcaagctgtcttatttcgataagatgtctaatgagatgccgatgactctgcctgaaacaacattagagacactgaaacataagatcaatccctccgcaggcgaggccttcccccaggccgtggatgtgctgttgtacaccccgggccaccttgatcccgcagagaaagttgaggacgcacaccctaaattgtggtgcgccttgagcgagggtaaggtcaccgtttttaacgcctcctcctggaccattcaccagcattcttttaaagtgggaactgctaaagtgaactgtatggtgatggccgaccagaaccaggtctgggttggcagtgaagatagcgttatatacattattaatgttcactccatgagctgcaataagcagctgaccgcccattgtagcagcgtaacagatctgatcgttcaggacggtcaggaggctccctcaaacgtgtattcttgtagcatggatggaatggtgctagtgtggaatgtgagcacgctccaagttacctcccgttttcaactgccccgcggcggcctcacgagcatccgccttcatgggggaaggctatggtgttgcactggaaactctattatggttatgaaaatgaacgggtctctgcatcaggagttgaagattgaagaaaacttcaaagatactagtacgtcctttcttgcattccaactgctgccagaggaagagcagctctgggccgcttgcgccgggcgctctgaagtttacatatggtccctcaaggaccttgcccagcccccacaaagagtcccgctggaagattgctcagagatcaactgcatgatccgggtgaaaaagcaggtgtgggtgggctcccgcgggctcgggcaggggacgcccaaaggaaaaatatacgttatcgatgccgaaagaaagaccgtggaaaaagagcttgtggcacatatggatacagtcagaactctttgctcagctgaggataggtacgttctttccgggtccggacgtgaggagggaaaagtagccatttggaagggcgaatag

SEQ ID NO: 29265 - DNA, 4491 bp, Artificial Sequence
  Description of Artificial Sequence: Synthetic coding sequence
atggctgaagaaagacctccgcggctggtggactattttgtggtcgcaggcctggccggcaacggggccccaatccccgaagagacttgggtgccagaacctagcggccccctaaggccgcctagaccagccgagcccataacagacgtcgccgtcatcgccagagctctgggcgaggaggtcccccagggatacacgtgtattcaggcttcggccgggggccatcctctcgaattgtctgcggggttactgggggggacacagccagtgatttgctaccgtagaggaagagataaacctcctttggtggagctgggggtgctgtatgaaggcaaagagaggcccaagcctggcttccaggtcctggacacaaccccttactctcattccgctaacttggccccccccgggccaggtcacccccggacataccttacatatcgtagggcggcggaaggagctggactccacgcgctcggtattaccgacctgtgtcttgttctccccagtaagggagagggaacaccacatacttactgtaggctacccaggaacctgaaccccgggatgtggggccctgcggtttatttatgttacaaggtcgggcttgctaaagctaacacccttgtttatgaagctgagctcttgggacgatatcctgaggaggacaatgaagcctttccattacccgagagcgtacccgtattctgtctgcccatgggcgctactattgagtgctggccagcccaaacaaagtatcccgtccctgttttctccacctttgttctgacaggagccgcaggcgacaaagtgtacggcgccgccctgcaattttacgaagcctttcccagagcgcggctgagcgagagacaggcgcgtgccctcggtctcttgtcagctgtggaacgaggcagagcactggggggcagggctgtgcggagtcgccgcgccatagctgtactatcgagatggcccgcctttcctgcattcagggccttcctcacctttctctacagatacagtgtaagcggaccacaccgactgccccttgaggcccacatttctcactttatacataacgtgccattccccagcccacagcggcctagaattttggtacagatgagcccatatgacaacctgctgttatgccagcctgtgtcttcaccactgccactaagcggggccagcttcctccagcttctacaaagcctgggaccagagcttgccattacccttctgctcgccgtgctgaccgaacataagcttcttgtgcattcactgcgccccgatctgttaaccagcgtatgtgaagctttggtctccatgatttttcctctccactggcagtgcccctacatccctttgtgtcctctcgtgttggcagatgtgctgagcgctccggtgcccttcatcgtgggaattcatagttcatattttgacttgcacgaccccccagccgatgtgatttgtgtagacctggacacaaacaccctgttccagacagaagagaagaagctgctgtccccccggaccttgcctcggagaccctacaaggtgctccttgccacactcaccaatctctaccagcagctggaccaaacatatactggccccgaagaggaagcaagcctggagttcctgctgacagattacgaggccgtgtgtggtcggcgcgcaaggctcgagcgggaggtccagggcgccttcctccggttcatggcctgtttgctcaagggataccgagtgtttttgcgacctctgacgcaggccccatccgagggggcccgagacgtggacaacctctttttcctccagggatttcttaaatcccgtgagcgctccagccacaagttgtactctcaattactgcacacccagatgttctcccagttcattgaagaatgttctttcggtagcgcccgccatgcagccctggaattctttgactcgtgcgtggagaaagtccacccggaacaagaaaagcccgaacccactcctctggtggaattggaggagctgagtggaagcgagctcacagtctttatcaccccaccagaggaacctgcactccctgagggctcagagtctacgccccaatattgctacgatgggttcccagaactgagggcagagcttttcgagtccttgcaagaacagcctggggccttgccagttccagggccttcacggagcgccccctcctccccggcccctcgacgaacaaagcaggaaatgaaagttgcccagagaatggctcagaaatcggcagccgtcccagagttgtgggccaggtgcctacttggccactgttatggactctggtttttgtgccttcctgcctatgttagatctgctccaagcagagtacaagctctgcatactgcataccacgtactgaggcaaatggagagtggaaaggttgtgctgcctgacgaagtctgttaccgcgtgttgatgcagctttgtagccattatgggcaacctgtgctgagcgtccgcgtgatgttagagatgagacaggccggaatcgttcctaacaccatcacctacggatactataataaggccgtgctggaatccaaatggccgagtgggacacctggaggtagactccgctgggctaagctgcggaacgtggttctcggagctgcgcaatttcgacagccgctacgcgagaggcagcagcagcaacaacaacagcagcaacagcagcagcagcaacagcaagaacaagtatctgcccaccaggaagcggggtcttcccaggctgagccctatctggagagaccaagtcctacaagacccctacagcgccaaacaacgtgggcgggccgctcgctcagggatcccgcttccccgcccggtaggttggtcaaatccgggagccttggcagtgccagaggagcacagcctactgtcgaggcaggagtggctcacatgatcgaggctctcggggtgttggaaccccgtggatctccagtgccatggcatgacggaagtctttcagacttgtctttgaccggcgaggaacccctccctggtgggagccctggcgggagcggatctgctctaagcgcgcagtcaaccgaggccctcgaaggtctgtcaggaaggggccccaaggccggcgggaggcaggatgaagccggaacgcctcggagggggctgggtgccagacttcagcagctgcttacgcccagcagacatagtccagccagccgcatacccccgcctgaacttcctccggacttacccccccccgcacggcgtagtccaatggacagcctgttgcatcctcgggagcgtcctggaagtacagccagcgaaagttctgcctctctgggctctgaatgggacctgagtgagtcaagcttgtctaatctgtctctgcggaggtcgtctgagaggctaagtgacactcccgggagtttccagagcccatctttggagatactgctgtccagctgctcactttgccgggcatgtgactctttggtctatgacgaagaaatcatggcaggctgggcgcccgacgacagcaatttgaacacgacatgtccattctgtgcttgccccttcgtgccgttactgagtgttcagacgttagatagtagaccttccgtgccttcacccaaatctgccggggcctccgggtccaaagacgcccccgtacctggaggccctgggcccgttctttctgatcggcggttgtgtttggctctggatgagccacagctctgtaacggccatatggggggtgcatcccgacgagtagagagcggcgcgtgggcctacctgagccccttggtattgagaaaagagctggaaagcctggtcgaaaacgaagggagtgaagtgctggctctccctgagctgccgtctgcacatcctatcattttttggaatttactatggtactttcagcgcctgaggctgccctccatactgcccgggctcgtgctggcttcttgcgatgggccctctcattcacaggccccttcaccatggctgacccccgaccccgcttcagttcaggtgagactgctgtgggatgtcttaacccctgacccaaactcatgtcccccgctttatgtgttatggcgagtgcactctcaaatcccacagagagttgtgtggccaggcccagtccctgcctctctgagcctcgctctcctagaatccgtgctgcgtcacgtggggcttaacgaagttcataaggccgtagggctcctcctggaaaccctgggcccgcctccaacgggccttcacttgcagcggggaatttaccgcgagatcctcttccttactatggccgcactagggaaggaccatgttgacattgttgctttcgacaaaaaatacaagagtgcttttaacaaactggcaagttcaatgggcaaagaagagctgaggcatcgaagggcgcaaatgcctacccccaaggcaatcgactgtagaaaatgtttcggcgcgccccctgaatgttag

SEQ ID NO: 29266 - DNA, 1002 bp, Artificial Sequence
  Description of Artificial Sequence: Synthetic coding sequence
atggtgccaggagaggaacccgctcgggaactcatggctgtgctgctgacccctaggttcaggcgattggtgtctcagaacgaattgccaggacctggccttaacggcccatcgtctagaaacaggcgcgatggattttgcaggaagcgacgaaccggagtgcatctttgtcaggtgctcatgaaccacaaggtctttgagcctgtgggaatgaagaagctgttcaaaaaggagaaagagcttgaattcgaggactcgaacattagcctttataggtttctgggcaacaaaagctcttacgactgctgtaagcgccaaaaagacgcagaaaatgaattcaacgagaccttgagaccagggtacgagatgatctccaatcccttggcgcaggaaattggcgaagagcggattgaagagctgatacataccattaatgggaaccctgctttatgccccaacattactgtgcaaaaaccatttctgagactctctaaagagggggtgagcttctacaccgccattacttctgataagacggatgtctggaaagagcagacactcttgtgtttattacaattgatccatctgccctttctcgacaatattctggagccaccagtgaaaacacaaaatctacaactgaataaagaggaggacctggtgatcaccaatacctgtctggatagggaacttatcccctcactgtgtctgcctgagatcgacaattggctgaacgctgccatagagtgcctggaatattttccggaccaactgattgtcaccgtttcccagcagttgatgcaaaatcgcaatgaagagacccgactgaatagccagaaaaaaatcctgtttgacgtcatcgccaaatattatgctcaagaacgggattgtctcctcacagatgagtacttcgacatccacagtggaattattgagttactggaaaatgagaaacgcgcagaggccctcgaagccacccagctgtacctcaggctactgtag

SEQ ID NO: 29267 - DNA, 885 bp, Artificial Sequence
  Description of Artificial Sequence: Synthetic coding sequence
atggtacctggtgaagaacccgccagagagttaatggccgtgttgttgactcctcggtttaggcggctggtctcacagaacgagctgccaggaccaggcttgaatggcccttcaagccgtaaccgccgagacggattttgtcggaagagaaggaccggctgttctggcccttttcaggctacacagttgtgggatgggatcatccactctctccaggcacaagtggagatcaagagacgcagacaccaccttcagacatataaagattgtttcaccgggtcggacgcggtagacgtggttctgagtcacctcatgcagaacacgtgtctttcctccaacgacatatcctgtctgaaaggcgttcacctgtgccaggtgttgatgaatcataaagttttcgagcctgtcggaatgaagaagctgttcaagaaggaaaaggagctggagttcgaggactcgaacatttctctgtaccgcttccttgggaacaagtcatcttacgactgctgcaagcgtcaaaaggacgcagagaacgaattcaatgaaactctgagacccggatacgagatgataagtaatccactggcgcaggaaattggtgaggaacgtattgaggagcttatccacactatcaacggcaatcccgcattatgccccaacataaccgtacagaagccttttcttcgcctgagcaaagaagacgtatggaaggaacagacgttactgtgccttctgcaactgattcacctgccctttcttgataatattcttgagccgcctgttaagactcaaaacctccaattgaataaagaggaggacctggtcatcaccaacacatgtctggaccgtgaacttattccaagtctatgcttaccggagaagtag

SEQ ID NO: 29268 - DNA, 1164 bp, Artificial Sequence
  Description of Artificial Sequence: Synthetic coding sequence
atggtgcccggggaggaacccgcccgggaactgatggccgtgctcctgacgccaagattccggcgtctagtcagccagaatgaattgccaggaccggggctcaacggaccctcgtcacggaatcgtcgtgatggcttctgccgaaaaaggcgcacaggctgctctggaccctttcaggctacccagctgtgggatggaatcatccattcccttcaggcccaggttgaaattaagcgtaggcgtcaccatctccagacgtataaggattgcttcaccgggtcagacgcagtggacgtggtactgagccatctgatgcaaaatacctgtctgtccagcaacgatattagctgtctcaaaggggtgcacctgtgtcaggtgctgatgaaccacaaggttttcgaaccagtcggtatgaaaaaactgttcaaaaaagaaaaagagctggaattcgaagattcaaacatatccctgtaccgctttctgggaaataagtctagttacgattgttgtaaacggcagaaggatgctgagaacgagttcaacgaaacactcaggccgggctatgagatgattagtaatcccctagcccaggaaatcggagaggaacgcatagaggagctgatccacaccatcaatgggaatccagctctgtgtccaaatattactgtccagaagccatttctccggcttagtaaggaagacgtttggaaggagcaaaccctgctgtgccttctccagttaattcacttgccattcctggacaacattctggaacccccagttaagacccagaatctacagcttaacaaggaggaggatctggtcattaccaatacatgtctcgacagagaactcatccctagcctgtgcctgcccgaaattgacaattggttgaacgctgctatcgagtgtctggagtactttcccgatcagttgatcgtcacagtatcacagcagctgatgcagaatagaaatgaggagacccgattgaacagtcagaaaaagatcctgtttgacgtgatagctaaatactatgcacaggagcgagattgtctcctgactgacgagtattttgacattcattctggtatcatcgagctgctagaaaatgaaaaacgggctgaggctcttgaggcaacccagctgtacctgcgattattatag

SEQ ID NO: 29269 - DNA, 309 bp, Artificial Sequence
  Description of Artificial Sequence: Synthetic coding sequence
atggcagatttcctcaagggcctgcccgtttacaacaagtccaacttcagcagattccacgccgactcagtgtgtaaagcctcaaatagacgcccatccgtgtacctgcctacccgagaatacccatctgagcagatcattgttacggaaaaaacaaatattttgctgagatacctgcaccagcaatgggataaaaagaatgcagcgaagaaacgtgaccaggagcaagtcgaactggagggggaatcgtcagcacccccccgcaaagtagctcgcaccgattcaccagacatgcacgaggacacttag

SEQ ID NO: 29270 - DNA, 528 bp, Artificial Sequence
  Description of Artificial Sequence: Synthetic coding sequence
atggatatcgcaattcaccatccatggatccgtagaccgttctttcctttccacagtccctcccgactctttgatcagttttttggcgagcatctcctggagagtgatctgttccccacctctacaagcctcagtcctttctatctgaggccgccttcgttcctgcgggcccccagctggttcgatactggcctgtcggaaatgagactggaaaaagatcgcttcagcgtcaaccttgatgtcaagcactttagccctgaggaattgaaggtgaaggtgttgggggacgtcattgaggtccatggtaagcacgaggaacgccaggacgaacacgggtttatcagtcgcgaatttcaccgtaaatataggatccctgccgacgtggaccctctgaccatcacatcttcactgtcctccgacggtgtgctcaccgttaacggtccaagaaagcaggtgagcggacccgaaaggaccatccccatcactcgtgaggagaaaccagccgtaactgccgcaccaaaaaagtag

SEQ ID NO: 29271 - DNA, 1032 bp, Artificial Sequence
  Description of Artificial Sequence: Synthetic coding sequence
atgatgttcccaggcctgctggcaccccccgctggctacccctctcttctgcggcctacgcctactctaacacttccacaatcccttcagtcagcctttagcgggcattcttcctttctggtggaagacttgattcggatctcccggcccccagcctatctgccacggagcgtgccaactgcttcaatgagccctcccagacaaggggcccccactgcgctgacggacacaggagccagtgatcttggcagccctggtcccggaagcagaaggggggggtctccgccgacagcatttagtcctgcctccgagaccacttttctcaagtttggcgtgaatgctattctgtcatctgggccacggacagagactagccccgctttgttgcagtcagtgcctcccaagacgttcgcttttccctacttcgagggatcctttcaacctttcataaggagctcttacttcccagcctcttcctctgtggtacctatcccggggaccttctcctggcctttagccgctcgtggtaagccaaggagaggtatgctgcgccgagcagtgtttagcgacgtccagcggaaggctctggagaaaatgtttcagaaacagaaatacatttcaaagcctgacagaaaaaagctagcggctaaactgggtctgaaagactcccaagtgaaaatttggttccagaatcgacgtatgaagtggcgtaactctaaggagcgggagctcctgagctccgggggttgccgggagcagaccctgcctacaaaactgaatcctcatcccgacctttctgatgtagggcagaaaggtcctggaaacgaagaagaggaggagggaccagggagccccagtcaccgcctggcttaccacgcctcgtccgaccctcaacacctgcgggatccacgcctgccaggccctcttccccccagccccgctcacagcagctcgcccgggaagccctcggacttctcagactcagaggaggaagaagagggggaagaacaggaggagatcactgtgtcctag

SEQ ID NO: 29272 - DNA, 288 bp, Artificial Sequence
  Description of Artificial Sequence: Synthetic coding sequence
atgctcggcgctcgcgtggcagcccacctggatgccttgggcccactggtgccatatgtgcctccacctctcttgccttctatgttttatgtgggtctcttctttgtgaacgtcctgatcctttactatgccttcctcatggagtatattgtcctcaacgtgggcttggtatttttgcctgaagatatggaccaggcactggtcgacctgggggtgctttcggatcccgggtctggcctctatgatgcagacagtgagctggacgtttttgatgcttaccttgagtag

SEQ ID NO: 29273 - DNA, 3816 bp, Artificial Sequence
  Description of Artificial Sequence: Synthetic coding sequence
atggaccggggagccgctgctgctcaagggaccgcaccaccacaggacggagaacaacccgcagagtcaccagagcccccacctccttggccgccaccgccccccccccctgcacctccgcccgctcccccactcctgtcagaggcatctcctgaaccaatccccgaaccttgtcccgaactggccccgggcccttgtcccgaggcaactagcgaaagtgcaacagaactttacacggagcccacccctgagccggctaccgaacctgccagcgagcctgctccagaacccgctacggagccagcaccggagcctgcgactgagcctgcccccgagcccgcgcccgagccagccaccgagtcagcacccgagccgacgccggagcccgccctggagagcgtccctgaaccggcaccagaattaactccagaagtggcacccgaacttgcaccagaaccaactccagaacccgtgacagaactggctcccgaattttgtccagaggctgcccccgagttccgtccctctcccgcgccctgcctgctgcagtgccctgtggacactcgtgaacgcggcctgaagaccagtccaagccctagcccaagcccctctccacgtaccccaatgagctggagtcggatcaagaagattcttaaggagggaccgatgcttaaaaactgtaactccttcaagagatggaagttaagatacttcctcgtgcagggccagaaactgtattttgcccatcatcccgctttcgctcatttcgagacaatagatctctcacaggccaccgtagccgagtctagttgccgcaatctttgtcattcgttctgcgtgataacaccccagaggaaaattactctcgctgcgcctaatcggaaagatatggaggagtggatcaacatcatcaagaccatacagcagggggagatatacaagatccccgccgccgagaacaatccttttctggtgggcatgcattgctggtactcttcctattctcatcgcactcagcactgcaatgtttgtcgggagagcatacctgctttatcgcgcgacgcaatcatatgcgaagtttgtaaggtcaaatcccatcggctctgtgcactcagggcaagcaaagattgtaaatggaacaccttatcaattactgacgacttgctattgccagctgacgaggtgaacatgccgcaccagtgggtggaaggaaatatgccagtgagctcccagtgcgcagtttgccatgagagttgcgggtcctatcaacgtctgcaggactttaggtgcctgtggtgtaactcaacagtccatgatgattgccgccggcgattctccaaggaatgctgctttcgatctcatagatccagcgtgattccgcctactgccctatccgatccaaagggcgatggacagttagtagtcagctccgacttttggaatttggactggtcatccgcttgcagttgtcctttgctgatcttcattaatagtaagagcggggatcatcagggaatcgtgtttctgaggaagttcaagcagtatcttaatccttcccaagtattcgatctgctgaaaggcggacccgaagcgggattgagcatgttcaagaacttcgctcgatttcggatcctggtgtgcggaggcgatgggtcagtgagttgggtccttagcctcattgatgcctttggcctccatgagaagtgccagctcgctgtaataccgctcgggacaggcaacgatctcgcacgagttctcgggtggggcgcattctggaacaagtcaaaatcgcccctcgacatcttgaacagggtagagcaagcatctgtaagaattctggaccggtggtctgttatgatacgtgagaccccaaggcagacaccactccttaagggccaggtggaaatggacgtcccaaggttcgaggcagccgccatacagcacttagagagtgccgctaccgagctcaacaagatactgaaggccaaatatccaactgagatgattattgcaacccgctttctgtgctcagctgtcgaggacttcgtcgtggacatagtaaaagcttgggggcaaattaaacagaataacacagctatagttagtgtgatccttaagtctgacctgatgtatgatcggctctcagtgctaatcgatgttctagctgaagaagcagctgctactagtgcagagaagtcagccactgagtatgcggactcatctaaagcagatagaaagcctttcatccctcagattgaccatatcgctaaatgcaaactggaacttgctacaaaggcccagtccctgcagaagagtctcaagctgatcatctttcaggtggagcaggctctagacgaagagagcagacaaactatttccgtgaagaatttcagtagtaccttcttcttggaggacgacccggaagacattaaccagacgagccctcgccgcagatcgagacgcggaaccctgagctccatctcgtctctcaagagcgaagacctcgataatctcaatttagatcatttgcattttaccccagagagcatccggttcaaggagaagtgcgtcatgaataattacttcggcatcgggctcgacgctaagatttccttggattttaacacccgccgcgacgagcatccaggacagtacaactcccgcttgaagaataagatgtggtatgggctgcttggcaccaaagaactcttacaacgcagttatagaaagctagaggagagggtgcacctagaatgtgacggggagacgatcagcctccctaacctccagggcatagtggttctgaacatcacttcctacgcaggcggcatcaacttttggggctccaacactgctacaaccgagtacgaggcgcctgccattgacgatggtaagctggaagtggtcgctatctttggcagtgtgcaaatggcaatgagtcgaattattaatttgcaccatcatagaattgcccagtgccatgaggtgatgattaccattgacggcgaggaaggaatcccagttcaagtggacggagaagcatggatacagcggccgggcctcattaaaatcaggtacaagaatgctgcccagatgctcacaagagatagagactttgaaaatagcatgaagatgtgggaatataagcacacagagatacaagccgctccgcagccccaactggatttccaggactcacaagaaagcctcagtgacgaggaatacgcccagatgcaacatctagcccggcttgccgaaaacctcatcagcaaactgaacgacctctcaaagatccatcagcacgtttctgttctgatgggcagcgtcaacgcttctgcaaatattttgaacgacatattttatggccaagactcaggtaatgaaatgggcgccgcgtcctgtattcctattgaaactctgagcaggaatgacgctgtggatgtcactttctccttaaagggattgtacgatgatacgaccgcttttctggatgagaaactgctgcgctccgctgaagacgagaccgcactacagtctgcactggacgccatgaataaagagtttaagaaactatcagagattgactggatgaacccaattttcgtgcccgaagagaagtcgagcgacactgactcgcgctctctacgactaaagatcaagttcccgaaacttgggaaaaaaaaagtcgaggaagaacgcaaaccaaaatctggccaatctgtgcagtcattcataggaaatctctggcacaggcggcatagagaagacgaagctgagggggacgacccactgacccctagccggtcgcagctgtag

SEQ ID NO: 29274 - DNA, 2550 bp, Artificial Sequence
  Description of Artificial Sequence: Synthetic coding sequence
atgtccgaagagcgtagcctctctttacttgccaaagcagtagatccacggcacccaaacatgatgaccgacgtggtcaaacttctgtctgctgtgtgcatcgtgggggaggagtcaatattggaagaagtgttggaagccttgacatcagccggagaggagaagaagatcgatagatttttttgcatcgtggaaggtctgaggcataactcggtgcagctgcaggtggcctgtatgcagctcatcaacgctctagtgacttccccagatgaccttgatttccggctccatatccgaaacgaatttatgcggtgcggcctaaaagaaattcttcctaatctaaagtgtatcaaaaatgacggcctggacatccagctcaaagttttcgacgagcataaggaggaggatctgttcgaactttcacatcggcttgaagacatccgcgctgaattagatgaagcgtacgacgtttacaatatggtttggtcgactgtgaaggaaacgagggcagagggttattttatttctatcctccagcacttgctcctaattcggaacgattacttcattcgccagcagtacttcaagttgattgatgaatgtgtgagccaaatcgtcctccatcgcgacggaatggaccccgattttacctataggaaaagactggacttggacctgacccagtttgtggacatatgtatagaccaggccaaactggaggaatttgaagagaaagcctctgaactgtacaagaaatttgaaaaggagtttactgatcaccaggaaacacaggccgagctccaaaagaaggaggcaaaaatcaatgagctccaagcggagctgcaggcctttaagagtcaatttggagctctgccggctgactgtaacatccccctccctccatccaaagaaggcgggaccgggcatagcgcattgccaccaccgccccccttgccctcagggggcggcgttccccctcccccgccaccccctcccccacctcctctcccaggcatgagaatgccttttagcggacccgtgccacccccgccacccttaggttttcttggcggccagaactccccacctttgccaattctgcctttcggcctgaaacctaaaaaggagttcaagccagagatcagcatgaggcggctgaactggttgaaaataagaccacacgagatgactgaaaactgcttctggatcaaggtgaacgagaacaagtatgaaaacgtagacctcctgtgtaaactggagaatacgttctgctgccagcagaaagagcgccgagaggaggaggacattgaagaaaaaaaatctattaagaagaagattaaggagttgaagttcctagactctaaaattgcccagaacctgagtatcttcctcagcagcttcagagttccatacgaggagattaggatgatgatactcgaagttgatgaaacgagactcgctgagtccatgatccagaatctaatcaaacatctccctgatcaagagcaactgaattccctgagtcagtttaagagcgagtactccaatctgtgtgagcctgagcagttcgtggtggtgatgtctaacgttaagagactcaggcctagactctccgccattctcttcaaactgcagtttgaggaacaggtcaataacattaagccagatattatggcagtgtccactgcttgtgaggagatcaagaaatcgaaaagcttctccaagctcttagaactcgtcttgctgatgggtaattatatgaacgccggttcccgaaatgctcagacttttggctttaacttgtctagcctttgtaagcttaaggacaccaaatcagccgatcagaaaacgactttactacactttttagttgagatctgcgaagaaaagtatccagatatcctaaacttcgtggacgacctcgaaccactcgacaaggcttcaaaggtctccgttgaaactctcgaaaaaaatctgagacagatggggagacagctccagcagttggagaaggagttggaaacatttccgcccccagaggacttgcatgataagttcgtaacaaaaatgtcaatcttcgtgattagtgcgaaggaacaatacgagaccctctccaaacttcatgaaaacatggagaagctttaccagagcattatcggttattacgccattgacgttaagaaggttagcgtggaggacttcctcacggacctgaataacttcaggaccacttttatgcaggcaatcaaggaaaatatcaagaaacgcgaggctgaagagaaggaaaaaagggtgcggattgctaaagaacttgctgagcgtgagcggctggaacgacagcagaaaaaaaaacgcctgctggagatgaagaccgagggagacgagacaggcgttatggacaatctgctcgaagctttacagagcggagccgccttcagggatcgacgcaaacggacgcctatgccgaaggacgtgaggcagtcattaagtcccatgtctcagcggcccgtattgaaggtctgtaaccatggcaataaaccgtatctgtag

SEQ ID NO: 29275 - DNA, 3582 bp, Artificial Sequence
  Description of Artificial Sequence: Synthetic coding sequence
atggagcggcatcagccaagactgcaccacccggcccagggatccgcggccggtacaccatatcccagcagcgccagtctacgtggctgcagggaatctaagatgccacggcgcaaagggccgcagcacccaccccccccaagtgggcccgaggagcctggggagaaaaggcccaaattccacttgaatatcaggaccctgaccgacgacatgctggataaattcgcgtcaattaggatccctggttcaaagaaagagaggccacctcttcccaacctaaaaactgctttcgccagctcggactgttccgccgccccactggaaatgatggagaactttcctaagccactaagtgaaaacgaactgctagagctgtttgagaagatgatggaggatatgaatctgaacgaagacaaaaaggcacctctgagggaaaaagacttcagcatcaaaaaggagatggtgatgcagtacattaacacagcatccaagaccgggagcctgaaaagaagccgacagatcagcccccaggagtttatccacgaactgaagatgggaagtgcagacgagcgcctcgttacgtgcctggagagcctgagagtctccttgacgagtaatccagttagctgggtcgaatcatttggccatgaggggctgggccttctgctggatatactggaaaaactcatctcaggaaagatacaggagaaagtggtgaagaaaaaccagcataaagtgattcagtgccttaaagcactaatgaatacccaatatgggctagaaagaatcatgagtgaggaacggagtctgtccttgcttgccaaagccgtggatcctagacacccaaatatgatgacagatgtggtgaagcttcttagtgccgtctgtattgtcggagaggaatctatacttgaggaagtactggaggccttgacatccgccggtgaagaaaagaaaatcgacaggttcttctgtatcgtggagggtctgaggcataactcggtgcagctccaggtggcttgtatgcagctgataaatgccctggttacaagtcccgacgacctagatttcagactccacattaggaacgagtttatgcggtgcggattaaaggagattctacccaaccttaagtgtataaagaatgatgggctagacatacagttgaaggttttcgacgagcataaagaagaggacttatttgagctgagccaccggctggaggatatccgggccgagctggacgaggcctacgatgtctataacatggtttggagcaccgtcaaagagacccgtgcagagggttactttatttccatcttgcagcatctgctgctgataagaaacgactacttcatcagacagcagtatttcaagctgattgatgaatgcgtgtcccagatagttctgcaccgtgacggaatggatccagattttacgtaccggaaaagacttgacctggatctcacgcagtttgtggacatttgtattgaccaggccaaactggaagagttcgaggagaaggctagcgagctctataaaaaattcgagaaggagttcaccgaccatcaggagacccaagccgagcttcaaaagaaagaagctaaaataaatgagctacaagcagagctgcaagcattcaagtcgcaatttggagcactgccagccgactgcaatattcctctgcccccttctaaagagggcggcactggacacagcgccctgccacctccgccccccctccctagtggagggggcgtgcctcccccccctccccccccaccccccccgcccctgcccggcatgagaatgccctttagtggcccagtgccaccgccccctccactaggtttcctgggggggcaaaactctccacctctgcctatcctgcccttcggattgaaacctaagaaggaatttaagccagagatcagtatgagaagactgaactggctgaaaatccgaccccatgaaatgaccgaaaactgtttttggatcaaggttaatgagaataaatatgagaatgtcgatcttttgtgtaaactcgaaaacacattctgctgtcagcagaaagagcggagggaggaggaagacatcgaggagaaaaagtccatcaagaagaagatcaaagaactgaaatttttagattccaaaatcgctcaaaacctgagtatcttcctgagcagttttagagtcccctatgaggaaatcagaatgatgatcctggaagtggatgaaacgcggctggctgaaagtatgatacagaatttaattaagcaccttcctgaccaggagcagctcaatagtttatcccagttcaaaagcgagtacagcaatctgtgtgagcccgagcaatttgtcgtggtgatgagtaatgtaaagagactgcgccctcggttaagtgccatcctcttcaaacttcagttcgaggagcaggtgaacaatatcaagcccgatataatggccgtgagtactgcctgcgaggagattaagaaatccaaatcattttcgaaactgttagaacttgtgctgctgatggggaactacatgaatgccgggagcagaaacgcccaaaccttcgggttcaatttatcctccctgtgtaaattaaaagatacgaagagcgccgatcagaaaaccacactcttacatttcctcgtagaaatctgcgaggaaaagtatcctgatatattgaacttcgttgatgacttagagcccctggataaagcctccaaagtgagtgtggagacgctggaaaagaacttaagacagatgggacggcagctgcagcaactcgagaaagagctggagaccttccctcctccggaggatctccacgacaagtttgtgacgaaaatgtccagatttgttatttctgcaaaagagcaatacgaaaccttgtctaaactgcacgagaacatggaaaaactgtatcagagcataatcggttactatgcaatcgacgtgaagaaggtgtccgttgaggactttctgaccgatttgaacaatttccggacgacattcatgcaggccataaaggagaatattaaaaagagagaggccgaagagaaggagaagcgcgtgaggatcgctaaggaattagccgaaagagagcggctggaacggcagcaaaagaagaagaggctactcgagatgaaaacggagggagatgagactggagtaatggataaccttctcgaagcccttcagtccggagccgcctttcgagaccgccgtaaaaggacgccaatgcccaaggatgtccgacagtcattgagccccatgagtcagcggcctgtgctgaaagtttgcaatcacgaaaaccaaaaggtacaactgactgagggcagtagatcacattataacatcaattgcaacagtacacgaacgcccgtggccaaggaactcaattacaatctggatacccacacatctacgggccgcattaaagcagccgaaaagaaagaggcttgtaatgtggaatcaaatcgcaaaaaggaaacggaactcctaggaagttttagtaaaaacgagtccgtgccggaggtagaggcccttctcgccaggcttcgcgctctctag

SEQ ID NO: 29276 - DNA, 3549 bp, Artificial Sequence
  Description of Artificial Sequence: Synthetic coding sequence
atggagcgtcaccaacctagactccaccacccagcacagggatcagcagccggaacaccttacccttccagcgcctctttacgtggctgtcgggagtctaaaatgcctcggaggaaggggccccagcatccaccaccaccctccggtcctgaggagcctggcgagaagcggcccaaatttcttgacaagtttgcaagtatacgcatcccaggatcgaagaaggagcgcccgccactgccaaatttgaaaacagcatttgcctcctcagactgcagtgccgcaccactggagatgatggaaaattttcctaaaccccttagtgagaacgaactcctagaactctttgagaagatgatggaggacatgaacttgaatgaagataagaaggctccgctgcgcgaaaaggatttttcgatcaagaaagaaatggtgatgcagtatattaacaccgcttctaaaactggcagcctgaagaggtccagacagattagtcctcaggagtttatccatgaactgaaaatgggttctgccgatgagaggcttgttacatgtctcgagtccctgcgagtgtccctcacttcgaaccccgtctcttgggtggaatcttttggtcatgaggggttaggactactgcttgacatcctggagaagctgatttccggaaaaatccaggaaaaggttgtgaagaagaatcaacacaaggtgatccagtgccttaaggctctcatgaacactcagtatggactggagagaattatgagcgaagagcgcagcctaagcctgctcgccaaggccgtcgaccctcgccacccaaatatgatgaccgacgtcgttaagctacttagcgcagtctgtatcgttggagaagagtccatattggaggaggttttagaggcccttacgagcgcaggagaggagaaaaagatcgatcgattcttttgtattgtggaaggcttgagacataacagcgtgcagctgcaagtggcctgcatgcaactaattaacgctctcgtgacctcaccggacgacctggactttaggctgcatatccggaacgagttcatgcgatgtggccttaaggagatattgccgaatctgaaatgtatcaagaacgacggactggatattcagctcaaggtctttgatgagcataaggaggaggacctttttgaattgtcccaccgactggaggacatcagagctgagttggacgaggcctacgacgtctacaacatggtttggagcactgtgaaggagacccgcgccgaggggtattttatttccatactgcagcatttgcttcttattcgtaatgattactttatcagacagcagtatttcaagctgatagacgagtgcgtttcccagatcgtgctgcacagagacgggatggaccctgattttacttatcgcaaacgccttgaccttgatctgacgcaatttgtggatatttgtatcgaccaggccaagttggaagaatttgaagagaaggcaagcgaactctataagaagttcgaaaaagaatttactgaccaccaggaaactcaggctgaactccagaagaaagaagcaaaaatcaacgagcttcaagcagaactccaagccttcaagtctcagtttggagcactacccgcagattgcaacataccacttcctccatccaaggagggtggtactggacactcagctctcccgccgccccctcctctaccttcaggcgggggagtgccacctcccccccctccacctccgcccccaccactgcctgggatgcgcatgcccttttccggacccgtgccgcctccccctcccctcggtttcctcgggggccaaaattccccacccttgcctatactgccattcggactgaaaccaaaaaaggagttcaaaccagaaataagcatgcggcgcctcaattggctgaagattcggccccatgagatgaccgagaactgcttctggattaaagtcaatgagaacaagtacgaaaacgtggatctactgtgtaaactggagaatacgttttgttgtcagcaaaaggaacgcagggaggaagaagatattgaggagaagaaatctattaaaaagaagatcaaggaactgaagtttttggacagtaaaatcgctcagaatctctccatctttctgtcctcctttagagtgccctacgaggagatacgaatgatgatcctggaggtggacgaaactcgccttgccgagtcaatgatccagaatcttatcaaacacttacctgaccaagagcagcttaactcactatctcagttcaaaagtgagtacagcaatttatgcgaaccagaacagtttgtggtagtcatgtcaaacgtgaagaggcttaggccaagactaagtgccattttgttcaagctgcagttcgaagagcaggtgaataacataaaaccagacatcatggcagtatcaaccgcttgcgaggaaataaaaaagtcaaaatcattctccaaactgctggagctcgtacttctcatgggaaattacatgaacgccggatcccgcaatgcacagacatttggcttcaatctgtcgtcactatgcaagctgaaagacactaagagtgcggatcaaaaaaccacgttactgcactttctcgtcgagatctgcgaggagaagtacccagatatcctaaatttcgttgacgacctcgaacctttggataaagcttctaaagtatcagtggagactctcgagaagaacctgaggcagatgggtcgccagctgcaacaattggaaaaagaactcgaaacctttcctcctccagaagacctacacgacaaattcgtcactaaaatgtctatatttgttatctctgcaaaagaacagtacgagacactgagcaagctgcatgagaatatggaaaaactgtatcagagcattatcgggtactatgccatcgacgtcaagaaagtttcagttgaggacttcctaactgacctcaataactttcgcaccacgtttatgcaggccatcaaagagaatatcaagaagcgcgaggctgaagaaaaggaaaaacgcgtaaggatagccaaggaactggccgagcgtgaaaggctggagcggcagcagaaaaagaagaggctgctcgagatgaaaactgaaggggatgaaaccggcgtgatggacaacctgttggaggcactacagagtggggctgccttcagggatcggcgcaagcgcacgcccatgccaaaagacgtccgccagtctttgagcccaatgagccagcgtcccgtgctgaaagtatgtaaccacgaaaatcagaaagtccaactgacagaaggatctcgatcacactacaacattaactgtaactcaactcgtacgcctgtcgcaaaagagctgaactataacttagacactcatactagcactgggagaataaaggcagctgagaaaaaagaagcctgcaacgttgaatcaaataggaagaaagaaaccgaattattaggaagctttagtaaaaacgagagcgtccctgaggtagaggcgctacttgctcggctcagggccctctag

SEQ ID NO: 29277 - DNA, 3372 bp, Artificial Sequence
  Description of Artificial Sequence: Synthetic coding sequence
atggagagacatcaacctcgtctgcaccatcctgcccagggatcggccgctggcactccataccctagcagcgcaagcttgcgtgggtgtcgtgaaagcaagatgcccaggcggaaggggcctcagcacccccctcctccatctggccctgaggagccaggtgaaaaacggccaaagtttgaagatatgaatcttaatgaggataagaaagcccctctgagagaaaaagactttagtataaagaaggagatggtgatgcaatatatcaacactgctagcaagactggcagtctcaaacggtcacgacagatctctcctcaggaatttatacacgaactgaagatgggcagcgccgacgagagactcgtgacatgtctggaatcccttagagttagcctgaccagcaacccagtgtcatgggtggagagctttggacacgaaggcctagggctgctcttggacattctagagaagctgatcagcggcaagatccaggaaaaggtggttaaaaagaatcaacataaagttatacagtgcctgaaagctctgatgaatacacagtacggcctggaaaggataatgagcgaagagcgaagcttatcacttctcgctaaggcggttgacccccggcacccaaacatgatgaccgatgtggtaaagctgctgagtgccgtgtgcatagtcggagaggagtccatcctcgaggaagtgttggaggccctgacgagcgctggcgaggaaaaaaagatcgacaggtttttttgtatcgttgaaggactgagacacaactctgtgcagctccaagttgcctgcatgcagctaataaacgccctggtgacttcgcccgacgaccttgacttccggttgcatattcggaacgagtttatgcgctgtgggctgaaggagattttaccaaatcttaaatgcattaagaacgatggcctggacatccagctaaaagtttttgacgaacataaggaggaggacctgtttgaactgtcacaccggctcgaggatattcgagccgaacttgacgaggcctatgacgtgtacaacatggtctggtcaaccgttaaggaaacgagggcagaaggctactttatatcgattctgcagcacctcttgctaattcgcaatgactatttcatccgacagcagtattttaagttaatcgatgaatgtgtgagtcaaattgtgctgcatcgtgatggcatggacccagattttacgtatagaaagcggcttgatctggacctcactcaattcgtagatatatgtatcgatcaggcaaaattggaagagttcgaggaaaaggctagcgagctctataagaaatttgagaaggaatttacggatcaccaggagacacaggcggagctccagaaaaaagaggcaaaaattaacgagctacaggcagagctccaggcttttaaaagtcaattcggagccctgccggcagactgtaatatccccctgccaccttctaaggagggaggtacaggacattccgcgctgccccctcccccccctttaccgagcggcggtggcgtacctcctccacccccaccgcctccccctccccccctgcccgggatgcgtatgccattctctggacctgtgcccccgccaccccccctgggattcttaggcggacagaactctcctccactgcctatccttcccttcggacttaagccaaaaaaggagtttaagcctgaaatctccatgcggcggctaaactggctgaagattagaccccatgagatgacagaaaattgtttttggatcaaggtgaacgaaaacaagtacgagaatgtagacctgttgtgcaagttggaaaacactttctgttgtcaacagaaggaacgcagggaggaagaggacatagaagagaaaaaatcaatcaaaaagaagatcaaagaactgaagtttctagactctaaaatcgcgcagaacttaagcatttttctgtcctcattccgcgtaccttatgaagagatcaggatgatgatccttgaagtggacgagactaggcttgcagagtcaatgatccagaacctgattaagcatcttccagaccaggaacagctgaactccctatctcagttcaagtccgaatactctaacctgtgtgagccagaacagttcgtcgtggttatgagcaacgtaaagcgactcagacctaggttgtctgccatattattcaaactccagttcgaggaacaggttaacaacataaagccagatatcatggcagtgagcacagcttgcgaggaaatcaagaagtccaagtctttttccaagctgctggagctggtgttgttgatgggcaattacatgaatgccggcagccggaacgctcagaccttcggattcaatctttcgagtctgtgcaagctaaaagacacaaagtctgctgaccagaagaccaccctgctgcattttctggtcgagatttgcgaggaaaagtatcccgatattcttaatttcgtggacgacctggaacctttggataaggccagcaaggttagcgttgaaacactggaaaaaaaccttcgacagatggggcgccagctccagcagttggagaaagagttggagacattcccaccaccggaagatctccatgacaaatttgtaaccaaaatgtcgatctttgttatttcggcgaaagaacaatatgagaccctgagtaagctccacgaaaatatggaaaaactgtaccaatcaatcataggttattacgctatcgatgtgaagaaagtctctgttgaggactttctcaccgacttgaacaactttagaacaaccttcatgcaagctatcaaggagaatatcaaaaagcgagaggcagaggagaaagaaaagagagttcggattgctaaagagctggccgagagggaacggctcgagagacagcaaaaaaaaaaacgcttgctcgaaatgaagacggaaggggatgagacgggcgtgatggataacctactcgaagccctgcaatccggagccgcgtttcgcgatagacgcaagcgaacaccaatgcctaaggacgtgcgtcagtccctgtcgcctatgagtcagaggcctgtgctgaaggtctgtaatcacgaaaatcaaaaagtccaattgactgagggcagtcgcagtcactacaacatcaactgcaacagcacccgtacaccagtggccaaagagcttaactacaacttggacactcatacaagcaccgggaggatcaaggctgctgaaaagaaagaggcatgtaacgtggagtccaatcggaagaaggagacagagctcctgggatcattctctaagaatgagagcgtgccagaggtggaggcactcctcgcacgactgcgggcactgtag

SEQ ID NO: 29278 - DNA, 3582 bp, Artificial Sequence
  Description of Artificial Sequence: Synthetic coding sequence
atggagagacatcagcctcgtctgcaccaccccgcccaaggatccgctgccggaaccccatatccctcaagcgcctcacttcggggctgtagagagtcaaaaatgccccgtcggaaagggccgcaacatcctccaccaccctctgggccagaagagccaggagaaaaacgccctaaattccatttaaacatccgcaccttgactgacgacatgctcgacaagttcgcctcaattagaatccctggatcgaagaaggagaggcccccattgccaaatctaaagactgcatttgccagttccgactgttctgccgcacctctggagatgatggagaactttccaaaacctctgagtgagaacgagcttctcgaacttttcgaaaagatgatggaggacatgaatctgaacgaggataaaaaggcccctctccgagagaaagacttcagcatcaagaaagagatggtaatgcaatacattaacacggcctctaaaactgggtccctcaagcggtccaggcagatctctccccaggagttcatccacgagcttaagatgggcagtgcagatgaaaggttagtgacctgtctggagtccctgagggtgagcctcacctccaacccggtcagttgggtagagtcattcggacatgaaggcctcggactgctattagacatcttggagaagctgatatccggaaaaatccaggagaaggtcgtaaaaaaaaaccagcataaggtcatccagtgcctgaaggccctgatgaacactcaatatggactggagcgaatcatgtccgaagagcggagcctgagcttattagccaaagcagtggatccccgccacccgaacatgatgacagacgtggtgaaactcctgtctgctgtgtgcatagtgggcgaggagtcaattctggaagaggtacttgaggccctgacgtccgccggggaggaaaagaaaatcgaccggtttttctgcatcgtcgaagggttgcgccataattctgtgcagttgcaggtggcctgtatgcaactcattaatgccctggtgacatccccagacgatctggactttcgcctacacattagaaacgaatttatgcggtgtggtctgaaagaaattctccccaatctgaaatgcatcaagaacgatggtctggacattcagctgaaggtcttcgacgagcacaaagaagaggatctcttcgagctgagccaccgcctcgaggatatcagagctgaacttgatgaggcctacgatgtgtataatatggtgtggagcacagtcaaggaaacgagagcagaggggtactttatttccattttgcagcacttgttgctgataaggaatgactatttcatcagacagcagtactttaagctgattgatgagtgcgtcagccagatagtgctgcatagagatggaatggatcccgattttacgtaccgcaagagattggatctcgacttaactcagtttgtggacatctgcattgatcaagccaagcttgaggagtttgaagagaaggcctcagaactgtataaaaagtttgagaaagagttcacggaccatcaggaaacccaggctgaactgcaaaagaaagaagctaagatcaatgaattacaggctgaactacaggcgtttaagtcgcagttcggggctctgccagcggactgtaacatccccctcccaccctctaaggagggagggaccggtcatagcgctctgccccccccacctcccctcccttcaggagggggagtgccccctcccccaccaccacctcccccgccccctcttcctggcatgcgaatgcccttctcaggaccagtccctccaccgccccccctcggcttcctgggaggccaaaatagccctcccttgcctattttgccatttggactcaagccaaaaaaggagtttaaacctgagatatcaatgagacggctcaactggctgaaaattcgtccccatgaaatgaccgagaactgcttctggattaaagtaaatgaaaataaatacgagaacgtggatctgttgtgtaaattagaaaataccttctgttgtcagcagaaggagcgcagagaggaagaggatatcgaggagaaaaaatccattaaaaagaagattaaagagctcaagttcctggacagtaaaatcgctcagaatctgagcattttcttaagcagctttagagtgccatacgaggagatccggatgatgatactggaggtggatgaaaccagactagccgaatctatgatacagaatttgattaagcatctgcctgaccaggaacaattgaattccctgagccagtttaagtctgagtactcaaatctgtgcgagcctgaacagttcgttgtggttatgtccaatgttaagcgtcttcgaccccggctgtccgctattctgttcaagctgcagttcgaagagcaggtcaacaatattaagcctgacatcatggccgtttccacggcatgcgaagagatcaaaaaatccaaatctttctctaaactgttagagttagtcctgctgatgggcaactacatgaatgctgggtcaaggaatgctcagacatttggttttaacttatctagcctgtgcaagctgaaggacacaaagtctgctgatcagaagaccaccctgctacactttctagttgagatctgtgaagaaaaatacccagatattctgaatttcgtagatgacctggaaccgctggataaggcctccaaggtcagcgtcgagacccttgaaaaaaacctgcggcagatgggtagacagctccagcaactcgagaaagaacttgaaacctttcccccccctgaagatctgcatgataagttcgtcactaaaatgtctattttcgtgatctcagctaaggagcagtatgagactctctccaagttgcatgagaacatggagaagttgtatcagtctatcataggatactatgccattgacgtcaaaaaggtttctgtggaggattttctcactgatttgaataactttcggacaaccttcatgcaggcaatcaaagaaaacatcaagaaaagagaagccgaggagaaagaaaaacgggttcgcattgccaaagaactggccgaacgcgaacgtctggagagacagcagaagaagaaaagactcctggagatgaaaaccgagggcgacgagactggggtgatggataaccttctggaggctttgcaatcaggagccgcttttcgagatcgaagaaagcggacccccatgcccaaagacgttcggcaatccttgtccccaatgtcccagcgcccggtcctgaaagtgtgcaaccatgaaaatcaaaaggtacagttgaccgaaggctcgcgaagccactacaacattaactgcaactctactcgcactccagtcgcaaaggagctgaactataatctggatacccatacttctacaggtcgaattaaggcggccgagaagaaagaggcatgcaacgtagaatcaaatcggaaaaaagagaccgagctactgggaagttttagtaagaatgaaagtgttccagaagtcgaggctttgttagctcggctccgcgccttatag

SEQ ID NO: 29279 - DNA, 3444 bp, Artificial Sequence
  Description of Artificial Sequence: Synthetic coding sequence
atggaacgccaccaaccccgcttacaccatccagcccagggctctgccgccggaaccccttacccatcaagtgcctctcttcggggatgcagagaaagtaagatgcctcggcggaaaggtccacagcatcccccaccccctagcgggcctgaggagccgggagaaaaacggccaaaatttcttgataagtttgcgtctattcgcatccccgggagtaagaaggagcggccccctctgccaaacctgaagactgcttttgctagctcagactgctcagccgccccactggagatgatggaaaatttcccgaaacctctcagcgaaaatgaactcctggagctgtttgaaaaaatgatgggctcactcaagcggagcagacagatatccccacaagagttcattcacgagttgaagatgggaagtgccgacgagagactcgtaacttgcctggagtcgctcagagtcagcttaacctcaaacccggtgtcttgggttgaaagttttggtcatgagggtttgggtctgcttctggacatactggagaagctcatcagtggcaaaatccaggagaaagtggtgaaaaaaaatcaacataaagtcatacagtgtttaaaggcacttatgaacacccagtacgggctggagcgcatcatgagcgaggagagatctctctctctgctggctaaggcggttgatcccaggcaccctaacatgatgactgatgtagtaaagttactgtctgctgtgtgtatagtgggggaagagtccattttggaggaggtactggaggcgcttacttcggctggagaggagaaaaagatcgaccgttttttctgcatagtagagggactacggcataactcagtgcagctgcaagtcgcgtgcatgcaactaatcaacgccctcgtcacatctccagatgatctggattttcgactacatatccgaaatgagttcatgcgatgcggtcttaaagagatcctgcccaacctgaaatgcatcaagaatgacggcttggatattcagttgaaggtcttcgatgagcataaagaggaagacttattcgagctgagtcacagattggaagacatccgagcggaactagatgaggcgtatgacgtgtataacatggtgtggagcacggttaaagagaccagggctgagggctactttatttcaattttgcagcacctacttctcatcaggaacgactacttcatccgtcagcagtacttcaaacttatcgacgaatgtgtttcccaaatcgtgttgcaccgcgatggcatggatccagacttcacctacaggaagcgcctggatctagatctgactcagtttgtcgatatttgtattgaccaggcgaaactagaagaattcgaggaaaaggctagcgaactctataagaagtttgagaaggagtttactgaccatcaggagacccaggccgaattgcagaagaaggaggccaagatcaacgagctccaggccgagttgcaggcctttaaaagtcagttcggggcattgccagcagattgtaacattccactcccaccctcaaaagaggggggtacagggcacagcgcgttgccaccaccacctcccttgccatccgggggaggggtgcccccgccgcccccaccgccgccccccccacctctcccaggcatgcgcatgcctttcagcggaccagtccctcctccccctccactgggattcctcggtggacagaatagtccgcctctgccgattctgccatttggcctaaagccaaagaaagagttcaagcctgagatttctatgagaagactcaattggctgaaaattcgccctcacgagatgacagaaaactgtttctggattaaagtgaacgagaacaagtatgaaaacgttgacctgctgtgcaaactggaaaacaccttttgctgtcagcagaaggagaggcgcgaggaggaagatatcgaagagaaaaagagcatcaagaagaagattaaagaactgaagtttctagacagcaagatcgcacagaacctttctatttttcttagctcatttcgcgtgccttacgaagagatacgcatgatgattctggaggtggacgaaacccgacttgcagagtctatgattcaaaaccttattaaacacctcccagaccaagaacagttgaatagcctgagccagtttaagtcagagtactcaaatttgtgtgagcccgagcagttcgtcgttgtgatgagcaacgtgaagcgactgagacctcgactgagcgccatcctctttaaattgcagtttgaagagcaagttaacaatatcaaaccagacatcatggctgtgagcactgcatgcgaggagataaaaaagtcgaagtcattttccaaactactggagttggtgcttttaatgggaaattacatgaatgcggggtcgcgaaatgcccaaacttttggcttcaatctgagcagcttatgtaagctgaaagacaccaaatccgcggaccagaagaccaccctcctccattttttggtggaaatttgcgaggagaaatacccagatattcttaattttgtcgacgacctcgagccactggataaggcctccaaagtcagcgtggagacgctcgaaaaaaacttgcgccaaatggggcggcaattgcagcaacttgagaaagaattagagaccttcccaccccctgaagatcttcacgacaagttcgtcactaagatgtccatattcgttattagcgccaaggagcagtatgagactctgagcaagttacacgaaaatatggaaaagctctaccagtcaatcattggatattacgccatagacgtgaaaaaggtctcggtggaggatttcctcactgacttgaataactttcggacaacgttcatgcaggcaatcaaggagaatatcaagaagcgcgaggctgaagagaaggagaaaagggttaggattgctaaagagctggccgagagagagcgccttgagaggcagcagaaaaagaagcggctcctagagatgaagaccgaaggggatgagaccggggttatggataacctgctcgaagcactgcagagtggggctgcttttcgcgacaggcgcaagcgcactccaatgccgaaggatgtaaggcaaagcttgtcacctatgtctcaaagacctgtcttgaaagtgtgtaaccacgaaaaccagaaagtgcagctcaccgagggcagccgaagccattacaacattaactgcaacagcacacgaacccccgtggcaaaggagctgaattacaaccttgatacccacaccagcacagggcgtatcaaagctgcggagaaaaaagaagcatgtaacgtggaaagcaacaggaaaaaggaaactgaacttttgggatcattcagcaaaaatgagtctgtgccagaagtcgaagctctgttagccaggcttagagccctttag

SEQ ID NO: 29280 - DNA, 3051 bp, Artificial Sequence
  Description of Artificial Sequence: Synthetic coding sequence
atggagcggcaccaacctcgactgcaccatccagcccagggctctgccgccggtaccccttatccatcttcagcaagtctgagaggatgtagagagtccaaaatgccccggagaaaaggccctcagcatcccccgcccccctcgggccccgaggaaccgggagagaagcgaccgaagttccacctgaacatacgcacgctgactgacgacatgctcgacaagtttgcaagtatccgcatcccggggagtaaaaaggaaagacctcccctacctaatcttaaaaccgcttttgcgtcttccgactgctctgctgcacccttagaaatgatggaaaactttcctaagccactgtctgaaaatgaattgttagagttgttcgagaagatgatggaggacatgaacctgaacgaggataaaaaggcccctttaagggagaaggacttttctatcaaaaaggaaatggtgatgcagtatatcaacactgccagcaaaacggggtccctaaaacgttcacgccagataagcccccaagaattcattcacgagctgaagatgggaagtgctgacgagcgcctcgtgacttgtctcgagagccttcgggtgtcgctgacctccaatcctgtgagttgggtggagtcctttgggcacgaaggactcgggctgctgctggatatcttagaaaagcttatcagcggtaaaattcaagagaaagttgtgaagaaaaaccagcacaaggtcattcagtgtttgaaggctttaatgaatacgcagtatgggctggaacggatcatgtccgaagagagaagtctgtcattgctggcgaaagccgtggatcctcgtcaccccaacatgatgacggatgtggtgaagctcctttcagcagtgtgcatcgtcggggaggagtcaatcctcgaagaagtcctggaggccttgacctccgccggggaggaaaagaaaatcgaccgttttttttgcatcgtggaggggctccgccataactcagtccagctgcaggtggcttgcatgcagctgatcaacgctctggttacatctcccgatgacctggatttccgcctgcacattcgaaatgaatttatgaggtgcggactcaaggaaatcctgcctaatctcaagtgtatcaaaaatgacggacttgatattcagctgaaagtttttgacgaacacaaggaggaggatctgttcgagcttagccatcgtcttgaggacattcgcgctgagctggatgaagcttatgacgtgtataacatggtatggtccacagtcaaggaaacaagagcggaaggctatttcatctcaatcctgcagcatttattgctcatccgcaatgattattttattaggcagcagtacttcaaactgattgatgagtgtgtctcacagatcgtactgcatcgcgatgggatggatccggactttacatatcggaagagacttgacctcgatctgacacagttcgtggacatctgcattgatcaggctaagcttgaggaattcgaagaaaaggccagcgagctgtataaaaagttcgagaaggagttcacagaccatcaggaaactcaggccgaattacagaagaaagaggccaaaattaacgaactccaggctgagcttcaggccttcaaatcccagtttggcgcactgcctgccgactgtaatattcctttacccccatcaaaagagggaggaaccggacactcggctctgcctccacccccaccgcttcctagtggcgggggggtgccgccacctcccccgccacccccaccaccccccctgcccgggatgaggatgcccttcagcggtcccgtgccaccacctcccccccttggattcctcggaggccagaatagtcctcctctgccaatcctcccatttggcctcaaacctaagaaggaattcaagccagaaatcagtatgcgtagactgaactggctgaagataagaccgcacgaaatgaccgagaactgcttctggatcaaggtaaatgagaacaaatatgagaatgttgatctcctttgtaagcttgaaaacactttctgttgtcaacagaaggagcgacgtgaagaggaagatatcgaggaaaagaagtctattaaaaagaagattaaagaactcaaattcctagattcgaagatagcccagaatctgagtatttttctctccagcttccgcgtcccttatgaggaaatcaggatgatgattctggaggtggatgagactcgcttggcagagagcatgattcagaaccttattaagcatctgccagatcaagagcagttgaattcgctgagtcagtttaaaagtgagtattcaaacctttgtgaacctgagcagtttgtggttgtgatgtcaaatgttaagcggctccgccctagactgtctgcaattctgttcaagttgcagttcgaggagcaggtgaacaatattaaacctgacattatggccgtgagcacggcctgcgaggaaattaaaaagagcaaaagcttctccaagcttctggagttagtgctgttaatggggaattacatgaacgcgggctctcgtaacgctcaaacttttggtttcaacctgagctcgctgtgcaaattgaaagatactaaaagtgcagatcagaaaactacactgcttcactttctcgtagaaatttgcgaagagaagtacccagacattttaaacttcgtggatgacttggaacctctggacaaggcatcaaaagtctccgttgaaactctcgagaaaaacttaaggcagatgggcagacagcttcaacaactggagaaagaactggagacatttccaccacctgaggacctgcatgacaagtttgtgacaaaaatgtcgattttcgttatctccgccaaggaacagtacgaaactctgagtaagctgcatgagaatatggagaagctgtaccagtccatcatcggctattacgctatcgatgttaagaaggtgtcggtggaggattttctcaccgacctcaataacttcagaactacctttatgaaggctatcaagttccagatttag

SEQ ID NO: 29281 - DNA, 3339 bp, Artificial Sequence
  Description of Artificial Sequence: Synthetic coding sequence
atggaacgacatcagccccgcttgcatcaccctgcacagggcagtgcagctggaacaccttatccttcctcggcttccctgcggggctgcagagagtctaagatgccccggcgaaagggcccccagcatccgcctcctcccagtgggccggaggaaccgggggagaagaggcccaaatttcacctgaacataagaactctaactgatgacatgctcgataagtttgcctccatccgaatacccggctctaagaaggagcggccgccattgcccaatctgaagactgccttcgccagctccgactgttctgcagctccgctggagatgatggaaaattttcccaaacctttatccgagaacgaactcctcgagttgtttgagaaaatgatggaggatatgaatctgaatgaggataagaaagctccactgcgagagaaggatttttctatcaagaaggagatggttatgcagtacattaacaccgcttctaaaacggggtctttgaaacgaagcagacaaatttctccgcaggagttcatccacgaactcaagatgggtagcgctgatgaacgccttgttacctgcctggaatccctgagagtcagcctaacatccaaccctgtgagctgggtagagtctttcggtcacgagggcttagggttactactggatattctcgagaaattgattagcgggaaaatccaggagaaagtggtcaagaagaaccaacataaggttattcaatgccttaaggcactgatgaatacacagtacggcctggaaagaataatgagcgaggagaggtctctgagtttgctggctaaggctgtggaccctcggcacccaaatatgatgacagacgtggtgaagctcctctccgccgtgtgcatcgtgggtgaagagtccattcttgaagaggtgctggaggctctgacgtctgctggcgaagagaagaagatcgatcggttcttttgcatagtcgaaggactgcggcacaatagtgtgcagctgcaagtggcatgtatgcagctcatcaatgccctggtgacaagccccgatgatctcgactttagactgcacattcgcaatgagttcatgagatgcggcctcaaggaaatactacccaatctgaaatgcatcaagaacgacggacttgacattcagctcaaggttttcgacgagcacaaagaagaggacctgtttgagctgtcccacaggctggaggatatcagggccgagctggatgaagcgtatgacgtgtacaatatggtgtggtcgacagtgaaggagacaagagccgaaggatattttataagtattctccaacacctcctgctgattaggaatgactatttcatccgacaacagtactttaagctgattgacgaatgcgtgagccaaattgtgctgcacagagatggcatggatcctgacttcacatatcggaagagactggaccttgaccttacccagttcgttgatatatgtatagaccaggccaaattggaagaattcgaggaaaaagctagcgagttatataagaaatttgagaaggaatttactgatcatcaggagacacaggccgaactgcagaagaaggaggctaagataaacgagcttcaagccgagttacaggccttcaagtcccaatttggcgcattgccggcagattgcaacatcccattgcccccatctaaagaaggaggaacagggcattcagctctgccgccaccccctcctctcccttcgggggggggtgtaccccccccaccgccaccccctccgccccccccactgcccgggatgagaatgccattctccgggcccgtgccaccacccccccccctcggctttctgggaggtcaaaatagtcctcctctcccaattctgcccttcggccttaagcccaagaaggaattcaagcccgagatcagtatgcgacgtctgaattggctgaaaattcgaccacatgagatgaccgaaaactgcttttggatcaaggtgaatgaaaacaaatatgagaacgtggacctgctctgcaagctggagaatactttctgctgtcagcaaaaggaaaggagagaggaagaagacattgaagaaaagaaatctatcaaaaaaaaaatcaaggaactgaaatttctggatagtaaaatcgctcaaaatctgtctatcttcctatctagctttagagtaccctacgaggaaataaggatgatgatacttgaggttgatgagacgaggctcgcagaatcaatgatccagaatttgattaagcacttacctgaccaggaacagttgaatagtctgtctcaattcaagagcgaatacagcaatctttgcgagccagagcagtttgtggtggtaatgagtaacgtaaagaggctcaggccgagactctccgctattctattcaagctgcagtttgaagagcaggtaaataacatcaaacccgacataatggctgtcagcacagcctgcgaggagatcaagaagagcaagtcattttccaagctgcttgagctagttctactgatgggcaattacatgaacgcaggttcgcggaacgcacagacttttggcttcaatctgtcttccctctgtaagcttaaagatacaaagtccgctgatcagaaaaccactctgttacatttcctggtggagatttgcgaggagaagtatcctgatatattaaactttgtcgatgacttggaacccttggataaggcctcgaaggtgtccgttgaaacactggagaagaatctgaggcaaatgggccgacagttgcagcagctcgaaaaggagctcgagactttccccccccccgaggacttacatgacaaattcgtcactaagatgagtagatttgtgatcagcgctaaggaacagtacgagacactctcaaaactccatgagaatatggagaagttgtaccagagcatcatcggttactacgctattgatgtgaaaaaggtatccgtcgaagacttccttactgacctgaataacttccggacaactttcatgcaggctatcaaagagaacatcaagaagcgggaggcggaggaaaaagaaaagagggttaggattgctaaggagctggcagagagagaaagactcgaaaggcaacagaagaaaaaacgccttctcgaaatgaaaacagagggggacgagaccggagtgatggataacctactggaagctctccagtccggagcagcatttcgagaccgtaggaagcgcacccctatgcccaaagatgtgcgacagtccctctcaccgatgagccaacgtcctgttctgaaggtgtgcaatcacggaaataaaccctatctgtag

SEQ ID NO: 29282 - DNA, 1866 bp, Artificial Sequence
  Description of Artificial Sequence: Synthetic coding sequence
atgtgttccggctggtcatcatcggtgatttggcggcatacccagtttgctgtggaaagatgtggcttttgtggcagttccggccccggcgcccctctcgagcccagtacgttgggctcaaagcacttgccttgggaggccgtcagtgccggcttcgcagatagaaataggaacatggatggggccatgtggctgagcctgtgtccagacaatgaggacttgctgtggcgcaagaaacacaaacttctgcaggcaagaggaaaaggggatttggctctgcaacgtcgagcggatgccaagttgtggaagaactatcaacttcagcgcttggctgaagaactgaggaggggttaccaagaggcgcagcacttgcatgtgggggggcttgaccgcctacagtccgcaagactcctgggttggggtggggggcgggcaagggagaacgagcccgactcacagggaccaattcagaggcggtcagcaagaccacctcgggccaaggaaaaacatcgcgcggccctgtcagaagagaggtcatgtagagaggagttgggccagcaacacccccgccactctaggcccagaaaaaccgcagcatcaccagagaagccacagactaccaaggctacagggcgaatgaactcacatcttgccccaccggagaaaagaaaagggagaccagaaccatccactaagagtggtggaggtcgatgcgccatccatcctaggcggagcaagggggcggacctagagcggagtaatcctctagtggctgcggtgggagaaattggactggtggaagaaaaggaaaaaggcacagcaagagccgggaggcgacaactggggaagggcgcggtgtgcttcgtgcccgctctaacaagccgcagccaaggccagagtttagaaggcaaactaagggacctgggccagttatggccagctgatagctcctgccgacgggaagcagtgagcccggcctcgcagtgtactctgcgcgaaaaaaacaagtggcagaaagagctagagctggccttcgaggagctgttcaacataaaccggaaattgaagaagcacttgtgtctttatctggccctcaagcctcgaatggaccagcggcctggggagggtcatgctttcagcgagatgcaggaatgcggagcgggaactccccggggtaagaagatggccgatcctgaaatgttgcctgccggggagcctagaagtccagctgaggaggaagcacagcaggccgcatctaagactgatctgaaaacctttatgggcaaagcccagaatcagaagtaccaagggaccgtcaaaccaacatttcggaatgggagccaaactctctctcctgaggctggaatttttatcaacaaagaggatagcctactgtattccactgagtcgggtcaggaaactcccaaactaggcaccctagctgaaggaagcctgcagctccacctgcaggatcaagcagaccgggtcggatccacagccagcagacagcggcaaaaggctgaaatggagcaacgccgccagaagcaactagagtctctggaacagatggaacaccctgatatgtcattggaaatccattacaaggccgagctggaaaaagagagaagagagcagaggcgggccagactggcgcatcttaaaagctcctccacgcgggcccaggagagagaacgggggtccgagcttagcacaacttccccatcaggcacaagcctcgccgacgatgatcgccatagccagatgatcagggatcaacagcagcagatcctacagcagaatagactccataagcagtttctagaggaggcccgaaagtgccttcgggagttccagaatatctgttag

SEQ ID NO: 29283 - DNA, 1539 bp, Artificial Sequence
  Description of Artificial Sequence: Synthetic coding sequence
atggctatcctgtccctcagagccccaggcccctggcaggcaatgcaggtttgggccgataggaccctgctgacccctcacaccggcgtgaccagccaggttctgggcgttgccgccgcggtcatgacacctctgcccggcggtcacgcagcgggcagaacgagggaggcaagatgggacgcgatggagtacgacgaaaaactcgcacggttccggcaggctcacctgaaccccttcaataaacaatctggccctcgccagcatgagcagggacccggcgaagaagtccccgacgtaacccccgaagaggcccttccagaactccctcccggcgagcctgagttcagatgccccgagcgcgtgatggacctcggcctttcagaggatcacttctctcgcccagtaggcctgtttctggcctccgacgtacagcaactgaggcaagctatcgaggaatgcaagcaggtgatcctggaactgccggagcagagtgagaagcagaaagacgctgtggtgagactgatacacctcagactgaaacttcaggagctgaaggacccgaacgaagacgaacctaacattagagttcttctggaacaccggttttacaaagagaaaagtaaaagcgtgaagcagacctgcgacaaatgcaatacaatcatctggggtctaatccaaacatggtatacctgcaccgggtgttactaccgctgtcatagcaaatgtttaaaccttatctcaaagccatgtgtatctagcaaagtgtcacatcaggcggagtacgaattaaatatctgtcctgaaactggactcgactcgcaggactatcgttgcgcagagtgtagggctcctatttctctgcggggcgtaccttcagaggccaggcaatgcgattatactggtcaatactattgttctcactgtcactggaacgacttagccgtgatccctgcacgagtggttcataattgggattttgagcctcgaaaagtctcgagatgctccatgagatacctggctctcatggtgagccggcctgtactgagactccgtgaaattaaccctctgctcttttcttacgtcgaagagctcgtggaaattcgcaaactgcggcaggatatacttctcatgaagccttatttcatcacttgcagggaagctatggaggcccgattactgttacagctccaagatagacagcatttcgtggaaaacgacgaaatgtactctgtccaggacctgctcgatgttcacgccggacgtctagggtgcagtctcacagaaattcacaccctctttgccaagcacattaaactggactgtgaacgatgtcaggcgaagggatttgtgtgtgagctctgtcgagaaggcgatgtcctgttccccttcgacagccatacgagcgtctgcgctgattgttctgcggtgtttcatagggattgttactacgataacagcaccacctgccccaaatgcgcccgtctgagtctgcgcaaacaaagcttattccaggaacctgggccagatgtggaagcttag

SEQ ID NO: 29284 - DNA, 594 bp, Artificial Sequence
  Description of Artificial Sequence: Synthetic coding sequence
atggagtatgatgaaaagctagcgcggttcaggcaagctcatcttaatccattcaataagcaatccgggccaagacagcatgaacaaggcccaggagaggaggtgcccgacgtgacgccggaggaggccctccccgagctcccacctggtgagcctgaattcagatgtccagagcgtgtgatggacttgggactgtccgaagatcatttctccagacccgtaggcttgttccttgcttcggatgtgcaacaactaaggcaggcgatagaagaatgtaagcaggtgattctagaactgccagaacagagtgagaagcagaaagacgctgtcgtgaggcttattcatctccgcctgaagttacaagaacttaaagatccaaatgaagatgagcccaatatccgcgtccttctggaacatcggttctacaaagagaaaagtaagtcagtcaaacagacttgtgataagtgtaacacaattatctggggactcatccagacttggtatacctgcaccgggggcccaaggcctaggcgaggtgtgcgcaatgagcgtgaccagtcctcgtgtctgcggtgggcacacatccagatgtag

SEQ ID NO: 29285 - DNA, 1356 bp, Artificial Sequence
  Description of Artificial Sequence: Synthetic coding sequence
atggagtatgacgaaaagctggcccgcttccgccaagctcatcttaaccccttcaataaacaatcaggtcccagacagcacgagcaaggtccaggcgaagaggtgcctgatgtgacacctgaagaggcactgccagagcttcctcccggagagcccgagtttagatgtccggaacgggttatggacctagggctatccgaggatcatttctctagacctgtcgggctcttcctggcttcagatgtgcagcagctacgccaagctattgaagagtgtaagcaggtaatcctggagctgcctgagcagtcagaaaaacaaaaggacgcggtggtgcgccttattcacctgcgcctgaagctgcaggaactgaaggatccaaatgaagatgagcccaacatcagagtgctgctggagcaccggttttacaaagaaaagagcaagagcgtaaagcaaacatgcgacaagtgtaacactatcatctggggtcttatccaaacttggtacacctgcactggatgctattatagatgccactctaagtgcttgaatttgatctctaagccttgcgttagctcaaaagtctctcatcaggccgagtatgaactcaacatttgccccgagaccgggcttgatagtcaagattaccgatgcgccgaatgccgagcccccatatcgctccgtggcgttccatcagaagcccgccagtgcgactacacggggcagtattattgcagccactgccactggaatgatttggcagtgataccagccagggttgttcacaattgggattttgagccaagaaaagtgtcacgctgcagtatgagataccttgcactgatggtctcacgtccagttctgcgtctgagagaaataaacccactactttttagttatgtggaggaactggtcgaaatccgaaagctgcggcaggatatacttctgatgaagccatattttatcacatgccgcgaggccatggaggcccgacttctactgcagctgcaagatagacagcatttcgttgagaatgacgagatgtattccgtgcaggatttgttggacgtgcacgccggccgcctgggctgctccctgacggagatccacacattatttgcaaagcatataaagcttgattgtgaacgatgtcaagccaagggctttgtgtgcgagctctgtagagaaggagacgtcctgttcccttttgacagtcatacctctgtatgtgccgactgtagtgctgtgtttcatagggactgctactatgacaatagcaccacctgccctaaatgcgcgaggctcagcttgagaaagcagagcctttttcaggaaccaggcccggatgtggaggcatag

SEQ ID NO: 29286 - DNA, 1326 bp, Artificial Sequence
  Description of Artificial Sequence: Synthetic coding sequence
atggagtacgacgagaaactagcccgcttcaggcaggcccacctgaaccccttcaacaaacagtcaggtccaaggcaacacgaacaaggacctggcgaggaggtgcccgacgtgacccccgaggaagcactgccagagctgcctcctggcgagccggagtttaggtgcccagagcgggtgatggaccttggcttatccgaggatcacttctccaggcctgttcttcgccaagccatagaggagtgcaaacaggtgatcctggaactccccgaacagtctgaaaagcagaaggacgctgtggtgaggctgattcatttgcggcttaaactgcaggaactgaaagaccccaatgaagacgaaccaaatataagagtgctgcttgaacatagattctataaggagaaaagtaagtccgtgaaacaaacttgtgacaagtgtaataccatcatttggggcctcattcagacatggtatacatgtactggttgttattatcgctgtcattcaaaatgcctcaacctgattagcaagccttgcgtgtcatcaaaagtgtctcaccaggccgaatatgagcttaatatctgcccagagacaggattagactcacaggactacagatgtgccgaatgtcgggcaccaataagcctccggggcgtgccctccgaagccaggcagtgcgattacaccgggcagtactattgcagccactgtcactggaatgatttagcagttattccagcaagggtggtgcataactgggatttcgagcccaggaaggtctccaggtgttccatgcggtacttagccctgatggtatctcggcctgtactccgcctgagagagattaatcccctcctgttcagttatgttgaagagctcgtggagatccggaaacttaggcaggatattctattaatgaaaccgtatttcatcacttgtcgggaggccatggaagcacgactcctgttacaactccaggaccggcagcactttgtagagaacgacgaaatgtattcagtgcaggatttactggacgttcacgccggtagacttgggtgctcacttaccgaaattcacacgttgttcgccaagcatataaagctggattgtgagcggtgtcaggccaagggattcgtctgtgaactgtgcagggagggcgatgtgctcttcccattcgacagccacaccagcgtctgtgctgattgctctgcagtgttccacagggattgttattacgataactccactacctgtcccaaatgcgccagacttagcctgagaaaacagagcctctttcaggaaccaggacctgatgtggaagcctag

SEQ ID NO: 29287 - DNA, 1563 bp, Artificial Sequence
  Description of Artificial Sequence: Synthetic coding sequence
atgtctcaggataatgacaccctgatgcgtgacatattgggtcatgaactggctgccatgagattacagaaattggagcagcagagacgcttgtttgagaagaaacaaaggcagaagcggcaagaactcctgatggtacaagctaaccccgacgcttccccttggctatggcgatcgtgccttcgcgaggaacgccttctaggtgaccggggcttggggaatcctttccttagaaagaaggttagcgaagcccacctgccttctggaattcattctgccctgggcacagtgtcctgtggcggtgatggccgcggggaaagaggcctcccaacccctcgcactgaggccgtgtttcggaatctggggctgcaaagcccttttctctcttggctccccgataacagcgatgctgaactcgaggaagtatcagtagagaacggttccgtctcgcctcccccatttaagcagtccccaagaatccggcgtaagggctggcaagctcaccaaagacctgggactcgtgccgaaggggagtcagactcacaggacatgggcgatgcccacaagtccccgaacatgggtcctaacccaggtatggacggggactgtgtgtatgaaaacctggcttttcagaaggaagaggatctcgaaaaaaagcgtgaggctagcgagtcaacaggcactaactcctctgccgctcataacgaagaactgtctaaggctctcaaaggggaaggcggtaccgatagtgatcatatgcgccatgaagcctctctggctattcggagcccatgtcccgggctggaagaagacatggaagcatacgtgctccggcctgctctgcctggtacaatgatgcagtgctatttgactagagacaagcatggcgtggataagggtctcttccctctgtactacctgtatctggagaccagcgatagtctgcagaggtttttgctggccgggcgaaagagaagacggagcaaaacctcaaattaccttatctccctggacccaacacacctgtcccgcgatggcgataattttgtgggtaaggtgcggtccaacgtattcagcaccaagtttactattttcgacaatggggtgaaccctgaccgcgagcacctaactagaaacacagcacgcattaggcaggaattgggtgctgtgtgctatgaaccaaacgtgctggggtacctgggcccccgcaaaatgaccgtgatcctgccaggaacaaattcccagaaccagcgaatcaacgtgcagccgctgaatgaacaggagtctctgcttagtcgataccaacgtggagataaacagggacttctcttattgcataacaagactccttcctgggataaagagaacggagtctatactttaaacttccacggcagagtcacaagagcttccgttaagaactttcagattgtagatccaaagcatcaggaacatttagttctgcagttcggacgggttggtccagatacattcaccatggatttttgctttcctttctcccccctccaggccttctctatctgtctgtcgtccttcaactag

SEQ ID NO: 29288 - DNA, 1422 bp, Artificial Sequence
  Description of Artificial Sequence: Synthetic coding sequence
atgccaaagctccaaggattcgaattttggtcccgcaccttacgcggagcaagacatgtcgtggctcctatggtggatcagagtgagttggcctggagattgctgagtcgtcgccacggcgctcagctgtgttatacaccaatgttacacgctcaagtgtttgtccgagacgcgaattatagaaaggaaaatctgtactgcgaagtctgtcccgaagatagacctttgatcgtgcaattctgcgccaacgatcccgaagtgtttgttcaggcggcacttttagcgcaggattattgcgatgcaatcgaccttaatctggggtgcccccagatgatagccaagcggggacattacggcgctttcctccaggacgaatgggatctccttcaacgcatgatcctgctggcacacgaaaagctgtccgtgcccgtgacttgcaagatcagagtattccccgaaattgacaaaacagtgaggtatgcgcagatgctcgagaaggctgggtgccagctgcttactgttcacggcaggacgaaagagcagaaaggcccattatcaggtgcggcttcctgggaacatatcaaggccgttcggaaagcggtggccattccggtgtttgccaatggcaacatccaatgtctgcaggatgtcgagaggtgtctgcgagacactggcgtgcagggagtcatgtctgccgaaggcaacctgcataacccggccttgttcgaaggcaggtccccagccgtgtgggaactcgcagaggaatatttggacatagttagggagcacccatgtcctcttagctacgtccgagcacacctctttaagctgtggcatcataccctccaagtgcaccaagagctgagggaagaactggccaaagtgaaaactcttgagggaatcgcggcagtttctcaggaactgaagctgcggtgtcaagaagagatttcccggcaagagggggctaagcccactggtgacctgccttttcactggatctgtcagccctacatacgccccgggccccgtgagggatccaaggaaaaggccggggcccgcagtaagcgcgcgttggaagaagaggagggcggcactgaggttttgtcaaagaataagcagaaaaaacagctgcggaacccccacaagactttcgaccccagtctgaagcctaaatacgccaagtgcgaccagtgcggcaacccaaaagggaatcgatgcgtattttccctttgtcgcggttgttgtaagaagcgggcaagcaaagaaacggccgattgtcctggtcatggcctgttgtttaaaactaagcttgaaaagtctctggcctggaaggaagcacagccagaactccaggaaccacaaccagcagctcccggaacccccggggggttctcagaagtcatgggctccgctcttgcctag

SEQ ID NO: 29289 - DNA, 1422 bp, Artificial Sequence
  Description of Artificial Sequence: Synthetic coding sequence
atgccaaaactgcagggctttgagttctggtctagaactctacggggcgcccgacacgttgtggcaccaatggtggatcagtccgaacttgcatggcggcttctgtcacgccggcatggagctcagctatgttatactcccatgctgcacgcccaggttttcgtgcgtgatgctaattatcggaaggaaaatctgtactgtgaagtatgtcctgaagataggcctctgatcgtgcagttctgtgccaacgacccagaggtgttcgttcaggccgcactgctggctcaggactattgcgatgcaatcgacctgaacctggggtgtcctcagatgatcgctaaacgaggccattatggggcattcttacaagacgagtgggacctgctccagcgcatgatattactcgcccatgaaaagcttagtgtgcctgtgacatgtaaaatcagagtgttcccagagattgacaagaccgttagatatgctcagatgctggagaaagcaggctgccagctcttgacggtgcacggccggaccaaggagcaaaagggaccactctccggtgcggcgtcgtgggagcatattaaagcggtcaggaaagccgttgctatacctgtattcgcaaatggaaacatacaatgtctgcaagatgtggaaaggtgcctgagggacaccggcgtccaaggggtgatgagcgcggagggcaacttgcacaatcccgccctgtttgaaggacgcagtcccgccgtctgggagcttgcagaggagtatttggacatcgtgcgggaacacccttgtcccctatcatacgttcgcgcgcatttatttaagctctggcatcatactctccaggtccaccaggagctacgagaggaactcgctaaggtaaagaccctcgaaggcatcgcagcagtcagccaggaactgaaattgcgatgccaggaggagatctcccgacaggagggtgctaagccaaccggcgacctgcccttccattggatatgccagccatatatccggccaggtccccgtgaaggctctaaagagaaggccggggccaggagtaaacgagccttggaagaagaggagggcgggaccgaagtcttatccaaaaacaaacagaaaaagcagctcagaaaccctcacaagaccttcgaccctagcctgaagcctaagtacgccaagtgtgatcagtgtgggaatccaaagggtaaccggtgtgtgttttctctctgcagaggctgctgtaaaaaaagagcatcgaaggaaacagccgattgtcctggccacggattgctatttaaaaccaaactcgagaagagcctcgcatggaaggaagcccagcctgagcttcaggagccccagcctgccgctcctggaaccccaggaggtttttccgaggtgatggggagtgcactggcatag

SEQ ID NO: 29290 - DNA, 894 bp, Artificial Sequence
  Description of Artificial Sequence: Synthetic coding sequence
cccagcttcgccggaccacgtgagaccctgcccgtgacctgtaagatcagagtcttccctgagatcgacaagacagtgcgttacgcccagatgttggagaaggctggatgccagctgctcacagtccacggcaggacgaaggaacagaaaggaccgttgtccggggcagcttcctgggagcacattaaagctgtaaggaaagcagtggctataccggtatttgcaaatgggaacatacaatgcctgcaagatgtagagcgctgcctgcgtgacacgggggtccaaggagtgatgtccgccgagggcaatttgcataatcctgctctctttgaaggtagaagccccgcggtatgggagctcgcagaagaataccttgatatcgtaagagagcacccttgtcccttatcctacgttcgggcgcatttatttaagctgtggcaccacactttgcaagttcaccaggaactacgcgaggaattagctaaagtcaagacgctggagggcattgctgccgtgagccaagagcttaagctaaggtgccaagaaatcagcaggcaggaaggcgctaaacccaccggagatctcccttttcactggatttgccagccctacattagaccaggccctcgcgaagggtctaaggagaaagccggcgccaggagcaagcgcgctcttgaggaagaagaagggggtactgaggtactgtctaaaaataagcagaagaaacagctcaggaatccccacaagactttcgacccgtctctgaagcccaaatacgccaagtgtgatcagtgcggcaaccctaaaatgtgcgtgcagccagtgcccaggcttttgcaagaggctagtctccagcgcgactgccgcctgccacgaagccggatagctttctag

SEQ ID NO: 29291 - DNA, 1011 bp, Artificial Sequence
  Description of Artificial Sequence: Synthetic coding sequence
atgattgccaagcgagttttgctcgcacatgaaaaactctcagtgccagtcacatgtaaaatacgagtctttcccgaaatcgacaagaccgtgcgatacgcccagatgttggaaaaggcaggctgtcagctactgacagtgcacgggagaacgaaagagcaaaaagggcctttaagtggggccgcctcttgggagcatattaaagctgttaggaaagcggtggcgatcccggtgtttgccaatggaaacatccagtgcctgcaggatgtggaacggtgcctccgagacacaggtgtccagggcgtcatgagtgctgagggaaatttgcacaatccggccctatttgagggacggagtcctgctgtttgggaattagcggaggaatacttggatattgtaagagcacacctctttaaactgtggcaccatacactgcaggtgcatcaggagctgcgtgaggagcttgccaaggtgaagactctggagggcattgccgccgtctcacaggagctcaagcttcgttgccaggaggagatctctaggcaggaaggggcaaagcctaccggcgacttgccctttcactggatttgccagccctatatcagaccaggtccccgcgaaggatctaaagaaaaggcaggcgcccgctcgaagcgggccttagaggaggaagaagggggcactgaggtgctctctaagaacaagcagaaaaagcaactgaggaaccctcataaaaccttcgaccccagtctaaagccaaagtacgctaaatgcgaccagtgcggcaatcccaaggggaacagatgtgtcttcagtctctgtcgtggatgctgtaagaagagagcatctaaggagaccgccgactgtcccggccacgggttacttttcaagacaaagcttgagaagtccctagcgtggaaggaggcccagcctgaacttcaggaaccacagcccgctgcccccggcaccccaggcggcttcagtgaagtgatgggaagcgcccttgcatag

SEQ ID NO: 29292 - DNA, 1953 bp, Artificial Sequence
  Description of Artificial Sequence: Synthetic coding sequence
atggcagaggggactgcagaggctccactggaaaacgggggcggtggagactcaggcgcaggcgcgctcgagcggggagtagccccaattaaacggcagtatttgacaactaaagaacagtttcatcaatttcttgaggcaaaggggcaggagaagacctgcagggagactgaagtaggggaccccgccggaaatgagctggccgagcctgaagctaagcgcattcgcctcgaagatggccagactgccgacggtcagacagaggaagccgccgagcctggagagcagttacagacccagaaacgtgcaagagggcaaaataagggcagaccgcatgttaaaccgactaattatgacaaaaatcggctctgtccctccttgatccaagaatcagccgctaagtgtttctttggggatagatgccgatttttgcacgacgttggacggtaccttgagacaaaacccgccgacttgggccccagatgcgtcctctttgaaacctttggaaggtgtccctatggcgttacttgtagattcgccggagcacacctgagaccggaaggacagaatcttgtgcaggaagaactggctgcaaggggcactcagcccccatcaatacggaacggactcgacaaagcattgcaacagcagcttcggaagcgtgaggttcggtttgagcgggccgagcaagctttacggagattttcccaaggaccaactcccgctgccgctgttcccgaaggtactgcagccgaaggcgccccccgtcaagagaactgtggtgcccagcaggtgcccgccggccctggcacaagcacacctccaagtagccccgtgaggacttgtggccccttaacagatgaagatgtagtgagactcagaccctgcgagaaaaaaagactggacatccggggcaagctgtatctggccccgctaactacgtgtggtaaccttccttttcgaaggatttgcaaacggttcggggccgacgtcacatgcggggaaatggccgtctgcacaaatcttctgcagggacagatgtcggagtgggccctgttgaagagacaccaatgcgaggatatcttcggcgtgcagctggaaggcgccttccccgacacaatgacaaagtgcgctgagctcctaagtcgaaccgtcgaagttgattttgtggatatcaatgtgggatgccccatcgacctcgtgtataaaaagggcggcggttgcgccttgatgaaccgctcaactaagtttcagcaaattgtgaggggtatgaatcaggtactcgatgtccccctgactgtaaagatccgaaccggagtgcaagaaagggttaatttggctcacaggctgctcccagagctgcgtgactggggcgtggcacttgtgacgctacatggtagatctagggagcaacgctacactaagctggccgattggcagtacatcgaagaatgcgtccaggctgctagcccaatgccgctatttgggaacggggatattctgtcttttgaggatgctaaccgcgctatgcagacaggggtgacaggcattatgattgcaagaggtgcgttgctcaagccctggttatttactgagattaaggaacaacgtcactgggatatcagtagctcagagcggctggatatactccgcgacttcactaattacgggctcgaacactggggatcggatacacagggagtggagaagacccggagatttttactcgagtggctgtcgttcttatgtcggtacgtacccgtagggctgttggaaaggctgcctcagagaatcaacgagaggcccccttactacctaggccgggactatctggaaaccctaatggcctctcaaaaagctgcagattggataaggatcagcgaaatgctgctagggcccgttccccccagtttcgctttccttccaaagcataaagcaaacgcgtataagtag

SEQ ID NO: 29293 - DNA, 1227 bp, Artificial Sequence
  Description of Artificial Sequence: Synthetic coding sequence
atggccgaggggacagcggaggctcctcttgagaacggtggcggcggtgatagcggcgccggagccctggagagaggcgtagctcccatcaagaggcagtatctcacaaccaaagaacaatttcaccagttcttggaggctaagggacaagagaagacctgcagagaaaccgaactggatatccggggcaagctatacctagcccccctgaccacctgcgggaacctcccttttagaagaatatgtaaaagattcggcgccgacgtgacttgcggagaaatggcagtgtgcaccaacctgcttcaggggcagatgtccgaatgggccttgttgaagagacatcagtgtgaggacattttcggagtccagctggagggagccttcccggatacaatgaccaagtgcgcggagctgctttcgaggactgtggaggtggacttcgttgacattaatgtgggatgtccaattgacctggtttataaaaagggagggggctgtgccttgatgaacaggtccaccaagttccaacaaattgtgcgaggaatgaaccaggtgctggacgtgcccttgacagtgaagatccgcactggcgtccaggaacgagtcaacctcgcccatcggctcctgcccgagctcagggattggggagtcgcactggtgactctgcacgggcgcagcagagagcagcgttataccaaactggccgattggcagtacatcgaggaatgcgttcaggcagcctcccccatgcctctgtttggaaacggtgacatcctatcattcgaggacgccaatcgagctatgcagacaggagtgactgggatcatgatagcccggggggcgctgttgaaaccatggctgttcacagagatcaaggaacagcgccattgggatatttcctccagtgagagattggacatcctcagagattttactaactatgggctagagcactggggatctgatacacaaggcgtggaaaagacgagaagattccttctggaatggttgagctttttatgtaggtacgtcccagttggcctgcttgagaggctgccccagcgcataaacgaaaggcctccatattacctggggcgggattatctcgagactcttatggccagccagaaggcagccgactggatccgaatatcagaaatgttacttgggccggttccaccatcttttgcctttttgcccaagcacaaggccaatgcctacaaatag

SEQ ID NO: 29294 - DNA, 954 bp, Artificial Sequence
  Description of Artificial Sequence: Synthetic coding sequence
atgaagtcggattgtatgcaaactactatctgtcaagagcgcaagaaggatcctatcgagatgtttcattcggggcagctggtcaaagtgtgtgcgcctatggtaaggtatagcaagctcgccttcagaaccttggttcgcaaatattcctgtgatctgtgttatacaccaatgattgtggccgcggacttcgtaaaatcaattaaagcccgcgactcagagtttaccacaaatcagggggactgtccgttgattgtccagtttgccgcgaatgacgctcggctactcagtgatgcagcccgtatcgtgtgcccctacgccaacgggatagatattaattgtgggtgcccacagcgttgggctatggcagagggttacggggcctgcctgataaataaacccgagctcgtccaggacatggttaagcaagtgagaaatcaagtcgaaacccctggatttagtgtctctattaagatccgaattcacgacgatttaaagaggaccgtagacctgtgtcagaaagccgaggccacaggggtgtcttggattactgtccacgggcggactgccgaggagcggcaccaacctgtccactacgattcaatcaagattatcaaggagaatatgtcaatcccagtgatcgctaacggtgatattcgctcccttaaggaagccgagaatgtgtggcgcatcaccgggaccgatggcgttatggtggcgcgtggactgcttgctaaccctgcaatgtttgccggctacgaggaaactccactcaagtgtatatgggattgggtcgatattgcactggaattgggtacaccttatatgtgcttccaccaacatcttatgtatatgatggaaaagattaccagccggcaggagaaaagagtgtttaacgccctcagctctacatccgccattattgattatctgacagatcactatggcatctag

SEQ ID NO: 29295 - DNA, 591 bp, Artificial Sequence
  Description of Artificial Sequence: Synthetic coding sequence
atggctgaaggctatggggcctgtctgatcaacaaacccgaactggttcaggatatggttaaacaggttagaaaccaggtggagacacccggcttttcagtatctatcaagattcgtatccatgacgatctaaaaaggactgtggatctctgccagaaagccgaagctaccggcgtgtcttggattactgttcacgggcgcaccgccgaggagcggcatcagcccgtgcactatgactctattaagataatcaaagaaaacatgagcatcccagtgattgccaatggggatattcgcagccttaaggaggccgaaaacgtgtggagaatcacaggtaccgatggagtgatggtggcaaggggcctcctggctaatccggctatgtttgcaggctatgaggaaacgcctctgaaatgcatctgggactgggtggatatagccctggagctgggaactccgtatatgtgctttcaccaacatctgatgtacatgatggaaaaaattacctctcgacaagaaaaaagagtgtttaatgccctcagttctacatcagcgatcatcgattacctgacagaccattatggaatttag

SEQ ID NO: 29296 - DNA, 3669 bp, Artificial Sequence
  Description of Artificial Sequence: Synthetic coding sequence
atgtctgaggccccaaggttttttgtgggaccggaagacaccgagattaaccctggaaactatagacacttctttcatcacgcggacgaggatgatgaagaggaggacgattctcctccggaaaggcagatcgtcgtgggaatatgtagcatggctaagaaatcaaaatcgaagccaatgaaagagatactcgagagaatttctctttttaaatacattaccgtggtagtcttcgaggaggaggttatccttaacgaaccagtcgagaattggccactatgtgattgtctgatttcattccatagcaagggcttccctctcgacaaagccgtggcatatgctaaacttcggaaccccttcgttatcaatgacctcaatatgcaatatctgatccaggataggagggaggtgtattcaatcctgcaggcagaaggaatcttgctgcccagatatgctattctgaaccgggacccaaataatccaaaggagtgcaacctgatcgagggcgaggaccacgtcgaagtcaatggcgaagtattccagaagccttttgtggagaagccagtaagtgccgaggatcacaatgtatacatatattacccgacatcagcaggggggggatcccagcgcctgtttaggaagattggctctcgctccagcgtctactcaccagaatcgaacgtccgaaagaccggaagctatatttacgaagagttcatgcccactgacgggacagatgtcaaggtctacacagtggggcctgactacgcacacgccgaggcccggaaatccccggctttagacggtaaggtggaaagggattccgaagggaaagaagtccgctacccagtgattctaaacgcacgagagaagctgattgcctggaaggtttgtctggctttcaagcagactgtgtgtgggttcgacctgctgagggccaacggacagagctacgtatgcgacgtgaacggattctcgtttgtgaaaaatagcatgaaatattatgatgactgcgcaaagattctgggtaacattgttatgcgagagttggctcctcagttccacataccatggtccatccccctcgaagcagaagacatacccatcgtacccacaacatccggcactatgatggagctacgctgtgtgattgcagttatcaggcatggcgacaggaccccaaagcagaagatgaagatggaggtacggcaccagaagttctttgatctttttgaaaagtgtgacgggtataagagtgggaaacttaaactgaagaagccaaaacagctgcaagaagtacttgacatcgccaggcagctactgatggagctgggacagaacaacgactctgagattgaggaaaataagccaaagttggaacagttaaaaacagtcctcgaaatgtacggtcattttagtggaattaatagaaaggttcagctgacttatctaccacacggatgtcccaaaacctcatcagaggaggaggactctcgccgcgaggaaccgtctcttcttctggtgctgaagtggggtggcgaactgactcctgctggccgcgtgcaggccgaggagctaggaagggccttccggtgtatgtaccccggggggcagggcgattatgccggttttccgggctgtggcctcttacgactccactccacgtaccgccacgatctcaagatatatgccagcgatgagggccgggtgcaaatgactgcggccgcttttgccaaaggcttactggcactcgaaggtgaactgacaccaatcctagtacagatggtaaagagtgcgaatatgaacggcttgcttgacagcgactccgatagtttatcatcttgccagcagagagtgaaagcgcggctacacgagattctacaaaaagatcgggacttcactgcggaagactatgaaaagctcacaccctctggatcaatctcgctgattaagtccatgcacttaattaaaaacccagtgaagacctgcgataaggtgtactctcttattcagtcacttacctcccaaattaggcaccgaatggaagaccctaagtcatcggacattcagctttaccacagcgaaactttggaactcatgttaagacgatggagcaagctggagaaagacttcaagacaaagaacggcagatatgatatctccaagataccagacatatatgattgtattaagtacgacgtacagcacaatggttcactcaaattggagaatactatggagctttacaggctcagcaaagctctggcggatattgtgatcccgcaggagtacggaatcactaaagctgaaaaactcgaaatcgccaaggggtactgtactccgctcgtgagaaagatccgaagcgatctgcagagaactcaagatgatgataccgttaacaagctgcaccccgtatacagcaggggagtgctgtctcccgagcggcacgtcagaacaaggttgtactttaccagcgagtcgcacgttcatagtctgctctctattctgcgatatggggctctctgtaacgaaagcaaagatgaacagtggaagcgggctatggattatctgaatgtcgtaaatgagctcaactacatgactcagatagttatcatgctgtatgaggatcctaacaaggaccttagctctgaggagcgctttcacgttgaactccactttagcccaggggccaaggggtgcgaggaggacaaaaacctgccctccgggtatgggtataggccagcttcccgagaaaatgaagggagacgccccttcaaaatagacaatgacgatgagccccataccagtaagagggatgaggtagatagagccgtcatactgttcaagccaatggtgagcgaacctatccatattcaccgcaagagcccattaccccgtagcaggaaaacagcaactaatgacgaggaaagtcctctgagcgtgagtagtccagaaggaactggtacatggctccactacacttctggtgtgggtactggacggagacggcgtcgctcaggggaacagatcacctccagccctgtgtctcctaagagtctcgctttcacctcctccatctttggctcttggcagcaggttgtcagcgagaacgccaattacctgaggacaccccgcactctggtggaacagaagcagaatcccactgtgggaagccattgcgcaggtcttttttctacctctgttttaggtgggtccagtagtgcaccaaatttgcaggactacgctcgaacgcacagaaaaaagttgacttcaagcggctgcattgacgggtttgaactatactccatggtaccatccatttgtcccctcgagaccttgcacaacgctctgagtctaaagcaggttgacgagttcctggcaagtattgccagtccttcgtccgacgtgccgcggaaaaccgcggagatttcttcaacagctctccgctcatccccaatcatgcggaaaaaggtctcgctcaacacctataccccagcaaagattctgccgaccccccctgctacactcaaaagtaccaaagcttcaagcaaaccagctactagtggcccttccagcgccgtcgtgccaaatacaagcagtcggaagaagaatatcacttccaaaactgaaacccacgaacacaaaaagaatacaggcaagaaaaaatag

SEQ ID NO: 29297 - DNA, 2970 bp, Artificial Sequence
  Description of Artificial Sequence: Synthetic coding sequence
atgaagggcctcggcgactcacgcccccgtcatctgagtgattcattagaccctccacatgagcccttgttcgctggcactgataggaatccctatttattaagccctactgaggcctttgctcgggaggcaagatttccaggacagaacacactccccggcgacggactgttccccttgaataatcagctgccccccccttctagtacgttccctagaattcattacaatagtcatttcgaagttcccgaggagagtccattcccctcccatgcccaggcaacaaagatcaacagactacctgccaatctgctggaccagttcgaaaaacaactccccattcacagggacgggtttagtacactgcagtttccaagaggggaagccaaggctcgaggggaatcgccaggccgcataaggcacctggtccatagtgttcaacgattgttctttactaaagccccttcacttgaagggactgctgggaaggtgggcggaaatggatctaaaaagggcgggatggaggacggtaagggacggagggccaagagcaaagagagggcaaaagcgggcgagccaaagaggcgctccaggtccaacatctctggatggtggtctagcgatgataacttagacggcgaggccggggcctttagatctagtgggcccgccagcggactgatgaccttggggcgccaggccgaacgcagccagcctcgatacttcatgcacgcgtacaacacaatctcaggacacatgctgaagaccacaaaaaacaacaccaccgaacttactgccccccctccccccccggcgcctcctgccacttgccctagtctgggagtaggaaccgacacaaattacgtgaaacggggatcctggtctaccctcacactgtcccacgcccatgaggtctgtcagaagacatccgcaactctcgataaaagcctcctgaagtccaaatcttgccatcagggtctggcctaccactatctgcaggtccctggaggcggcggcgagtggtctacaaccctcctatcgccaagagagactgatgctgcagccgagggaccaatcccctgtagacggatgcgcagtggttcctatattaaagcaatgggcgatgaagactcggatgagagtggcggttcccccaagcccagcccgaagaccgccgcgcgacgacagagctatctccgtgccacccaacagtctctcggtgaacaaagcaatccccgcagatcgctggaccggttggactctgtcgacatgctgctaccctcaaaatgccccagctgggaggaggattacacccctgtaagtgatagcttaaacgattcctcatgtatttcgcaaattttcgggcaagcatccctgattccacaactgttcgggcatgagcaacaggtacgtgaggcagagctgtctgatcagtacgaagctgcctgcgagtcagcgtgctcggaagcagagtccacagccgcggaaactctagacctccctctaccttcgtacttcagaagccgaagccattcctaccttcgggctatccaggctgggtgctcacaggaggaggacagcgtgtccctgcagtccctatcaccaccccctagcaccgggagtttatccaactcaagaactctcccttcctcatcctgcctggtggcttacaagaagacaccgcctccagtgccacctagaaccacttctaagccatttattagcgtaaccgtccagtcaagcacggaatcagcccaggacacttatctcgactcccaagaccacaagagcgaagtaacaagtcagtcaggtctatcaaatagcagtgactcattagattcctctacccggccaccttcagtgacacgcgggggagtggcgccagcgccggaggcccccgaaccccctcctaagcacgcggcactcaaaagcgaacaaggcacattaacaagcagtgaatctcaccccgaagccgcacccaagcgtaaactatctagcattggaatccaggagaggacaaggaggaacggcagccacttaagcgaagataacggccctaaggccatcgatgtgatggccccaagttctgagtcctcagtgcccagtcactcgatgagttcccgtagggataccgattccgacactcaggacgcaaatgattcctcgtgcaaaagttcggagagaagcctgcctgactgtacccctcacccaaactcaattagcattgacgccgggccacggcaggcgcccaaaatagcccagattaagagaaacctttcgtacggtgataacagtgacccagcactggaggctagctcgctgcctcctccggatccctggctggagaccagctcctcctcccctgccgagccagcccagccaggcgcgtgtcgtagagatgggtattggttcctgaaactcttacaggccgagaccgaacgacttgagggatggtgttgccagatggataaagaaactaaagagaacaacttatctgaggaagtattgggaaaggtgctctccgctgtaggaagtgctcaactgctcatgtcacagaaatttcagcagtttaggggtctgtgcgaacagaacctcaatccagatgctaaccctcgtccaactgctcaagacctggccggtttctgggatctgttgcagctgtctatcgaggatataagtatgaagtttgatgagctgtaccatctgaaagctaactcttggcagctggtggagactcccgaaaaacgtaaggaggaaaaaaaaccaccgcctccggtgccaaagaaaccagctaaatctaagcccgcagtttctagagacaaggcttccgatgcctctgacaaacagcgacaggaagccaggaaacggttgttggctgctaagagggccgcctctgttagacagaacagcgcaaccgaatcagctgatagtatcgaaatctacgttccagaggcacagacgcggctgtag

SEQ ID NO: 29298 - DNA, 2979 bp, Artificial Sequence
  Description of Artificial Sequence: Synthetic coding sequence
atgaaaggactgggggactcccgccctaggcacctgtccgattccctggatcctcctcacgagccgctttttgccgggactgacagaaacccatatttgttgtccccgacagaagccttcgcacgcgaggctcgattcccaggccaaaataccctgccaggggatggcctctttcccctaaacaaccaattgcctccccctagtagcacgttcccaagaatccactataactcgcatttcgaagttccggaggagtcgccattccccagccacgctcaggctacaaagattaatcgtctgcctgcgaacttgcttgaccagtttgagaaacaattgcccattcatagggacggattctccacactgcagttcccacgcggggaggcaaaagcaaggggcgaaagccctggacgaattcgtcacttggtccattcagtccagcgccttttctttacaaaagcgccttctcttgaaggcactgcaggtaaggtgggtggtaatggtagcaagaaaggggggatggaggatggaaaagggcgacgcgccaagagtaaggagagggctaaagccggagagcctaagaggcggtctagaagtaacatttctgggtggtggtcctcggacgacaatctggatggagaggcaggagcattcagatcctccggtcccgcttccggattaatgacattagggaggcaggcggagagatcgcaaccaaggtactttatgcatgcctacaataccattagcggacatatgctgaagacaactaaaaataataccacagagctcacagcccctcctccaccacccgccccccccgctacatgccctagcctgggagtaggcaccgatactaactacgtgaagcgtggttcctggtccaccctgactctgtcgcatgcccacgaggtgtgccagaaaacctctgctaccctggataagtctctcctaaaatcaaaatcatgtcaccaaggactcgcttaccactacctccaggtgccgggtggcggaggcgaatggtccacgacgctactgagccccagggagacagacgctgctgctgagggccccatcccatgcagacgaatgaggtccggtagttatataaaggccatgggcgacgaagactccgatgagagtggagggtcacccaagccatcacctaagacagcagctcgccgtcagtcatatctaagggccacacagcaaagcctgggagagcaatctaacccgcgtaggagtctggatagactagattccgtcgatatgctgctgccatcgaaatgccctagttgggaagaggactacacacccgtctccgactctttgaatgattcctcatgcatctcccagattttcggacaggctagcttgatacctcaattatttgggcatgaacagcaagtgagggaagctgagctttccgaccagtatgaggccgcatgcgagtctgcctgcagcgaggctgagagtacagccgcagagactttggacctccctctcccatcttacttcagaagtagatctcattcttatttgagggctattcaggcaggctgtagtcaagaagaagattccgtgagtctacagtccctgtctccgccaccgtccacaggcagcctcagcaattcaaggacgcttcccagctcttcctgtttagtggcttacaaaaagaccccacccccagttccacctcgcacgacatctaagcccttcatcagtgtgaccgtgcagtcatccaccgagagcgctcaggacacgtacctggatagccaggatcacaagagcgaagtcactagccagtctgggctgtcaaattcatcagatagcctggattctagtactcgtcctcccagcgtgacccgcggaggcgtagccccggcaccggaggcccctgagcccccgcccaagcacgccgccttgaagtcggaacaaggcacactcaccagctcagaatcgcatccagaggcggcacccaaacggaagctgtcttccattggtatccaggtcgactgtatccagcccgtcccaaaagaagagcctagccccgcaaccaagttccagtccataggtgtccaagtggaggatgactggcgaagttcagttccttctcattcaatgtcttcacgtcgggacacggacagcgacacccaggacgctaatgattcctcgtgcaagagctccgagcgatccctgccagactgcacacctcatcccaacagtatcagtattgacgccggaccacggcaagcgcccaaaatcgctcagatcaagcgcaatttgagctacggagataactccgatccggctttggaggcatccagtctgccccccccagacccctggttggagacatctagctccagccctgcggaaccagcacaacctggcgcatgtcggagggacgggtattggttcctgaaactcctgcaggcggagacagaacggttggagggctggtgctgccaaatggacaaagagacaaaagaaaataatctgtcagaagaggtcctgggcaaagttctctctgctgtgggcagcgcgcaactgctcatgagccagaaatttcagcagttccgcggattgtgcgaacaaaacttgaaccccgatgccaacccacgcccgacagcacaagatctagccgggttctgggacttgctacagctttctatcgaggatatctcaatgaaattcgatgagctctaccatctgaaggctaattcttggcagttggtcgaaactccagaaaagaggaaggaggaaaaaaaaccaccccccccagtgcctaagaagcctgccaaatcaaagccagcagtatcgcgcgataaagcatcagacgctagcgataagcagaggcaggaagccagaaagagactcctcgcagcgaagagagcagctagcgtgcgtcaaaatagcgctacggaatccgctgattcaattgaaatttacgttcccgaggcccagacacgcctttag

SEQ ID NO: 29299 - DNA, 2979 bp, Artificial Sequence
  Description of Artificial Sequence: Synthetic coding sequence
atgaagggcctaggagactcacgcccccggcacctgtcagattcactagatccgccacatgagcccctgttcgcaggcacggacaggaatccctatctcctcagccctactgaagcttttgctagagaggctcgatttccaggacagaatactctgcctggagacggcctttttcctttaaacaaccagttgcctcctccctcctctacgtttcctaggatccactacaatagccatttcgaggtgccagaggaaagcccatttccaagccacgcccaggcaacaaagataaatcgactaccggccaacctgctggaccaattcgagaaacagctccctattcacagggacggcttttctacactacagtttccgagaggcgaggcgaaggcacgcggcgaaagcccaggccgaatccgtcacctggtgcattccgtgcagagactgttcttcaccaaagccccatcactagagggcacagctggcaaggtcggcgggaacggcagtaagaaaggagggatggaggacggtaaaggaagacgcgccaagtctaaggaacgcgcaaaagccggcgaacccaaacgacgcagtcgcagcaacatttcgggctggtggtcctccgacgacaatctggacggtgaagccggagcgttccgatcttccggccccgcatctggtctgatgacgttgggaaggcaggccgaacgatcccagccacgctatttcatgcatgcgtacaatactatttctgggcatatgttaaaaaccactaaaaacaacacaacagaactgaccgcaccacctccaccaccggcacccccggctacctgtccctcacttggcgtcggcacggataccaattacgttaagcgcggttcttggagcacgctcaccctgtcccacgcgcatgaagtgtgtcagaagacaagtgcaacattagacaagtccctgctgaagagtaaaagctgccatcaagggcttgcttatcattatctccaagtccccgggggcgggggagagtggtcgacaactctgttgtctcctagagaaactgacgccgccgctgagggccccattccttgtagacggatgcgatcagggagctacatcaaggccatgggagacgaggactccgatgaatcaggcggtagccccaagccaagccctaagactgccgctcggcggcagagctacctaagggctacccaacagtccctgggggaacagtcaaatccgcgcaggtccctagaccgccttgattctgtcgacatgctcctgccctctaaatgcccatcatgggaagaagactatactccagtgtcggacagtcttaatgactcctcctgcatttcgcagatatttggacaggccagtttgatcccccagctgttcggacacgaacaacaagttcgggaagccgaactttcagatcaatacgaagccgcatgcgaatccgcttgctctgaggcagaaagcacggccgcagagacattggacctgcccttaccttcttattttaggagcagatcccattcatacctccgggccatacaggccggctgttcccaagaggaggatagcgttagcctccagtctcttagccccccacctagcacaggctcccttagtaatagtcgaaccttgccatcctcatcctgcctggtggcatacaagaagactccaccccctgtcccccctaggacaacgagcaagccttttataagcgtgaccgtgcagtcatctactgaaagcgcccaggatacctacctggattcgcaggatcataagtctgaagtcacgtctcagtccggcctatcaaattccagcgatagcttggattcatccacgcgcccaccaagcgtgacacgcgggggcgtggcccctgccccagaggcgcctgagccccccccgaagcacgccgccctcaagtccgaacagggtactctaacgtcttccgagtctcaccctgaggcggcacctaagagaaagctctcctcaatcgggatccaggtagattgcattcagccagtccctaaggaagagccttcacctgctacaaaattccaatctatcggagtccaggtcgaggatgattggcgatcctctgtgccgtcacactcaatgtcaagcagaagggataccgactccgacactcaggacgcgaatgacagttcgtgtaagagctccgaacggtccttgccagattgtactcctcaccctaattccatctccatcgacgccggccccaggcaggcgccaaaaatcgcccagatcaaacgcaatttatcatatggagataactccgatccagctcttgaagcctcaagcctgcccccgcctgacccctggctggagactagtagctctagtcctgcagagcccgcgcagccaggagcctgtcgccgtgacggttattggttcctcaaactcttgcaagcggaaaccgagcgactggaaggttggtgctgccagatggacaaggaaaccaaggagaataatctgtctgaggaggtgctgggcaaggtccttagtgccgtaggaagcgcacagttattaatgtctcagaagtttcaacagttcagaggcctgtgcgaacagaacctgaacccagatgccaatccccgtcccacggcgcaggacctcgccggattctgggacctgctccagttgtctatcgaggacatctccatgaagtttgacgaactgtaccacttaaaggctaattcttggcagcttgtggagacccctgaaaaaaggaaagaggagaaaaaacctcctcctcccgttccgaagaagccagccaagtccaaaccagctgtcagcagagataaagcctcagacgcctccgataagcaaagacaagaggcacgcaaacggcttctggctgctaagcgcgctgccagcgtgagacagaacagcgcgacagagagtgccgattcaatagagatttatgttccagaagctcagactagattgtag

SEQ ID NO: 29300 - DNA, 1362 bp, Artificial Sequence
  Description of Artificial Sequence: Synthetic coding sequence
atggcactatgtctggaactgctcaagcagtgttctagctgtttggtcgcatataagaagacaccaccaccagttccaccgagaaccacctcgaaaccatttatcagcgtgacggtccaaagcagtacagaatccgcacaggacacctatttggattctcaggaccataaatccgaagtgacctcccaatctggtttgagcaattctagtgattccctcgacagtagcaccaggccgcccagtgtgacaaggggtggcgtcgcaccagcgccggaggcacccgaaccaccacccaaacacgccgctctgaaaagcgagcagggtaccttgaccagttctgaaagtcacccggaggcggcgccaaaaagaaagctgtcttccatcggaattcaggtagactgtattcaacccgtgcccaaagaggaaccatctcctgcaacaaagttccagtccatcggggtgcaggttgaagacgactggcgatcttctgtgccatcccactcaatgagtagcagaagggataccgatagtgacactcaggacgctaacgacagttcatgtaaaagcagtgagcgatccctccccgactgcacaccacacccgaattcaatcagcatcgacgcaggacctcggcaggcccctaagatagctcaaattaagcggaatctttcatacggagataattccgacccagcccttgaagcttcttctctgccccctccagatccatggcttgaaacaagctcttccagtcccgcagagccagctcaaccaggcgcatgtaggcgcgacggttactggttcttgaaacttctgcaggccgagaccgagcgcctggagggatggtgttgccagatggacaaagaaactaaagaaaacaacttgtccgaagaagttctggggaaagtcctgtcagcagtcgggtcagcacagctgcttatgtctcagaagttccagcagttccgcgggctttgtgagcagaacctcaaccccgacgcaaatcctaggcctaccgcccaagatctcgccgggttctgggatctgctccagttaagcatcgaagacataagcatgaagttcgatgagttgtaccatctgaaggccaacagctggcagctggtcgagaccccagaaaaacggaaggaagagaagaagcccccgcctcccgtgcctaagaagccggccaaatctaagcccgctgttagcagggataaggccagcgacgcctcggacaaacagagacaggaagctaggaagaggttactcgccgctaaacgcgctgcctccgtccggcagaatagcgcgactgagtcagccgatagtattgaaatatatgttcctgaggcccagacccggttatag

SEQ ID NO: 29301 - DNA, 2979 bp, Artificial Sequence
  Description of Artificial Sequence: Synthetic coding sequence
atgaagggcctgggcgacagtaggcctaggcacctatcagactccctggacccccctcacgagcctctgttcgcaggaaccgaccggaatccatacctgctatctcccacagaggcttttgctagagaggcccgctttcctggtcagaatactctacctggcgacggtctgttcccactcaataatcagctgccacctccttcgagcacatttcctcgcatccattacaactctcactttgaagtgcctgaggaatcgccctttccatctcatgcacaggccactaaaatcaatagactgcccgctaacctgctggatcaattcgaaaaacagctgccgatacatcgtgatgggttttccaccctccaatttccccgaggagaagctaaggctcgtggtgaaagtcccgggcgtatccgccatctggtgcacagcgtccagcgcctgtttttcacgaaagcgcccagcttggagggcaccgcaggaaaggtgggcgggaatggatctaagaaggggggcatggaggatgggaagggtagacgcgctaagtcaaaggagcgggcaaaggccggagagccaaaacgtcgatccaggtctaatatctccggatggtggtcctcagacgacaatcttgatggggaggccggagcgttccgatcttctgggccagccagtgggctgatgactctgggtagacaggccgaaaggagccagcccagatatttcatgcacgcctacaatacaatctctgggcacatgctgaaaacaaccaagaacaacacaacagaacttacggctccccccccccctccagctcccccggccacctgcccctccctgggagtggggaccgatacaaattatgttaagagaggttcctggtccacactgaccctctctcatgctcacgaggtgtgtcagaagacaagcgcaacactagacaaaagtcttctgaaatcaaagagctgccaccagggtctagcctatcattacctacaggtgccaggaggagggggagagtggtcaacaaccctgctgtctcctagggagaccgatgctgccgcagaaggaccgattccttgcagaagaatgcggagcgggagttacatcaaagctatgggcgacgaggacagtgacgaaagcgggggatcccctaaaccaagtcccaagactgccgcccgcagacaaagctacctccgggctacccagcagagcttaggcgaacaatccaaccctcggcgaagtttggatcggctggatagcgtggacatgctgctcccatcgaaatgtccatcttgggaagaggactacaccccagtctcggactcacttaacgatagcagttgcataagtcagatctttggacaggccagcctgatcccccagttgtttggccacgaacagcaggtgcgggaggccgagctctcagaccagtacgaagcggcatgcgaatcggcttgcagcgaagcagaaagtaccgccgctgagaccttggaccttcctttaccctcctatttccggagccgctctcattcctacctgcgggcgattcaagcaggatgctctcaggaggaagattcagttagtctccagtctctaagccctccgccttccactggatctctttctaatagcagaactttgccgagctcatcatgcctcgttgcctacaagaaaacgcccccaccagtgccgccgaggacgacatccaagcctttcatctctgtgactgtccagtcctccacggagagtgcacaggatacatatctggatagccaggaccataaatccgaagtgacttcacagtcaggactgtcaaatagctctgatagcctagattcctctacccggccgccttcagtgacacgtggtggcgttgcccctgctccagaggcccccgagccgccccctaaacatgccgccctgaagtctgaacaagggacgctgacttccagcgaatcacaccctgaagccgctccaaaacggaagctttcctccatcggaatccaagtggactgtatacagccagtgccaaaagaggagccctcacctgccacgaagttccagtccattggagtacaggttgaggacgattggaggtcctccgtccctagccacagtatgagctcacggagagacaccgactccgatactcaggatgctaacgatagttcctgcaagtctagcgaaagaagcctgcccgattgtaccccccatccgaactcaatctccatcgacgcggggccccgccaggcccccaagatagcacagattaagagaaacctgtcctatggagacaattcagacccagcgctggaggcatcttctttgcccccacccgacccctggcttgagacgtcctcctcttcccctgctgagcccgcacagccaggggcctgcaggagagacggctattggtttctgaaacttctgcaggcggaaaccgagcgtctcgagggctggtgctgccagatggacaaagaaacaaaagagaacaacctgagcgaagaagtgttggggaaagtgctctcagccgtgggcagtgcccaactcttaatgtcccaaaaattccagcagttccgaggactgtgcgagcagaaccttaacccagacgcaaacccaaggccaacagctcaggatctggccgggttctgggacctgctccagctgagcatcgaagatatcagcatgaagttcgatgagttgtaccatctcaaggcgaactcatggcagttagttgagactccagagaaaaggaaagaagagaaaaaacccccgccccccgtgcccaagaaaccagcaaaatcaaagcccgcggtcagtcgcgataaagctagtgacgcttcagacaaacagcgacaagaggcccggaagcgtctgctggccgccaaaagggccgccagcgtgcggcagaatagcgccaccgagtccgccgatagcatcgagatctacgtgcctgaggctcagaccagactatag

SEQ ID NO: 29302 - DNA, 2970 bp, Artificial Sequence
  Description of Artificial Sequence: Synthetic coding sequence
atgaagggcctcggcgactcccgcccgagacacctctcagattcacttgacccaccccatgagcccctgtttgccgggactgatcgcaatccatacctcctgagcccaaccgaagccttcgccagagaggcaagatttcctggccaaaacacactgcccggggatggactatttccactcaataaccaactccccccccccagcagcacctttccccgtatccattacaactcccactttgaggtgcccgaggaaagcccttttccttcccatgctcaagctaccaaaattaatcggctgcctgccaacttgctggaccagtttgagaaacagctgcctatccaccgcgatggattttcaacactgcagtttcctcggggtgaggcaaaggcacgcggcgaaagcccgggccgcattcggcacctggtgcactcggtgcagagactgttcttcacaaaggccccctctctggagggcacagccggcaaggtgggcggaaatggtagtaaaaaaggcgggatggaggacggaaaaggacgcagggccaaaagcaaggaacgtgcaaaggcaggtgagcccaaacggcgctccaggagtaatatctccgggtggtggtcctctgacgacaacctggacggggaagccggggccttccgttcaagcggacctgcctctggactaatgactctgggcaggcaggccgagcgcagtcagccgcgatacttcatgcatgcctacaacaccatcagtggtcatatgctgaaaacaacgaagaacaacaccactgaactgacagctcctccccccccacctgcgccccctgcaacatgccctagcctgggggtcggcactgacacaaactacgtgaagcgaggcagctggagtaccctgactctgagtcatgcccatgaggtctgccagaagaccagcgccacattagacaagagcttattaaagagtaagagttgccatcagggtctggcataccattacctgcaagtgcccggcgggggcggagagtggtcaaccactctgctgtcaccccgcgagaccgacgctgcagctgaagggccaattccctgtcgtcggatgagatctggcagctatatcaaggccatgggagacgaagactctgacgaaagcggagggagtcccaaaccctctcctaaaacggcagcaagaaggcagtcatatctgagggctactcaacagagcctaggagagcagtccaaccccagacggtcgctagatcggctcgactccgtggacatgctcctcccttccaagtgcccatcgtgggaggaagactacactcccgtgagtgattcgctgaatgacagctcatgtatttctcaaatcttcggtcaggccagcttgattccacagctctttggtcacgaacaacaggttcgtgaggccgagctatcagaccagtatgaggcggcctgcgaatcagcctgctcagaggctgaatcaactgcggctgaaaccctcgatctgccactgccatcatacttcagatctcgatctcactcgtatctccgggccatccaggccggttgctctcaggaggaggattctgtatccctgcagagcctgtcaccccctcccagcacagggagtctgtccaactcccggacgctgccctcttccagttgcctggtggcatataaaaaaacacctcctcccgtgccaccacgcacgacaagtaaacctttcatcagtgtgaccgtacagtcctcaaccgagagcgcgcaagacacctacctcgactcccaggaccataagagcgaagtcacctctcaatccggtctctccaacagctccgatagcttggacagctcaacccgccctccatctgttaccagaggtggggtggctcctgctccagaggcgcccgaacctcctcctaagcacgccgctttgaaatcagaacagggcaccctgacaagctctgaatcacaccccgaagctgctccgaaacgcaagctgagcagtattgggatacaagaacggacaaggcggaacggctcacatctctcagaagataacggtcctaaggcgattgacgtaatggcccccagttcagaatcatccgtcccttctcactccatgagctcccgcagagataccgacagtgatactcaagacgcgaacgattcatcttgcaagagttccgagaggtctttgccagactgcacgccccatcctaacagcataagcattgacgcgggaccccgacaggcccctaaaatcgcgcagatcaagcgaaacctaagttatggagataattctgatcccgctttagaggccagttcactcccccctcccgatccctggctggaaaccagttcatcctccccagccgaacctgctcaacccggcgcctgtcgacgggatgggtactggttcctgaaactgctccaggccgagacagagcgactcgaggggtggtgctgccagatggataaagagacgaaagaaaataacctgagcgaagaggtgctagggaaggtgctgtcagcagtagggtccgctcaattgttaatgagccagaagtttcagcagtttcggggactctgtgaacagaatctgaaccctgacgccaatcctcgacctacagcgcaggacctggcgggattttgggatcttttgcaattgtcaatagaagacattagcatgaagttcgatgaactgtatcaccttaaggccaatagttggcaactggtggaaactccagaaaagaggaaagaagagaagaagccccctccacccgtgcctaaaaaaccagcaaaaagcaagcctgccgtttccagggacaaggctagcgatgcctcagacaaacagaggcaagaggccagaaagcgtcttcttgccgccaaaagggccgctagtgtcagacagaactctgctactgagtcggcggactccatcgagatttacgttcccgaagcacagactcgtctgtag

SEQ ID NO: 29303 - DNA, 2970 bp, Artificial Sequence
  Description of Artificial Sequence: Synthetic coding sequence
atgaaagggttgggagatagtcggccacgccatctgagcgactcgctcgatcccccgcacgaacctctcttcgctggtaccgatcgcaacccatatctgctgagcccaaccgaggcctttgccagagaggcgcggtttcccggacagaacacgttaccaggtgatggcctattcccacttaacaatcagctgcctcctccgagttcaacatttccaagaatacattataattcccacttcgaggtacccgaagagtctccatttcccagtcacgcccaagctacaaagattaacaggttaccagccaatttactggatcagtttgaaaaacaattgcccattcaccgcgatgggttctccacactccagttccctaggggggaagctaaggctagaggagaatcgccaggccggatcaggcatttggtgcactccgtccagagactgttttttacaaaggccccgagcctggaaggaacggccggaaaagtggggggtaatggctccaagaaaggaggtatggaggacgggaagggcagacgcgccaagagtaaagagagagccaaggccggtgagcctaaaaggcgctccaggagcaacatttcaggatggtggagcagtgatgacaacttagatggcgaggccggcgccttcagatcgtcgggccccgcttctggacttatgaccctgggaaggcaggccgaacggagccagccccgttacttcatgcacgcctacaacacaatcagcggtcacatgctgaagaccacaaaaaataacacgacggaactcactgccccgcctccaccacctgctccacccgccacttgtccctctctgggggtcggcaccgatactaattacgtcaagcgaggcagctggtctacgttaactctgagccacgctcatgaggtctgtcaaaaaaccagcgccacactcgacaagagcctgctgaaatcaaagagctgccatcagggcctggcataccactatctgcaggtgccagggggcggcggcgaatggtccaccactctgctaagccccagagaaacagatgctgctgccgaaggccctataccttgtaggagaatgcgatcaggaagctatattaaggccatgggagacgaagatagcgacgaatctgggggctcccccaaacccagccctaagaccgcggcgcggagacaaagctatttgagagccactcagcaaagcttgggggagcagtcaaaccctagaaggtccctggatcgtctggatagcgtggacatgctgctgcctagtaaatgtccaagctgggaagaagattacacccccgttagcgatagcctcaatgactctagctgcattagtcagatatttgggcaggcaagcctaattccccaattatttggacacgaacagcaagttagggaggctgagctgagcgatcagtacgaagctgcttgtgaatcagcctgttctgaggccgagtccacagctgctgaaaccctggacttgcccctgccgagctatttcaggagccgaagccatagttacctcagggcaattcaggccggatgcagccaggaggaggactcggtatcactgcagtctctctccccccctcctagcacaggaagcttgtccaatagtcggaccctcccctcgagtagctgtttggtggcgtataagaagacacccccgccagtcccaccacggaccacctctaaacctttcatcagcgtgacagtgcaatcttccaccgagagtgcccaagatacatatctggacagccaggaccataagtccgaagtaacgagccagtccggtcttagcaactcctctgactcgctggattcgagtacccggcctccttccgtgacacggggcggggtggctcctgcccctgaagcaccagagccccctcccaaacatgcagctttaaagtcggaacagggtacactgacctccagcgaatcgcaccccgaggcggcaccaaagagaaagttgtcctcaataggtatacaggaacgcactcgcaggaacggcagccatttatcagaagataatggaccaaaggccattgacgtgatggcaccatcgagcgagagctcagtcccgtcgcatagtatgtcatctcgacgggataccgacagtgatactcaggatgccaatgatagctcatgtaagtcgtcagagaggagcttacccgactgcaccccgcaccccaactccatctccattgatgccggacccaggcaagctcccaagattgcccaaattaaaaggaacctgtcctatggagacaattcagacccggcgctcgaagctagttctttgccaccccccgacccgtggctggaaacttcttcctcatcgcccgccgagcctgcacaacccggcgcctgtaggagggacggctactggtttctcaagctccttcaagcggaaactgaacgactagagggatggtgctgccagatggacaaagagactaaggagaacaacttgagcgaagaagtgctgggcaaggtgcttagtgccgtgggaagcgctcagctgctcatgtcccagaagttccaacaatttagaggcttgtgtgaacagaacctgaatcccgacgccaatcccagaccaactgctcaggatctggcaggattctgggacttgttacagctgtctatcgaagacataagcatgaagtttgacgagctctaccatctgaaggccaattcttggcagcttgttgagactccagagaaacgaaaggaagagaagaagcctccccccccagttcccaaaaaacctgccaagtccaaaccagccgtttctcgggacaaggcctcagatgcatccgataagcagagacaagaagctagaaaaagacttttagctgctaaacgggccgcttctgtccgccagaattccgcgacagaatcagccgactctattgagatctacgtccctgaggctcagacccgcctgtag

SEQ ID NO: 29304 - DNA, 576 bp, Artificial Sequence
  Description of Artificial Sequence: Synthetic coding sequence
atgcctggttcagaggacctgcgcaagggcaaggatcagatgcactctcatcgtaagaggacaatgttcacaaagaaacagctggaagatcttaacattttgtttaacgagaacccttacccaaatccttcattacagaaagaaatggcatccaagatcgacattcacccgacagtgcttcaggtgtggtttaaaaatcatagagccaagctgaagaaggctaagtgtaaacacattcatcagaagcaggagacaccacagcctccgatcccagaggggggcgtctccaccagcgtgggtctgcggaatgccgatacactgcccagactaccgaacgccgcccatcccatcgggctggtatatacaggacatagagttcctagctttcagctcatcctgtaccctaacctgaaagtgccagccaatgacttcatcggtcatcgcatcgtccatttcgggtgttgccgcgatccaaatatctattgcttatatcccattctcgagtctcaggtgtgtgccccgtccttccacagcgggagccccgcctgcagttccaatcagtcgcgcgaaagatag

SEQ ID NO: 29305 - DNA, 2052 bp, Artificial Sequence
  Description of Artificial Sequence: Synthetic coding sequence
atgctggcttgcttgacccgtggcaacctgttggatgtgctgcaggagggcttcaacgagcagcagctgcaagcctatgtcgcatgggtcaacgcacaactcaagaagagaccagccgttaaacccgtgcaggacctgaggcaggacctgagagatggagtgatcctggcttaccttattgagatcgtagccggcgagaaactgtccggggttcagctaagccccggtaaccagcaggagatgaagaacaatgtggaaaaggtgctgcagtttgttgcatccaagaaaattcggatgcatcagacttccgccaaggatatagttgacggcaatctgaaatcaatcatgcggctagttcttgcgctggccgcccatttcaaaccgggctcctcccgtactgtgaatcaaggccgggattctcgggctcctctccagagtcatcgcccacactgtgccacggcagttgcccagggcgccgccgcagcactggcggacgtgtgtcatgatatgtcacgatcggggagagacgtgtttcggtacagacagagaaattccagtatggatgaagagatcgagaacccgtattggtccgttcgggctctggtgcagcagtacgaaggacagcagagatcgccgtcggaatcctcatgttcaagcctcacctctccctcgcctatacatagcgcaaagtcagagagtatcataacccaatctgaagaaaaggcagactttgtcattatcccggcagagggaatcgaaaaccgcacagaagggacggatagcccgttaagtcgagattggcggcctggaagtccaggtacctatctggagacgagctgggaggaacaattgctggaacagcaggagtacctggagaaagagatggaggaggccaagaaaatgatcagtggcctgcaagcattactgctgaatggatctctgcctgaggacgaacaggaaagacctttagccctatgcgagcctggggtcaacccagaggaacagctgattataatccagtctaggctggatcagagtatggaggagaaccaggatcttaagaaagaactactaaagtgtaagcaagaagcacggaacctgcagggtataaaagacgcactacagcagcgcctaactcagcaagacacctctgttctccagttaaaacaggagctgctaagggctaacatggataaggatgagcttcacaaccagaacgtggacctgcagagaaaattggacgaaaggaatcgacttttaggggagtataagaaagaattgggacagaaggatagattactccagcagcaccaggccaaactggaagaggcactgcgtaaattgtccgacgtgtcttaccatcaggtagacttagagcgagagctggagcacaaggatgtactactcgcgcactgtatgaaacgggaggctgatgaggcgacaaattataatagccacaattctcagtccaatggattcttattacctactgctgggaagggcgccacctcagtcagcaatagaggaactagcgatctacaactcgtgagggatgctttaagaagtcttaggaattcattctccgggcacgaccctcaacaccatactatagacagcctggaacagggaataagttctctcatggaacgtctgcacgtgatggaaactcagaaaaagcaggaacgcaaggtgagagtgaagtctcctagaacgcaggtcgggtcagagtacagggagagctggccaccaaattccaagcttccacattctcagagctctcccaccgtgtcatcaacctgtacaaaagtactttactttacagataggagcctgacccctttcatggttaacattccaaaacgactcgaggaagtcaccctcaaggattttaaggccgccatcgaccgcgaagggaatcacagatatcactttaaagccctggatcctgagttcggcaccgttaaggaagaaattttccacgacgatgatgcaatccctggctgggaaggaaagatcgtcgcatgggtcgaggaggatcacggggaaaactag

SEQ ID NO: 29306 - DNA, 384 bp, Artificial Sequence
  Description of Artificial Sequence: Synthetic coding sequence
atggctgcacctcccaaggcacccatcagggtacggaatctgacaatccgtgctggggccctgaccgggaaggaaaataatatgctccaaccagaaacccatatctttactgcacctgaggaggtgcccaaggtttcagatcaggccctggtttccgctcactcagagtggcagcgaaaactcgaggctgctgaggccttgctgactctgagaaactctgcacaggcacccccagacagcatttccctgcatcagccatgcaaccccccagccccagccggcgataaaggcttccagcccccatccccaagtctacggcctcgacctgcttcctcgataagtctgccgatcggccacctggggtgcattagtctgctgtcttag

SEQ ID NO: 29307 - DNA, 579 bp, Artificial Sequence
  Description of Artificial Sequence: Synthetic coding sequence
atggccgccccacccaaggctcccattcgagttaggaaccttacaatcagagccggagcactcaccggcaaggaaaataatatgcttcaaccggagactcacatctttactgcacctgaggagggaagcagccagggtgcccttctgttggggcaggccccagagccactgtcactgccatgcaccccagtgaccctggagcagcagctggtcagcccttctggtgacccacaccgggctcccgccctgcccagtatttgcagcacattgatcttacagccttgtgccacattagaccctttactcttgcagccacaggttccaaaagtgagcgaccaggcactggtgagcgctcactcagaatggcaaagaaagctggaggctgcggaagcacttcttaccctgcggaatagtgcccaggccccaccggactccatttcactccatcaaccgtgcaacccgcccgccccggccggggataagggttttcaacccccctcaccgagcctccgaccaagacctgccagttcaatcagcctacccattggccacctgggctgtattagcctcctgagttag

SEQ ID NO: 29308 - DNA, 384 bp, Artificial Sequence
  Description of Artificial Sequence: Synthetic coding sequence
atggccgctccccctaaagcacccatccgcgtaagaaatctgaccatcagagccggagccttgacaggtaaagagaataacatgctgcagccagagactcatatattcactgctccagaggaagtgcctaaagtctctgaccaggctcttgtcagcgcccactcggagtggcagcggaagctggaggccgcagaagccctcctgactctgcgaaactctgctcaggctccacctgactccatctctttacatcaaccctgcaaccctccagcccccgcaggcgataagggcttccagccaccttccccgtctctgagaccacgacccgcatcttctatatccctccctataggacaccttggctgcatatccctgctcagctag

SEQ ID NO: 29309 - DNA, 579 bp, Artificial Sequence
  Description of Artificial Sequence: Synthetic coding sequence
atggccgctccgccaaaggcccctatacgtgtgcgcaacttaaccatacgggctggtgcactcactggtaaggagaataacatgctgcaacccgagactcacatctttaccgcccccgaggagggctctagccagggggccctgttgttgggccaggcccccgaacctttgagcctcccctgcactcccgttacattagaacaacagctggtcagcccatccggtgatcctcatcgtgcccctgccctgccctcgatctgctcaacccttattttacagccttgcgccacgcttgaccccctgcttctccagccccaggttccaaaggtctcggaccaggcactggtgagcgcccacagtgaatggcagcggaaactcgaggcagctgaggcattgttaacactccgcaactcagctcaagcccccccagattctatttcactgcatcaaccttgtaatccccccgctccagctggagacaagggatttcagccaccaagtccaagcctgaggccccgtcccgcttctagcatcagtttgccaatcggtcacctcggatgcatatctctgctgagctag

SEQ ID NO: 29310 - DNA, 579 bp, Artificial Sequence
  Description of Artificial Sequence: Synthetic coding sequence
atggcagctccgcccaaggcgccaattcgcgtcaggaacctgactataagggctggtgccttgacaggaaaagagaacaatatgctccaacctgagacacacatctttacggctcccgaggaggggtcatctcagggtgcactactcctgggccaggcccctgagccattaagcctaccatgcaccccagtgacactcgagcagcagttagtttctccctccggagacccacacagggctcctgccctgccatccatatgtagcactctgatcctgcagccctgcgctactttggacccccttctgttacaaccccaagtacctaaggtgagcgaccaggcgctggtctctgcccatagcgagtggcagagaaagttagaagcagccgaggccctgctaactcttagaaatagcgcccaggccccacctgattctatcagcctacaccagccctgcaaccccccagcaccagccggagataaaggtttccagccaccctctccatcactgcggcctcgacccgctagtagcatctctttgcctattgggcatttgggctgtatttctctgttatcatag

SEQ ID NO: 29311 - DNA, 384 bp, Artificial Sequence
  Description of Artificial Sequence: Synthetic coding sequence
atggcagctccacctaaggcacccatccgcgtgcggaacctcacaatccgggcaggcgcactaaccggtaaagagaacaacatgcttcagccagagactcacattttcactgcacccgaggaagtgccaaaggttagcgatcaagcattagtgagtgcacactcggaatggcagcgaaagctggaggcagctgaagcgctcttgaccctgcgcaatagcgcacaggccccgcctgactccatatctctccaccagccatgcaatcctcctgcacccgcaggcgacaagggttttcagccccccagcccatcccttcgaccgcggcccgctagttctatttcccttccaattggccatctgggatgtatatcccttctgtcttag

SEQ ID NO: 29312 - DNA, 195 bp, Artificial Sequence
  Description of Artificial Sequence: Synthetic coding sequence
atggctgcccctcccaaggctcccattcgggtacgtaacctgacaatacgggctggtgctctgacggggaaagaaaacaacatgcttcagcctgagacgcatatcttcactgcaccagaagagggtagctcccaaggggccctgctgttagggcaagctcctgaaccgctttctctgccttgcactccggtgtag

SEQ ID NO: 29313 - DNA, 306 bp, Artificial Sequence
  Description of Artificial Sequence: Synthetic coding sequence
atggctgcaccgcccaaggccccaattcgcgtccggaatttgacaatccgggccggtgccctgacgggaaaagagaacaacatgttacagcctgaaacccacatttttaccgcaccagaagaaggatcttctcagggagccctgctactgggacaggcacccgaaccattatcactgccttgcacacctgttacactggagcaacagctggtttctcctagtggggaccctcatagagcgccagccctgccctcgatttgttcaaccctcatactccagccttgcgccaccctagacccactatag

SEQ ID NO: 29314 - DNA, 579 bp, Artificial Sequence
  Description of Artificial Sequence: Synthetic coding sequence
atggccgcaccccccaaggcgccaatccgagttcggaatctcactatccgcgccggagccttgacaggcaaagagaacaacatgctccaacccgaaacccatatctttactgcaccggaggagggcagtagtcagggggctctcctgctgggccaggcgccagaacctctgtccctcccctgtacacctgtcactttagagcagcagttagtctcaccctccggcgaccctcatcgggccccagccttaccctcgatttgttctacactgatcctgcagccttgtgccacactggaccctttgctgctccagccccaggtgcctaaagtttcagaccaggcgctcgtctccgctcactcagagtggcaacggaagcttgaggcggccgaggctctgctcaccttgaggaactctgcccaggcccctcccgatagtataagcctacaccaaccttgcaatccacccgcccccgcaggcgacaaaggatttcagccaccaagcccgtcccttagacctaggcctgcgtcctcaatttccctccctattgggcatctcggatgtatttctctgctatcatag

SEQ ID NO: 29315 - DNA, 1191 bp, Artificial Sequence
  Description of Artificial Sequence: Synthetic coding sequence
atgttgattacggtgtactgcgtgcgtcgagatctctctgaagtgacttttagcctgcaggtgagtcccgacttcgaactgcgtaatttcaaggttctgtgtgaagcagaatcgcgggtgccagttgaagagatccaaattatccacatggagagactgttaatagaggatcattgctccctgggatcgtacggactaaaggacggcgatattgtcgttttattgcagaaggacaatgtggggcctcgcgcccctgggagggctccgaatcagccccgcgtggacttctcaggcatagctgttccgggcacatctagttcccgtccacaacatcctggtcagcagcagcaaaggacacccgccgcacaaagaagccagggtttagcgagcggcgagaaggtcgccgggctccagggacttggttcccctgccctgataagaagtatgttactgagcaatccccatgacctcagcttattgaaagagaggaatcctcccctggctgaagcactgctgagcgggtccctagagacatttagtcaagttctcatggaacaacagagagagaaagcactgagagaacaagagcgactgagactatataccgcggacccccttgatagagaagcgcaagccaaaatcgaggaggaaatcaggcaacaaaatatcgaagaaaacatgaatatcgccatcgaggaggcaccagaatcttttggacaggtgacgatgctgtatattaactgtaaggtgaacggacaccctctgaaggcattcgtggacagtggggcccagatgaccattatgagccaggcctgcgctgagcggtgtaatattatgcggctggtcgaccggcgctgggccggcgtggcaaaaggagtgggaactcaacggattatcgggagagtgcatctggcacagatccagattgagggtgacttcctccaatgtagtttctccatcctggaggaccagccaatggacatgttgctggggctggatatgctgcggagacaccaatgctccatagaccttaagaaaaatgtgctggtcataggcactaccggtacacaaacctatttcctgccagaaggcgagttacccctctgcagcagaatggtttccggccaagacgaatcttcagacaaagagatcacgcattcagtgatggacagcgggaggaaagaacactag

SEQ ID NO: 29316 - DNA, 1200 bp, Artificial Sequence
  Description of Artificial Sequence: Synthetic coding sequence
atgctcttgacagtgtactgcgtgaggcgagatttgtctgaagtgacgttttctctccaagtagacgcagattttgaactgcataacttccgggctctctgcgagctggagtctggaattcccgctgctgagtcacaaatagtctacgcggagcgtccactcacggacaatcatcgttccttggctagctacggactgaaagatggtgatgtcgtaattctgaggcagaaggagaacgctgaccccaggccccctgtacagtttccaaacctgccacgcatcgacttcagcagcattgctgttcccggaacatcgtcacctcgacagcgtcagccccccggaactcagcaaagccacagctccccgggggagattacttccagtccacagggactggacaatccggctctgttgagggacatgctgctggcgaatcctcatgagctgagcttgttaaaggaacgtaaccccccactcgcggaggcactcttgagcggagatctcgaaaaattttctcgagttctcgttgagcagcagcaggaccgcgcacgcagagagcaggagagaattagattgttttcagccgacccatttgacttggaggctcaggctaaaatagaggaagacattcggcagcagaatatcgaggagaacatgaccatcgccatggaggaggcccccgagagctttggtcaggtcgtgatgctttacatcaattgcaaggttaacggacatcccgtcaaggctttcgttgattccggagcccagatgaccatcatgagccaagcgtgcgccgaaaggtgtaacatcatgcggctggtcgatcgaagatgggccggtatagccaaaggagtcgggacccagaagatcataggtcgtgtccacctcgcgcaggtgcagatcgaaggtgatttcctgccctgttcattttccatcctagaagagcaacccatggatatgcttctgggcctcgatatgctgaaacgtcaccaatgctctatcgacctcaaaaaaaacgtgcttgtcattgggacaaccggcagccagactaccttcctccccgaaggagagctccctgaatgtgcgcggctggcctatggggctggcagggaagatgtgcgtcctgaagaaattgctgatcaggagctggccgaagcgctgcagaagtctgccgaagatgccgagcggcagaaaccgtag

SEQ ID NO: 29317 - DNA, 1167 bp, Artificial Sequence
  Description of Artificial Sequence: Synthetic coding sequence
atgaatacgatgtatgtgatgatggcacaaatcctgcggtcgcatcttatcaaagcaactgttatccctaaccgggtgaaaatgctgccctactttggcattatacgaaacagaatgatgtctacccataagtcaaaaaaaaagataagggagtactacaggctgctgaatgttgaggaagggtgctcggccgatgaggtgagagagagttttcacaaactggccaaacagtatcacccagacagtggcagcaatactgcagatagcgctacatttatccgcatagaaaaggcttaccgtaaggtcctgtctcatgtgattgagcaaacaaatgccagtcagagtaagggcgaagaggaagaagacgtggagaaattcaagtacaaaacccctcagcaccggcattacctctctttcgagggaattgggtttgggacccccacacagcgcgagaaacactaccgccagtttagagccgaccgagctgccgaacaggtcatggaataccagaaacagaagctgcagtctcaatactttcccgacagcgtgatcgtgaagaacatccgacagtccaagcagcaaaagatcacacaggccattgagcgcttagtggaggacctaatacaagagtctatggccaaaggggattttgacaacctgtctggcaagggaaagcccttgaaaaagttctccgattgctcttatattgacccaatgacccataacctgaaccgtattttgatcgataatggctatcagccagaatggattctgaagcagaaagagatctccgatacaatagaacaactgcgcgaggccattttagtgtcccgcaagaagctgggcaaccctatgacccctactgagaaaaaacagtggaaccacgtatgtgagcagtttcaggagaatatcagaaagttgaataagaggataaacgatttcaatcttatcgtccccattctgacccggcaaaaggtgcacttcgacgcacagaaagagattgtgcgggcacaaaaaatttatgaaacccttatcaagactaaagaggtaaccgatcggaatcctaacaacctggaccagggagaaggcgaaaagactcctgagattaagaaaggctttctgaattggatgaatctgtggaagttcattaaaatcagaagtttttag

SEQ ID NO: 29318 - DNA, 1167 bp, Artificial Sequence
  Description of Artificial Sequence: Synthetic coding sequence
atgaataccatgtacgtcatgatggcccagatcctccggagccatctgattaaagccacggtgatcccaaaccgagttaagatgctcccttacttcgggataatccgaaaccgtatgatgagtacccataagtccaagaagaagattcgggaatactatcgactgcttaatgttgaggagggctgttcagcggacgaggtacgggagagctttcacaaactcgctaagcaataccatcctgatagcggctcaaacaccgcagacagcgctacattcatccgaatagagaaggcctaccggaaggtcctgtctcacgttattgaacagacaaacgcttcccagagcaagggtgaagaagaggaagatgtggaaaagttcaaatataaaacgccccaacatcggcactacctgagctttgagggaattggattcggtacgccaacacagcgcgagaagcattacaggcaattccgggctgaccgggccgccgagcaggttatggagtatcagaaacagaagcttcaatctcagtacttcccagactctgtgattgttaagaacattagacagagcaagcagcaaaagataacccaggccatcgagcgcctcgtggaggacctgatccaggagtccatggccaaaggggattttgacaatctgtctggcaaggggaaaccacttaagaagttctctgattgttcgtatatcgacccaatgacacataaccttaacagaattctcatcgacaatggataccagcccgagtggatcctgaagcaaaaggaaattagtgatacaatcgagcagcttagggaggctatcttggtttccaggaagaagctcgggaaccccatgactcctactgagaagaaacagtggaaccatgtgtgtgagcagttccaagagaacatcaggaaactgaataaacgcattaatgattttaacctgatcgtgccaattcttactagacagaaagtgcatttcgatgctcagaaagaaattgtcagagcacagaaaatctacgaaactttaatcaagactaaggaagtcaccgatcgcaatccaaataacctcgatcagggcgagggggagaagacccctgaaattaagaaagggttcctgaactggatgaatctgtggaagttcattaaaattagaagtttttag

SEQ ID NO: 29319 - DNA, 1194 bp, Artificial Sequence
  Description of Artificial Sequence: Synthetic coding sequence
atggtcaaagagaccacatactacgacgtgctgggagttaaacctaacgccacccaggaagagctaaagaaggcctatcgaaagttggccttgaagtaccatcctgataaaaaccctaatgaaggagagaagtttaaacagatctctcaggcttacgaggtcctctctgatgccaagaagcgggaattatacgacaagggcggggaacaagccataaaggagggcggggctgggggaggctttggtagcccgatggatatcttcgacatgtttttcggcggcggcgggaggatgcagagagagcgacgcggaaagaatgttgtgcatcagctctcagtgacgctggaggacctgtataacggcgccacacgcaagctggctctgcagaagaacgtgatttgtgataagtgtgaaggaagggggggcaaaaaaggggcggtggagtgttgccccaattgcaggggcaccggcatgcaaatcaggattcatcaaattggcccaggaatggttcagcaaattcagagcgtgtgcatggagtgccagggacacggcgaaaggatctcacccaaagataggtgtaaaagctgcaatggaaggaagattgtgcgggagaaaaaaattttggaggtgcacatcgacaagggcatgaaggacggccagaagatcacctttcatggcgaaggcgaccaggagccgggtctcgagcccggcgatattatcatagttttggatcagaaggatcatgccgtttttacacgtaggggagaggatctcttcatgtgcatggacatccagcttgtcgaggccctgtgtggattccagaaacccatttcgaccctggataacaggacgatcgtgatcacatcgcaccctggacaaatcgtgaagcatggcgatatcaaatgcgttctgaacgagggcatgccaatctatcggcggccgtacgagaagggacgtctcatcattgagtttaaggttaatttccctgagaacggtttcctatctcctgacaaactgtccctgcttgagaagcttctacctgagcgcaaggaagtggaggaaaccgatgaaatggatcaggtcgaactagtagacttcgacccaaaccaggaacgccgaaggcattacaacggggaggcctatgaggatgacgaacatcacccgagggggggcgtccaatgtcagacatcctag

SEQ ID NO: 29320 - DNA, 774 bp, Artificial Sequence
  Description of Artificial Sequence: Synthetic coding sequence
atgcagataagaatccaccagatcggtccaggcatggtccagcagattcagagcgtgtgcatggagtgccagggacatggtgagagaatttcccctaaggaccgatgtaagagttgtaatggacggaaaatcgtgcgtgaaaaaaagatcctggaagtgcacatcgacaaaggaatgaaggacggtcagaagattaccttccatggagagggcgatcaagagccaggccttgagccaggggacattatcatcgtgctggatcagaaagatcatgcagtgtttacaagaagaggggaggacctatttatgtgtatggatatacagctggtagaagccctgtgcggtttccagaaaccaataagtacactggacaaccgaacaattgtgattacttcacacccagggcagattgttaaacacggcgacattaagtgtgtactaaatgagggcatgcccatatacaggagaccatacgagaaagggagactcataatagaatttaaggttaactttcctgagaacggcttcctgtctcctgataagctgagtctcctcgagaagctgcttccagaacggaaggaggtggaagaaacggacgagatggaccaagtagagctggtggattttgacccaaaccaggaacggcggcgccactataatggagaggcatatgaagatgacgagcaccatcccagaggcggcgttcagtgtcagacctctaatggaccggttaacaacacacactgctggcatcttatgtgttcgtctgagtag

SEQ ID NO: 29321 - DNA, 723 bp, Artificial Sequence
  Description of Artificial Sequence: Synthetic coding sequence
atgcaaatacgtatacatcagatcggcccaggtatggttcagcagatacagtcagtgtgtatggagtgccaaggtcacggtgagagaatatctccaaaagatcggtgcaagagttgtaatgggaggaagatcgtgcgagaaaagaaaatcctcgaagtgcatatcgacaaaggcatgaaggatggccagaagatcactttccacggtgaaggggaccaggaacccggcttagagccaggcgacataattatcgtactcgaccagaaagaccacgcagtgtttacaagacgtggtgaagacctgttcatgtgcatggatatccagctggtagaggccctctgtgggtttcagaaacccatatcaacactcgataaccgcaccatagttataactagtcacccgggccagatcgttaagcacggagacattaagtgcgtcctgaatgaagggatgccaatttaccgccgcccatatgaaaagggtcgactgataattgagtttaaagtcaatttccccgagaatggctttctgagccccgacaagctgagccttctcgaaaagctgctgcccgagcggaaggaggtcgaagagacagacgagatggaccaagtagagctagtagatttcgaccctaatcaggagcgacgtaggcattataatggcgaggcttatgaggacgacgaacaccacccccgcgggggcgtccagtgccagacttcttag

SEQ ID NO: 29322 - DNA, 1194 bp, Artificial Sequence
  Description of Artificial Sequence: Synthetic coding sequence
atggtgaaagagacccagtactacgatatccttggcgtcaagcccagtgccagcccggaggaaattaaaaaggcctaccgtaaactcgccttgaagtatcaccctgataaaaatcctgacgagggagagaaatttaagctcatctcacaggcatatgaggtgctgagcgatcctaaaaagcgggatgtgtatgaccaaggcggcgaacaggccatcaaggagggtggcagcggaagtccctcgtttagctctcctatggatatatttgacatgttctttgggggaggcgggcggatggcaagagagcgccggggaaaaaacgtagtgcaccaactgagcgtcactttagaggacttgtataacggtgtcacaaagaagctcgcgcttcagaagaacgttatttgtgagaaatgcgaaggtgtgggcgggaagaaagggtccgtggaaaagtgtcctctttgcaaagggcgcggtatgcaaattcatatacagcaaattggccctggcatggttcagcagattcagaccgtttgcatcgagtgcaaaggccaaggagagcggataaatcccaaagatcgctgtgaaagttgcagtggagcgaaggtcattagagagaagaaaattatcgaagttcacgtggagaaaggaatgaaagatggccagaagatcctatttcacggagagggtgaccaggaaccagaactggagccaggtgacgtcataattgtgcttgatcagaaggatcatagtgtgtttcagagacgaggtcatgacctgatcatgaagatgaagatccaactgtctgaggctttgtgcgggttcaaaaagaccatcaagacgcttgacaataggattctggtgatcacctcgaaggcaggagaggtgatcaagcacggggacttgcggtgcgtgagagacgaggggatgcctatttacaaagcacctcttgaaaaggggatactcattattcaattcttggtgatttttcctgaaaaacactggctctcactggaaaagttgccgcagctggaggcgttgctacctcctcgacagaaggtcagaataacagatgacatggatcaggtagagctgaaggaattctgtccgaacgagcagaactggcgccagcaccgagaggcctacgaggaggacgaggatggacctcaggctggcgtccaatgccagacagcttag

SEQ ID NO: 29323 - DNA, 1194 bp, Artificial Sequence
  Description of Artificial Sequence: Synthetic coding sequence
atggtcaaggagacccagtattatgacattctgggggtgaagccatcagcctctcctgaagagattaagaaagcttacaggaaactcgcattgaaataccaccctgacaaaaaccctgatgagggggaaaagtttaaattaatctcccaggcctacgaggtcctgtccgatcctaaaaaacgggatgtttacgaccaagggggagaacaggctattaaggagggggggtccgggtcacccagcttctcctctccgatggatatcttcgacatgtttttcggtggagggggccggatggcacgggagagacgaggaaagaacgtcgtgcaccaactatccgtgacactcgaggatctatataacggcgtaactaaaaagctggcgttacagaaaaatgtgatctgtgaaaaatgtgagggcgttgggggcaagaaagggagcgtggagaaatgtcctctatgtaaaggtaggggcatgcagatccatattcagcagatcgggccaggcatggttcagcagattcagaccgtgtgtatcgaatgtaaggggcagggcgaaagaattaatccaaaggacagatgcgagtcctgcagtggcgccaaggttatcagggaaaagaaaataatagaagttcacgtggaaaagggtatgaaggacggacagaaaatcttgtttcatggggaaggagatcaggaaccagagctggaacctggagatgtcatcattgtattggaccaaaaagaccatagcgtcttccagcggcgagggcatgatctgatcatgaaaatgaaaattcaactgtccgaggctctctgtggattcaaaaagactatcaaaactcttgataatcggatcctggtcattactagcaaagccggtgaggtgattaagcacggcgatctaagatgtgtccgcgacgaagggatgccaatctacaaggcaccgcttgagaaaggcattctcattattcagtttctagtgatatttcctgaaaagcactggctgtcactggagaagctgccccagctggaggcgctgctgccaccccgccaaaaagttaggatcactgatgatatggatcaggtggagctgaaagaattttgcccaaatgaacagaattggagacaacaccgcgaagcctatgaagaagacgaagacggccctcaagccggagtgcagtgccagacagcctag

SEQ ID NO: 29324 - DNA, 1281 bp, Artificial Sequence
  Description of Artificial Sequence: Synthetic coding sequence
atggctcgcggagggagccagtcatggagttcaggcgaatcagacgggcagcctaaggagcaaacccctgaaaagcctcggcacaaaatggtgaaagagacacagtattacgatatcctgggggtaaagccaagcgcttcccccgaagagattaagaaagcctaccgcaagttagcactgaagtatcatccagataaaaacccagacgagggcgagaagtttaagctgatttcccaggcgtacgaagttttgagcgaccccaaaaagagagatgtgtatgatcagggaggagagcaagcaattaaggagggcggctcagggtccccctctttttcaagtccgatggacatcttcgacatgtttttcggaggcggtggccgaatggcgagggagagacgtgggaaaaacgtggttcatcaactgtcggtaaccttagaggacctgtacaacggcgtgacaaaaaagctggccctacagaagaacgttatatgcgaaaaatgcgagggagtggggggtaagaaaggatccgtggagaagtgccctttgtgcaagggcagaggtatgcagattcacatccagcagattggcccaggcatggtacagcagatccaaacagtttgtatcgagtgtaaggggcagggtgagcgaattaatcccaaagaccgctgcgagagctgctccggagcgaaggtgatccgggaaaaaaagataatagaagtgcacgttgagaagggaatgaaagatggccagaagattctgttccacggcgagggggatcaagagccagagctagaaccgggggatgtaattatcgttctggatcagaaagatcattccgtgtttcaacgacgcggccacgatctgatcatgaagatgaagatccaactttcagaagccctgtgcgggtttaaaaagacaatcaagactctcgataataggattcttgtgattacgtcaaaggcaggagaggtcatcaaacacggtgatttacggtgtgtacgcgatgaggggatgccaatatacaaggccccattggaaaaaggaattctcatcattcaatttctcgtgattttccctgagaaacactggttaagcctggagaagctccctcagcttgaggcgctgctgccccctcggcagaaagtccggatcaccgacgatatggaccaggtggagctcaaagaattctgccctaacgagcaaaattggcgtcaacatcgggaagcttacgaggaggacgaggatgggccccaagcaggtgtacagtgccaaactgcatag

SEQ ID NO: 29325 - DNA, 1113 bp, Artificial Sequence
  Description of Artificial Sequence: Synthetic coding sequence
atgtgggagtcacttacgctggatagcggtcagatctccgctctaacccgattcaaactcatttcccaggcctatgaggtgctgagcgacccgaaaaaacgcgacgtctatgaccaggggggcgagcaggctatcaaagagggaggctcaggaagtccatcattttcaagccctatggacatttttgatatgttcttcgggggtggaggacgcatggcgagggaaagacggggcaagaacgtggtgcaccagctgagcgtaaccctcgaggatctatacaacggggttacaaaaaagcttgccttgcagaaaaatgtgatctgtgaaaaatgtgaaggagtcggaggcaagaagggatccgtcgagaagtgtccactgtgtaagggtcgcggcatgcaaatccatatccaacagatcggaccaggcatggttcaacaaattcaaacagtctgtatcgagtgcaaaggtcagggagagcgaatcaatccaaaagatagatgcgagtcctgtagcggcgctaaagttataagagagaagaagattatcgaggtgcatgtggagaaaggcatgaaggacggtcagaaaatcctttttcacggcgagggcgatcaggagccagagctcgaacccggcgacgtaatcattgtccttgaccagaaagaccacagcgtgtttcagagacgcggtcacgaccttattatgaagatgaagattcagttatccgaagccctttgtggattcaagaaaaccataaaaactctcgacaaccggattctcgtgattaccagcaaagccggtgaggtcataaaacatggcgatcttcggtgcgtcagagatgagggcatgcccatatacaaagcacctcttgagaaagggatcctgataattcaattcctggtgatattcccagaaaaacattggctatcactcgagaagctgcctcagttagaagccctgctcccaccacgccagaaggtgcgcataaccgacgacatggaccaagttgaactgaaagagttttgtcctaatgagcaaaactggagacaacatagggaagcctacgaagaggacgaagacggacctcaggctggcgtgcaatgtcagacagcctag

SEQ ID NO: 29326 - DNA, 951 bp, Artificial Sequence
  Description of Artificial Sequence: Synthetic coding sequence
atgggacaggattactattctgtgttgggcatcacccgcaacagcgaggacgcgcagatcaaacaggcatacaggaggctggcgttaaagcaccaccctcttaaaagcaacgaaccttcctccgccgaaatcttcagacagattgcagaggcatatgatgtcctctcagacccaatgaagcgcgggatctatgataaattcggagaagaaggtctaaagggcggtatcccactggaattcggctctcaaactccctggacaactggttatgtattccatgggaagcccgagaaagtgtttcatgaatttttcgggggcaataatccctttagcgagttttttgacgccgagggaagcgaggtagatcttaactttggagggcttcaaggccgtggagtgaaaaagcaagatccacaggtggaaagagatctgtacctgagcctcgaggacctcttttttgggtgcacaaagaaaatcaaaatcagccgacgcgtcctcaacgaggatggatattccagcaccatcaaggacaagattctgacaatcgatgtgaagccaggctggagacagggaacccgcattacttttgagaaagagggtgaccagggtcctaacatcattcccgccgacataatctttatcgtcaaggaaaaactgcacccccgttttcggagggagaacgacaacctgttcttcgtgaaccctattccgctgggtaaagcgctgacttgttgcacagtagaggtgcggaccctggatgatcggttacttaacatcccgatcaacgacattatccatcccaaatatttcaaaaaggtgccaggcgaggggatgcctctacctgaggatcccacaaaaaagggcgacctgtttatcttcttcgatatacagttcccaacacgtcttactccccagaagaagcaaatgctgcgtcaggcgctcctgacgtag

SEQ ID NO: 29327 - DNA, 426 bp, Artificial Sequence
  Description of Artificial Sequence: Synthetic coding sequence
atggagactagtcgcggacgtaatctagctaaggtgactaggcctacctctccctgtcatcttcttgctagccccgcgcaaggtccaaacatcattcccgcagacataatcttcattgtgaaagagaaactccatcctaggtttagacgtgagaacgacaatttgttcttcgttaacccaatccccctgggcaaagccctgacatgctgtaccgtcgaggttcggacccttgacgaccgcctgctgaatattcccatcaacgatatcatccacccaaagtactttaagaaggtgcctggagagggcatgccactcccagaggaccctacaaagaagggagaccttttcatcttctttgatattcagttcccaacccggctcacgcctcagaaaaaacagatgctgagacaagccctgctgacctag

SEQ ID NO: 29328 - DNA, 426 bp, Artificial Sequence
  Description of Artificial Sequence: Synthetic coding sequence
atggaaacgtcgaggggccgaaacttggcaaaagttactcgcccaacctctccctgtcatctcttggctagccccgctcagggcccaaacatcatacctgcggatatcatctttatcgttaaagagaaactccaccccaggtttcgccgcgaaaacgacaatctgttttttgtcaatcctatccctcttggaaaggctctgacctgttgtaccgtggaagtaagaactctggatgatcgactgctgaacatcccgataaacgatatcatccatcctaaatacttcaagaaggtcccaggagagggaatgcctttaccagaagatcccaccaagaaaggggacctgtttatatttttcgacatccagtttccgacacgcttaaccccacagaagaaacagatgcttaggcaggcactgttgacttag

SEQ ID NO: 29329 - DNA, 930 bp, Artificial Sequence
  Description of Artificial Sequence: Synthetic coding sequence
atggtggattactacgaagtcctgggcttacagagatatgcttcgccagaggacatcaaaaaggcttaccacaaggtggccctcaagtggcatccggacaaaaacccagaaaataaggaagaggctgagcgaaaattcaaggaggtggccgaggcatacgaggttctttccaacgacgagaagcgagatatctatgataagtacgggacagaaggccttaacggcggcgggtcccactttgatgacgaatgcgaatacggattcacatttcataagccagacgatgtctttaaagaaatattccacgagcgcgaccccttctcgtttcacttcttcgaagattccctggaagatcttctgaatcggcccggcagttcctatgggaataggaacagggatgctggctattttttctcgacggcatctgagtatccaatttttgagaagttctcctcttatgatactggatatacgagccaggggtccctcggtcatgaggggctgacttctttttcatctctggcgtttgataactccggcatggacaactatatttcagtgacaacatcagataaaatcgtcaatggtagaaacataaatacaaagaaaattatcgagtccgaccaagaaagagaggccgaggacaatggggagttaaccttctttctcgtcaactcagttgccaacgaagaaggattcgcaaaggagtgctcgtggcggacgcaatctttcaataattatagccctaactctcacagttctaagcacgtgagtcagtatactttcgttgacaatgatgaaggtggaatatcatgggtgaccagcaaccgcgatcctcctattttcagcgcaggtgttaaagaagggggaaaaagaaaaaagaaaaagagaaaggaggtgcagaagaagagtacgaagcgcaactgctag

SEQ ID NO: 29330 - DNA, 699 bp, Artificial Sequence
  Description of Artificial Sequence: Synthetic coding sequence
atggcaaactactatgaggtcttaggtgtccaggcctcggcctctcccgaggacatcaagaaggcgtaccgtaagctcgcactgagatggcatcccgataaaaaccccgacaacaaggaggaagctgagaaaaagttcaagctcgtgtccgaagcctacgaggtcctttcggattcaaagaagaggagcctttatgaccgcgccggatgtgatagctggcgggccgggggtggagcctccaccccgtaccatagtccctttgacaccgggtacaccttccgcaacccagaagatattttccgagagttcttcggaggcctcgaccccttttcatttgagttttgggattctcctttcaacagcgaccgcggaggacgggggcacggactgcggggtgcttttagcgccggattcggggagttccccgcctttatggaagccttttcttcttttaacatgctggggtgctcgggagggtcccatacaacctttagttccaccagctttggaggatcctcctcagggtcctcaggatttaagtcggtgatgtctagcaccgaaatgattaacggacacaaggtaaccacaaagcggatagtcgaaaacgggcaggagcgggttgaggtagaagaagacggacagctcaaaagcgtgaccgttaacggtaaggagcagctgaagtggatggactccaaatag

SEQ ID NO: 29331 - DNA, 699 bp, Artificial Sequence
  Description of Artificial Sequence: Synthetic coding sequence
atggccaattattatgaggtcctgggcgtacaggcttcagcatctcccgaagacattaagaaggcctatagaaaactggctctccggtggcacccagacaagaatcctgacaacaaagaagaggcggagaagaagttcaagctggtcagtgaggcctacgaagtgctgtccgactccaagaaaaggtcgctctatgatagggcaggctgcgacagctggcgcgccggtgggggggcatcaactccttaccactcaccgttcgacacgggctatacctttcgtaatcccgaggacatcttccgggagttcttcggcgggctagaccctttttcattcgagttctgggactccccatttaactccgaccggggtggtagaggccacggacttcgtggtgcgtttagtgcgggcttcggggaatttcctgcatttatggaggctttcagctccttcaacatgctgggatgcagtggcggcagtcatacgactttctcaagcacgagctttggagggagctcatcaggctccagcgggttcaaaagcgtgatgagctcaaccgaaatgattaacggccataaagtgactactaaacgtattgtggagaacggccaggaacgcgtggaggtggaagaggatgggcagcttaagtcagtcaccgtgaatggcaaggagcagttgaaatggatggactcaaaatag

SEQ ID NO: 29332 - DNA, 1107 bp, Artificial Sequence
  Description of Artificial Sequence: Synthetic coding sequence
atgcagcctggctccagtagatgcgaggaagagactcccagcctgctgtgggggcttgaccccgtctttctggcattcgccaagctctatatacgggacatccttgacatgaaggagagccgtcaggtgcctggagtgtttctttacaatggtcacccaatcaaacaggtagatgtactgggaaccgtgatcggtgttcgtgagagagatgccttttactcttatggtgttgatgatagcaccggtgtgatcaactgcatctgctggaagaaacttaacacagaatccgtttctgcagccccaagcgccgctcgcgaactcagcctgacatcgcaacttaagaagctgcaagagaccatcgaacagaagactaagatcgagatcggcgacacaatcagggtgagaggaagcattcgcacctaccgggaagaaagagagatccacgctacaacttattataaagtcgacgacccagtgtggaatatccagatagccaggatgctagagctgccaactatttaccgaaaggtttacgaccaacctttccatagcagcgcccttgagaaggaagaagcccttagcaatccgggcgccttagatctgcctagtctaacctctctgttatcagaaaaggcaaaggaattccttatggagaaccgagtgcagtctttttaccagcaggaactggaaatggtcgagagtcttctgagtttggctaaccagcccgtcatccactcagccagctctgaccaggttaacttcaagaaggatacaacatctaaggcgatccactccatcttcaagaacgccatccaacttctgcaggagaaaggactcgtatttcaaaaggacgacgggtttgataatctctattacgtaacacgtgaagacaaggacttgcaccggaagatccaccgcattattcagcaagactgccagaagcccaatcacatggagaagggttgccacttcctgcacatccttgcctgcgcgaggctcagcatcagacctgggttatccgaggccgtgcttcagcaagtgcttgagctcttagaggatcagagcgatattgtatccacaatggagcactactacacagccttttag

SEQ ID NO: 29333 - DNA, 324 bp, Artificial Sequence
  Description of Artificial Sequence: Synthetic coding sequence
atggatgcaattcttaattacaggagtgaagacaccgaggattattatactcttctgggatgcgatgagctgtctagcgtggaacagatactcgcagagtttaaggttcgggcactggaatgtcaccctgacaagcatcctgagaacccaaaggctgtggaaacgttccaaaaactgcagaaagctaaagagatcctgactaacgaggagagcagagccaggtatgaccattggaggcggtctcaaatgtcgatgcctttccaacagtgggaggcattaaatgattcagtgaaaaccgttgggttctctttgggcgcaacatag

SEQ ID NO: 29334 - DNA, 1407 bp, Artificial Sequence
  Description of Artificial Sequence: Synthetic coding sequence
atgggattcctcggtactgggacgtggatacttgttctcgtgctccccatccaggctttcccaaagcccggtgggtcccaggataagagccttcacaatagggaattgagcgccgagcggcccctgaacgaacaaatcgccgaggcggaggaggataagataaagaaaacgtacccccccgagaacaaacctggacagagtaattattcatttgtggacaatttgaatctgctgaaggccattaccgaaaaagagaaaatcgagaaagaaaggcagtccattcgaagtagcccactggacaataagcttaatgttgaggatgtagatagcacaaaaaatcgaaagctcatcgatgactatgacagcacaaagtcggggcttgaccataaattccaggatgacccagacgggttgcatcagctggacggtaccccactaacagccgaagacattgtacataaaatcgctgctagaatatacgaggagaatgatcgcgccgtgtttgataagattgttagcaaattattaaacctaggccttattacagagagccaggcacacaccctcgaagacgaggtggcagaggttctccagaagctgatctccaaggaggctaacaattatgaagaggaccctaacaagccaacctcgtggacggagaatcaagcgggtaagattccggaaaaagtgacccccatggccgccattcaggacggcctcgcaaaaggagaaaacgatgagaccgtctccaacactctgacactgacaaatggtctcgagagaaggaccaagacttactccgaagataatttcgaggaactgcagtatttccctaatttctacgcattactgaaaagtatcgatagcgagaaggaggctaaggaaaaggagaccctgattactattatgaaaacccttattgactttgttaagatgatggtcaagtatggcactatttccccagaggagggagtaagctatctggaaaacctggatgagatgattgccctgcaaactaaaaataagctcgagaaaaatgctacggacaacatttccaagctgtttcccgcaccttctgaaaagagccacgaagagacggatagcaccaaggaggaagcagcaaagatggaaaaagaatatggatcacttaaggacagtactaaggatgacaacagtaacccggggggcaaaacagacgaacctaaaggaaaaaccgaagcctacctagaggcaatccgcaagaatatcgaatggcttaaaaagcacgataaaaaaggaaataaggaggattatgatctgtccaagatgagagatttcataaataagcaggctgatgcttacgttgagaagggtatcttggacaaagaagaggcagaagcaataaagcgcatatacagtagcctgtag

SEQ ID NO: 29335 - DNA, 450 bp, Artificial Sequence
  Description of Artificial Sequence: Synthetic coding sequence
atgatggctgtggaacaaatgcctaagaaggattggtattccatcctcggggctgacccctcagctaatataagcgacttaaagcaaaaatatcagaagttgattctgatgtatcacccagacaagcagtcaaccgacgttcctgcgggaacagttgaggaatgcgtgcagaagtttattgagatcgaccaggcgtggaaaattctgggaaacgaagagacaaagagggagtatgacttgcagaggtgtgaggacgacctaagaaacgttggacctgtggatgctcaggtctacctcgaggagatgagctggaatgaaggcgatcacagtttttatctgtcttgtcgttgtggaggaaagtattccgttagcaaagacgaggccgaggaggtaagtcttataagctgcgatacctgcagcttaatcattgagcttctgcattataactag

SEQ ID NO: 29336 - DNA, 255 bp, Artificial Sequence
  Description of Artificial Sequence: Synthetic coding sequence
atggcagtggagcagatgcccaagaaagattggtattccattctgggggccgaccctagcgctaatatcagtgacttaaagcagaaatatcagaagctgattctcatgtaccatcctgacaagcaatcaaccgatgtccctgccggaacggtggaggagtgcgtgcaaaaattcatagagattgatcaggcctggaaaatcctgggtaacgaggaaacaaagcgagagtacgacttacaacgctgtgggagctag

SEQ ID NO: 29337 - DNA, 1167 bp, Artificial Sequence
  Description of Artificial Sequence: Synthetic coding sequence
atgaacaccatgtatgtgatgatggcccagattcttaggtcccacctcatcaaggctacggtcataccaaacagagtaaaaatgctgccctactttggcattatcagaaacaggatgatgtcaacacacaagtcaaagaaaaagatccgagaatattaccgcctcctgaacgtggaagagggatgcagcgctgacgaggtaagggaaagcttccataaattagccaaacagtaccatcctgactcaggcagtaacaccgcggactcggcaacgttcatccggatagaaaaggcctaccgaaaggtgctgagtcatgtgatagaacagaccaacgctagccagtctaagggcgaagaggaggaagacgtagagaaattcaagtacaagaccccccaacacaggcactacctgtcctttgaagggatcggcttcggaacaccaacacagagggaaaagcactatcgtcaatttcgggccgaccgcgccgcggaacaggttatggaataccagaaacaaaaattgcagtcccagtactttccggacagcgtcatcgtgaagaatatacgccagtcaaaacagcagaagatcacccaggccatcgaaagactcgtcgaggatctaattcaggagtcgatggctaaaggagacttcgacaacttaagcggaaaggggaaaccactgaagaagttcagtgattgtagctacatcgacccaatgactcataaccttaatcgaattctgatagacaacggctaccagccagagtggatcctcaaacagaaggagatatcagacaccatcgaacagcttcgggaggccattctcgtgtctagaaaaaagttgggaaatccaatgactccgactgagaagaagcaatggaatcacgtgtgcgagcagtttcaggagaatattcgaaagcttaacaaacgcatcaacgattttaaccttatcgtgcccatcctgactcggcagaaggtgcacttcgatgcgcagaaagagatagtccgtgcacaaaaaatttacgagacgctaataaagacgaaggaggtgacagatcgcaatccaaataaccttgatcagggcgaaggggagaagactccggaaattaagaagggcttcctcaactggatgaatctgtggaagtttatcaaaatacggagtttctag

SEQ ID NO: 29338 - DNA, 1167 bp, Artificial Sequence
  Description of Artificial Sequence: Synthetic coding sequence
atgaacactatgtacgtgatgatggcccaaattttacggtcccatctcattaaagccactgtgattcctaacagggtcaagatgctgccttactttggtattattaggaacagaatgatgtcaacccacaaatctaaaaaaaagatacgggaatattacagactgctgaatgtggaagagggatgttccgccgatgaagtgagagaatcgttccacaagctggctaaacagtatcaccctgactctggatctaatacggcagactcagcaacattcatacggattgaaaaagcctatagaaaggttctgtcgcatgttatcgaacagaccaatgccagccagagcaaaggtgaggaggaagaggacgttgagaagttcaaatacaagacaccacagcatagacactacttatcttttgaggggattggattcggaacaccaactcagagggagaaacattatcgccagtttcgcgctgatcgcgcagcagagcaggtgatggaatatcagaaacagaaactccagagccaatactttcccgacagcgtaatcgttaaaaatatccgccagtcaaagcaacaaaagatcacgcaagccattgagagattagtcgaagatcttattcaggaaagcatggctaaaggagatttcgataacctgagcggcaaaggtaaacctctgaagaagtttagcgactgctcatacatcgacccgatgacccacaaccttaacaggatcttgatagataacggctaccagccagagtggatcctgaagcagaaagagatatctgatacgattgagcagctacgcgaggctatcttggtttcacggaaaaaattaggtaacccaatgacacccaccgagaaaaaacaatggaatcacgtatgcgagcaatttcaagagaatattcgcaagctcaacaagcgcatcaacgactttaacctcattgtgccgatccttacccgccagaaggtgcacttcgacgcccagaaagaaattgtgagggctcaaaaaatttacgagacactcattaagacgaaggaagtgaccgatagaaatccaaataacctcgaccaaggtgagggggaaaagaccccagagatcaagaaggggttcttgaactggatgaacttgtggaagttcattaagatcagatctttttag

SEQ ID NO: 29339 - DNA, 1167 bp, Artificial Sequence
  Description of Artificial Sequence: Synthetic coding sequence
atgaacactatgtacgtcatgatggcccagatacttaggtcccacctgatcaaagcaactgtgatacccaaccgtgtgaaaatgctgccctattttggaatcatcaggaaccgaatgatgtcaacacacaaatccaagaaaaaaatccgtgagtattatcgactccttaatgtggaggaaggatgctcagccgatgaggttagagaaagcttccacaaactagccaagcagtatcatcctgatagcggcagcaacaccgcagattccgcaaccttcattcgcatagagaaggcctaccgcaaagtattatcccacgtgatagagcaaactaacgccagccagtctaaaggcgaggaggaggaagatgtggagaagttcaagtacaaaactccgcagcataggcactatctgtccttcgaaggaataggatttgggacccctacccagagggagaaacattaccggcagttcagagcagatcgcgcggcggagcaggtgatggaataccaaaagcagaagttacagtcccagtatttccccgactcagtgattgtgaaaaacattcggcagtctaagcagcagaaaatcactcaggctatcgagcgcttggtcgaggatttgatccaggagagcatggccaaaggagacttcgacaacctgtccggcaagggtaaacccttgaaaaagtttagcgattgctcatatatcgacccaatgactcataacctaaaccggatcctcatagacaatggataccagcccgagtggatactcaagcagaaagagatatctgataccatcgagcagcttagagaagctattctcgtgtcaagaaagaagctgggtaaccccatgaccccaaccgagaagaaacaatggaatcatgtgtgtgagcagttccaagaaaacattcgtaaattaaataagcggatcaacgacttcaacttgattgtgccgattcttacccggcaaaaggtacattttgacgcccagaaggagatcgttcgagcccagaagatctatgaaacgctgattaaaaccaaggaggtgactgataggaatccaaacaacttggaccagggcgaaggtgaaaaaactccagagataaagaaaggattcctgaattggatgaacttatggaagtttataaaaattaggtccttctag

SEQ ID NO: 29340 - DNA, 462 bp, Artificial Sequence
  Description of Artificial Sequence: Synthetic coding sequence
atgggcgcacctttactctccccaggatggggagcaggagcagccgggcggcgttggtggatgttgctggcacccctgctgccagctctcctcctggtgagaccggctggcgcactggttgagggcttgtattgtggaacacgagactgttatgaagtgctgggcgtcagccgatctgccggcaaggccgagatagcaagagcttacagacaactagctcggcggtatcatcccgaccggtaccgcccacagcccggggatgaggggcccggccgcaccccccagagcgccgaggaggccttcctgttagttgctacagcatacgagaccttaaaggtctctcaggcagccgccgagctgcagcagtattgtatgcagaatgcatgcaaggatgcactgctcgtgggggttccagccggatcaaacccattcagggaacctaggtcgtgtgccctgttatag

SEQ ID NO: 29341 - DNA, 996 bp, Artificial Sequence
  Description of Artificial Sequence: Synthetic coding sequence
atggcttccaatttcaatgacatcgtgaagcagggttacgtgaaaatcagaagcagaaagctcgggatcttccgaagatgttggcttgtttttaagaaagcatccagcaagggcccacgccgactcgaaaagtttcctgacgagaaggcggcatacttccgaaacttccataaggtgaccgagctgcacaatatcaaaaacattaccaggctgccgagggagaccaaaaagcacgctgtggccataatattccatgacgagactagcaaaacctttgcctgtgagtccgaactggaagcagaggagtggtgtaagcatttgtgcatggaatgtcttgggacacgccttaacgacatcagcctgggcgaacctgacctcctggctgcaggggtccagagggagcagaatgagcgattcaacgtgtatctcatgccaacacccaacttagacatctatggagagtgcaccatgcaaattacacatgaaaatatctacctgtgggatatccataacgccaaagtgaaactggttatgtggccactgtcgagcttgcggcgctatgggcgcgactcgacctggtttacattcgagagtggacggatgtgtgacacaggcgagggcctgttcactttccagactcgcgagggagagatgatttaccagaaagtgcattctgcgacgttggctatcgcggaacaacacgaaaggctgatgctcgaaatggaacagaaggccaggttgcagacctcactgacggagccaatgactctcagcaagagcatctcccttcctagatcagcctattggcaccacatcactcgccagaacagtgtgggagagatctatagcctgcagggccatgggtttggctcttccaaaatgtccagggctcagacctttccctcttacgcgcccgaacagtctgaggaggctcaacagccattaagccggtccagctcttacggattcagctactcttccagtttgatccagtag

SEQ ID NO: 29342 - DNA, 615 bp, Artificial Sequence
  Description of Artificial Sequence: Synthetic coding sequence
atggcagaggacacatacagccacaagatggtgaagacaaatcatcggcggtgccggactaagttcactgaggagcaactaaagatccttattaataccttcaatcaaaaaccttacccaggttatgccactaagcagaaactcgcgttggaaattaataccgaagaatcgaggatacagatatggttccaaaaccgcagggcgcgccatggattccagaagagaccggaggccgagactctagagagctcacaatctcagggacaagaccagcctggggtggaatttcaaagtagagaagctcggcggtgtcgtacaacctacagcgcatctcagctgcacactctgataaaagcttttatgaaaaacccctacccgggaatcgatagtcgcgaggaactggccaaggagatcggagttcccgagtcacgggtgcagatctggttccaaaaccggcgctcaaggctcctgctgcagaggaaaagagaacccgtagcgtctctcgagcaagaagaacagggtaagattcctgagggcctccaaggcgctgaggatacccagaatggcaccaacttcacatctgattcacacttcagtggagctcgaacgtggtag

SEQ ID NO: 29343 - DNA, 2259 bp, Artificial Sequence
  Description of Artificial Sequence: Synthetic coding sequence
atgacagctggttcagtgtgcgtcccccagatcatccctctgagagtcccccagcccggtaaggcaaatcatgaaatagacaacaacaccctgttagagatgaaatctgatacgcctgacgtgaatatttactatacgttggacggatctaagcccgaattcttgaagcgcataggctacggcgaaaacaacaccttcaagtacataaagccaatcacactgcctgatgggaaaatccaggttaaggcaatagccgtgagcaaggattgcaggcagtcaggtattgttactaaggttttccatgtggactatgagccaccgaatatcgttagccctgaggataacgtggagaatgtgttaaaagacagctccaggcaggagtttaagaatgggtttgtcggttctaaactgaagaagaaatacaagaatagcgaaaaccagcgaagctggaatgttaatctgaggaaattccctgagagcccgctggaaatccccgcctacggtgggggatctggaagcagacctccaactcgacaatcccagagccccggctttgcccacgtctcgggccagaagtgtttgacttccaccgagattatgcgaatccagcgtgagacagactttcttaagtgtgcgcactgcttggcgccccggcccagtgacccattcgcccgtttctgccaggaatgcgggtctcctgtgcctcctatcttcggctgccgtctgccccctcctgaaggtgctcaaatgggcctgtgcgccgaatgcaggagcctcgtgcctatgaacacacctatctgtgttgtttgtgaggctccactggcccttcagctgcagccccaggccagtcttcacctcaaagagaaagttatctgccgggcttgcggcactggtaatcccgctcacctgcggtactgcgtgacttgtgagggcgccctccccagctcacaggagtcaatgtgttccggggacaaagcgcccccaccgccaacccagaaaggagggacaatttcatgctacagatgcgggcgctggaatctctgggaggcttcattttgcggatggtgcggagccatgctgggcatcccagccggttgtagcgtttgcccaaaatgtggcgcctctaatcacctctccgcacgattttgcgggtcctgtggaatctgcgttaaatctcttgtgaagttgtccctggaccggtccctggcgctggccgccgaggagcctcgaccttttagcgagtccctaaacataccccttccgaggtccgacgtggggactaagagggacataggaactcaaacagtaggactcttctacccaagcggaaagttactggctaagaaggaacaggagctcgccagccagaaacagcgtcaagaaaagatgagcgaccacaagccactgctgacagcgattagccccggcaggggctattggcgtcgccagttggatcatatttcagcacacttgcggtgttatgcccaaaataacccagaattccgcgctctgatagcagagccgagaatgggtaagctaatcagcgccacagtgcacgaggacggatgcgaagtcagtattcgtcttaattactctcaggtttctaataaaaacctctatctgaacaaggctgtaaactttagcgaccacttgctctcatctgccgcagagggggacgggggactgtgtggaagccgctctagctgggttagtgattacagccagagcaccagcgataccatcgagaagatcaagcgtatcaagaattttaaaactaagaccttccaggagaaaaaggagcagctgattcccgagaacagactgctgctgaaggaagtcgggccaaccggggaaggccgagtctccgtgattgagcagctgctcgatgagggtgccgatcccaattgctgtgacgaggacaaccgccccgtgattacggtggcggtgatgaacaagcaccacgaagcaatccccgtgctcgtacagcggggtgctgatatagaccaacagtggggaccacttcgcaacacagctctgcacgaggctaccctgcttggcttggctggtagagagtcaaccgcaacgctcctcggatgtaatgctagtatccaaaaaaaaaacgccggagggcagacagcctatgacctggctttgaacactggcgacgacctggttacctcattatttgccgcaaaattcgggcaaggcctggaagatcagctggctcagacccggagtttatcattagacgactgctag

SEQ ID NO: 29344 - DNA, 2193 bp, Artificial Sequence
  Description of Artificial Sequence: Synthetic coding sequence
atgacagccggctccgtgtgtgtacctcagatcattcctctgcgtgtgccgcagcccggcaaggcgaatcatgagatcgataacaataccctactggaaatgaagtctgacaccccagatgtcaatatctattacactctagacgggtcaaaacctgagttcctgaaaagaatcggatatggagagaacaatacattcaaatatattaagcctattacgctccccgatggcaagatccaagtcaaggcaatcgcagtctctaaggattgtagacagagcgggattgtgacaaaagtgtttcatgttgactacgaacctccaaacatcgtatcacctgaggacaatgtggagaacgtcctgaaagattcctcccgccaggcccgggagtttaagaacggttttgtgggttccaagttgaaaaaaaaatacaagaacagtgaaaaccagagatcatggaacgtcaatctccggaagtttcccgagagtcccctcgaaattcctgcttacggtggtggatctggctcacggcctccaacccgccaaagtcagagcccgggatttgcacatgtgtccggacagaagtgtctaacgtccacggaaattatgagaatacaaagagaaacagacttccttaaatgtgctcattgcttagcgccgcgcccgagtgatccatttgcgcggttttgtcaagaatgcggtagtcccgtgccgccaattttcggttgccgactgccgcccccggagggggcacagatgggcttatgcgctgagtgccgctcgctcgtgcctatgaacacgcccatatgcgtcgtttgtgaagctcccctcgccctgcaactacagccccaggcatccctgcatctgaaagaaaaagtgatctgccgcgcgtgtggcacaggcaatccagcacatctccggtattgcgtgacctgcgaaggagctctcccgagcagccaagaatctatgtgcagcggagataaagccccgccacctccaactcagaagggcggaacaatctcctgctatcggtgtggtagatggaatctctgggaagcttctttttgcggttggtgcggcgctatgctgggcattcccgccggttgcagtgtgtgccctaaatgcggggcttccaaccacctgtcagccaggttctgtggaagttgcgggatctgcgtgaagtctctggtcaagctgtccctcgaccggagtctcgccttagcggccgaagaaccacggcccttcagtgagagccttaacattccgcttccaaggagcgatgtcggcacgaaacgggatatcggtacacaaacggtaggactgttctatccaagcggaaaactcctcgctaagaaagagcaggagctcgccagtcagaagcagcgtcaggagaagatgtccgaccacaaaccacttctaacagccatatctcccgggcgaggctactggagacgacaactggaccatattagcgcccacctgcgttgttatgctcaaaataaccctgagttcagagccctcatcgctgagccacggatggggaagctgatcagcgccacagtccacgaggacgggtgcgaagtgtcgatccgtctcaattattcacaagtaagcaataaagtgcggaaattaaggcttcgggaggttaagcagccggcttcttcgaaaggaacaaagctggctgggaggccattgataaagaattttaaaacaaagaccttccaggagaagaaggaacaacttatcccagagaacaggcttctgctcaaggaggtggggccaactggcgagggaagagttagcgtgattgaacagctgcttgatgagggtgctgacccaaactgctgcgacgaagacaacaggccagtcattactgtggctgtgatgaataagcaccatgaggcaatccctgtccttgtgcagcgtggcgcagatatagaccagcaatggggacctctccgcaatactgccctgcacgaggctactctacttggtctcgctgggcgcgagtccactgcgacccttttggggtgtaatgccagcatacagaagaaaaatgccggtggtcagacggcttacgaccttgctctgaacacaggagacgatctggttacctccctttttgctgccaagtttggtcaaggattggaagaccagctcgcacagacacgtagtctgtcactcgatgattgctag

SEQ ID NO: 29345 - DNA, 1917 bp, Artificial Sequence
  Description of Artificial Sequence: Synthetic coding sequence
atgctgacactcgaaagcttccagcgtgtccactggaagagtcagctcatggtggaagatcaggtgttggaccacccacccgcctcgcccagacaggacaccgtgccatttacatttaagagttttctgttcggccactccatggagattaggccgtggaagcggaaggggagaactctgtttagacggctgctgttccaatcgcccggtttcgcccatgtgagtggccaaaagtgtttgacctccaccgaaatcatgcgcattcaacgcgaaacagacttcctcaagtgcgctcattgcctggccccaaggccgtccgacccctttgcacggttctgccaggagtgcggctctccagtccctccaatcttcggctgtcggttgccgcctcctgaaggtgcccagatgggactctgtgcagagtgtcggagtctcgttcctatgaatactcctatttgcgtcgtgtgcgaagcccccttggctctgcagctgcagccacaggctagcctgcatttgaaggaaaaggtaatatgtcgggcatgcggcacaggcaaccctgcacacctccgctactgcgttacctgtgagggggctcttccatcatctcaggagagcatgtgctcaggagataaagcccctccaccgccaactcaaaaagggggcaccatcagctgttatcgttgtgggcgctggaacctgtgggaggcttctttctgtggatggtgtggcgcaatgttgggcatccctgcaggctgcagcgtgtgcccaaaatgtggagccagtaatcacctatcagctcgcttctgcggatcttgcggaatctgcgtaaaatctttggtaaaacttagtttagacaggagtctagctctagccgctgaggagccacggcctttttctgagtctctcaacattcctttaccacgatccgatgtgggaacaaagcgggacatcgggacacaaacagtggggctcttttatccctctgggaagctgctcgccaagaaggaacaagaattggccagtcaaaagcagcgccaggaaaagatgtcggatcataagcctctgcttaccgccatctcgcccgggagggggtactggcgcaggcagctcgatcacatttcagcccacctgagatgttatgcacagaataatccagaattcagggcacttatcgcggaacctagaatgggtaagttaatttccgccactgtgcacgaggatggctgtgaggtaagcatccgcctcaactattcgcaggttagtaataagaacttgtatcttaacaaggccgtgaacttctcagaccatcttttgtcttccgcggctgaaggggacggcggactgtgcggcagtcgtagttcctgggtgtccgattactctcagtccacgagcgacactatcgagaaaatcaaacgaatcaagaattttaagaccaaaacctttcaagaaaaaaaagagcagctcatacctgaaaacagactgctgcttaaggaggtggggcccacaggggagggacgtgtgagcgtcatcgagcagctcctggacgaaggcgccgacccaaattgttgcgatgaggacaataggcctgtgatcaccgtggccgtgatgaacaagcaccacgaggcaatacctgtgctagtgcagcgtggtgcagatattgatcagcagtggggtcccttaagaaacacagcactgcacgaagcgactctgctcggactggccggaagagagagtactgcaacactgttaggctgtaacgcctcgatacaaaagaaaaacgctggtggccaaactgcttacgatcttgctctcaatactggcgatgaccttgtgacctctctcttcgcagcaaaatttgggcaggggcttgaggatcagctggcacagactagatcattgagtctcgatgactgctag

SEQ ID NO: 29346 - DNA, 1656 bp, Artificial Sequence
  Description of Artificial Sequence: Synthetic coding sequence
taacaaagggagactgattttctcaaatgtgcccactgcctggctcccaggccctctgatcctttcgccagattttgccaagaatgcggatctccagtgcctcccatttttggatgcagactaccccccccagagggtgcccaaatgggtctgtgcgccgaatgcagatccttggttcccatgaataccccaatctgcgtggtgtgtgaggcacctctggctctccaactccaaccacaagcttcgctccatctgaaggagaaggtgatttgtagggcgtgtgggaccggtaacccagcacacctcaggtactgtgtgacatgcgagggcgcccttccctcctctcaggagagtatgtgttcaggcgataaagccccaccgcctcctacacagaagggcggaacaattagttgctaccgctgcggacggtggaacctgtgggaggccagcttctgcggctggtgtggcgccatgctcgggatcccggccggctgctccgtgtgtcctaagtgcggcgcttctaatcatctttcagcacgcttctgcggctcctgtggaatctgcgttaaatccctggtcaaactgagtctggatagaagcctggcactcgctgctgaggagccgcgccccttctctgagtctcttaatatccctttgccccggtctgacgtcggaacaaaaagggacatcgggacccagacagtgggcctgttctacccgtcaggcaagctgcttgccaagaaggaacaggaactcgcgagccagaaacagcggcaagaaaagatgtccgaccacaaacctcttttgacagcaatctccccagggcgcggctactggagaagacagctggatcacattagcgcccacttgcgctgctatgcgcagaataatccagaatttagggccctgatcgccgagccccggatgggcaaattgatctccgccaccgtgcacgaagatgggtgtgaggtgagcatccgactgaattattcccaggtcagtaacaaaaatctgtatttaaacaaggcagtgaattttagtgaccacctcctttcgagcgccgccgagggagatgggggcctgtgcgggagccgctccagttgggtcagcgattattcacagagcacatctgacaccattgagaagatcaaacggatcaaaaattttaagaccaaaaccttccaagagaagaaggagcaacttatccccgagaaccgattgctcctgaaggaggtggggcccaccggggaaggcagagtgtcagttatcgaacaactgctagacgagggagctgatcctaattgctgcgacgaggacaacaggccagtgatcaccgttgcagtgatgaataaacatcacgaggcaatacctgtgctggtgcagcgtggcgccgacattgaccaacaatggggccctctccgcaacaccgctctccacgaggctactctgttgggccttgccggccgcgagtctacagccaccttgctgggctgcaacgcctccatacaaaagaaaaatgcaggcgggcaaaccgcgtatgacctagctctgaacaccggggacgatttggtgacttccctcttcgcagccaaatttggccagggattagaggaccagctggcacagactaggtccctcagcctggatgactgttag

SEQ ID NO: 29347 - DNA, 1758 bp, Artificial Sequence
  Description of Artificial Sequence: Synthetic coding sequence
atgctcacactggaatcttttcaaagtcccggctttgctcatgtatccggacagaagtgtcttacatctaccgagatcatgcggatccagagggagacggattttcttaaatgcgcgcactgcttagcccctcgtccttccgatccattcgcaagattttgccaggaatgtgggtcccccgtgccccctatcttcgggtgcagattgcctccacctgagggcgcccagatgggtctttgtgctgagtgcagaagtcttgtccccatgaacactcctatttgtgtagtctgtgaagctccactggccttgcagctgcagccgcaggcgtccctccatctgaaggagaaagtgatttgtcgggcgtgcgggaccggcaacccagcccatctgagatattgcgtcacttgtgaaggggctctgcctagtagtcaggagagcatgtgcagtggagacaaagcgccaccaccgccgactcagaaaggcggcacgataagttgctacaggtgtgggcgctggaatctctgggaagcatctttctgtgggtggtgtggggccatgttggggatccccgctggatgcagcgtttgccctaaatgtggagccagtaatcacctaagcgcgaggttttgtgggtcatgcggtatctgcgtcaagtctcttgttaaactgtcccttgaccgctcactcgccctggcagccgaagagccacggcccttcagcgagccgcgttgcgcgtggcagagcttgaacattccccttcctcggagtgatgtgggcactaaacgggacataggaacgcaaaccgtgggcttgttttacccatccggcaagctgctggctaaaaaggaacaggagctggcttcccagaagcagcggcaggaaaagatgtctgatcacaagcctctcctaacggctatctcaccgggacggggttactggaggcggcagcttgaccacatcagcgcacacctgaggtgctatgctcagaataaccctgaatttagagccctcattgcagaacctagaatgggcaaactcatctccgccactgttcacgaagatggatgtgaagtctcgatcagattgaattacagccaggtttccaataaaaacttgtatctcaacaaggctgtgaacttttccgaccacttgctgtcgagcgcagctgaaggagacggaggattgtgtggtagccgcagtagctgggtgagcgattacagccagtccacatctgacacaattgagaaaattaaacgcatcaagaatttcaagacgaagacgttccaagaaaaaaaagagcagctgatcccagaaaatcgcctgctcctgaaggaagttggtcctactggagagggcagggtgtccgtgatcgagcaactgttagatgaaggcgcagaccctaactgttgcgacgaggataatcggccagtgattacagtcgctgtgatgaataaacatcacgaggccatccccgtgttggtgcagcgtggggctgatatcgatcaacagtgggggcctctccgaaatactgccttgcatgaagcaaccctgctgggcctggctggccgtgaatccactgccacactgctcgggtgtaacgctagtatccagaaaaaaaacgctggagggcagactgcttatgacttggcattaaatactggggatgacttggttacgtccttgttcgccgctaaatttggccaagggttggaggaccagctggctcagactcggagtctctccttagacgattgttag

SEQ ID NO: 29348 - DNA, 1614 bp, Artificial Sequence
  Description of Artificial Sequence: Synthetic coding sequence
atgacgatcaacagctttaagtcgccaggttttgcccatgtatctgggcagaagtgcctcacatcgaccgaaatcatgcgcatacagcgcgagacagacttcctgaagtgcgcccattgcctcgcgccccgcccctcagacccatttgctcggttctgtcaagagtgcggttcccccgtgcctcccatatttggatgtaggttaccccccccggagggcgcccagatggggctgtgtgcggagtgccgttctctggttcccatgaacacccccatctgcgtcgtctgcgaagcccctttggctctccaacttcagcctcaagcctctttgcatttaaaggaaaaggtgatttgccgagcgtgcggcaccggtaatcccgcccatctgcgttactgcgtgacttgtgaaggtgctctgcccagcagtcaagagctgggcatccccgcagggtgctcagtgtgcccgaagtgcggcgctagtaaccacttgtcagcacggttttgcggaagctgtggcatctgcgtcaagtccctggtcaaactcagcttagatagaagtctggcactcgctgcggaggaaccgcgtcctttctctgagtcactgaatattccattgccacggtcagatgttggtactaagcgggacattggcactcagactgtcggtcttttctaccctagcggcaagctgctcgcaaaaaaggagcaggagctcgcttcccaaaaacagcgacaggagaagatgtcagatcacaagcccctgctgactgcaatttctccaggtcggggatactggcgacgccagctagatcatatcagtgcgcacctacgctgctacgcacagaataaccccgagtttcgcgcactgatcgccgagcctcgcatgggtaaactgatctccgcaaccgtccatgaggatggctgtgaggtctccatccgactcaattactctcaggttagcaacaagaatttgtacttgaataaagccgtgaattttagcgatcacctgctgagctcagccgcagagggcgatggcggtctgtgcggtagcaggagtagctgggtgtccgactactcccagtccacctctgataccatcgagaagattaaaagaatcaaaaattttaagacaaagacatttcaggagaaaaaagagcagctcatccccgaaaacagactgctcttgaaagaggtgggccccacgggggagggacgggtatccgtgattgaacaactgctggatgagggcgcggatccaaattgctgcgatgaagacaatagaccagttatcaccgtggctgtcatgaacaagcaccatgaggccatacctgttttggtgcagcggggggcggatatcgaccaacagtggggcccactgaggaataccgccctccacgaagcaacgctgctgggcttggcagggagggaatcgactgccacactcctgggatgcaacgccagtatccagaagaagaacgcaggggggcagaccgcctacgatctggccctcaataccggggatgacctcgtaacgagcctcttcgctgccaaatttggccaggggttggaagaccagctggcccaaacaagatcgctgtccctggatgattgttag

SEQ ID NO: 29349 - DNA, 1755 bp, Artificial Sequence
  Description of Artificial Sequence: Synthetic coding sequence
atgacaattaactcgtttaagagtcccggtttcgcacacgtctcaggacagaagtgtttaaccagcacggaaattatgcggatccagagggagaccgactttctgaaatgcgcacattgtctcgctcctcgaccctctgacccgttcgcgaggttctgtcaagagtgtggaagcccagtgcctcccattttcggatgtaggctccctccgcccgagggcgctcagatgggcctgtgcgcagaatgccgcagcctggtaccaatgaacacacccatctgtgtggtctgtgaggcaccgctggccctgcagttacaaccacaggcctcgctgcatcttaaagaaaaagtaatttgcagagcctgcggcacaggcaaccctgcgcatctcaggtattgcgttacttgtgagggagccctcccatccagtcaggagagcatgtgctccggtgacaaagcccccccaccaccaacgcagaaagggggtactatctcgtgctataggtgcggccgctggaatttatgggaggcctcattttgtggctggtgcggcgccatgctggggattcccgcaggctgttccgtttgcccaaagtgcggtgcctccaaccatctgtctgcccgtttttgcggcagttgcggaatatgtgtcaagagcttggtgaaattatcactggaccgatctctggccttggcagccgaggaaccacgaccattctcggaacccaggtgcgcctggcagagcttgaatattcccttaccaagatcagatgtcgggaccaagcgagacattggaacccaaacagtgggactcttctatccaagcgggaaactgctagctaaaaaggagcaggaactggcctcccagaagcagcgacaggaaaagatgtcagatcataaaccacttctaacagccatcagtcccggtcggggttattggagacgacagctcgatcacatcagcgcgcatctccgttgctacgctcagaataacccagagtttcgcgctctgattgcagagcccaggatgggcaagttgatttctgctaccgtacacgaggacgggtgtgaagtgtccattcggctcaactattcacaagtgtccaacaagaatctctatctcaacaaagccgtcaacttctcagatcatctactctctagtgctgctgaaggtgacggaggtttatgcggtagtcgctccagctgggtcagcgactattctcagtctaccagcgataccattgagaagattaaaagaatcaagaatttcaagacaaaaacctttcaggaaaaaaaggagcagctgatacctgagaatcggttgttgctgaaagaggtagggcctacgggagaaggacgggtttcagtcatagaacagcttttagatgagggcgctgatccaaattgctgtgatgaagacaaccggccagttattacagtggccgtgatgaataagcatcacgaggcgattcctgttttagtgcagcgcggagccgacatagatcagcagtggggcccgctgcgaaacacggccctgcatgaggctactcttttagggcttgcagggcgggagtcaaccgcaacactactgggatgcaacgccagcatccaaaaaaagaacgcgggtggccagactgcctatgacctggcgctcaatacaggggacgacctcgtaacctcactgtttgctgccaagtttggacagggactcgaggatcagctggctcagaccaggtcactgagcttagacgactgctag

SEQ ID NO: 29350 - DNA, 1050 bp, Artificial Sequence
  Description of Artificial Sequence: Synthetic coding sequence
atggccggcggatcacctgctgccaagagggtggtggtgtatcgcaacggtgaccctttttttcccggatctcagctcgttgtgactcagcggcggtttccaaccatggaggccttcctgtgcgaggtgaccagtgctgtgcaggccccgttagccgtgcgggctctctacactccgtgccatggccaccccgtgactaatcttgcggacttgaaaaatcgaggacagtatgtggcagctgggtttgagaggtttcacaagctgcattatctcccacataggggcaaggaccccggaggtaaaagctgcagacttcaggggcctcctgtgactcggcatctatgtgatggagccatcggacggcaactgccagcaggcgctccatcatatatccatgtgtttaggaatggagacttagtcagcccccccttttctctgaaactcagtcaagcagccagtcaggactgggagaccgttctcaagctgctgactgagaaagtgaaattacaatcaggggccgtctgcaaactgtgcacgttagaaggcctgcccttaagcgcagggaaggagcttgtaacaggccattattatgtagccgtcggggaggatgaatttaaggatctcccctatcttgaacttttggtgccctcaccatcactgccccgcgggtgttggcaaccaccgggcagtaaatcaagaccacacagacaaggtgctcagggtcatcgggctcaggtgactcagcccagcccaaaagagccggataggataaagccttcagctttctatgcacgtcctcagcagactatccaacctcgctcgaagctgcccactttatcgttcccatcgggagtcatcggagtgtacggggctccacatcgcaggaaggaaacagcaggggccttggaggtcgcggacgatgaggacacacagaccgaagaaccacttgatcagcgtgctgcccaaatcgtggaagaagccctgtctttagagaaccagccaggggccggtgctgcaatctcggcttcagcacctgctctgccatcttag

SEQ ID NO: 29351 - DNA, 453 bp, Artificial Sequence
  Description of Artificial Sequence: Synthetic coding sequence
ttaatcctcgaggagcagttcccgtctgggctgattggtcccctcttcaccatgaatggacatttgctgggcgattccaaagacctccaggataatcacttttatgttgccgtggggctagaaacctttaagtattttccttactggaagagccctcgggtaccttcagaggtgcagcagcggtacgcaaacgttgagaagaattcccagcggaaaaagaaagtggattccaaggggaaggagccgtgcaagtacgatggcatccctccaaaaacacaggacagcgtctactatgctaaggaagagaagaaaaagactctcgccgaacctctggtccaaaggggagcagaaggcgacgtttataaagcacccacgcccagcaaagaaacacagggcgcactggatgttaaagaagagcacaatgttcaactcgaggtgcccgtggaccagtag

SEQ ID NO: 29352 - DNA, 579 bp, Artificial Sequence
  Description of Artificial Sequence: Synthetic coding sequence
atggccgctcccccgaaggctcccattagggtgagaaacctgaccatcagagccggggctctgaccggaaaagaaaacaatatgcttcaacccgaaacccatatttttaccgccccggaggaaggttcgagtcaaggggccctcctgttaggccaggctcccgaacctctctccttaccatgcacccctgtaacgctcgagcagcagttagtgtccccaagcggagatccacatagggcacctgccctgccgagcatctgcagcaccctgatactccagccctgtgcgacactggatccactactgcttcaaccgcaggtccctaaagtgtccgaccaggccctggtctctgcacacagtgaatggcaacgaaaactggaggccgccgaagctctgctgacccttaggaactccgcacaggccccgcctgacagtataagcttacatcagccgtgtaacccgcctgcgccggccggcgataaaggctttcagcctccctccccctccctgcgccctaggccagcctctagtatatcccttcccataggtcatcttgggtgcatctctctgctgtcatag

SEQ ID NO: 29353 - DNA, 534 bp, Artificial Sequence
  Description of Artificial Sequence: Synthetic coding sequence
atggaaagtatatacctgcagaaacatctgggtgcttgcttaactcaaggcctggcggaggtcgcaagagtgcgtcctgtcgaccctattgaatacctcgctctctggatctataagtataaagaaaacgttacaatggagcagctccgacaaaaagaaatggccaaactggaacgagaacgcgagcttgccctaatggaacaggagatgatggagaggctgaaggcagaagaattgcttcttcaacagcaacagcttgccttgcagcttgagttggagatgcaagaaaaagaacgccagcgaatccaagagctgcagcgggctcaggagcagctaggtaaggaaatgcgaatgaatatggaaaacttagtgcgaaacgaggacattctgcatagtgaagaggcgacgctggactcagggaagacccttgccgagattagcgatagatacggcgcccccaacctgtcccgcgtagaggagctggacgagccgatgttctccgacatcgcgttgaacattgaccaggacctgtag

SEQ ID NO: 29354 - DNA, 534 bp, Artificial Sequence
  Description of Artificial Sequence: Synthetic coding sequence
atggagagtatctacctgcagaaacacctcggagcgtgcctgacccagggcctggcagaggttgctagggtacgacccgtagatccaatagagtacctagccctgtggatctataaatacaaggagaacgtgaccatggagcagctgagacagaaggaaatggccaaacttgaaagggagcgcgagctggcactcatggagcaagagatgatggaacggctcaaagctgaggaacttctcctgcagcaacagcaactggccctgcagctggaactggagatgcaggaaaaggagagacaacgtatacaagagttacagcgagcacaggagcagttaggtaaggagatgcgaatgaacatggagaacctggtgcggaatgaggatatcttgcacagcgaggaggcgacgctggatagcggaaagacgctcgctgaaattagcgatagatatggagccccaaaccttagccgtgttgaggaattagatgagcccatgttcagtgatatagccctgaatatcgaccaagatctctag

SEQ ID NO: 29355 - DNA, 555 bp, Artificial Sequence
  Description of Artificial Sequence: Synthetic coding sequence
atggagtctatatacctgcagaaacatcttggagcttgcttgactcagggacttgcggaggtggctagggtgcggcctgttgatccaattgagtatctcgctctctggatttacaagtacaaggagaatgtgactatggaacagctgagacagaaggagatggccaagctggaaagagagagggagttggcgctcatggagcaggaaatgatggaaaggcttaaggccgaggaattgctgctgcaacagcagcagctggccctgcaactggaactggaaatgcaggaaaaagaacgacagagaatccaggaactgcagcgagcccaggagcaactgggcaaagaaatgcgtatgaacatggaaaatttagttcggaatgaggatatactgcacagtgaggaagctacgctcgacagtggaaagacactcgctgagatcagcgatcgatacggggctccaaatctgtcgcgcgtcgaagagctcgacgagccaatgttttctgacgtctctatatcagtgttttgtgagaaaactcgtttttgcttctgcttctag

SEQ ID NO: 29356 - DNA, 243 bp, Artificial Sequence
  Description of Artificial Sequence: Synthetic coding sequence
atggaatcaatctatctgcagaaacacttaggggcttgtctcacacagggactggctgaagtggcgcgtgtgcgacccgttgaccccatcgagtacctggctttatggatctacaagtataaggaaaacgtgacgatggaacaactcagacagaaggagatggctaagttagaacgagagagggaacttgcactgatggaacaagagatgatggagcgtctaaaggctgaggagctcctttag

SEQ ID NO: 29357 - DNA, 462 bp, Artificial Sequence
  Description of Artificial Sequence: Synthetic coding sequence
atggaaagcatttaccttcagaaacatctgggcgcttgccttacccaggggctggccgaggtggccagggtcaggcctgttgatcctatcgagtacctcgctctctggatctacaagtataaggaaaacgtgacaatggagcaattaaggcagaaggagatggcgaaattggaaagggaacgggagttagcactgatggagcaggagatgatggaacgcctgaaagcagaagaactgctgcttcagcagcagcagctggcactgcagcttgaattagaaatgcaggagaaggagcggcagaggatccaggaacttcaacgggcacaggagcagcttggcaaggagatgcgaatgaatatggaaaaccttgtgaggaacgaggacatcctacactccgaggaagccacactagacagtgggaagacactggctgagatcagcgacaggtatggggccccctag

SEQ ID NO: 29358 - DNA, 534 bp, Artificial Sequence
  Description of Artificial Sequence: Synthetic coding sequence
atggaaaccaactatctcaaaagatgttttggcaactgtttggctcaggcgttggccgaagtggcaaaagtgaggccctccgacccgatcgaatacctggctcattggctttatcactaccggaaaacagctaaggccaaagaagaaaacagggaaaaaaagatccacctacaggaggagtatgattcctcattgaaggagatggagatgacagaaatgttgaagcaggaagagtatcaaatccagcagaactgcgaaaagtgccataaggagctgacatccgagacagtcagcaccaaaaaaacgatcttcatgcaggaggatacaaaccctctggagaaggaagccctcaagcaggaattcttgcctgggacttcatccctgataccaggtatgccacagcaggtcccgccgtcagaatctgccgggcagatcgaccagaattttaaaatgccacaggagatcaactataaagaggcttttcaacacgaggtggctcacgagatgcctccagggagcaagtctcccttctag

SEQ ID NO: 29359 - DNA, 534 bp, Artificial Sequence
  Description of Artificial Sequence: Synthetic coding sequence
atggaaacaaattacttgaaacgctgtttcggcaattgcctagcccaggctcttgcagaagtggctaaggtgcgcccttctgatcccatagagtacttagcacattggctttatcattacaggaaaaccgccaaggctaaggaagagaaccgggaaaagaagattcatctgcaggaagagtatgacagttcattgaaagaaatggagatgactgaaatgctgaaacaggaggagtatcagatacagcagaattgcgagaaatgccacaaagagcttacatcggagacggtgtctacaaaaaagactatatttatgcaggaagacaccaacccccttgagaaggaggctttgaaacaggaatttctgcccgggacctcaagtctaatcccgggcatgccacagcaggtgcctccaagcgaaagcgcagggcagattgatcagaatttcaaaatgccacaagaaataaactacaaggaggccttccagcacgaagtcgctcacgaaatgcctcccggctcaaaatctcctttctag

SEQ ID NO: 29360 - DNA, 576 bp, Artificial Sequence
  Description of Artificial Sequence: Synthetic coding sequence
atgatactacgaccgccgcagcaatgcggcactgccgctagaatggaaaccaattatctcaagagatgttttgggaattgtctggctcaggcactggcggaagtggccaaagtgaggccctccgaccctatcgaatatctggcacactggctgtaccactatcgcaagacggcgaaggcaaaagaggagaacagagagaaaaagatccatcttcaagaggagtacgattcatctctgaaggaaatggagatgacagaaatgctgaagcaggaggagtaccagattcaacaaaattgcgaaaaatgccacaaggagctcaccagcgagaccgtgagcactaaaaagaccatattcatgcaggaagatactaatccactggaaaaagaggcacttaagcaggagtttctgcccggcacttcatctttgattcctggcatgcctcagcaggttcctccaagcgagagcgccggacagattgatcagaatttcaagatgccccaagagataaactataaggaagcctttcaacatgaggttgcccatgaaatgcctccgggctccaagtcgccattctag

SEQ ID NO: 29361 - DNA, 534 bp, Artificial Sequence
  Description of Artificial Sequence: Synthetic coding sequence
atggaaaccaattatctgaaaagatgttttgggaattgcttggctcaggcgctcgccgaggttgccaaggtgcgaccttcagatcctattgaataccttgcccattggctctaccactacagaaaaaccgccaaggcaaaagaggagaatagagagaagaaaatccacctgcaggaagagtacgactccagcctgaaagagatggagatgaccgaaatgctgaaacaagaggaataccaaattcaacaaaattgcgagaaatgtcataaagagctaacaagcgagaccgtctccactaagaagacaatcttcatgcaggaggataccaaccccctcgagaaagaggctctgaaacaagagttcttgccagggacttcttcccttatccccggtatgccacagcaggtcccgccctcagaaagcgcaggccaaattgatcagaattttaagatgccccaggaaatcaactacaaggaggccttccaacatgaagtcgctcatgagatgccaccaggttccaaatctcctttctag

SEQ ID NO: 29362 - DNA, 381 bp, Artificial Sequence
  Description of Artificial Sequence: Synthetic coding sequence
atggaaactaactatctcaagaggtgttttgggaattgcttggcccaggccctggccgaggtagctaaagtgaggccatccgaccctattgagtacctggcacattggttgtatcattaccgaaaaactgccaaggctaaggaggaaaatagggagaaaaagatccatctgcaggaagaatacgacagttctttaaaggagatggaaatgacagaaatgctgaagcaggaagaataccaaatccagcagaactgcgaaaagtgtcacaaggagttaaccagtgaaaccgtctctaccaaaaaaactatcttcatgcaggaggacaccaaccctctcgagaaagaggctctgaagcaggaatttttacctgggacctcgtag

SEQ ID NO: 29363 - DNA, 534 bp, Artificial Sequence
  Description of Artificial Sequence: Synthetic coding sequence
atggaaacaaactacctcaaacgatgtttcgggaactgcctggcgcaggccctagcagaagtggccaaggtgcgcccctctgaccccatcgaatatctggcgcactggctgtaccattacagaaaaacagctaaggcaaaagaggaaaatcgagaaaaaaagatccacctacaggaggagtatgattcgagtcttaaggaaatggaaatgaccgaaatgcttaagcaggaggagtaccaaatccagcaaaactgtgaaaaatgtcacaaggaacttacgagcgaaaccgtttctacaaaaaagaccatctttatgcaagaggatactaacccgttagagaaggaggcgctgaagcaggagttcctgcccggaacatcctccctgatccctggcatgcctcagcaggtcccaccctccgagagcgccggtcagatcgaccagaattttaagatgccacaagaaatcaactataaggaagccttccagcacgaggtggcccacgagatgccacccgggtctaagtcaccattttag

SEQ ID NO: 29364 - DNA, 915 bp, Artificial Sequence
  Description of Artificial Sequence: Synthetic coding sequence
atgagcctgaatcctcccattttccttaagcgcagcgaagaaaacagctcgaagttcgtcgagacaaagcagagccagacaacttctattgcatccgaggaccccctgcagaacctgtgcctggccagtcaagaggtcctccagaaggcccagcagtcagggagaagtaagtgtctgaagtgtggaggttcgcggatgttttactgctacacatgctacgtgcccgttgaaaacgtgcccattgagcagatcccattggtgaaactgccactgaagatcgacatcatcaagcatccaaacgagaccgacggcaagtctacagcaatacacgcaaagctgctcgcaccggagtttgtgaatatctatacgtatccctgcatcccggaatatgaggaaaaagaccacgaggtagccctgatctttccgggtccacagtccatctctataaaggatatttccttccatctccagaagcgcatccagaataacgtccgaggaaaaaatgatgaccccgacaaaccctcttttaaacgaaaacggactgaggaacaggagttctgcgatcttaacgacagtaagtgtaagggaaccacgctgaagaaaattatcttcatagacagcacttggaaccagactaataagatctttacggacgagagattgcagggattacttcaggtcgaattaaagacccgcaaaacttgtttttggcggcatcaaaaaggcaaaccggatacattcctttcaacaatcgaggccatctattatttcttggtcgactaccatacagacatcctgaaggaaaaataccggggacagtacgacaatctgttgttcttctactcttttatgtaccagctgatcaagaacgccaagtgctccggcgacaaagagaccggcaaattgacccattag

SEQ ID NO: 29365 - DNA, 330 bp, Artificial Sequence
  Description of Artificial Sequence: Synthetic coding sequence
atgtcacttaaccctcctatcttcctcaaaaggagcgaagaaaattcttcaaagttcgtggaaacaaagcagtcacaaaccacctcaatcgcatccgaggatcccctgcaaaacctttgccttgcctctcaggaggtcctgcagaaggcacagcaaagcggccgctccaaatgcctcaagtgcggcggctcccggatgttctactgctatacctgctacgtcccagtggagaatgtgcccatcgagcaaattcctttggtgaagttcagcctctatcatctgggtcagtctatggtgtcaagcgcgtccaagataacttgtatcggatag

SEQ ID NO: 29366 - DNA, 915 bp, Artificial Sequence
  Description of Artificial Sequence: Synthetic coding sequence
atgtccctgaatccgccgatctttctcaagcgttccgaggaaaatagctcaaagttcgtggagactaaacagtcccaaaccacctctattgcctcagaagatcccctgcagaacctgtgcctggcttcacaggaagtactgcaaaaggctcaacagtcaggaaggtcaaagtgcctgaaatgtggcgggtccagaatgttctactgctatacatgctatgtacccgtggagaatgtcccgatcgaacagatacctctggttaagcttccccttaagattgatattattaaacacccaaacgagacggatggtaaatcaactgccatccacgccaagctactggctcctgagttcgttaacatttacacctacccttgcatccccgaatatgaggagaaagaccacgaagtggcactgatttttcctggtccccagagcatatccatcaaagatatttccttccacctgcagaagcggatacagaataatgtccgaggcaagaacgacgatccagataaaccatcgttcaagagaaaacgaacagaggaacaggaattctgtgacctgaatgactcgaaatgcaagggcaccaccttgaagaaaatcatctttatcgacagcacatggaatcagactaacaagatttttaccgacgagaggctccagggcttgctgcaggtcgaactcaaaactagaaagacttgcttttggaggcatcagaaggggaagcccgacaccttcttaagtaccatcgaagcaatttattatttcctggttgactaccacactgacatactcaaagagaaataccgaggtcagtacgacaaccttcttttcttctacagctttatgtaccagttgatcaagaacgcaaaatgctctggtgataaagaaaccggcaagcttactcactag

SEQ ID NO: 29367 - DNA, 654 bp, Artificial Sequence
  Description of Artificial Sequence: Synthetic coding sequence
atgctgccactgaaaattgatatcatcaagcatcccaatgagactgacgggaagtctaccgctatacacgcaaagctgttggccccagaatttgtaaacatctatacatacccctgtattcctgagtatgaggaaaaagaccacgaggtggcattaatattccctggtccccaatcaatctcaatcaaggacatctctttccacctccagaagagaattcaaaataacgtgcgtgggaagaatgacgatccagacaaaccaagctttaaaaggaaaaggacagaggagcaggagttttgtgacctgaacgacagtaaatgcaaaggcacgacccttaaaaagattatattcatcgattccacatggaatcagacaaacaagatttttaccgatgaaaggctgcagggcctcttacaggtagaactgaaaacccggaaaacgtgtttttggaggcatcagaaaggcaaaccagatacattcctgtccacaatcgaagccatctattatttccttgtggactatcatacagacatactgaaggagaagtataggggacaatacgacaacttacttttcttttattccttcatgtaccaactgattaagaatgccaagtgtagcggagacaaggagactggcaagctcacacattag

SEQ ID NO: 29368 - DNA, 915 bp, Artificial Sequence
  Description of Artificial Sequence: Synthetic coding sequence
atgagcctgaacccacctatctttctgaagagatccgaagagaattcctccaagtttgtggagacaaagcagtcccaaacaacctccatcgcctcagaagatcctctccaaaacctgtgcctcgcctcccaggaagtgctgcaaaaagcccaacagagcggacgcagcaagtgtctgaaatgtggtggatccagaatgttctattgttacacttgttacgtgcctgttgagaacgtgcccattgaacagattcccttggtgaagctgcctctgaagatcgatattattaaacatccaaacgagacagacggaaagtctacggcaattcatgccaagttgctggcccccgagtttgttaacatttacacctacccgtgcatccctgagtacgaggagaaggaccatgaggtggcattgatcttcccggggccgcaaagtatatctatcaaggacatcagcttccacctgcagaaaaggatccagaataatgtgagaggcaagaatgatgaccctgacaagccaagcttcaaacggaaaaggaccgaggagcaggagttctgcgatctgaacgatagcaagtgtaaaggcacaaccctgaagaagattattttcatcgatagcacatggaatcagactaataagatattcacagacgagcgcctccagggcctcctgcaagtcgagctcaaaacccgcaagacatgtttttggcggcaccagaaaggtaagccggacactttcctgtccactatcgaagctatttattattttctagtggattaccacacggacatcctgaaagagaagtacaggggccaatatgataaccttttatttttctactcatttatgtatcaactgattaagaatgctaagtgctccggcgacaaagagaccggtaaactgacacactag

SEQ ID NO: 29369 - DNA, 285 bp, Artificial Sequence
  Description of Artificial Sequence: Synthetic coding sequence
atgagcctcaatccccctatttttctgaagcgctccgaggaaaacagcagcaagttcgtggaaacaaagcagagccaaacgacttctatcgccagtgaggacccactccagaacctgtgcctggcatcgcaggaggtgctgcagaaggctcagcaaagcgggcggtcaaagtgtctaaaatgtggcgggagccggatgttctactgctatacgtgttacgtgccggttgaaaatgtgcccatcgaacaaattcctctcgtgaagctacccttaaaaatcgattag

SEQ ID NO: 29370 - DNA, 897 bp, Artificial Sequence
  Description of Artificial Sequence: Synthetic coding sequence
atggaatcccagaaagaagccagaaccctccaagagccagttgcaaggccatctggagctagttccagccagactcccaatgacaaggagagaagggagggaggtgccgtgccagctgcggccgctctcggcgcggaggccgatgacgatagcgccgatggcttgtgggaactgccagtcgaaccagctgagcgccgtcctgagtgcacacggtgcagccggcctcagaaagtatgcctttgtccgtttcttcctgcacaccccctgcatatcagtacccatctatacattatccagcatccagctgaggagaacaaagtgcttagaactgtcccactgctggcagcatgcctgcctcaggacaagtgcaaggtcaagatcggtagaagattttctgaagagcgcgatccagagttgagcacggtgtgtcggaagagcggcaccctcattctgtatcctggtgccgaagccgcaaatctggaggagtttatccttgactcacccgtgtatccctcaactataatcattatcgacggcacctggagtcaggcgaaagacatcttctataagaattccctgttcaggcatccaaagcaggtacagcttaagacatccatcagtagccagtatgtgatccggatgcagccaactaatcgttgcctgagcactcttgaatgcgcagccgtggccctgagcatactggagaaaaacaattatattcaggaaaccctcttacgacctctgcaagctttatgttccttccagctccagcatggcgctcagatccgcctgagcaaggagcacttactcaaaaacgggttgtacccaaaacccatgcctaaaaacaaaaggaaattacgcaaaatggagctattaatgaattctgtgaaaatttag

SEQ ID NO: 29371 - DNA, 3477 bp, Artificial Sequence
  Description of Artificial Sequence: Synthetic coding sequence
atggcaacccggaaggatacagaggaggagcaggtagtgccttccgaggaagacgaggcaaacgtgcgagctgtgcaggctcactaccttcgctctcccagcccgtcccagtactctatggtatctgacgcggaaacagagtctatttttatggaacccattcatctaagttcagcaatcgctgccaaacaaattatcaacgaagaactgaagcctcctggagtgagagccgatgccgaatgccctggcatgctcgagagcgccgaacagttacttgttgaggacttgtacaatagagtgcgcgaaaagatggatgatacttctctctacaataccccctgtgtgctggatctacaacgcgctctggtccaggatcgacaggaggcaccctggaatgaagttgacgaagtctggcctaatgtattcattgctgaaaagtctgtggctgtgaacaaggggagattgaaacggcttggcatcacccacattctgaacgcggcccatgggaccggtgtgtacactgggcccgagttctacactggactggaaatccaatatctgggcgtggaggttgatgatttcccggaggtggatataagccagcacttcaggaaggcctcagagttcctggatgaggccctgctcacctaccgcgggaaggtgctcgtttcctctgagatgggtatttctcgctctgcagtactggttgtggcctatctgatgatcttccacaacatggcaattctcgaggctctgatgacagtcaggaagaaaagagccatttaccctaatgaggggttcttgaagcaactgcgtgagttaaacgagaaactgatggaagaacgcgaggaagattacgggcgcgaaggcggcagtgcagaggctgaggagggggaggggaccggttctatgctgggcgcccgcgttcatgcattgactgtggaggaggaggacgactccgcatcacacctctccggtagctccctgggaaaagccacacaggcctcaaagccactgacactgatcgatgaagaagaggaggaaaaactgtatgaacaatggaagaagggccagggtctattatccgataaggtgccgcaagacggtgggggatggcggagtgcaagtagcggccaggggggcgaggaattggaagatgaggatgtcgagcgtattatccaggaatggcagagccggaacgaacggtatcaggcagaagggtacaggcgttggggcagagaggaagagaaggaggaagaatccgacgctggaagctcagtgggaagacgccgtagaactctgtccgaatcttctgcttgggagtctgtgtcatctcacgatatctgggttctgaaacagcagctcgagctcaaccggcctgaccatggacgccgtagaagagcagactcgatgtctagtgagagtacctgggacgcatggaacgaacgtcttttggagattgaaaaggaggccagccggagataccacgccaagtctaagagagaagaagccgccgaccgctcctccgaagctggaagtcgcgtgcgagaagacgatgaggacagtgtgggtagtgaggcgtctagcttctacaacttttgtagcagaaacaaagataagctgaccgccctcgaaagatggaaaattaaacgcatccaattcgggtttcataaaaaggatctaggtgcaggggactcctcaggagaacctggcgcggaggaggcagtgggtgaaaaaaacccatcagatgtgagcctcacggcataccaagcatggaaactcaaacatcagaagaaagtcggctcggagaacaaggaggaggttgttgaactgagcaagggcgaggattctgctctggccaaaaagcgccagcgcaggctcgagctgctggagaggtcccgccaaacattggaggaatcacaatccatggcctcatgggaggcagatagctctacggcatcgggctcgatcccgctgtctgcattttggagcgccgaccccagcgtgagcgccgatggggatacaacctccgttctatcgacacaaagccacaggtcccatctgtcgcaggcagcttcgaacattgctggatgcagcacttcaaatcctactaccccgttacccaatcttccggtgggtcctggggatactatctctattgcaagtatccagaactggattgctaatgtcgtttctgaaaccctcgcacaaaaacagaatgaaatgctccttctctccaggtccccctccgttgctagcatgaaagctgtccctgctgcaagctgtctcggtgatgatcaggtgtctatgttgtcgggccatagctcctcttctcttggtggctgcctcctgcctcaatcacaggccaggccctcctctgatatgcaatctgtgctctcatgcaacaccactctgagttcacccgcagagagctgccgcagcaaggtgcgtggtacaagcaaaccaatcttttcgctctttgccgacaacgtagacctgaaagagctgggccgaaaggaaaaggagatgcagatggagctgagggagaaaatgagcgagtataagatggagaaactggcaagtgacaataaacgatcctctctattcaaaaagaaaaaagtgaaagaggatgaagacgatggcgttggcgacggagacgaagacacagacagcgcaatcggcagcttcaggtatagtagcaggagtaattcccagaagcccgaaaccgatacctgctcaagtctggccgtgtgcgatcactatgctagtggttccagggttggcaaagaaatggattcctctattaataagtggctcagcggcctgaggactgaagagaaacccccttttcaaagcgattggtctggcagcagcagaggtaagtacaccagaagttccctcctccgagagaccgagagcaagtccagctcatataagttctcgaagtctcagtctgaggagcaggatacctcaagttatcatgaagccaatggaaacagcgtccgtagcacatctcgcttttcttccagtagtacacgggagggccgtgagatgcacaaatttagtcggtctacctataacgaaacatcatccagtagagaggaaagcccagaaccatacttctttcgtagaacgcccgagtcttcggagcgagaggaatcacctgaaccacaaagacccaactgggcccgctcacgggattgggaggacgtggaggagtctagtaagtcggattttagtgagtttggcgcaaagaggaaatttacacagtcctttatgagaagcgaagaggaaggcgaaaaggagcgcactgagaaccgagaggaaggcagattcgcctcaggaaggagatcgcagtaccggaggtcaacagatagggaagaggaagaggagatggacgacgaggctattatcgccgcgtggagacgccgccaggaggaaacacgtacaaagttacaaaaacgcagagaggactag

SEQ ID NO: 29372 - DNA, 3477 bp, Artificial Sequence
  Description of Artificial Sequence: Synthetic coding sequence
atggcaacacgcaaggacaccgaggaggaacaggtcgtcccctccgaggaagacgaggctaacgtacgcgctgtgcaggcacattacctgaggagtccaagcccatcccagtattcaatggtgtctgacgcagagactgaatccatttttatggaacccatccacttgtctagtgctatagctgcaaaacagataattaacgaagaattgaaaccccctggggtgcgggcggacgctgagtgccctgggatgttagaaagcgccgaacagctcttagtcgaagatctatataatcgcgttcgcgagaagatggacgacacaagtctctacaacacaccttgtgtgttggacctgcagcgagctctggtgcaagacagacaagaagcaccgtggaatgaagtggatgaggtgtggcctaatgtgtttattgcagagaagagcgtggctgtgaataaaggaagactaaaacgcctgggaatcacacacatcctgaacgccgctcacggcaccggggtttatacggggcccgaattctacaccggattggaaatccaatatttgggggtcgaggtagacgattttcccgaggtggacattagtcaacatttccggaaagcctccgagtttctcgacgaagccttgttgacctaccggggcaaggtcttagtaagcagcgaaatggggatttcacgctccgccgtgctggtcgtcgcgtacctgatgattttccacaacatggccattttggaggccctgatgacggttagaaagaagcgagctatttatcctaatgaggggtttcttaaacagctgcgcgagttaaatgaaaaactaatggaggaaagagaagaagattatgggcgcgaggggggctcggccgaagctgaggagggtgagggtacaggcagcatgctcggtgccagggtacacgccctcactgtcgaagaggaagacgatagtgccagccacctgagcggctcctccctgggaaaagccacacaggcatcaaagccacttacactaattgatgaagaagaggaggaaaaactgtacgaacagtggaaaaaggggcagggcctgctgagcgataaagtcccacaagacgggggcggctggcggtcggcctcctcaggtcagggtggtgaagaactggaggacgaagacgtcgaaaggatcatccaggagtggcaaagtagaaatgaacgctatcaggcagaagggtatcgtaggtgggggagagaagaggaaaaggaggaagagagtgatgccggatcttctgtggggcgcagacggcgcacccttagcgagagctccgcttgggaatctgtgtcctcccatgacatatgggttcttaagcagcagttggaacttaaccgtcccgaccatgggcggcggagaagggctgacagcatgtcatccgaaagtacatgggacgcttggaacgagaggctactggagatcgaaaaggaggccagccgacggtatcacgccaaatccaagagggaggaagctgcggataggtcaagcgaagccggatcccgtgttcgagaagacgatgaggatagtgtcgggtccgaggcatcctccttttacaacttttgcagtagaaataaggacaagctgaccgctctggaaaggtggaaaatcaagagaatccagttcgggttccacaagaaagacctgggcgctggtgattcatccggggaacctggagctgaagaagcggtcggtgagaagaacccctctgatgtatctcttaccgcttaccaggcgtggaagttaaagcaccagaaaaaggttggttccgagaacaaggaagaagttgtagaactgagcaaaggcgaggattcagctcttgctaagaagcggcagcgccgactcgagctcctggaaaggtctaggcagacccttgaggagagccaatccatggcctcttgggaggctgactccagcactgcgtctgggtcaatcccccttagcgccttctggtccgcggatccctcagtctcagccgatggcgacacaaccagcgttctgagcactcagtcgcataggtcacacctgagccaggctgcctccaacattgccggatgctccacttctaatcctaccactccactaccgaatttacccgtaggccccggcgatacaatttccattgcatccatccagaactggatcgcgaacgtggtcagcgagactttggcgcaaaagcagaacgagatgctgttgctgtcccgcagcccttcagttgccagtatgaaagccgtgcccgccgccagctgtctcggtgacgaccaggtcagcatgctgtccggccacagttccagcagcctgggaggatgtctcctcccacagtcccaagctcgtccaagttctgacatgcagtctgtgctctcatgcaacactaccctttcttcccccgcagaaagctgcaggtctaaggtgagggggacgagcaaaccaattttcagtctgtttgcagacaacgtggacttaaaagagcttggtaggaaagaaaaggagatgcagatggaacttcgcgagaaaatgtccgagtacaaaatggagaaactcgctagcgataataagcgcagttcccttttcaaaaagaaaaaagtcaaagaggacgaagatgatggggtcggtgatggcgatgaggacactgactctgccatcggctcattccgctattcctctcggagcaacagccagaaaccagaaactgatacatgttcttccctagctgtctgcgaccattatgcatctggatccagagttggcaaggaaatggacagctccataaacaagtggcttagtggactgcgcacagaggaaaagcccccctttcagagtgattggagcggatcttctcgcggaaagtacacaaggtcaagcttactgcgtgagactgaaagtaagtcttcctcatataaattttctaagagccagtcagaagagcaggataccagctcttaccatgaagccaatggcaattctgtgagatccacttctagattttcttcaagcagcacgcgggaaggccgagagatgcacaaattctctagaagcacgtacaacgagacatcctcgtccagagaggagtcaccagaaccctacttcttccgccgcactcccgagtctagtgaacgcgaggaaagtcctgagccgcaaagacctaattgggcccgatcccgtgactgggaggacgtggaagaaagtagcaaaagcgactttagtgaattcggagctaagcgaaagtttacgcaaagcttcatgcgctctgaagaagagggagagaaggaaaggaccgaaaatcgtgaggaaggcagattcgcaagtggaaggaggtcacagtaccgacggagcaccgacagggaggaagaagaggaaatggatgatgaggccataattgccgcttggaggcgacggcaagaggaaacaaggactaaactgcagaagcgtcgcgaagactag

SEQ ID NO: 29373 - DNA, 3477 bp, Artificial Sequence
  Description of Artificial Sequence: Synthetic coding sequence
atggccactagaaaggatacagaggaggaacaggtcgtaccttccgaggaggacgaggccaacgtgcgggcggtgcaggctcactatttgcgaagtccctctccatctcagtacagcatggtgtcagatgccgagacagagtctatatttatggagccaattcacctctcttcggcaattgctgctaaacagatcatcaatgaggagcttaaacccccaggtgtaagagcagacgctgaatgtccaggaatgctggaatctgccgagcaactattggtcgaggacctctacaatagggtgcgcgagaagatggacgatacttcactgtacaataccccgtgtgttttggacctgcagagggctctcgttcaggacaggcaagaggccccatggaatgaggtcgatgaggtatggcccaacgtgtttatcgcggagaaatctgtggcggtcaacaaaggacgcctgaagagattgggcattacccacatcttaaatgctgcacacgggacaggggtgtatactggcccagagttctatacgggcttggagatccagtatctgggcgttgaggttgacgactttcccgaagtggatatttctcagcactttaggaaggcgtccgagttcctggacgaggccctcctaacgtaccggggcaaggtactcgtgagcagcgagatgggcattagcagaagtgccgtcctggtggtggcatacctgatgattttccataacatggctatcctggaagccctgatgaccgtccgcaagaaacgcgccatctacccaaacgagggcttcctgaagcagctgcgcgaattaaacgagaagctgatggaggaaagagaagaagactacgggcgagaggggggatctgccgaggcagaggaaggcgaggggactggatccatgctcggggcccgcgtgcatgccttgacggtggaggaagaagacgactcagccagccacctatctggctcatccctgggaaaggcgacacaggcttccaaacctcttaccctaatcgacgaagaggaggaagagaaactctacgaacagtggaaaaaaggccaaggactgctgagtgataaggtccctcaggatggcgggggatggcggtccgcatcttcgggccagggaggcgaagaactagaagacgaagacgttgagcggatcatccaggaatggcagtcacggaatgagcgctaccaggcggaggggtacagacgatggggccgggaagaggagaaagaggaggagtcagacgcgggttcttcagtcggcagacggcggcgcaccctaagcgaaagtagtgcctgggaaagcgtgagcagccatgatatttgggttctgaagcaacagctggaactgaatcggcctgatcacggccggagaaggagagctgacagtatgagtagtgagtccacgtgggatgcttggaacgagcggctgttggaaatcgagaaggaagcctcacggcgttaccacgccaaatctaagagggaagaagcagcagatagatcatccgaagctggaagccgggtaagagaagacgacgaggactctgtcggcagcgaggcaagcagcttctacaacttctgtagtcgcaacaaagacaagttaaccgcattggagcgctggaagataaagaggatccagttcggctttcacaagaaagacctcggcgccggcgattccagcggcgaacctggcgcagaagaggctgtaggagagaagaatcccagtgacgtatcactcactgcttatcaggcttggaaattaaaacatcagaaaaaggtgggcagcgagaacaaagaggaggtcgtggagctgtcaaaaggcgaagactccgccttggcaaaaaagcgacagcggcgcctggagctgcttgagcgtagcagacagacactggaggagtcacagtcaatggcaagttgggaggctgatagttccacggcatctggatcgattccattgagtgcattctggtctgctgacccttcagtgtccgccgacggagacaccacatccgtcctgtctacacagtcacataggtcccatctgagtcaggccgcatctaatattgccgggtgctccacaagcaatccaactacacccctacccaatctgccggtagggcctggtgacactatcagcatagctagtatccaaaattggattgccaatgtcgtgtccgaaaccctggcccaaaagcagaacgaaatgctgcttctgagccgaagccccagcgtggcatccatgaaagccgttcctgcagcaagttgcttaggcgatgaccaggtgagcatgctctccggccactcaagcagctcgttgggtggctgtctcctccctcagagccaggcaaggccttcaagtgatatgcaatcagtcctatcttgcaatacaaccctttcttcacccgccgaatcatgccgctccaaggttaggggaacctccaagccaattttctcattgttcgccgacaatgtggatctgaaggagctggggaggaaggagaaggagatgcaaatggagctgagggagaagatgtcagaatacaagatggaaaaactggccagtgacaacaagagatcttcactcttcaagaagaaaaaggtaaaggaggacgaggatgacggggttggtgacggcgacgaagacacagactctgccattggatcctttcgatattcatcacgcagcaattctcagaaacccgagacagatacgtgctccagtctggccgtgtgcgaccactatgctagtggatccagagtgggcaaagaaatggactcaagcatcaataaatggttgtccggacttcgcaccgaggagaagccgcccttccaatcggattggtccggttcctcacgcggcaaatatactcggtcttcccttctccgggaaacagagagcaagtcgtcctcctacaaattttctaagagtcagtctgaagagcaggacacctcttcttatcacgaggccaatggtaattccgtgcgtagcacatcacgtttttcatcaagtagtactagagagggccgtgagatgcacaagttttcacgaagcacgtacaacgagacaagttcaagccgtgaggagtcacctgaaccatatttcttccggcgcacaccagagtccagcgagcgggaggagagcccagagccacagcggcccaactgggcccgatctagggactgggaggacgtggaggagagcagcaaaagtgacttttctgagttcggagccaagagaaagtttacccagtctttcatgaggtctgaggaggagggagagaaagaacggacggaaaaccgtgaggagggccggttcgccagtggcagacgttcccagtacagacgctccacggatagggaagaagaggaggaaatggacgatgaagcgataatcgcagcatggcgcagacggcaggaggagactagaactaaactgcagaagagacgtgaggattag

SEQ ID NO: 29374 - DNA, 531 bp, Artificial Sequence
  Description of Artificial Sequence: Synthetic coding sequence
atggggcctgccgaagcaggccggcgcggcgcagctagccctgttccgccccccttagttcgagtagccccctcactattcttaggttctgccagagccgcgggagcagaagagcagttggcccgcgccggcgtcaccttgtgcgttaacgtctcacgccagcagcctggtccgagggccccgggcgtagctgagctgagagttcccgtgttcgacgaccctgctgaagacctgctcgcacatctggagcctacctgtgccgctatggaggccgctgtgagggccggcggggcctgcctcgtgtattgtaaaaatgggcgcagccgctccgcggccgtctgcactgcttatctgatgagacacagaggcctgtctcttgctaaagctttccagatggtgaagagtgcccgccccgtggcggaaccaaatcccggtttttggagtcagctgcaaaagtatgaagaagccttgcaagctcagtcttgtcttcaaggtgagcccccagcgctgggattgggtcctgaggcgtag

SEQ ID NO: 29375 - DNA, 531 bp, Artificial Sequence
  Description of Artificial Sequence: Synthetic coding sequence
atggggccggctgaagccgggagacggggcgcagcaagtcctgtgcccccccctttggttcgggtggctccctccctgttccttgggtctgccagagctgctggagccgaggagcagctggcacgagccggtgtcacgctgtgcgtgaacgtgagccggcagcagcccggaccacgggcccctggcgttgccgaacttcgggtccctgtgttcgacgatcccgcagaggatctcctggcccatcttgagcctacttgcgccgccatggaagccgccgtacgcgctggcggtgcctgcttagtttattgtaagaatggtcggagccggtccgcagctgtgtgtacagcctacctgatgcgtcatcgtggactgagtttagccaaagcctttcaaatggtaaaatcagcccgaccggttgcggagcccaaccccggattttggagtcagctccagaaatatgaagaggcactccaagcacagtcatgcctccaaggggaaccacccgccttagggcttggtcctgaagcttag

SEQ ID NO: 29376 - DNA, 1155 bp, Artificial Sequence
  Description of Artificial Sequence: Synthetic coding sequence
atggaagggcttggaaggtcatgtctatggctgcggcgagagctgagcccacctaggccgaggctgctactactggattgtagaagtcgtgagttgtacgagtctgctcgaatcgggggagccctgagtgtggccctacctgctctgctgcttagacgcctgcggcgtgggtcactgtcagtgcgggccttgctacccggacctcctctccaacctcccccgcctgccccagtgctgctgtatgatcagggtgggggaagacgccggcgaggggaagcggaggccgaggccgaggagtgggaagcggagtcagtgctgggaaccctgctgcagaagcttagggaggagggttacctggcttactacctgcaaggtggcttttcgcggtttcaggctgagtgcccccacctctgtgaaacaagcctggccggaagggcaggtagttcgatggcgcccgtcccaggccctgtgcctgtggtcggcctggggtccctatgcctcggttccgactgtagcgatgccgagagcgaagccgatagagattccatgtcttgcggccttgatagtgaaggggcaaccccgcccccagtgggactgcgtgcttccttcccagtgcagatcctccctaatctgtacctggggtctgctcgcgactccgcaaatctagagtcactggctaagcttgggattaggtatattctgaatgtgacacccaatctgcctaatttcttcgaaaaaaatggggattttcattataaacaaatccccatctctgaccactggtcccagaatctgtcccggtttttcccagaagcaatcgagttcatagatgaagccctcagtcagaactgtggcgtcctggtacattgtttagcaggggtgagccgaagcgtaacggtgactgtggcatacctgatgcagaaactgcacttgtctctcaacgatgcctacgacctggttaagcggaagaagtctaatatttctcccaacttcaactttatggggcaactgttggactttgaacggtctctgaggctcgaggaaaggcatagtcaggaacagggatcaggcgggcaagcctccgcagccagcaatcctccgtccttttttaccacaccgacctcagatggagcctttgagttggctcctacatag

SEQ ID NO: 29377 - DNA, 1707 bp, Artificial Sequence
  Description of Artificial Sequence: Synthetic coding sequence
atgaagtggaaggaaaagctgggcgatggcgtctatgatactttcatgatgattgacgaaacaaagtgtcccccctgctctaatgtgctctgcaatccctccgagcctcctccaccacgtaggctaaacatgacaactgaacagttcaccggagaccatactcagcatttcctggacggtggagagatgaaggtggagcagttgtttcaagagttcggcaaccggaagagtaataccattcaaagtgatggaatctccgactcagagaagtgctcgccaacggtctcccaaggtaagtcttctgactgtctaaatactgttaagtcaaacagctcgagcaaagctcctaaggtggtgcccttgacacctgaacaggctttgaaacagtataagcaccacctcacggcctatgaaaagttggagattattaattacccagaaatttatttcgtcggcccaaatgcaaagaaacgccacggcgttatagggggacctaataacggcgggtatgacgacgcagacggtgcctacatccatgtccctagggaccacctggcctatcggtatgaggtgttaaagatcatcggcaagggctctttcggccaggtagctcgcgtgtacgaccataaattacgccagtacgtggctcttaaaatggttcgtaatgagaaacgtttccaccggcaggccgccgaagagattcggatcttggagcacctcaagaaacaggacaaaaccgggagcatgaacgtaattcatatgctggagtcatttacttttcgaaaccatgtatgtatggccttcgagctcctctcaattgacttatatgaattgataaaaaagaataagttccaaggatttagcgttcaactcgtcagaaaatttgctcagtccattttgcagtctctggacgctttgcacaagaacaagatcatccactgtgatctgaaacccgagaatatactacttaaacatcacgggcgctcctcgacgaaagtgattgattttggaagtagttgtttcgagtaccaaaaactttatacatacatccagagccggttttatagggcacctgagattatcctgggaagtcggtatagtacacccatcgacatttggtcatttggctgcatcctcgccgagttgctgacaggccaacctctcttcccgggcgaagacgagggcgaccagcttgcatgcatgatggaacttctgggaatgcctcctcccaaacttctggaacagtcaaagcgcgctaaatactttataaattctaagggcattccaaggtactgctcagtgacaacacaggccgacgggcgggtggttctggtggggggtaggtcaagacgaggcaagaagcggggacctccgggctcaaaggactggggaacagcactgaaggggtgcgatgattacctctttatcgagttcttaaagagatgcctgcattgggatccgagtgccaggctaacacccgcccaggctctgcggcacccctggattagcaaaagtgtcccaaggcctttgactaccatcgataaagtgtcaggcaaacgagtggttaatcctgcctctgcctttcagggcttagggtccaaactaccgcctgtggtgggcatcgctaataagctcaaagctaacctcatgtcagagacgaacgggtctatccccctgtgttctgtgctaccaaagttgattagctag

SEQ ID NO: 29378 - DNA, 1767 bp, Artificial Sequence
  Description of Artificial Sequence: Synthetic coding sequence
atgctgcccctgctggactcaagtaagagggccggcacgctgggatcaggctgtggcgtcccgagagtccactccgcggctctgtcaagagaagaaggcgccagccgggatatttggagaattaaagtgtgggcacgggtgatgactaccccggctggttctgggtccggtttcgggtctgtatcttggtggggattgtcccccgcactggacctgcaggccgaatcccctcccgttgatcccgactctcaggccgacaccgtgcactccaacccagagttggacgtgcttctcctgggctctgtggacggtcgacacctgctgagaaccttgtccagggctaagttctggcctcggcggagattcaacttctttgtgctggagaataacctcgaggccgtggcccggcacatgctcatctttagccttgctcttgaagaacctgaaaagatgggactgcaggagagatctgagaccttcctggaagtgtgggggaacgcactgctacgtcctccagtagctgcatttgttcgggcacaagccgatctgctcgcgcacctggtgcccgagcccgacagactcgaggaacaactaccatggctgtcactccgggctctcaagttccgagagcgggacgccctggaggcagtgttcaggttttgggccggtggggaaaagggtccgcaggccttccctatgagccgcctgtgggatagcaggctgaggcactacctgggttcccgatacgatgctcggaggggtgtgagcgattgggacctgcggatgaaactccacgacagaggagcccaggtcattcatcctcaagaattcagacgctggagagataccggggtcgcattcgagctgagggattcctctgcctaccacgtgccaaataggacgttagcttccggacgactgctgagttatcgcggagaaagggtcgccgccaggggttattggggtgatatcgctactgggcctttcgtggcctttggaattgaagcggacgacgaatctctccttcggacttccaatggccaacccgttaagactgccggagaaatcacccagcacaacgtgactgaactactacgcgacgtcgcagcttgggggcgggctcgcgcaacagggggggacctggaggagcagcaacacgctgaaggcagccctgagccggggactcctgctgcccccaccccggagtcctttacggtccacttccttcctttagacagtgcccaaaccttacaccacaaaagttgctataacggacgctttcagctgctgtacgtcgcctgcgggatggtacacttgctcatccccgagttgggggcctgtgttgcaccgggagggaacctcatcgttgagttagcgcggtatctggttgacgtgcgacaggagcaactccagggctttaatacgcgcgtcagggagctggctcaagcagccggattcgccccccaaacaggggcccgcccttcagagacattcgcccggttttgtaaatcccaggagtcagcgctcgggaacactgtgcctgctgtggagccaggcactcctccccttgacatattagcacagcccttggaggcctccaaccctgcactcgagggactcacacagcccctccagggcggtactccccattgcgaaccttgtcagttaccaagcgagtcacccgggagccttagtgaagttctcgcacagccacaaggggccctggctcctcccaattgcgagagcgactccaaaacaggcgtatag

SEQ ID NO: 29379 - DNA, 1827 bp, Artificial Sequence
  Description of Artificial Sequence: Synthetic coding sequence
atgctgccacttctggatagctctaagagagcgggcactcttgggtcaggatgcggcgtcccacgagtgcactctgcagccctttcccgggaggaaggcgctagtagagatatatggcgcataaaggtgtgggccagggtcatgaccaccccagcaggatccgggagtggatttggtagcgtttcatggtggggcctgtctccagcccttgacctccaagctgaacgagacgctactgtggatgctcttccaaccacgatggtgccacaacctgccgtcatattgccagggcctccagtggatcccgatagtcaggccgatacagtgcactccaatccagagctggatgtcttattgctgggctccgtcgatggccggcatctgcttagaacattgagcagggcaaagttttggccacggaggcgctttaacttttttgtcctcgagaacaacttggaagcagtggcacggcacatgctaatcttcagtctagccctggaggaaccggagaagatgggcctccaggagcgcagtgaaactttcctcgaggtttggggcaacgccctgcttaggccgccagtagccgcttttgttcgcgcacaagccgacctgcttgcacacctcgtaccagaaccagacaggctggaggagcagctgccatggctctctctgagggccctcaaatttcgcgagcgcgacgcgcttgaggctgtttttaggttctgggccggaggtgagaaaggtccacaagccttcccaatgagcagattgtgggactcccgcctgaggcactacctgggaagcagatatgatgcacgccgcggcgtctctgactgggacctccgcatgaagttacatgacaggggggcacaggtaatccatccacaagaatttcggcggtggagagacacgggggttgctttcgagctcagggattctagtgcctatcatgtgcccaatcgcacgcttgcaagtggccgcttgctgagctataggggagagagggtagccgctagaggctattggggcgacatagccactggtccattcgtagcgttcgggattgaggcagatgacgagtcactgttgcggacgtcaaatggtcagccagtgaagactgccggtgagatcacacagcacaacgttacagagctgctgcgggacgtggctgcgtgggggagagcaagggccacaggcggagacttagaagaacagcagcatgccgaaggttctccggaacccggtacgcccgctcccacacctgaaagttttacagttcattttttgcccctggactcagctcaaactctgcaccacaagtcctgttacaacgggagattccagctactgtacgtggcctgcggaatggtccatctactcatccccgaattgggcgcgtgcgtagccccaggaggaaacctgatcgtcgagctggctcgctatcttgtagacgtacgccaagaacaactccaggggttcaacacgcgcgtgcgcgagcttgcccaggccgccggtttcgcccctcagacaggagcgcgaccctcagaaacttttgctcggttttgcaaaagccaggaatcagccctcgggaataccgtaccagccgtggagcctggaaccccacctttggatatccttgcgcaacctctggaggcctctaaccccgccctggagggcctgacacagccgctgcagggaggaactccccactgtgaaccttgtcagctgcctagcgagtcacccggctcactgtccgaagttcttgcgcagccacagggagccctagctccacctaactgtgaaagcgattccaagacaggtgtgtag

SEQ ID NO: 29380 - DNA, 288 bp, Artificial Sequence
  Description of Artificial Sequence: Synthetic coding sequence
atgaccacacccgccgggagcggttctggctttggatcggttagctggtggggcttgtctccagctctggacctacaagctgagtcaccccccgtggaccctgactctcaggcagacactgtccattctaaccccgagttagatgttcttctgctgggctcagtcgatggcagacatctccttaggactctcagcagagcaaaattttggccccgccgaaggttcaatgtgtcttgggacgaggacgagagtcctgatagtcgggttctagagggcggcagggattag

SEQ ID NO: 29381 - DNA, 9279 bp, Artificial Sequence
  Description of Artificial Sequence: Synthetic coding sequence
atgtccgatgcaaataaagctgccatagccgccgaaaaggaggccttgaacttaaaactccctccaatcgtccacctgccggagaacataggtgtggatactccaactcaaagcaagctcctgaaatatagacgttctaaggagcaacagcagaaaattaatcagcttgtcattgacggcgctaagagaaacttggatcgcactctcggcaagcggactccactactaccacctccagattaccctcaaacaatgacgtccgagatgaaaaaaaagggtttcaactatatatatatgaagcagtgcgtggagtcaagcccattggtgcccatccagcaggaatggctggatcacatgctgcgacttattccggagagtcttaaggagggcaaggagagagaggagttgttggagtctttaatcaatgaggtttccagcgatttcgagaattccatgaagcgctacctggttcagtcagtgcttgtgaaacctcctgtcaaaagcctcgaagatgaaggagggcctctgcctgaatccccagttggactggactattccaacccatggcattccagttatgtccaagccaggaaccaaatcttctctaacctgcatattattcaccctaccatgaaaatgctactggacctcgggtacactactttcgctgatactgtgttgttggattttacaggtattagagcaaagggccccatcgactgtgagagcttgaaaactgatttgtcaattcagacgagaaatgccgaagagaaaataatgaacacttggtaccctaaggtaattaatctattcactaaaaaggaggccctggagggggtgaagccagagaagctggacgcgttttattcctgtgtgtcgactttgatgtccaaccaactgaaagatctcctccgccggaccgtggaaggcttcgtgaagttgtttgatcctaaagaccagcaaagattacccatctttaagatagaattgactttcgacgatgataaaatggaattttacccaacattccaggacctcgaggacaacgtgctgagtctggtggaacgcattgccgaggctcttcagaatgtgcagacaataccctcatggctttccggtacatccacacccgtaaacttggatactgagcttccggagcatgtgctgcactgggcagttgacactctaaaggctgccgttcaccggaatctggagggggcccgaaaacactatgagacctacgtggaaaaatataattggctcctggatggtaccgccgtcgagaatatagagacatttcagactgaagatcacacatttgacgagtacacagagtttatcgaaaaatttttgagccttgcctctgagataatgctccttcctcaatggatccactacaccatggtgagactagattgtgaagacttgaagactgggctcacaaacaaggccaaggctttcgccaacattctactgaacgacattgcctctaaatacagaaaggagaatgaatgcatttgcagtgagttcgaggccatcaaggaacacgccctcaaagtgcccgaaacaacagaggagatgatggacttgatcagttacgtcgagaaggccagaacggtcggcatagaagaactcatcttgagaatccaggagtctaaaagacaaatgtcctattttctggacgtgttcctttttccccaagaagacttggccttgaacgccaccgtcctgatgtggcctaggaagataaaccctattttcgatgaaaacgatgaactgatcgagaacgcaaaacataaaaaggagaatgagctaatggccaagcgagagaagttgatactggaaatcgagaaagaatctcggaggatggaagagttcaccgaatttgcagagttagaaaggatgcagcagtacgtaacagatgtgaggcagctacaaaaaagaatccaggaaagtgaggaggcagttcaatttatcaataaagaggaagagctttttaagtgggaactgacaaagtaccctgagctcgataagcttaaagtcaatatcgaaccatatcaaaaattcttcaacttcgtcttgaagtggcagagatcagaaaaacgctggatggacgggggttttctggacctgaacggcgaaagcatggaagcggatgttgaagaattttcacgggaaattttcaagactctgaaattttttcaaacaaagctcaagaaagaactgcaggaaaagcgtaaagcggccaggaagaggtcactggaggaagaaaaaattgaggaggagccaaaggacaatgctaccattactatgtgtcgcatgcgggcgcgtcactggaagcaaatttctgaaattgtcggctacgatttgactccagacagcggaaccacactgaggaaggtactgaagctgaacttgaccccatatcttgaacagtttgaagtaatctctgcgggtgcatctaaggaattttctctggaaaaagcaatgaacacaatgataggaacatgggaagacatagcatttcatatttctctctaccgcgataccggggtgtgcattctatcttccgtggacgaaatccaggcgattctggatgatcaaatcattaagactcaaacgatgagagggtccccatttatcaagcctttcgagcatgagatcaaggcctgggaggatcgcctgatcaggatccaagaaacaattgatgagtggctgaaggtgcaggcacaatggctctatctggagcctattttctgctcagaggacatcatgcagcagatgccggaagaaggtagacagttccagacagtggatcgtcactggagagatattatgaaattttgtgccaaggaccccaaggtcttagccgctacctccttaactggcttgctggagaaactgcaaaactgcaacgaactgctggaaaaaatcatgaagggactgaatgcctatcttgagaagaaaaggctgttctttccgcggtttttttttctgtccaacgacgaaatgctcgagatacttagcgaaacgaaagacccactgcgggtgcagcctcatttaaagaaatgttttgaaggaattgccaagttagaattcctgccaaacctggacattaaagcgatgtatagcagcgagggcgagcgcgtagagcttatagcattgattagtaccagtgccgcccgcggcgccgttgaaaaatggctgattcaagtggaagatcttatgctccgttcagtgcacgatgtcatcgcagcggccaggctcgcctacccagaatctgcgagaagggattgggtgcgggaatggcccggacaggtcgtgctatgcatcagtcagatgttttggaccagcgagacgcaggaagtgatcagtggcgggacagaggggctgaagaagtattacaaggagctgcagaaccaactgaacgagatagtggaattggtgcgaggaaagctctctaagcagacaagaactacactaggtgcactggtgaccatcgacgtgcatgcccgggatgtcgtgatggacatgatcaaaatgggggtgtcccatgacaccgactttttgtggctcgcccagctacgatactactgggaaaatgaaaatgcccgggtgcggattattaattgtaatgtgaagtatgcctacgaatacctcggcaattccccgcggctggtgatcactcccctcacggatcggtgctaccgaacactcatcggcgcgttctacctgaatctgggcggagctcccgaaggtcccgctggcacaggaaaaaccgaaaccacaaaagatcttgccaaggctctcgccgtccagtgtgtagtgtttaactgttcagatggcctggattaccttgccatgggaaaatttttcaaaggactggcttcatctggggcatgggcctgcttcgacgagttcaaccgcatagaactagaggtgctgagcgtggttgctcagcagattttatgcatccaacgagctatccagcaaaaactcgtggtgtttgtgttcgagggtacagaactgaaactcaaccccaactgttttgtcgccatcactatgaaccccgggtacgctgggcgcagcgagctgccagacaacttgaaagtattgttccgtaccgtagccatgatggttcccaactacgctttaatcgccgagatcagcctgtactcctatggcttccttaacgctcgccctctatcggtgaagatagttatgacgtaccggctctgcagcgagcagctgagcagtcagtttcactacgactatgggatgagggctgtgaaagccgttctcgtggctgccggtaatctgaaactgaagtacccaaacgagaacgaggatatcctattactccgctcaataaaagacgtgaacgaaccaaaattcctctctcacgacataccactgtttaatggcattactagcgatctgttcccagggatcaaactgcccgaggctgattaccatgagtttctagaatgtgcgcacgaggcgtgcaatgtgcacaatttgcagcctgtcaagttcttcttagagaagattatccagacatatgagatgatgattgtgaggcacggttttatgctcgttggggaacctttcgccgctaagactaaggtgttgcatgtgttggccgacaccctgacccttatgaatgaacatggatatggagaagaggaaaaagtgatctatcggacagttaaccctaaatctatcacaatgggtcaattattcggacagtttgatcccgtgagtcacgagtggactgatggcattgtggccaacactttcagagagttcgccctgtcagagaccccggacaggaaatgggtggttttcgacgggcctattgacacgctgtggatcgagtctatgaatactgttctcgatgacaataaaaaactgtgcctgatgtccggggagattattcagatgtcccctcagatgtctctcatttttgagaccatggatttgagccaggcctcgccagcaactgtaagtcgctgtggcatgatctacctggagccctcccagctgggttgggagccgctggtcagcagctggcttaactcgctgaaaggccctttgtgcgagcctgagtaccaggccctgttaaggggcctttttgcttggctaatcccacctagcctgaaccagcgggtggagctctttcaactgaattacctatatacaaccatagtgagcaaaattctgaagatcctgatcactttcaggatttccaactattttaagtacgtgcctttgaagactcagtgtacattcatcaaatttttccttcaccagcaggcttgttttatattttccctaatttggagcataggaggttcttgcgacacggacggcagacgtgtctttgacacctttatacgactgatcatcctaggcaaagacgacgagaaccccgtgcctgatagcgtcggcaaatgggagtgcccatttgacgagaagggactggtttacgattacatgtatgagctgaagaacaagggccggtgggttcactggaatgaactcattaagaatactaacctgggggacaagcaaatcaaaattcaggatatcatcgtccctactatggataccatcaggtacacatttcttatggacttatcgatcacgtatgctaagcccctgctgtttgtgggacccacaggaacgggcaaaagcgtttacgttaaggacaagctcatgaatcacctggaaaaagaccaatatttccctttttacattaacctgtctgctcgcactagcgcaaatcaggtgcagaacataatcatggctcgtctagataagcgtcgaaagggtgtgtttgggccaccaatgggcaaaaagtgcatcattttcatcgatgatatgaacatgcccgctctcgaaaagtacggagcacagccccctatagaacttttgcgtcagttctttgactgtggccattggtacgacctcaaggatacttccaaaatcactctggttgatatagagcttatcgctgctatgggcccaccagggggaggcaggaacccagtcaccccccgctgcatacgccacttcaatatttgttctatcaactcttttagcgacgaaaccatggttcgtatctttagcagcatagtcgcattctacttacggacccacgagtttcccccggagtatttcgtgatcggtaaccagatcgttaatgggacaatggaaatttacaaacagtcagtggagaacctcctcccaacaccaacaaaatcacactacacatttaatctcagggacttctcccgcgtgattagaggatgtctactgattgaacgtgatgcggtggctaataagcacaccatgattcgattgttcgtgcatgaagtgctcagggtgttctatgatcggctcataaacgatgacgatagacggtggctgtttcagttgaccaagaccgtaattaaagaccactttaaggagtccttccactctatattcagccatctgagaaaacagaacgctcccgtaacagaagaggacttgagaaatctgatgttcggcgattacatgaacccagatctggaaggtgacgacagggtttacattgaaatccccaatattcatcactttagtgatgtggttgaccagtgcctcgacgagtataatcagactcataaaaccaggatgaatctcgtgatttttcgctacgttctggaacacttgagcagaatctgccgcgttttgaaacagtcgggcggaaatgcacttctggttggtctcgggggttcagggcgccagagtctcaccagattggcaacatccatggccaagatgcacatttttcagcccgaaatatcaaagtcttacggcatgaatgagtggagggaagatatgaaaagctttattgccgtcccggttaccaacagaatcgtggacaacaagagcaagattctggagaaaaggctgcgctatcttaatgaccacttcacttacaatctgtactgtaacatttgcagaagtctctttgaaaaggataaactgctcttttcattcttgctctgcgcaaaccttctccttgcccgaaaggaaatagaatatcaagaattgatgtttctgttaacaggcggagtttccctgaagtccgctgagaagaatcctgatcccacctggctccaggataagtcttgggaagagatatgtagggcctctgagttccccgcttttagaggattgagacagcatttctgtgagcatatttacgaatggagggagatttacgattccaaagagccccacaacgcaaagtttcccgctccaatggacaaaaatctaaacgaattgcaaaagattatcatcctgcggtgtctgcgacctgacaaaattaccccagccatcactaactacgtgactgacaagctcggaaagaagttcgtggagcctcctccctttgatctcacaaaatcttacctagactcaaattgtacaattcccctgattttcgtcctctcaccaggggctgacccaatggcaagcctcttaaagttcgctaacgataaaagcatgagcggtaataaattccaggctatttcattaggacaagggcaaggccctatcgcagctaaaatgattaaagccgcgattgaagaaggaacctgggtctgcctccagaattgccatcttgccgtgagctggatgcccatgctcgagaagatctgcgaagactttactagcgagacctgtaattcctcatttcgcctttggttgacaagttacccctcctccaaatttcccgtgaccattctacaaaatggagtgaagatgactaacgagccaccaacaggcctgcggctgaatctgctgcagagctacctgactgatcccgtctctgatcctgaattcttcaaagggtgtcgcggaaaggaactggcctgggagaagctgttatttggtgtgtgctttttccacgccctggtccaggaaagaaagaagttcggacctctggggtggaatatcccgtatggctttaacgaaagcgacctacgtatcagcattaggcagttacagctgtttatcaacgaatacgataccatcccctttgaggccatctcttatctgaccggtgaatgcaactacggcggccgggttaccgacgactgggatcgccgactgttactgacaatgttggcagatttctacaacctctatattgtggaaaacccccactacaagtttagcccaagcggcaattatttcgcccctccaaaggggacgtatgaggattacattgagtttatcaagaagctgccatttactcagcatcctgaaatttttgggttacatgagaatgttgacatatccaaggatctgcagcagaccaaaactctttttgaatctctgttgcttacccaggggggaagcaaacaaaccggcgcttctggctctacagaccagatcctgttagagataacaaaagacatccttaacaagctccccagcgacttcgacattgaaatggctctaagaaagtatcctgtgaggtacgaggaatccatgaacacagtgctggtccaagagatggagcgctttaacaacctaatcatcactatccgaaatactctaagagacctcgagaaggctatcaagggcgtggtggtgatggactcggcactggaggcattaagtggctccttgctggtgggcaaggtccccgagatatgggccaaacggagctatccatccctgaaaccactgggctcgtacatcactgatttcttggcgagactgaacttcttacaggactggtacaactcgggaaagccatgtgtcttctggttgagtgggtttttcttcacccaggctttcctgaccggtgctatgcagaattacgcccgtaagtacacaacacccattgatctactgggatacgagtttgaggtgatcccatcggatacttccgacacaagccctgaagatggtgtttatattcatggactctatctagacggagcgagatgggatagggaatctggcttgttagctgagcagtaccctaaattgctgttcgatctcatgccaattatttggatcaaaccaacccagaagtctaggatcatcaagagcgatgcgtatgtgtgcccattatataagacttctgagcggaagggcaccctgtctacgaccggtcactccacaaactttgtgattgctatgttactgaagacagaccagcccacgaggcactggataaaaaggggggtagcactgctgtgccagctggatgattag

SEQ ID NO: 29382 - DNA, 13374 bp, Artificial Sequence
  Description of Artificial Sequence: Synthetic coding sequence
atgaccatggctccggatgtccggctcgagtacttggaagaagtggcctcaatcgttctaaaattcaaacctgacaaatggagtaaattaatcggcgctgaggagaacgtggccctgttcaccgagttttttgagaagcccgatgtccaggtgctggttttaactttgaacgctgcgggaatgataatcccgtgcttggggttcccacagtctctcaagtcaaagggcgtctattttatcaagaccaagagtgaaaacatcaataaagataactaccgagcccgtctcctctacggagacatatcacctactccagttgaccagctcatagccgtggtcgaggaggttctgagctctctcctgaatcaatcagaaaatatggctggatggccccaggtggtgagtgaagacattgttaaacaggtccaccgcctgaagaacgagatgtttgttatgagcgggaagattaaaggaaagacgcttttaccgattccagaacacctgggatctcttgacggtacactagagtctatggaacggatcccaagtagcctcgacaacttactgcttcatgctattgagaccacaatcatagattggtcgcaccagattcgcgacgtcctttcaaaggattccgcacaagcactcctcgatggcctgcaccccttacctcaggtcgaattcgaattttgggacactaggcttcttaatttgaagtgcatacacgagcagcttaatcggcccaaggtgaacaagatcgtggaaatcttggagaaggcaaaaagttgctactggccggcactccagaacgtgtatacgaacgtgacagagggattgaaagaggcaaacgatatcgtactatacttgaagcctctacgcatcctgttggaagaaatggaacaggccgatttcacaatgctgccaacttttattgctaaagtgcttgatactatctgctttatctgggccacgagcgagtattacaacacacctgccagaattatcgtgatcctgcaggagttctgcaaccagattattgagatgacccggacgtttctgtctccagaggaagtgttaaaagggctgcagggggagatcgaggaggtactcagcggtatttcgctcgccgtgaacgttctgaaggagctttaccagacctacgacttctgttgtgtgaatatgaaattattctttaaggataaggaaccagtgccatgggaattcccttcaagcctcgctttctcccggattaacagtttcttccagcggatccagacaattgaggagttgtataaaacggctattgaatttctcaagttggagaaaatagaactggggggagttcgcggtaacctgctgggctctctggttactaggatttatgatgaagtgtttgaactggtcaaggtctttgctgactgcaagtatgatccattagatccgggagattccaattttgaccgtgattacgccgattttgagatcaaaattcaagatctggatcgccgcctcgcaactattttttgtcagggtttcgatgattgttcatgtataaaatcctcagcgaaactcctttacatgtgcggaggtctcatggagcgcccactcattttagccgaagtggcccccagatactcagtaatgttagagctgttcgacgccgaactggataacgccaaaatactgtacgacgctcagatggcggcctctgaggagggcaacatccccttgatacacaagaacatgccccccgtggccggacagctgaagtggtccttggagctgcaggaaagactcgaggtgtccatgaaacacctgaagcatgtggaacaccctgtcatgtctggagcagaagcgaagctcacttaccagaagtacgatgagatgatggagctcctgaggtgtcacagggaaaaaatataccagcagtgggtggctggagtagatcaggactgccacttcaacctaggccagcctctgatcctgagggacgcagccagcaacctcatacatgtgaatttttcaaaggctctcgtggccgtgctccgggaagtcaagtacctcaatttccagcaacaaaaggagattcccgactcagccgagagccttttcagtgaaaatgagacgtttcggaagtttgttggcaatttggagctaattgtcgggtggtacaacgagattaagaccattgtgaaggcagtcgaatttctgttgataaagtccgaactggaggctattgatgtgaaactcttatcagccgaaacaaccctgttctggaatggtgaaggggtcttccagtatatccaggaagtgagggagatcctccataacctgcagaaccggatgcagaaagccaaacaaaacattgaggggattagtcaggcaatgaaggactggtccgccaaccccctattcgaacgtaaagataataagaaggaagccctgctggacttggacggtcgcattgctaacctgaataaacggtatgccgcggtgagggacgccggggtcaagatacaagcaatggtcgcggagaatgccgaattatttcgggccgacactctgtcgctgccttggaaggactacgtgatatatatagacgacatggtgctggatgaatttgaccagtttataagaaaatctttatcattcttaatggacaacatggagtctattgccccattattcgagatccggatggaactggatgaggacggtttgacctttaatccaacactggaggtcgggagcgaccggggcttcttggccttgattgagggcctagtcaacgacatttacaacgtcgcccgcctcattccaaggctcgctaaagatcggatgaattataaaatggacctggaagataacacagacctgatcgagatgcgagaggaggtctcctcactagttatcaacgcaatgaaagaggccgaggagtaccaggattcattcgagcgatactcctatctgtggacggacaaccttcaggagttcatgaagaactttctgatttacggctgcgctgttacagcagaggaccttgacacatggacagatgacactatacccaagactcccccaactcttgcccagttccaggagcagattgatagctacgagaaattgtacgaagaggtgagcaagtgcgagaataccaaagtttttcacggatggctgcagtgtgactgcagacccttcaaacaggccctcctgagcacaattcggagatggggctttatgttcaagcggcacctgagtaaccatgtgacaaacagcctggctgatcttgaagcctttatgaaggttgccagaatgggattgacaaagccactcaaagagggggactatgatgggctcgtggaggtcatggggcatctgatgaaggttaaagaaagacaggccgccacagacaacatgttcgaaccactcaagcaaaccattgagttgctcaagacatatggcgaggagatgccagaggagatccatctgaagttacaggaattaccggaacattgggcgaacacaaagaaactagccatccaagtcaagctcacagtagctccactgcaggctaacgaggtcagcattctccgaaggaaatgccagcagtttgagctgaagcagcacgaatttcgcgagagatttagacgggaggcgcccttctccttttcagacccgaacccatacaaaagcctgaacaaacagcagaaaagtatttcagccatggagggcatcatggaagcgttgtcaaaatctggcggcctattcgaagttcctgtgcccgactacaagcaactgaaggcctgtcacagggaagtgcggcttcttaaggaattgtgggatatggttgtggtggttaacacatccatcgaagattggaagaccaccaaatggaaggacataaatgttgagcagatggacattgattgcaaaaagttcgccaaggatatgcgatctttggacaaggagatgaagacatgggatgccttcgtgggtctcgacaacacggtgaaaaacgtcatcacgtccttgcgggcagtgagcgaactgcagaatcccgcaattcgagaacggcactggcagcagctgatgcaagcaacacaagtaaaattcaaaatgtctgaagaaactacactcgccgaccttctccagttgaatctgcacagctacgaagatgaggtcagaaatatcgttgataaggccgtgaaggaatccgggatggaaaaggtgctcaaggcattggatagcacctggtccatgatggaattccagcatgagcctcaccctcgaacagggaccatgatgctgaaatcatccgaggtgttggtcgagactctggaggataatcaagtacagctgcagaatctgatgatgtccaaatacttggcacatttcctgaaagaagtgacaagctggcagcagaagctcagtacggctgacagtgtgatctcgatctggtttgaggtgcaaaggacatggtcccatcttgaatctatttttatcggctctgaggatattcgtacccagctgcctggagattcgcaacgttttgatgacattaaccaagaattcaaagctctgatggaagacgccgttaaaactcctaatgtggtcgaggctacctcaaagcctgggctgtataataagctggaagctctgaaaaagtctctggcaatctgcgagaaggcgctggccgagtacttggaaacgaagaggctggccttccctagattttacttcgtgagcagcgccgaccttttggatattctctccaatggaaatgaccctgtcgaggtgtctagacacctctccaaattgttcgacagcctgtgtaagctgaagtttcgactagacgcttcagataaacctctgaaagtcggtcttgggatgtattcaaaggaagacgaatacatggtgttcgatcaagagtgcgatcttagcggtcaggtggaagtatggttaaatagggtacttgacagaatgtgcagtaccttaaggcacgaaattcccgaggccgttgtcacctacgaggagaagccaagggaacagtggattttggactaccccgcacaggtcgctctgacatgcacccagatttggtggaccaccgaggtgggtctggctttcgcacgtcttgaggagggctacgagaatgctattagagattataacaaaaaacagatcagtcagctgaatgtactgatcacacttctcatgggaaatcttaacgccggtgacaggatgaaaattatgacgatatgcaccatagatgttcatgcaagggacgtagtcgcgaaaatgatagttgtggagtcgtcccaggcctttacttggcaagctcagctgcgacatcgttgggacgaggagaaacgccactgtttcgctaacatctgtgacgctcaaatccagtactcatacgagtatctcggaaataccccacgccttgtaatcacccccttgaccgacagatgttatatcactctgacccagtccctgcaccttatcatgggcggggcacctgcagggcccgccggtaccggcaaaaccgagacaaccaaggatttgggcagggcactcggcactatggtttatgtgtttaattgcagtgagcagatggactacaaaagctgcggcaatatttacaaagggttggcccagaccggggcttggggatgtttcgatgaatttaacaggatcagtgttgaggtgctctctgttatagcggtgcaggtaaagtgcgtacaggacgctattcgtgcaaagaaaaaggcctttaatttcctcggtgagataatcgggctaatcccaaccgtcggaatattcataaccatgaacccaggatatgccgggagggctgagcttcccgagaatcttaaggcactttttaggccctgtgcgatggtagttccagacttcgaactgatttgcgagatcatgctcatggctgagggcttcttggaagccaggctgctggctcggaaatttatcactctgtacacgctttgcaaagaactgctgtctaaacaggaccactacgactggggcttgagagccatcaagagcgtgctggtggtggcaggcagcctgaaaaggggagaccctagcagagctgaggatcaagtgctcatgcgggcccttcgagactttaacattccgaagatcgtcaccgatgacttaccagtgtttatgggcttgatcggggacctgttccctgctctagacgtgccacggaagcgcgatctgaacttcgagaaaatcattaagcagtcaatcgtcgagctgaaactgcaggctgaggactcgttcgtgctgaaagtggttcagttggaggaactcttacaggtccgccactccgtgttcattgtggggaatgccggatccgggaagtcacaagtcctgaagtcgctgaacaaaacatatcaaaatcttaagagaaagcccgtggctgttgacctggaccctaaagccgtgacttgtgatgaactttttggcatcattaatcccgtcacgcgagaatggaaggacggtttattctcaacgatcatgcgggaccttgccaacatcacccatgatggcccaaaatggatcatcctagacggagacatcgatccaatgtggattgagagtctaaacactgtgatggatgataacaaagtgcttacgttggcgtctaacgagaggatccctctgaaccggacgatgcgcctggtctttgagatctcacatctcagaacagctacgcccgcaacggtcagtcgcgctggtatcctgtacataaatcccgccgacttgggctggaatcccgtggtgtccagctggattgaaagacgcaaagtacagtctgaaaaagcaaatctcatgattctcttcgataaataccttcccacatgtttggataagctgcgatttgggttcaagaaaataactccggtgccagaaataacagtaatccagacaattctgtacctactggaatgcctgcttaccgagaagactgtgccccctgactctccccgtgaattgtatgaactctactttgtatttacttgcttttgggctttcggaggcgcgatgtttcaggatcaattggtggactaccgagtggagttttccaaatggtggatcaatgaattcaaaaccatcaagttccctagtcaggggactatctttgactactacatagacccggacacgaaaaagtttctcccttggactgataaggtcccaagcttcgaactggaccctgacgtaccactgcaagcttctctggtgcatacgactgagaccattcgtattagatacttcatggacctgcttatggaaaaaagttggcctgttatgctggtggggaacgctggcaccggtaagtccgttctgatgggggacaaattggaaagtcttaataccgataactacctcgtacaggccgtcccattcaatttctatacaacctccgccatgctgcagggcgtactggaaaaaccgctggagaagaagtccgggcggaactacggcccaccaggcacgaaaaagctggtttacttcatcgatgacatgaacatgccagaggttgacaaatatggcacagtggccccgcatacacttatcagacagcacatggatcacaggcattggtatgatagacataaactgaccttaaaggacattcacaactgccaatatgtggcttgcatgaaccctacatcaggtagcttcaccatagactcccggttgcaacgtcacttttgcgtctttgctgtatccttccccggccaagaagcactgaccaccatatacaacactatcctcactcagcacctggcattcagatccgtcagcatggccatccagaggatttcttcgcagctggtggccgcagcactggccctgcaccagaaaattaccgcaaccttcctgcccactgccatcaaattccactacgttttcaatttaagagacctctccaacatcttccagggcctattattttcaacagcggaggtgttgaaaacacccctggatttagtgcggctgtggttgcacgagactgaaagagtgtacggtgacaaaatggtggatgagaaggaccaggagaccctgcacagagtgacaatggccagtactaaaaaattttttgatgatttaggggacgaactcctattcgcaaaacctaacattttttgccacttcgcacagggaataggtgaccccaagtatgtgccggtcactgatatggcccccctgaataaacttctcgtagacgttttagactcatacaacgaggttaatgccgtgatgaacctggtgctgtttgaggacgccgttgcccacatctgtaggatcaaccgcatattagagtctccccgcgggaacgccctacttgtaggggtgggaggctcaggaaaacaaagcctttctaggctggcagcatacatcagtggcctggacgtcttccagatcactttaaagaagggttacggaatccccgatctaaagatcgatctggctgcccagtacattaaagctgctgtcaaaaatgtcccctcggtgtttctcatgacggacagccaggtggcagaagaacagtttctggttctaattaatgatcttctagcaagcggcgaaatacccggccttttcatggaggacgaggtggagaacataatctctagtatgcgcccacaggtgaaaagcctgggcatgaacgatactagagaaacttgctggaagtttttcattgaaaaagtcaggagacagctcaaagtgatcctgtgcttttcacccgtgggatcagtcctgcgagttagagctcgaaaattccccgctgtcgtcaattgcaccgcaattgactggtttcacgaatggcccgaggacgctttggtatcagtgtccgctagattcctggaagaaaccgagggcattccatgggaggtgaaggcatctatttctttcttcatgagctatgttcatactacagtgaatgaaatgtcacgcgtgtatctggctactgaacgtcgctataattacaccacccctaaaacatttcttgaacagatcaaactgtaccagaacctcctggcgaagaaaaggaccgaactggtggcgaagatagagcgtttggagaatggcctgatgaagcttcagagtactgcaagccaggttgacgatcttaaggcaaagttggccattcaagaggccgagctcaagcaaaagaacgaatccgcagatcagttgatccaagtggttgggatagaagcagagaaggtgtccaaggaaaaggccatcgccgaccaggaagaggtgaaggtggaggttattaacaagaacgtgaccgagaagcagaaggcctgtgagaccgacctcgcaaaggccgaaccagccctgttggcagcccaggaagccttagataccttgaataagaataacctcaccgaactcaagtcatttggctcaccgccagatgcggtagtaaatgtgaccgctgctgtcatgattttaaccgcccccgggggaaagattcccaaagataaatcatggaaggccgctaagatcatgatgggtaaggtggacaccttcctggatagtctgaagaagttcgacaaggaacatattcccgaggcgtgtcttaaagcatttaaaccatatcagggaaatcctacatttgatcccgaattcatcaggtccaaaagcacagctgctgctgggctgtgttcatggtgtatcaatatcgtcaggttttacgaggtgtattgcgacgttgctcccaagcgccaggcgctggaggaagcaaatgcagagctcgcagaagcccaagagaaactaagtcgcattaagaacaaaatagccgagttgaacgcaaatctgtctaaccttacatcggcgtttgaaaaggccactgcagagaagatcaagtgccagcaagaagcggatgctacaaaccgcgtgatcctgttagcaaaccgcctcgtgggaggtctggccagcgagaacattcgatgggcagagtccgtcgaaaactttcggtcccagggcgttaccctttgcggcgacgtcctgctgatctccgcattcgtcagctatgtgggctatttcacaaagaagtaccgtaatgaacttatggagaagttctggatcccttacatacataacctgaaggtacctatcccaattacaaatggattagatcctctgtccctgttaactgacgatgccgatgttgccacgtggaataaccaggggctgcctagcgacagaatgagtactgagaatgctaccatcctggggaatacagaacgatggcccctcattgttgacgcgcagctccaggggattaagtggattaaaaacaagtataggtccgagttgaaagccattagactcgggcagaaatcataccttgatgtcatcgagcaagctatcagcgagggagatacactcctgatcgagaatattggcgagaccgtggatccggttctggaccccctgttgggtaggaatactataaagaaagggaagtacatcaagattggcgataaggaagttgagtaccacccaaagttccgactgatcctccataccaaatatttcaatccacactataagccagagatgcaggctcaatgcaccctgatcaactttctagtgactcgcgatggattggaagatcaactgcttgcggcggtggtcgcaaaggaaagacctgaccttgaacagttaaaagctaacctgacaaagtcgcagaatgaattcaaaatagtcctcaaagagctggaagattctctgctggccaggttgagcgctgccagcggaaacttccttggagataccgcattggttgaaaaccttgagacaacaaagcataccgccagtgagatcgaggagaaggtcgtggaggccaaaatcactgaggtgaaaatcaatgaagctagggagaattataggccagcggccgaacgagctagtctgctgtattttatcctaaatgacctcaacaagatcaaccccgtgtatcagttctccctgaaggctttcaacgtcgttttcgagaaagcaattcagagaaccactccagctaacgaggtgaaacagagagtcataaacctgactgatgaaatcacgtattcggtgtacatgtacaccgctagaggcctgttcgaacgggacaaactgatatttctcgcgcaggtcacatttcaagtgttaagtatgaaaaaggagctgaaccctgtcgaactggattttctccttaggtttccgtttaaggccggcgtcgtgtctcctgtggatttcctgcaacatcagggctgggggggaatcaaagcgcttagcgaaatggacgaattcaaaaacctggactctgacatcgaaggtagcgctaaaaggtggaaaaagcttgttgaaagcgaggctcccgaaaaggagatttttcccaaagaatggaagaacaaaactgctctgcaaaagctctgtatggttagatgcctgcggcccgataggatgacctacgccatcaagaacttcgtggaagaaaaaatggggagtaaatttgtagaaggcaggtctgtcgagttttcaaagtcatacgaagaatcctctccttcaacatccatcttttttatcctgtcacccggagtcgacccgctcaaggatgtggaggcactgggtaaaaagttgggtttcactatcgacaacggcaagctacacaacgtcagcttggggcaggggcaggaagtggtggcggagaatgctttggatgtcgctgcagagaagggccattgggtgatcctgcagaacattcatttagtggctaggtggctggggaccctcgacaaaaagctggagcactatagtactgggagtcacgaagattaccgcgtttttatctcagccgaaccagcaccctctccagagacgcacattatcccccaaggaattctagaaaacgctatcaaaataactaacgagccaccaacaggaatgcatgctaaccttcataaagccctagacctgttcactcaagacaccctggaaatgtgtaccaaggaaatggaattcaagtgcatgctcttcgcactgtgttactttcatgctgtggttgctgagaggcggaaatttggcgcccaaggttggaatcgatcgtatcctttcaacaacggagatctcacgatatcgataaatgtcctgtataattacctagaggccaatccaaaggtgccatgggacgatttacgctacctctttggggagataatgtacgggggccacatcacagacgattgggataggcggctctgtagaacctaccttgctgagtacataaggaccgagatgctagagggcgacgttctgctcgccccaggatttcagatccctccaaatctcgattacaaaggataccacgaatacatagatgaaaatctcccacctgagtctccttacctctatggcctgcaccctaacgctgagattggtttcttaacggtcacttctgagaagcttttcaggaccgttctggagatgcaaccgaaggagacagactccggggctggcactggcgtttcgagagaagaaaaagtaaaggctgtcttggacgatatcctggagaaaataccagagacgttcaatatggcggaaatcatggctaaagcagccgagaaaaccccttacgtggtcgtggcctttcaggagtgtgagagaatgaacatcttgaccaacgagatgcggcgtagcctcaaagagcttaaccttggactgaaaggggaactgaccattaccaccgatgtggaagaccttagcaccgccctgttctacgatactgtacctgatacctgggtggccagggcctacccatcgatgatgggcctggccgcctggtacgccgacctgttgttgagaattagggaactcgaagcctggactacggattttgcattgccaacaaccgtgtggctggcaggctttttcaacccccagagtttcctgacagccatcatgcaatccatggcaaggaagaatgaatggccattggacaaaatgtgcctcagcgtcgaggtaactaagaaaaatcgcgaggatatgacagccccaccccgggaaggttcctatgtgtacggactgtttatggagggcgctaggtgggatacccagacaggcgtgatcgctgaagcacgcctgaaagagctcacaccagctatgcctgtgatttttatcaaggccattcccgtggaccgcatggagaccaaaaatatttacgagtgtcccgtttataaaacccgtattagaggtcctacttatgtgtggacgttcaatttgaaaacgaaggaaaaggctgctaaatggattctagctgctgtcgcactcctactgcaggtttag

SEQ ID NO: 29383 - DNA, 13458 bp, Artificial Sequence
  Description of Artificial Sequence: Synthetic coding sequence
atgaccatggcccccgacgtccgtctagagtatctagaggaagtggcctccattgtccttaagttcaaacccgacaagtggtcaaagttgattggtgcagaagagaatgttgctctgttcaccgagttcttcgaaaaaccagacgtgcaggtcctggttctcactcttaatgctgccgggatgatcatcccatgcctcggcttccctcagtctctcaaatccaagggagtgtactttataaaaacaaaatcagaaaatataaataaagacaactaccgggcacggctcctgtacggcgatatcagccccaccccagtggaccagctgattgccgttgtggaagaggtgctcagctctttactaaaccagtcagagaacatggcgggctggcctcaagttgtgtcggaagacattgtgaagcaggtgcatagactgaagaacgaaatgttcgtcatgtctggcaagataaaaggcaaaactttgctgccgataccagagcatcttgggtctcttgacggcacactggaatccatggagcgcattccttcaagcctagacaatctgctcctacacgcgatagaaacaacaattattgattggtcccaccagattcgtgacgtcctctcaaaagacagcgctcaggctctgctggacggtcttcaccccctcccacaggtggagtttgagttttgggacacccgactgttgaacctcaaatgcatccacgaacaattgaaccgcccaaaagtgaacaaaattgtggaaatcctggagaaagccaaatcttgctactggccagcactccaaaatgtctataccaatgtgactgaaggacttaaggaggctaacgacattgtgctttacttgaaaccgctgcgcattttgcttgaagaaatggagcaggccgacttcaccatgctgcctacatttatcgccaaggtgctggatactatttgcttcatctgggccaccagtgagtattacaacacccctgcccgcattatcgtcatcctgcaagagttttgtaaccagataattgaaatgactagaacctttctgagcccggaggaggttcttaaagggctccagggggaaattgaagaagttctgtctgggatctctctggcagttaatgtgctgaaggaattgtaccagacatatgacttctgctgtgttaacatgaaactctttttcaaagacaaagagccagtcccatgggaatttccttcgtccctggctttctcaagaatcaatagtttctttcagaggattcagacaattgaagagctgtataaaaccgccatcgagtttttgaagcttgagaaaatcgagttgggcggcgttcgtggcaacctgctaggctcactggtcaccagaatttatgacgaggtgtttgaattagtcaaagtctttgccgactgcaagtacgaccccctggaccccggggattccaactttgacagggattacgccgactttgagataaagattcaggatttggatcgtcggctcgccaccatcttttgtcaaggatttgacgattgctcatgcattaagtcgtccgcgaagttattgtacatgtgtggagggttaatggagaggccactgatccttgcagaagttgcgcccaggtatagtgtgatgctggagttgtttgacgccgaactggacaacgccaaaattctctatgatgcgcagatggcggcctctgaagagggcaatattccacttattcataagaatatgccccctgtcgctggtcagctcaagtggagcctagaactgcaggagcggttggaagtgagcatgaagcacttgaaacacgtcgaacaccctgtgatgtccggagcagaggccaagctgacataccagaaatatgacgagatgatggagctcctccggtgtcacagggagaagatctaccagcagtgggtagcgggcgtcgatcaggattgccacttcaatttaggccaaccactcattctgcgagatgctgccagcaaccttatccatgtcaatttttccaaggcacttgttgctgttctgagagaggtcaaatatcttaattttcagcagcaaaaggaaatccccgactctgctgaatctcttttttctgagaacgagaccttccgcaagtttgtcggtaacctcgagttaattgtcgggtggtataacgagatcaaaactatcgtaaaggcagtggagtttctccttatcaagtcagagctagaggccatcgacgttaagctgctgagtgccgaaaccaccctgttctggaacggggagggcgtcttccagtatattcaggaggtgcgcgagatcttgcacaacctgcagaatcgcatgcagaaggcaaaacagaatatagaaggcatcagccaggctatgaaggactggtctgctaacccactgtttgaaaggaaagataataaaaaggaggctctgctcgatctcgatggaaggattgccaatctcaacaagcggtacgcagctgtgcgtgatgccggggtcaagattcaggccatggtcgctgaaaatgcagagctgttcagagctgacactttaagtttaccttggaaggactacgtaatatacatcgacgatatggtgctcgatgaattcgatcaattcattaggaaatctcttagtttcctgatggacaatatggtcatcgacgaatctattgctccactgttcgagatccgcatggagctggatgaagacgggctgacattcaatccaactctagaggtggggagcgatcgcggctttttggctctgatcgaggggctggtgaatgatatctacaacgtggcacggctgattccgaggctggccaaggatcgcatgaattacaaaatggacctggaggataacaccgatcttattgagatgcgggaagaggtgagtagtctcgtgatcaacgcaatgaaggaagctgaagaatatcaggacagtttcgagaggtattcttacctctggactgacaacttgcaagaattcatgaaaaactttctgatctatggctgtgccgtcactgcagaggatctcgacacatggacagacgacaccatcccaaaaacccctcctactcttgcccagtttcaagagcagatcgacagttatgagaaattatatgaagaagtctcgaaatgtgaaaatacgaaggtgttccacggctggttacagtgcgactgtcggccattcaaacaggctctgctgagtaccattaggaggtggggctttatgtttaaacgacacctctcgaaccacgtgacgaactcactggctgacctggaagcgttcatgaaagtggctcggatgggccttacaaagcctctgaaagagggggattacgatggcctcgtcgaggtgatgggccatttgatgaaggttaaggagcgccaggctgcaacagataatatgttcgagccccttaagcagactattgaactgctaaaaacgtacggcgaggaaatgccggaggaaatccatttaaagctgcaggaactgcccgagcattgggctaacacgaaaaaactggccatacaggttaagctcactgtggcccctttacaagccaacgaagtgagcattctcagaaggaaatgccagcagttcgaactgaaacaacacgaattccgtgaacgttttagacgagaagccccgttttccttttcagatcccaatccttacaaatccctgaataaggtattcctcctaaaagggattatggaggccttaagtaaaagtggaggattgttcgaagttcctgtgcccgactataaacagttgaaggcttgccatagggaagtaagattattaaaagagctctgggatatggttgtggtagttaatacctctattgaagactggaaaaccactaagtggaaagatattaatgtggagcagatggacatcgactgtaaaaaatttgctaaagatatgcggtctttggacaaagagatgaagacttgggatgctttcgtcgggctcgacaatactgtgaaaaatgtcatcacatccctgcgtgctgttagtgagctgcagaaccctgccattagggagagacattggcagcaactgatgcaggctacacaagtgaaattcaagatgagtgaagagacaacgctggccgatcttttgcagttaaacctccatagttatgaagacgaggttaggaacatcgtcgataaggcggtgaaagagtccggaatggagaaggtgctcaaggcattggattctacctggtccatgatggagtttcaacatgagccacaccccagaacagggacgatgatgctgaaatcctccgaggtgctcgtggaaacactggaagacaatcaggtacaactgcagaacctaatgatgtcaaagtatctcgcacacttcttaaaagaagtgacgagctggcaacagaagctaagcacagcagatagcgttatcagcatctggttcgaggtgcagcgaacctggtctcacctcgagtcaatatttatcggatctgaagatatacgaacccagcttcccggcgatagccagagattcgacgatatcaaccaggaatttaaggcgttgatggaggatgcagtgaaaactcccaacgtggtggaggcaacgtctaagcccggcctttacaataagctggaagcactaaagaaatccctcgcaatctgcgaaaaagcattagccgagtatttggagactaagaggttggcttttccacgcttctacttcgtatcatcagcagacctcctggatatactgagcaacggcaatgatccggtggaggtctctagacatctgagcaagttgtttgactctctttgtaagctgaaatttaggctggacgccagcgataagccactcaaagtggggctgggtatgtatagcaaagaggacgaatacatggtcttcgaccaagaatgcgacctgtctggacaagtggaggtgtggctgaacagggttctcgaccgcatgtgttctacattaagacacgaaattcccgaagccgtcgttacttatgaagagaaacccagagagcagtggattctggattatcccgctcaaatctggtggacaactgaggtgggcctcgcttttgcccgtcttgaggagggctacgagaacgctatccgagactataacaagaagcagatctcccagctgaatgtcctaattaccttgttgatgggtaacttaaatgcgggtgaccggatgaaaatcatgaccatctgcaccattgacgtgcacgccagggatgtggtggctaaaatgatcgtggagagttcccaggcattcacctggcaggcccagctaagacacagatgggacgaagagaaaagacactgctttgctaatatatgtgatgctcaaatccagtacagttatgagtatctgggcaacacccctcggctcgtcattacacccctcacagatcgctgctacattaccttgacacagtcccttcatctcattatggggggggctcccgcagggccagccggtactgggaaaaccgagaccactaaggatctgggcagggccttaggcactatggtgtacgtcttcaactgttctgagcagatggattataagtcgtgtggcaatatctacaagggattggcacagacgggcgcttggggctgtttcgacgagttcaacagaatatccgtagaagtcctctcagtcatcgccgtacaggtgaagtgcgtccaggatgcaatacgggcgaaaaaaaaggccttcaatttcttaggcgagatcattggattaatccctacagtagggatcttcatcacaatgaaccctgggtacgcaggaagagcggaacttccagagaacctcaaagccttatttcggccatgcgcaatggttgtgccagacttcgaactcatttgtgagattatgctgatggccgaaggctttcttgaggcccgactgcttgctagaaagtttataaccctgtacacattatgtaaagagttgctcagcaagcaggatcactatgactggggcctgagggcaatcaagtccgtacttgtggtggcaggctctctgaagcgaggggatccatctcgtgccgaagaccaggtgctcatgcgggcactgagggattttaatattcccaaaatcgtcactgacgatctgcctgtattcatgggcctgataggcgatctttttcctgccctggatgtgccaaggaagcgggacttgaacttcgagaagattataaaacaaagcatcgttgagttgaaacttcaggccgaggacagctttgtcttaaaagtcgtgcagcttgaggaacttctccaggtacggcattctgtgtttattgtcggaaatgctggaagtgggaagtctcaggtgctaaagtccttgaacaaaacataccagaacttgaagcgaaaacccgtcgccgttgatcttgaccctaaggccgtgacctgcgatgagcttttcggaataatcaatccggtcacgcgcgagtggaaggatggcctgttttcaacgataatgagagacctggcaaacattacacatgacggcccaaagtggataattcttgacggggatatcgatccaatgtggattgagtctttgaacacggtgatggatgacaacaaggtccttactctggcgagtaacgagaggattcctctgaatcgcacaatgcgactggtcttcgaaattagccacctgagaacggcgacacccgcaactgtatcaagggccggcatactctacattaatccagcagacctcggctggaacccggttgtgtcatcctggatagagagacgtaaagttcagtccgaaaaagccaacctaatgatactttttgacaaataccttccgacatgcctcgataagctgagatttggctttaagaagataacccccgtgccagaaatcaccgtgatccagaccattctatacctgcttgaatgcctgctcactgagaaaactgtgcctcccgattcccctcgggaattatacgagttatatttcgtcttcacttgcttctgggcctttggcggcgctatgtttcaggatcagctggtggactatcgggtggaattctcgaaatggtggatcaacgaattcaaaacaattaagtttccaagccagggaactatctttgattactacattgacccagacacaaaaaagtttctgccctggactgacaaagttcccagcttcgagttggatcccgatgtgcccctgcaggcaagccttgttcacacaacagagactattcgaataaggtactttatggacctgttaatggagaagagttggcccgtgatgctggtgggaaacgctggaactgggaaaagcgtgctcatgggcgacaaactggaaagcctgaatacggataactatctggtacaggccgtgccattcaacttttataccaccagtgccatgcttcaaggagtgctcgaaaagcccttagagaaaaaatcaggccggaactacgggccaccgggaacgaaaaagttagtttattttattgatgatatgaacatgcctgaggtggacaaatatggcactgtggcgccccatacattgatcagacagcatatggatcatcgacattggtacgaccggcataagctcacactcaaggatattcacaattgccagtatgtcgcctgcatgaatcctacttcaggatccttcactatcgactcacgcttgcagcgtcacttttgcgtgttcgcagtctcattccccggtcaagaagctctgaccaccatctacaacaccattttaactcaacacttggccttcaggtctgtctccatggcaatccagcgaatttcttcccagctcgtggcagcagcactagctctccaccagaagataactgcaaccttcctccccacggcaatcaagttccattacgtgttcaatttgcgtgatctcagtaatatcttccagggtttgctgttctcgactgccgaagtgctgaagacacctctcgatttggtgcggttgtggctgcacgaaacagaacgcgtttacggagacaaaatggtggatgagaaggaccaggaaacacttcatagagtgacaatggccagcacaaaaaaattcttcgacgacttgggggacgaactcctgtttgcgaaaccgaacattttctgccactttgcacaagggatcggtgatcccaagtacgtacctgtgactgacatggcccccctgaataagcttctggtcgatgtcctcgatagttacaatgaagtgaatgcggttatgaatctcgtgcttttcgaggatgccgttgcccacatctgccgaataaatagaatcctggaatccccacgcgggaacgccctcctcgtgggagtggggggaagtggcaaacagtctttaagcagactcgctgcatatatctccgggctcgacgttttccagataacactgaagaagggctacggaatccctgacctgaaaattgatctggctgcgcaatatatcaaagccgccgtgaaaaacgtcccatcagtttttctgatgacggactcacaggtcgccgaagaacaattcctggtgttgatcaacgacttgttagcaagcggagaaatccccggcctcttcatggaggatgaggtggagaacattatcagttctatgcgccctcaggtgaagtcgctgggaatgaacgatacaagagaaacctgctggaaattctttattgagaaagtgaggcggcagctcaaggttatcctttgcttctctcctgtgggcagcgtgctgagagtgagggcccgtaaattcccagccgtggtgaattgcacagccatcgactggttccatgagtggccagaggacgctttagtttccgtttcagctcgattccttgaagagacagagggaatcccctgggaagtgaaagcctccataagcttttttatgtcctacgttcacaccaccgtgaatgaaatgagcagggtataccttgccacagaaaggcggtacaattataccaccccaaagacgttcctggaacaaattaagttatatcagaacctgctggcaaaaaaacggactgagttggtcgcaaagatcgagaggctggagaatggacttatgaagctgcaaagcaccgcatcgcaggtggatgacttaaaagccaaactggcaatccaggaggcggaactgaaacaaaagaacgaatccgctgatcaattgattcaggtcgtgggcattgaggccgagaaggtcagcaaagagaaggccatcgcagatcaggaggaagtaaaggtagaggttattaacaaaaacgtgaccgagaagcagaaggcctgcgaaacggacctcgcaaaggccgaacccgcccttttagctgcgcaagaagccctggataccctgaataagaacaatctgacggagcttaaatccttcggctccccaccagacgcggtggtaaacgttactgctgcggtgatgattttaaccgcaccagggggcaagatccctaaggataaaagctggaaagccgcaaagatcatgatgggaaaggtggacacgtttctcgattccctcaagaaattcgataaggagcacatccccgaggcgtgcctcaaagcgtttaaaccttatcagggcaacccaacgttcgaccctgagtttatcaggtctaagagcaccgctgccgcgggcctttgttcgtggtgcatcaacattgttaggttttacgaagtgtactgcgacgtcgctccgaagaggcaggctctcgaggaggccaacgcggagctcgcagaggcacaggagaagctgtctcggattaaaaataaaatcgctgagctaaatgccaacctttctaacttgacttctgcattcgaaaaagcgaccgccgagaagattaagtgtcagcaagaggcagatgccactaaccgggtgattttgctggccaatcggctcgtgggcggcctggccagcgaaaatatccgttgggcggaaagcgtcgaaaattttaggtcccagggtgttactttatgtggagacgtgctcttgatcagtgctttcgtttcctacgtgggctactttaccaagaagtatcgcaatgaattgatggaaaagttctggattccatacatccataaccttaaagtgccgataccaattacaaacggtctggaccctctttctttgctgacagacgatgcagatgtggctacctggaacaatcaggggctgccctcggatcgcatgtctacagagaacgcgacaattctgggaaataccgagagatggccattgatcgtggatgcacagctccagggaattaaatggattaagaacaagtaccgctcagagctgaaagccataaggctgggacagaaatcatatcttgacgtgatcgagcaggccatcagcgagggggacactctgcttattgaaaatattggcgaaacggttgatccagtcctcgacccattactgggcagaaacaccatcaaaaagggtaagtatatcaaaattggggacaaagaggttgaatatcacccaaaatttcgccttatacttcacactaaatacttcaatcctcactacaagcccgagatgcaggcccagtgtacattgatcaactttttggtgacacgcgatggattggaggaccaactcctggccgccgttgtggcaaaagagaggccagacttggagcaactcaaggccaatttgaccaagagtcagaacgagttcaagatcgtgctgaaggaactggaggattcactgttggctagattgtccgctgcgagcggaaacttcctcggcgacacagcacttgtcgagaatcttgagactacaaagcatacagcctcagagatcgaagaaaaggtggtcgaggcaaagatcacagaggtcaaaatcaatgaggcccgcgagaattataggccagccgcagagagggcctctttactgtactttatcctcaacgacttgaataagattaatcctgtttaccaattttccctgaaggcttttaacgtcgtgtttgagaaggccatccagcggacaacacctgcaaacgaggtgaaacagagagtgattaatctgactgatgagattacgtactccgtttacatgtacacagctcgggggctgttcgaacgtgataagctgatcttcttggcccaggtcactttccaggtgctaagtatgaagaaggaactcaacccggttgaactggattttctgctgcgctttcccttcaaggccggagtggtgtcccctgttgactttctgcagcaccaaggttgggggggcataaaggccctgagcgagatggatgagtttaagaaccttgattccgacatagagggatctgccaagagatggaaaaaactggtcgagagcgaagccccagagaaggagatctttcctaaggaatggaagaacaagacggcattgcagaagctgtgcatggtccgatgcctgagaccagatcggatgacctatgccatcaagaacttcgttgaggaaaaaatgggctccaaattcgtggagggaaggtccgtggagttttcaaagtcctatgaggaaagcagtccttcaacaagcatcttcttcatcctctctcccggtgttgatcctctgaaggacgtcgaggctctgggcaagaagcttggattcactattgataacggcaagcttcataacgtgtcattaggccagggtcaagaggtggtcgccgaaaacgcgctcgatgtggcggctgaaaaaggccactgggttatcctacaggtgcgggggggacagcattgtagaaacatccaccttgtggcccgctggctcggaacattggacaagaagctggagcattatagtactggtagtcacgaagactatagagtattcataagtgccgaaccagccccatccccagaaactcacattattcctcagggcatcctcgagaatgccattaagatcacgaacgagcctcctactggcatgcatgccaacttgcataaggccctggacttattcactcaagatactctcgagatgtgtacaaaggagatggagtttaagtgcatgctgtttgcactttgttacttccacgctgtggttgcggaacgaaggaaatttggggcacaaggttggaacaggtcttacccattcaataacggggacctgaccatatccattaacgtgctctacaattatctggaggcaaaccccaaggtgccctgggatgacttgcgatacctcttcggtgagatcatgtacggtggacacatcacagatgattgggaccgcagactgtgccgtacttatctggcggaatatataaggacggagatgcttgaaggcgatgtccttctcgccccaggattccaaattccccccaacttggactacaaagggtatcacgagtacatcgatgaaaacctgccacctgaaagcccttacctgtatggactgcacccaaatgcggagattggcttcctcaccgttacatcagagaaattgtttcggaccgtcctagaaatgcagcctaaggagacagactcaggagcaggcacaggtgttagtcgcgaagagaaggccggaagcctgaaactcctgccctctgaacggaaaggcgaggacctggagttgcgtagagggggctgtccaggaaccggctttcaggtgaaagctgtcctggacgacatacttgagaagattcctgaaacgtttaacatggccgagatcatggccaaagctgccgagaagactccctacgttgtggtggcctttcaggaatgcgagcggatgaatattcttaccaacgaaatgagaaggagtttaaaggagctcaatttagggttaaaaggtgaactgacaattaccaccgacgttgaagatctgagcactgcactattttatgatacagtcccagatacctgggtggcccgggcatacccctctatgatgggactggcggcctggtatgcagacttgctgctgcgcatcagagagctcgaagcatggactactgactttgcattgcccacgacagtctggctcgcagggttctttaacccccaaagtttcctgactgctattatgcagagtatggcacggaagaacgaatggccgctggacaagatgtgcctgtccgtggaggtcaccaagaaaaatcgcgaggacatgaccgctcctcccagagaaggatcctacgtgtatggcctatttatggaaggtgctcggtgggacacccagactggcgtaattgccgaggccagacttaaggagcttacaccagcaatgcctgtgatcttcatcaaagccatccctgtcgatcgaatggaaaccaagaatatctatgagtgccctgtctacaagaccaggatccgcgggccaacttatgtctggacattcaatctgaagactaaggaaaaggcagccaagtggatcctagcggctgtcgcactgttgttgcaggtctag

SEQ ID NO: 29384 - DNA, 1545 bp, Artificial Sequence
  Description of Artificial Sequence: Synthetic coding sequence
atggccgatgcagaagtgatcatactgcccaagaaacacaagaaaaagaaagagagaaagtcactgcccgaggaggacgtcgctgagattcagcatgcagaggaatttctcattaagcccgaatctaaagtcgccaaactcgacacctctcagtggcctctgctgctaaaaaacttcgataaactgaacgtaaggacgactcattacacacccctggcgtgcggaagcaatcctctgaagcgagaaatcggcgactacatcagaacgggtttcattaacctagataagccttccaaccccagttcgcatgaggtggtggcttggatccggcggattctgagggtggagaagacaggccattcagggacgctggatccaaaggtcactgggtgcctaatcgtatgtatcgagcgggccacccggttagtcaagtctcagcagtctgcaggcaaggaatacgtgggcatcgtgcgcctgcataatgctatcgaaggggggacccagctgagtagagctcttgagactctgaccggcgccttattccaacggcctcccctaattgctgcagtaaaacggcagctgagggtccgtactatttatgaatcaaagatgattgagtacgaccctgaacggaggttaggaatcttttgggtatcctgcgaggctgggacgtacattcggaccctgtgtgtgcatctcggactcctcctcggcgtcggaggccaaatgcaagagctgagacgcgttcgatcaggggttatgtccgagaaggaccatatggtcactatgcatgacgtacttgacgctcaatggctgtacgacaatcacaaggatgaaagttacttacggcgcgtggtctacccgctcgaaaagcttttaactagtcacaagcgcctggttatgaaggactccgccgtgaatgctatatgttatggggccaagataatgctgccaggcgtcttaagatatgaagacggcatcgaagtaaatcaggagatagtggtgattaccactaaaggcgaggccatttgcatggccatcgcattaatgaccaccgccgtgattagtacatgtgatcatggaattgtggccaagatcaagagagtaatcatggaaagggatacctatccccggaagtggggactcggcccgaaagctagtcaaaagaaactcatgatcaagcagggcttgctagataaacacggtaaacccacagatagcacccctgcgacatggaagcaagagtacgtggactattccgagtcagcaaagaaagaagtggtggccgaggttgtgaaagctccacaggtcgttgctgaagccgccaagactgcgaaacggaagagagagtcagaatcagaaagtgacgaaactcctccggccgcaccacagctgattaagaaagagaagaaaaaaagtaagaaggataagaaggctaaggctgggctcgagtctggcgccgaacctggggacggggactcggacacaacaaagaaaaagaagaaaaaaaagaaggcaaaggaggtggaactcgtgtcagagtag

SEQ ID NO: 29385 - DNA, 13125 bp, Artificial Sequence
  Description of Artificial Sequence: Synthetic coding sequence
atgaaagtggatcgaaccaagctcaagaaaacacccacggaagcccctgctgactgcagggcattaatcgacaagctcaaggtgtgcaacgatgagcagctgctgctcgagctccaacagataaagacatggaatatcggaaaatgtgaactttatcactgggtggatctcctggatagattcgatgggatactggctgatgctgggcagaccgtggagaatatgtcatggatgctggtctgcgaccggcctgagagggaacagctgaagatgctgctcctggcagtccttaactttactgctctgttgatcgaatatagcttttctcgccatttatattcatccatcgagcatctaaccactctgttagcatcttcggatatgcaggttgtgttggccgtcctgaacctgctgtacgtgttctctaagcgcagcaactatattacacgactgggatcagacaagcgtacgccgctgttaacccggctgcagcatctggctgaaagttggggcggaaaggagaacggatttggactggcggagtgctgccgggatctccacatgatgaagtacccaccgtccgcaacaacactgcactttgagttctacgccgatccgggcgctgaggttaaaatcgaaaagcggactaccagtaataccctgcattacattcacatcgaacagctggacaaaataagtgagtctccttcggaaattatggagtcactaacaaagatgtacagcatccctaaagacaagcagatgctgctctttacccacatccgcttggcccacggattctccaatcatcggaagaggctgcaggcagtacaagcccggctccatgctatctccattctcgtgtacagcaacgcactccaggagagcgccaacagtatactgtacaatggactgatcgaggaacttgtggatgttctacaaatcaccgacaaacagttaatggagattaaagctgcgagtctgcgcaccttaaccagcatcgttcacttagagcgcactcccaaattatcttctatcatcgactgcacaggtactgcgagttaccacgggtttctgcctgtgcttgttcggaattgcattcaggccatgatagatccctccatggacccctatcctcatcagttcgctaccgccttgttttcctttttatatcatttagcctcatatgatgccggaggtgaggctttagtaagctgtgggatgatggaggcactgctaaaggttatcaaatttctaggagacgaacaggatcagatcacgtttgtgactcgggctgtccgggtggtggacctgataacaaacttggacatggcagctttccagtcacattcaggcctgtcaattttcatctataggctggaacatgaagttgacctgtgtcgcaaagaatgccccttcgtaatcaagccaaagatccagcggccaaacaccacacaggagggggaagagatggagacggacatggatggagtccagtgcattccgcaaagggccgccctgctcaagagtatgctcaacttcctcaagaaagcaatccaggaccctgccttcagcgacggaatacgccatgtcatggatggaagcctgcccacttctcttaagcacataatttccaacgcagaatattacggcccgagcttgttcctgctggccaccgaggtcgtgacagtgttcgtgttccaggagccctcactgctatctagtttgcaagacaatggccttacagacgtgatgctgcacgccctgctaattaaagatgtgcccgccactcgcgaggtgctagggtctcttcccaatgttttctcagctctttgccttaacgcaagggggctgcaatcattcgtccaatgtcagccattcgagagactctttaaggtgttattatctccagattacctacctgccatgaggagaagaaggagcagcgacccactgggggataccgcttccaatctgggatctgcggtggacgaacttatgcggcaccagccgactctgaaaactgatgcaaccactgccattattaagcttctcgaggaaatttgtaacttgggcagggatccgaagtacatctgtcagaaacccagcatacagaaggccgatggcacagccactgcgcccccccccagaagcaaccatgccgcggaggaggcctcttccgaagacgaagaggaagaggaggtccaggctatgcagtcgttcaattccacccaacagaacgagaccgaacctaatcagcaggtggttgggaccgaagagcgcattcctatacccctgatggactacatacttaacgtcatgaagttcgtcgaatcaatcctttctaacaacactacagatgatcattgccaggaatttgtcaaccagaaagggctgctcccgcttgtaacaattttgggccttcctaaccttcctattgacttccccacctccgctgcttgtcaggccgtcgcaggcgtatgtaaaagcatcctgacactatcccacgagcctaaggttcttcaggaaggtcttcttcagctggactcaatcttgagctccctggagccgctccacagacctattgaatcccctggaggttccgtcctgctgcgggaacttgcctgcgctggtaatgtcgcagatgcgaccctttctgctcaggcgacacccctgctccatgcattgacggcagcccacgcctacatcatgatgttcgtgcacacctgtagggtcggccagagcgaaatccgatcaattagcgtgaaccaatggggctcccagttagggctctccgttcttagtaaattatcacaactgtattgctcgctcgtatgggagagcactgtccttctctcgctgtgtactcccaactcactgccgagtggctgcgagttcgggcaggctgatatgcaaaaattggtgcctaaagacgaaaaagccggcacaacgcagggcggtaaacgctctgacggcgaacaggatggcgcagctggttctatggatgcctccacccaggggctgctcgaaggtattggtctcgacggtgataccctcgccccaatggagacagacgaacctactgctagcgattctaaaggcaagtcaaagattacacctgccatggcagcccgcataaagcagatcaaacccctgttgtcggcttcttcacggctgggccgggccctggccgagctgttcgggcttctagtcaagctctgcgtcggttcaccagtccgacagcgacgaagccaccatgctgccagtactaccaccgcccccacccctgccgcacgcagcactgcttccgccttgacaaaactgctcacaaaaggcctgtcatggcaaccccccccctatacccctaccccccggttcaggctgacttttttcatctgttcggttggtttcacatcacccatgttattcgacgagaggaagtatccctaccaccttatgctacaaaagtttctgtgttcgggaggacataacgctttgtttgaaacgtttaactgggctctctcgatggggggcaaagtaccagtgtcagagggcttagaacattccgatctgccagacggtactggggaatttctggacgcctggctgatgctggtcgagaagatggtaaaccctaccaccgtgctggagtccccacactccctaccggctaagctacctggaggggtgcagaactttccgcagttctctgccctccggttcctggttgtgacacagaaggccgcatttacttgcatcaaaaacctctggaataggaagcccctgaaagtgtacgggggcagaatggccgagtcaatgctcgctatattgtgccatattcttaggggcgagccagtgatccgtgaaaggctgagcaaagagaaggagggatctaggggagaggaagatactgggcaggaagagggcggctcgaggagagaaccccaagttaatcagcagcaactgcagcagttgatggatatgggttttacccgagagcacgccatggaggcgctactgaacacgtctactatggagcaggccacagaatatctgctcacgcacccccctcccattatggggggagttgtacgcgatttgtcaatgtcggaggaagatcagatgatgcgagcaatcgccatgtctctgggacaggatatcccgatggaccagcgggccgaaagtcccgaggaggtcgcctgtcggaaagaagaagaggagcggaaggcaagggaaaaacaggaggaggaagaagctaagtgtcttgagaaattccaagacgcagatcctcttgagcaggacgagctccacacttttactgacacgatgctaccgggctgttttcacctgctcgacgagttacccgataccgtctatcgcgtctgtgacctgataatgaccgcaattaaaaggaacggagctgattaccgagatatgattcttaagcaagttgtgaatcaggtgtgggaagcagcagacgtcctgattaaggctgcgcttcccttgaccacttctgacacaaagaccgtgagcgagtggatcagtcagatggccaccctaccacaggcatcaaacttggcgacgcgcatactgctcctcactctgctcttcgaagaactgaaactcccttgcgcctgggtagttgagagttccggaattctgaatgtcctgattaagctgctcgaggttgtgcagccctgtctgcaggctgctaaggagcaaaaggaagtgcagacccctaaatggataacccctgtcctgctgcttattgatttttatgagaagacagcaatttcaagcaaacggagggctcaaatgacgaaatatcttcagagtaacagcaacaattggcgttggtttgacgaccgctctggacgctggtgtagttactccgcctctaacaatagtacaatcgacagcgcttggaagagcggcgaaacaagcgtgcgcttcacggccggcagacggcggtacacagttcaatttaccactatggtgcaggtcaacgaggaaaccgggaatcgtcggcccgttatgctcacattgctgcgtgtaccaagacttaacaaaaattctaaaaatagtaatggccaggagctagaaaaaacactggaggagtcaaaggaaatggacatcaaaaggaaggaaaacaaaggcaacgacaccccgctcgcgctcgaaagcacaaatacagagaaggagacatcactagaggaaaccaagatcggcgaaatcctaatccaaggtttgaccgaggacatggtgactgttctcatcagggcctgcgtgtctatgctgggagtgccggttgaccccgacacactgcatgccaccttgcgactgtgcctgcgactgacgagggatcacaaatacgccatgatgtttgctgagctgaagtcaacacgcatgatcttaaacttgacccagagctcggggtttaacggcttcacccctctggttacccttctgctgcgacacataatcgaggacccttgtactttgcgacatacaatggagaaagtggttcggtcagcagcaacttcaggcgcaggcagcacgacttctggagtcgtgtcaggatccttgggcagccgggagattaactacatacttcgtgtcctgggccctgctgcctgtaggaaccccgacatctttaccgaagttgctaattgttgtattagaatcgcacttcctgcgccccgcggcagcggaacagccagtgatgatgaatttgagaatcttcgcatcaaaggaccaaacgctgtacagcttgtgaaaactaccccgctaaagccctctccactcccagttattcctgacaccattaaagaagtgatttacgatatgcttaacgccctggccgcctatcacgcccctgaggaggccgataaatctgaccccaagcccggtgtgatgacacaggaggttggccagttgcttcaggacatgggcgatgatgtctaccaacagtataggtcacttacacgccagtcatcggattttgatacccaatccggattctccattaacagccaggtgttcgcggctgatggtgcatctaccgaaacttcagccagtggaactagtcaaggtgaggcgtcaaccccggaggaatcccgggatggaaaaaaagacaaggaaggagaccgggcttctgaagagggcaagcaaaagggaaaaggatctaaaccattgatgccaacaagcacaatcctcagactactggcagagcttgtgcggagctatgtaggcatagccaccttgattgcaaattactcttacaccgtgggacagtcagaactgattaaggaagactgttcggtgctcgccttcgtgcttgaccacctgctgccccacacacagaatgctgaggataaggatactcctgctttggcccgcctattcttggcaagcctcgcagcggctggctcaggcaccgatgctcaggtggccttggtgaacgaggtcaaagccgccctgggaagagccttggccatggccgagagtaccgaaaagcacgctagactccaagctgtgatgtgtattatttccacaatcatggaaagttgtccctccacgtctagtttctatagctccgctactgcgaagacacagcataacggaatgaataatattattaggttattcctgaaaaaggggcttgttaacgacctagccagagtcccgcacagcttagacctgtcttctccgaacatggcgaacaccgtaaatgcagcactgaagcccctggaaactctgagccggatagtaaaccagccttcatccctatttgggagtaaaagcgccagcagtaaaaacaagtctgaacaggacgcacagggagccagtcaggactcctcctctaaccagcaggatccaggcgagcccggcgaagccgaggttcaggaagaggaccacgatgtcactcagaccgaagtggccgatggagacatcatggatggagaagctgagaccgactctgtggttattgccggacagccagaagtactgtcatctcaggagatgcaggtagagaacgagctggaagatctgattgatgaattattggagcgcgacggcggctccggcaactcgaccatcatagtaagcagatccggagaggatgaatcccaggaagacgtgctcatggatgaagcaccaagtaatctatcacaggcttccactctgcaggccaaccgcgaagattctatgaacatcttggaccctgaagacgaggaagagcacacacaggaggaagacagtagtggaagcaatgaagacgaagatgactcccaggatgaggaggaagaggaggaggaagacgaagaagatgaccaggaagacgatgagggggaggaaggggatgaagatgacgatgatgatggttccgagatggagctcgacgaagactaccccgacatgaacgcaagccccctcgtcaggtttgagcgttttgaccgcgaagatgaccttattattgagttcgacaatatgttttctagtgctaccgatatccctccaagccccgggaacatccccacaacacacccacttatggtcagacacgccgatcactcctctttgacgctggggagcgggtccagcacaacccggctgacccaggggatcgggagaagccagcggaccctgaggcagctgaccgctaacaccggccataccatccatgtgcactaccctgggaataggcagccaaatccccctctgatcctgcagcgattactgggccctagcgccgcagccgacatactccagctttcttccagcctaccgttgcagagcagaggacgagctcgtctccttgtgggaaacgacgatgtacatataattgcccggtcagacgatgagctgctagacgactttttccatgatcagtccaccgccaccagccaggcaggtacactgtcctctatcccgacagcccttacaaggtggactgaagaatgcaaagtcttggacgctgaaagtatgcacgactgtgtgagcgtcgttaaggtgagtattgtgaaccaccttgagtttctgagggacgaagaactggaagagcgaagagagaagcgtcgaaaacaattagcggaagaggaaaccaagatcacagataaaggcaaagaggacaaagagaatcgggatcaatccgcacagtgcactgccagtaaatcgaatgacagtacagagcagaacctgagcgatggtacccccatgccagatagttatcccacaactccatctagtaccgatgcagctacatccgagagtaaagagacactgggaacgctgcagagttcgcagcagcagcccaccctccctacaccaccagctcttggggaggtgccccaggagcttcagtcacctgccggagaggggggatcctcaacccagttgctcatgccagtcgaaccggaggagttgggtccaaccaggccttctggcgaagccgaaacaactcagatggagctgagccctgctcccactatcacaagccttagccccgaacgcgcggaagattcagacgcgctcaccgcggttagtagtcagttggagggtagcccaatggatactagttccctggcaagctgcacactcgaagaggcagtgggggacacatccgcagccggcagctcggagcagccaagagctggatcctccacgccgggggatgccccgccggccgtggccgaagtgcaaggaaggtccgatggttccggagagagcgcccagcctcccgaggattcctctccgcctgcctccagcgaaagcagcagtacaagagactccgctgttgcaatctccggcgcggactcaagggggattctggaggaaccgctcccttctacatcttcagaggaggaggatccactggccggtatctccctgcctgaaggggtagacccttcctttctcgcagcccttccggacgatatccggagagaagtgttgcagaatcaacttgggattagacctcccacacgaacagctccttccaccaacagcagcgctccagcagtggtgggaaaccctggcgtcactgaggtttcacccgagtttctggccgctcttccaccagctatccaagaagaggtcttggcccaacagcgggccgaacagcagagaagagagctcgcccaaaacgccagctccgacacacctatggatcccgtcactttcatccagaccttacccagtgatctgcgcagatcagttcttgaggacatggaggactctgtgttagctgtgatgccccccgacattgcagccgaagcacaggccctccgcagggagcaggaggcacgtcaaaggcagttgatgcacgagagactcttcgggcactcctctacgtctgccctgtctgccatcctgaggagtcctgccttcacctcacgactatcaggcaacaggggcgttcaatacactcgacttgctgtccaaagggggggcacctttcaaatgggaggctcttcatcacataatagaccttccggatctaacgttgacaccctgctcagactgagaggaagacttctgttggaccacgaggcactgtcatgtctgctcgtgcttctgttcgtagatgaacccaagctgaacacgagtaggctccaccgcgtcctccggaatctgtgctaccatgctcaaacgcgtcattgggtgatcaggagtctgctctcaattctccaacggagctccgagtcggagttgtgtattgagacaccgaagctcactacctccgaggagaagggaaagaaatcctccaaatcatgtggttctagctcccatgagaatagaccactcgatcttctgcataagatggagagcaagagtagtaatcaacttagttggctgtctgtgagtatggatgccgcactgggctgccggacgaacatttttcagattcagagatcgggcggccggaaacacaccgaaaagcacgctagtggaggatccactgtgcatatccatcctcaagcagctcccgtcgtctgtagacatgtgctcgataccctgatccagctcgctaaagtcttcccctcacactttacccaacagagaaccaaagagaccaattgcgaatccgacagggaaaggggtaataaagcatgcagcccctgctcgagtcaaagctcttcaagcggcatttgcaccgatttctgggacctgttagtgaaactggataatatgaatgtctcccgaaaaggtaaaaatagtgtgaaatcggtgcctgtgtcagctgggggggagggcgagactagcccatactcactcgaggcttctccactcggtcagctgatgaacatgctttctcacccagtgatcagacgcagcagcctgctcactgagaagctgctccgcctgctcagcctcatcagtatcgctctccctgaaaacaaggttagtgaggcacaggcaaactccggaagcggggcttcatctaccactaccgctacaagcaccacttccaccaccaccaccacagcggcgtccacaacccccacccctcccacggcgccgacacctgtcacaagcgcccctgcgctggtcgccgctacggctatttcaacgatcgtggtggcggctagtacgactgtaaccaccccaaccacagcgacaacaacggtttctatatccccaaccaccaaggggagtaagagtccggcaaaagtatctgatggcggcagctcgagcactgatttcaagatggtttcatcaggactgaccgaaaatcagctgcagttgagcgtagaggttctgacatcccatagttgctccgaagaaggactggaagacgccgccaacgtactcctgcagctgagccgcggagacagcgggacgagggataccgtactcaagttattgttgaacggagcacgtcacctcgggtataccttgtgcaaacagattggcacattacttgccgaacttcgcgagtacaatctggaacaacaacgcagagcccagtgcgaaacactgagccctgacgggctcccggaggaacagccccaaacaaccaaattgaaagggaagatgcagtcacgttttgacatggcggagaacgtcgtcatcgtcgcgagtcaaaaacgacccctgggggggagggaacttcagctgccatccatgtcaatgctcacaagcaaaacctccacgcagaaattcttcctccgggttctccaggtcatcatacaactgagggacgatacccgccgcgccaacaagaaagccaaacagacaggcaggcttggctctagcgggctgggtagtgccagttctattcaggccgctgtcagacaattagaggccgaggctgacgcgatcatccagatggttagagaagggcagagagcaaggcgtcagcaacaggcagctacctccgagagtagccaatctgaagcctccgttagaagagaagagtccccaatggacgtggatcagccttccccatcagcccaagacacacagagtattgcgagcgacggtaccccccagggcgaaaaggaaaaggaggagagacccccagagctccccttgttaagcgaacaactctcccttgatgagctgtgggatatgctgggcgagtgcctcaaggagctggaagagtcccatgaccagcatgctgttttggttctccagccagccgtggaagccttcttcctggtccacgccaccgaaagagagtccaagcctcctgtgagggacacccgtgagtcgcaattggcacatattaaggacgagccgcctcccctttctcccgcacctctcacccctgcaactccttctagtttagatccgtttttctctagggagcctagttccatgcatattagttccagccttcctcccgacacccaaaagtttctgaggtttgcagagactcatcgtaccgtgctcaatcagatactgcggcaatccacaacccaccttgccgacggaccgtttgctgttctggtggattatatccgcgtcctcgacttcgacgtcaaaagaaagtatttccggcaggaactggaaagactcgacgagggcctcagaaaagaggatatggcagtgcatgtgagaagagaccatgtctttgaagactcttatagagagctccatagaaagagcccggaagagatgaaaaaccggttatatatcgtattcgaaggggaagaaggccaggacgccggaggcttgctgcgggagtggtacatgattatatctcgcgaaatgtttaacccgatgtatgcccttttcagaacttccccaggtgatcgggtgacttacaccatcaatccttctagccattgtaatcccaatcacctgtcgtatttcaagttcgtaggccggatagtggctaaggctgtctacgacaatagactcctggaatgttatttcactcggagtttttacaaacatattctgggaaagtccgtcaggtacaccgatatggagtcggaagattatcatttttaccagggactcgtgtacctcctggagaacgatgtttcaacgctgggttatgacctcacgttcagcacagaagtgcaggagttcggtgtttgtgaagtcagggatttaaaaccaaacggggccaacattctggtcacagaggagaataaaaaagagtatgtccatctggtatgccagatgagaatgaccggcgccattcggaaacagctggcggctttcttagaggggttctatgagatcatacccaagaggctgatcagtattttcaccgagcaggaactcgagctgctgattagcggccttccgaccatagatatcgatgacctgaaatccaatacagaataccacaagtaccagtcaaactccattcagatccagtggttctggcgggcgctacgctccttcgaccaggccgatcgagccaaattcttgcagttcgtgaccggaacttccaaggtgcccctgcaggggtttgccgccttggaaggcatgaacgggattcagaagtttcaaattcacagagatgatcgtagcaccgaccgcttacccagcgcccatacgtgcttcaaccagctggatttgccggcctacgagtccttcgaaaaattgagacatatgctcctactggcaatacaagagtgctccgaaggatttggtctggcttag

SEQ ID NO: 29386 - DNA, 1746 bp, Artificial Sequence
  Description of Artificial Sequence: Synthetic coding sequence
atgaccagcgctgtggtggactcgggcgggaccattcttgagctctcctccaacggagttgaaaatcaggaggagagtgagaaagtctccgaatatcccgcagtaatcgtggagccagtgccctctgcccggctggaacaggggtacgctgcccaggtcctggtgtatgatgatgagacttacatgatgcaagacgtcgcagaagaacaggaagtagaaacagagaacgtcgaaactgtcgaggcttcagtgcacagctcgaacgcccactgcacagacaagaccatcgaagccgcggaggccttacttcacatggagagccccacttgcttgcgggattctagaagtccagaattcattcacgccgctatgcggccagatgttatcacagagacagtcgtcgaggtgtccactgaggagtctgagccgatggataccagcccaatccccacatctcccgacagccatgagcctatgaagaagaagaaggtaggacgcaagccaaaaacccaacaaagtccaataagtaacgggagccctgaattgggcatcaaaaaaaaacctagagaggggaaaggaaataccacctacttgtgggagttcttactggatcttttgcaagacaaaaatacatgcccacggtatataaaatggacacagagggaaaaggggatattcaaactggtggattccaaagccgtttccaaactgtggggaaaacacaagaataaaccagatatgaattacgagacaatgggtagggccctgcggtactactatcagaggggcattcttgcgaaggtcgaaggccagcgtctggtttaccagtttaaggacatgcccaaaaacattgtggttatcgacgacgacaagagcgagacctgcaatgaggacctagccggaaccaccgacgaaaaaagcctagagcgcgttagtctgtcagctgaatccctgttgaaagcagcttcgagtgtgcgctctggaaaaaattcttccccgattaactgcagcagggccgaaaaaggagtggcccgtgtcgtgaatataacaagcccaggacacgatgcctcatcaagaagcccaacaacaacagcaagcgttagcgccaccgcagcccctcgcaccgtccgcgtggccatgcaagtgccggtggtgatgacctcccttggccagaaaataagcactgtcgcagtgcaatcagtgaatgccggagcaccattaattacatccacctcaccgaccaccgcgacaagcccgaaggttgttatccagactatccccaccgtaatgcccgcatctaccgaaaatggagacaagatcacaatgcaacctgccaaaatcatcactatccctgcgacacagcttgcccagtgccaactgcaaaccaagtctaatcttacaggttccggcagtatcaacattgtgggcacacctctagcggtgcgggcactcacccctgttagcatcgcacatggcactcctgtgatgcggctgagcatgccaactcaacaggcttccgggcaaacccccccccgggttatttctgctgtaatcaaggggccagaggtaaagtctgaagccgtggccaagaagcaggagcatgatgttaaaaccctgcaactggtcgaagaaaaacctgcggacggaaacaagactgtgacacatgtggtcgtagtcagcgccccatcggctatagcacttcccgtaactatgaagacggagggcctcgtcacctgcgagaaatag

SEQ ID NO: 29387 - DNA, 1602 bp, Artificial Sequence
  Description of Artificial Sequence: Synthetic coding sequence
atggcaaccagcctgcacgagggaccaaccaatcagttagacctgctgattcgggctgtcgaagccagcgtgcactcatcaaacgcacactgtacggataagactatcgaggccgcagaagcactgctgcacatggaatctcctacatgtctgagagactccagatctcccgtggaggtattcgtgccaccctgcgtgagcactcctgaattcatacatgcagcaatgcggcccgacgtgataaccgaaactgttgtggaggtgtctacagaggaatctgagcctatggacacgtcccctatccctacgtctccggatagtcatgagccgatgaagaagaagaaggtcggtcggaaacctaaaacccaacagtcccccatctcaaatgggagtccggaactaggcattaaaaagaaacccagggaagggaaaggaaacacgacttacctctgggaatttctgcttgatctactgcaagataaaaatacctgtcccagatatataaagtggacccagagagagaaaggaattttcaaactggtggattcaaaggcggtgagcaaactgtggggtaagcacaaaaataaacccgatatgaactatgagacaatggggcgggcccttcggtattactaccaaaggggtatcctggcaaaagtggaaggacagcggctcgtataccaattcaaagacatgcccaaaaacatcgtggtaatcgatgacgacaagtctgaaacctgcaacgaggacttggccggcacaactgacgagaagagtttggaacgcgtgtcgcttagcgccgagtcgttgctaaaggctgcgtcgagcgtgcggagcggcaagaactcttcccccatcaattgctcccgtgccgagaagggcgtagccagggtggttaacatcactagtcccgggcacgatgcaagctcacgaagtccgacaacaaccgctagcgtgtccgctaccgccgctccacggacagtccgcgttgccatgcaagtccccgtcgtgatgacgtcactcggccagaaaatttccaccgtcgcagttcagagtgtgaatgccggcgctcccctgattacatccacatcccctaccaccgcaacctcccctaaggtagtgattcagaccatacctactgttatgcctgctagcactgagaacggggacaaaatcaccatgcagcccgccaagatcattacgatcccagccactcagttggctcagtgtcagctgcagacaaagtccaacctaacaggaagcggctccattaatattgtgggcacaccactcgccgtgcgggccctaacccccgtgagtattgcacacggaacgccagtgatgcggctgagcatgcccacgcagcaggcctccggccaaacccctcctcgagtgatatctgccgttattaaaggacctgaggtgaaatctgaagcggtggctaaaaaacaggagcacgatgtgaaaaccctgcagcttgtggaggagaagcccgccgacggcaataagacggtgacccatgtggtggtggtgtctgctccctctgccatcgctctgcccgtcacaatgaaaacggagggccttgttacgtgcgaaaagtag

SEQ ID NO: 29388 - DNA, 1515 bp, Artificial Sequence
  Description of Artificial Sequence: Synthetic coding sequence
atggctacttcccttcatgaaggtccgactaaccagttagacctgcttatccgggccgtcgaggcatcggttcacagctcaaacgcccattgcacagacaagacaattgaggcagctgaagccctcctgcatatggagtctcctacatgcttgcgagactctcggtccccggtagaggtctttgtgccgccgtgtgtgagtacccccgagtttattcacgccgccatgcggccagacgtgattactgaaaccgtggtagaagtgagtacggaggagtccgagcctatggacacaagccccatcccaacctctcccgattcacatgaaccaatgaaaaagaaaaagggaaacacaacctatctgtgggaatttctcctggatctgctgcaggataagaatacttgcccacgctatatcaaatggactcagagggaaaagggcatcttcaagttggtcgactccaaggcagtgagcaaactctggggcaaacataagaataaacctgacatgaactacgaaaccatggggagagctttgcgatattattaccagagggggattttggcaaaggtggaagggcagcggcttgtctatcagttcaaggacatgccaaaaaatatcgtcgtgattgatgatgataagtccgaaacatgtaatgaggacttggctggaaccacagatgagaagtctctcgagagagtgagcttatctgcagaatccctgcttaaggccgcgtcttcggtgaggtccgggaaaaacagtagccctatcaactgttctagagcggaaaaaggagtggctagggtggttaacattacaagtccgggccacgacgcgtcttccagaagccctaccacgactgcttctgtgtctgccaccgcagcaccaagaacagtgcgcgtggccatgcaggtcccagtggtcatgacgtccctgggtcagaaaatctccaccgttgctgtgcagtccgtcaatgctggggcccccctgattacatctaccagtccgacaacagctacatcccccaaagtggtaattcagactatcccgacggtcatgcccgcatcaaccgagaacggtgataaaattaccatgcagcccgctaaaatcatcaccatacctgcgacacagctcgctcagtgccaacttcaaacgaagtccaacctgactgggtccggatccatcaacattgtgggcaccccccttgctgtgcgcgctctgactccagtctccattgcccacggaacaccagtgatgcggttgtccatgcctacgcagcaggccagcggacagacaccaccaagagtcatttccgccgtcattaagggtccggaggtaaagagcgaggccgtggctaagaagcaggagcacgacgtcaagaccttgcagctagtcgaagaaaagcctgcagacggcaacaagacagtaacccatgtcgtagtagtgtcagcgccttcggccattgccctgcccgtgactatgaaaactgaaggcctggtgacatgtgaaaaatag

SEQ ID NO: 29389 - DNA, 1782 bp, Artificial Sequence
  Description of Artificial Sequence: Synthetic coding sequence
atgacatccgccgtagtggatagtggtggtaccatcttagagctgagctctaacggggtggagaatcaagaagagagcgaaaaggtttccgaatatccagctgtaatcgtcgagccagtgccaagcgctcgtttagagcagggctacgcagcacaggtgttggtttatgacgatgagacatacatgatgcaagacgtcgccgaggaacaagaggtggaaacagaaaatgtcgagaccgttgaagcctccgtacactctagtaacgcccactgcacagataaaacgatcgaagccgctgaggctctcctgcacatggaatcaccaacttgtctccgggatagtcgcagccccgtagaagtctttgtgcccccttgcgtctcgacccctgagttcattcacgccgccatgcgtcccgacgtaattaccgagactgtggttgaagtgagcactgaagagtctgaacctatggatacctccccgatccctaccagcccagactcccatgaacctatgaagaaaaagaaggtgggtcgtaaacccaagacccagcagagccccataagcaatggatcccctgagctgggcattaagaaaaagcctagagaaggtaagggaaacaccacctacctgtgggaatttctgttagatctgttgcaggataaaaatacatgcccaagatatataaagtggactcagcgcgagaagggtatctttaaattggtcgattccaaggccgtctctaagctgtggggaaagcacaaaaacaaaccagatatgaattacgaaactatgggacgtgctctgaggtactattatcagcgaggcattctcgcaaaggtggagggacagcgcctcgtgtaccagtttaaggacatgcccaaaaacatcgtagtgatcgatgatgacaaatcagagacctgcaatgaggacctggccggcacgactgatgagaagtccctggagcgtgtatcactgtcagctgagtccctccttaaggccgccagcagcgtgaggagtggcaaaaacagctcaccaatcaactgtagtagggccgagaagggggtggcccgtgttgttaatattacaagccctgggcatgacgcttccagccgcagcccaacaactacggcgtcagtgagcgcaacagcggcacctcgcaccgttcgagtggcgatgcaagttcccgttgtgatgacctccctcgggcagaaaatttccaccgtggctgtccagtccgtgaatgccggagctcccctaattactagcacttcccccaccactgcaacctcccccaaggtcgtcatccagacaatacctacagtgatgccagcctcgacggaaaacggagataagattacgatgcagcccgctaagataattacaattccagcaacccagctcgcccaatgccaactccagacaaaatcaaacttaacaggatccggatccataaacattgttggtactccgctcgccgtgcgggcactaactcctgtgtcaattgcccacggcacccccgtgatgcgactgagcatgcccacacagcaggcctccggacagactccgcctcgcgtgatttctgctgtaattaagggcccagaagtgaagtcagaagcagtagctaagaaacaggaacacgatgtgaaaactttgcagctggtcgaagaaaagcctgccgacgggaataagaccgtgactcacgtggtagtggtgagtgctccatctgccatagctctccctgtgacaatgaaaacagagggactggtcacgtgtgagaagtag

SEQ ID NO: 29390 - DNA, 1746 bp, Artificial Sequence
  Description of Artificial Sequence: Synthetic coding sequence
atgacttccgcagtggtggattccgggggaacgatattggagcttagctctaacggagttgagaaccaggaggagtctgagaaagtgagcgagtatccagccgtgattgtagagccggtaccctcagccaggttagaacagggctacgcagcgcaggtcctcgtgtatgacgacgagacttacatgatgcaggatgtggcagaggaacaggaggtcgaaactgaaaacgtggagacagtggaggcctccgtgcacagcagtaacgctcattgcaccgataagactatcgaagcagcggaggccttgctccacatggagtcgcctacttgcctgcgcgactcccggtcccctgaattcatccacgcagcaatgagaccagatgtgattaccgaaacagtggtggaagtctccacggaggaaagcgaacctatggacacgagtccgatccccaccagtccagattcacatgaaccaatgaagaagaaaaaggtgggaaggaaaccgaagacccagcagtcgccaattagcaacggaagcccagagctgggaataaagaaaaagccaagagagggtaaaggcaacaccacctatctctgggaatttctcctcgacctgctgcaggataagaacacatgcccccggtatattaaatggactcagcgggaaaagggcattttcaaactggtagattcgaaggcagtgagcaagctgtgggggaagcataaaaacaaaccagacatgaattatgagaccatgggacgagcgcttcgttattactatcagagaggaatcctggccaaagtggagggtcagagacttgtctatcagtttaaggacatgcctaagaacatcgttgtcattgatgatgataagtccgaaacttgcaacgaggacctagccggaacaacagacgaaaaaagtctcgaacgagtatccctatcagccgaaagcctgctcaaagcggcctctagcgtgaggtcgggaaaaaactcatcccccatcaattgttcccgagcagagaagggcgtggcacgggttgtcaacattacgtcacctggacacgatgcctcatcaaggagccctaccaccaccgcatcagtctccgccacagctgcgcctcggaccgtgcgagtcgctatgcaggtgcccgtggtgatgactagcctgggtcaaaagatctctaccgtggcagtgcagtccgtcaatgctggcgcccctctgattacttccacctctccgactaccgcaactagcccaaaggttgtgatccaaactatacctactgtgatgccagcaagcactgagaacggagataaaatcaccatgcagccggccaagatcataacaataccagccacccaactggcacagtgccaacttcaaacaaagtccaatctgacagggtcaggaagtatcaacatagtgggaactcccttagccgtgcgggcactcacccccgtgagcatcgcacatggcactcccgtaatgcggctgtcaatgcccacccagcaagcttcaggacagacgcccccccgtgtgataagtgcagttatcaaggggccagaagtcaaatccgaagcagtcgctaagaaacaggaacatgatgtcaaaaccctccagctcgtggaagagaagccagccgacgggaataaaactgtgactcatgtagtcgtggtaagtgctccctctgccattgccctccctgttacaatgaagacagaggggctcgtgacctgcgagaagtag

SEQ ID NO: 29391 - DNA, 1191 bp, Artificial Sequence
  Description of Artificial Sequence: Synthetic coding sequence
atgagtgtgatcgtctttaagggaaacactacctacctctgggaatttttgctggacctgttgcaggataagaatacgtgtcctagatatataaagtggacccaaagggagaagggaatatttaaactggtcgattctaaagccgtttctaagctctgggggaagcataagaacaagcctgacatgaactatgaaacaatgggtcgggccctgcggtattactatcaaaggggcatcctcgcgaaggttgagggacagagactagtctaccagtttaaagatatgcccaaaaacatcgttgtgattgacgacgacaagagcgaaacttgtaatgaagacttggccggtactactgacgaaaaatctctagagcgagtcagcctctctgcggagtctctgctgaaggcagcttcatccgttaggagtgggaagaattcctcccctatcaactgttcgcgggcagaaaagggagtcgctcgcgttgttaacatcacaagtccaggacacgacgcctcttcccgctcacccactaccactgctagcgtctccgccacggcagcaccgcggaccgttcgggtcgccatgcaggtcccagtggtgatgacctctctgggccagaagattagtacggtagcagtgcagtccgtaaatgccggggcccctctgataacttcaacttccccaactacagctaccagcccgaaagtggtgattcagaccatcccaaccgtgatgcccgctagcaccgaaaatggcgataagattactatgcagcctgctaagataattactatacctgctactcaattggctcaatgccagctacagaccaagtctaatctcaccggatccggatccattaacattgtggggacaccccttgcagtgagagcgctgacccccgtcagcattgctcacggaacacctgtgatgaggctgtcgatgccaacccaacaagcttccggtcaaaccccccctcgagtgatctcagccgtgatcaaaggtccagaggttaaatccgaagccgtcgctaagaaacaagaacatgacgtcaaaaccctgcagctggtggaggagaagccggctgacgggaacaagactgtcacccatgtggtggtggtctcagccccgtccgcaatcgcactgccagtaaccatgaaaactgaaggactggtaacatgcgaaaaatag

SEQ ID NO: 29392 - DNA, 2385 bp, Artificial Sequence
  Description of Artificial Sequence: Synthetic coding sequence
atggcctctcccaccctttcgccagatagctcaagtcaggaagccctgagcgctcctacttgtagccccaccagcgactcggagaacctgtcaccagatgagctggagctcctcgccaaactcgaagagcagaaccgtttgctggaagccgactccaaatccatgcgcagtatgaacggctccaggcgcaacagcgggtcctctctcgtgagcagcagctccgcatcgtctaacttatctcatttggaggaagatacctggatactgtggggccgaattgccaatgagtgggaagagtggcgtaggcgcaaggagaaactgcttaaggaattaatccgaaaggggattccccatcactttcgcgctattgtctggcagctcttatgctcagccactgacatgcccgttaagaatcagtacagtgaattgctaaagatgagtagcccttgtgagaagctcatcagaagagatatcgcccggacttatcctgagcatgaattcttcaaggggcaggattctctaggccaggaggttctgttcaacgtgatgaaggcttactccctcgtggatagagaggtcggatattgccagggaagcgcatttatcgtcggtttgctactgatgcagatgccagaagaggaggccttctgcgtgttcgtgcgcctaatgcaggagtataggctgcgcgagctctttaaaccctcaatggccgagctcggactgtgcatctatcaatttgaatatatgcttcaggagcagctcccggatctcaatactcattttcgcagccagtcatttcacacatccatgtacgctagttcttggtttctgactctctttctcaccacattccccctccctgtggctactcgcgtgtttgatatatttatgtacgagggcctggagatcgttttccgggtaggtttagccttgctccaggtaaatcaggccgagctgatgcaactcgatatggagggcatgagccagtactttcagagggtaatccctcaccagttcgactcttgccctgacaagttggtgctcaaggcgtaccaggtgaagtataaccccaaaaaaatgaaaagactggaaaaagaatatgccgctatgaaatctaaagagatggaggagcagatagagatcaagagacttcgaacggaaaaccgtctgctcaaacagcgaatcgaaacactggagaaggggcaggtgactcgagcccaagaggccgaagaaaattatgttatcaagagggagttggcagtggttcgccagcagtgcagctccgccgccgaggacctgcagaaagcgcagtctacaattagacagttgcaggagcagcaggagaacccccggctcactgaggacttcgtttcacatctggagacagagctcgagcagtcccggctgcgcgaaaccgagactctgggtgctcttagggagatgcaggataaggtgctggatatggaaaagcgcaatagtagtttaccagatgaaaacaacgtcgcgcaattacaggaagaactgaaggcgctcaaggtccgagaggggcaggccgtcgcttccactcgagagctgaagctccagctgcaggagcttagtgacacctggcaggcccatctggcccggggcggacggtggaaagagagtccaagaaagctggttgtcggtgaactgcaggacgagttgatgtctgttcgcctaagagaggcccaggcgctcgccgaaggtagggaactgcgacagagagtggtcgagctagagacacaagatcacattcataggaacttgttaaatcgcgtagaagctgagcgggccgctctgcaggagaagctgcagtacttagcagcccagaacaagggcttgcagacacagctatcggagagccgcaggaagcaagccgaagctgaatgtaaatcaaaagaagaggtgatggcggttagactgcgggaggccgattccatggccgcggtcgccgaaatgagacagcgaattgccgagcttgagatccagcgggaagaaggacgaatccagggccagctgaaccatagcgattcctctcagtatatcagagaacttaaggaccagatcgaggaactgaaggctgaggtccgcttgctgaagggcccgcccccgtttgaagacccgctagcatttgatggcctgtcactggcaaggcacctagatgaggattctctgccatctagcgatgaggaactgttgggagtaggggttggtgctgccctgcaagacgctctgtaccccctatcacctagagatgctagattttttcgccggctggaacgtccggcaaaggattcagagggctccagcgattctgacgcagacgagcttgcggcaccctactcgcaagggctcgataattag

SEQ ID NO: 29393 - DNA, 2418 bp, Artificial Sequence
  Description of Artificial Sequence: Synthetic coding sequence
atggccagccccaccctgtcccccgatagctccagccaagaagctttatccgcccctacttgcagccccacttcggactccgaaaacttatctcctgacgaactggaactgttagcaaaactcgaggagcagaaccgcttgttagaggccgattcaaaatccatgcgctccatgaacggcagcagaaggaactccggatcttccttagttagctcttccagtgcctcaagcaatctgtctcacctggaggaagacacatggatcctttggggtcgcatcgccaacgagtgggaggagtggcgtcggaggaaagaaaaactccttaaagaactgatccgcaaaggaataccccaccacttccgcgctattgtgtggcagctcttgtgctccgcaaccgacatgccggtgaagaaccagtatagcgagctgttgaagatgtcttcgccatgcgaaaagctgatcaggagagacatagcccggacctatcccgagcacgaattctttaaaggccaggattcgcttggccaggaggtgttattcaacgtgatgaaagcttacagtctggttgacagagaggttggatattgccagggcagtgcattcatcgtcgggctccttctgatgcagatgcctgaagaagaagccttctgcgtgttcgtgaggttaatgcaggaatacaggctacgtgagctcttcaagccaagcatggccgagctgggactatgtatctatcagttcgaatacatgcttcaggagcagctgccagatctcaatactcacttcaggagccagagctttcacacatcaatgtacgcttcttcctggtttcttaccttgttcttaaccacgttccctctgcctgtggccacccgagtctttgatatctttatgtacgaagggctcgagatagtttttcgggttggtttggcactgctgcaggtgaaccaggctgagctcatgcagctggacatggagggcatgtcccagtactttcagagagttatcccccaccagtttgatagttgtccagacaaattggttttgaaggcatatcaggtaaagtacaatccaaagaagatgaagcgattggagaaggaatacgccgcaatgaaatccaaggaaatggaggaacagatagagattaaacggttgaggaccgagaaccgcttgttaaagcagcgaattgagaccctggaaaaggaaagcgcggccctggccgacagactcatccagggccaggtgacacgcgcgcaagaggccgaggagaattacgtgataaagagggaactggccgtcgtgcggcagcagtgttcttcagccgcagaagatcttcagaaggcccaaagcacaattaggcaactgcaggagcagcaggagaacccccgccttacggaggactttgtgagccatctggaaactgagctcgaacagtccaggttacgagagaccgagaccctcggcgcactgcgggaaatgcaagataaagtcttagacatggagaaaaggaacagtagtctgccagacgagaataacgttgcacaactgcaggaagagctgaaagcactgaaagtaagggagggtcaggcggttgcctccacgcgtgagctgaagttgcagctccaggagctgtctgatacgtggcaggctcatttagcccgaggggggcgttggaaggagtcccctcgtaagctggtggtgggcgaattacaggatgagctcatgagcgtgagactgagagaagcgcaggccctcgctgagggcagagaattaaggcagagggttgtcgagctcgagacacaagatcacattcacagaaacctgctgaacagggttgaagcggagcgcgcggcactacaggagaagctacagtatctggcggcgcagaacaaagggctccagactcagttgtccgagagtcgtcgtaagcaagccgaagcagaatgtaagtcgaaggaggaagtcatggcggtgcgcctgagggaggcggacagtatggctgccgttgccgagatgcggcagaggatcgcagaacttgagattcagcgcgaagaagggcggattcaggggcagctgaaccacagcgactcttcccaatacatcagggaattgaaggaccagatagaagagcttaaggctgaagtccggctgttgaagggacccccaccgttcgaggatcccctcgcctttgatggtctgagcctcgctagacatctggatgaagactcgttgccatcgtcggacgaggaactgcttggtgtgggagtgggcgcggccctccaggatgcactgtaccccttgtcgccccgggatgctcggttcttccgtcgtctggagaggcctgcgaaagactctgagggttcttcggattccgacgctgatgagctagcagccccatactcgcaggggcttgacaattag

SEQ ID NO: 29394 - DNA, 7740 bp, Artificial Sequence
  Description of Artificial Sequence: Synthetic coding sequence
atggctgaagccgttaaacctcaacgcagagcaaaggccaaagcgagccggactaagaccaaggagaaaaagaagtacgagacaccccagcgagaggaatcctccgaggtttccctgccgaaaaccagtcgtgaacaggaaattccctccttagcctgcgagtttaaaggcgaccacttgaaagtcgtcacagattcccaactgcaggacgacgcttctggccagaacgagtctgagatgtttgacgtgccactgacttcccttaccatctccaacgaagagtcactgacatgcaacaccgagccgcctaaggagggtggagaggccagaccctgcgttggcgattccgcagttacgcctaaagtgcatcctggcgacaatgtggggacaaaggtggagactcctaagaattttaccgaagtcgaagagaatatgtccgtgcagggtggactgtctgaaagtgccccccagtccaacttttcctatacacagcccgccatggagaacatacaggtccgggagacccagaactcaaaggaagacaaacaaggactggtgtgctcctctgaggtcccccaaaatgtaggccttcaatctagttgccctgcaaagcacgggtttcagaccccaagggtcaagaagctgtacccacagctgcccgccgagatagccggggaagcaccagcactggtcgctgtcaaacctctgctgcgcagcgaaagactctaccctgaacttccatcccagctggagctggttccatttactaaggaacagctgaagatcctggaacctggatcctggttggaaaacgtggaaagctaccttgaagagttcgattcgatggcgcaccaagacagacatgagttttacgaattattgttgaactattcacgatgtcgaaaacagctactgctcgccgaggccgagcttctaacgctcacttccgattgtcagaacgcgaaaagtcgcctttggcagttcaaagaggaacagatgtccgtgcaggggatctgtgcagatcaagtgaaggtgttcagctatcaccgttatcagcgcgtcgaaatgaacgagaacgccctggtagagttaaagaaattgtttgatgccaaatccgagcatctccaccagactcttgctctccattcttacacatctgtgctgtccagattgcaagtagagagttatatttacgctctgttatctagtagcgcagttctgcgctcttccgccattcatcagcagggacgagcttctaaacagacagagtctattccaagcgacctttgtcagttgaaggagtgtatatctgttctgtttatgttcacccggcgcgtgaacgaggatactcaattccatgatgatattttgctgtggctccagaaactcgtttccgttttacagcgggtaggttgtcctggcgatcacctcttccttttgaatcacattctgcggtgccccgcaggtgtgtcaaagtgggcggtgccattcatccagatcaaggtcctgcataacccttccggagtgttccacttcatgcagagcttggcattattgatgtcgcccgtgaagaatcgggcagagttcatgtgtcatatgaagccgtcagagcgaaaaccctcctcatctggtcctgggagcggcacgtggactctggtggacgaaggcggagaagaagacgaggacccagagactagctggatcctcttaaacgaggatgacctggtgactatattggctcagttccctttccatgagttgttccagcacttattggggtttaaggctaaaggcgattatcttcccgaaactacgaggccgcaagaaatgatgaagattttcgcatttgccaattcattggtcgaactcctggcagtcggactggaaacctttaacagagcaaggtaccgccagttcgtgaaacggatagggtatatgatcagaatgacccttggatacgtttcagaccactgggcccaatatgttagccacaatcagggatcgggcttggctcagcaaccctactcaatggagaagctgcaagtggagttcgatgagctgttcctccgcgcggtgttgcacgtgctgaaggctaaacgattaggtatttggttgttcatgagtgaaatgccgttcgggactctttccgttcagatgctctggaaactcttctatttgatgcatcaggtagagtcagagaatctccagcagctgtcctcttcccttcaacctgcccagtgtaagcagcagctgcaggaccctgagcatttcactaatttcgagaaatgtctatcttccatgaattcttctgaagagatctgtctgttaactactttcgcccagatggctcaggccaggcgtacgaacgtggacgaagactttataaagatcatagtattggagatctatgaggttagctatgtgacgctttccactcgggaaactttcagtaaggtcggacgcgagctgctgggaacaatcacagccgtgcatccagaaatcatttccgtattactcgaccgagtacaggaaaccatcgatcaggtcggtatggtgagtctctatttattcaaggagcttcctctctacctctggcagccctctgcttctgagattgctgtgatccgggactggctcctgaattataacctgaccgtggtgaaaaacaaactggcatgtgttattctggagggcctgaattggggattcgctaagcaggccacactacaccttgatcaagccgtgcatgcggaggttgcactgatggtgctcgaagcttaccagaaatatttagcacagaagccctatgccggcatcctgtctgagtccatgaagcaggtgagctatcttgcctctattgtccggtacggtgaaactccggagacgtctttcaaccagtgggcctggaacctaatactgcgtctgaagttgcataagaacgactatggaatccagcccaattgtccagccgttccctttagtgttacagtgcccgacatgaccgaatctccgacattccaccccttactgaaggcagtgaaggctggaatgcccattgggtgctatctggctctgtccatgaccgccgtcggacactcaattgaaaaattttgcgccgagggtatccctctgctcgggattctcgtccaatcgcggcatctgagaacagtggtccacgtactagataagattctgcccctgttctatccctgccaatactacctccttaaaaatgagcaatttctgtcccacctgctcctgtttcttcacctcgactctggtgtgccacagggggtcacacaacaagtgacacataaggtcgcccagcacttaacaggtgcttcacacggggataacgttaagctgctcaattctatgatacaggcccatatctccgttagtacgcaaccaaacgaggtgggccccgtggcggtcctggagttttgggtgcaagcgctcatatcacagcatctgtggtatagggaacaacccattctgttcctgatggatcatctgtgtaaagcagcctttcagttgatgcaagaggattgcatccaaaagttactatatcagcaacacaaaaacgcactgggctatcattgcgataggagccttctctccagcttggttagttggattgtggcaggaaatataacacccagcttcgtggagggccttgccaccccgacccaggtgtggtttgcgtggaccgtgttaaatatggagtctatcttcgaagaagattcacagctcaggagagtcatagaaggggaactggtaatcaactctgccttcactccggaccaggccctgaagaaggctcagacacagctcaagctgccaattgtgccgagtctgcagcgccttctgatctaccgatgggcgcaccaggccctggtaactccgtctgaccatccacttctgcccttaatctggcagaaattctttttgctgtacctgcaccggcctggaccccagtatggtttacccattgatggatgcataggaagacggtttttccagagccccgctcatattaacctgctgaaagagatgaaaagaagattgacggaggtagcggacttccatcacgctgctagcaaagcgctccgcgttccggccgaggggagcgaggggctgccagaaagtcacagcggcaccccagggtacttaaccagccctgagctccacaaagaactggttaggctgttcaatgtatacattttgtggctggaggatgaaaactttcagaagggcgacacttatatcccttcactccctaagcactatgatatacaccggctcgccaaggttatgcagaaccagcaagacctttggatggaataccttaacatggagcgaatttaccatgaatttcaggaaaccgtcggcctgtggacacaggcgaaattagaaagccactccaccccgtgtagcctgtccgtgcagctcgacttcaccgatcccctgctggccaaagagagagtcctgtcaaacttgaggaaacacgaggcaccccagccacctctcgccttacacccgaccaaacctcctgttcccgtgataagttctgctgtgctgctttcccaaaaagacgccacccagttagtgtgcacagacctcaatctgcttcagcaacaggcaaggacagctgccctgagggaatcccagcaagtggccctggacggcgaactgctggacaccatgcctaagcaatatgtgaatagggaggagcagaccactctgcacctggagtgccgcggctcttccggaaaaaagtgtcagggagctgccgtggttacagtacagttcgaaggaatgcataagaatgaggctatctcccagcagctacatgttctccgcaaggaagtcaagcaattgcaggccgaggccgccaaacctccctcactgaacattgtggaggcggccgtgcacgcagagaacttgatcactgctctggtgaacgcgtacaagctgcagccaacccccgggatccagaaggtggggatttccctgtttttcactattgttgattacgtaagcgatgagactcaacgacaccctccaacccggcagttcttcacatcctgcattgaaatcttggggcaagtgttcataagcggtatcaagtccgagtgtcgcaaggtcctggaaactatcttaaagaatagccgattgtgctcattgctaagtcctttcttcacgcctaacgccgctccagctgaatttatacagttatacgagcaagtcgttaaattcctttctgaagacaattctgatatgatctttatgctgctcacaaagttcgatttgaaacaatggctgtccgcgaccaaaccgcccctgagtgaccgtaccagactgttggagtctatccaccttgcactgaccgcctggggtctggagcccgacgaagatattctgatgccatttaatctgttttgtaagcactggacatacttactcctgtaccagtttccggatcagtatagtgacatactccgtttgctgatgcaaagctccgctgagcagttgctttcccctgagtgttggaaagccaccctgcgcgccctggggtgctgtgctccctcgtgtcagcaaggcgctgcaagcaccgaaggcgcagtgctccccagcagttctgacgcacttctgtccgacaaacaagtgatggaaactatccagtggctgtctgacttcttttacaagctccgtctttctaagatggattttaagtcttttggcctgttttccaagtggtccccatacatggcagacgtgaaaacattcctgggctatcttgtaaagagacttattgacctcgagatgacatgtctggcacaggacccaacagcttcaaggaagaccgttctgaaaagcctgcacagtgtgattattcaactgttcaagccatggattttagtgttggaggataacgaaagttctcaacagcgtcactatccttggctggaatcagataccgtcgtagcgtcctcaatagtacaattgttcactgactgcatagactctttgcacgagtccttcaaggataagctcctccctggcgacgccggtgcactgtggttgcatctcatgcactactgtgaagcctgtaccgctccaaagatgccggagttcattctgtatgcctttcactcaacctacaggaagctcccgtggaaggacctacatcctgatcagatgctgatggaggctttcttcaaggtggaaagaggttcccccaaatcatgtttcctttttctgggaagcgtcctgtgtgaggtcaattgggtgtccgtgctgtcagacgcttggaactcaagtccccatcctgaaacgaggtccatgatcgtttgtctcttgtttatgatgatcttactggccaaggaggtgcaactcgtggaccagacggacagcccactcctgtctttactcggccagaccagcagcctgagctggcacttagtagatattgtgtcatatcagtccgttctaagctatttctccagtcattacccccctagtattatcctcgctaaggagtcttatgccgagctcatcatgaagctgctcaaggtgagcgccggactgtctattcctacagattcgcaaaagcatctcgacgctgtgcctaagtgtcaagcgtttacccaccagatggtacaattcctgtctactctggagcaaaacggcaagattaccctagctgtgctcgaacaagaaatgtccaaactgctggatgacattattgtattcaatccacccgacatggactcgcaaactcgccacatggccctttccagcttattcatggaagtgctcatgatgatgaataatgctactattccaactgcagagttcctgcggggctctatcaggacctggatcggccagaagatgcacggactggtcgtcctacccctcctgactgcagcttgccagtcgctggctagtgtgcgtcacatggcggagactaccgaagcgtgtatcaccgcctactttaaagagtcccccctgaatcagaactctgggtggggtccgatccttgtgtcacttcaagtacccgagttgactatggaagaattcttgcaggagtgcctcaccttgggtagctacctcacgctatatgtttatctgcttcaatgcctaaacagtgaacagacactgcgaaatgagatgaaagtgctgttaattctgtccaagtggcttgagcaggtctaccccagctcagtagaggaggaggcgaaacttttcctgtggtggcatcaggttctgcagttgtctctgattcaaacagagcagaacgacagcgttctgacagagtcggtgattagaattctcttgctggtgcagagtagacagaaccttgtggccgaggaaagattgtccagcggcatacttggcgcaataggctttggcaggaagtcgcctcttagcaatcgatttcgggtggtggcacgctccatggctgcgttcctgagtgttcaggtgcccatggaggatcagattaggctgagacccggctccgaactgcacttaacgcctaaggctcagcaagctttgaatgcgttggagtctatggcgtcaagcaagcagtatgtggagtaccaggatcaaatcctgcaggccacacagttcatccggcacccgggtcattgtctgcaggacgggaagagtttcctcgcgctgctagtaaactgtctttatcccgaggtacactatttggaccacataaggtag

SEQ ID NO: 29395 - DNA, 4071 bp, Artificial Sequence
  Description of Artificial Sequence: Synthetic coding sequence
atgatacaggcccacatctctgtgtccacgcagcctaatgaagtcggaccagtcgctgtgctagaattctgggtgcaggccctaatcagtcagcacctctggtaccgcgagcagcctatcttgtttttaatggaccatctgtgtaaagcagctttccagctgatgcaggaggactgtatccagaagctcttgtatcagcagcacaaaaacgctttaggctatcactgcgatcggtccctgctgagctcactggtgagctggattgtggctggtaacatcaccccatctttcgtcgagggactggctactcccacgcaggtgtggtttgcctggactgtgctgaatatggagagcatctttgaggaggactcccaattgcgaagagttatagaaggggagttggtgatcaattccgccttcaccccagaccaggcccttaaaaaagcacagactcagctcaaactgccaattgtgccctctctgcagcgactgctcatttaccggtgggctcatcaggcgctagtgacccccagcgaccacccacttctgcccttgatctggcagaagttctttctgctgtacttgcacaggcccgggccccagtatggattgcccattgacggctgcatcggtcggagattttttcagagtcctgcacacattaatctgttgaaggaaatgaaacggcgattgactgaggtagccgatttccaccatgcagccagcaaagctctgcgagtgcctgccgaggggtcagagggtctgcccgagtcacactctggtacaccaggttacctgacatctcccgagctccataaagaactagtaaggctattcaatgtgtacatcctgtggctagaggatgaaaattttcagaagggcgatacatatatccccagccttccaaagcactatgatattcaccgcctggccaaagtgatgcaaaaccagcaggacctctggatggagtatctgaatatggagcggatctaccacgaattccaggagacagttggactctggacccaagccaagctcgaatcacacagcactccatgttccctcagcgttcagcttgattttacagatcctctcctggccaaggagagagtcttaagcaatctgcgaaaacacgaggctccccagccccccctggctttgcaccctaccaagccccctgttcctgttatttcatctgcagtgcttctaagccaaaaagatgcaactcagctcgtctgtaccgatctcaatttgttacagcagcaggcccggaccgcggcccttagagagtcccagcaggtcgccctggatggtgagttgctagacactatgcccaaacagtacgtgaaccgggaggaacagacaaccctgcacctggagtgcaggggttcttccgggaagaagtgccaaggcgcagcagtagtgaccgtgcaattcgagggcatgcacaaaaacgaagccatctctcagcagctgcacgtgctacgtaaggaggtgaagcagttgcaagccgaggccgcgaaacccccttctctcaacatcgtcgaggctgctgttcacgccgaaaacctgattaccgcgttggtgaacgcttacaaactgcagccgactccaggcatccagaaggtcggcatatcactgtttttcactatcgttgattacgttagtgacgaaacgcaaagacatcctccgacacggcagttttttactagttgtattgaaattctcgggcaggtttttatctcggggatcaagtctgagtgtcggaaggttttagagaccatcctgaaaaatagtagactctgcagcttgctcagtcccttttttacaccaaatgccgcgccagccgagtttatccagttatacgagcaagtggtgaagtttcttagcgaagataacagtgacatgatatttatgttgctgaccaagtttgatctgaagcaatggctcagcgccaccaagccacctctctctgacaggacccggctgcttgagtcaatacaccttgccctgactgcctggggacttgagcccgacgaggatattctgatgccattcaacttgttttgtaagcattggacatatctgctactctatcagttccctgaccagtatagcgacattttaaggctcttaatgcagagttccgctgaacagcttctgagcccagagtgttggaaggctacactgcgggctctggggtgctgtgccccaagctgtcagcagggggccgcctctaccgagggagccgtcctgcctagctcttctgacgctttgttgagcgacaagcaagtgatggaaacgatacaatggctgtctgatttcttctacaagctgcgtctgtccaagatggacttcaagtccttcggactgttttccaagtggagcccatatatggcagacgtgaaaacgttcctgggatatctcgtcaaacgcctcatcgacctggaaatgacctgtctggcacaagatcctactgccagccggaaaactgtccttaagagcctccatagcgtgatcatccagctcttcaaaccctggattttggtgctcgaagataacgagtcctctcagcagagacattatccctggcttgagagcgacacagtcgttgcctctagcattgtccagctattcacagattgcatcgattctttacacgaaagcttcaaagacaaattgctgccaggggatgccggagctctgtggctgcacctgatgcactactgcgaagcctgtaccgcccccaagatgcccgagtttattctatatgcttttcatagtacttacagaaaactgccttggaaggatctgcaccctgaccagatgcttatggaggcattctttaaggtggaacgggggtcacccaagtcatgtttcctctttttgggctcagtcctgtgtgaggttaactgggtgagcgtgctgtccgatgcttggaattcaagtccgcacccagaaacacggtccatgatagtatgtctgctcttcatgatgatcctactagcgaaagaagttcagctggtcgaccaaaccgattcccctcttctgagtctgttaggacagacttcctccctctcctggcacctggtggacatagtaagttatcagtccgttctttcttatttctcaagccactatccaccaagcataatcctggctaaggagtcatatgccgagttaattatgaaactcctaaaagttagcgccggcctgtctatcccaacagacagtcagaagcatttagatgcggtgcctaaatgccaggcatttacccatcagatggtgcagttcctgtctaccctggaacagaatgggaagattacgcttgccgtgttggaacaagaaatgtccaaactccttgacgacataatcgtcttcaacccgcccgacatggactctcagacgagacatatggccctcagcagcttgtttatggaagttctgatgatgatgaacaacgctaccatcccaaccgcagagttcctgcgtggtagcatacggacctggatcgggcagaagatgcacggactcgtagtgctacctctgctgacagccgcttgtcagtctctcgcatctgtaaggcacatggccgagacgaccgaagcgtgcataacagcgtacttcaaagagagtccgctgaaccaaaattctggttggggacccatacttgtgagcctccaagtcccagagttgactatggaagagttcctccaggagtgtctgacgttgggaagctatcttaccctgtacgtgtatctcctccagtgtctgaacagcgagcagaccctgcgtaatgagatgaaagtgctgctgattttgtcaaaatggcttgaacaggtttatccttcaagcgtggaagaagaagccaagcttttcctgtggtggcaccaggttctgcagctttccctcatccaaaccgagcagaatgacagcgtgttaaccgagtcggtcatcaggattttgctgctggttcagagcagacagaatctggtagctgaagagcggctgtctagcggaatcctaggggcaattggattcggccggaagtccccactgtcaaatagatag

SEQ ID NO: 29396 - DNA, 1524 bp, Artificial Sequence
  Description of Artificial Sequence: Synthetic coding sequence
acaactcccgtggagagaggcagccctaaatcatgtttcctcttcctcggctccgtgctgtgcgaggtcaactgggtcagcgtccttagcgatgcctggaactcatctccccacccggagacaagaagcatgatagtttgcctactgttcatgatgatattactcgcaaaggaggtacaactggttgatcagacagactcccccctgctgtccctgctcggacagacctctagtctgagttggcacctcgtcgacattgtgtcttaccagtccgtcctgtcttatttttcaagtcattaccccccatcgattatcttggcgaaagaatcttacgccgagctgattatgaaactactgaaggtgtctgcggggctctcaattccaactgactcacagaaacatctggacgcagtgccaaaatgtcaggccttcactcaccagatggtgcagtttctgagcactttagagcagaatggcaagatcacactggctgtgttggagcaggagatgagcaagctcctcgatgatatcattgttttcaaccctccggatatggactcacagacgcgccacatggctctgtcttcattatttatggaggtacttatgatgatgaacaacgccacaattccaactgctgaattcttgaggggcagtatccgaacctggatcggacaaaaaatgcacggactcgtggtcctccccctccttacagctgcttgtcaatccctagcctcagtccgtcatatggcagagacgacagaggcttgtataacagcgtattttaaggagagtccgttaaatcagaatagcggttggggtccgatcctcgtctccctgcaagtgcctgaactcaccatggaagagttcctacaagaatgcctgacactcgggtcctacctcacactatatgtgtacttgctgcagtgtctgaactccgagcaaacactgaggaacgagatgaaggtattgctaattctgtccaaatggttggaacaagtgtatcctagctccgtggaggaggaggcaaagttatttctttggtggcatcaggttctgcaattgtctctgattcagaccgaacaaaacgacagcgttcttaccgagtcagtgatacgcatactgctgctggtgcagtcccgacaaaacctcgtagccgaagagcgattgtcctctggcattctgggcgcgataggctttggacgcaagtcgcccctgagtaaccggttccgcgttgtcgctcggtccatggcagcatttctatccgttcaggtacctatggaggatcaaataaggcttcggccaggtagcgagctgcacctgacccctaaagcccagcaggccttaaacgcattagagagcatggccagttcaaagcagtacgtggaatatcaggaccagattttgcaagccacccagtttataagacaccccggccattgtctgcaggatgggaagtcgttcctcgctctgttggtcaattgcctgtatccggaggttcactatctggaccatattcggtag

SEQ ID NO: 29397 - DNA, 636 bp, Artificial Sequence
  Description of Artificial Sequence: Synthetic coding sequence
atgaaccggaagaaactgcagaagctcaccgacaccttgaccaagaattgcaagcatttcaataagttcgaagttaattgcctgatcaaattgttctatgacctggtcggtggcgttgaacggcaaggccttgtggtagggctcgatcgcaacgccttccggaatatactccatgtgacctttggtatgacggacgatatgatcatggacagggtctttcgtggatttgacaaggataatgatggctgtgtgaacgtgctggagtggatacatggcctctctttgtttctcagaggaagtcttgaagagaaaatgaagtattgtttcgaagtgtttgatctgaacggggatgggttcatcagcaaggaagagatgtttcatatgctgaagaattccttgctgaagcagcctagtgaagaagatcctgatgaagggatcaaggatctggtggagattacgcttaagaagatggaccacgaccacgacggcaagctctcctttgcagattatgaattagccgtcagagaagagacactgctattggaggccttcggcccctgtctccctgatcctaagtcccaaatggagttcgaggctcaggtctttaaagatcctaacgaattcaacgatatgtag

SEQ ID NO: 29398 - DNA, 480 bp, Artificial Sequence
  Description of Artificial Sequence: Synthetic coding sequence
atgaatagaaagaagctgcagaagcttaccgataccttgaccaaaaactgtaaacaccttttccgcggcttcgataaagataatgatgggtgcgtcaacgttctggagtggatccacgggttgagcctgtttctgaggggcagcctggaagaaaaaatgaagtattgcttcgaggtattcgacctgaatggggacggcttcatatctaaggaggagatgtttcacatgctgaagaatagcctactgaaacaaccatctgaagaggacccagatgaggggataaaagacttagtggagatcacactgaagaaaatggaccacgatcacgacgggaagctatctttcgccgattatgagctggctgtgagagaagaaacgctcctactggaagctttcggcccctgccttccggacccaaaatcccagatggagtttgaggcccaggtgtttaaggaccctaacgaatttaatgatatgtag

SEQ ID NO: 29399 - DNA, 636 bp, Artificial Sequence
  Description of Artificial Sequence: Synthetic coding sequence
atgaatcgcaagaagctgcagaagctcaccgataccttaaccaagaactgcaaacatttcaacaaatttgaagtgaattgtctgattaaactgttctatgatttagtaggtggggttgaacgccaggggctggttgtgggactggatcggaatgccttccgcaacattctccatgtgacatttggcatgactgatgacatgatcatggatcgagtgtttagaggtttcgacaaagacaacgatggatgcgtcaatgtattggagtggatccatggtctatccctgtttctaaggggttcacttgaggaaaagatgaagtactgctttgaggtgttcgacctcaatggagacggcttcatttcaaaggaggagatgttccatatgctcaagaacagcctcctgaagcagccctccgaggaagaccccgatgagggaatcaaggatctggtagaaatcaccctcaaaaaaatggatcacgatcacgatggcaaactctcttttgcggattatgagctggcagtgagggaggagacccttcttctggaagcttttggcccctgtttgcctgatccgaaaagtcaaatggagtttgaagcacaagtcttcaaggaccccaacgaattcaacgatatgtag

SEQ ID NO: 29400 - DNA, 390 bp, Artificial Sequence
  Description of Artificial Sequence: Synthetic coding sequence
tgagtgaatgtgctggagtggatccatggcctgagcctgttcctgagggggtccctggaggagaagatgaagtattgcttcgaagtgttcgatctaaatggcgatggttttatatccaaagaggagatgtttcacatgctgaaaaactctctgttaaaacagccatcagaggaggatccagatgaagggattaaggacctcgtcgagataactctgaaaaagatggaccacgaccacgacggcaaactgtccttcgctgactacgagctcgcagtgagggaggaaactctcttactggaggctttcggcccttgcttgcccgatccaaagtcacagatggaattcgaggctcaggtgtttaaggacccaaatgaatttaacgacatgtag

SEQ ID NO: 29401 - DNA, 480 bp, Artificial Sequence
  Description of Artificial Sequence: Synthetic coding sequence
atgaataggaagaagttgcagaaactgaccgacactctgaccaaaaattgtaagcacttgtttaggggcttcgataaggataacgatggctgtgtgaatgtcttggaatggatacacggcctaagcctgttccttcgtggatcactcgaagaaaaaatgaagtactgcttcgaggtttttgacctgaacggtgatggttttatttccaaggaggagatgttccatatgctgaaaaattcactgctgaagcagccttctgaggaggatccagacgaaggcattaaggacctggtagaaatcacgctcaagaagatggatcatgaccacgacgggaagctttctttcgctgactacgagcttgccgtccgagaagaaaccttgcttcttgaggcctttggcccatgccttcctgaccctaagtcccagatggagtttgaagcacaggtgttcaaagatccgaatgagtttaatgatatgtag

SEQ ID NO: 29402 - DNA, 384 bp, Artificial Sequence
  Description of Artificial Sequence: Synthetic coding sequence
atggagactagttcacgggaacttcaggccgcagaatacctggaaaaacatcagataaaggaggtggtctcttacttgacaagcgctttgctgtttttccggcccgaaaaaccgaaagagtatctgattagcctgctggaaaggcttcgtatcgctaaggtgaccggggttgccttcccattctttatggataatagcaacatcgtcgccatgttcgaaatgatggattcatccggacggggaacaatctcgttcgtccagtacaaagaagcgctcaaaacccttggcctgtgtacggaggatgaagacctccaggacgacgggcataaaattactctggacaaattcaaagaggaggtgaacaagagaatgaaggagatttag

SEQ ID NO: 29403 - DNA, 450 bp, Artificial Sequence
  Description of Artificial Sequence: Synthetic coding sequence
atgagcagcatcaaccccaatactagcgggatcctgctcgagggtttcttaaatattgtgaggaagaagaaggaagcccagaggtaccgtaatgaggtcagacatattttcaccgcttttgacacctattacagaggttttttaacccttgaggattttaagaaagcgtttaggcaggtagccccaaagttgcctgagcggacagtgctggaagtcttcagaggtctgaggatattctctaagtgcctgctttgtcacatcgatcaaaagtccaaaaatccgagtagtggtcttctggcggccgactctattatacaggcccaccctagcccggttcagatcttaagacaaatgtatatcaataacgagctggaaggacgtggtttcatttgggatagctctattagctggcggtttatgtggaacatctacgggaccggagaatactag

SEQ ID NO: 29404 - DNA, 492 bp, Artificial Sequence
  Description of Artificial Sequence: Synthetic coding sequence
atgttcttctcagaggctcgggcacgaagtcggacctgggaagcttcgccttccgagcatcggaaatgggtggaggtgttcaaagcctgcgacgaggaccataagggctacctttcaagagaggattttaagacagccgtcgttatgctctttggctacaagccctccaaaatcgaggttgactctgtcatgtccagcatcaacccgaatacaagcgggatcctcctagaaggtttcctcaatatagtgaggaagaaaaaagaggcccagcgctatcgtaacgaagtgcggcacatattcaccgcttttgacacctattatagaggcttcctcaccttggaggattttaaaaaggccttccggcaggtggcccccaaactgcctgaaaggactgttttggaggtgttcagggaggtcgaccgcgatagtgatggccacgtttccttccgcgattttgagtatgcgttaaattatggccaaaaggaggcgtag

SEQ ID NO: 29405 - DNA, 420 bp, Artificial Sequence
  Description of Artificial Sequence: Synthetic coding sequence
atggtgtttaaggcttgtgacgaggatcacaagggatatttgtcacgggaggactttaagaccgcagttgttatgctgttcggctataagccctccaagatagaggtcgacagcgtcatgagcagtattaaccccaatacttccggaattttgctggagggattcctcaatatagtacggaagaaaaaggaggcccaacgctaccgaaacgaggtgcgccatatcttcacagccttcgacacttactaccgggggttcttaaccctcgaggattttaagaaagccttccgacaggtcgctcccaagcttcccgaacggactgtcttggaggtgtttagggaggttgatcgggattccgacgggcatgtgtcgttcagagacttcgaatacgccttgaactatggtcagaaagaggcctag

SEQ ID NO: 29406 - DNA, 357 bp, Artificial Sequence
  Description of Artificial Sequence: Synthetic coding sequence
atggtgttcaaagcatgcgatgaggaccacaagggctacttgagccgtgaagactttaagacagcagtggtgatgttgttcgggtataaaccttctaaaattgaggttgattccgtgatgagttcgatcaaccctaacacaagcggaattctcctggagggatttttgaacattgtgcggaagaagaaagaggcacaacggtacaggaatgaggtgaggcatattttcaccgcttttgacacctattaccggggattccttactctggaagactttaagaaggcctttcgccaggtggcaccaaagctgcccgaacgaactgtgttagaggtatttaggggcatcttttcggcttag

SEQ ID NO: 29407 - DNA, 2355 bp, Artificial Sequence
  Description of Artificial Sequence: Synthetic coding sequence
atggaaaccaaggtgcacctcttctgccaggcggaggaaaatatcgacctgctcgacgatggctccaattctttcgcaaccgacctcagcagcggaactatcaatcacaaaaagtacattaagttttctaaaaccatcgaaaaggagataagccccgagatacgttccttgtcacctgagtataaaaaaatattcgagacgtcaatcatcttctgtggcgaggaaaagtcttctgacttctccggggagaaaaaggtgggccggaaaagcttgcaggttcagcaacacagtaagcgaaccgagatcattccccctttcctgaagctgtctaaagagaaagtgacacggaaggagaatagcctgtgtaagttgcctaaccagtacagcgtgcacaagacctcctcacccctgtgtactagctccgctattactcgcgagaaagagatgctcagcaatctgtatatgactctgtacgacgaagtcacccatgggtacttacattctaaggaactgagcgggaatcatatggtggacataggcgatatcatctttacactgaacgagctacaggagcaatatgaagacgtctctatcaccgagggctctccgctgaatgagatcacgtccgaccgtaaactctcaagcgtggccggttgttatttgaaatacaagaagaagaactccttaagtagtaagctgccagagccttctatctcaaaaaagttaaataagaaaagtaatcagtactactccaagattatggagaacgacgatctggaatctaaacggccaaagaatacatggcagataaggaagttcctcggaggcgtgggatccagcaacgtgggcgtccaggagccctacagcaaaaacgggattaattttaagaagcatagcgagaagggtgaaattcatgacagtaaatctaagccacagtcactcaagtcctccacatccctctctaaatctctggacaagtcggacatttctagcatccctaagctccaaaagccggccgtccggaaacactcctctctccaaaagcaggtctccagtactgagaagaccgctatctccacactcgagaacttctgtgaggccatttccaaacttcaggagaattacattgccgccgaggagctccagagcatactgccaagtactggaatcaatttgttagatgaagaatttcagaaaatagtcacagatacgtcgcgcaacgagaatgggatggtcgagctggatgatttcgtgaacgccctggctaaggaacgttcatttcccgaatgtaatgcccttccgggtgtaatcaaggctatcgacaagatcaaagacaagaatgtggattacgaagacttaaacacttgtctccagaatttcggaatctatctctctaagccagaatttaagaagatcactgaactgaccgaagcaggtgagaccaaaaaggtcaactttaaggaatttattgacactatgatgagcaataccgaatgcttttctgaaaagcttgtgctgcccgacgctattgagactctagatgatctgcgcaaggaaacaatgtccgtgagcgatttgtggaatactctatcttcactgaacagtaacctaaagaaagacgaatttctagccgcccttgaactggtgaccgttgatgagggggataaggtgcagtttgaggagtttgcgaaggttgtaagaaatatgcgggacgctgccaggctcgaagagctccaggaggtggtgttggccgccgacctgctggagggcgacatgattgcagggaagaacctcgaggacttcctgaggaacgtcggcattaagagtcccaaagaagaggtggagaagattctgcaatcagatttcgtgtccgaggacaatatggtaaatattaaagactgcatgagggccttacgtgatactcaaaaattttctaactacatcgacttcagaaaggaggccagtaacctcaaactacccaaagttaacgagattaaagaagctgctaatatcctgagtcacgtcgataacggcaaaatcgggatccccgacctggaacacgctctgaaatgtttaaacgtgaatcttacggaggaagacttcaatgaagcgctgaattgttgcaatgtaagcgacaatatggaggtggatctgaaggacttcctaatgaaaatgaaagagagccctcattttcagaagagtaaggccacacagatcctgctggccacaacccagatcttgcagaacgacctggttgacgtctctgacctgaaaaccctgctgatggacaaggaccttcacacggcaaacgcaattctcactgtcatgctccggcatgtccccgagcacggttag

SEQ ID NO: 29408 - DNA, 810 bp, Artificial Sequence
  Description of Artificial Sequence: Synthetic coding sequence
atgcttgggcctggacaagtccgcctgaggccacgtgtgtggcgggacaaagccggagggcgggtggccgatggcgcctcaggactgcctcccgcaagaggctcctggcgtgagacaggaaccggtcgtgcgttgggagctagtagcccgcctcgcccagcgcaaggtagctcgtcacctgggatccagtccggtccctcatctaggcccggaagcccaaggggtgccgagcaggctggtacacctaggcctcggctgtcactggggatttcccaggctactggctctgccgctcggtggaggactcgccggacaggaaaggggctcggatataacagtgatgaaatcagaccccggaccctattaattgaacatctcatggagggcggtcggagggatcaccataccatgaccgtgctgtggggaacccaagagattattgtggccgagtttcacaaaaagatcaaagaggcatttgaggtctttgatcacgaatctaacaacacggtggatgtgagagagatcgggactattatccggtccctcgggtgctgtccaaccgaaggggagctccacgacctcattgctgaggtcgaggaagaggagccaacgggctatatccgcttcgaaaaattcctcccagtgatgacagagattctgctggaaaggaagtatcgtccaattcccgaggacgtgctccttcgcgcgtttgaggtgttagactctgctaaacgaggcttcctgactaaggacgagttaatcaagtacatgactgaggaagacggtgtgtccttacgcaggccaggatag

SEQ ID NO: 29409 - DNA, 489 bp, Artificial Sequence
  Description of Artificial Sequence: Synthetic coding sequence
atggctgacgagaaagaccgtgaagaaataattgtggcagaattccacaagaagattaaggaggcttttgaagtttttgaccacgagtctaataatacagtcgacgtccgcgaaatcgggaccataatcaggtctttaggttgttgccctaccgaaggagagttacatgatctgattgccgaggtggaagaggaggaacccacggggtacatccgattcgagaagttcctccccgtgatgacggaaatactcctcgagcggaaatatagacctatcccagaggatgtgctcctgcgagctttcgaagttctcgatagtgcgaaacgcggctttctgaccaaagacgaattaataaaatacatgacagaggaaggggagccattttctcaggaggagatggaagaaatgctctccgcagccatagaccccgagagcaacagtatcaactataaagactacattacaatgatggtcattgacgagaattag

SEQ ID NO: 29410 - DNA, 402 bp, Artificial Sequence
  Description of Artificial Sequence: Synthetic coding sequence
atggctgacgagaaagaccgcgaagagataatagtcgctgagttccataagaagatcaaagaggcgtttgaagtcttcgatcacgaatccaataacacagtggatgtgagggaaattggtaccattattcggtcccttggctgctgtcctaccgagggagaacttcatgacctgatcgcagaggtcgaggaggaagagccgaccggatacatccggttcgagaagttcctccctgtgatgaccgaaatactgttagagagaaagtaccggccgatacctgaagacgtcttactgcgcgcgtttgaagttttagatagcgctaagcgcggttttttgaccaaggacgagttaatcaagtatatgaccgaagaggatggtgtgtcactcaggcggcccggatag

SEQ ID NO: 29411 - DNA, 1317 bp, Artificial Sequence
  Description of Artificial Sequence: Synthetic coding sequence
atggctgtgagcgagatcaaacctaagttaaagctgaatcccctgaccaaagtgcctatctcacacaataaaagagatcgcgaccttccgggctccttacaatgtcagctgcagcacaaagagaaaaagctctccgcctcccaaatggcagcgttccaggatgcatacaatttcttctacaaagacaaaaccgggtgtattgactttcacggactgatgtgtacggtggcgaagctgggaatgaatctgactaagcatgatgtttacaatgaattgaaatgtgctgatattgacagggacggcaaagttaattttagcgacttcattaaggtcctcacagataaaaacttattcttaaaggcggtggttcctgagaaggaaacctgtctggacctcgcagggaatccgggaattctgttgttcgagattttgagtcgcctccttgagacaagcgcactgccacgtaagagtattatagagattgtcagttacttccagaggaagttccagcacacggggccagggatgctctggtctccatacacaatggggtacgggaagagaaccttgaaacccgacatctgtacgcccccttcaagttcgatggccgcatttgcgaatgccgcccgcatcgcgattatgaaagaaaaggatttatttaaatttcttgaagaacttaagagatgcaattctgggtctgatagcccatattctaaaatacctatcttccccctgttcccaaatgtcgacggagtggtcatgggaaaaccatttaaggatatgcagaagttggaaatgctccgcatcaaggagcccctgcacttcttcgaggactacttctttcacaagagggattggaaaactcaggccgctaacattaaaagtatggacccagcctctggctactcaaacaatatcttcaccatcgatcagatgctgaagaagaagcagacatgtaccgtggcggatgcaacggcaattaaacaacacgtgaagcgtgcgaccgatacatacaacctgggtatcgccttggagcaccggaaggagatgctcaatctgtggcaaaaaatccgcggcgacctgataggtatggacagccgaaacgagtcattttacgacactttctctacttacacctggagttggaatgtatgtcaggagctgctctccccaaaagatctcaggctttatgatgcatacgtgaatcgaaactcctctcataactccaggtcctcttcttcctcggatacaagcgaatgctatacagactcaggtcggaagcgcaagcgaaagggtctcaagggattccagcagtag

SEQ ID NO: 29412 - DNA, 489 bp, Artificial Sequence
  Description of Artificial Sequence: Synthetic coding sequence
atggcagtcagcgagattaagccaaagttaaagctgaatccgctaactaaagtgccaattagccataacaagcgagaccgggatctccctggctcactccagtgtcagctgcagcacaaggaaaagaaactctccgcgtcacagatggccgccttccaggacgcctataatttcttttacaaagacaaaaccggctgcatcgactttcatggcctaatgtgtactgtggcaaaacttgggatgaatctaacaaaacacgacgtatacaacgaactcaaatgcgccgatattgatcgagacgggaaagtgaatttttcagactttataaaggtgctcacggacaagaacctcttcctgaaggccgttgtacccgagaaggagacgtgtctggatctcgcagggaaccctggaatacttctgttcgagatcctgagcagattgcttgaaacctcagctcttccaaggaaaagtattattgagattgtgtag

SEQ ID NO: 29413 - DNA, 525 bp, Artificial Sequence
  Description of Artificial Sequence: Synthetic coding sequence
atggctgtgtctgaaataaaacccaaactgaagctgaatccactgactaaagtgcccatctcccacaacaaacgggatcgagatctgcccgggtccctccagtgccaattgcaacacaaagaaaagaagctgagcgccagccagatggcagcatttcaagacgcctacaattttttttataaggacaagactggctgcatcgatttccacgggcttatgtgtaccgtggctaagctgggtatgaacttaactaagcacgacgtgtacaatgagttaaagtgtgctgacatcgacagggacggcaaggtgaatttttcagatttcatcaaagtcttaactgacaagaacctttttttaaaagccgtcgtgcccgaaaaagagacatgtctggacctcgccggaaatcccggcatactcttgttcgagatcttgtcccgcctcttggaaacatcagccctgccccgcaagtcaatcattgagatagtttcctattttcagcgtaagtttcagcacactgggccatag

SEQ ID NO: 29414 - DNA, 1473 bp, Artificial Sequence
  Description of Artificial Sequence: Synthetic coding sequence
atgaaggagctaatgccccatttaacgttcaacggaaacggcaaaataaatgtgaattccatcatggaaggattgaagaaattcaaaccaaaggggatggttaccctccacaagctgaagactgctaatgatatcaaggatagagttactggccacatggcagtctctgagatcaaacctaaactcaaacttaacccactgacaaaagttccaattagccacaacaagagagatcgggatctgcctggctccctccaatgccagctgcagcacaaggagaagaaactgagcgctagccagatggccgctttccaggacgcttacaattttttctacaaggacaaaactggatgcattgacttccatggtctcatgtgtaccgtggccaaattgggtatgaacttgaccaaacacgacgtttataacgaactcaagtgcgcagacattgatcgcgacggtaaggtaaacttttctgacttcataaaggtcctgaccgacaaaaatctgtttctcaaagccgttgtgccagaaaaagagacctgcttggatctggcaggcaatcccggaattctgctgtttgagatcttaagccggctgctcgagactagcgccctcccgcgcaaaagcataattgaaatagtgagctatttccaacgcaagtttcagcatactgggcctggaatgttgtggtctccttacactatggggtacggcaaacgaaccctgaagcctgatatttgtacaccaccgtctagttcaatggctgcgtttgcaaatgcagcccgcatcgcaatcatgaaggagaaagacctcttcaaattcctggaggaactgaagagatgcaatagtggatccgatagcccttactctaaaatccccatcttcccactgttccctaacgtggacggggtggtcatggggaaacccttcaaggacatgcagaaactcgagatgctgaggatcaaagaacccctccatttcttcgaggactactttttccacaaaagggactggaagactcaggcagccaatattaaaagtatggacccggcctccggctattccaataacatctttaccatcgaccagatgttgaaaaagaaacagacttgcactgttgctgatgctactgcaatcaaacagcacgtgaaacgagccaccgatacatacaatttgggaatagccctcgaacatcgaaaggagatgctcaacctttggcagaaaatccggggggatcttattggaatggacagccgcaacgagagtttctacgatacattctcaacctacacttggtcgtggaatgtttgtcaggaactgctctccccaaaggacttacgcttatatgacgcttacgttaaccgaaactcttcgcataactccagatcctcgtcatcttccgatacctctgaatgctataccgactctggccgtaagcgaaagagaaaagggctgaaagggtttcaacagtag

SEQ ID NO: 29415 - DNA, 4140 bp, Artificial Sequence
  Description of Artificial Sequence: Synthetic coding sequence
atgaatgagtctgcaagtcaggaggaactgcgacctgcgcaagaaaaccggaaggaagacaaggaaagaaagtggaacctgaccgaggtgaaagagcttcacgaaaccctccagagtgtacctgacgtccccgtgaaggaagatacaaactcggttgtggaaaaggccatggatgagattaaatctcaagaattgaacctggaaggccagaggaaaatcagtcctggctctattaaggatagcaagacggaagcgagtgggaatatcgccattagaaagagtgcaaaggtcatttttgcattagatgaaaccgagctgaaatcaaaacctgagcacacttggaagaagaacctttttgaaagaatggaggctagggcccaggctatgcagcagaaaataatcgacaaagaaaatctcaagaaggagcttgagaagaaggccgagaagaaattgccgcgggataatctggccaaggaatggttcaacaccgatagtatgacgttgaacaacacagcctaccttttggacaaactcttgcccacccttgtccctggcgtggagaacatgctgacacaagttgagaaaaagaaggtgctcacggaggctgataccccgtccaaattcgatccaatcaactacttgggcgaatatctgatcaggaacaaccctaactacatcaaagaccctggtatgagcggttatcagcgtctcatgaaagaggtgacagaggacctgaagatttatgtgcctgacactatatgcaacagggtgagcaagatgaaagagaacgtaaaacagaaccgtaagcaacgcgaatcaattgacaaaattatcgtgaaggtggctaacacccgcaaacaggcactgcaggagcagtttgacgaatggatcctggaccctaaagggatgatccccaagagtgttatccagaacgtccttcaagaattcttccagaatcccgatttcaagcttggaagccattgtaagcagctggacatcacagactcaaccgagccacggctcaacaagatggagtttaccgagtacatttcatcccacatcaaagatctgaagagcgaaatgttcgaagagctgcttaagcacctctgtcactctgcagatgagttccgggaggtgatcaaagctgacatgcgccgccagatgtttgcagaactgtttttacattgtgaccacggcaaggtgggctttcttgatagacagagaacactggcattgctggaactgttctacgaccactcttcacagatgctgaggtcccttctcaggaaccccaggcaatggccctttattgagtttgaggagattaacctcacagaactttggggtgatatggacaatcaaaagcacatatacgagggctttgacaaagtcttgttggagatgaatactctgcttagtgccaaccatgcgtcaaagacacagtccaagctcctcgagtcaccggatcagccgaaactcaacgaacaacggacttctaccccgagccccaatccacctgagcagcagcgcggtgttacagcagaacagggcccgcagagaatcagcattgaagagcagcagcagggcaaaaagcccaccgccgaacaggagctatatattgagtcagtaatcgaacctggtacacacacggagagtaccctggaacagggttccagccgacgcctgttgaccgagcaagagacacaccgcgagagtaccacggaacaagggcagcataaagggagtatcgaggggcaggggcctcgacgcgtgtctgtctcagagcagggctcaagcagggagagcgtggctgagcagggcagtcgaagggagagcatcgccgagcaggaccgccataaagggtcagttgccgaacaaggcagtaggaggatgagcgccgccgagcaggggtcgttgcgggagagcgtaatcgaggaaccttaccagaaatcagagcagggaccatatggggaaattatctctgaggaacaggaagacattggaagcacttctcagagcagaaaagacagtattctgaaaagtacaaagtacggcgagcctatcaccagtgagtatatagaggtgccactccaagagaagaggagttgggagcagacgtatgaagaggagatctttctttcctcagaactacaggaagaggttcccaccttgtctcggaaggatcatttccccgaaactaccaagaaagaggtacagaaagacaaaccttgtgaaccaaaaagccagaagattgaaggcaagagttggtcaggcgagttctttacatgtaactggaaaatgaagtacgtgacttttgaggacgaggagcaagccaatctcatctatggaaattctcgatttactgcaaaactgcacattcagttccccaaaccccacccaggccacgaagtgcgacttagctccaaacagttccagaattatatcgagttagtcgtgagtgagctgcggggaaatgaggatcaggttctcgagtccgtggtagagttcctgatgaatgccctcgaacggtcacacatcgagtccttgcgcaacagcgccagaaggaaatggctgcaccagatccagtgtgctgccgagacctctggtgttagtctggagcccgtctacagtgagacttttaaggctcttatgcaagacgcagaagcccatggtaataagaaaatctccgcccacatttcgctcctcgaggagaacttgctgctccccgaaaagggcaacgtcttactccgaaatgttgcctgtactctggatgatgcccagtttgtgctgaaccgggtgctatatcgggacatgaaaggaatttcctttacggtggtcgacgagggtaaacccattcatgtgcctcaggtgcaatatcacggtaacatcttcttttggaaccaaagtaggaacaagcacgattacaacggatcttttttggccctccccctccaggacgcctacatgagaatattcggtgtgcttgccgtggacaccctgcgggacccgcacgaaattaacatttttttaccccatgagatccgcttttaccaaggtgtcgcaaacgtattttctactgcttatcactacgtgcacagtcgggaacacatattgcatattgtcatcactggtattggctggctttatgacgtcacctcgtctatcacatctattacaacttactttgtggaacccagccctgcccaggatagtgactatgttttacgaaatatgatggtgacaggacagttaggtctgacggagattcacaagaaccccccaacaattcataggaaatcttgtatcttcagggatttcttgttcaaatgcacggatagttctgaagttgttctggcaagtgcctgcggtgaaacacatatagtggtgccactccgagagcgtactggggaagccctcggagtgctggatttcaacataggacagaacagaatgttgctctgtcaggagtacaaggaccttcaaaagatgatgaaggtggttcaggttgcttgttatgagattcttggggagttctctggtgaaatcaaaaagaagtatattctggaaatcgaaaatgtcagagaagtgcagagggcgggaattctgttttttcgaattatgctactcgaactacaagaaagcatccagttgctcaactcaatggaattcgtgtcgttattgctttatgatcatactctagtgaccgaacccaattccccccaggactccaagtcaatggaactcgaggccaatgtgaagctggtccgggatatactcaaggccgtcattctatttttccaccccgaactggagttctcatccgatttcggctcatgggacaaatgcaaattctacgtgaacaagtacctagtcaacaacatctgtgctttcgatcccacggctaagcacgtggaggtgaacgttcagttaatcgacgagtacatccgggatcacagccgaaccgaggtatggaagttcggcaatgttgtgatagaacacctctatcattggattcacatctgtagcgcactgatgaagatcactaaacagctcaatagcgggattaccccccctctcccaagtaagacagataactacatgtatgcgaagatgccaggggagggactccaggaaaaatag

SEQ ID NO: 29416 - DNA, 2781 bp, Artificial Sequence
  Description of Artificial Sequence: Synthetic coding sequence
atgaacgaaagcgcaagtcaggaagaactgcgtccggcacaagaaaacaggaaggaggacaaggagcggaagtggaacctaaccgaggtcaaggagctccatgaaactctgcagagcgtgccggacgtaccagtgaaggaagacacaaactcagtggttgagaaagctatggacgaaattaaatctcaggagcttaacctggagggccaacgcaaaatctcccccgggtccattaaggatagcaagacagaggccagtggaaacattgcaattcggaaatccgccaaggttatatttgctctagacgaaaccgagctgaagtccaagccagagcatacctggaaaaagaatctgtttgagcggatggaagcgcgggctcaagcaatgcagcagaaaatcatcgacaaagagaacctgaagaaggagctggagaaaaaggccgaaaaaaagttgccccgtgataatctcgctaaagagtggttcaatacggatagtatgaccctgaacaacaccgcctaccttctggacaagcttttgccaaccttggtccctggtgttgaaaatatgctgacacaggttgagaagaagaaagttctgacagaggcagacaccccctccaagttcgacccaataaattatctcggtgaatacctgattcgcaataacccaaattacatcaaggaccccggcatgtctggctatcaaaggcttatgaaggaagtgaccgaggacctgaagatctacgttccagacaccatatgtaacagagtttcaaagatgaaagagaatgtcaagcagaatcggaagcagcgagaatctatcgacaaaattatcgtaaaggtggccaacactcggaaacaggccctgcaggagcagttcgacgagtggatacttgatcctaagggtatgatccctaaatcagtgatccagaatgttcttcaggagttttttcaaaatcctgatttcaaactgggctcacactgtaagcagctggatattacggattccaccgagccgagattaaacaaaatggagtttactgagtacatatcatcccatatcaaagacctgaaatccgaaatgttcgaggagttattgaaacatctctgccactctgcggatgagttccgggaggtgataaaggcggacatgcgaagacagatgtttgcggagttattccttcactgtgaccacggcaaggtgggcttcctagatagacagcgcaccttggcactgctggaactgttctatgaccactccagtcaaatgctgaggtccctcctgaggaatccacggcagtggccttttatcgagtttgaggaaattaatctaacggagctttggggggacatggacaaccagaagcacatatacgagggctttgacaaagtcctgctggaaatgaacaccttgctctccgcaaaccatgcgagcaagacccagagcaagttacttgaatcccccgaccagccaaagttgaatgaacaaaggactagtactccatcacctaatcctcctgaacagcagaggggggtcaccgctgagcaggggccgcaacgcatttcaattgaggaacagcaacagggcaagaaaccaaccgctgaacaagagctgtacattgaaagtgtgattgaacccggcactcacacggaaagtaccttagaacaggggagcagccgtcgcctcctgactgaacaggaaacccaccgcgagagtactaccgaacagggacaacataagggaagcatcgagggtcaaggtccacgacgcgtttccgtcagcgagcagggcagctcacgtgaatcagtcgccgagcaggggtcacgtcgcgagtccattgctgagcaggataggcacaagggatctgtggcggaacagggatccaggcggatgtcagcagccgaacagggtagtcttcgagaatcagtgatcgaggagccttatcagaagagtgagcagggtccatacggcgagatcatttctgaggagcaggaagacatcggtagcacaagtcagtcccgcaaggactctatcctaaaaagtacaaaatacggcgagccaatcactagcgagtacattgaggtgccccttcaggaaaaaagaagctgggagcaaacctatgaggaagagattttcctgtcttcggaactccaggaggaagtgcccacgctttctagaaaagaccactttccagaaacaaccaagaaggaggtgcagaaagacaaaccttgtgaaccaaaaagccagaaaatcgagggaaagagctggtcgggggaattcttcacctgcaattggaagatgaaatatgtgacgttcgaggacgaggagcaggccaacctcatctacgggaactccaggttcaccgacttgcacagtatcattagaaacatccaatcctgtaaggaagttaaagggcgcaccgcattcaacggcgtgtctttcaatctcttgcaatttgttcaacttctggaaactttcgtgggagaagacgctcctctttcggtgtccgaaacattaactagctttttcaaggagggatacgtcgaaaccgaacaggagaaaatgaacgcgctagaacaattttcccaaaatgccttccaggtccgacagcggttgctgttagaggccatctttcagaagtgggatagcgacgggtcaggcttcctagatctgaaggaagtggatgaattactgtatacctacaaagaggggatggagaaagagtccatgaagaaggggctcactctgagcccggggtggagtgctgttgcccagctctag

SEQ ID NO: 29417 - DNA, 2928 bp, Artificial Sequence
  Description of Artificial Sequence: Synthetic coding sequence
atgaatgagtcagcctctcaagaggagttgagacctgcacaggaaaatagaaaagaggataaagaacgtaagtggaatctgaccgaggttaaagagctgcacgagacattgcagtcagtgcccgatgtccctgtgaaagaggacacaaacagcgtagtggagaaggccatggacgagatcaaaagccaggagctcaatctggaaggacagagaaagatctcccctggctcgattaaggatagcaagaccgaagcctcggggaacatcgctatccggaaatccgcgaaggttatctttgccttggacgagactgagttgaaatccaaaccagagcacacatggaaaaagaacttatttgaaaggatggaagccagggcacaggccatgcagcagaaaatcatcgacaaggagaacttgaagaaagaactagaaaagaaggctgagaaaaaactgccccgcgataacctggcaaaggagtggttcaataccgactcaatgacactaaacaatactgcttatttgttagacaaattgctgcctaccctggttcccggcgtggagaacatgctcactcaggtggaaaaaaagaaggtgctgactgaggcggacacaccttctaaattcgacccaatcaattacttaggggagtacctcattagaaacaaccctaactacatcaaggatccaggcatgtccggatatcagcgcttgatgaaagaggtcacggaggacctgaagatctacgtaccagacacaatctgcaacagagtgagcaagatgaaagaaaatgtgaagcagaatagaaaacagagggagtcgatcgataaaataatcgtgaaagtggccaacacgagaaaacaagctctgcaggagcagtttgatgaatggatcctggatccaaaagggatgatccctaaaagcgtgattcaaaatgttctgcaggaattcttccaaaaccccgacttcaagcttggtagccactgcaaacagctcgatattacagactccactgagccccgacttaacaaaatggagttcacggagtacatcagttcacacattaaggatctaaaatcggagatgtttgaggaactgctcaagcacctttgtcattcagctgatgagtttcgcgaggtcatcaaagccgacatgcgccgtcaaatgttcgccgagctcttcctgcactgtgaccacggcaaggtgggctttttggacaggcagagaacccttgccctcttagagctcttctatgatcactccagccagatgcttaggagccttctcaggaaccctcggcagtggcccttcattgagttcgaagagatcaatctgacagagttgtggggcgacatggataaccaaaagcacatctatgaaggctttgacaaggtactgctggagatgaacacattgcttagcgccaatcatgcatccaaaacacagtccaaactgctggagagcccagaccagcctaaactcaatgagcagagaaccagtacaccctctcctaacccacccgagcagcagagaggcgtgacagccgagcagggtccccagaggatatccatcgaagagcagcagcaggggaaaaagcctaccgctgagcaggagctgtatatcgaatccgtgattgagcctggaacacacaccgaatcaacactcgagcagggaagcagcagaagacttctcactgaacaggaaacccacagggagtccaccactgagcagggacagcataagggttccatcgaggggcagggcccacgccgggtgtccgtgtccgaacaaggcagttctagagagtcggtggctgagcaggggtcccgacgggagtcgatagcagaacaagatcggcacaagggttctgtcgctgaacagggtagtagaaggatgagcgccgctgagcagggatctctaagagagagcgtgatcgaggaaccttaccagaaaagtgagcagggcccctacggagaaattattagtgaggaacaagaggatatcggttctactagccagagcaggaaggacagcatactgaagtctactaagtatggggagccaattacgtcagaatatatagaggtgcctctgcaggaaaagcgtagctgggagcaaacttacgaggaggaaatctttctctcatcagaactgcaagaagaggtgccgactctcagtagaaaggatcactttccagaaaccacgaaaaaggaagtgcagaaggataaaccctgtgagcccaagtcacagaagatcgaaggcaagtcttggagtggagagttctttacttgtaactggaaaatgaaatacgtgacatttgaagatgaagaacaagcaaacctcatctatgggaacagtagattcacggatctgcattccattatccggaatatccagagctgcaaagaggttaaagggcgaacggcctttaacggcgtttcatttaatctgttgcaattcgtgcagctgctcgagacgtttgttggggaagacgcccccctaagcgtgtccgagaccctcacctcttttttcaaggaggggtacgtcgagacggagcaggaaaagatgaatgccctggaacaattttcccaaaacgccttccaggtccgccaacggctgctgctcgaggcaatatttcagaagtgggactcggacggaagcggttttttggatctcaaagaggtcgacgagctgttatacacatacaaagagggcatggagaaggaaagcatgaagaaggatcactccaggaccgaagtttggaaatttggcaacgtagtgatcgaacatctttaccactggattcacatctgctccgctcttatgaagatcacaaagcagttaaactcgggcattacaccccctcttccttctaaaaccgataattacatgtatgcaaagatgccgggggaagggttacaagagaagtag

SEQ ID NO: 29418 - DNA, 4512 bp, Artificial Sequence
  Description of Artificial Sequence: Synthetic coding sequence
atgaatgagagcgcaagtcaggaggaactcagacccgcccaggagaatagaaaggaagataaagagcgaaagtggaaccttacagaagtcaaagaactgcatgagacactgcaatccgtgcccgacgtccctgtgaaagaagacactaacagtgtagtggagaaagccatggacgagataaagtcccaggagctgaatctggaaggacagcgaaagatttcaccgggtagcattaaagattctaaaaccgaagcatctggaaacatcgccatccggaagagcgctaaggtgattttcgcactggacgaaaccgagcttaaatcaaagccagaacacacctggaaaaaaaacctgtttgagcgcatggaggctagggcccaggccatgcagcaaaagattatcgataaagagaacctgaaaaaagaactggagaagaaggctgagaagaaattacctagagacaacctagctaaagagtggtttaatactgattccatgaccctcaacaatacagcatacctactggacaagctgttgcccactctcgtgcccggtgttgagaacatgttaacacaggtggaaaagaaaaaggtgcttacagaggctgatacaccaagtaaattcgatcctattaactacctgggagaatatttgattcgaaacaatcccaactatattaaagaccctggcatgtcaggctaccagcgtcttatgaaagaagtaactgaagacctcaagatttacgtgccagacactatttgtaaccgagtcagcaaaatgaaagaaaatgtgaaacagaacaggaagcagcgagagtctatcgacaagatcatcgtgaaagtggccaatacacgaaagcaggcattacaggaacagttcgacgagtggatcctggaccccaagggaatgatcccaaaatctgtgatccaaaatgtcctgcaggaattcttccagaatcccgattttaaactgggcagtcattgcaaacagttggacataaccgactctaccgaaccacgcttaaataaaatggagttcacagagtatatctcttctcacataaaggatctgaagagcgagatgtttgaggaattgctgaaacacctctgccactcggccgacgaattcagagaggtaatcaaggccgatatgaggcggcaaatgtttgccgagttatttctgcactgcgaccatggtaaggtgggatttcttgaccggcagcgcactctggccctgctggaattattctatgatcacagtagtcagatgctgcgctccctcttacgtaacccaaggcagtggcccttcatcgaatttgaagagattaacctcaccgagctctggggcgacatggacaatcaaaaacatatttacgaggggtttgacaaagttctcttggagatgaatactctactttctgcaaatcacgctagcaagacccagtcaaagctcctggaatcccccgatcagccaaagttaaatgagcagcgcactagcacaccctcccccaacccacccgagcagcagcgcggggttaccgccgaacaggggccccagcgcatctccatcgaggaacaacagcagggaaagaagccgactgctgaacaagagctgtacatcgagtccgtgatcgagccaggcacccacaccgaatcaacactcgagcagggaagtagccggagactgctgactgaacaggagacacatagagagtctaccacagagcagggacagcacaagggttccattgaaggccaggggccacgccgggtaagcgtgagcgaacaaggaagcagccgcgagtcagtcgccgaacagggcagtcgtagggagtctatagcggagcaagatcgtcacaaaggatccgttgctgagcaagggtctagaagaatgtctgccgctgaacagggctccttgagagaaagcgtcatcgaagaaccctatcagaagtccgagcaggggccgtatggagaaattatttccgaagagcaggaggacatcggcagcacaagccagagtcgcaaagactccatattaaaatctactaaatatggggaacccatcacatcagaatatattgaagtgccactacaagagaagcgctcatgggagcagacctacgaagaggagatctttttgtctagcgaattgcaagaagaagtgccaacattgagccggaaggaccacttccccgagacaacaaagaaggaggttcaaaaagacaagccttgtgagccaaaatctcagaaaattgaaggcaagtcctggtccggcgaattttttacatgcaactggaagatgaaatacgttactttcgaggacgaggagcaggccaacctaatatacggaaattctcggtttacagatctccactcaatcatccggaacattcagagctgcaaggaggtaaaaggaagaacggccttcaatggcgtgtctttcaatctgctgcagtttgtgcaactactggaaaccttcgttggcgaagatgctcccctgagcgtgtccgaaaccctaacatctttctttaaggaaggatacgtagaaactgaacaggaaaagatgaacgctttagagcagttctcacagaatgcatttcaggtgagacagcgtctcctactggaggctattttccagaagtgggacagtgacggcagtggttttctggatctcaaggaggtggatgagctgctttacacctacaaggagggcatggaaaaggaaagcatgaaaaaagctaagctccatattcagttcccaaaaccacatcccggacacgaagtgaggctcagttcgaagcagttccagaattacatcgagctggtcgtatccgaactccggggaaatgaggaccaggtgttggaaagcgttgtcgaattcctgatgaatgccctggagcgctcccacatcgaatccttacgaaactccgcccggcggaagtggctgcaccaaatccaatgtgcagctgaaacctctggggtgagtctggaacctgtctactctgagacattcaaggctctgatgcaggatgcagaggcacacggtaacaaaaagatctctgcgcacatctctctactggaggaaaatttgcttctgcccgagaagggcaacgtcttacttcggaacgtggcatgcactcttgacgatgcccaattcgtccttaatagagtcctatatcgagacatgaaggggatctccttcacagtggttgatgaggggaaaccaatccacgttccccaggtgcaatatcatggtaacatcttcttttggaaccagtctagaaacaaacatgattataatggctccttccttgcactgcctctgcaggacgcgtatatgaggatcttcggagtgttggccgtggacacacttagagatcctcatgagataaatatttttctgccacacgaaattagattctaccagggggtcgccaacgtgtttagtacagcatatcattatgtgcacagccgcgagcacattctacatatcgtgataaccggcattggctggctgtatgacgtcacctctagtattacaagcataaccacctatttcgtggagccgtcccctgctcaagactccgactatgtgcttcgtaatatgatggtgactggacaattggggctcaccgaaattcacaagaaccccccaaccattcatcgcaagtcttgcattttcagagattttctgtttaaatgcacagattcaagtgaggtcgtgctcgcaagcgcatgcggggagacacatattgtcgtgcctctgagagagaggactggagaggctttaggtgtgttagattttaatattgggcagaatcgcatgctgctttgtcaggaatacaaagaccttcagaagatgatgaaggtcgtccaagtggcatgttatgaaatcctaggggagttcagcggtgaaattaaaaaaaagtacattcttgagatcgagaacgtgagggaggtccaaagagctgggatcctcttctttcggatcatgttactcgagttacaggaatccattcagttgctcaacagcatggaattcgtttcactactgctgtacgatcatactctggtcacagaaccaaattccccccaggattccaaatccatggagctggaggcaaacgtgaagctcgttcgcgacatcctgaaagcggttattctctttttccaccctgagctcgaattttcttctgatttcggcagttgggataaatgcaagttctatgttaataaatatcttgtgaacaacatttgtgcctttgatcccaccgctaagcacgtggaggtcaacgtgcagttgattgatgaatacatccgcgaccatagtagaactgaagtctggaaatttggaaacgtagtaattgagcacctttaccactggattcacatttgttcagctctgatgaagattacaaagcagctcaattctggtataacccccccgctacctagtaaaaccgataattacatgtacgccaaaatgccgggcgaaggcctgcaggaaaaatag

SEQ ID NO: 29419 - DNA, 2571 bp, Artificial Sequence
  Description of Artificial Sequence: Synthetic coding sequence
ttgggtcaaatgaagtgtaaagagcttaacctggaggggcaacgcaagatttcccccggcagcattaaggatagcaagaccgaggcatctggtaatatcgccatacgcaaatccgccaaggtgatcttcgccctagatgaaacagaactcaaatccaaaccggaacatacttggaagaaaaatctgtttgaacgaatggaggctcgcgcacaggctatgcagcagaagatcattgataaagaaaacctgaagaaagagctggaaaagaaggcagagaaaaagctgccacgagataacctggctaaggagtggttcaacactgactcaatgactctaaataatacagcctacttgttagacaaattactgcctaccctggttcccggggtggagaacatgctgactcaagtggagaagaagaaggtcctcacagaagcagatacccctagtaagttcgacccaattaactacctcggcgagtatttgattaggaataatccgaactacataaaggacccagggatgtctggataccagcggttgatgaaggaagtgactgaagatctaaaaatctacgtgccagacaccatctgcaacagagtgagtaaaatgaaggagaatgttaaacagaatcgaaagcaacgagaatcaatcgacaagatcattgttaaggtcgcaaatacaagaaagcaagctcttcaggagcagtttgacgagtggatccttgatccaaagggcatgattcctaagtccgtcattcagaatgtgcttcaagaatttttccagaaccccgatttcaaactcggttctcactgcaaacagttagacatcacagacagtaccgagccaagacttaataagatggagttcaccgagtacatttcaagtcacattaaagacctgaagagcgaaatgttcgaagaactgctgaagcacctctgccacagcgctgacgagtttcgagaagtcatcaaggccgatatgaggcgacagatgttcgcggagctattcctgcactgcgatcatggtaaggttgggtttctagacaggcagcggacactggcactgttggagctgttttacgatcattcatcccaaatgcttaggagcctgttgcgcaatcctcgccagtggccttttattgaatttgaagaaatcaatctcacggagctctggggggacatggacaatcagaaacacatatacgaaggtttcgacaaagtccttctggagatgaacaccctgctaagtgctaaccatgcctcaaagacccaaagcaagctgttagaatctcccgatcagccaaagctgaatgagcagcgcacttcaactccgtcgccgaatccacccgagcagcaacgtggcgtgacagccgaacagggccctcaaagaataagtatcgaggagcaacagcaagggaagaagcctaccgcagagcaggagttatacatagaaagcgtgattgagcccggcactcacaccgagagcacactggagcagggcagctcccggcgtctcctcaccgagcaagagactcatcgagaatcaaccactgagcagggccagcacaaaggcagtatcgagggccaaggacccagacgtgtgtccgtgtcggagcagggatcgtcacgggaaagcgtagcagaacaaggctctaggagagagtcaattgccgaacaggatcggcacaagggctccgtcgcggagcagggctctcgccgcatgtcagctgcagagcaaggttcccttcgggaaagcgtgattgaagagccatatcaaaagtctgagcaaggcccatatggggagatcatctccgaggaacaagaagacattggaagcacatcccagagcagaaaggattctatcctgaagagtaccaagtatggagagccaattacatctgaatatatcgaagtgcccctccaggagaagagatcctgggaacagacatacgaggaagagatctttctaagttcagagcttcaggaagaggtaccgactctcagtagaaaagaccattttccagaaactactaagaaggaagtacagaaagacaagccctgcgagcctaagagccagaaaattgaggggaagtcttggtccggagagttcttcacttgcaactggaagatgaagtacgttacattcgaagacgaagagcaagccaatttgatttacggaaacagccgtttcactgacctgcatagcattataagaaacatccagagctgcaaagaggtgaaggggcggactgcattcaatggggttagtttcaatctgctgcagtttgtgcagctgttggagacatttgtgggagaggatgccccactgtccgtaagcgaaaccttgaccagcttttttaaagaggggtacgttgaaacagagcaggagaaaatgaacgccctcgagcaggtctcactgtgccggcaggcgggagtgcaatggcgcaattgtagctccttacagccacctacccctggtctgaagcgctcctctcaccacaggctcctgagtaattgggactatagagagagaagaaagtttttccccctcgaaacaaagttcccatag

SEQ ID NO: 29420 - DNA, 1527 bp, Artificial Sequence
  Description of Artificial Sequence: Synthetic coding sequence
atgaaggaaaacgtgaagcagaatcgcaagcagcgagaaagtatagacaagatcattgttaaagttgccaacactcgtaaacaagccttgcaagagcagttcgacgaatggatcctagatcccaaaggaatgattcccaaaagcgtgctgcagattcaaaatgtcttgcaggagttcttccaaaaccccgatttcaaattaggttcccattgtaagcaactcgatatcacggactccacggagccgaggcttaacaagatggagttcaccgaatacatctctagccacatcaaggacctcaagtcagagatgttcgaggagctgctcaagcacctatgccactctgcggacgagtttcgggaggtgatcaaagcagatatgcgcaggcagatgtttgccgagctctttcttcattgtgaccatgggaaggtgggctttctggaccggcagcggacactcgcactgttggagctgttctacgatcacagctcgcagatgttaagaagcctcctacggaacccacgccagtggccattcatagaatttgaggagattaacctgacagagttatggggcgatatggataaccagaagcacatctacgagggattcgacaaggtgctcttggaaatgaacacattgctttctgctaatcacgcaagcaagacacaatcgaaactgcttgagagcccagatcagccgaaactgaacgagcagcgcaccagcacaccgtcccctaacccgccagagcaacagcgaggcgtcactgctgagcagggaccacagaggatcagcattgaggagcagcagcagggaaagaagcccaccgcagaacaagagctttatatcgaaagcgtcatcgaacccggcacccacaccgagtctaccctggagcaagggagctctagaaggctgctgacagagcaggaaactcatcgcgagtctactactgaacaaggccagcacaagggaagcattgagggccagggcccgcggcgggtgtccgttagtgagcaaggctcttctagggaaagtgtggctgagcagggcagtcggcgggagagtatcgcagagcaggataggcataaagggagcgtggcagagcagggctcgcggaggatgtccgctgccgagcagggctccctcagggaatcggttatagaggagccatatcagaagtcagaacaaggcccctatggagaaataatttctgaggaacaggaagatatcggttctacatctcaaagccgcaaggatagcattttgaagagtactaaatacggggaacctatcaccagtgaatatatcgaggttcctttacaggaaaagaggtcgtgggagcagacctatgaagaagaaatttttctgtcgtcagagctgcaggaagaagtgcccaccctctctcggaaagaccattttcccgaaacgaccaaaaaggaagtgcagaaggacaagccctgcgaacctaagagtcagaagatcgagggaaagagctggtctggggagttctttacatgtaattggtag

SEQ ID NO: 29421 - DNA, 2571 bp, Artificial Sequence
  Description of Artificial Sequence: Synthetic coding sequence
atggacgagatcaaaagtcaggaactcaatcttgaagggcaaaggaagatctcccctggttcaatcaaggacagcaaaacagaggctagcggtaatatcgctatccggaagtctgccaaggtgatcttcgccctggatgagacagaattgaagagtaagccggaacacacctggaagaagaacctatttgagagaatggaggctcgcgctcaggcgatgcagcagaagattattgacaaggaaaatttgaagaaggagctcgaaaagaaggctgaaaagaagctgcctagagacaatcttgcgaaggaatggttcaacaccgactccatgacactgaacaataccgcttacttgctcgataagctgctgccaacattggttccaggggtggagaatatgctcacccaggtcgaaaaaaaaaaggtcttgacagaagctgacactccgagcaaattcgaccctattaattacttgggcgagtacttaattagaaacaaccctaattacatcaaggatcctgggatgtcaggatatcagaggctcatgaaagaggtaacagaggacttgaagatctatgttcctgacaccatatgtaatcgggtgtcgaagatgaaagagaatgtgaagcagaaccgcaagcagcgtgaatctattgacaaaattattgttaaagtagccaatacccgtaaacaggctttgcaggaacagttcgatgagtggatcctggaccccaaaggcatgatcccaaagtcagtaatccagaacgtgctacaagagttctttcagaacccagacttcaagctgggtagccactgcaaacaattggatattactgactcaaccgaaccaagactcaacaagatggagttcacggagtatataagctcgcatattaaggacctcaagagtgagatgtttgaggagctactaaaacacctttgccattctgcagatgaatttagggaggtcataaaagcagatatgcggcgacagatgtttgcggagcttttcctacattgcgatcacggtaaagtcggattcctcgaccgccagcggacactggccctgctggagttgttctacgatcacagctcccagatgcttagaagcctcctccgaaatccccgccagtggcctttcatcgaatttgaagaaatcaatcttactgagctttggggggatatggataaccaaaaacacatatatgaggggttcgataaagtactgctggagatgaacaccctcctgtccgctaatcatgcatctaaaacgcagagcaagttgttggagagcccggatcagccaaagctgaacgaacaacgtactagcacaccgagtcctaacccaccagaacaacagcggggcgtgacagccgagcagggcccacagcgtatcagtattgaagagcagcagcaaggcaagaagccaaccgctgaacaggaattgtacatcgagagcgtcatcgagcctggtacccatactgaaagtactttagaacaagggagctcccgaaggctgctaaccgaacaggaaacccaccgcgagtccacaaccgaacaaggacaacacaagggatcaattgaagggcagggccccaggcgtgtgtctgtgagcgagcaaggctcttcgcgagagtctgttgccgagcaagggtcgcggcgggagtcaattgctgagcaagatagacataaaggtagcgtcgcagagcagggaagccggcgcatgagcgcggccgaacagggttcgctgcgtgaatccgtcatagaggagccatatcaaaagtctgaacaggggccttacggggagattatcagcgaggagcaggaagacattggcagcaccagccagtcccgcaaggattcaatcttgaagagtacgaaatacggtgaaccaataacctcagaatacatcgaggttcctttgcaggagaaaaggtcatgggagcagacatacgaggaggagatcttccttagttcagaacttcaagaggaggttccaacgttgagtcgtaaagaccacttccctgagacaaccaagaaagaagtgcaaaaagacaaaccctgtgagcctaagagccagaagatagagggaaagagctggagcggagagttctttacatgcaactggaaaatgaagtatgtcaccttcgaggacgaagaacaggctaaccttatttacggtaattctagatttaccgatctccactccattatcagaaatattcagagctgtaaggaggtcaagggacggaccgctttcaatggcgtgtccttcaacctcctgcagttcgtccagcttctagagacctttgtgggcgaggatgcccctctgagcgtgtcggagaccttgacatcattcttcaaggaaggatatgtggagactgagcaggagaagatgaatgctttggaacaggtctcactgtgccggcaggcaggcgtgcagtggcggaactgctcgagtctgcagcctcccacaccaggtctgaagcgaagcagccatcatagactgctgtctaactgggactatcgtgaaaggaggaagttttttcctctcgaaactaagttcccttag

SEQ ID NO: 29422 - DNA, 1710 bp, Artificial Sequence
  Description of Artificial Sequence: Synthetic coding sequence
atggaattcaccgagtacatctcttcccacataaaagatctgaaaagcgagatgttcgaagagctcctgaaacacctgtgtcattccgcagacgaatttcgtgaggtgattaaggcggacatgagacgacagatgtttgccgaactatttttgcattgcgatcacggaaaggtgggatttctggatagacagagaaccttggcactcctcgaactcttctacgaccatagctctcagatgctccgatctctgctccggaatccacgacaatggccattcatcgaatttgaagaaatcaacctcacagagctgtggggtgatatggataaccaaaagcacatctatgagggattcgacaaagtgctcttggagatgaataccctgctgagcgctaaccacgcttcaaaaacacagtctaaactgcttgaaagtcctgatcagcccaagctgaatgagcagcgcacttctaccccaagccccaatcctcccgaacagcagaggggagtcaccgctgagcagggtccacagagaatttccatcgaagaacaacagcagggtaagaaacccacagccgagcaagagctgtacatcgagagtgtcatcgagcctggtactcacaccgagtcaacactggagcagggatcctccagacgattgcttacggagcaggaaacccaccgagaatctaccactgaacagggacagcacaaggggagtattgaggggcagggaccgcgccgcgtttcagtgtccgaacagggctcatccagggagtccgtggccgaacaggggtcgcggcgggaatccatcgcagaacaggacagacacaagggatccgtcgcagaacaggggagcaggcgaatgagtgctgccgagcaaggcagcctgcgggagtccgttatcgaggaaccctatcaaaaaagcgaacaagggccatacggcgagatcatctctgaagagcaggaagacatcggaagcacctcccagtcccgaaaggatagtatcttgaaatccaccaagtacggggagccaatcacatcagagtacattgaagtcccactgcaggagaaaagatcttgggagcagacatatgaagaagaaatattccttagttcagagttgcaggaagaggtgccgaccctctctagaaaggaccatttccctgaaacaactaaaaaggaggtgcagaaggataaaccttgtgaacccaagtcccagaagattgagggtaagtcgtggagcggtgaattcttcacctgcaattggaagatgaagtatgtgactttcgaggatgaagagcaggcaaatcttatatatggaaatagcagatttacagatctgcacagcataatacgcaatattcagagttgcaaagaagtgaaaggccggacagccttcaatggcgtctcttttaacctcttacagttcgtgcaacttctcgagacattcgttggagaggacgccccccttagtgttagcgagacactcacttccttctttaaggagggatatgttgagacagaacaggagaagatgaacgcattggagcaagtctcattatgtcgccaggccggcgtacagtggcggaactgctcttctctgcagccccctactcctggcctcaagcggagttcacaccacagactgctgtctaattgggattatcgggaaaggcgcaaatttttcccactcgaaaccaaatttccgtag

SEQ ID NO: 29423 - DNA, 1890 bp, Artificial Sequence
  Description of Artificial Sequence: Synthetic coding sequence
atggccatcagtccccggtcagatgctacgttctccagtcagaagagtactccctcagaatctccacggaccaaaaagtttcccctcactgaagaagaaatcttttacatgaattgccgggcggcgtatctgaccgtgtttaagagtagcttggaaaacattatttctaaagatcagttgtacctagccctacagcacgctgggcgaaatcctagccaaaaaactattaataagtactggacccctcaaaccgccaaacttaattttgacgatttctgcatcatactgaggaaagaaaagcccacctcaaaagccgagctgctgaaaagcttcaaacagctcgacgtgaacgatgatgggtgcatcctccacacagatctttacaagttcctgactaagcggggggagaagatgaccagagaggaggtgaatgcaattatcaatttggctgacgtcaatgcggatggtaaattcgattacatcaaattttgtaagctgtacatgaccaccaacgaacagtgcctgaagacaactttagagaaacttgaagtggattctaaactcatgcggcaccagtttgggaatcacatcgaaggcagccccgagcgtgacccctcacccgtgcccaagcctagcccaaagatcaccagaaagaccgatccagaaacatttctcaataagggtgacacgcgatcaagcctcttgtcggccaccaggaaatttaagacctccgtctcttttacggtcaccatgggcgcgaacgggaaccgtaatagtaagctgatggagcccaacctgataaaggactggcaacatatgcagtcaaagggttgttttttcttggaggaagatggggagataatcagtcaccagtaccgcatgcagattgcccagcgatccatggtgtacctgaccatcaaacctttaaacttatctcaggttgaaggtaaaccatccccgtggctgtctgtagacacagctttatacatactgaaggagaacgagtctcaggccaacctacaattggtctgcttcacagagctaaggaacagagaagtgtttggctggaccggtgagttggggcccgggatctactggcttataccaagcacaacgggctgccgattaaggaaaaagatcaaaccagtcacggacgaagctcagttggtctaccgcgacgaaaccggtgaactttttctgacaaaggagttcaagtccactctcagcgacattttcgaggtgattgatctggatggaaacggtctgttgtcgctggaggaatataattttttcgaactccgaaccagtggcgagaaatgcgatgaagatgcgtgggctgtgtgtcgcgagaatttcgacaccaagagaaatgagcttacacgccagggttttatggaccttaacttaatggaagcaaacgacagagaaggcgacccatgtgatctgtgggtgaccctgcactcaatgggatataataaggccctggaattgaccgaagcatgccctttcgtgatcgacatctatgctgagaagtgcaagcccaaaattaaagccgtgcacatggaggcttgctccgggcaactggaaaaggcgatatgcaagtcggtactgtccaatggtgacgccaaggtgatggacgggtatgaaaatatcatcgttcacacctattcatgcgatacctggattactagtgtcattgaaaataaatctgacgaaaaggtcatcatccacattagcaacgaattaagcaagaattgtattaacaacagaggcctgaacatctttgccgtggaagttggtcccaaaagcaccatggtgtgtcaacacgtgatgccgctaaatgagagacaggagtggatctactactgcatttacagcttaataagttag

SEQ ID NO: 29424 - DNA, 594 bp, Artificial Sequence
  Description of Artificial Sequence: Synthetic coding sequence
atgaggctgaaacaaggttctttcctgtggtacctctatttagataaaatttattgtctcctgagcgtacgcaatgtgaaggccctcgctgaatattttcacatccttgacgttcacggtaaaaacactctcaatgatgtccttttctatcacttccttcaccatgtgaccgacctgaaaaaggctcagataaacatcgtattcgacatgctggactggaacgccgttggagaaatagacttcgagaagttttacatgctcgtttgtatgctgctcgcgcaccagaatcacctcgaagggcaatttatgtacaggcactccaggccggtgttcgatctgttggacctcaaaggtgacctcaggatcggtgcaaaaaactttgaaatgtataggtttctcttcaacattcaaaagcaggaattgaaggatctgtttagggatttcgatatcacaggagacaatcgcctcaactaccaagagttcaaactttatacgatcatctacactgacaagctgcagaaacgtcagaagacagaagagaaagaaaaaggggagagaaagcggtcattatactctaagtgccacatcaaatag

SEQ ID NO: 29425 - DNA, 2454 bp, Artificial Sequence
  Description of Artificial Sequence: Synthetic coding sequence
atgtacggagtttgcggctgttgcggagctctgagaccacggtataagagattagtcgataatatctttcctgaggaccccgaggatggtctcgtcaaaactaatatggagaaactgaccttttatgcattgtcagcgcctgaaaaattggaccgcatcggagcctatctgagcgagcggctgatccgcgatgttggccgccaccgctatgggtatgtgtgcatcgccatggaagcccttgatcagctcttgatggcttgtcattgtcagtccatcaatctctttgtcgaatcattcctgaaaatggtcgctaagctcctggagtctgaaaaaccaaaccttcagatcctcgggaccaacagctttgtaaagttcgcaaacatcgaggaagatactccttcttaccacaggagctacgactttttcgtctctcggttttctgaaatgtgtcattctagccacgatgatctcgagattaagacaaaaatacgcatgtccggtatcaaaggtctccagggggtggtgcgcaaaactgtcaacgacgagctccaggcaaacatctgggacccacagcatatggataagattgttcccagccttctgtttaatctgcagcatgttgaggaggccgaatccagaagcccaagtccgctgcaggctcctgagaaggagaaagagtcgcccgctgagcttgccgaacgttgtctccgagagctgcttggtcgggccgccttcggaaatatcaaaaatgctattaagcctgtactgattcacctggataatcatagtctgtgggagccaaaagtgttcgcaatacgctgtttcaagatcattatgtacagcatccagccacaacacagccacctggtcatccagcagttgctgggccacctggatgccaacagtcgctccgctgccacggttcgagctggaatagtcgaggttttatcagaggctgccgtcatcgcagccaccgggtccgtgggacctactgtgcttgaaatgtttaacacattgctgaggcaactgcggctatcgatcgattatgccctaaccggttcctacgacggcgccgtgagtctaggaacgaaaatcataaaggagcacgaagaacgaatgtttcaagaggctgtgattaaaacagtaggttcgtttgcgtccacgcttcctacgtaccagcggagcgaggtgattttgttcatcatgagtaaggttcccagaccatctctgcaccaggctgtggatacgggaaggaccggagaaaatcggaacagactcacccagatcatgctcctaaaatcacttctgcaggtcagtacaggattccagtgcaacaacatgatgagtgccctgcccagtaacttcctggataggctgctttccactgctctgatggaggatgctgagatcagattgttcgtgctcgagatcctgatatcatttatcgatagacatggcaatagacacaaattctcaacaatctctactctgagcgacatctctgttctgaagttgaaagtggacaagtgctcccgtcaagacactgtttttatgaagaaacacagccagcagctttacaggcacatttatctaagttgtaaagaggaaaccaatgtgcagaagcattacgaagccctgtatggattgctcgctctcatatctatagaactcgccaacgaggaagtggtggttgacttgattaggctggttctggctgtgcaggacgtggcccaggtgaatgaagaaaatttgcccgtgtacaacaggtgtgctttgtacgcactgggcgcagcctatcttaacttgatttctcagctgactacagtgcccgccttttgccaacatatccacgaagtgatcgaaacgaggaagaaggaagcaccttacatgttgcctgaggatgtgtttgtggagaggccgcggctgagtcagaatctagacggcgtagtcatagagctactattcagacagagcaagatttcagaggtactcggcggcagcggatacaactctgatcgcctctgcctgccctatatcccccagttgacagatgaggataggctttcgaagcggcggagcatcggtgagacaatctcactgcaggtggaagtggaaagcaggaatagtcccgaaaaagaggaacgggtccctgccgaggaaatcacttatgagactctgaaaaaggctatcgtggactccgtggctgttgaggaacaggaaagggagcgccggaggcaggtggtggaaaagttccagaaagccccctttgaagaaattgcggctcactgtggggctcgggcaagcttgctacagagtaaattgaatcagatctttgaaatcacgatacgccctccgccgagcccttccgggacgatcacagcggcatacggtcagccgcagaaccatagtatccccgtgtacgaaatgaaatttccagatctctgcgtctactag

SEQ ID NO: 29426 - DNA, 2349 bp, Artificial Sequence
  Description of Artificial Sequence: Synthetic coding sequence
atggagaaactgacgttttacgccctgtctgctcctgagaagctcgaccgtatcggagcttatttgtcagaaaggctcatccgcgacgttgggcggcacaggtacggctacgtctgtatcgcgatggaggccctggatcagttgttaatggcctgtcactgccagagcatcaacctttttgtggaatcattccttaagatggtagctaaattgctggagagcgagaagcccaatttgcaaatactgggtaccaacagtttcgtgaagttcgcaaatattgaggaggacactccgtcttatcacaggtcttatgatttcttcgtttccagattcagcgagatgtgtcactcaagccatgacgacctggaaataaaaacgaaaatccgcatgagcggaatcaaaggattgcagggcgtcgtgcgaaaaacggtgaacgatgagctccaagctaacatctgggacccacaacacatggataagatcgtgccttccctgttgtttaacttgcagcatgtcgaagaggccgagtctcggtctcccagtcccttgcaggcgccggaaaaagagaaggaatccccagccgagctcgcagagaggtgcctcagagagttacttggtcgtgccgcctttggcaacattaagaatgcaatcaaacctgtcttgattcatctggacaatcactctctgtgggaacccaaggtctttgcaattcgctgcttcaagattatcatgtactccattcagccccagcattcgcacctggtaattcagcagctgttggggcacctggacgccaatagccgatccgccgctacggtacgggcggggattgtggaggtgttatccgaagctgcggtcatcgccgccacagggtctgtcgggccaactgtactggagatgtttaataccttgctgaggcaactgaggctctccattgactacgccttgacaggcagttatgatggtgccgtatctctcggtaccaaaattatcaaggagcatgaggagagaatgttccaagaggccgtaatcaagactgtaggttctttcgccagtacactgccgacataccagcgtagtgaggtgatcctttttatcatgtctaaggtgccgcgcccgtcgctccaccaggcggtagacaccgggaggaccggcgagaatcgcaatcgactcacccagatcatgctgctaaaaagtctgcttcaggtgagcacggggtttcaatgtaacaatatgatgtccgccctgcccagcaacttcctggacagacttctgagcactgccctcatggaggatgccgaaatcagactcttcgttctggaaatactgatctcattcatagaccgccacggcaataggcacaagttttcgactatttctaccctgagtgacatatctgtgttaaaattgaaggtagataaatgctcaagacaggacacggtgttcatgaaaaaacacagccagcagctatatagacacatctatctgagttgtaaggaggaaaccaacgttcaaaagcattacgaggcattatacggcctcttggccctcatcagtatagagcttgcaaatgaggaagtggtagtagatctcattcgacttgtgcttgcagtccaggacgtggcacaagtcaacgaagaaaacctccccgtgtacaatcgttgtgctttgtatgccctgggggcagcgtacctcaatctgatcagccagcttacaactgttccagccttttgtcagcacattcatgaggttattgagactcgcaaaaaagaggccccatacatgctccccgaagacgtgttcgtggaaaggccccgcctgagccagaaccttgacggcgtggtgattgaactgttgtttcgtcaatccaaaatctcagaggtgcttggtgggtccgggtataacagtgatcgcttgtgtctgccatatataccacagctcactgacgaagaccggctgtctaagcgccgaagtatcggagaaactatcagtttacaagtggaggtggagagccgaaactcacccgagaaggaggagagggttccagctgaggagattacctacgagacactgaaaaaggcaatcgttgacagcgtggcagtggaagagcaggagagggagagacggcgacaagtcgtggagaagttccagaaagctccatttgaggagattgcggctcattgtggagcgcgggctagcctcctgcagtccaaactgaatcagatcttcgaaattaccatccgacctcccccctccccatccggcacaatcactgccgcgtacggacaaccccagaatcacagcatcccagtctacgagatgaaattccccgacctctgtgtgtactag

SEQ ID NO: 29427 - DNA, 4572 bp, Artificial Sequence
  Description of Artificial Sequence: Synthetic coding sequence
atgaccagcgtgtggaagaggttgcagcgagttggcaagagggctgcaaaatttcagttcgttgcttgttatcatgaactcgtgctggagtgtaccaaaaagtggcaacctgacaagctcgtcgtggtgtggacaaggaggaaccgtagaatatgtagtaaggcacattcctggcagcccggcatccagaacccatacagaggaactgtcgtgtggatggtccctgagaatgtggacatttctgttacactgtaccgtgacccacatgtcgatcagtacgaggccaaggaatggaccttcatcatcgaaaatgaatccaaaggacagcggaaggtgctggcgacggccgaagtcgacctggccaggcatgcagggccagtccctgtacaggtgcctgttcgtctgcgcttaaagccaaaatcggtgaaagtcgtgcaggccgagctctccttgacactgagcggagtgctcctacgggaggggagggctaccgacgatgatatgcagagtctggcctcgctcatgtccgttaagcccagcgatgtgggtaatttggatgatttcgccgagagtgatgaggacgaggcgcatgggccaggggctcccgaggcccgcgcacgggtgccccagcctgatccatctcgtgaattgaagaccctgtgcgaagaggaggaggaggggcaaggtcgccctcagcaggccgtcgcttctccgtccaacgcggaggatacatctcccgctcccgtgtctgcacccgctccccccgctcgcaccagtcgtggacagggttccgaacgcgccaacgaagcgggcgggcaggtgggcccggaggctcctcggccaccggaaacctccccggaaatgcgctcgagccgccagcctgcgcaggataccgcacccacccccgctccgcggctgagaaaggggagtgacgcactgagacctccggtgcctcagggagaagacgaagttcccaaagcctcaggagccccccctgccggactgggtagcgcaagggaaacccaggcacaggcctgccctcaggaagggaccgaggcccatggcgctcggctggggccatccatcgaagacaaggggagtggggacccgtttggcaggcaacgtctgaaagctgaagagatggatactgaggacaggccggaagcctcgggggttgacacagagccacgaagtgggggtcgggaggcaaatacgaagcggagtggcgttagggcaggagaagcagaggaatcgagcgcagtctgccaggtggacgcggagcagaggagtaaggtgcggcacgtggacactaagggccctgaggccacgggcgtgatgcccgaagctagatgtagggggacccctgaggccccccctagaggttcccaaggaaggctgggagttcgcaccagggacgaggcaccctctggactttcgctcccaccagcagaacccgctggccatagcgggcagttgggggacttagagggcgcgcgggccgccgccggtcaggagcgtgagggggcagaggtacggggtggcgctcccgggatcgaggggactggccttgaacagggccctagtgtgggggctatcagcactcggccacaggtttctagctggcagggagccctgctctccacagcacaaggtgctatttctcgcggtctggggggatgggaggcggaagcgggcggtagcggcgatctggagacagaaactgaggtggtgggcttagaggtcctcggtacacaggagaaagaggtcgaagggtccggattccctgagacaagaacactagagattgaaattctgggagcactcgaaaaggaagccgctaggagtcgagtgctggagagcgaggtggccggcactgctcaatgcgagggcctggagacccaggaaacagaggttggggtaatagaaaccccaggtactgagactgaagtccttggaactcagaagactgaggcaggggggtcaggcgtgctgcagaccagaaccaccatagcggaaacagaggtgctcgtaacccaggaaattagcggcgacctgggccctctgaagatagaggacaccatccagagtgaaatgctgggcacccaggaaacagaagtggaggcctctcgagttcccgaatccgaggccgaaggcaccgaggctaaaattttggggactcaggagattactgcaagggatagcggagtgcgagaaatcgaagccgaaattgctgagtctgatattctggtggcacaggaaatcgaggtcggtttgttaggggtgctgggaatagagactggcgctgcagaaggcgcaatattgggcacccaggaaatcgcctccagagacagcggcgtgcccggactggaagcagacacaacgggcatacaagtgaaggaggtgggcggtagcgaagtccccgagatcgcaaccggtacggccgagaccgagatcctgggaacccaggagattgccagtcggtccagcggagtgcctggcctggaatccgaagtcgctggcgcccaggagaccgaggttggcggctctggaattagtgggcccgaagcgggcatggccgaggctagagtactgatgacgagaaagaccgaaattatcgttccagaagctgagaaggaagaggcccagacatctggcgtgcaggaggctgaaacaagagttggtagcgctctgaaatatgaagccctgcgcgctcctgtcacccagcccagggtgttaggctctcaggaagcgaaggctgagatttcaggggtccagggaagcgagactcaggtgctgcgtgtacaggaagctgaggcgggcgtctgggggatgtccgaggggaagtctggcgcttggggcgcccaggaagcggagatgaaggtcctggaatcccctgaaaacaaatcaggcacatttaaagcgcaggaggcagaggctggcgtgctaggtaatgaaaaaggaaaggaggcagaaggcagtttgaccgaggctagtctaccagaagcgcaggtcgctagcggagccggagcgggcgcgcccagggcttcttcccccgaaaaggccgaggaggatagacgcctcccgggaagtcaggcacctccggctctggtgtcttcaagccaatcactcctggagtggtgccaggaagttacgacaggatacaggggcgttaggatcacaaacttcactacatcctggcggaacggactggccttttgtgccatcctccacaggttctacccggacaagatagattacgcttctctggatcctttaaatataaaacagaacaacaaacaagcctttgacgggtttgctgcacttggtgtttcacggctcctcgagcctgccgacatggtattgctgtcagttccggataaactcatcgtcatgacctacctttgccagatcagggctttctgcaccggccaggagttgcaactcgtgcagctggaaggtggaggaggagccggcacataccgggtcggcagtgcccaaccttcccctcccgacgatctggatgccggtggcctcgctcaaaggttaagggggcacggagccgaaggcccccaggagcccaaggaagcggctgaccgggctgacggcgctgcacccggggtggcctcccgaaacgccgtcgccgggcgagcctctaaagacgggggagcggaagcccctcgcgagagccggcctgccgaggtaccagccgaagggctcgttaacggtgccggagctcccggaggaggcggcgtgcgattgaggcgcccctctgtgaacggcgagccaggaagtgtgccgccccctcgtgcccacggcagttttagccacgtaagagacgctgacctgctcaagaaacgaaggtcccgcctcaggaattccagctcctttagcatggatgacccagacgctggggccatgggggccgcggctgccgaaggtcaagcgcctgacccatccccagctccggggcctcctaccgctgccgacagccagcaaccgccaggaggctcgtccccttccgaagagcctccaccttcacccggggaggaagctggccttcagaggtttcaagataccagccagtacgtgtgtgcagaactgcaagcactagagcaggaacagcggcagatcgacgggcgggcggccgaggttgagatgcagcttagaagtctcatggaatcaggggccaataagctccaagaagaggtactgatccaggagtggttcactcttgtgaataaaaaaaacgcacttatcagacggcaggatcagttgcaattactgatggaggagcaggacttggagcggcgttttgaactgctttcacgagaactgagagctatgttggccatcgaagattggcagaagaccagtgcacaacagcatcgggagcaactactgctcgaggaacttgtgtccttggttaaccagcgcgacgaacttgttcgagacctggaccacaaggagcgtatcgcactggaggaagacgaacgcttagagcggggacttgaacagagaagaaggaagctcagcagacagttgtcccgccgtgaacgctgcgttctctcgtag

SEQ ID NO: 29428 - DNA, 1005 bp, Artificial Sequence
  Description of Artificial Sequence: Synthetic coding sequence
atgaagcattttctgagaatgctgattcaggtctgtctgtacttttattgcaaattcctctggaggtgtttgaagttcgtgatgcggaagctcactgggagatgcgagctgcagcggatctgttacaataccaaacccggggcctccaggaccatgaaaatcgaaactagcctcagagacagtaagtccaaactgctgcagactagcgtgtcagtacaccctgatgcgatcgaaaagacaattgaggatattatggagctgaagaaaataaacccggacgtaaacccacagttggggatctctctgcaggcatgcctcctccagattgttggttatagaaacctcatcgcggatgtcgagaagctccgtcgtgaagcctacgattccgataacccccagcatgaggagatgctgctgaagttgtggaagtttttgaagcccaacacccctcttgagagtcgcatatcgaagcagtggtgtgagatcggattccaaggagatgatccaaaaactgacttccgtggcatggggctgctcgggttgtacaatctgcagtacttcgctgagcgggatgccaccgccgcccagcaggttctgtcagacagtctgcatccaaagtgccgggatatcacgaaggaggaaatttcaaagtttagcaaggcagagtgggagaaaaaacggatggacaaagccattggttacagttttgccattgtcggaattaatatcacagacctggcctataatctgctcgtttccggtgcattaaagactcatttttacaacattgcgcccgaggccccgacattgtcccatttccagcagacattctgctacttgatgcacgaattccacaagttttggatagaagaggaccccatggatatcatggagttcaatagagtcagagagaaatttcgaaagaggatcatcaagcagctgcagaaccccgatatggcactctgtccccattttgctgcctccgagggcctaattaatatgtag

SEQ ID NO: 29429 - DNA, 981 bp, Artificial Sequence
  Description of Artificial Sequence: Synthetic coding sequence
atgaaacatttcttgcggatgttgatccaagtgtgtctgtatttctactgtaaattcctgtggcgatgcttaaagttcgtgatgcggaagctgacagggcgctgtgagctgcaaagaatttgctacaatacgaagccaggggcgagcagaaccatgaagatagagactagtttgagagattcgaaatcaaagctccttcagacatctgtctcagtgcaccccgatgccatcgagaaaaccatagaagatattatggagctcaaaaagatcaatccggacgtgaatccgcagcttgggatctctctccaggcttgcctgcttcagattgtcggctacaggaacctcatcgctgacgtggagaagctgaggcgggaagcctacgactctgataatcctcagcacgaggaaatgctgctgaagttgtggaagtttctcaagcccaatacaccacttgaatcaagaatatccaaacagtggtgcgagatagggttccagggcgatgatcctaaaacagactttagaggcatgggcctgctaggactttataacttacagtacttcgcagaaagagacgcaacagcagcacagcaggtgctgagtgacagcctgcacccaaagtgcagcaaatttagcaaagctgaatgggagaaaaagcgaatggacaaggccatcggttactctttcgcaattgtgggtataaacattaccgacctcgcatacaacctcctcgtgtctggtgctctcaagacccacttctataatattgcgcctgaagcccccaccctgagtcacttccaacaaaccttctgttatctgatgcatgaattccataagttttggatagaggaggaccctatggatattatggagtttaatcgagtgcgtgagaaattcagaaaacgcatcattaagcaactgcagaaccctgacatggctttatgtccccactttgccgccagcgaaggcctgatcaatatgtag

SEQ ID NO: 29430 - DNA, 1176 bp, Artificial Sequence
  Description of Artificial Sequence: Synthetic coding sequence
atgaacgagaagtcatgttccttccactctaaagaagaactgcgcgacggacaaggcgaacgcctttcagcgggatacagcccaagctatgataaggacaaatccgtgttggctttccgggggatcccaatctctgaactgaagaaccatggaatcctgcaagctctaaccactgaagcatatgaatgggagccccgtgtggtctctactgaggtggtgcgcgctcaagaggagtgggaggcggttgataccatccagcctgaaactggatctcaggcctcatccgagcagccagggcaactcatatcgttctccgaagccctccagcacttccagacggttgacctttctccctttaaaaaaagaatccagcccaccatcaggagaacaggcttagccgcactccgccactacttgtttggtccccccaagcttcatcagagattacgtgaggaacgcgatcttgtgctcaccatcgcccagtgcggactcgatagccaggatcctgttcatggacgcgtgctgcagactatctacaaaaaactgactggctcgaagtttgattgtgcactccacggcaatcattgggaagacttgggctttcagggcgccaaccctgccacggacctccgcggcgcgggcttcctggctctgctgcacctgttatacctggtgatggacagtaagacgttgcccatggcccaggagatcttcaggctgagtcgccaccacatacaacaatttccattctgcctgatgtcagtgaacatcacgcacatcgcaattcaggctctccgtgaggagtgcctcagcagagagtgcaaccgccagcagaaagtgatccccgtggtcaacagcttttacgccgcaacattcctgcaccttgctcacgtttggagaacacagagaaaaactattagcgacagcggttttgtcctcaaaggggtcctcttcctgctgggccggccacgtctcaatgcccagtgcccacgctcaagggaaccaaaggttgttgcccgactggtgctggctgcggtactcccccatcctcacttcttaaagtttcagctgaccaaaataagcatcacccatccgctagaatcagcaagcagcccattttccgctctgacggtggccctgttttggagctatacctacgataaacacatcttctag

SEQ ID NO: 29431 - DNA, 1146 bp, Artificial Sequence
  Description of Artificial Sequence: Synthetic coding sequence
atgaacgaaaagagttgttcctttcactcgaaagaggagctcagagatggccagggagagagactgtctgccgggtacagtccttcctatgacaaggataagagcgtgctggccttcaggggcatacccataagtgagctcaagaaccacggaatcctccaggcattgacaactgaggcgtatgagtgggagcctcgtgtggtctctacggaggtggttcgtgcccaagaagaatgggaagcagtcgatacaatccagcccgaaaccggatcccaagcttccagtgagcagcccgggcaattaatcagtttctccgaggcgctccaacacttccaaactgtggacttgtcaccattcaaaaaaaggatacagccaactattaggcggactggcctggcggcactgcggcactatttatttggaccccccaagctgcaccagaggttgcgagaggaacgggacctcgtgctaacaattgcccagtgtggcttagatagccaggatcccgttcatgggagagtgcttcaaaccatctacaagaagctcaccggatccaagttcgactgcgccctgcacggcaatcattgggaggacctcggatttcagggggccaaccctgccaccgacctgagaggggctggttttttggcactgctccacctcctctatctggtgatggattcaaaaacactccctatggcccaagaaatctttcgtctgtcaagacatcatattcagcagttcccattttgtctgatgtccgtaaatattacacatattgcgatccaagcactgcgggaagagtgccttagccgcgagtgcaatcgtcagcagaaggtgatccccgtggttaacagcttttacgctgctacctttttgcacctggctcatgtttggcgcacccagcggaagaccatttcagattccggctttgttctgaaggaattagaagtgctcgcgaagaagtcaccacggaggctactgaagacgctcgaactgtaccttgctagggtaagcaaaggccaggcgagcttactcggcgcccagaagtgctatgggccagaggcgccccccttcaaggatctgacgttcactggcgagagtgatctgcagtcacatagcagtgagggcgtatggttaatctag

SEQ ID NO: 29432 - DNA, 1146 bp, Artificial Sequence
  Description of Artificial Sequence: Synthetic coding sequence
atgaacgagaaaagctgctcctttcactctaaagaagagctgagggacggccaaggagaaagactttcagctgggtattccccaagctatgacaaagataagagtgttcttgccttcagaggcatcccgatttccgagctgaagaaccacggcattctgcaagctctgactactgaggcttacgagtgggagcctcgagtcgtgagtaccgaagttgtacgggcccaggaggagtgggaggccgtggacaccattcaacccgagacaggctcccaggctagttctgaacagcccggacagcttatttctttcagcgaagcactgcagcattttcagactgtggacctgagccccttcaagaagcgcatccagcccacaatccgacgaaccggattggccgctctgcggcactatttgttcggcccgccaaagctgcatcaacgactccgagaggaacgggacctggttctcactatcgcccaatgcgggcttgactctcaagacccggtgcacggacgtgttctgcagaccatttacaaaaagttaacaggctcgaagttcgattgtgcgttacacggcaaccattgggaggacctcggttttcagggggccaaccccgctactgaccttcggggagccgggtttcttgcccttctgcacctcctgtacctggtcatggactctaaaacgctgccgatggcccaggagatctttagactttcgcggcatcatatccaacagtttccattctgcttgatgagcgtcaatatcacccatattgccattcaagcacttcgtgaagagtgtctaagccgcgaatgtaaccgccagcagaaggttatccctgtggtgaactccttctacgcagcaacctttctccacctggcccatgtttggcgcacccagcgaaaaaccattagcgacagtggattcgtactgaaggaactagaagtgctcgctaaaaagtctcctcggcgtctcctcaaaaccttggagctttatctcgctagagtgagcaaaggccaggccagtctgcttggggctcaaaagtgctacggacctgaggcgcctccctttaaagacctgacattcaccggagaaagcgacctccaatcacactcgtctgaaggagtatggctgatttag

SEQ ID NO: 29433 - DNA, 612 bp, Artificial Sequence
  Description of Artificial Sequence: Synthetic coding sequence
atgaatgagaagtcttgcagctttcactccaaggaggagctcagagatggtcagggcgagcggctgtctgcaggttacagcccctcctacgataaggataagagcgttcttgccttcagaggaatccccatatcagagctgaagaaccacggtattcttcaagccctaactactgaggcctacgagtgggagccaagagttgtttccactgaagttgtgagggcccaagaggagtgggaagcagtggacaccatacaacctgaaactggttcccaagccagttccgagcagcctggccagctcataagcttctcggaagcacttcagcattttcagacagtagacctcagtccatttaagaagcgcatccaacccaccatccggcgaacaggtttggcggccctccgccactacctcttcggcccccccaagctgcaccagcgactgagagaggaaagagatctggtcttgactatcgcacagtgcgggcttgactctcaggatccagtccacggccgcgtcctacaaacaatttacaagaaactgacgggatcaaaatttgattgtgctctccacggtaatcactgggaagatctggggtttcagggatag

SEQ ID NO: 29434 - DNA, 1146 bp, Artificial Sequence
  Description of Artificial Sequence: Synthetic coding sequence
atgaatgagaagtcttgttctttccacagcaaggaagagcttcgagacggacagggggagagactttcagccggatattcaccctcgtatgacaaagacaaatccgtgctggcgttccggggcatccccatcagcgagctgaagaaccacggcattctccaggccctgactacagaggcttacgagtgggagcctagggtagtcagcactgaagttgtgcgtgcccaggaagagtgggaagctgtcgacacgattcagccggaaacaggttcacaggcgtcatcagagcagcctgggcagctgatctccttctccgaggctctccagcacttccagacagtggacctttcccccttcaagaagcgtatccagcccacaattagaaggacagggctggccgctctgcgtcactatctgttcgggcctccaaagctgcatcagcgcttaagagaagagcgggatctggtcctcacaatcgctcagtgtgggctcgactctcaagaccccgttcacgggagggtgttgcaaaccatctataagaagctcacaggtagcaagtttgactgtgccttgcacggcaaccattgggaagacctcgggttccagggggcaaaccccgccactgatcttaggggggcaggctttcttgccctcttgcacctgctgtatctagtcatggactctaaaaccttgcctatggctcaggaaatcttccggctgtcccgacaccacatacagcagttcccattctgtctcatgtctgtgaacattacgcacatagccattcaagctctgcgagaggagtgcctgtcacgggaatgcaaccgccagcaaaaggtcattcccgttgtgaattctttctacgcggccacgttcctgcaccttgcccatgtgtggcgaacccaacggaagaccatctcagacagtggctttgttctgaaggagctcgaggtgctggccaaaaaaagccctcgacgactcctgaaaaccctggaactctatctcgctagggtaagtaaggggcaggcaagcctcctcggtgcacagaaatgttacggtccagaggcccccccattcaaagacctgacattcactggggaatctgatctgcagtcccattctagcgagggggtgtggctcatatag

SEQ ID NO: 29435 - DNA, 1146 bp, Artificial Sequence
  Description of Artificial Sequence: Synthetic coding sequence
atgaacgaaaagagctgtagctttcattctaaggaggaactccgggatgggcaaggggaacgactatctgccgggtattccccttcttacgataaggataagagcgttctggccttccggggaatacctatctccgagctgaagaaccatggtatcctgcaggccctgaccacagaagcctatgaatgggagccccgggtggtcagcaccgaggttgtgagagcccaggaagagtgggaagccgtggacaccatccagcccgaaaccggatcgcaggccagctcagaacagccaggacagctgataagcttcagcgaagcactccagcactttcaaaccgtggacctgtccccttttaaaaagagaatccagccaaccatccgtaggaccggcctggcagcactccgtcattatctttttgggccacccaaacttcaccagcgacttcgcgaagaaagggatttagtgctgaccattgctcagtgtggacttgatagccaggatccagtccatggccgcgtcctgcagaccatctataagaagctgactggctccaagttcgactgcgccctacacggaaatcattgggaggacctggggttccagggtgcgaaccctgctaccgatctccggggagccggtttcttagcccttctacacttgctatatctagttatggatagtaaaactctccccatggcccaggaaattttccggctgtcgcgacaccatatccagcagttcccattttgtctaatgtccgtcaatattacacacattgcaattcaggcactcagagaggagtgcctgtcccgcgaatgtaatcggcagcaaaaagtgatcccggtggttaactcattctatgccgccaccttcctccacctagctcacgtgtggaggactcaaaggaaaactatctcagactcaggctttgtgcttaaggaactggaggtactcgccaagaagagccccaggaggctgttgaaaacattagagctgtatctggccagagtgagtaagggccaagccagtctgctgggagcacagaaatgttacggtcctgaagcgcccccttttaaagacctcacgttcacgggggagtctgatcttcagtcacattcatctgaaggcgtgtggctgatctag

SEQ ID NO: 29436 - DNA, 363 bp, Artificial Sequence
  Description of Artificial Sequence: Synthetic coding sequence
atgaacgagaaaagctgtagcttccattcaaaagaagaactgagggatggacagggcgagcggctaagtgcaggctactcacctagttacgacaaggacaagtccgtgttggcgtttcgaggcatccccattagtgagctgaagaaccacggtattctgcaggctctgactactgaggcctacgagtgggagccacgcgtggtcagcaccgaagtggtccgcgctcaggaagagtgggaggcagtggatacgatccagcctgagacaggaagccaagccagtagcgagcagcccggacaacttatcagcttttctgaggccttgcaacacttccagacggtagatctgagcccctttaagtag

SEQ ID NO: 29437 - DNA, 765 bp, Artificial Sequence
  Description of Artificial Sequence: Synthetic coding sequence
atgaacgagaaatcatgttcattccactcaaaggaagagttgcgtgacggacagggggagcgtctctctgccggatacagccctagctatgacaaagacaagtccgtgcttgcttttagaggcatccccatctctgagctgaagaatcatggcattctgcaagccctcactaccgaggcttacgagtgggagccaagggttgtatcaaccgaagtggtcagagcccaggaggaatgggaggccgtcgatactatccaacccgagacagggtctcaggcttcttctgagcagcctggacaactcatctcgttctcagaagcgctgcagcattttcaaactgtggatttatcaccgttcaagaagcgaatccagcctaccataagacgtaccggactggctgccctgagacactacctgttcggcccaccaaaactccatcagagactgcgtgaggagcgtgacctggtactcaccatagcgcagtgtggcttggacagccaagacccggtgcacggacgcgtgctgcagactatctacaagaagctgactggctcaaaattcgattgtgctttacacggaaatcactgggaggacctcggcttccagggtgcgaatccagctaccgatctcagaggagccggctttctggcccttttgcaccttctgtacctggtcatggattcaaagaccctccccatggcacaagaaatcttccggctgtcaaggcatcacatccaaatcgagaggaatcagggcaaggggtag

SEQ ID NO: 29438 - DNA, 3363 bp, Artificial Sequence
  Description of Artificial Sequence: Synthetic coding sequence
atggtgttaaatagcctggacaagatgattcaactccagaagaataccgccaacatacggaacatctgcgttctggcccatgtggatcatggaaagaccactcttgccgactgcctcatctcatccaatggcattatatcctcccggctggccggcaagctgcgctatatggattctcgtgaggacgaacagatccgggggatcaccatgaagtcctctgcgatcagcttgcactacgctaccggaaatgaggaatacctgatcaacctgattgattctcccgggcacgtggatttctccagcgaagtcagcactgccgtgcgtatctgtgacgggtgtattatcgtggtcgacgccgtggaaggcgtgtgtccccagactcaggcagtactgaggcaggcctggctggaaaatatcaggcctgtccttgtaatcaacaaaatcgataggctgatagtggagttgaaatttacaccccaggaggcctactcccatctgaagaacatcctggaacagattaacgcactcacaggcactctattcacctccaaagtcttggaggaacgagctgagagagagactgaatcccaggtgaaccccaatagcgagcagggggaacaggtttacgactggtccaccggtctggaggacaccgacgattcacacctctatttttcacccgagcaggggaacgtcgtgtttaccagtgccattgacggctggggctttggaattgagcactttgcgaggatttatagtcagaaaattggaataaagaaagaggtcctcatgaagaccctgtggggcgattattatattaacatgaaggctaagaaaatcatgaagggggatcaggctaaagggaagaagcccctgtttgtgcaactgattctggagaacatctggtcgctgtacgatgccgtactcaaaaaggacaaggacaagattgataaaattgtgactagcctgggcctgaagataggggcccgcgaggcgcggcatagtgaccctaaagtacagattaacgcaatttgctctcagtggctgcctattagtcacgccgttctcgctatggtctgtcagaaacttccttcacctctggatattaccgcggaaagagtggaacgactcatgtgcaccggcagtcagacttttgactccttcccacccgagacgcaggccctgaaagctgcattcatgaaatgcggttccgaagacacagccccggtgattattttcgtgtcgaagatgttcgccgtcgacgccaaagctctgcctcagaacaaacccagaccccttacccaggaggagattgctcagcgccgagaaagggcccggcagcgtcatgcagaaaaactcgccgcagctcagggtcaggcacctttggaaccgactcaggatggttcagccatcgagacttgtccgaaaggtgaggagcctaggggcgacgagcagcaggttgagagcatgacacctaagccagtattgcaggaggaaaacaatcaggagagcttcatcgcattcgcaagagtgttctccggcgtggcccgccggggcaagaagatcttcgtgttgggaccaaaatatagcccacttgagttcctgcggagggtgcccctcggtttttctgcaccccctgacggactgccgcaagtcccacatatggcgtactgcgcgttggaaaacctttatttgctgatgggacgggaactggagtacctagaagaagtgcctccagggaacgtgcttggtatcggtgggctccaagacttcgttctgaagagcgccacgttgtgctccctgccgtcttgccctccgtttatacccttaaatttcgaggcgacgccaatcgttagggtcgccgtcgagcccaagcacccatctgagatgcctcagttagtgaagggaatgaaactcttgaaccaggcagatccatgcgttcaaatcctgatccaagagaccggtgagcacgtgctggtgaccgcaggtgaggtgcatctgcaacggtgcctcgacgacttgaaggagaggttcgccaagatccacatctccgtgagcgagcccatcattcccttccgagagacaattacaaagcccccgaaggtggatatggtcaacgaagagattgggaaacagcagaaggtcgccgtgattcaccagatgaaggaggatcagtccaaaattcccgaaggcatccaagtggactcagatgggcttattaccataacaactccgaacaaactcgccaccctgtccgttagagctatgccactgcccgaggaggtgacacaaattctggaggagaatagcgacctaattaggtctatggaacagctaaccagtagccttaacgaaggtgagaatacacatatgatccaccagaagacccaagaaaaaatctgggagttcaaaggcaaactagaacaacatctgactggaagaaggtggcgaaatatcgttgatcagatctggtcatttggcccccggaagtgcgggcctaatatcctcgtcaataagtccgaggactttcaaaatagcgtatggacagggccggcagacaaagctagtaaggaagcaagccggtacagagatttagggaactcgatcgtcagtggtttccagttagccacattatctggccccatgtgtgaagaaccactgatgggagtatgcttcgtcctggagaagtgggacctcagtaagttcgaggagcaaggagcatccgacctcgcaaaagaaggccaggaagagaatgaaacgtgttcaggcggaaacgagaatcaggagctccaagatggctgcagtgaggcattcgaaaagagaacatcacaaaagggggaaagccctctgaccgactgctatggtcctttctccggacaattgatcgcgacaatgaaagaagcctgccgatatgcattgcaggtaaagcctcaaaggcttatggcggcaatgtacacatgtgacatcatggccacaggagatgtgttggggcgagtgtacgccgttttaagcaagagagagggccgcgtcttgcaggaggaaatgaaagaggggacagacatgttcattatcaaggctgttctgccagtggccgagtcttttggatttgcggatgaaattaggaaaagaacatctggacttgcatcaccacagctagtcttttcgcattgggagataattccatcagatccattctgggtgcccaccaccgaggaagagtacttgcattttggagaaaaggccgacagcgagaatcaagccaggaagtacatgaacgccgtgcgtaaacggaagggactgtacgtagaggagaagatagtcgaacacgctgaaaagcagcggaccctgagcaagaataaatag

SEQ ID NO: 29439 - DNA, 3210 bp, Artificial Sequence
  Description of Artificial Sequence: Synthetic coding sequence
atggtgcttaacagtttagacaaaatgatccagctgcagaaaaatacagctaatatcaggaacatctgcgtgctagcgcacgtagaccatgggaatgaagagtatctgataaacctgattgattctcccggtcatgtagacttctcatcagaggtctcaacagctgtgcgcatatgcgatggctgtattattgtcgtggatgcggtggagggggtgtgtccacagacacaggcggtcctgcggcaggcctggcttgaaaacataaggcctgttctcgtgatcaataaaatcgacaggctgatcgtggagctcaaattcaccccacaggaagcctactctcacctcaaaaacatcctcgaacagatcaacgccttaaccggcactctttttacctccaaggttttggaggaaagagctgagcgcgagacagagagccaagtgaaccctaactctgaacagggcgaacaagtgtacgactggtctacgggcctggaggacacagatgactcacacctctacttttcccccgaacaggggaatgtggtcttcacaagtgccatagacggttgggggttcgggatcgaacactttgctcgcatctactctcagaagattggcatcaaaaaggaagtactgatgaagactctttggggcgactactacattaatatgaaggcaaagaaaatcatgaagggcgatcaggccaaaggaaaaaaacctctgttcgtgcagcttatcctggaaaacatttggagcctgtatgacgctgtcttgaagaaagataaagacaagattgataagatcgtgactagtctcggcctgaaaatcggagcgcgtgaggcccgacatagcgatccgaaagtacaaatcaatgcaatttgcagccagtggctgccgatatcccatgcagtgctggccatggtgtgccagaagctcccttctcctctcgatataactgcggaacgagtcgaacgactcatgtgcacagggtcccagacattcgactcctttccgcccgagacgcaggccctgaaagccgccttcatgaaatgcgggtctgaggatacagctccagtcattattttcgtttccaaaatgttcgccgtggacgctaaagcactgccccagaataagccacgtccgctgacccaggaagagatagcccaacggagggaaagagcccggcagagacacgccgagaaattggccgcggcccaaggccaagcccctcttgaaccaacccaggatggcagcgccatcgagacctgtccaaaaggtgaagagcctcgtggggatgaacagcaagtcgaaagtatgactcccaaacccgtacttcaagaagagaataatcaggagagcttcatcgccttcgcacgcgtatttagcggtgtggcgaggagaggcaaaaagatcttcgtgctgggccctaaatactcaccactggagtttctaaggcgcgtgccactgggcttttcagctccgccggatggtttgccccaggttccccacatggcgtattgcgccctcgagaacctgtacctgctgatggggagagaactggaatacctggaggaagtgcctccaggaaacgttctgggcattggaggactccaggatttcgtgttgaaaagcgcaacattgtgctctttgccctcctgtcctcctttcattccgctgaacttcgaggctacaccaattgtcagagtggcagtcgagccgaaacacccaagcgaaatgccccagttagtgaagggcatgaaactcctaaaccaggctgatccttgcgttcagattctgatccaggaaaccggtgaacacgtgttggtgactgccggcgaagtgcatctacagcggtgcttagatgatctgaaggagcggtttgctaaaatccatattagtgtctccgaacccattattcccttcagagaaactattaccaagccccccaaagtggacatggtcaacgaggaaatcggaaagcagcaaaaggtagccgtcatccaccagatgaaggaagaccaaagtaagatacccgagggtattcaggtggactccgatggtctcattaccattaccacccccaacaaacttgccacattgtctgtgcgggccatgccgctgcccgaggaagtgactcagattttggaggagaattcagacctgatcaggagtatggaacagctgaccagcagccttaatgagggcgagaatacgcacatgatacatcagaagacgcaagagaaaatatgggagttcaaaggcaagttggagcagcatctgacagggagacgatggcggaacattgtcgaccagatctggtcattcggaccaagaaaatgtggccctaatatcctcgtgaataagagtgaggacttccagaactccgtgtggaccggcccagccgataaagcctctaaggaagcttctaggtaccgcgacctgggtaatagcatcgtgtctggcttccaacttgctactctttccggacccatgtgtgaggagcctttgatgggcgtgtgtttcgtgttggaaaagtgggacctgtccaaatttgaggaacaaggtgcctccgaccttgccaaagaggggcaggaagaaaatgagacatgttcaggcggcaacgaaaatcaggagctgcaggatggctgctccgaagcctttgaaaagcggaccagtcaaaaaggtgaaagccccctgacggactgctacggacccttctcagggcagctgattgccacaatgaaagaagcttgccgttatgctctccaggtcaaaccccagcgcctcatggctgcaatgtatacctgcgacatcatggccaccggggatgtgctgggtagggtgtatgccgtgctctccaagcgcgagggcagagtgttacaggaggagatgaaggaagggactgatatgttcataataaaggccgtgctgcccgtggccgagagcttcggattcgctgatgaaatcagaaagaggacttcaggcctcgcttcacctcagctggtcttctcacattgggaaatcattccctcagatcccttttgggttccaacaaccgaggaggaatacctgcattttggcgagaaggctgattcggaaaaccaggctcggaagtatatgaacgcagtccgcaagcgaaagggtctgtatgtggaagaaaagatcgtggagcatgccgagaaacaacgcacactttcgaaaaacaaatag

SEQ ID NO: 29440 - DNA, 93 bp, Artificial Sequence
  Description of Artificial Sequence: Synthetic coding sequence
atggttcttaactcactggacaagatgattcaattgcagaagaataccgcaaacatccggaacatttgtgtgttagcgcacgtcgatcactag

SEQ ID NO: 29441 - DNA, 54 bp, Artificial Sequence
  Description of Artificial Sequence: Synthetic coding sequence
atggtcctgaattcactcgataagatgatccagctccaaaagaataccgcatag

SEQ ID NO: 29442 - DNA, 420 bp, Artificial Sequence
  Description of Artificial Sequence: Synthetic coding sequence
atgtggcatactgtcccccgcgcaggtcttggtcgggtcgggtgccgtggactgccaggttgcagggcccaccctccaggtgcatgggcctgctgcactgagcaggcttgggccctggctcccctgacagtcccctccaggccatccctgtgctccgggccccggaccggcagcggacagcaggctcccggattgcaagatgtgctgtctctttggtcagtgtgtgacgacgagcatagctggagctttctttatgcaggtccctgggccagcgagcgagctactggttggcgacttagtcacgaagtggagggtcaaagtcagggcctgcaggtcacctcttgtaggcaccacgcacttcttccgtgggcagttctaggtgccccttcctggccgtgggctcagtggcctgttgcctag

SEQ ID NO: 29443 - DNA, 309 bp, Artificial Sequence
  Description of Artificial Sequence: Synthetic coding sequence
atgggcgctgagtgggaactgggcgcagaggctggagggtccctgcttctttgcgcagccttgcttgcggccgggtgcgccctcggcctaagattgggccgcggccagggggcagcagatcgcggtgccttgatttggctgtgctatgacgcgctcgttcacttcgccttggcttttcccgccgatcatcccgtgagagtgagagccgtctggctcctagatgacttgcccccacgagtggcacaccagaaaccacagcctcagcaccagcaattagccgtgctcctggccctccccgttttcttctag

SEQ ID NO: 29444 - DNA, 387 bp, Artificial Sequence
  Description of Artificial Sequence: Synthetic coding sequence
atgggagctgaatgggaactgggagcggaggccggtggctcccttctgttgtgtgccgcactgctcgccgctggctgcgccctagggctacgtcttgggcggggccaaggcgcagccgaccggggggctctcatctggctttgctacgatgccctggtgcacttcgctctggaagggccgtttgtctacctgtccctcgtgggaaacgtagccaactccgacggcctcatagcctcactctcggatgcgcgatgggtatatttcgacccaacaatcgtgtccgtggagatccttaccgtggcattggacggttcgctggctctgttccttatctacgccatcgtgaaagagaagtattatcgcgatcgcgtggcatggggcgaatag

SEQ ID NO: 29445 - DNA, 1815 bp, Artificial Sequence
  Description of Artificial Sequence: Synthetic coding sequence
atgttgggcatgaacatgcttctcataacactgttcttgttgctccccctgtcaatgcttaaaggtgaaccttgggagggatgtttgcactgcacacacacaacatggagcggtaacatcatgaccaagactttactgtaccatacttattatgagtgcgctggcacctgcctaggcacatgcacccacaaccagacaacctactctgtctgtgatcctggccggggccaaccctacgtgtgctacgatcccaaatcctcacctggaacctggttcgagatccatgtgggttccaaagagggagacctactgaaccagaccaaggtctttccatccggaaaggatgtggtttccctgtactttgatgtctgtcaaatagtgagcatgggctctctctttcccgtgatcttttcatcaatggagtattacagtagttgccacaaaaaccggtacgcccatcccgcttgcagtacggattctcctgtgactacatgttgggactgcaccacctggtcaacgaatcaacagagtctgggccctatcatgctcaccaagatccctctggaaccagattgtaagacaagcacttgcaatagcgtcaacttaactatactggagccagatcaaccgatatggaccaccggtttgaaggcaccactcggtgcccgcgtctcaggcgaagagatcggcccaggagcctacgtctatttgtatatcattaagaaaacacggacacggtcaacccagcagtttagggtatttgaatctttctatgaacatgttaatcagaagttgccagagcccccccctttggcatccaatttattcgcccaactggccgagaacatcgccagttcgctgcacgtcgctagctgctatgtttgcggaggtatgaatatgggcgaccaatggccttgggaggcacgggagttgatgccgcaagacaattttactctcaccgcttctagcttggagcccgcccccagctctcagtccatctggtttctgaagacctctatcattggcaaattttgcattgcccggtggggcaaggccttcaccgatcccgtgggagagctgacctgcctcggtcaacaatactacaacgagacccttggcaagacactctggcggggcaagagtaataattctgaaagtcctcacccatcaccattttcacgctttcccagcttgaaccactcttggtaccaactagaggccccaaacacctggcaggcacccagcggcctgtactggatatgcggccctcaggcgtaccgccagctcccggccaaatggtcgggcgcctgcgtgctcggcacgattagacccagctttttcctgatgcctctgaaacaaggtgaagcgctgggttatccaatttatgacgaaactaagcgcaagagcaagcgcggtatcacgatcggagactggaaagacaatgagtggcccccagagcgcataatccaatattacgggcccgctacatgggccgaggacggtatgtgggggtatcgaacacctgtatacatgttaaatcggatcattcggctgcaggccgttcttgagatcatcaccaacgagaccgccggcgctctgaacctcttggctcaacaagccaccaagatgcggaatgtgatatatcaaaacaggctggctcttgattatcttctggcgcaggaggagggcgtgtgtggaaagtttaacttgactaattgctgtctcgagttggatgacgagggaaaggtcatcaaggagatcaccgctaaaatccagaaactggctcacatacccgtgcaaacctggaaaggatag

SEQ ID NO: 29446 - DNA, 1692 bp, Artificial Sequence
  Description of Artificial Sequence: Synthetic coding sequence
atgggtagcctgtcaaactatgctctgcttcaactgacgctgaccgccttccttacaatcctcgtacagccacaacaccttcttgctccagtgtttaggactctgtccatcttgacaaaccaaagcaattgttggctgtgtgagcatctcgacaatgcagagcagcctgagttggttttcgtgccagcctccgcgtccacgtggtggacctacagcggtcaatggatgtacgaacgcgtgtggtatccgcaggctgaggtacagaaccacagcaccagttcatataggaaagtaacatggcattgggaggcaagcatggaggcacagggcctgtccttcgctcaggttagactgcttgagggaaattttagcttatgtgtagagaacaaaaacggatctggaccgtttcttggcaacatcccaaagcaatattgtaaccagatcctttggtttgattcaactgacgggactttcatgccgagcatagatgtgactaacgagtcaagaaacgacgatgacgataccagtgtctgcttgggaactagacagtgttcatggttcgccggctgtacgaatcgaacgtggaactccagtgctgtgcctttgatagggctgccaaacactcaggattacaaatgggtggaccggaatagcgggcttacctggagcgggaacgacacttgcttgtacagctgccagaatcagaccaagggcttgctctatcagctcttcaggaaccttttttgtagttacggacttaccgaggcccacgggaagtggaggtgcgcagacgcatctatcactaacgataagggccatgacgggcaccgcaccccaacctggtggctaacaggctccaatctgaccctttccgtcaataatagcggtctgttttttctgtgcggcaacggcgtgtataagggctttccacccaagtggtccggcaggtgtggtcttggctacttggtgccttcactgacacgataccttacactgaacgcctcccagatcacgaatctcagatcgttcatccacaaggtcactccacaccggtgtacacagggcgacactgataatcctcctttgtactgcaacccgaaggacaacagcacaattcgcgcactcttcccctctttaggcacctatgacttggaaaaggctatcttgaacatcagcaaggccatggaacaggagttttcagcgaccaagcagacactggaagcccaccagtctaaggtgtccagcctggcttccgcctcaaggaaagaccatgtgctggacatcccaaccacccagaggcagacggcttgtggcaccgtaggtaaacagtgctgtctgtatataaactacagcgaagagatcaaatcaaacattcagaggctccatgaggctagcgaaaatcttaagaacgttcctctcctcgactggcagggcattttcgccaaagtgggggactggttccgaagttgggggtacgtacttttgattgtgttattctgtctgtttatctttgtgctgatttacgtcagggtgtttcgcaaaagtcggagatccctaaactcccagccactcaacttagctctgtctccgcaacagtcagcacagctgctcgtttccgaaaccagctgtcaagtaagcaacagagcaatgaagggcttgaccacgcaccaatatgacacgtcactgttatag

SEQ ID NO: 29447 - DNA, 1692 bp, Artificial Sequence
  Description of Artificial Sequence: Synthetic coding sequence
atgggatccttaagtaactacgctctgctgcagttaactctgacagccttcctgacgattctggttcagccacaacatctgctggctcccgtcttcaggacactctctattcttactaaccagagcaactgctggctgtgcgagcacctggacaatgcagaacagcccgaactggtctttgtaccagccagcgcttccacatggtggacgtatagtggacagtggatgtacgagagagtgtggtacccccaagcagaagtgcaaaaccacagcacaagctcttatagaaaagtcacctggcactgggaagctagtatggaggcccagggcctcagctttgcccaggttcgcctgctagaggggaatttttcgctgtgtgttgagaataagaatggatctggacctttccttggcaatattccaaagcagtactgcaatcagattctttggttcgacagcactgacggtactttcatgccttccatagatgtaaccaacgagtcccgcaatgatgacgacgacacttcagtgtgtctgggaaccagacagtgttcatggttcgctggttgtacaaataggacttggaattcatccgcagtcccactgataggcctcccgaacactcaagattataagtgggtggatcgaaactcaggcctcacatggtccgggaacgatacttgcctttactcttgccagaaccagacgaagggattgctttaccagctgtttcggaatctcttctgcagttacggcctgacagaagcccatggtaaatggcgatgcgcagatgcaagcataactaatgataaaggacacgacggccacagaacacccacctggtggctcaccggctccaatctgacgctgagtgtgaacaactcggggctgttttttctgtgcggaaacggagtttacaaaggatttccacctaagtggtctggccgctgcggtttagggtacttggtgccttcgttaacacgctaccttaccttaaatgctagccagatcacaaacttgcgcagcttcattcataaagtcacccctcaccggtgcactcaaggggataccgacaatcccccgctctactgtaatcctaaggacaactcaacaatcagggcgctcttcccctctttgggcacctacgaccttgaaaaggcaatactaaacatcagcaaggctatggagcaagaattttctgcaacgaagcaaacgttggaagcacatcaatcaaaggtctcaagccttgccagtgcctcccggaaggatcacgtcctggacatcccaaccacccagagacagacagcgtgtggaactgtggggaaacagtgctgcctgtacattaactacagcgaggagatcaaatctaatatccagaggctgcatgaggcaagtgaaaacctcaagaatgtgcctctcctggactggcaggggatttttgccaaggtgggcgactggttccggagctggggttacgtgttacttattgtcctgttctgtctttttatatttgtcttgatttacgtgagggtttttagaaagtccaggcgttctttaaactcccaacctcttaacctggccctcagcccacagcagtccgcgcagctgctggtgagtgaaaccagctgccaggttagcaatcgcgctatgaaagggctaaccacccaccagtacgacacctccttgctatag

SEQ ID NO: 29448 - DNA, 1608 bp, Artificial Sequence
  Description of Artificial Sequence: Synthetic coding sequence
atgaccgaaaagttcttgttcctctatctctccttgttacctatgcccctcctcagtcaggcacaatggaacgagaattcactagtgtctttcagtaagatcattgcttcaggcaatcatctgtccaactgttggatctgtcataactttatcacccggtccagcagttaccagtatatcttggtccggaatttttccttaaacctcacattcggatcgggtattccggagggccagcacaaatcagtcccattgcaggtgtccttagcgaattccgctcaccaggtgccatgcttggatctgaccccccccttcaatcagtcctccaaaacttctttctatttctataattgctcaagccttaatcagacatgttgcccctgccccgagggccattgtgataggaaaaatacttcagaggaggggtttccctctcccacaatccatccgatgtccttcagtccagctggatgtcacccgaatttaacccattggtgtccagcaaaacaaatgaacgactatcgggataaaagcccgcaaaataggtgtgccgcgtgggagggaaaagaactcatcacttggcgcgtcctctacagtctacccaaagcccacacggtgccaacatggcccaaatctactgtgccgctgggcgggccactgtctccagcttgcaaccagaccatcccagcaggttggaagtctcagctccacaagtggttcgactcccacatcccgcgatgggcctgcacccctcctggatacgtttttctttgtgggccgcagaagaataaactgccctttgacggctctccaaaaatcacctatagtacacctcccgtggccaatttgtacacttgcatcaacaacatccaacatacaggagagtgtgccgtcggactgctggggccccgagggataggtgttacaatttataacacaacccagcctagacagaaacgtgccctgggattgattttggccggaatgggggccgccattgggatgatagcaccttggggcggttttacttaccacgatgttaccttacggaacctgtcgcgccagatcgacaatatcgccaaaagcactcgggatagcatctcgaaactcaaagcctctatcgacagcctcgccaatgtggtgatggacaacagattagcactggactacctgttggctgaacagggcggcgtgtgcgcagtcattaacaagagttgttgcgtttatgtgaataactccggagccatcgaggaagatataaagaaaatctacgatgaagctacttggttgcacgactttggaaaaggaggagcgtctgctcgagcgatctgggaagcggtgaagtccgcactgcctagcctcaattggttcgttccactcctcgggccagccacagtaattctgctgttgttcctgttcgggccttgtttcttcaacctgctaatcaaatgcgtgagttcacgcatcaagcagttccatatgaagagcccccagatggaacgctaccaattatctgtcattggcggcccttcaacttacaaacacatctctccactagacgcaagcggacaaagattccgggagaccatggaagagttttccctgtag

SEQ ID NO: 29449 - DNA, 795 bp, Artificial Sequence
  Description of Artificial Sequence: Synthetic coding sequence
atggcccttgaggccgctggcgggcctccagaagagaccctctctctctggaagagagaacaagccagattgaaagcgcacgtcgtcgatcgagataccgaagcttggcaacgggatcccgcgtttagcggactccaacgcgttggaggagtggacgtctcttttgttaagggagactccgtgcgagcttgtgccagcttggtggtactctcctttcctgaactcgaagtgttactcgtcgacgggaacggcgttctccatcataggggatttggagtggcttgccacctgggagtgttgaccgacctcccatgcgtgggagtggccaagaaattattacaggtcgatggcctagaaaacaatgcccttcataaggagaagattcgtctgctccagacccggggggacagctttccactgctgggggacagtggcacagtgctcggcatggcgcttagatcgcatgaccggagcaccagacctttatacatcagtgtcggacaccggatgagtctggaagctgcagtccgtctcacttgttgctgttgcagattccggatccccgagcctgtgcgccaagccgacatctgttcacgggagcacattcgcaaatctctggggttacccgggccccccactccaagaagcccaaaggctcagaggcccgtggcctgcccaaaaggagacagcggcgaatcctcaggggaaggccaacccccacaggatcacagccctggccctcgtaccgcccctcgcccgggcagccaggaacaagcgggtaaggattggcagtag

SEQ ID NO: 29450 - DNA, 849 bp, Artificial Sequence
  Description of Artificial Sequence: Synthetic coding sequence
atggctctggaggcggcaggaggccctcccgaagagacgctctctctttggaagcgcgagcaggctaggttaaaagctcacgtggtggatcgcgacacggaggcatggcaacgggacccagcattttctggtttgcaacgcgtcggtggagtcgacgtgagttttgtgaagggcgactctgtgcgagcgtgtgcttccttggtagttctcagctttccagagcttgaagtcgtctatgaagaatcaaggatggttagtctaaccgcaccatacgtatctgggtttctggcattcagggaagtgccctttttgctggagctggtgcaacagctgcgcgaaaaggagcctggcttgatgcctcaggttctcttagtggatggaaacggcgtactccaccacaggggcttcggcgtggcctgtcatctgggggtgttgacagacctgccatgtgttggggtggccaagaagcttctgcaggtggatggtctggaaaataatgccctccacaaagagaaaattcgccttctgcagaccagaggcgatagttttcctcttctgggagatagtggtaccgtcttgggcatggctcttcgcagccacgatcgatccactaggccactgtacataagcgtgggccatagaatgtccttggaggccgctgtcagactgacctgttgctgctgcaggttccggataccagagcctgtaaggcaagctgatatatgcagtcgcgaacatattcgcaagagcctgggcctacctgggccccccacgccccgcagccctaaggcccagcgacctgtcgcttgtcccaaaggagactcaggggagagcagcgctctctgttag

SEQ ID NO: 29451 - DNA, 714 bp, Artificial Sequence
  Description of Artificial Sequence: Synthetic coding sequence
atggctctggaggctgccggggggcctccagaagaaacactctccctgtggaagcgggagcaggccagattaaaagcacacgtggttgacagggacaccgaagcttggcaacgggacccagccttttctggcctgcagagagtggggggtgtggacgtctcttttgtcaagggcgactcggtaagagcgtgtgcatcgttggtagtactctctttcccagagttggaagtgcttctagtggacggcaatggtgtgctgcaccatagaggttttggtgtggcctgccacctcggagtcttaactgacctgccatgcgtaggtgtggcaaagaagctgctacaggtggacggtctggagaacaatgccttacacaaggaaaaaatcaggttgctgcaaactaggggtgacagctttccactgttaggagacagcgggactgtgttggggatggccctacggtcacacgatagaagcacaagacctttatatatctctgtaggccatcggatgagcctggaggccgctgtgcggctgacatgctgctgttgtcggttcagaatcccagagcctgtgagacaagccgatatctgcagccgcgagcacattagaaagtcattaggattaccagggccacccactcccagaagccctaaggctcagcgcccggttgcgtgccctaagggggatagtggcgagagttctgcactgtgttag

SEQ ID NO: 29452 - DNA, 771 bp, Artificial Sequence
  Description of Artificial Sequence: Synthetic coding sequence
atggaccctacctgcagttccgagtgtatctacaacttaatcccgtcagacttgaaggagcctccccagccaccgagatacatttctatcttcaaggccacagttaaagacgatatgcagaaggccaagactgctatgaaaacaatgggccccgctaaggttgaagtccccagccctaaagacttcctcaaaaagcattccaaggagaaaaccttgccccctaaaaaaaacttcgatcggaatgttcccaagaaacccgcggttcccctgaaaaccgatcaccccgttatgggtatccagtccggtaaaaattttattaacacaaacgctgcagacatcattatgggggtggccaagaagcctaagccaatctatgtcgacaagcgcaccggcgataaacacgacctggaaccaagcggactggtgcccaagtatatcaacaagaaagattacggtgtcacccctgagtatatttgtaagcgtaatgaagaaatcaaaaaggcccaggaggactacgacaggtacatacaggaaaacctcaagaaagctgctatgaagcgcctctccgatgaggaaagggaggctgttctgcaagggttaaaaaaaaactgggaagaggtccataaagagttccagtccctgagcgtgtttatcgattccatccccaaaaaaattcgcaagcagagactcgaagaagagatgaagcagctggaacatgacattggtattatcgagaaacacaagattatctacattgccaataacgcatag

SEQ ID NO: 29453 - DNA, 768 bp, Artificial Sequence
  Description of Artificial Sequence: Synthetic coding sequence
atggaccctacgtgctcgtctgagtgcatttacaacctgattcccagcgacctgaaggagccacctcaaccgccacgttatatcagcattttcaaggccaccgttaaagacgacatgcaaaaggccaagactgccatgaagactatgggccccgctaaagtcgaggtcccctcccctaaagattttctgaagaagcatagcaaggaaaagactctgccacccaaaaagaattttgaccgcaatgtgccgaagaaaccagcagtgccgctgaagacagatcacccagtgatgggaatccagtccggcaaaaacttcataaacacaaatgcggccgacatcatcatgggtgttgccaagaaacctaagcccatctacgttgataaacgcacaggcgacaaacacgatctcgagccgtcgggtttggtgcctaagtatataaataaaaaagattacggcgtgacacccgagtatatttgtaagagaaatgaagagattaagaaagcccaggaggactacgacaggtacatccaagaaaaccttaagaaggccgcaatgaaaaggctttcggacgaggaacgtgaggcggtgttgcaaggattgaagaagaactgggaagaagtgcataaggagttccagtccctgtctgtgtttatcgattctatacccaagaagatccggaagcagcgcttggaggaagaaatgaaacagcttgagcacgatatcggcatcattgagaaacacaaaatcatctacatcgcgaacaaatag

SEQ ID NO: 29454 - DNA, 771 bp, Artificial Sequence
  Description of Artificial Sequence: Synthetic coding sequence
atggatccaacatgtagctctgaatgcatttataatcttatccccagcgaccttaaggaaccccctcagccaccaagatacatctctatcttcaaggcgactgtgaaagatgatatgcagaaggcaaaaacagccatgaaaaccatggggcccgcaaaggtagaggtaccctctcctaaagactttctgaaaaagcactccaaagagaagaccctgcctccgaaaaagaacttcgaccggaacgtgcctaaaaagcccgccgtgccactgaaaaccgaccaccctgtgatgggcattcaaagtggtaaaaattttatcaacaccaacgccgccgacataattatgggcgttgcaaagaaaccaaaacctatctacgtagacaaacgcacaggggacaaacacgatcttgagccttcgggcctcgtgcctaaatacatcaataagaaagattacggagtgactcctgaatatatatgcaaacgcaacgaagaaattaagaaggcccaggaggactacgacagatacatccaggagaatcttaaaaaagccgctatgaaacgactttctgatgaggaaagagaggctgtacttcagggactgaaaaaaaactgggaggaagtgcataaggagtttcagagcctgtccgtattcattgactcgattcccaaaaagataagaaaacagcggctcgaggaggagatgaagcaactcgaacatgacatcgggatcattgaaaagcataaaatcatctacattgccaacaacgcatag

SEQ ID NO: 29455 - DNA, 1305 bp, Artificial Sequence
  Description of Artificial Sequence: Synthetic coding sequence
atgagtattgaaaaaatctgggcccgcgaaattctggactcaagaggcaacccaactgtggaagtagacttatataccgctaaagggctgttcagagcggcagtcccctccggcgcttctacggggatttacgaggcccttgagctcagggatggagataaacagagatatctcggaaaaggggtgttgaaggccgttgatcacatcaatagtaccatagcccctgcactcatctcctccggactttctgtggttgagcaggaaaaactggataatcttatgctcgagctggatggaactgagaataagagcaaattcggtgctaacgcaattctgggagtttctttagcagtgtgcaaagcgggtgccgcagagcgcgagcttccactgtatcggcacatcgcacaacttgccggcaacagtgatctgattttgccggtgccggcctttaacgtgataaatggcggcagtcacgccggcaacaagctggcaatgcaggagttcatgatcttacctgtcggcgcagagtccttccgcgatgcgatgaggcttggggctgaagtgtaccacaccctgaagggggtcatcaaagacaaatatggaaaggacgcaaccaacgtaggggacgaaggcggattcgccccgaacattctcgagaattccgaggctctcgaactagtgaaagaggccatcgacaaggccggctacacagaaaagattgtgatcggcatggatgtggcagctagcgagttctaccgggatgggaagtacgatttggacttcaagtcaccgacagatccttctagatacattactggggaccagctgggtgccttataccaggacttcgttagggactatcccgtcgtttccatcgaggaccccttcgaccaggatgattgggccgcatggagcaaatttacagctaacgtggggatacagatcgttggagacgacctgacggtgaccaacccaaaacggatagagcgtgcagtggaggagaaggcttgtaattgtcttcttttaaaggtcaatcagatcgggagtgtaaccgaagcaatccaggcttgcaaacttgcacaggaaaatggctggggggtcatggtgagccacagaagcggcgagactgaggacacttttattgctgaccttgttgtaggcctgtgcaccggccagatcaagaccggggctccctgccggtcggagaggctcgctaaatataaccagctgatgagaattgaagaagagttgggtgacgaagcacggtttgccggccataatttcaggaacccatcggtgctctag

SEQ ID NO: 29456 - DNA, 1887 bp, Artificial Sequence
  Description of Artificial Sequence: Synthetic coding sequence
atggaggaagagggagggggccggtcttgtggtaccacaagggagttacaaaagttgaagcaacaagcaatggaatattaccgtgagaacgatgtgcctcggaggctggaagagctgctcaattcgacattttacttgcagcctgccgacgtctacgggcacctcaaggcaaactgtttttccaagctggccaaaccccctaccatttgcaaaattgtaggaaaggacgtgctcgacggtcttggcctgcccactctccaggtggacatcttctgcactattcagaactttcccaagaacgtgtgttcagtggtgatctccacccacttcgaagtccatgaaaatgctctgccggaacttgcaaaggctgaggaggccgaacgagcctcagctgtcagcactgcggtgcaatgggttaacagcaccatcacacatgagctacaggggatggctccctccgatcaggccgaagtcgatcatcttctgaggatcttcttcgcttcaaaggtgcaagaggataagggccgtaaagagctcgagaagagcttggaatacagtacggtcccgacgccactgcctcccgtgccaccaccccctcctccaccaccccccactaagaaaaagggtcaaaagccaggccgcaaggacaccattactgaaaagccaatcgcacctgccgagccggtagagcccgttctatctggctcaatggcaattggtgccgtgagtctcgctgtggctaaggcctgcgcaatgctcctgaataaaccattgtacctgaatatcgcactgctgaagcataatcaggagcaaccaaccaccctcagtatgccattactgatggtgtctttagtctcctgtgggaaatcctccagtggtaagctgaacttgatgaaggaggtgatctgcatccctcacccggagttgacgacgaagcagggtgttgagatgttgatggagatgcagaaacacataaacaagatcatagagatggtttctcctagtcctcctaaggcagaaaccaaaaaaggccacgacggctccaaacgaggccagcagcaaatcactggtaagatgtcccacttaggctgtctgactattaattgtgatagcatcgagcaaccattgttactcatccaggagatttgcgccaatctcggcctcgaacttggtacaaacctgcatctggcaatcaattgcgcagggcatgagttaatggattataacaaaggtaagtacgaagttatcatgggaacttacaagaatgccgctgagatggtagacttatacgtcgatttaatcaacaagtacccgtccattattgcactcatagatccatttagaaaggaggacagcgagcaatgggatagcatataccacgcacttggatctcgctgctacattatagctggtaccgcttccaaatcaatcagcaagctgctggaacagggtaatatcagcatccccaaaagcaatggcttgatcattaaacacaccaatcaaacaaccatgtcagatttagtcgaaatcactaaccttatcgacagtaagaaacacatcaccgtgtttggctccactgagggcgagtcatccgatgattccctagttgatctggccgttggcctcggcgtccgcttcatcaagctggggggtttgtccagaggagaaagagtaaccaaatacaatagattgctcaccatagaagaggagctggttcaaaatggcacgctcggattcaaggaagaacacacgttcttctacttcaacgaagaagcagagaaggccgcagaagccttggaggcagccgcagctcgtgagccactggtacccacgtttccaacccagggtgtggaagagtcagctgagaccggcgcgagctccggctag

SEQ ID NO: 29457 - DNA, 1824 bp, Artificial Sequence
  Description of Artificial Sequence: Synthetic coding sequence
atggccttcagacggcaggtcaaaaactttgttaaaaactactctgacgcggagataaaggtccgcgaggcaacttctaacgatccttggggtccatccagctccctgatgttggacatatccgacctcacgttcaacactattagtctttcagaaatcatgaacatgctgtggcaccgactgaacgaccatggcaaaaattggcgacacgtctacaagtcactgaccttaatggactatctgattaagaacgggtctaagaaggtcatccaacattgtagagaaggtttttgtaatctacaaacactgaaggactttcagcacatcgatgaggcaggcaaagatcagggatattacataagagagaaatctaagcaggtgatcaccttgctgatggacgagcccttactgtgtaaagagagggaagtggcctgcagaacgagacagaggacttctcattccattctgtttagcaagcgacagctgggtagctccaactccttaaccgcctgtacttctgcccctacccctgatattagtgctagcgaaaagaaatacaaactgccaaagttcggtcggctacacaacaagcggaacgtttgcaaggccggccttaaacaagagcattgccaggacgtgcatctgcccaccgagaccatgctgtcacaagaaacattgcctctgaaaattcatggctggaagagtacggaagacctgatgaccttcttggacgacgacccggagctgccactgctggcaaccccaccgtccatagtcagccctataacatgcctcagcgaggccgaagaagtctgtaacctgtctggagcagatgccgtgccaacactctctgaaaacagcccttcgggccagagggatgtaagtctggacaagcggagcgacgggatatttactaacactgttaccgagaacctcctggaaacccctttggagaaacagtctgccgccgaggggttaaagactctcaccattttgccagcttgttggtcgagcaaggaggaatttattagtccagatttgcgggtgtccaagtcagactctacattccacaatcaagcgagtgtcgaaacgctctgtttgagcccgtcctttaaaatcttcgaccgggtgaaagagatcgtgataaacaaagcctatcagaagccagcgcagtcaagtattcagatggatgacaagattctgaagacgaccacccgcgtttccaccgcatctgaaggtgcatcctccttttcccccctaagcatgagcagcccagacctggcctcgcccgagaaatccgcccatttgctgtcacctatactcgcaggaccctctttttggaccctctctcaccaacagctctcatccactagtttcaaagacgaggacaaaactgccaaactgcaccattcttttgctagccgggggcctgtgtcctctgacgtcgaggagaatgacagcctgaacctgctgggtatccttcccaataacagtgacagcgcaaaaaagaacatctctcacatatctagctcccactggggcgaattttctacccagaatgtggaccagtttattccattgtcttgctcaggcttccagagcaccaaggacttcccccaagagcctgaggcaaaaaatagtatttccgtgcttttaagggaggtcaaaagggctatagcacgtctgcacgaagacctcagcaccgtaattcaagagctcaacgtgatcaacaacattctgatgagcatgagcctcaacagctcacagatctctcaatctagccaagtgccccagtcttcagaaggttctagcgaccagatttag

SEQ ID NO: 29458 - DNA, 906 bp, Artificial Sequence
  Description of Artificial Sequence: Synthetic coding sequence
atgcaggcatcagccgaccaggtggagcgcgatatactggagacacaaaagcgcctacagcaagacaggctgaactcagaacaaagtcaggccctgcagcaccaacaggagaccgggtcttccctaaaggaggcggaagtcctattgaaagatctctttttggatgtcgataaagccaggcggctgaagcacccccaagcagaagagaccgagaaggatattgagcagctgcacgagagggtgacccaggaatgtgcagaatattgcgctctttatgaaaagatggtacttcccccgagaagaggtattcagggacggttaggtaccagagcaggggctgagaccgaagctggtctgcgtcggcccgtctgggccggacacggcggtgctggtgggacagaccgtggggctcaacaccgtgcagaaggagatcagagaccaagaagagctgccgctgagccaggtggggccggatgccggcaccaccccgagcccattcctcggccaacagagggcggcgtcgtcgccagggccgaaccaggacagcctgtgcacgctctgcagggctgcacttggcagctttctgcactggctgagcagcagcgacgcatcctccaacaggactggagcgatctcatggccgaccctgcgggggtgagacgtgaatatgagcacttcaagcagcatgaacttcttagtcaggaacaatcagtcaaccagttggaggaggatggcaagcggatggtggagttgcgacatccagccgtagggccgatccaggcccaccaggaagcattaaagatggagtggcagaactttctcaacctctgtatctgtcaggagacccagcttcaacacgtcgaagactattcccggatattatgcccaagcagctctcctcactag

SEQ ID NO: 29459 - DNA, 1038 bp, Artificial Sequence
  Description of Artificial Sequence: Synthetic coding sequence
atgcagcacgtgagcagcagccagagcagccagagacatgttcagtggcccggggcctgccctggcgccggggaggaacagcctgcctgttctcaaccatccttaccgctgacgctgcctagcccctcccatcagctgcagcagttaatggatggtagcgggctgactcagatcgcccagggcgctcaggttcagctgcaacatcctggcacacctattaccgtacgcgagcgacggccgtctcaaccccacacgcagtccgggggcaccatccaccaccttgggccccagtcgcccgccgcagccgggggtgctggattgcagccgctggccagcccatctcatatcaccaccgctaacctgcctcctcagcccaggccattgggttttgaacgaactcctggggttctgctccccggtgcaggcggggcagccggattcggaatgacttcaccccctcccccgacctcaccctcccgcaccgctgtgccgcctggcctttctagcctgcctctgacaagtgtggggaataccgggatgaagaaggttccaaagaaattggaggagatcccacctgccagcccagaaatggcccaaatgcggaaacagtgcttggactatcaccaccaggagatgcaagccttgaaggaagtgtttaaagaatatctcattgaactgttctttttgcagcatttccagggtaacatgatggatttcctggccttcaaggagcgcctgtatggaccgctccaggcttatctgcgccagaatgaccttgatatcgaagaagaggaagaagaacacttcgaggtgattaatgacgaagtcaaagtcgtggcacggaagcatggccagcccggaactccggtagctatagcgacacagctaccaccacgcacctctgccgcattccccgcccagcagcagcctttgcaaccactggcacctacaactgttttgtccgtttctgcagactggaatgctctcctgcagcgtcctaacaagtacatttggggactgcagtatctggagatgtag

SEQ ID NO: 29460 - DNA, 1467 bp, Artificial Sequence
  Description of Artificial Sequence: Synthetic coding sequence
atgcagcacgtgtccagcagtcaatcctctcagaggcatgtgcagtggccaggggcctgtcctggcgccggagaggagcagcctgcttgttctcagcccagcctgcctcttacgttaccctcacccagtcatcaattacagcaactcatggtacggggcggtcccgcgggagggcagaacatgaacgtcgacctgcagggagtgggacccggcttgcagggttccccacaggtgacactcgcgcccctgcccctgccgtctcctacatcgcccggattccagttctcggcgcagcctagacggtttgaacatggatccccaagctacatccaggtgacctctcctctgagccagcaggtgcagacgcaatcgccgacacaaccctcaccgggacccggacaagcactccagaacgtgcgggcaggtgccccaggccctggacttgggttatgctccagttctcctacaggggacttcgtcgacgcctcagttcttgtgaggcagatttcactttccccaagctcaggaggccacttcgttttccaggatggctctggactcacccaaatcgcgcagggcgcccaggttcagcttcagcatccgggtacaccgatcactgtccgggaacggcgacctagccagccacacactcagtccgggggcactatccaccatctgggaccccaatcccccgctgcagcaggaggggcgggcctacagcccttggcctctccaagtcatattaccacggccaatctgcccccccaaatctcctcaatcatccagggtcagctggtccaacagcagcaagtgctgcaaggacctcccttgccacgaccattagggttcgagcgcacacccggcgtgctattgccaggagccgggggtgctgccggatttggaatgacttctcccccaccaccaacctcgccatcccgaacagcagtgcctccagggctctcctcactcccactcacctctgtgggcaatacaggcatgaaaaaagtgcctaagaagctcgaagagataccacctgccagccctgagatggcccagatgcgaaaacagtgccttgactatcaccaccaagaaatgcaagccctaaaggaggtcttcaaagagtacctgattgagctattctttctgcagcactttcaggggaacatgatggattttttagcattcaaagagaggctttacggcccattgcaggcttatcttaggcagaatgacctcgacatcgaggaagaggaggaggagcacttcgaggtgataaatgacgaagttaaggtggtggctaggaagcacggccagcctggtacgcctgtcgccattgcaactcagttgcctccccgaacgtccgctgcattccctgcccagcaacagccccttcagcagatacacatgggtacgcctgtgccgggggacgtgaacagcatcaagatggaagcctccaagcggcagtag

SEQ ID NO: 29461 - DNA, 1260 bp, Artificial Sequence
  Description of Artificial Sequence: Synthetic coding sequence
atgcagcacgtgtcttcaagccagtcgtctcagagacatgtccaatggccgggtgcctgccctggtgccggtgaagagcagcccgcatgcagtcaacccagcttgcccctgaccttaccctccccttctcaccagctacagcagctcatggtgcagactcagagccccacccaaccgagtccaggtccagggcaagctctgcagaacgttcgtgccggggcgcctggccccggactcggcctttgttcctcatccccaactggcgacttcgtcgacgcgagtgtgctggttcgccagatctccctgtccccttcctcaggggggcactttgtctttcaagatggcagcggtcttactcagatagcccagggtgcacaggtgcaactacagcacccaggaacacctatcaccgtgcgagagcggaggccttctcagccccacacccagagcggcggcacaatccaccatcttgggccccagtctccagccgctgcaggaggcgcagggttgcagcccctggcttctccatcacacatcactactgctaatttaccaccccaaatctcttccattatccagggacaacttgtgcagcagcaacaggtgctgcagggcccccctctgccaaggcctctcggtttcgaacgcacgcccggcgtccttcttcccggagccggcggtgccgctggttttggcatgaccagccctccaccacccacatctccaagccgcaccgccgtacctcccggactatcttccctccccctgacctccgtaggtaacacggggatgaaaaaggtgcccaagaaactggaagaaattcctcccgcatcccccgaaatggcgcaaatgcggaagcagtgtctggactaccaccatcaggagatgcaggctctcaaagaagtttttaaagaatacttgattgaattgttcttcttgcagcacttccaggggaatatgatggatttcctggcattcaaggaaaggttatacggtcccttacaagcgtacctgcgccagaatgatctcgatatcgaggaggaggaagaggagcactttgaggtgattaacgatgaagtgaaagttgtagctaggaagcacggacagccaggcacccccgtggctatcgcaacccagttaccacctcggaccagtgcagcatttccggcgcagcaacagcccctgcaagtgctgagcgacggctctacagttcagctgccgagactatctagtctgggattcgaagatagcatgtgctag

SEQ ID NO: 29462 - DNA, 1071 bp, Artificial Sequence
  Description of Artificial Sequence: Synthetic coding sequence
atgcagcacgtctcatcctcacagagcagtcagagacacgtgcagtggccgggcgcttgcccaggagcaggagaggaacagccagcatgctcccaacctagtctgccgttgacccttccatctccctctcatcagctgcagcagctgatggacggatcaggcctgacacagatagcacagggagcacaggtacagctgcagcatccaggaaccccgatcacagtcagagagaggcgccctagccagccacatacacaaagtggtggcactatccaccacctgggtccgcagagtcccgccgcagccggaggggcagggctgcagccgctggcctctccctcccatataaccacagccaacttgccgccccagatctccagcatcattcagggtcaactcgtgcaacagcaacaagtgctgcagggccctccattgccccgacctctcgggtttgaacgaaccccaggggttctacttcccggagccggaggcgccgcagggtttggtatgaccagcccccctccaccaacgagcccatcccgcacagccgtgcctcctgggctctcttcactgccgctgactagcgtggggaatactggtatgaagaaggtccccaaaaaactggaggagatccctccagcgtcaccagagatggctcagatgcgcaaacaatgtctggattatcaccaccaggaaatgcaggcactgaaggaagtcttcaaagagtatttaatcgagctgttctttcttcagcacttccaaggcaatatgatggactttctggcctttaaggagcgcctgtatggcccactgcaggcctacttaaggcaaaatgaccttgatatcgaagaggaggaggaggagcacttcgaggttattaatgatgaggttaaagtggtcgcgcgcaagcatggccagccgggtactcccgtggcgatcgccacccagctgcccccccgcactagcgccgcatttcccgcacaacagcagcctctacaggtgctgagcgacggcagcacagtacagctgccgcggctgtcatctttaggcttcgaggacagtatgtgctag

SEQ ID NO: 29463 - DNA, 654 bp, Artificial Sequence
  Description of Artificial Sequence: Synthetic coding sequence
atgcaacatgtctcatcatcacagtcgagccagcgacacgtccagtggcctggagcctgtccaggtgctggagaggagcagccagcgtgtagccaaccctcactccccttgacgctgccttctccctcccaccagctgcagcaactcatggatggttctggtctgacgcagatcgctcagggcgcccaggtccagttgcagcacccagggacgcccattactgttcgggaaagaaggccatcccagccacacacccaaagtggcggtactatccatcatcttgggcctcaatcgcctgcagcagccggaggcgccgggttgcagccattggctagccccagccacattaccacagcgaacctgcccccgcagatctcttcgataatccagggtcagctggtgcagcaacagcaggtgttgcaaggaccaccgctgccccgccccctcggctttgaacggacccctggagtcttacttcctggtgcggggggggcggcaggttttggaatgaccagcccaccacctccaacaagcccctcccgcacagccgtgcctcccggcctttcttcattgccgctgacaagcgttggcaatactggaatgaagaaagtgccaaagaagctggaggagatacccccagcctctcccgaatag

SEQ ID NO: 29464 - DNA, 1071 bp, Artificial Sequence
  Description of Artificial Sequence: Synthetic coding sequence
atgcaacatgtctcttctagccagtcctctcagcgccacgtgcagtggcccggcgcgtgtcccggtgccggtgaggagcaacctgcctgcagccaaccaagcctgccactgacactcccctcacccagtcatcagcttcagcaactaatggatggcagcggcctcacacagatcgcccagggcgctcaggtccagctgcagcacccaggtacacctatcaccgtgcgtgaacggcgcccctctcagccgcatacacaatcaggggggaccattcatcatctgggcccccagtcaccagcagcggccggcggagctggcctgcagcccttggcttcgccgtcacacattactaccgctaatctcccccctcagatttcttcaataatccagggccagcttgtccagcagcaacaagtgctccaggggcctccgctgcctcggccacttggctttgagcgtacccccggcgttctcctccccggcgccgggggcgctgcgggatttggaatgacgagcccacccccacctacttccccgagcaggacggctgtgccgcccggtctgtcaagcctgcctctcacctctgttggcaatacgggtatgaagaaagtgcctaagaagctcgaggaaatacccccagcctcacccgagatggcgcagatgaggaagcaatgcttggattaccaccaccaagagatgcaagcccttaaagaggtgttcaaagaatacctaatagaactctttttcctgcagcactttcagggcaatatgatggattttttggccttcaaggaacgactgtacgggcccttgcaagcatacctgaggcagaatgaccttgacatcgaggaagaggaggaggaacacttcgaagtcattaatgacgaggtgaaagtggtggctcggaaacatggccagcccggcaccccagtcgctatcgctactcaactgccccccaggaccagtgctgcctttcccgcccagcagcagcctctccaggtgttgagcgacggatccacagtgcagctgcctagactttcatcactcggcttcgaagactccatgtgctag

SEQ ID NO: 29465 - DNA, 672 bp, Artificial Sequence
  Description of Artificial Sequence: Synthetic coding sequence
atgcagcacgtatcctcctctcagtcttctcagaggcacgttcagtggccaggagcctgtcccggtgcgggtgaggagcagccagcctgtagtcaacctagcctgcctctgacgctgccctcccccagccaccagctacagcaactgatggtgcagacccagagcccaactcagccaagtccaggtcccgggcaggcactgcagaacgtgagggcaggggcccctgggcccgggctggggctctgctctagctccccaactggtgacttcgtcgatgcttctgtccttgtcagacagatctctctctcaccatctagcggcggtcatttcgtgtttcaggacggcagtggtctgacccagattgcacagggtgcccaggtccaactacagcaccctgggaccccaattaccgtgcgtgagagacgaccaagtcagcctcatacacagagcggtggaactattcatcacctggggccacagagccctgctgctgccggcggagccggccttcagccgctggcctccccctctcacatcacaaccgcgaatcttccaccccagatttcgtccataattcagggccaattagtccagcagcagcaagtattacaaggtccccctttgcctcggcccctgggatttgagagaactcccggcgttctcctaccctag

SEQ ID NO: 29466 - DNA, 471 bp, Artificial Sequence
  Description of Artificial Sequence: Synthetic coding sequence
atgcagcatgtgtcttcttcccagtcatcacagaggcatgttcagtggcctggagcctgcccgggcgcgggtgaagagcagccagcatgctctcagccgtcactgcccctgaccctgccctccccttcacaccagctgcagcagctcatggtgcagactcagagtcccactcagccgagccctggtccaggccaggcactgcaaaacgtgagggctggcgctccagggcccggcttaggcctgtgttcgtcatctcccacaggagacttcgttgacgcctctgtcttggtcaggcagatctccctgagcccttcgtccggcggccacttcgtgtttcaggatgggtctggcttaacccagatagcccaaggcgctcaggtacagctgcagcatcctggaacacctatcacagtcagagaacgccgcccaagccaaccccacactcagagcggggggaccattcaccactag

SEQ ID NO: 29467 - DNA, 3393 bp, Artificial Sequence
  Description of Artificial Sequence: Synthetic coding sequence
atgcaattcccttcccccccagccgcgagaagtagtcccgcgccacaggctgcttccagttcggaagccgcagcccccgccacaggccagccaggacctagctgtcctgtcccaggcacatcacgtaggggccgccccggcactccacccgccggccgagtcgaggaagaggaggaggaagaagaggaagatgtagataaggacccacatcctacccagaatacgtgcctgcggtgccgacactttagcttgcgagaacgcaaacgcgaacctcggagaacaatgggcgggtgcgaggtacgggagtttctgcttcagtttggtttcttcctgcctctgctgacagcatggcccggcgattgcagccacgtgtccaataatcaggttgttttattagacacaaccacggtgctgggtgaattaggctggaagacataccctcttaacggctgggatgcaattactgaaatggacgaacacaatcgccctatccatacctaccaggtttgcaacgtgatggaacctaaccagaacaactggttacgtactaactggatttccagagatgctgcccaaaaaatctacgtggagatgaaatttaccctacgggactgtaacagcatcccatgggtcttaggaacttgtaaagaaaccttcaatcttttttatatggaatccgacgagagccatggtataaaattcaagcctaatcagtatacaaagatcgacaccattgctgccgatgaaagtttcacccagatggacctgggggacagaatcctgaaactcaacactgagattcgtgaggtcgggcccattgagaggaaagggttttacctcgcattccaagacattggcgcctgcatcgcgctggtgtctgtcagggtgttttataagaaatgtccctttacagtgcgaaatctggcaatgttccccgataccattcctagagtggatagtagctccctggtggaagtccggggttcttgtgttaagagcgctgaagaacgcgatacccctaagctgtattgtggggccgatggggattggctggtaccattgggaaggtgcatctgctccacaggttacgaagagatcgaggggtcttgtcacgcctgcaggccagggttttacaaagccttcgccggtaacacaaagtgctctaaatgccccccacattcactgacctacatggaagcaacctctgtatgccagtgcgagaaaggatacttcagagccgagaaggatcctccttccatggcctgtacgcgccctccttccgcgccgagaaatgtcgtctttaacattaatgaaacggccctgatcttggagtggtcccccccatccgacaccggggggaggaaagatttgacgtactccgtcatttgcaagaaatgtggcctcgatacctcacaatgtgaggactgcggtggagggctccgattcataccgcggcataccggcctgatcaataattcagtcattgtgctggattttgtgagccatgttaactatacgtttgaaattgaggcgatgaatggcgtctcggagttgagctttagccccaagccttttaccgccatcaccgtgaccacagatcaggacgcccccagcttgattggggtcgtgcgaaaggattgggcatcgcagaactctattgccctatcgtggcaggctccggctttttccaacggcgccatcctggactacgagatcaagtattatgaaaaagaacatgagcagctgacttacagctccactcgcagcaaagctccttccgttatcatcacagggctgaaaccagcgacaaaatacgtgtttcacatccgagtcagaaccgccaccgggtactcaggttactcccagaaattcgagttcgagaccggagacgagaccagtgatatggcagccgagcagggacagattctggtgatcgcaaccgccgcggtcgggggattcacacttttagtaattctgactttatttttcctaataaccggccgctgccagtggtacatcaaagcaaagatgaagtccgaggagaaaaggcgaaaccacctccagaacggtcatctccggttccctggtataaagacatacatcgacccagacacgtatgaggacccatcgctagccgttcatgaattcgccaaggagatcgatccctcccgaattagaattgaaagagtgattggagcaggggagtttggggaggtctgctctgggcgcctgaagacaccaggtaaacgcgagataccggtggccattaagacacttaagggtggtcacatggaccggcagagacgagatttcctacgggaggctagcatcatggggcagttcgaccatcctaacataatcaggctggaaggtgtggtgacaaaaaggtcttttccggccatcggcgttgaagccttctgtccaagtttcctgcgggccgggtttctgaattcaattcaggcaccacacccagttccaggcgggggctccctgccgcccaggattcccgcagggcggcctgtgatgatcgtagtcgagtatatggagaacgggagcttggatagcttcctgagaaagcacgacggtcattttacagtcatccagctcgttggaatgctgagagggattgctagcgggatgaaatacttaagtgacatgggttacgtgcacagggatctggctgcaaggaacatcctggttaatagtaacctggtttgtaaggtttccgatttcgggctttcgagagtgctcgaagatgatcccgaggccgcctacactaccacaggaggcaagataccaattcggtggaccgcccctgaggccattgcttatcgcaagttttcctccgcctccgatgcttggagttatggaatcgtgatgtgggaggtaatgagttacggtgagcggccctattgggagatgagcaaccaggatgtcatcttgtccatcgaagaagggtaccgactgcctgcgcccatgggatgtcctgcctcactacaccaactcatgctccactgctggcagaaagaacgcaaccaccggccgaaatttaccgacatcgtgtcttttctggacaagctcatccgaaacccttccgctctgcacaccttggttgaggacatcttggtgatgccagaaagtccaggagaggtgccagaataccctttgtttgtgactgtgggagattggctggacagcattaaaatgggccaatacaagaacaatttcgttgcggccggatttacgactttcgatctcatctcacgcatgtccattgatgatatcagaaggattggcgtgatcctaataggccaccagcgtagaattgttagcagtattcaaacattacggcttcacatgatgcacatccaagaaaagggatttcatgtctag

SEQ ID NO: 29468 - DNA, 726 bp, Artificial Sequence
  Description of Artificial Sequence: Synthetic coding sequence
atggccgcagagcagggacagatcctggttattgccaccgccgcagtcggggggtttactcttctggtcattttaactcttttctttctcatcacaggtagatgccagtggtatattaaagctaagatgaagtccgaggagaaaagaagaaaccatctccagaacggccacctcaggttccctgggataaaaacttatattgaccccgacacttacgaggatccttcgttggctgtccatgaattcgcaaaggaaattgacccttccagaatacgaatagagagagtcattggcgcaggcgagttcggagaggtatgcagtggaaggctgaagacccccggtaagagggagattccagtggccatcaagaccctgaaaggtggccacatggaccgccagagacgagatttccttcgggaggcttcgattatggggcagtttgaccaccccaatattatacgcctggagggcgtagtgacaaagcgttctttcccagccatcggcgtggaagcgttttgcccctccttcttgcgggcaggcttcctcaactcgattcaggcaccgcatccggtccccggtggcggcagtctacccccgcgaatccctgccggcagaccggttatgatcgtcgtggagtacatggaaaacggctcactcgatagtttcttgcgactttaccccaaggcagaatataatggaaaacaatgcagtcgatatagtatctag

SEQ ID NO: 29469 - DNA, 1005 bp, Artificial Sequence
  Description of Artificial Sequence: Synthetic coding sequence
atgaaggacagtcccttccaggttaccaagctttactggttaaacgaaaagtgggatttcatagcaagtgcaagcgacatggctgccgagcaggggcagattctggtgatcgccaccgcagctgtgggcggcttcactctactcgtgatccttactcttttcttccttattacagggagatgccagtggtacattaaggcaaaaatgaaaagcgaggagaagcgccgcaatcaccttcagaacgggcacctgcggtttcccggcatcaaaacttatatcgacccagatacgtacgaggacccttcgctggccgtccatgagttcgctaaagagattgatcccagcagaattcgcatcgagcgagtgataggtgccggcgagttcggggaggtgtgttccggaaggttaaagacacctggtaagagagaaattcctgtagccataaagacattaaaggggggccacatggaccgacaacggagggatttcttaagggaggcttcgattatgggacagttcgatcaccccaacattatccggctggaaggagttgtcaccaagcgttcgtttccagctatcggtgtggaggccttctgtcccagcttcttgagagcaggttttctgaattctatccaggccccacatccagtgccaggtggaggctcattgcccccccgcataccggccgggagacctgtaatgatagtcgtagaatacatggaaaacgggtcattggactctttcctgaggaaacacgacgggcattttaccgttattcaacttgttggaatgctgcggggcatcgcgagtggaatgaaatatttgagcgatatgggatacgttcacagagacttggcagcacggaacattctggtgaattctaatttagtctgtaaggtctccgacttcggtctctccagggtgctggaggacgaccctgaggcagcgtataccacaactgacttgttccaaacactgaccctcaatctgtgctactccgcatag

SEQ ID NO: 29470 - DNA, 858 bp, Artificial Sequence
  Description of Artificial Sequence: Synthetic coding sequence
atgggaggttgcgaagtgcgtgaatttctgttgcagttcggatttttcctgccactgttgacagcgtggccaggcgattgctcccatgtatctaacaatcaggtcgttctcctggataccactaccgttctgggtgaattgggctggaaaacgtatccgctcaatggatgggatgcaatcactgaaatggatgaacacaacagaccgatccacacttaccaggtctgtaacgtaatggagcctaatcagaacaattggttacgtaccaattggatttcgcgggatgccgcacagaagatttacgtcgagatgaagtttacactccgcgattgtaattccatcccatgggtgctgggaacgtgtaaagagacctttaatttattttacatggagagcgacgagagccacggcatcaagttcaagccaaaccagtacacaaaaatcgacacgattgcagctgatgagagctttacgcagatggacctgggcgacaggattctgaagctcaatactgagatccgcgaagtcggtcccattgagaggaagggtttttacttggctttccaggacattggagcctgtatcgccctggtctctgtgcgggtcttctataagaaatgtccattcaccgtacgaaatctcgccatgttccccgataccatccctcgggtcgactcctcctccctggtcgaggtgagaggtagttgcgtgaaatccgcagaggagcgtgacactcccaagctgtactgtggcgccgacggtgactggttggtcccactcgggcgctgtatctgctccacgggatacgaggagatcgaggggagctgccacggagcatctaaggggcgctgcttttag

SEQ ID NO: 29471 - DNA, 7263 bp, Artificial Sequence
  Description of Artificial Sequence: Synthetic coding sequence
atgagtggacacaccctgccccccctaccagtcccaggcaccaattctacagagcaagcttcagtacccagagccatggcagcaaccctcggtgcaggaacgccacccaggcctcaagcacgctccattgcgggggtatatgttgaagccagtggacaagctcaatcagtgtacgccgcaatggagcaggggctgctgccagctggccttggtcaagcccttcttgaggctcaagccgccactggcggcctcgtagatttggctagaggccagcttctccctgtttccaaagctctgcagcaaggactggtgggacttgagttgaaggaaaagctgttggctgccgaaagagccaccactgggtacccagacccctatggtggggaaaagttagccttatttcaggccataggtaaggaggtggtggatcgcgcccttgggcaaagttggctcgaggttcagctcgccactggaggactggtggatcccgcccagggcgtcctagttgcccccgaacctgcctgccatcagggcctccttgatcgggaaacctggcacaaactaagcgagttggagcccggtacaggagacctccgtttcctggaccctaacactctggagcgcctgacctaccatcagctgctagaaagatgtgtgagagctcccggcagcggcctggcactcctgcccctcaaaatcacctttaggtcaatggggggtgccgtaagcgcagctgaactgcttgaggtcggaattctggatgagcaggccgtccaggggctccgcgaaggcaggttagccgcggttgatgtgtccgcacgggcggaggttagaaggtacctggaggggaccggctctgtagctggcgtggtgcttttgcccgagggccacaagaagagttttttccaagccgctacggagcatcttcttcccatgggcactgcccttccccttctggaggcccaggccgccacacataccttagtggatcccatcacaggacaacgcctctgggttgacgaggcagtgcgtgccggcctcgtgtccccagaactgcacgagcaacttttggtggctgagcaggccgtgacaggtcaccacgacccatttagtggatcacagataccactctttcaggccatgaagaagggcttagtcgacagaccactggccttacggctgctcgacgctcagctcgctactggtgggttggtgtgtcccgctcgccgcctccgcttaccgttagaggccgcacttcgttgcggttgcctggacgaagacacccagaggcaattgtcccaggcgggcagtttctccgatggcactcacggcggacttcggtacgagcagctcctcgcactgtgtgttactgatcctgagacgggactggcgttccttcctttgtccggtggcccacggggtggggagccacaaggccccccatttatcaaatacagtacaagacaggccctgtccactgccaccgccacggtgtcggttggcaaatttagaggcagaccagtgagtctgtgggagctgctgttctccgaggctatctcttcagaacagagggcgatgctggcccagcagtaccaggagggcaccctgtctgtggagaaactagcagcaaagctgagcgctaccctagaacaggccgcagcgactgctcgagtgactttttccgggctaagagacaccgtgacccccggtgagcttctaaaggccgagattatcgaccaggacctctacgaacgtctagaacacgggcaggccacagccaaggacgtcgggtcactcgccagcgttcagcgttaccttcaggggaccggttgtatagctggactgctcctgcccgggagtcaggagagactgagtatatatgaagctcggtgcaagggtctgttaaggcctggcactgctctcatactgcttgaggctcaagccgcaacaggttttatcattgaccccaaggcaaacaaggggcactcagtggaagaggctctccgcgccgcagtcattggtcctgacgtgttcgccaagctcctctcggcggaaagggctgtaacagggtatacagacccttatactggccaacagatcagtctgttccaagctatgcaaaaggggttaattgttagggaacacgggatccggctgttggaagctcagatcgccacaggcggggttattgatcctgttcattctcatcgtgtgcccgtggacgtggcctaccggagggggtacttcgatcagatgctcaacctgatcttgcttgacccatcagacgacaccaaagggttctttgaccccaacacacatgagaatctgacttatctccagttactagaacggtgtgttcgcgatccagaaaccggcctgtacctcctacccctgagcagcacacagagccctctagtggatagtgcgacccagcaggcatttcagaatcttctcctgagcgttaaatacgggagattccaggggcaacgggtatccgcctgggagttaatcaactccgaatacttcagcgaaggacgaaggaggcagcttctgagaaggtaccggcagcgtgaggttactttgggccaggtggctaagctgcttgaagctgagacccagagacaagcagacatcatgctgcctgctctgcggagtcgcgtgacagtacaccaattacttgaggctgggattattgaccaacaattgcttgatcaggtcctggcgggcactattagccccgaggcccttctcttaatggacggggtgagaagatacctatgtgggctgggtgcagtcgggggtgtcaggcttctgccctccggccagcgtctctccctgtatcaagctatgagacagaaactgcttgggccaagagttgcattagccctgctggaagctcaggccgccactgggaccatcatggacccacacagtcccgaaagcctgtccgtggacgaggcagttaggcggggcgtcgtcgggccagagctttatggtcgactgaagcgtgcagaaggagccatcgccggtttcagggatccatttagtggaaagcaagtgagcgtttttcaggccatgaaaaagggattgatcccttgggaacaggctgcaaggttactcgaggcacaggtcgcgactgggggaatcatcgatccaacctctcaccaccatttaccgatgccagtggccatccaacggggatatgtggatcaagagatggagactgcactgtcctcgagcagtgagacctttccaacgcctgatggccagggacggactagttatgcccagctgctcgaggagtgcccacgggacgagacctccgggttgcacttgctgcccttgcctgagagtgcaccagcactccctacggaagagcaggttcagcggtccctccaggctgtgccaggagccaaggatggtacgagtctttgggaccttctgagtagctgccattttacggaggagcagaggcgcgggttgctagaggacgtacaggaaggtcgaacaaccgtgccacaactgttggccagtgtgcaacgttgggtccaggaaaccaaactcctcgctcaggcccgcgtgatggtgccggggccacggggagaagttcctgctgtgtggctgttggatgcgggcattattacgcaggagactctggaggccttggcacaggggacccagtcacccgctcaggtggccgagcagcctgctgtcaaggcctgcctgtgggggactggatgcgtagccggtgtcttgcttcaaccctcaggcgcaaaagcctccatcgctcaggcagtgcgggatggtctccttcccaccggccttggccaaagattgctcgaggcgcaagtcgcctccgggttcctggttgaccccttgaataaccagcgtctttctgtggaggacgccgttaaggtgggacttgtcggcagggaactcagtgagcagttaggccaagcagaaagggctgctgccggctatcctgacccctacagcagagcctccctttcactatggcaggctatggaaaagggccttgtgccccagaatgagggattaccactcctgcaggtgcagctggccacaggtggagtagtagacccagtgcacggtgtgcacctgcctcaggctgcagcctgtcggctgggattgctggacacacaaacctcacaggttctcaccgccgtggataaggacaataaattttttttcgatccatctgcccgtgaccaggtcacatatcagcaacttagagagaggtgtgtatgtgatagtgaaacaggactattactgctgcctttgccctccgacaccgtgctggaagtggacgatcatacagcagtcgcgctgagggcaatgaaggtgccagtgagtacaggcaggttcaaaggatgttctgttagtttatgggacctcctcctgagcgaatacgtcggcgctgacaagcgacgggaactagtcgcgttgtgtaggagcggacgcgctgcagctctgcgacaggtcgtgtccgccgtgaccacactagtggaggcggctgagcgccagcctttacaggccacatttcgcggactgaggaaacaggtgtccgctcgcgatctctttcgagcgcagcttatttcccgaaagaccctggacgaattgtctcaagggaccactactgtgaaggaagtggcagaaatggactcagtgaaaagaagcctagagggggggaactttattgctggggtcctcattcagggaacacaagagcggatgagcatccccgaggccttgcggaggcatatactcagacctggtacggccctggtgttgctcgaggctcaggccgctaccggctttattattgatccagtcgaaaatcgtaagctcaccgttgaagaggcctttaaggccgggatgtttggtaaggagacatatgtgaagctgctgtccgccgagcgggcagtgaccggatataccgatccgtatacaggacagcagatctccctgttccaggcaatgcaaaaggacctcattgtacgcgagcacggaatcaggctgttggaagcccagatcgccactggggggattatcgatccagtacacagccatcgggtgcccgtggatgtggcttataggtgtggatatttcgacgaggagatgaacaggatcctggctgatccgtccgacgacacaaagggcttctttgaccccaacacacatgaaaatttgacctacctgcagctgctcgagagatgcgtggaggaccctgagaccgggctttatctcctacaaatcattaagaagggtgaaaattacgtctacatcaacgaagcaactcggcacgtgcttcagtcccggaccgctaagatgcgtgtgggccggtttgctgaccaggtggtaagtttctgggacctgctatcttccccctattttactgaagaccgaaaacgcgagctgattcaggaatatggggcccaatcaggggggctggagaaacttcttgagatcattacgacaaccatagaagagacagagacccagaaccagggtattaaggtggctgccattagaggagaagtcacagcagccgatttatttaactcgagagtcatagatcagaaaaccctgcataccctgagagtgggaaggacgggtggccaagcactgtccacgcttgagtgcgtgaaaccttatctcgagggaagcggatgcatagccggcgtgactgtcccctccacgagggaggtcatgtccctgcatgaagctagccgaaaggaactgatccccgctgcttttgctacctggctcttagaagctcaggctgcaaccgggttcctgctcgatccatgcaccaggcaaaaactgagcgtcgacgaggcagtcgatgttgggttggtgaatgaagagttgcgcgagagactattaaaggctgagagagcagccaccggctatcgagacccggcaactggtgatacaatccctctattccaggctatgcagaagcagcttatcgaaaaggccgaagccctgcggctcttggaggtgcaagttgccactgggggggtcatcgatccccagcatcaccaccgattacctctcgaaactgcttaccgcagaggctgtctgcataaggatatctacgccctaatctctgatcagaagcacatgcggaagcgattcgtagacccaaacactcaagagaaggtgtcatacagggagttgcaggaaagatgtaggccccaggaagataccggatggctgctctttcctgtgaataaagcagccagagacagcgaacatatcgatgacgagacaagaagggctttagaagccgagcaggttgagattacagtgggcaggttccggggacagaaacctacactttgggcacttctgaactcagaatacgttaccgaggaaaaaaagttgcaacttgtcaggatgtaccggacacacacgcgccgggcattgcagactgtggcccagctgatcctggagctcatcgaaaagcaggagacttctaataaacacttatggtttcagggaatccgccgtcagattaccgcttctgaactactttcatctgccattattacagaagaaatgctgcaggacctagagacaggtcgtagcaccacacaggagctgatggaggatgacagggtgaagcggtatctcgaggggacttcctgtatcgccggagtcctcgttcccgcaaaggaccagccaggcaggcaggagaagatgagcatatatcaagcaatgtggaagggtgtgttgagaccagggactgctctggtattgctcgaagcccaggcagccaccggcttcgtgatcgatcctgtgcgcaacttgcgtctttcggtggaggaagccgtcgccgcaggtgtggtggggggggaaattcaggagaagttgctgagtgccgaaagggccgtgaccggttataccgacccgtatactggacagcaaattagtctcttccaggccatgcagaaagacctgatcgtaagagaacatggcatcaggctgttggaggcacagatagccacgggcggtgtaatagaccccgtccattctcatcgagtgccagtggacgtagcctaccgccgggggtacttcgacgaggagatgaatagggtacttgccgacccgtccgatgacaccaagggattcttcgatccgaacacccacgaaaacttgacctatctacagctgctgcagcgagctaccctggatccagagacgggcctgctattcttgtccctgtctctgcagtag

SEQ ID NO: 29472 - DNA, 15267 bp, Artificial Sequence
  Description of Artificial Sequence: Synthetic coding sequence
atgtctggccacacattacctccactgcccgtccccggcactaactctacggaacaggcctctgtcccacgggctatggccgcaacgctcggggcggggacaccgcctaggccacaggctagatccattgcgggggtctatgttgaagcatcagggcaggcccagagcgtgtacgctgcaatggaacaggggctcctgcctgccggattgggccaagcattattggaagcccaggctgccactggaggtttagtggacctcgccagaggccagctgctgcctgtgtccaaagcactgcagcagggcctggtcggactagagttaaaagagaagttactggccgcagaacgcgctactactggatacccagacccttacggtggtgagaaactcgccctgtttcaggctatcggaaaggaggtggtggaccgggcactggggcaatcctggctggaggtccagctggccactgggggcctcgtggatccagctcagggcgttttagtggctcccgaacccgcatgtcaccaggggctcctcgacagggaaacatggcataagctgagcgaactggaacccggtactggtgacttgcggttcctcgatcccaataccctggagcgattaacctaccatcaactcttagaaagatgtgtgcgcgcacccggtagcgggctcgctctgctgccactgaagattacctttcggagtatgggtggagcagtgtctgctgcggagctgctggaagtgggtattctggatgaacaggctgtccagggactccgtgaagggcgtctcgccgctgtcgacgtgtccgctcgggctgaggtgaggcgctacctggaggggacaggctccgtagcgggcgtggtcctattacctgagggacacaaaaaaagcttctttcaggccgcgaccgagcaccttctgcccatggggaccgcactgcccctcctcgaagcacaagcagctacccacactcttgttgaccccattaccgggcaaaggttgtgggtcgacgaggcagtaagagccggcctggtcagccctgagcttcacgagcaattactcgtggcagagcaggctgtgacgggacaccacgatccattctctggcagccagattcccctgttccaggctatgaagaaagggctggtcgatcgacctctggcattgcgcctgctcgatgcacaactggcgacagggggcttggtttgtccagcacggcgattgagactgccactcgaggctgcacttaggtgcggatgtttggatgaggatactcagaggcaactttcacaggcaggcagctttagtgatggcacgcacggcggcttgcggtatgaacagctgttagctctttgtgtaaccgatccggaaaccggactcgctttcctgcctttgtctggaggaccccggggcggtgagccccagggccctcccttcatcaagtattccacacgacaagctctgtcaaccgccacagccactgtaagcgtaggcaagttcagagggagaccggtcagtttatgggaactgctgttttcggaggccatttctagcgaacagcgcgccatgctagcccagcagtatcaggagggcacgctgtccgtggagaagctggcggccaagctcagcgccaccctagaacaggctgcagcgactgcccgagtaaccttctccggcttgcgggacacagtcaccccgggcgagctgcttaaggcggagattattgaccaggacctctatgagcgtcttgagcacggtcaggctaccgccaaggatgtcggctcccttgcctccgtccagaggtacctgcaaggcaccggctgtatagctggactgcttctaccaggctcacaggaacggctgagtatctacgaggcaagatgcaaaggcttactcaggcccggtactgctctcatcctgcttgaggcccaggccgcaaccggtttcatcatagatccaaaagccaacaagggccactccgttgaggaggcattgagagcagctgtcatcggcccggacgtgttcgctaaactactgagcgctgagcgtgccgtgaccggttacacggatccatacactggccaacagattagtctgttccaggccatgcaaaagggccttatagttagagagcacgggatcagactcttggaggcgcagattgcaacgggcggagttatcgacccagttcatagccacagagtaccagtcgatgtcgcctatcgccgcggttattttgaccagatgttgaatttaattctgttggatccgtcggatgatacgaagggcttttttgacccaaatactcacgagaacctgacatacctgcagcttttggaacgctgcgtgcgagaccccgagacagggttgtaccttcttcccctgtcgtcaacccagagccccctggtcgactccgcaactcagcaggcattccagaacctcctactatccgtgaaatatggtcgatttcagggacagcgtgtcagcgcctgggaactgattaattccgagtatttcagtgagggacggaggagacagctgctcaggaggtatcgccagcgggaagttacacttggtcaggttgccaagctgctggaagccgagacacaacgtcaggccgacattatgcttcccgccttgcgcagtcgggttaccgtacatcaactgctcgaggcggggatcatagaccagcagttgctggatcaggtgcttgccgggaccatttcccccgaagcactgttgcttatggacggagttaggcggtatctttgtggcctaggtgcggtcggaggagtccggctcttacctagcgggcagagactgtcactctaccaggccatgagacagaagctgcttgggccccgcgttgccctggctctacttgaggcccaggctgccactggcactatcatggacccgcattccccagaatcgctgtccgtcgatgaagccgttcgccggggggtcgtaggacctgagttatacggcagactcaaaagggcggagggtgctattgccggctttagggatccattttccgggaaacaggtgtccgtgtttcaggcgatgaaaaaggggctaattccgtgggagcaagcagcgagacttctggaggcccaggtggctaccggaggaatcattgacccaaccagccaccaccacctgcccatgcctgtggctattcagcggggctacgtggaccaggaaatggagactgcactgtcaagcagctccgagacttttccaacaccagacgggcagggcaggaccagctacgcccagttgttggaagagtgcccccgggatgagaccagcggcctgcaccttctcccgctgccagagtccgcccctgctcttcccacggaggagcaagtacagaggagtctccaggccgtgcctggcgctaaggacggtacgagcctgtgggaccttctatcaagctgtcattttactgaagagcagaggcggggtcttctggaagacgtccaagagggccgtactactgtgccccaactgttggcttcggtccagagatgggtgcaggaaaccaagttgctggcacaggcacgagtcatggttccaggcccaagaggagaggtgcccgccgtgtggctcttggacgccggcataataacgcaggagacgcttgaggccctggcccagggaacccagtcccccgcccaggtggccgagcagccagccgtcaaggcctgtctgtggggcacaggctgtgtcgctggcgtcctcctgcaaccgagtggggctaaggcctctatcgcacaagctgtacgcgatggcctgctgccaacgggactagggcagcgattgctagaggctcaggtagcctcaggcttcctagtggatccgctgaataaccagaggctctcagtggaggatgctgtgaaggtggggctggttgggagagagctgtctgaacagctgggccaggcagagcgcgccgccgcaggctatcccgacccttactctcgagccagcctgtcgttatggcaggccatggagaaggggctggtaccccagaatgaaggactgccccttctgcaggttcagctggcaaccggcggggtggtggatcccgtacacggtgtccatctgccacaggctgcagcctgtcgtttagggctcctcgacacgcagacctcacaggtgctaaccgccgtagacaaagacaacaagtttttctttgatccaagtgcacgggaccaagtcacatatcaacagttgcgggaacgttgtgtgtgtgactccgagaccggcctacttctgctgcccctcccctctgacacagtattagaagtggacgatcacactgccgtcgctctgcgggctatgaaagtgcccgtttccacaggtcgcttcaaaggctgctcagttagcttgtgggacctgctgcttagcgagtacgttggcgccgataagcgccgggagcttgtggccctctgccgtagtggccgtgccgcggccttgagacaggtggtgagcgcagtcaccactctggtggaagcggcagaacgccaacctctccaagcgacctttcgcggactgcggaagcaggtgtccgcacgagatctgtttcgggcccagctaattagccgcaaaactttggatgaattgtcccaggggacaacaactgtgaaagaagtcgcagaaatggactctgtgaagcgcagtcttgaggggggcaatttcatcgcgggcgtcctgattcagggcacacaggaacggatgagcattccagaggcgttgaggagacacattctgcggccagggaccgctttagttctgttggaagcccaggcagcaacaggcttcattatcgacccagtagaaaaccggaaactcaccgtagaagaagcctttaaggccggcatgttcgggaaagaaacgtatgttaagctgctatcggcggagcgcgccgtcacaggctacaccgatccttacacaggtcagcagattagcttatttcaggccatgcagaaagatctgatcgtgcgagagcacggcattcgactactcgaagctcaaattgccaccggcgggattatagatcctgtgcacagtcaccgcgtgccagtcgacgtggcctaccggtgcggctacttcgatgaagaaatgaatcggatcctcgccgacccaagcgatgacactaagggcttctttgatcctaatacacacgaaaacctgacatatctgcagctgttagagcgctgcgttgaagaccctgaaaccggcctttatctgctgcagatcatcaagaaaggggagaattatgtgtacatcaatgaggcaactcggcacgtgcttcaaagcagaaccgcaaaaatgcgcgtgggaaggtttgcggaccaggtggtttccttctgggatttattgtcttcaccttactttacggaagataggaaaagggagctgatccaggagtatggtgctcagagcggggggctcgaaaaactccttgagatcattactaccaccatcgaggaaacagagactcagaatcaaggtataaaggtggccgccatccggggagaggttactgcagccgatttgtttaattcacgagtcatcgaccagaagactctgcacacattgagagtcggacggacaggaggccaggcactgtccacgctcgaatgcgtgaagccctacctcgagggctctggctgtatcgccggcgtgaccgttccctctacgcgcgaggtcatgagcctgcacgaagccagccgcaaggagctgatcccagccgcattcgcaacatggcttctagaggctcaggcagcgaccgggttcctgttagatccatgcacccggcagaagctttccgtagatgaggctgtagacgtgggcctcgtgaatgaggagctgcgggagagactcttgaaagcggagcgtgctgcaacaggctacagagatccagccacgggagacacaatcccactctttcaggccatgcagaaacagcttattgaaaaagctgaggctctccgtctgctggaggtccaggtcgctactggtggggtaattgacccccagcatcaccataggctccctcttgagaccgcttacagacgtggctgcctgcataaagacatctacgctctaatttctgaccagaagcatatgcgtaagcgcttcgtggatccaaatacccaggagaaagtttcttatcgtgaactccaagaacggtgccgcccacaagaggacaccggttggctcctgttccccgtgaataaagctgctcgggactccgagcacatcgacgatgagacgaggcgtgcccttgaagctgagcaagttgaaataaccgtggggcggttccgcggccaaaagcctacactctgggccttactgaatagcgagtatgttactgaagagaaaaagctgcaattggtgcgcatgtatagaactcataccagaagggccttacagaccgtggcacagctcattctcgagcttatcgagaaacaggaaacctctaataagcacctttggtttcaaggtatcaggcgtcagattaccgcctcagaattactgtcttcagctatcatcaccgaagagatgttgcaggacctggaaaccggacgctcgaccactcaggaattgatggaggatgatagggtaaagcgatatcttgaaggaacctcttgcattgctggagtgctggtgcccgcaaaggatcagcctgggcggcaggaaaagatgagtatttaccaagctatgtggaagggggtcctccgaccaggcacagccctggtcctactggaggcgcaggccgccaccggttttgttatcgacccggttaggaacctgcgactgagcgtagaagaggcagtggcagctggcgtcgtaggtggggaaattcaagagaagcttctgtccgctgaacgggcagtcaccgggtacacagatccctacacaggtcagcagatctctctgttccaagccatgcagaaggatctgatcgtgcgcgaacacggcattcggctcctggaggctcaaattgctactggaggcgtgatcgatcctgtgcattctcaccgggtacccgtcgacgtcgcctacaggaggggttacttcgacgaggagatgaatcgagtcctggctgacccctctgatgataccaaaggtttctttgacccaaacacacacgaaaacctcacatacgtccaactcctaaggcgatgcgttcccgaccctgatacaggactgtacatgctgcagttggccggaagaggaagcgccgttcaccagctgtctgaagaattgagatgcgctctccgcgatgctagggtgacccctggcagtggggccctgcagggccagtccgtgtctgtctgggagctcctgttctatcgggaggtctctgaagatcgcaggcaggatttactgtcgagatacagagccggcaccctaacagtagaggaactcggggccactctcacttctcttcttgcccaggctcaggcacaagctcgcgccgaggccgaggcgggatcacctcgccctgaccctcgggaagccttgcgcgcggccacgatggaggttaaggtcgggcggcttaggggtcgcgctgtgcccgtgtgggacgtcttggcatcaggttacgtgagtcgcgcagcaagagaagagctccttgctgagtttggctctggcaccctcgacctgcccgctctcaccaggagactaactgcaatcatcgaagaggccgaggaagctccgggcgctcgcccccagctgcaggatgcatggagaggtccgcgtgagcccggccctgctggtaggggtgacggcgatagcgggcgatctcaacgagaaggtcagggggagggtgagacccaagaggccgctgccgccgccgccgcggctgccgcccgccggcaggagcagacccttagagatgcgaccatggaggttcagcgtggccagtttcaaggaagaccagtttcagtctgggatgttttattctcatcatacttgtcggaggcacgcagagatgagctgttggcacagcacgccgctggcgccctcggactgcccgatctagttgccgttcttactagggtgatcgaagagactgaagagcgactgagcaaagtcagctttagaggactgcggcgtcaggtgagcgcatctgagttgcataccagtggaattctggggcccgagactcttcgtgatctggctcagggaacaaagacccttcaggaggtaaccgagatggacagtgtaaagcggtatctagaagggaccagctgcattgccggcgtgcttgtgcccgcaaaagatcaaccgggccggcaggagaagatgtctatttatcaggcaatgtggaagggagtactcaggcccggcacagcacttgtactgctcgaggcccaggctgccaccggattcgtcatcgaccccgtcagaaacttacgcctgtccgtggaggaagccgtcgcggccggagttgtaggcggcgagatacaggagaaactgttgtcagctgagcgagccgtgaccggctacaccgatccatacacgggccaacagataagcttgtttcaggccatgcaaaaagacctgatcgtccgagagcacggcatacgcttgctggaggcacagatcgccacaggcggcgttatagaccccgtgcattcacatagggtacctgtggatgtagcctatcaacgaggctacttcgacgaggagatgaaccgggtgcttgccgacccctctgatgacactaaggggttcttcgacccgaacacccacgagaatttaacatacgtgcagctgctgagacgctgcgttccggacccggataccggcctgtatatgctgcagctcgctggccggggctcagccgtgcatcagctgagcgaggaactgcggtgtgcgctacgcgatgcccgcgtgacgcccggctccggagctttacaagggcagtccgtgagtgtgtgggaattactattctatagagaggtgtctgaggacagaaggcaggatctcctctcgagatatcgtgccgggactctaaccgtggaggagctgggagcgaccctgaccagcctgctggcccaagcacaggctcaggcccgtgccgaagcagaagctggaagtcctaggccggatccgcgggaggccctgcgcgccgctactatggaggtgaaagttggtcggctcaggggcagagccgtgcctgtatgggatgttctagccagcggctatgttagtcgcgctgcacgcgaggaactcctggccgagtttggtagcggcacgcttgacctccctgcattgacgagacgactgacagctatcatcgaagaggccgaggaagcgccgggcgccaggcctcagttgcaggacgcctggaggggaccccgagaacctggaccggctgggagaggggatggggattccggtcggagccagcgcgagggtcagggcgagggcgaaactcaagaggcggccgctgccgctcgacgtcaagaacaaaccctccgcgacgctactatggaggtgcaaagaggtcagttccagggtagaccagtgtctgtgtgggatgttctctttagctcatacttatctgaagcaaggcgggacgagctgctggctcagcatgctgcaggtgccctgggtttgcctgacttggttgccgttttgacccgagtcattgaggagactgaggagagactctctaaggtgtccttccggggcctgaggtgtcaagtgtctgcttcagagctccatacgagcggaattctcggtcctgagacccttagggaccttgcccaagggacaaagactctgcaggaggtcactgaaatggattctgtgaaacgatatcttgaaggcacctcctgcatcgcaggggttctggttcctgctaaagaccagccgggtagacaggagaagatgtccatttaccaggccatgtggaagggagtgctccgacctggcactgcactggttctgctggaggcacaggctgcgacaggctttgtcatcgatcccgttcgcaatctcagactgtctgtcgaggaggccgtcgctgctggggtggtggggggggagattcaggagaaactcctttcagcggagagagcagtcacaggttatacagatccctacaccggacaacagattagcctcttccaagccatgcagaaggacttaatcgtgcgcgagcacgggatcagactcttggaggctcagatcgctacaggtggcgtgattgatccagtgcatagccatcgcgtgccggtggatgtggcgtacaggcgaggatactttgatgaggaaatgaacagagtattggctgatccgtccgatgataccaaaggcttctttgacccaaatactcacgagaatctcacctatgtgcagctgctgagacgctgtgtgccagacccagacaccgggctgtacatgcttcaattggccggaaggggttccgctgtgcaccagcttagcgaggaactgaggtgtgccctgcgcgacgctcgcgttactcccggatctggagccttgcagggtcagtcagtcagcgtctgggagttgctcttttatagagaagtctctgaagatcgacgccaggatcttctgagccggtacagggcagggaccttaaccgtggaggaactgggagctacactgacaagccttctggcacaggcgcaggcccaagcacgggctgaggctgaggctggcagccccaggcccgatccacgtgaggcccttcgtgcagctactatggaagtgaaagttggtaggctgagaggaagagcagtgcccgtgtgggacgtgctcgcaagtggctatgtgagtagagccgccagagaagagctattggctgaatttgggtctggaaccctggatcttcccgctctgacccgccgacttactgccattatagaagaagccgaagaagccccgggcgccaggccgcaactccaggacgcttggcgtgggcctcgcgagcctggcccagccggccggggggacggtgactctggaaggtcgcaaagggagggacagggcgagggggagacccaggaggctgccgcagccacagctgccgcacgcagacaggaacagactctccgtgacgccacaatggaagtgcagcgaggtcaatttcaggggagaccggtgtcggtctgggacgtacttttttcctcgtacctctcagaagccagaagagatgaacttctcgcccaacatgccgcaggtgcgttgggcttgcccgatcttgtcgcagtgctgacacgcgttatagaggagacggaagaacggcttagcaaggtgagtttcagaggcttacggcggcaagtgtccgcctcagaactacatacttccggcatactaggccctgagaccctgagggatttggcacagggcactaagaccttgcaggaagtgacagagatggactctgtgaagaggtatcttgaggggacctcgtgcattgccggagtgctcgtgcccgctaaggaccagccaggtcgacaagaaaaaatgtcaatctatcaggccatgtggaagggagttttaagaccgggtaccgctttggtcctgcttgaggcccaggccgccactggctttgttatagaccccgtgaggaatctgcgcctgtccgtggaagaggcagtggccgcgggagtcgtcggtggcgaaatccaggaaaagctattgtctgccgagcgtgccgtgacagggtacaccgatccatacacagggcagcagatctccctgttccaggctatgcagaaggacctgattgttcgcgagcatggcatccgactattggaggctcaaattgctaccggcggggtcatagacccggtccattcccatagggtgcccgttgacgttgcgtaccggcgcgggtacttcgacgaggaaatgaatagggtactggccgatccctctgacgatacgaaggggttcttcgaccccaatactcatgaaaatctgacgtatgtccagcttctgcggagatgtgtgccagaccctgatacgggtttatacatgctacagttggcaggtcggggcagcgcagtgcaccagctctccgaggaactacgctgcgctctgagagatgcaagggtaacccctggaagcggggccctacagggacagtcagtgtccgtgtgggaactcttgttctatagagaagtgagcgaggacaggaggcaggacctgctctccaggtaccgtgcaggcaccctcacggtggaagagctgggagcaacactgaccagcctgctggcgcaagcccaagcgcaagcacgtgctgaggccgaagctggctcaccgagacctgatccaagagaagccttgagggcagcgaccatggaggtgaaagtgggccggctcagaggacgcgctgtgccagtctgggacgttctcgcctctggctacgtttctcgggccgccagggaagagctgctggcagagtttggctctggaactcttgatctgccagctctcactaggagacttaccgcaataatagaagaagccgaggaggccccaggagcaagacctcagctgcaggatgcatggcgcggccctcgcgaacctggtcctgctggccgcggagatggggacagcggccgatcccagagagagggccagggggaaggagaaacccaggaagccgctgccgctacggctgcggcccgaaggcaggaacagacactgagagacgctactatggaggtacaaagggggcagttccagggaagaccggtgtccgtgtgggatgtactattttcaagttatctgtctgaggccagacgagacgaattgctcgcccagcacgccgcgggcgctttggggcttccggacctggtcgcggtactgactcgcgttattgaggagaccgaggagcggctgtccaaggtgtcttttcggggtttgcgccgccaagtctctgcaagtgagctgcacacttctggtattctaggacctgaaaccctgagagacttggcccaagggacaaaaacgttacaggaagtcaccgaaatggattctgtgaaacggtatcttgaggggaccagctgcattgcgggcgtgctggtccccgctaaagaccagccagggcatcaagaaaagatgtcaatataccaggcaatgtggaaaggtgtgcttcgccctggaactgctctcgtgctgcttgaagcccaggccgcaaccggattcgtaatcgacccagtgaggaatctaagactgtccgtcgaagaagctgttgcggctggggtggtggggggggagattcaggagaaactgctttccgcagaaagagcggtaaccgggtacaccgacccttacaccgggcagcagatatccctgttccaggccatgcagaaggatctgattgtgagggagcatgggatccgactgctcgaggctcagatcgcgaccggtggcgtcatcgaccctgtgcattcccaccgagtgcccgtggacgtagcctaccggcgggggtactttgatgaggagatgaatcgagtgttggcacatccttctgacgatacaaaggggtttttcgaccccaatacccacgagaacctcacctatgtgcagcttcttcgtaggtgtgtgcccgaccccgatactggtctgtatatgttgcagctggcaggtcggggctccgctgttcatcagttgagtgaagagctgagatgtgctctgagggatgctcgggtgatgcctgggtccggggccttacaggggcagagcgtctctgtgtgggagctgcttttctaccgagaagtgtctgaggaccggagacaagatctgttgagccgctatcgtgccggtaccttgacggtggaagaactcggtgcaactttgacaagcttattagctcaggcccaggcacaggcccgcgctgaggcggaggcagaggccggatcccctaggcccgatcccagagaggcactccgggccgccacaatggaggtgaaggtaggcaggctgagagggcgtgctgttcctgtgtgggacgtcctggcttccggatatgtctccggggccgcacgcgaggaactgctggcagagttcggttccggcactctcgatctgccagccctgacgcgccggctgactgccatcatagaagaagctgaggaagcccctggtgcaaggcctcagctgcaggatgcctggcgcgggccccgcgagccaggacccgccggtcgcggtgatggcgacagcggaagatcccagagggaggggcagggtgagggcgagacccaagaagcagccgctgccgcccgccgacaggaacaaaccttaagagacgctaccatggaggtccaaagaggacagttccaaggcaggccagtgtcagtctgggacgtgttattctccagttatttaagtgaggcccatcgggacgaattactggcacagcacgcagctggcgccctaggcctacccgatctagtcgcagttttgactcgggtgatcgaagagaccgaggagagactcagtaaggtaagcttccggggccttcgcaggcaggtcagtgcgtccgagcttcatacttcagggatactagggccagagacccttagggatttggctcaaggcacaaagacattgcaggaagtcaccgagatggattccgttaaacgatatctggagggcacttcatgtatagctggtgtgttagtacccgccaaagaccaacctggaaggcaagaaaagatgtctatttaccaggcaatgtggaagggggtcctccggcctgggaccgcgttggttctgctagaggcacaggccgccacaggcttcgtgattgaccccgtacgcaatctgcggctgtcagtggaggaggcggtggcagcaggcgttgtcggcggcgagatccaggaaaagctcttgtcggccgagcgggctgttaccggctacacggatccatacactgggcagcagatcagtctgttccaggcaatgcagaaggacctgatcgtgcgcgaacacggcatcagactgctcgaagctcagattgccacgggaggcgtgatcgaccccgtgcacagccatcgcgtgccagtagatgttgcctaccgacggggatactttgacgaggaaatgaatcgcgtgctcgcggacccttccgatgacacaaaaggcttttttgatcctaatacacacgagaatttaacttatttgcagctccttcagagagctactctcgaccctgagacgggcctactctttttgtccttgtctttgcagtag

SEQ ID NO: 29473 - DNA, 2715 bp, Artificial Sequence
  Description of Artificial Sequence: Synthetic coding sequence
atggaaagtttccacacgcgtttttccgcctggaccccattctccaataagtcgttaaatagacagctgttccaggagcgcgtcgccctgattagccactggtttgatttgtggactaataagcagaggcaggagtttcttttcgccatctttctgcggtgcaccaagagccagttgcgcttcgtccaggactggttctcagaaagaatgcaagtggcgaaggtggatttttccaccgttctccctcggttcatcagtctctatatctttagtttcctgagtccaaaagacctgtgcgctgctgctcaagtctcttggccatggaagtttctgacagaacaggactgcctgtggatgcctaaatgtgttaaatttgggtggtttctgccatatacccccaccgataatgagtacggcgcttggaaacggcactacatcgcctgcgtctcacaccttgattggctcacacctcgggaggctgccgctacctacggtacactcaatgagcccaaaaccgaagacgaagaattgctagaaaggcaacgggagaagtgcctgagaaaacggatatgggaaaagatagccttgcggaagaaggagctatttaaagtaagacccccctgggtcagtggaacctgttgtagctccgtgttgaagcctcggtgccaaccccgactgtcacagaccgtgcgcgagcgagtaggcttgcacgaggctttggaaaagcagctagtcttgaccagtctcgagaccttgcccaagcgctccaacattagcggcagtcactcgtaccccctactgtctaagaaaaattggcacggtgtgcacaaaaacgacgatcggagttcttacgcgctgcggccccactttatgttaataagttcccggattcccgcctatgagatggtgatggaaagtgtcaaggctggcgtcgtctctgtggtctacgagcactccgtcaccctcgaaagccttctgtacctgattgaaaaggcactggacggacagaaggcgcagagcattggtattttttccgatggggacagcagagaaatcaacctcttacagggctacaaaataggggtaaagaacctgctgaggccggaagtcagggacttttgggagaaactgggcagctacgtcgctacagaagaggagggaggacacgtggatttcttcgtgcccctgggcgcctcggaggccggcatcgaggtgctctctcagctttctcagcttaccggcacattttttaccgcgcccactggcatcgcgaccgggagctaccaacacattttatccgactggttggggtctcagtggggcaaggcaccttcctcgatttatttttgcgagtcaaaacttcagacctggagctctttcaccgatttcttggaggagacactgaagactgtacgcaagcagctgtaccccttctttaaagagctccaaaagagcatatccggtcgcatgatcgggcagtttatgttcgataccatgggcatgacaaacatacttaataatcaggatactgctcaggccctcgctgacggactcatggagctaagtaaggaggacagtgaacgcaacgtcgtggaggataacagctgggacacaaagtctaggctgagcaagaatgacctgaattttgaggcgctgattaatttggagagaattctgcagaaagactccgccgagaaaagggccagggtggtgcgggaacttctgcaaagcgagagaaaatatgtccaaatattggagatcgtcagggatgtttacgttgctccacttaaagcagctttatcgtccaatcgcgccattttgtctgcagccaatattcagataattttttgcgatattctgcagatcctgagcctgaatcgccagtttctggataacctgagggataggttacaagagtgggggcccgcgcactgtgtaggagagatcgtgacaaaatttggcagtcagctgaacacttacaccaacttttttaacaactaccctgtgattcttaagacaattgagaagtgccgggaaatgatccctgcctttaggactttccttaagcggcatgacaagaccatcgttacgaaaatgttgtcactgcctgaattgctcctgtacccctccagaaggttcgaggagtatcttaatttgttgtacgccgtcagactccatacgcctgccgagcacgtggaccggggagacctgactaccgccattgatcagattaagaagtacaaggggtatattgatcagatgaaacagaatatcacgatgaaggatcatctgagcgacatccaacggataatctggggatgcccgacattgtctgaggtcaaccgatacctcatccgtgtccaggatgtcgcccagctgcactgctgcgacgaagaaatctcattcagcttacgcctttacgagcacatccacgatcttagtctgttccttttcaatgacgctctgctggtgtcaagcagagggacatctcacactccattcgaaaggacctccaagacgacataccaatttattgcctccgtcgctctgcatagactcctgattgagaatatcccggacagcaaatatgtgaaaaacgccttcattctccagggaccgaagtataagtggatttgtgccacggaaatcgaagatgacaagtttctttggctcagtgtgcttcgcaacgcaatcaaatcttctatggagaagtag

SEQ ID NO: 29474 - DNA, 234 bp, Artificial Sequence
  Description of Artificial Sequence: Synthetic coding sequence
atggagagcttccatacccggttctctgcctggacaccgttcagcaataaaagcctcaacagacagctgtttcaggaacgcgtggccctgattagccactggtttgacctctggacgaacaaacaacgacaagagttcttgtttgccatctttcttcgctgtacgaaaagccaactgcgctttgtacaagactggtttagtgagcggatgcaggtggctaaggtcgacttttag

SEQ ID NO: 29475 - DNA, 2715 bp, Artificial Sequence
  Description of Artificial Sequence: Synthetic coding sequence
atggagtcctttcatacaagattttcagcgtggacccccttctcaaataaaagtctgaacagacagttgtttcaggaacgagtggccctgatctcacattggtttgatctttggaccaataaacagagacaagagtttttgtttgctatctttctgagatgcactaaatctcagctgaggtttgtgcaagattggtttagtgagaggatgcaggttgctaaggttgactttagcaccgtactaccaagattcatatcgttatacatctttagcttcctctcacctaaggacctttgcgcggctgcacaggtgtcttggccatggaagtttcttaccgagcaggactgtttgtggatgcctaaatgcgtgaaattcggttggtttctaccctacacccctaccgacaacgaatatggagcgtggaaaaggcactacattgcctgtgtgagtcatttggactggctgacccctagggaggccgcagctacttacggaacactgaacgagcccaaaaccgaagacgaagagctccttgaacgccagagagagaaatgtctccgaaagagaatttgggaaaaaatagccctacggaagaaagagttgtttaaggtcagaccaccttgggtcagcggcacatgttgctcttccgttctaaagcccagatgtcagccaagactctcccaaacggttcgcgagcgcgtggggctgcacgaggcactggagaaacagctcgtacttacgtctcttgagacactcccaaagcggtccaacatttcgggctctcatagttatccactcctgagcaagaaaaattggcacggcgtccacaagaacgacgaccggagttcttacgccttgcgcccgcatttcatgctaatctccagtcgtattcctgcatacgagatggtgatggagagcgttaaagccggcgtagtctccgtggtatacgaacattcggtgaccctggaatcactcctgtacctcatcgagaaagcactcgacggacagaaggctcagtcaatcggaatcttcagcgacggtgacagtagagaaattaatctgcttcagggatacaagatcggagtgaaaaacttgttgcgtcccgaggtacgtgacttttgggaaaagctcgggtcctacgtagcaacagaagaagaaggaggacacgtggacttcttcgtgcccctcggcgccagcgaggccggtatcgaggtgctgtcacaactgtctcaactaaccggcaccttctttacagcccctacgggcatcgcaaccggatcttaccaacacatactgtcggactggctggggtcacagtggggaaaggccccaagctcaatttatttttgtgagagcaaattacaaacttggtcgagctttaccgactttctcgaggaaactctgaagacagtgaggaaacagctgtacccctttttcaaggaattgcagaagtccatctccggacgcatgatcggacagtttatgttcgacaccatgggcatgactaacatattaaataaccaggataccgcacaggctctggccgacggccttatggagctgagcaaggaagacagcgagcggaatgtggtggaagacaacagctgggacacgaagtctaggttaagtaagaatgacttgaatttcgaggctcttatcaacttggagcgcattcttcaaaaagattctgctgagaaacgagcccgcgtggtgcgggagctattgcaaagtgagcgcaagtacgtccagattcttgagatcgtacgcgacgtgtatgttgctcctctcaaggctgccctgtcatccaacagagctattctgtcagccgccaacatccagattatcttctgtgacatcctgcagattctctcactaaaccggcagttcttggacaatctgcgtgatagattacaggaatggggccccgcgcactgcgtgggcgaaatcgtgaccaaattcggctcccagcttaacacatacaccaattttttcaacaattatcccgttatccttaaaactatcgagaaatgccgtgagatgattcctgcgtttaggactttcctgaagcggcatgataagactattgtgacaaaaatgctctcgctccccgagctcttgctgtatccgtcccgaagatttgaggaatatcttaacttactgtatgctgtgcgcctccataccccagctgagcatgttgaccgcggcgacctcacaactgctatcgaccagataaaaaagtataagggctacatcgaccaaatgaagcaaaacattactatgaaagaccaccttagtgacattcagcggatcatctggggctgtcccactctaagtgaggtgaaccgatacctgatcagagtgcaagacgttgctcagctgcattgctgtgatgaggaaatcagtttcagccttcggttgtacgagcacatccatgacctatccctcttcctttttaatgacgccctactcgtgtcatcacgggggacctcgcatacacccttcgaacgtacatcgaagacgacctaccagttcatagcgtcggtcgccctgcaccggcttttgatcgagaatatccctgacagtaagtatgtaaagaacgcttttattctgcaaggtcctaaatataaatggatctgtgctaccgaaattgaggatgataaatttctgtggttgtctgtccttagaaacgctattaagtcatctatggagaagtag

SEQ ID NO: 29476 - DNA, 2277 bp, Artificial Sequence
  Description of Artificial Sequence: Synthetic coding sequence
atgcaggtggccaaggtggatttttctaccgtactgccccggtttatttccttgtatatcttttctttcctgagccctaaggacctttgtgctgccgcccaagtgagctggccatggaagttccttaccgaacaggactgtctgtggatgcctaaatgtgttaagttcggatggtttctgccctacactcccaccgacaacgagtacggagcctggaagagacactacatcgcttgtgtctctcatttggattggctgacaccaagggaggccgccgctacatacggtactcttaacgagccaaagactgaggacgaggagctcctggagcgccagagagagaaatgtctgcggaaacgaatctgggaaaagattgcgctcagaaaaaaggagttgtttaaagttagaccgccttgggtgtccggcacgtgctgttcatcggtgcttaagcctcgttgtcaaccacgactgtctcagaccgtgcgtgaaagggtcggcctgcacgaagcgctcgaaaaacagttagtgctgacttcgctcgagacattgccaaagcgttctaacatttccggctctcactcttaccctttactttcaaaaaagaattggcatggggtacacaagaatgacgaccggtcttcttacgccctgaggccgcactttatgctgataagcagccgcatccccgcttacgaaatggtgatggagagcgtaaaggccggggtggtgtctgtggtctatgagcattctgtaacactggagtccctcctgtacttgattgaaaaggcattggacgggcagaaagctcaatcgattggaatattttctgatggcgattcccgcgaaattaacctgctgcaggggtacaaaattggcgtcaagaacttactcaggcctgaggtcagggatttttgggagaagctcgggtcctacgtcgcaactgaagaagagggtggacacgttgatttcttcgttccattgggcgcatctgaggcagggatcgaggttttgtcccagttatctcagttgactgggactttttttactgccccgacagggatagctactgggtcttatcaacacatcctcagtgactggcttggcagtcagtgggggaaagcgccttcttctatctacttctgcgagtccaaactccagacctggtcctcattcacggacttcttggaggagactctgaagaccgtgagaaaacagctgtacccttttttcaaagagttacagaagagtatttctggaagaatgatcgggcagttcatgtttgacaccatgggtatgaccaatatcctaaataatcaggacaccgcacaggcgctcgctgatggacttatggaattgtctaaagaggatagtgagaggaacgttgtggaagacaactcttgggacactaagagccgattgagtaaaaatgacctgaactttgaggccctgatcaatttggagcgcatcctgcagaaggattccgcagaaaaaagggcaagagtggtaagagaactgctgcaatccgagcgcaaatacgtccagatcctagagatagtccgggatgtgtatgtggcacctttgaaagccgcactcagctcaaaccgcgctatcctgtccgccgcgaacatccagatcatcttttgcgacatcttgcagatcttgagcttgaaccgccagtttctggataatctgcgggaccggttgcaggagtgggggcccgctcactgtgttggtgaaattgtcacaaagttcgggtctcaactgaacacatacaccaatttctttaataactaccccgttatcctaaaaaccatcgaaaagatgaaacagaacataactatgaaagaccatctatctgatatccagcgcataatttggggctgtcctacgttgagtgaagtcaatcggtaccttatccgggtgcaggatgtcgctcagctccattgctgcgatgaggagatatccttcagtctgcggttgtacgaacatatacacgatctcagcctttttctgttcaacgatgctctgctggtctcatctcgaggaacgagtcatactccattcgagcgaacatctaaaacaacttatcagtttattgccagtgttgccctgcatcgactcctgatcgaaaatatcccagacagtaaatatgtgaagaacgcattcattctgcagggccctaaatacaaatggatctgtgctacggaaattgaagatgacaaatttctttggctgtcagtgctgaggaacgcgataaagtcctctatggaaaagtag

SEQ ID NO: 29477 - DNA, 987 bp, Artificial Sequence
  Description of Artificial Sequence: Synthetic coding sequence
atggcgactaaaagattggcccggcagctaggtctgatcaggaggaaatccatagcacccgccaacggaaatcttgggaggtcaaagagcaagcagctgtttgattacctaatagtcatagactttgaatcgacgtgttggaatgacggaaaacaccaccattcacaggagatcatcgagttcccggctgtcctcttgaataccagcaccggccaaatcgacagcgagtttcaggcgtacgtacagccacaggagcaccccattctgagtgagttctgtatggagctgactggcattaagcaagcacaggtggacgagggtgttcctctcaaaatttgtttatctcagttctgcaaatggattcataagatacagcaacagaaaaatatcatattcgcaaccgggatcagtgaaccctccgcctcagaggttaagctctgtgcctttgtgacctggtcagactgggatcttggcgtgtgccttgagtacgagtgcaaacggaagcagctgctaaaaccggtgtttctcaattcctggatcgaccttagagccacttacaaactgttttaccggcggaaacctaaaggcctgtccggtgctctgcaggaggtggggatcgagtttagcggccgcgaacactctgggcttgacgactcccgtaatacagccctcctagcgtggaagatgataagggacgggtgcgtcatgaagatcacgagatcgctcaataaagggcccttcttactaccttcttggacctggaactccgatctggctagcggggaccagcatgctttcctgcaacaagaatttggatgtggcacctatcgaaccctcctgcagaagccaaacatgtcaaaacaagaaaaaggtaacattctctggctcaccatggtatggctttctttagcatgtctgcagcgcaaaaactataacgactgcatgttgaataccgcctctcaaacggtgaccactgaaaaattctag

SEQ ID NO: 29478 - DNA, 2076 bp, Artificial Sequence
  Description of Artificial Sequence: Synthetic coding sequence
atggccactaaaagactggccaggcagctgggcttgatcagacgcaaatctatcgctcccgcaaacgggaacctgggccggtctaaatcaaaacagctgttcgactatctgatagtgatcgatttcgaatcaacctgctggaacgacggtaaacaccaccactcgcaggaaattattgaattcccagctgtgctcttaaatactagcaccggccaaatcgatagcgagttccaggcgtacgtacagccacaggaacaccctatcctgtcagaattctgtatggaactaaccggtatcaaacaggcacaagttgatgagggggtccccctgaaaatatgtctcagccagttctgcaaatggatacacaaaatccagcagcagaagaacatcatattcgctacggggatttcagagccctctgcctccgaagttaaactgtgtgccttcgttacatggagtgactgggacctaggcgtctgtttagagtacgagtgcaagagaaagcagctattgaaaccagtctttcttaattcctggatcgaccttcgcgcaacttataaactgttctacaggcggaagcctaagggtctcagcggcgcactgcaagaggtggggattgagtttagcggcagggaacacagtggattggacgattcccggaataccgcactgcttgcctggaaaatgattcgcgacggatgcgttatgaagatcaccagatctctgaataaggtgccaacaaagaagaacttctccatacttgctaggaacctgaataccattcaggttgaagagatgtccgcttgtaatattagcattcagggcccctcaatatataacaaggagcctaagaatatcattaaccctcacgaaaaggttcaaatgaaatctatctgtgctaatagtcccattaaagctcagcaagaccaattgcaagttaagaacaacatcaaggcgagtctgcataatgtgaagagctccctgcccctgttcaacaccaagtctagcacctccgtagggcaattgcagagccccactctcaacagccctatttacatgcaaaaacaggggaaaaatgaacacctcgcattcaacacaaagtctaaggcctctacggtggggagtgaactggtgctcgtatccaccaccgtgccaaccgtccaccacgtttctgacctagagatgagctccactctggactgcctgcccgtactagcggactgggaggacgtcgtgctgctcccagcctcccaaccagaggagaatgtggattgcactgttcccatcagcgactctgacctggaaatatcctttaacagcggtgagcgtcttatggtgcttaaggaactggagatgtccagtcatgagaatttcggcgatatagaggagaccccgcagaaaagcgaaacctcaaagagcatagtgtacaagagtcctcacacgaccatttataacgtgaaggaggccaaagaccccggttcagacattagtgcattcaaactccctgagcacaagagtagtactttcaacagagtcaacgctaacatgagtcatcctctcgtcctgggaaaacacccgttgttgtcaggaggtacgaaacggaatccgtgttcaccacaagcctttcctcccgccaaaaaacagccatttacgatccacgaggagaagcctactagttcggactgctctccagtacggtcatcctcctggcgaaggctccctagcatcctgacaagcacagtgaacttacaagaaccgtggaagagtggcaagatgacaccacccctctgtaagtgtggtaggagaagtaaacgcctagtggtcagcaataacggcccgaaccacggaaaagtcttctattgctgtccgatcggaaagtatcaggagaatcgtaagtgctgcggctacttcaagtgggagcagacgctccagaaagagcgagccaacagcatggttccgtcacacagcactggcggcctgacattttcctcccctgagacatctcacatctgtgacaggaaccttagcatcagtacaaaaaacagcctgagactgcgacctagcatgaggaattag

SEQ ID NO: 29479 - DNA, 1281 bp, Artificial Sequence
  Description of Artificial Sequence: Synthetic coding sequence
atgtcagcgtgcaatataagcattcaggggccaagcatctacaacaaggagccaaagaacatcattaatccccacgaaaaggtacagatgaagtctatttgtgccaactcacctataaaagcccagcaagatcagcttcaggttaagaataacattaaagcctcactccataatgtcaaatcctctctgccactgttcaatacaaagagtagcacttcggtgggacagttacagagccctacccttaatagtcctatctatatgcagaagcaaggtaagaacgagcatttggccttcaataccaaatctaaggcctcgaccgtggggagcgaactcgtgttagtcagtaccaccgtccctaccgtccaccacgttagcgacctcgaaatgagttccaccttggattgcctgccggtcctggccgactgggaggatgtggtgctcctgcctgcatcccagcctgaggagaacgtcgattgtactgtgcccattagcgacagcgaccttgagatcagttttaacagtggagaacgacttatggtgctgaaggagcttgagatgagcagccacgagaattttggtgacatagaggagacaccacagaagtctgagacaagtaagagtatcgtgtataaatctccacatactactatctacaacgtgaaggaggccaaggaccccggatccgatatctccgccttcaaacttcctgagcacaaaagttctacattcaatcgcgtgaacgctaatatgtcacaccctctggtgctgggaaagcacccgttgttgtccggcgggaccaagcggaacccatgctccccccaggcatttcctcctgctaaaaaacagccgttcacaattcatgaggaaaagccaacctccagcgactgctctcctgtaagatcctcctcttggcggaggctcccttccatactcacgagcacagtgaaccttcaagaaccctggaagtcaggtaaaatgaccccccctctgtgtaaatgcggtcgacggtctaaacgcctggttgtctctaataacggcccaaatcacggaaaagtcttttactgctgtccaatagggaaatatcaagaaaatagaaagtgttgcggttactttaagtgggagcaaactctgcagaaagaacgggccaatagcatggtaccctctcatagtactggcggcctcacattcagtagccctgaaacgtcacacatttgtgatagaaacctcagcatttccactaaaaattccttgagactccgtccgtctatgaggaattag

SEQ ID NO: 29480 - DNA, 696 bp, Artificial Sequence
  Description of Artificial Sequence: Synthetic coding sequence
atggtctccttcccacctcagagataccattatttcctggtactggactttgaggccacctgcgacaagccccagatccaccctcaggaaattattgaattccctatcctgaagttgaacggcagaaccatggaaattgagtccacgtttcacatgtacgtgcagcccgtagttcatccacagttaacacctttttgtactgaactgactggtatcatacaggccatggtagatggacagccctctctgcagcaggtcctggaaagggtggacgaatggatggccaaagagggactgctggatcccaatgtgaaatcaatcttcgttacttgcggagattgggacctgaaggtgatgctccctggccagtgccagtatctggggctcccagtcgcagactatttcaagcagtggattaatttgaagaaaggctcttctcccggaaccgcgtccggaacaagttgctatcagtcagaggaggcccagagaaaagaaaatacacctggagtgaaggcttactcttttgccatgggttgctggcctaagaacgggctcctcgacatgaacaaagggctctctttacagcatatcgggaggcctcactcaggcatagatgactgcaagaacatcgccaacatcatgaaaacacttgcataccgtgggtttatcttcaagcagacctctaagcccttttag

SEQ ID NO: 29481 - DNA, 1014 bp, Artificial Sequence
  Description of Artificial Sequence: Synthetic coding sequence
atggcaaccgccagcccagctgccgatggtgggcggggccgcccttgggagggcggtctggtgtcgtggccaccagcccctcctctgactctaccctggacttggatgggaccatcctgggggcagcatccaggccattgggggtttccggcgttgactgagccatctgcctcccctgccgccgggctgggaatcttcgaggtccggcgcgtgctggatgccagcgggtgcagcatgctcgcccctttacaaaccggggctgctaggttctcaagctacttgttgagcagagcccgtaaggtgctcgggtcccatctgttttctccgtgcggagtgcctgaattttgctccatctctactagaaagttagccgcccacggttttggcgccagcatggccgccatggttagctttcccccacagaggtaccattatttcctggtgttggacttcgaggccacttgtgataaaccacagatccatccccaagagataatcgaatttcctatactgaaactgaacggacggacaatggagatcgagtccacctttcacatgtatgtccagcctgtggtgcatccacagctcacacctttctgtaccgagctgactggaatcatccaggcaatggttgatggccagccctcactccaacaggtactggaacgagtcgatgaatggatggccaaagagggtctcctggaccccaatgtgaagagcatcttcgtgacttgcggtgactgggatctgaaggttatgctgcctggacagtgtcagtacttgggcttacctgttgccgactatttcaagcagtggatcaatctgaagaaggcctactctttcgctatgggttgctggcccaaaaacggtctgctcgatatgaataaaggcctgtccttgcagcacattgggagaccccacagcggcatcgacgattgtaagaatattgccaatataatgaaaactctcgcctaccgtggattcatctttaaacagaccagtaagcccttttag

SEQ ID NO: 29482 - DNA, 669 bp, Artificial Sequence
  Description of Artificial Sequence: Synthetic coding sequence
atgtttgttatgttgcaggtgccttggcttcagagctgcgccaatctcgtccaaatcggcgcccccctccccctgctcggctgcctcggccagtactttgaggttttagggtcaatggaggtgctggccggacagtacggtatggaaattattgaatttcctattctcaagctgaatggtagaacaatggagattgagtctacattccacatgtacgtacagcccgttgtacaccctcagctcaccccgttttgcactgagctgacaggcattatacaggccatggtagacggtcaacccagcctccaacaagtgttagaaagagtcgatgagtggatggcaaaagagggactgcttgaccctaacgtcaagtccatttttgttacgtgtggggactgggaccttaaagtgatgttgccaggacagtgccaatatctgggccttcccgtggcggactacttcaaacagtggattaaccttaaaaaggcttattccttcgctatgggttgctggcctaaaaacggcctgttagacatgaataaagggctcagcctccagcatatcggacggccccactccggcatagatgactgcaagaacattgccaacataatgaagaccctagcttaccgaggcttcattttcaaacagacttccaaacccttctag

SEQ ID NO: 29483 - DNA, 660 bp, Artificial Sequence
  Description of Artificial Sequence: Synthetic coding sequence
atggccaccgccagcccggccgccgacggagggagggggcgaccgtgggaaggcggccttgtgtcctggccacccgcccccccgctcacactgccttggacttggatgggccccagctggggccagcacccgggggaaatcatagagttccccatcctgaagttaaacggcaggaccatggagattgagagcaccttccacatgtacgtgcaacccgttgtgcatccccaactgacccctttttgtaccgagctcacaggaatcattcaggcaatggttgatgggcagcctagccttcagcaggtgctggagagggtcgatgagtggatggcaaaagagggcctcctcgatccaaatgtgaagagtatttttgtgacgtgcggggactgggatctgaaggtcatgctccccggccagtgccagtatttgggactacccgtggccgactacttcaaacagtggataaaccttaagaaagcgtacagttttgccatggggtgttggcccaagaatggcctattagatatgaacaaaggattgtcactacagcacattggacggcctcactctggtatcgatgactgcaaaaatattgccaatatcatgaaaactctggcctaccgagggttcatcttcaagcagacaagcaagccattttag

SEQ ID NO: 29484 - DNA, 531 bp, Artificial Sequence
  Description of Artificial Sequence: Synthetic coding sequence
atggcgactgcctcccccgccgctgatgggggccggggaaggccctgggagggtgggctggtttcctggcccccagcaccccctcttactctaccttggacgtggatgggtcctagctgggggcagcaccccggtgagatcattgagtttccaatcctcaaactaaacgggcggacaatggaaatagagtctacattccatatgtacgtgcagccagtggtgcacccacagttgactcctttctgcaccgagctgaccggcatcatccaagccatggtcgatggtcagcccagcttgcaacaagtgctggagagagtcgacgagtggatggccaaagaaggattgctcgatcctaatgtgaaatccattttcgtgacatgcggggactgggatctgaaagtgatgcttcccggacaatgccaatacttggggttgcctgtggctgattacttcaagcagtggatcaatcttaagaaggcctacagtttcgccatgggttgctggcctaagaatggcctgctggacatgtag

SEQ ID NO: 29485 - DNA, 615 bp, Artificial Sequence
  Description of Artificial Sequence: Synthetic coding sequence
ctgcaggagattatagagtttcccatcctgaagctgaacggccgcacgatggagatcgaaagtacctttcatatgtatgtccaaccagtggtccatccccagctgactcccttctgcactgaactgacgggaatcatccaggcaatggtggacgggcagcccagcttgcagcaggttttggagagggtggacgaatggatggcgaaggagggtctactggaccccaatgtcaaaagtatttttgttacttgcggagactgggatctgaaagtgatgctcccaggccaatgtcagtaccttgggttgcccgtagccgactacttcaaacagtggatcaatctcaagaaaggtagcagccccggtacagcctcaggcactagttgttaccagagtgaagaagctcaaagaaaggagaatacccccggtgtgaaagcttactccttcgccatggggtgttggcctaaaaacgggcttctcgacatgaataaaggtctctctctccagcacatcggtcggccccactctggcatagatgactgtaagaatattgccaatatcatgaagactctcgcctatcggggctttatattcaagcaaacttccaaacccttttag

SEQ ID NO: 29486 - DNA, 753 bp, Artificial Sequence
  Description of Artificial Sequence: Synthetic coding sequence
atggcaacagcctctccagctgctgacggggggaggggaagaccttgggaaggagggctcgtaagctggccccctgcccctcccttgacattaccgtggacttggatgggcccatcctggggtcagcatccgggacattggggcttcccagctcttactgaaccctcagccagtcccgcagcagggctagggatcttcgaggtcagacgagatgcgtctggctgcagtatgctggctcctctgcagaccggggccgcacgcttctcctcgtatctgctgtcgcgcgcccggaaagtgttgggctctcatttattttcaccatgtggcgttccagaattttgctctatatcgacccgcaaactagccgcccacggattcggtgcttcgatggccgctatggtcagctttcctcctcaacggtatcactacttccttgtgctggatttcgaggctacatgcgacaaacctcagatccaccctcaagagatcattgaatttcccattttgaagctgaacgggaggaccatggagatcgagtctacattccacatgtatgttcagcctgtggtgcacccgcagctgactccattctgcactgagctcactggtatcattcaggcgatggttgacggtcagccatccctgcagcaggtactggagcgcgtggatgagtggatggcaaaggaaggtctgctagaccccaacgtcaagtcaatcttcgtcacgtgcggagactgggacctcaaagtatag

SEQ ID NO: 29487 - DNA, 483 bp, Artificial Sequence
  Description of Artificial Sequence: Synthetic coding sequence
atggagatagagtcaactttccacatgtatgtgcagcctgttgttcacccccagttgacaccattttgtaccgagctcaccggaatcattcaggccatggtggacgggcagccatcccttcaacaggtgctggaacgcgtggacgagtggatggccaaggagggactcttagatccgaacgtcaagagtatattcgttacgtgcggggactgggacctcaaagtgatgttgcctggacagtgccaatatttaggtctgccggtagcagactatttcaaacagtggatcaatctcaagaaggcttattcctttgcaatggggtgttggcccaagaacggcctgctggatatgaacaagggtctctccctccagcacatcggtcggccccattcagggatcgatgactgcaaaaatatcgcaaacatcatgaagacactggcatacagaggctttatcttcaagcagacatcgaagcctttctag

SEQ ID NO: 29488 - DNA, 3018 bp, Artificial Sequence
  Description of Artificial Sequence: Synthetic coding sequence
atggaaaaacaacgcgccctggttgccgctaaggatggagatgttgccacattagaaaggctcctcgaggccggcgcactaggaccgggcatcactgacgccctaggggctggtttggtgcatcatgccactcgagccggacatctggattgtgtgaagttcctggtacagagagcacagcttccaggaaaccagagagcccacaacggcgcaacaccagcccacgatgcagccgcgacaggaagcctggccgagttatgctggttggtgcgggagggtggatgtggcttgcaggatcaagatgcctctggagtgtcacccctgcatttggccgctcgttttggccaccccgtgttagttgaatggttgttacacgagggtcacagcgccactctcgagacccgcgaaggagctaggccgctccatcacgcagctgtgtcaggagatctgacctgcctgaagttactgacggccgcacacgggtcctccgtcaatagacggacccgaagcggtgcttcacctttatatttagcgtgccaagagggtcatctccatctggcacagttcctggtgaaagactgcggagccgacgtccacctgcgagccttggatggcatgtccgctctgcacgcagcggcagcaaggggccactatagcctggtggtgtggctggtgacttttacagacatcggcctgaccgctcgggacaacgaaggcgccaccgcattgcactttgctgcccggggcggacatacaccaatcctggacagactactactgatgggcacgccaatcttgagggacagttggggcggcacacccctgcacgatgcagccgaaaatggacagatggaatgttgccagacactcgtcagtcaccacgtagacccctccctgcgcgacgaggacgggtataccgccgcggacctggccgaataccatggtcatcgtgattgcgcgcagtatcttagagaagtggcacagcctgtacccttgcttatgaccccccctcctcccccatttccgccaccgcctcttttagccaccaggcgttcactggaagacgggcgacgtggaggccccggaccgggaaacccttcaccaatgtcgttgagccccgcttggcccgggcatccagatcagcctctgcccagggagcagatgactagccccgctccaccccggattattacctcggctaccgccgatcctgaagggacggaaactgccctggccggagacaccagcgacgggcttgcagcactccagctggacgggctgccctctggagatatagatggactggtgcctactcgggacgagagggggcagcccatcccagaatggaagcgccaggtaatggtgagaaaattgcaagcgaggcttggcgccgagtcctcagccgaagcccaggacaacggcggatcgagcggacccaccgaacaggctgcttggcggtactcccagacgcaccaggccattctaggcccctttggggagttgctcaccgaagacgatctggtgtacttggaaaaacagatcgccgacctccagctgagaagaaggtgtcaggagtacgagagcgaactgggtaggttagccgcagagctgcaggctctgcttccagagccgttggttagcatcaccgtgaattcacactttctgccgagagcccccggattggaggtggaagaagcttcaatccctgccgctgaaccagctggctctgcagaggcatccgaggtggcccccggggtacagccattgccattctggtgctcacacataagccgtctggtccgctctctgtcactgcttttaaagggcgtgcatggcctggtgcagggggacgaaaagccctccacccgccccctgcaggacacatgccgggaggcaagcgccagccccccaaggtccgaggcgcagcgtcagattcaggaatggggtgtgagcgtccggacacttaggggaaattttgagagtgcatccgggccactgtgcggctttaatccgggcccttgtgaacccggggctcagcaccgacaatgtcttagtggctgctggcctgctctgccgaagccacggtctggcctggctagtggcgaacccaggcccggcgatacagaagaagccagcgacagcggaatctcttgcgaggaggtcccatcagaggccggggccgccgctgggcccgatctggctagcttgagaaaggaaaggattatcatgttatttctgtcccactggaggagatccgcctatacaccggcacttaaaacagtggcttgccgaaccctcggcgctcgccacgcaggtctgagagggcaggaagctgccagaagtccaggtccccctagtcctccctccgagggccccaggctaggccacctatggcaacagcggtctactatcacacacctgctgggtaattggaaggcaattatggcacacgtgccagctaggcagttacgccgtttatctaggcaaccgcgaggggccctttcaccagagcagtttctgcctcacgtcgatggcgccccagtgccgtactcttcactttctcttgacctctttatgctagggtactttcagcttcttgaatgcgatctccccgcagaggaacgtaaattgcggcatctgttatgtttcgaagtgttcgagcacctgggcacacacgggtgggaagccgtccgcgcctttcacaaagccgtgaccgacgaagtcgcagccgggcggcgggcctggactgacgggttcgaagacataaaggctcgatttttcggctcgtcccaaaggccggcatgggacactgagccgggcagaaaatcaggcttaacactgttggggccactgcctcacgctgctgtcccatgtagcggacccgagcccaccgcccaacggttgggcagcaggagccaacaaggctcctttaatggagaggatatttgtggatatattaacagatccttcgccttctggaaggagaaagaagccgaaatgtttaatttcggcgaatag

SEQ ID NO: 29489 - DNA, 2886 bp, Artificial Sequence
  Description of Artificial Sequence: Synthetic coding sequence
atggaaaagcaacgtgcccttgtggccgccaaggatggtgacgtggccaccctggagaggctgctggaggctggagcccttggccccggcataacagatgctctcggggccgggctggtgcatcacgctacccgggctggacacctggactgcgtgaaattcctggtgcagagagcgcagctacctggtaaccaaagagcccataacggtgcaacaccagcacacgacgcagccgctactggcagcttggccgagctgtgctggctcgtccgggagggcggctgtggtctgcaagaccaggacgcctccggcgtgtcccctctgcatcttgctgcgcgtttcggacacccggtgctcgttgagtggttactgcacgaggggcactccgccaccttggagactagggagggtgccagacctctgcatcatgccgctgtcagcggtgatcttacgtgcttgaagctgttgaccgccgcgcatggcagttccgtcaacaggaggacgcgctctggcgcttcacccttgtatcttgcctgtcaagagggacacctccatctcgcccagtttttggtgaaggactgcggtgccgatgtgcacctcagggcactcgacggcatgagcgcccttcacgccgctgctgcaaggggccactactcgttggtcgtgtggcttgtgacatttaccgatatcggactgactgcccgtgataatgaaggagccaccgctcttcattttgccgcccgcggcggtcacacgcctattcttgaccgcctgttgttaatgggcaccccaatactccgtgacagctggggagggacaccattgcacgatgccgccgagaacggccaaatggaggtgcctctgcttatgacccctccacctcctccgttccctcctccccccctactggccaccaggcgctctttggaagatggcaggcgaggggggccaggccctggcaatccatcacccatgtctttgtcacccgcctggccaggccaccccgaccaacccctgccgcgcgagcagatgacatcaccggcccccccacggataattacatccgctacggccgatcccgaaggcactgagactgccctggccggtgatacatccgatggcttggccgctctgcagcttgatggactcccaagtggggacatcgacggcttagtccccacccgagatgagcgtggtcaaccaatcccagaatggaaacgtcaagtaatggtgcggaagctgcaggccaggctaggcgcggagtcctctgcggaggctcaggataacggaggaagctcaggtcccaccgagcaagctgcatggaggtatagtcagacccatcaggccatcctcggaccattcggggaactgcttactgaggacgatttagtatatctcgagaagcagattgctgacctacagctccgaaggcgctgccaagagtatgagagcgaattgggaagactcgccgccgagctgcaagcccttctgcctgagccactcgtgtccataaccgttaacagccatttcttgccccgggcaccgggattggaagtagaggaggcctccattccagccgccgaacccgcaggaagcgccgaggcctctgaagtggctcccggtgtccagccgctccccttttggtgctctcatattagccggcttgttcgatctctctctctactcctaaaaggagtacatggtctcgtacagggagatgagaagccaagcactcgtccactccaagacacatgtcgagaagctagcgcaagtcccccacgtagtgaagcccagaggcagattcaggaatggggtgtcagtgtgcgaactcttaggggtaatttcgaaagcgccagcggccctctctgtggattcaatcccggcccctgtgaaccgggggctcagcatcgacaatgtctgtccggctgctggccagccctgcccaagccccgaagcgggctcgcttctggcgaacctagacccggagacaccgaagaggcaagcgatagtgggatttcctgtgaagaggtcccatcagaagccggtgcagccgccggaccagatctggctagtcttcgaaaggagaggattattatgctcttcctatcccactggagacgcagcgcttatactcccgcactgaaaaccgtcgcgtgcagaacactcggggcccgccatgctgggttgagaggacaggaagccgccaggtctcccgggcctccaagccctccatcagagggaccacggcttggtcacttgtggcagcagcgctcaactatcacacatctccttggaaattggaaggcaatcatggcccacgtcccggccaggcagctcagaaggctgtctaggcaacctcgtggcgccctttcaccagaacagtttctgcctcacgtggacggagctcccgtgccttattcctcgttgagtctggatttattcatgctgggctattttcaattgctcgagtgcgatctgccagccgaggagcgcaagctgcgccacctgctttgctttgaggtgttcgaacatctcggcacccatggttgggaggcagttcgggcatttcataaagcggtcactgatgaagtcgcagccggtcgcagggcctggacagatgggtttgaggacatcaaggctcgcttctttggatcaagccagaggcctgcatgggataccgaacctgggcggaagtccggactcacgctccttggcccgctcccccacgccgcggtgccatgttctggcccagagcccacagcacagaggcttggctcacgtagtcagcaaggcagtttcaatggagaagatatctgcggatatattaaccgtagtttcgccttctggaaagagaaggaagcggaaatgttcaacttcggggagtag

SEQ ID NO: 29490 - DNA, 1914 bp, Artificial Sequence
  Description of Artificial Sequence: Synthetic coding sequence
atgtcactgtcaccagcatggccagggcacccggaccagccccttcctagagaacagatgacatctccagcaccacccagaatcattaccagtgctaccgctgacccggaggggaccgagactgccttagctggcgataccagtgacgggctggcagcactgcaactggatgggctcccctccggtgatatcgacggcctggtgccgaccagggatgagcggggtcagccaataccagaatggaaacgacaggtaatggtgcgcaaacttcaggcccggctgggtgctgagtcctccgccgaagcccaagacaatggcggctctagcggtcctacggaacaagccgcctggcgctattcccagactcatcaggcaatcctgggtcccttcggggagctgcttaccgaggatgacctggtgtacctagagaaacagatcgcagacttacagctgcgacgacgttgccaagaatacgagtctgagttaggtcgtctcgcggcagagttacaagctttgctgcccgaacctctggtatcaatcaccgtcaactctcactttctgcccagggctccgggccttgaggtggaggaggcaagtatccccgccgcggaaccagcaggaagcgccgaagcgtcagaggttgctccaggcgttcagccacttcccttctggtgtagccacatcagtagactggttagatctcttagcttattattgaaaggcgttcacggattggtccagggggacgagaagccatccactagaccactgcaggatacatgcagagaagctagcgcgtctccgccccgctctgaggcccagcgacagatccaggagtggggagtttccgtccgtactctgaggggtaattttgagtcagcaagcgggccactttgtggtttcaatcctgggccttgcgagccaggagcacaacacagacagtgtctgtcagggtgttggcctgcccttccaaagccaaggagcggccttgcttcgggtgaaccacgaccaggggacactgaggaagcgtcggactctggaatctcctgtgaggaggttccatctgaggcgggagccgccgccggcccagacctggcaagcttacgtaaagagcgcatcattatgcttttcctgtcacactggcgccgctcagcgtacacacccgccctgaaaaccgttgcctgccgcaccctgggcgcaaggcacgccggccttagaggccaggaggctgcaagaagtcccggaccaccatctccaccaagtgagggtccaaggctgggccacctgtggcagcaaaggagtacaattacccacctgctcgggaactggaaagcaatcatggcacatgtcccagcccgtcagctccgtcggctcagtcgccagcccagaggggctctgagcccagagcagttcttaccccatgtggacggcgcacctgtgccatatagctccctctcccttgatctctttatgctcggttacttccagctcttagaatgcgatctgcccgcagaagagcgcaagctgaggcacctgctctgctttgaggtgttcgagcacttaggcacccacggttgggaagcagtaagggcatttcataaggccgtgaccgacgaggtggcggccggcagaagggcatggactgatgggtttgaagatatcaaagccagattttttggtagttctcaacggcctgcctgggatacggagccaggtcggaagagcgggctgaccctgttagggccccttcctcatgcggccgtaccttgctctgggccagagccaaccgcccaaagactcggtagtaggtcccagcaagggagcttcaacggggaagatatttgtgggtatataaatcggagctttgctttctggaaggagaaagaggccgaaatgttcaactttggcgagtag

SEQ ID NO: 29491 - DNA, 249 bp, Artificial Sequence
  Description of Artificial Sequence: Synthetic coding sequence
atgtcactgtcccccgcttggccagggcacccggaccaaccattgcctcgggaacagatgacaagcccagcccccccacggataattacaagtgccacggccgaccctgagggcactgaaaccgctttagctggggatacaagtgacggccttgctgcattacaactggatggcctgccatctggtgatattgatggtcttgtgccaactagagacgagaggggccagccaattcctgagtggaagtag

SEQ ID NO: 29492 - DNA, 1194 bp, Artificial Sequence
  Description of Artificial Sequence: Synthetic coding sequence
  Description of Combined DNA/RNA Molecule: Synthetic coding sequence
atggctggatacgagtacgtaagccctgagcagctagccggcttcgacaaatataagtacagcgcagttgacaccaacccactatcactctacgttatgcaccctttttggaacaccatcgtaaaggtgtttcccacctggctcgcacccaaccttattaccttcagcggcttcctgttagtggtgtttaactttctgcttatggcttattttgatccggatttttatgcaagcgcccccggacacaagcacgtgcctgactgggtgtggatcgtcgtcggcatattaaatttcgtggcttacactctggacggcgtcgacggcaaacaggcgcgaaggaccaattcctccactcctctcggcgagctctttgatcacggtctcgacagttggtcctgcgtgtactttgtcgtgaccgtgtattcaattttcggtagagggagcacaggcgtgtctgtgttcgtcctctatttactgttgtgggtcgtgctcttcagctttatcctgtcccactgggaaaagtataataccggaatccttttcctgccgtggggttatgatatatcccaggtgactatctccttcgtgtatatcgtgacggccgtagttggcgttgaagcttggtacgagcccttcctgttcaactttctttacagggacctctttactgccatgatcattggatgcgccctgtgcgtgacactgcctatgagcctgctcaacttttttcgctcctataagaacaacactttgaaactaaactctgtctacgaagccatggtgccgctgttctctccgtgtttgttatttatcttaagcactgcctggatcctgtggtccccatccgacattttggaactgcacccccgcgtcttctacttcatggtaggaaccgcctttgccaatagtacctgccagctcatcgtgtgtcagatgagtagcacacggtgtccgaccctgaactggctgctcgtcccactgttcttagtggtgctggtggtcaacctgggtgtggcctcttatgtggaatccatcctcctttataccctgaccaccgccttcacactggcccatatccactatggcgtcagagttgtgaagcagttaagttcccacttccagatctaccctttctccctgcgaaagcctaacagtgatugattgggcatggaggaaaaaaatatcgggctgtag

SEQ ID NO: 29493 - DNA, 357 bp, Artificial Sequence
  Description of Artificial Sequence: Synthetic coding sequence
atgcatccattctggaacaccattgtcaaagtcttccccacatggctggcccccaaccttatcacatttagcggtttccttttggtcgtcttcaactttctgttgatggcctactttgacccggatttctatgcctctgcaccgggtcataaacatgttcccgactgggtgtggatagttgtgggcatcctgaacttcgttgcctatactctcgatggagtggacggcaagcaggcccgaaggacaaattcctcaacaccattaggcgagctgtttgatcatggtctggactcgtggagctgcgtttattttgtggtgacagtatattctatttttggaagaggaagtacaggctag

SEQ ID NO: 29494 - DNA, 1200 bp, Artificial Sequence
  Description of Artificial Sequence: Synthetic coding sequence
atgggacggaagtccctttacctgttaatcgtcggcattctgattgcctactatatctatacccccctgcctgataatgtggaggaaccctggcgaatgatgtggattaatgcccacctgaaaaccatccagaatttagccactttcgtcgaactgctgggtcttcatcattttatggatagctttaaggttgtgggatcttttgatgaagtgcccccaacctccgatgagaacgtgaccgttactgagacaaagttcaataacatcctagtgcgagtttacgtccccaagcggaagtctgaggcacttcggcgagggctgttctatatccacggcggggggtggtgtgtgggctcggctgccttaagtggttacgatcttttgtccaggtggacagcggatcggctagatgccgttgtggtgtcaacaaattatcgcctcgcccccaaataccacttcccaatccaatttgaggacgtgtacaatgctctcaggtggtttctcagaaagaaggttctagctaagtacggcgtaaacccagagaggatcggtatctcaggtgactcagccggcggcaaccttgcggccgccgttacccaacaactgctggacgatccagatgtgaagattaagctgaaaatccagagcctaatctacccagccctgcagccactggacgtggacttgccctcttaccaggagaatagtaacttcctgttcctgtcgaagtctctcatggtgaggttttggtccgagtacttcactacagatcgtagcctcgaaaaggctatgctgagtagacaacatgtgcctgttgaatccagccacctgttcaaatttgtcaactggagcagtctcttacctgagcggttcatcaagggccacgtttataacaacccaaactacggatcttccgaattggcgaaaaaataccccggcttcttggacgtgcgggctgctcccttgctggcggacgacaacaaattgagaggactgcctctcacatacgttatcacatgccagtatgacttgcttcgggatgatggcctaatgtacgtgacccggctaaggaacaccggcgtccaggtgacacataaccatgttgaggatggttttcatggcgccttcagttttctaggtctgaagatttctcaccgcctgatcaaccagtacattgaatggctgaaagaaaacctctag

SEQ ID NO: 29495 - DNA, 2745 bp, Artificial Sequence
  Description of Artificial Sequence: Synthetic coding sequence
atgagtaggttttttaccacaggttcagattcagagtccgagtcctccctatctggggaagagctggtgacaaaaccagtcggaggcaactatggaaaacagcctctgctgttgtccgaggacgaggaggacacgaagcgcgtagttaggtcggccaaagataagcgattcgaagaactgacaaacctgattcgaacaatccgaaatgctatgaaaattagggacgttaccaagtgcttggaagagtttgagcttctcggaaaggcttacggcaaggctaaatctattgtggacaaggaaggagtgcctcgattttacatccgtatcctcgcggatctggaagactatttgaatgagttatgggaggacaaggaggggaaaaagaaaatgaataaaaataatgccaaagccctatcaactctacggcaaaagatccgtaaatataatcgggatttcgaatcgcatattactagctacaaacagaaccctgagcagtccgccgacgaagacgccgagaaaaatgaagaagacagtgaaggcagtagcgatgaggacgaggacgaagacggggttagcgcagccacatttctgaagaagaagtctgaagcacctagcggagaatctcgcaaattcctgaagaaaatggacgacgaagacgaagactcagaggattctgaggacgacgaggactgggacacaggaagtaccagctccgatagtgattcggaggaagaggaagggaaacaaactgccttggccagcagatttcttaagaaagcccccactactgatgaagataagaaggcagcagaaaaaaagcgagaagacaaagctaaaaaaaagcacgatcggaaatctaagcggctggacgaagaagaagaggaggacaacgaggggggcgagtgggagcgggtgcgggggggcgtgccgctggtgaaggagaagcctaaaatgtttgcaaaaggaacagagataacgcatgccgttgtcattaaaaagcttaatgaaattctgcaggcgcgaggcaagaaagggaccgatcgcgccgcccaaattgaactgctgcagctcctggtccaaatcgctgccgagaacaatctgggcgagggcgtgatcgtgaagatcaaatttaatatcatagcgtctttatacgactacaatccaaatctcgcaacctacatgaagcccgagatgtggggcaagtgcctggattgtatcaatgagttgatggatatcctgtttgcaaaccccaatatcttcgtgggagagaatatactggaagagagtgaaaacctccacaacgccgaccagcccctccgggtgcggggctgcattctaactcttgttgagcggatggacgaggagtttactaagattatgcagaacaccgatccgcattctcaggaatatgtggagcacctgaaagacgaagcacaggtctgcgctatcattgagcgagtacagaggtatcttgaggaaaagggaacaacagaggaggtttgccggatctatctgctgcgcatcttgcacacatattacaaatttgactacaaagctcatcagagacagctcactccacctgaaggcagttcgaaaagcgaacaggatcaagccgagaatgaaggcgaagacagtgccgttttgatggagagactctgcaagtatatttacgcgaaggaccggacagacaggattaggacctgtgcgatcctttgtcatatctaccaccacgccttacatagtagatggtaccaagcccgcgatctgatgctgatgagccatctgcaagacaacattcaacatgccgaccctcccgtacagatcttgtacaacagaacaatggtccagttagggatttgcgccttccgccaagggctgactaaagatgcccataacgctctgctggacattcagagcagcggccgtgccaaagagctcctggggcagggacttttgctcaggtccttgcaggaaaggaaccaagaacaagagaaggtggaaaggcgccgccaggtgccttttcatctgcacattaacttagagctcttggaatgcgtatacttggtgtccgcaatgctgctagaaataccatatatggccgctcacgaaagcgatgcacgcagaagaatgatcagcaaacagtttcatcaccagctaagggtgggcgaacgacaaccactcttgggtcctcccgagtccatgagagaacatgtcgtggccgcgtcaaaagcaatgaagatgggggattggaagacttgtcacagctttattatcaatgaaaaaatgaacgggaaggtttgggacctgtttcctgaggccgataaggtgcgaactatgcttgtcagaaagatccaggaggaaagccttcggacttatctgttcacgtatagctccgtgtacgattccatctctatggaaaccctgtcagacatgttcgaattagatttacccaccgtgcactctatcatttccaagatgataattaacgaggagttaatggcctcactcgatcagcccactcagacagtggtgatgcatcgaaccgaacctacggctcagcaaaatctcgctctgcagctggccgagaaacttggatcgctcgtcgagaataacgagcgagtttttgaccacaaacagggcacttacggtggctactttcgagaccagaaagatggctatagaaagaacgagggatatatgcgtcgagggggctatcgtcagcaacagagccagacggcttattag

SEQ ID NO: 29496 - DNA, 2745 bp, Artificial Sequence
  Description of Artificial Sequence: Synthetic coding sequence
atgtcgcgtttctttaccacgggaagtgattccgagagtgagtcaagcctcagtggcgaggaacttgtgactaagcctgtgggcgggaactatgggaagcagcccctattattgtcggaagatgaggaagacaccaagcgcgtcgtgcggagtgccaaggataaaaggtttgaagagttgaccaatctgatccgtaccatcaggaacgccatgaagatacgggatgtgacaaagtgcctcgaggaattcgaacttctgggtaaagcttatggtaaagctaagtcaattgtcgataaggaaggcgtcccaagattctacattcgcatcctagcggacctggaagactatcttaacgaattatgggaagataaagaaggaaagaaaaagatgaataaaaataacgctaaggcccttagcacactgcgacagaagattcgaaaatataaccgggattttgaatcccacatcacaagctacaaacagaatcccgagcagtcagccgacgaagatgctgagaagaatgaggaagactccgaaggcagttctgacgaggacgaggatgaggacggtgtttctgcagcgacattcctgaaaaagaaatcagaggctccctcaggcgagtcaaggaagtttctcaagaagatggacgacgaggatgaggatagcgaggatagtgaagatgatgaggactgggacaccggtagtacatcctccgactcagacagcgaagaggaagagggaaagcagaccgcactggcctcacgttttctcaaaaaagctccaactacagacgaggataagaaagccgcggaaaagaagcgagaagataaggcaaaaaagaagcatgaccggaagagtaagcggctggacgaagaagaagaggaggacaacgaaggcggcgagtgggagcgtgttcgcggtggagtgcccctcgttaaagagaaaccaaagatgttcgcaaagggcactgaaataactcacgccgttgttatcaaaaagctgaacgaaattctgcaagctaggggcaagaagggaactgacagggctgcacagattgaactgctccagctcctggtgcagatcgctgccgagaacaacctgggagaaggggtgattgtgaagattaaatttaacatcatagcctctctatatgactataatcccaatctcgccacatatatgaaaccagaaatgtgggggaagtgtttagactgtatcaatgaattaatggacatcctcttcgcgaacccaaacatctttgtaggcgagaacatcctggaggagtctgaaaatcttcacaatgccgaccaacccctgcgtgtgagggggtgcatcctgacactggtcgaaagaatggatgaggagtttactaagatcatgcaaaatacagacccccacagtcaagagtacgtggaacatctaaaagacgaggcccaggtgtgcgcgattatagaaagggtgcagcggtacctggaggaaaagggaacaaccgaggaagtatgtagaatttatctgcttcgtatcctgcacacctattataaatttgattacaaggctcatcagcgacaacttactccccccgaggggtcaagcaaaagcgagcaggaccaggccgaaaatgaaggggaggatagcgccgttctgatggagaggctctgcaaatacatatacgccaaggacagaacagaccggattcggacatgtgccatactgtgccatatttaccatcacgctttacactcacggtggtaccaggcacgagaccttatgctcatgtcacacctgcaggataatatccagcatgctgaccctccagtccagatcctctataatagaacaatggtccagttagggatatgcgccttccggcagggattgactaaggatgcccacaatgcgctcttggatatccagtcctccggcagggcgaaggaattgctcggacaaggactgttactgagaagtttgcaggagcgtaaccaggagcaagagaaggtagagcgtaggcgtcaggtaccattccatctacatattaatctggagctgctggagtgcgtttatctagtatccgccatgctcctggaaatcccttacatggccgcccacgagtcagacgccagacgcagaatgatctccaaacagtttcatcaccagcttagagtcggggaacggcagcccttattaggcccccctgaaagcatgagagagcacgtagtcgcagcttcgaaggcgatgaagatgggagactggaaaacctgtcattccttcataattaatgaaaaaatgaatggcaaagtatgggacctttttcccgaagcagacaaagtcagaactatgctggtgaggaaaattcaggaagaatccctgcgaacctatcttttcacctactcttccgtttacgacagtatttcgatggagaccctgtcggatatgtttgagctggatcttcctacggttcattctataatcagtaaaatgatcataaacgaggaacttatggcttcactggatcagccaacccagactgtcgtcatgcaccgcaccgaaccaacagcacagcaaaatcttgccttacagctagctgagaagttaggctccctggttgagaacaacgaaagggtgtttgaccacaagcaaggcacctacggtggttatttcagggatcagaaagatggctaccgtaagaatgagggatatatgcgacgtgggggatacagacagcagcagagccagacggcctactag

SEQ ID NO: 29497 - DNA, 2745 bp, Artificial Sequence
  Description of Artificial Sequence: Synthetic coding sequence
atgtctagattttttactactggaagcgattcggagtccgaatcctctctcagcggtgaagagctggtgacaaaacctgtgggtggcaactatggaaagcaacctctactgctgtcagaagatgaagaagataccaagcgagtggtgagaagcgccaaggacaagagatttgaagagctgacgaacctgatacgcactatccgcaacgctatgaagattcgggatgtcaccaaatgtttagaggagttcgagctcctggggaaagcatacggtaaagctaaatctatagttgataaggagggagtgccacgattttacatccgcatcctggccgatttggaggactatcttaacgagctgtgggaggacaaggagggtaaaaaaaagatgaacaaaaacaatgccaaagccctctccactctgcgtcagaagattcgaaaatataatagggatttcgaaagccacatcacctcttacaagcagaaccctgagcaaagcgccgacgaggacgctgaaaaaaatgaagaggactcagaaggctcttctgacgaggatgaggatgaagacggcgtatcggccgctacctttctgaaaaagaagagcgaagctcccagcggtgagtcccgcaaattcctgaagaaaatggacgacgaagacgaggattctgaggactcagaggatgatgaagactgggacaccggctctacttcttccgatagcgactcagaagaggaggaggggaagcagaccgccttagctagcagattccttaaaaaggcgccaaccaccgatgaggacaagaaggccgctgagaaaaagcgggaggataaggccaagaaaaaacatgacagaaagtccaaaagactggatgaggaagaggaggaagacaatgagggcggtgaatgggagcgcgttagggggggggtgccactcgtgaaggagaaacccaagatgttcgctaagggcacagaaatcacccatgctgttgtcataaagaaactcaacgagatcctgcaggcccgcggaaaaaaggggaccgaccgtgctgcccagattgaacttttgcaacttctcgtgcagatcgcagcagaaaataacctgggggaaggtgttattgtcaagatcaaatttaacatcatcgcgtctttatacgattataaccctaatttggccacttacatgaagccagaaatgtggggcaagtgcttggactgcataaatgagttaatggacatactctttgccaaccctaatatcttcgtgggagaaaatattctcgaggagagcgagaatctccacaatgcagaccaacccttgcgagttcgagggtgcatcctgacactagtggaaagaatggacgaggaattcaccaaaatcatgcagaataccgacccacactcccaggagtatgtcgagcacctgaaggacgaagcccaggtgtgcgcgatcatagaacgcgtgcagagatatcttgaagaaaagggtacgactgaagaggtatgccgaatatatctcttgcgcattctgcatacatattacaaatttgattataaggcccaccagagacagctgaccccgcctgagggctcaagtaagtcagagcaggaccaggcagagaacgagggcgaagattccgctgtactgatggagagactttgtaagtatatctatgcaaaagaccggactgaccgtatccgcacatgtgccatcctttgccacatctaccaccatgccctgcacagcagatggtaccaggcacgggatcttatgttaatgagtcatctgcaagacaatatccagcacgctgacccgccagtacagatcttgtataatagaacaatggtacagctgggtatttgtgccttcagacagggcctgacaaaggacgcccataacgcattgctggatatacagtcctctggaagggccaaggagctgctcgggcaaggcctactgctcaggagtctgcaagagaggaaccaggaacaggagaaagtcgagaggcggaggcaggtcccatttcacttgcatattaacttggagttgctcgagtgcgtctatttagtcagtgctatgctcctcgaaatcccctacatggcagcccatgagtccgacgccaggcgccgtatgatcagcaaacagtttcatcatcaactccgcgtgggcgaacggcagccactgctgggccccccagagagcatgagggagcacgtggttgctgctagcaaggccatgaaaatgggcgattggaaaacgtgccacagctttattattaacgaaaagatgaacggcaaggtgtgggatctgtttccagaagctgacaaggtccgaaccatgctggtgaggaagattcaggaagagtccctacggacatatctgtttacatacagcagtgtctatgacagcatatcaatggaaacactatcggatatgttcgagctcgatctgccaaccgtccactccatcatctccaaaatgattataaatgaggagcttatggcatctctagaccagcctactcagacagttgtcatgcaccgcaccgagcccactgcccaacagaacctggcgctccagttagccgaaaaactagggagcttggtggagaacaatgagcgcgtcttcgatcacaaacagggcacctatggaggttattttagagaccagaaggacggataccgtaaaaacgaaggatacatgcgcagagggggctatcgacagcaacagagccagactgcttactag

SEQ ID NO: 29498 - DNA, 2289 bp, Artificial Sequence
  Description of Artificial Sequence: Synthetic coding sequence
atgagcagatttttcacaacaggctccgattcagagtctgagtcttcgctgtctggggaggagttggtgaccaagcccgtcggaggcaactatgggaagcagcccctactcttgagtgaagacgaggaagatactaagagagtcgttagatctgcaaaggacaaacgttttgaagagctcaccaatctgattagaacaattcgcaacgccatgaagattagggacgtcaccaaatgcctggaagaattcgagctcctgggaaaagcctatgggaaggccaagtccattgtagacaaggagggggtccccaggttctacatacggattctcgccgatttggaggattatctgaatgaactctgggaagataaagagggtaaaaagaagcacgatcgcaaatccaagagactggacgaggaagaagaagaagataacgaggggggcgagtgggaaagagttagaggcggcgtgcctttagtaaaagagaagcctaaaatgtttgccaaggggaccgagatcacccacgctgtcgttataaagaagctgaacgagatactgcaggccagaggtaagaaagggacggatagagccgctcaaatcgagttgctccagctgcttgtgcagatcgccgccgaaaacaacctgggagaaggggtcatcgtaaaaatcaagtttaatatcattgcaagtttatacgattacaaccccaacctggcaacatatatgaaaccagaaatgtggggcaagtgcctggactgcatcaacgagctgatggacatcctgttcgctaatcccaatatcttcgtgggagagaacattctggaagagagtgagaacctccacaatgccgatcaacctttgcgagtgcgtgggtgcatcttgacactggtggagcgcatggacgaagagttcaccaagataatgcagaataccgatccgcactctcaggagtatgttgagcacctgaaggatgaggcccaggtgtgtgccataattgagcgcgttcagaggtacctggaagaaaaaggcactacagaagaggtgtgcaggatttacttactgcgtattctgcatacctattacaagttcgattataaggctcaccagcgccaactgacgcctcctgagggatcttcaaaatcggagcaggatcaagccgagaatgagggcgaggatagtgcagtccttatggaaaggctctgtaagtacatttatgccaaggatagaactgatcggattcgtacttgtgcaattctctgtcatatctatcaccatgccttacactctcggtggtatcaagccagagatctcatgcttatgagtcacttgcaggacaacatccagcacgctgatccccccgttcagatcctctacaatcgtaccatggtccagttgggaatatgtgcttttcggcagggacttactaaggacgcacataacgctctactggacatccagtcatctggtcgggccaaggagcttctgggacagggcctgcttctgaggtctttgcaagagagaaaccaggagcaggagaaggtggaaaggcgtcgtcaggtaccgttccacctgcatatcaacctggaattgttggaatgcgtatatctggtttccgcaatgttgcttgagataccatatatggctgctcacgagagcgacgctcgccgcaggatgatctcgaaacaatttcatcatcagctgcgggttggcgaaaggcagcctctgctagggcctcctgagagtatgcgggagcatgtcgtcgccgcctctaaggctatgaaaatgggcgattggaagacatgccatagttttatcattaatgagaaaatgaacggaaaagtgtgggacctcttcccagaggccgacaaagttaggaccatgctggtccggaagatacaggaggagtcactacggacctacctctttacatattccagcgtttacgatagtattagcatggaaaccctctccgacatgttcgagttagatctgcctacagtgcatagtatcatctccaagatgataattaatgaggaattgatggcgagtttggaccagccaacacagaccgtggtgatgcacagaacagagccaacggcgcagcagaatctcgctctccagcttgccgagaaattaggttctctcgtggagaacaatgagagagtgtttgatcataaacagggcacttatggaggttacttccgagatcaaaaggatggttatcggaagaatgagggctacatgcgccggggcggatacagacagcaacagagccagacagcttattag

SEQ ID NO: 29499 - DNA, 2700 bp, Artificial Sequence
  Description of Artificial Sequence: Synthetic coding sequence
atgtctcgtttttttaccaccgggtcagactctgagtctgaaagttctttgtctggcgaggagctggtgaccaagccagtcggcggcaactatgggaaacaaccactgctcttgagcgaagatgaggaagacacaaaacgggtcgtgaggtctgcgaaagataaacgctttgaggaactcacaaacctgattcggaccatcaggaatgccatgaaaatcagagacgttaccaagtgtctcgaggaatttgagctcctgggaaaagcctacggcaaggccaagtctattgtcgacaaagagggcgtacctcgcttctatatccgaattctggcggacttggaggactacctgaatgaactgtgggaggacaaggagggaaaaaagaagattcgtaagtacaaccgagactttgagagtcatatcacaagctacaaacagaaccctgagcaatcagcagacgaagacgcggagaagaatgaggaggactcagagggttcatccgatgaggatgaggacgaagatggggttagcgccgccacgtttctaaagaaaaagagcgaggctccttcaggagaaagccgcaagttcctcaaaaagatggatgacgaagatgaggattctgaggatagcgaggatgatgaggactgggacacaggtagtacaagcagcgattcagattcagaagaggaggaaggcaagcagactgctctggcaagcagatttttgaagaaggcacccactaccgatgaggacaagaaggctgcggagaaaaaaagagaggataaagccaaaaaaaagcatgatcgcaagtcaaagaggttagacgaagaggaagaggaggacaatgagggaggagagtgggagcgggtccgtggaggcgtcccactagttaaggaaaagccgaagatgttcgccaaagggacagagataacccacgcggtcgtaatcaagaaactcaatgaaattctccaggcaaggggtaaaaaaggaacagatcgcgccgcccagatcgagctgcttcagctgcttgtgcagattgcggccgagaataatctaggggagggagtgatcgtaaagatcaaattcaacattatcgcgtccctttatgattataaccccaatttggctacttacatgaagcccgagatgtggggcaaatgcctggactgcatcaatgagttaatggacatactgtttgcgaatcctaatatattcgtcggtgagaatatactggaagagagtgagaacctccacaatgccgatcaaccactgagggtgcgcggttgtatcctgacactggttgagaggatggatgaagaattcaccaagattatgcaaaatacagatccacactcacaggagtacgtcgagcatctgaaggacgaagcacaggtgtgcgctatcatcgagcgggtgcagaggtatctcgaggagaaggggacgactgaagaggtttgccgtatttacttgctgcggatcctgcacacctactacaaattcgactacaaggcccaccagcggcagctaacaccccccgaaggaagctccaagagcgaacaagaccaggcagagaatgagggagaggattctgcggttctcatggaacgcctgtgtaaatacatctacgcgaaagatagaacggaccgcattagaacgtgtgccatactctgtcacatctaccatcacgccctgcactcacgctggtaccaagcccgcgatctcatgctcatgagccatctgcaggacaatatccagcacgctgatccaccagtacagattctgtacaatcgtactatggtccaactgggcatctgcgcctttaggcaggggctcaccaaggatgcacataatgcattactcgacatacagtcttcaggacgagccaaggagctactcggccaaggcttgctgctgcggtcactgcaggagcgcaaccaggaacaggagaaggtcgagaggagaaggcaggtcccattccacctccacattaatttagaattgctggagtgcgtctatttggtgtctgccatgctactggagatcccatacatggccgcacacgaatccgacgctagacgccgcatgattagtaagcagttccaccatcaacttcgagtcggggaaagacagcctctgctaggaccaccggagtcgatgagagaacacgttgtcgctgctagtaaagcaatgaagatgggcgattggaaaacgtgtcactcattcatcatcaacgaaaagatgaatggcaaggtttgggacctgtttccagaagctgacaaggtgcgcacaatgttggtgagaaaaattcaggaagagtcacttaggacttatctgtttacatattccagtgtttacgactctatttctatggagacattatcagacatgttcgaactggacctgccgacggtacattctatcatctccaaaatgatcattaatgaggaattgatggcttctctggaccagcctacccagaccgtggtgatgcaccggactgagcctactgctcaacagaatctggcactccaactggctgagaagctgggatcgttggtggaaaacaacgagcgagtgtttgaccataaacagggtacgtacggagggtacttcagagatcagaaggacggttaccgcaaaaatgaaggctatatgcgcagaggaggttaccgacagcaacagagccagactgcttactag

SEQ ID NO: 29500 - DNA, 729 bp, Artificial Sequence
  Description of Artificial Sequence: Synthetic coding sequence
atgctggcagtggaagtgagtgaggctgaggggggaatccgggagtgggaagaggaggaaaaggaggaggaggcggcagaaaggaccccaactggcgagaaaagcccaaacagcccccggaccctcctgtccctgcgtgggaaagctaggaccggcgggcccatggaggtcaagctggaactgcaccctctgcagaatcgttgggctctgtggttcttcaaaaatgatcgcagccgggcttggcaggataacctgcatctggtgactaaggtcgatacggttgaggacttttgggcactgtacagccacatacagctggccagtaagctgtcgagcggatgcgactacgccctgttcaaggacgggatccagcctatgtgggaagattcccgaaacaagaggggcgggagatggctcgtgagcctcgctaagcagcaaagacacattgaactggaccgcctctggttggagaccttactgtgcctaatcggcgagtcattcgaggaacattcccgggaagtctgtggcgcagttgtcaacatacggactaagggtgacaaaatcgccgtctggaccagggaagccgaaaatcaagccggagtgctgcacgtgggcagggtatacaaagagagattgggcctcagcccgaaaaccatcattggctaccaagctcatgccgacacggccaccaagagtaatagtctggcgaaaaataagtttgtcgtgtag

SEQ ID NO: 29501 - DNA, 729 bp, Artificial Sequence
  Description of Artificial Sequence: Synthetic coding sequence
atgctggcggtggaggtgtcagaggccgagggtggaattcgggagtgggaagaggaggaaaaagaggaggaagccgccgaacggactcctacaggagagaagagcccaaactcaccccgaacactgcttagcctaaggggtaaagcccggactggaggccccatggaagttaagctggagttgcatcctctgcagaatcgttgggccctgtggtttttcaagaatgacaggtctcgagcatggcaagacaacctgcaccttgtcactaaggtggatactgtcgaggatttctgggccctgtactcacacatccagctggcttccaagctgtcatccggctgcgactatgctctcttcaaggatggcattcagcctatgtgggaggactccaggaacaagcggggcgggaggtggctggttagtctagccaagcagcagcgtcatattgagcttgataggctttggcttgagactctgctgtgtttgataggggagtccttcgaagagcactctagggaggtctgtggggccgtggttaacattagaactaagggggacaagatcgctgtttggacgagagaggcagagaaccaagctggcgttttgcatgtcggccgagtgtacaaagagaggctgggcctcagtccaaaaacaataatcggctaccaggctcatgccgataccgcgacgaagagcaattctctcgctaaaaataagttcgtcgtctag

SEQ ID NO: 29502 - DNA, 273 bp, Artificial Sequence
  Description of Artificial Sequence: Synthetic coding sequence
atgctggccgtggaggtttccgaagcagaaggcgggataagagagtgggaagaggaagagaaagaagaggaggccgctgagcgcacaccaacgggtgagaagtccccgaacagtccgagaactctgctgtccctccggggaaaagcccgcacgggtggacccatggaggtgaaacttgagctccaccctctgcagaatcgctgggccctgtggtttttcaaaaacgatcgcagcagagcctggcaggacaatctgcacctcgtgacgaagtag

SEQ ID NO: 29503 - DNA, 525 bp, Artificial Sequence
  Description of Artificial Sequence: Synthetic coding sequence
atggccgccgcgatggtgcccggcagatcagaaagttgggaacgaggggagccaggcaggcctgccttgtatttctgtggctccattcgtggcggtagagaagacagaacgctgtacgagagaatcgtgtctcgtctgcggcgatttggcactgtcttaaccgagcatgttgccgcagccgagctgggggcccggggggaggaggctgccggcggcgacagactcatccacgaacaggatctcgaatggctgcagcaggctgacgtggttgtggctgaggtgacacaaccatcattaggagtgggatatgagttaggcagggccgttgcctttaataagaggatcctgtgtctatttcgccctcagtccggtagggtcctctccgctatgattagaggagccgccgacggttctcgcttccaggtttgggattacgaggagggtgaggtggaagccctcctcgataggtacttcgaagctgatccacccggccaggtggccgcctctccagatcctactacctag

SEQ ID NO: 29504 - DNA, 423 bp, Artificial Sequence
  Description of Artificial Sequence: Synthetic coding sequence
atgtcacgatcccggcagccacctctagtaacaggcatttcaccaaatgaaggaatcccctggacaaaggtgaccataaggggggagaatttgggaactggccctactgatctcattgggcttaccatttgtggccataattgcctcctgaccgccgagtggatgtccgccagcaagatcgtttgtagggtaggccaggccaaaaacgacaaaggggacatcattgtaactaccaagagtggagggcgcggcacttccacagtgtcttttaaactactgaaacccgaaaaaataggaatcctcgaccaatccgccgtttgggttgacgagatgaattattacgacatgcgtaccgatcgtaacaagggcatccctcctctgtcccttagaccagccaatccccttggcattgaaatcgagtag

SEQ ID NO: 29505 - DNA, 1560 bp, Artificial Sequence
  Description of Artificial Sequence: Synthetic coding sequence
atgctggacttagacaacgacacaaggccctccgttctggggcatctctctcagacagcctctctgaagagaggcagttcttttcagagcgggcgcgacgacacatggcgctataaaacaccacaccgggtagctttcgtcgaaaaattaactaaactcgtgttgtcccagctgccgaatttctggaagctctggatttcctacgtgaacggatctctgtttagcgagactgctgagaaatcagggcagatcgagcggtccaaaaacgttcgtcaacggcagaatgacttcaagaagatgatacaggaggttatgcactctctagtaaagctgacccgtggggctctgcttcctctcagtatcagagatggagaagcaaagcagtatggtggatgggaggtcaaatgtgaactgtctggtcagtggctggcgcacgctatccagacagttaggctaacccacgaaagtctgaccgccttggagatacccaacgatttgctgcagactatccaggacttgatactagacctgcgagtgagatgcgtgatggccaccttgcagcatacagctgaggagatcaagcgattggctgaaaaggaagactggatagtggacaacgaaggcctgacttcgcttccctgtcagttcgagcagtgcattgtgtgttccctgcagtcactcaagggcgtgttagagtgtaaaccaggggaggcatccgtgttccaacaaccaaagacacaagaggaggtatgtcagctatccattaacattatgcaagtatttatctattgtctggagcagctcagcactaagcctgatgccgatatcgatacaacgcatctgagtgtagacgtgagttcgccagacctgttcggcagcattcacgaggacttttctttgacgtcagagcagcgtctgctgatagtgttatctaattgttgctatctagaaaggcataccttcctgaacatagcggagcacttcgagaagcataactttcaaggcatagaaaagataactcaggttagcatggcctccctaaaggagctggatcagcggctattcgagaactacatcgagttgaaggccgatccaatagtgggctctctagagcctggcatctacgctggctacttcgactggaaagattgtttgccgcctacgggcgtgagaaactacttgaaagaggcccttgtgaatattatcgcagtgcacgcggaggttttcactatttctaaagagctggtgcccagagtgctctccaaagtcattgaggcggtgagcgaggaactgtcccgacttatgcagtgtgtgtcatctttcagcaaaaatggtgccctgcaggcccggctcgagatttgcgccctacgagatacagtagcggtctacttgactcccgagagcaaatcttcctttaagcaggccctggaggccctgccccagctcagttctggggcagacaagaagctgctcgaagagctgctaaacaaatttaagagctcaatgcatttacagctgacgtgcttccaggcggcctcctccaccatgatgaaaacgtag

SEQ ID NO: 29506 - DNA, 1230 bp, Artificial Sequence
  Description of Artificial Sequence: Synthetic coding sequence
atggccgcattagagaacggagagttgggcccactgctgtcacccggcacactgcgcgggctggaggatgaatgcgtgaccgatgtcaaagcacagacaagagcggcactgctgcgggtcctgcaagaggacgaagaacactggggatccctggaggaccaaccctcctctctggcgcaagacgtttgcgaacttcttgaagaacataccgaacgggcccctcggatcagtcaagaatttggagaaagaatggcacactgttgcctgggaggcctggccgaattcttgcagagttttcagcagagggtggaacggttccatgaaaaccccgcagtccgtgagatgttaccggatacatacatatccaagaccatcgctttggtgaattgtggccctcccctgagggccctcgcagaaaggctcgcgcgggtaggcccacctgagtcagagcctgccagagaagcttctgcatctgcactggatcacgtgacaagactttgccacagagtggtggctaacctactctttcaagagctgcaacctcactttaataaactcatgcggagaaagtggctatccagtccagaagcactggacggaatagtgggtacccttggagcacaagccctggctctcaggaggatgcaggacgaaccttaccaagctcttgtagccgagctgcatagaagagctttggtggaatatgtgaggccgctgttgaggggacgcctgaggtgctcctccgcacgcaccagaagccgcgtggcaggtcgcttgcgagaagatgccgcgcaacttcagcgactattccggcgactagaatcacaggcgtcctggttagatgcagttgttccacacttggcggaagtgatgcagctcgaggacaccccttccatccaagtggaagtgggcgtgttggtgcgtgattatccggacatccgccagaaacacgtggcagcactgctggatattagaggattacgcaatacggccgcccgacaggagatcttggccgttgcaagggacttagaactgagcgaagagggtgcgctgagtcccccccgtgatcgagcgttctttgctgacatccccgtgcctcggccctccttctgcctctctctgcccctttttcttggaagactgcctctgagtagacttgcaaggccatcattagcgtgcttgccacggccaaggccaccctccctcgcgagaccacgcgcacagaggtag

SEQ ID NO: 29507 - DNA, 1230 bp, Artificial Sequence
  Description of Artificial Sequence: Synthetic coding sequence
atggccgccctggagaacggggaattagggccgctgcttagtcccggcacattgcgcgggctcgaagacgagtgtgtgacggacgttaaggcacagacccgagcggccctcttgcgggtgctgcaggaggatgaagagcattgggggtccctggaagaccagccgagttctctcgcacaggatgtgtgcgaacttttggaagaacacaccgagcgcgctcccaggattagccaggagtttggagaaagaatggcgcactgctgcctcggtggcttggccgagttcctgcagtcattccagcaacgtgtcgaaaggttccacgaaaaccccgcagtgcgggaaatgctgcctgatacttatatcagtaaaaccatcgccctggtgaactgcggccctcccctccgggcactcgcggaaagacttgccagggtaggccctcccgaaagcgagccagcaagggaggccagcgcctcggcgctcgatcacgtgacgcggctgtgtcatagagtagtcgcaaacctgctcttccaggagttgcaacctcattttaataagcttatgcggcggaagtggctatcgtcccctgaagctctagacggcattgtgggaacactgggagcacaggccctggcccttagacgcatgcaggatgagccttatcaagccctcgtggccgaattgcaccgccgggccctggtggaatatgtgcgacctttactccgcggcaggctccgttgttcttccgcacgcacaaggagcagggtcgcagggagactgagagaagatgcagcacagcttcaacgtctgttcaggcgcttagaaagtcaggccagctggctggatgcggtagtgccacacctggcggaagtgatgcagcttgaggacacgccatctattcaggtcgaagttggcgtgttggtgcgtgattaccctgatatcagacagaaacatgttgctgccctgctagacatccgaggattgagaaataccgctgccaggcaggaaatcttagcggtcgcacgagacctggagctgtccgaagaaggcgcattgtcccctcctagggatcgtgccttctttgcagatatcccagtccctcggccgtcattctgtctgtctctcccgttgttcctgggccgtctcccactatcccggcttgctagaccgtccctagcctgtctccccagaccccgacctccttcccttgctagaccaagggcgcagaggtag

SEQ ID NO: 29508 - DNA, 2169 bp, Artificial Sequence
  Description of Artificial Sequence: Synthetic coding sequence
atgccttccccacaaaccgatactcccggtcccgaactgcagtccccaaaagaggccgaggagcctcagactccagcccagggctccagaaggaccagttcaaggaaagagccaaatgctcatcggaaggacggtacccgactgggtctggggagtctcagacaggccttctctagggccagccaacgggccctaactcaggtctcgaaagaagatacaggactgttcagacgttcctcttgcagtctgtttagaagctttaggcaggccctgaatgatggcccggctacgggccatagccaagctacaccagaagtgccttcaggggtaatgaatggtgtgagtcaacaggccagcacgggcgctgcatctgaagagctcaagcctgaggccgagggaaaatcagtcgccgacctgatcaccgaaagacaactgctcgccgcatttgagcagctgctgcgacttgagactctcctggtggccgaaaaagccagtcgaacattcgagcaagaccccaccgccttcgcacggcgggctatggacgtgtgtctgctgtatgacggcctcgctgctgagattggggcgattgttcgcgaaacgcttgattcagacggtgtggatgccgcagccttggccgagctggcccgggtggttagcgcagaagaggaggctcatccatccccaccagacgacggcgatttccttagaactcctagaaggtggcggcagcactgggaggaggccgtacggcgatctgcgcaggaaagggtgaggagaccaggcgcagggtgggcgttcggggaggctgagggagctagcggcctcgctcaattgcttgcggaattaggtgggctggtcagacgtgacttacagaaggttaggcaggaagtccagccggcatatgccgcagcaggattccccgcatgggaggtgtatctgagagcattccactctgcagttgcacagcgcctccaggaactggctcgtgacgcaagagggtgcgagcagctgtacattttactggactgggcagcaaatgtgtatggttccccagattttttgggggctccaggtctggcactgccagcggagcctctgccgcccctactcgcacctgacgtgtgggcacggctggagtcagactatacctcatttctggaggcgaaaatcgccagctgtttcgactcaattttacaattagagcagtcccactgggcagctgcagaggtgccagaggttctgcagggcctctaccaggctccactctccatggatgtgcacatgctcgttgccgagcacgtgaaggccgccggagcaatcagcgccgagctggaagccaccactttgcgaatatgcaccagggcgctaggattgttcgtgcctaggttcgagaaagccttcctagcctccgaagccgtttctgagcctcatctgggcgcgtacatcaatgcatgcgaggaactgcggaccagccttctctctcggtttccaggtacacaagaggagctggaaaagccgctggtgacagcaacttgctcctttcagaaacacctgctgcagggcctacagagggagctacagcccttatttcgagtggtttgtacgcgggattggcttactcaggactggctccatcccctcatggataaagtggtaacttttgctggtcacctgcagcgggtggcaagaccaagggctcaagagacgctacaggaagttcataggtttgtcgttagagaatatctggccagggcattgcgcccaagggagcggtttcgaggcatggaacggatgcacggcagtcaaaagatgagcctggacgcccaggcaatctcggatacattccagggtctaggctctgaggccacgtggctggatcaggctatacagtgcgtggctgaaatccttggcgaaacttataaggatgacatacagagacacctcgagactcttatacgcagttacccagacatcagaagggatcacatcttggcgatcctggcactaagacggctgggccggcaacggaatcaacatctcctgcagcacacacaggacctcctccgtgcagctgccggtgccgccggagctgaagctccccgcggccgagtgttgttcgaggagatcaaggttccctccgcgatggccgtcctgatcacctgcgtctag

SEQ ID NO: 29509 - DNA, 1545 bp, Artificial Sequence
  Description of Artificial Sequence: Synthetic coding sequence
atggaagattcagaatttctggcctacgtagaactcctggatgaggtggagcagggcagcgtccgcgccaaagcttcctcagtgtcattacacgccgagcgcacctggatggagaaaatgaaggtcgaggatctcaacgtatgcgaacccgcaagtcccgcgccagaggcccctgctaccagcctgctgaacgacctgaagtactccccctccgaggaagaagaagtaacttacacagtcattaatcagtttcaacagaaattcggcgctgccattctccacataaaaaaacagaatgtgctatctgtcgctgctgaaggtgccaatgtttgtcgtcacggaaagctatgttggctgcaggtggcaaccaattgtagggtgtatctgttcgatatcttcttactagggtccagggctttccataacggtctccaaatgattctggaggacaaaaggatccttaaggtcattcatgactgccggtggttaagcgattgtctgagtcatcaatatggcatcctactgaataatgtgtttgacacacaggtagcagacgtcctgcagttctccatggagacaggagggtacctccccaattgcattacaaccctccaggagtcccttatcaagcacctccaggtggccccgaagtatctgtcctttcttgaaaagcgtcagaaacttatacaggagaatcctgaggtgtggttcattcgcccagtgagtccatccttgctgaagattctagcactggaggccacctatctgctgcccctgcgacttgcactgcttgacgaaatgatgagcgatctaaccacactggttgatggctatctgaacacataccgcgaaggctccgcagaccgtctgggaggtacagagcccacctgtatggagttgcccgaagagctgctgcagctcaaggatttccagaaacagagacgcgaaaaggctgctcgagaataccgggtgaacgctcagggcctgcttattagaactgtgctgcaaccaaaaaaactggtcaccgagacggccggcaaagaagagaaagttaagggttttctcttcggcaaaaacttccgtattgataaagctccatctttcacttctcaggatttccacggagatgtgaatctgctgaaggaggagtcattaaataaacaggccacaaatcctcaacatctgcccccaacagaggagggggaaaccagtgaagattctagcaacaagctgatctgcaccaaaagcaaagggtctgaagaccaaagaatcacccagaaggagcatttcatgacacctaaacacgagttccaggcctcactgagcctcaaggaagaaactgaacaattactcatggtggagaacaaagaggacctgaaatgcacaaagcaggccgtatccatgtcaagctttccccaggagacccgtgtatcaccttcagacacgttctaccccataagaaagactgtcgtgagcacactgccaccctgtcctgccctcgaaaagatagactcctggatatccccattcctgaacctgccttag

SEQ ID NO: 29510 - DNA, 1719 bp, Artificial Sequence
  Description of Artificial Sequence: Synthetic coding sequence
atggatcccagctcagattaccacttcctatcacagatcctgtggaagcgggttaaactcacacttgtgtgcggcgtgtttgagggggtcttgcaacacgttgacccaaataagatcgttgtgcttaaaaaggtcaagaatgtcgagacaggacgatcagtcccaggagtgaagctgttcttcggtcacgaaatagtaaacgtcgagctgctggacgaagtcgagcaaggtagcgtccgggcaaaagcgtcaagtgtgagcttgcatgcagaaagaacctggatggagaagatgaaagtggaagacctcaacgtatgcgagccggcttcccctgccccagaagcacctgcaacatccctcctaaacgacctcaaatactcaccaagcgaagaggaagaagtgacgtacactgtcatcaatcagttccagcagaaattcggtgctgcaatcctgcacataaagaaacagaatgtattatccgtggcggccgagggggctaacgtttgcagacacggtaagctgtgttggctccaggtggccactaattgtcgcgtgtacttgttcgacatctttctcttgggatcacgtgcctttcataatgggctgcaaatgattcttgaggacaaacgtattctcaaggtgatccatgattgtcggtggctgtccgattgcttgtcgcatcagtatgggatcctcctgaacaacgtcttcgatacccaggttgcggatgttcttcagttctctatggaaaccggggggtatttacctaattgcatcacgaccctgcaagagtccctgatcaaacatctgcaggtagccccaaaatatctctccttccttgagaagcggcagaaactgatccaggagaatccagaggtgtggtttattaggcctgtcagcccttcactgttgaagatcctggccctcgaggcaacatatctcctgccgctgcggcttgcattgctggatgaaatgatgagcgacctgaccaccctggtagatgggtaccttaacacctaccgtgaggggtccgccgatcgacttgggggcactgagcctacatgtatggagctccccgaggagctgttacagttaaaagactttcagaaacagcgcagggagaaagctgctcgcgaatatcgcgtgaacgcacagggtctgctaatccggacagtgctgcagccaaagaaattggtgaccgagacagctgggaaggaagagaaggtaaaggggttcctctttggaaaaaattttcgcatcgataaggctccttcattcactagtcaggatttccatggggacgttaacctcctgaaagaagaaagcctgaataagcaggccaccaatccccagcacctgccccccacagaggagggggagacatctgaagatagctctaacaagctgatctgtaccaaaagcaaggggtccgaggaccagcgaattacccaaaaggaacatttcatgactcccaagcatgagttccaggcgtctctttcccttaaagaagaaactgaacagctgctgatggtggagaacaaggaggacttgaagtgcacgaaacaggccgtttcaatgtcatctttcccacaagagactcgagtctcaccctcagacaccttttaccctatcaggaaaacagtcgtttccaccttacccccctgtcccgccctggagaagatcgactcctggatctcccccttcctgaaccttccctag

SEQ ID NO: 29511 - DNA, 816 bp, Artificial Sequence
  Description of Artificial Sequence: Synthetic coding sequence
atgtccagacagaaccttgtcgcattgaccgtaactactctgcttggtgtagccgtgggtggctttgtactgtggaaaggcatccagcggaggcggcgcagcaagacatcccccgtcacacaacagccgcagcagaaagttctgggtagtagggaattaccgccaccggaagacgaccaattgcacagcagtgctcccaggtcctcctggaaggagaggattctcaaggctaaagtggtcacggtttcccaggaggccgagtgggatcagatcgaaccactcctgcgttcggaattggaggacttccccgtgctcggaatcgattgtgaatgggtgaacttggaagggaaggcatcccccctgagtctgctgcagatggcctccccatcaggcttatgtgtgttggtgcgtcttccaaaactgatctgtggcggaaaaacgctgcccaggaccttacttgatattcttgctgacgggaccattctgaaggttggggtagggtgctctgaagatgcaagcaagcttctccaagattatggattggttgtgcgaggatgcctggatttgaggtaccttgctatgcgtcaacggaataacttgctctgtaacggactgtccctgaagtctcttgccgagactgtgcttaattttcccctggacaagtctctgctactgagatgcagcaattgggatgctgaaaccctgactgaggaccaggtcatatatgctgcacgcgacgcccagatctcggtagctttattcctgcacctgcttggctacccctttagcaggaatagcccgggagaaaagaggtag

SEQ ID NO: 29512 - DNA, 1866 bp, Artificial Sequence
  Description of Artificial Sequence: Synthetic coding sequence
atgtcaagacagaatctcgtggcccttacggtcacaacattgctaggcgtcgctgtcggaggcttcgtactgtggaagggaatccaacggaggaggagatctaaaaccagtcccgtgacacagcagccccaacagaaggtgctggggtcgagagaactgcccccccctgaagatgaccagctgcattcttcggcccctcggtcctcatggaaggagcggatactgaaggccaaagtcgtgactgtcagtcaggaggccgagtgggaccagattgagccattactgagaagtgaactagaagatttcccagtgctgggcatcgactgcgaatgggtcaatctggaggggaaagcatcccctttatcccttctgcaaatggccagcccttctggtctgtgcgtgctggtcagactgccaaagctgatttgtggagggaaaaccctgccacggacactcctggatatactggccgacggaacaattctgaaagtgggggtcggatgttctgaggacgcatccaaactgcttcaggactatggattggtggtacgcggttgcctggatctccgctatctcgcgatgcgacagaggaacaacctcctgtgcaacggcctttctctcaagagcctcgcagagactgtgttaaacttcccacttgacaagagtcttttgttgcgttgttccaactgggatgcggagacactcaccgaggaccaggtcatttacgcagccagagatgcgcagattagcgtggcactcttcctgcatctgctgggatacccctttagtcgcaactcacctggtgagaaaaatgatgatcattcctcttggaggaaggtgctagaaaaatgtcagggggtggttgacatccccttccgcagtaaggggatgagccgactgggcgaagaggtgaacggagaggcaactgaatcgcagcagaaaccacgcaataagaagtccaaaatggatggcatggtacccggaaaccatcagggacgcgatccaaggaagcacaagagaaagccgttgggcgtcggatattcagccagaaagtctcccctgtacgataattgctttctccacgccccagacgggcagcccctctgcacatgtgataggcggaaggcacaatggtacctcgataagggcattggtgaactcgtgagtgaggagccgttcgtggttaagctgcgattcgagcctgccggtaggccagaatcacctggggattactatctgatggtaaaggagaatctgtgtgtcgtatgcggaaagagagacagctatattcgcaagaacgtgataccccatgaatatagaaagcattttcctatagagatgaaagatcataattcgcatgacgtactattattgtgtactagctgccacgcaatttctaactactacgacaatcacttgaaacagcagttggcaaaagaattccaagcccccattggttctgaggaaggactaagactcctagaagatccggaacgccgccaggtgcggtccggtgctagggcgctgctgaacgctgaatccctgccaacgcagcggaaggaagaactgctgcaggctctacgtgaattttataacacagatgtggtgacagaggaaatgcttcaggaggcggccagtctagaaacacgcatttcaaatgaaaactacgttccacacggcctgaaagtggtccaatgccactcccagggtggcctaaggagtctaatgcagctcgaaagccggtggaggcagcattttctggattcaatgcagcctaaacatctgcctcagcaatggtctgtagaccataaccaccagaaactactaagaaagttcggggaggatctccctatccaactttcatag

SEQ ID NO: 29513 - DNA, 1491 bp, Artificial Sequence
  Description of Artificial Sequence: Synthetic coding sequence
atggcttccccttctgggttgtgcgtgctcgtgcgattaccaaaactaatctgtggtggaaaaaccctgccaaggacactcctggacatcctagccgacgggacaatcctcaaagtgggtgtggggtgctccgaggatgcctctaaacttttacaggattatgggctggtggttcggggctgcctggatctgagatatttggccatgcggcaaaggaataatctactgtgtaacggactctcgctgaaatcgcttgccgagaccgtgctcaactttcctttagataaatctctccttctgaggtgttctaattgggatgcagaaactctgaccgaagatcaggtgatctacgcagctagggacgctcagattagtgtggcgcttttcctgcatctcctcggatatcccttctcaaggaatagccctggtgagaagaacgatgatcacagtagttggagaaaagtgctggaaaagtgtcagggcgttgtagacatccctttcaggagtaaaggaatgtcaaggctgggcgaagaggttaacggagaggctactgagtctcagcagaaacctcgcaacaaaaagtcaaaaatggacgggatggtccccggaaatcaccaaggtcgtgatccccgtaagcacaagaggaaaccgctgggtgtgggatactccgcacgtaagtcaccattatacgacaactgtttcttgcatgctccagacgggcagccactgtgcacctgtgacagacgcaaagcccagtggtatttggataaggggatcggcgagctcgtctcagaagaaccgttcgtagtaaagcttcgtttcgagcccgccggccggcccgaatcaccaggtgattattacctgatggtcaaggagaacctctgcgtcgtatgcggtaaacgtgattcctacattcggaagaacgtgatacctcacgaatatcgaaaacactttcctattgagatgaaagatcacaactctcacgacgtcctgctgctgtgtactagctgccatgccatatccaactactacgacaaccacttgaagcagcagctcgccaaagagttccaggcgcccattgggtcagaagaaggcctgaggctcttggaagacccggagagaagacaggtccgctcgggagcaagagctctgctgaacgcagaatcacttccaacccagaggaaggaagaactgctgcaagcgctgcgggagttctacaacaccgacgttgttactgaagaaatgctgcaggaggctgcatcactggagactcggatcagtaatgaaaattatgttccccacggtctgaaagtagtgcagtgtcacagccagggcggactcagatccttgatgcagcttgagagccgctggcgccagcattttctcgattctatgcagccaaaacacttaccccaacaatggagcgtcgaccataatcatcagaaattgctgcgcaagttcggcgaagacttgcctatccagctttcctag

SEQ ID NO: 29514 - DNA, 1866 bp, Artificial Sequence
  Description of Artificial Sequence: Synthetic coding sequence
atgtcaagacaaaatttagtggctctcacagttactacacttttgggcgtagccgtcggagggttcgttctctggaagggcatacagcggcggaggcggtccaagacaagccctgttacccagcagcctcagcaaaaagtactcgggagcagagaactgccaccgcccgaggacgatcaactacacagtagcgccccccgctcatcctggaaggagcgaatcttgaaggcaaaagttgtaacggtaagccaggaggccgaatgggaccagatcgagcctctactgaggagcgagctggaagatttcccagtgctgggaatcgactgcgaatgggtgaatctggaaggcaaggcgagtccactaagtttgctgcagatggcctcgccctctggactgtgtgtgcttgtgcggctccctaaactgatatgtggcggaaaaaccctccccaggacgctccttgatatactggccgatggcaccattctgaaggtaggcgttgggtgtagcgaagacgccagcaagttgctacaggattacggactggtggtaagagggtgcctggacttgaggtacctggcaatgaggcagagaaataacctgctctgcaatggcctttcattgaagagcctcgctgagaccgtcctcaactttccactggataaaagcctccttctcaggtgctccaactgggatgcagagactctaactgaggaccaagtcatttacgctgctagagacgctcagatctcagtagcacttttcctccacctgctggggtatccattcagtcggaactctccaggcgaaaagaatgatgatcattcctcctggcgtaaggtgctagaaaagtgccagggcgtcgtggacattccattccgcagtaaaggaatgtcccgacttggcgaggaagtaaacggtgaggcaactgaaagtcagcaaaaaccaaggaacaagaagagcaaaatggatggtatggtgcccgggaatcatcagggccgggaccctaggaagcataaaagaaaacctttaggggtgggttattccgcgagaaagtcacctctgtacgataactgttttctgcatgcccctgatgggcagccgctctgtacctgcgataggcggaaagcccagtggtatctggacaaggggatcggcgagctagtgtcagaggaacccttcgtggttaagcttaggttcgagcccgctggacgtcccgagtcccccggagattactatttgatggtgaaagagaatctctgtgtggtgtgcgggaaacgggacagttacattaggaaaaacgtgatcccacacgagtataggaagcacttcccgattgagatgaaggatcacaattcccacgacgttttactgctttgtacctcatgccacgctattagcaattactatgacaatcacttaaagcagcagctggccaaggagtttcaagccccgattgggtcagaggaaggtttacgattgctggaggacccagagcgtcggcaggtgcgcagcggggcccgtgctcttttaaatgcggagagtctgcccacccagaggaaggaagaattactgcaggccctccgggaattttacaatactgacgttgtcaccgaagaaatgcttcaggaagccgcttctttggaaaccaggatctccaacgagaattatgtcccccatgggctgaaagtggtgcaatgtcactcccagggggggcttcggtcgctgatgcagctggagagccgatggaggcaacactttctcgattccatgcagccaaagcacctacctcagcagtggtcagtagatcacaatcatcagaaactgctgcgtaagttcggtgaggacttaccaattcagctgagttag

SEQ ID NO: 29515 - DNA, 1491 bp, Artificial Sequence
  Description of Artificial Sequence: Synthetic coding sequence
atggctagccctagcggattgtgtgtgctggtgcgactaccgaaactgatttgcggaggcaagaccctgcctcgcacgctcttggacatcctcgccgatggaaccatcctgaaagtgggtgtggggtgctctgaggacgcctctaagctactccaggattatggactcgtcgtacgggggtgcctcgacctgcggtacttggccatgcgccaacggaacaatttattgtgtaacgggctatcgctgaagagccttgccgagacagtgttaaactttcctctagacaagagcctgctcctgcggtgcagcaattgggatgcagaaactctgacagaagatcaggtcatctacgccgctagagacgcgcagatatctgtggctttatttttgcacctcctgggctacccgttctcgcggaactcaccaggcgagaaaaatgatgatcacagtagttggcgaaaagtgctggaaaaatgtcaaggggtggtggacattcccttccggtctaaaggaatgtcccgcctgggggaggaggttaacggagaagctaccgaatctcagcagaaacctcgcaacaagaagtccaaaatggatggcatggtccctgggaaccaccagggcagagacccaagaaaacacaagaggaagccattgggcgtcgggtactcagcacgcaaatcccctctctatgacaattgcttcctccatgcccctgacggccagccactgtgtacttgcgacagaagaaaggcacaatggtacctggataagggtattggggaactggtgtcagaagaacctttcgtggtgaagcttaggtttgaaccagctggtcggccagagtctccaggcgactattacttgatggtgaaggaaaacctgtgtgtagtgtgcgggaaacgtgatagctacatccgcaagaatgttatcccccatgagtatcggaagcactttcccatcgagatgaaagaccataactcacacgacgtcttacttctgtgcaccagctgccacgccataagcaactactatgataaccacctcaagcaacaactagcaaaggaatttcaagctccgatagggagtgaggaaggcctccgactgctggaagaccctgaacgtcgccaagtacggtcaggtgccagagccctgcttaacgctgagtccctgcccacgcagcgtaaagaagaattgcttcaggcgctcagagagttctacaatacagacgtggtcacagaggagatgctccaggaagccgcaagcttggagacacgcatttccaacgagaactacgtgcctcacggactcaaagttgtacaatgtcatagtcagggcggactccgatctcttatgcagctggaaagcagatggcgccagcacttcttagactccatgcagccgaaacacctccctcaacaatggagcgtggatcataatcaccagaagctcctcagaaagtttggagaggatctgcctatccaactgagttag

SEQ ID NO: 29516 - DNA, 1491 bp, Artificial Sequence
  Description of Artificial Sequence: Synthetic coding sequence
atggcatccccatccggattatgcgtactagtgcgcctgcccaaactcatttgcggcggcaaaacgctgccccgaactctgctggacatcctagctgatggaacaattctcaaagtgggtgtggggtgctctgaagacgctagcaaattgctgcaggactacggccttgtcgttaggggctgcctggatctgaggtatctcgccatgcgccagagaaacaacctgctttgtaatggcctttcccttaaatctcttgcggagaccgtcctgaacttccctctcgacaagagtctgctgctaaggtgcagtaactgggacgccgagacactcaccgaggaccaggttatatatgccgcaagagatgcccaaatttccgtggctctgttcctccatctgctgggataccctttctcccggaactccccaggtgaaaagaatgatgatcacagcagctggaggaaagtcctggaaaagtgtcagggggtggtcgacattcctttccgatcaaagggcatgtctcggctgggagaagaagtgaacggcgaggctacagagtctcagcagaagcccagaaataagaaatccaagatggacggcatggtgcctgggaaccaccagggtagagatcccaggaaacacaaacgtaaaccgctgggtgtgggttattctgcacgcaaaagtcctttatatgataactgtttcctccacgctccggatggccagcccctgtgcacatgcgacagacggaaagcgcagtggtacttggacaaagggatcggagagttggtttcagaggaacccttcgttgtgaagcttagattcgaaccagcaggtcgcccagagagccccggcgactactacttaatggtcaaggagaacctgtgcgtagtttgcgggaaacgtgactcctacatccgtaagaacgtgatcccacatgaatacagaaaacactttcctatagagatgaaagaccataattcccacgacgtcctcctgttgtgtacctcctgccacgcaatctctaattattatgacaaccacctgaaacagcaactagccaaagagttccaggcccccataggctcagaagaggggttaagattactggaagacccggagagacgacaagtccgctcaggggcaagagctttacttaatgcagagtccctgcctacccaaagaaaagaggaactgctgcaggctctgcgcgagttttacaataccgacgtggtcaccgaggagatgcttcaggaagccgcgtcgctggaaacacggattagtaacgagaactatgtcccacacggactgaaggtggtgcagtgtcattcccagggtgggctgagatccctcatgcagctggagagccgttggagacagcattttctggattccatgcagccaaagcatctaccacagcagtggagcgttgaccacaatcatcagaaattgctgcgtaagttcggggaggacttacccattcagctcagctag

SEQ ID NO: 29517 - DNA, 1491 bp, Artificial Sequence
  Description of Artificial Sequence: Synthetic coding sequence
atggcctcgcctagcggtctgtgcgtactcgtccggcttcccaaactgatctgtggcggcaaaaccctgcccagaaccctgctggacatcctggcggacggcacgatactaaaggtgggagtgggttgcagtgaggacgcctccaagctcctccaagattatgggcttgtagtccgggggtgtttggaccttaggtatctagcaatgaggcagcggaacaatctgctgtgtaacggattgtctcttaaaagcttggcagaaactgttctgaattttccactggataagtctctcctgctgcgttgtagcaattgggacgcagagaccctgactgaagaccaagtcatctacgctgctagagacgctcagatcagtgtggctctgttccttcaccttctcgggtaccccttttcccggaacagcccaggcgagaaaaacgatgatcattcttcgtggagaaaagttctggaaaagtgccaaggtgtggtggacatcccatttagaagtaagggcatgagtaggctgggggaggaggtgaatggagaagctacagaaagccagcagaaaccacgcaataagaagagcaagatggacggcatggtaccagggaaccaccaggggcgtgatcccaggaaacacaagagaaagcctttgggtgttggctacagcgcgagaaagtcgcctctttatgacaactgttttctccacgcccccgatggtcagcccctctgcacgtgcgaccggaggaaggcccaatggtacctggataagggaattggtgagctggtatcagaagaaccattcgtggtgaaactgcgtttcgaaccagctggccggccagaaagtccaggagattattacctgatggtgaaagaaaacctgtgcgtcgtgtgcggcaaaagggacagctatataaggaagaatgttatccctcatgagtatcggaagcactttcccatcgagatgaaggatcacaatagtcatgatgtgttgcttctgtgtacatcctgccacgccattagtaactactatgataatcatctgaaacagcaacttgctaaagagtttcaggcccccataggtagcgaagagggcttacgactgttagaggatccagaacggaggcaggtgcgctctggagcccgtgctctgctgaacgcagagagtttgcctactcaacggaaggaggaacttttgcaagctctgagagagttctacaataccgatgtggtcacggaggaaatgctccaggaagcggcctccctggaaactcgaatttcaaatgagaattacgtgccccacgggctgaaagtggtccagtgtcacagccaggggggactccgatccttgatgcagctggaaagccgatggagacagcatttcctcgacagtatgcaaccaaaacacttgccgcagcagtggtctgtcgaccacaatcaccaaaagctgctgcgaaaattcggagaagatctccctatccagttgtcctag

SEQ ID NO: 29518 - DNA, 345 bp, Artificial Sequence
  Description of Artificial Sequence: Synthetic coding sequence
atggcctctcctagtggcctttgcgttctcgtaaggctgccgaagctcatctgcgggggaaaaacactacctcgcacactgctggatattttagctgatggcactattctgaaagtgggagtagggtgtagcgaagacgcatctaaactcctgcaggattacggcctagttgtgagaggttgcctggatcttagatatctggcaatgcgccagcggaataacttgctgtgcaacggtttgagtttaaaatcactggctgagacagtattgaatttcccgttggataagtctctactgcttcgttgctccaactgggacgcagaaaccctgaccgaggaccagtag

SEQ ID NO: 29519 - DNA, 1491 bp, Artificial Sequence
  Description of Artificial Sequence: Synthetic coding sequence
atggcctccccctctggcctctgtgtcctcgtcaggcttccgaagctgatttgcggagggaagacacttcctcggacactcttagatattctagctgacggcactattctgaaggtgggtgtagggtgcagtgaagacgcttccaagctgctgcaagactacgggctggtggtgcggggttgcctggaccttcgctatctagctatgcgccagaggaacaatcttctctgcaacggactttcccttaaatccttggctgagacagtcctgaactttcccttagataagagtctgctcttaagatgctcaaactgggatgctgagactctgaccgaagatcaggtcatctacgccgcgcgtgacgcgcagatttctgtggcactgtttctccacttgctgggctatccttttagcaggaattccccaggcgagaagaatgacgaccactcatcctggcgcaaagtactcgaaaagtgccagggcgtggtcgacattcctttcaggtccaagggcatgagcagactgggggaagaagtgaacggcgaggccacggagagccagcagaagccaagaaacaaaaagtcgaaaatggacgggatggtgccaggcaaccaccagggtagagacccgcgcaaacacaagcggaagcctctgggagtcgggtatagcgccaggaaaagccccttatacgataactgctttctgcacgcccctgacgggcagccattgtgcacgtgtgatcggagaaaagcccaatggtacctggataagggaattggggaacttgtgagcgaggagccttttgtcgttaagttgaggttcgaaccggctggtcggccggagagccctggtgattactacctgatggtcaaggagaacctgtgtgtggtttgtggcaaaagggactcttatataagaaaaaatgtcatcccgcatgaataccgtaagcactttccaattgagatgaaggaccacaattctcacgacgtactgcttctgtgcacatcatgtcacgcgattagcaattattatgataatcacctgaaacagcaacttgcaaaggagttccaggctcccatcgggagtgaagagggtctgcggctcctggaggatccagagcggcggcaagtccgcagtggggccagggccctgctcaatgctgagagcctgccaacccaaaggaaagaggagctcctccaggcgctgcgcgagttctataacacagacgtcgtaaccgaggaaatgctgcaggaggctgcttcactggaaacgcgaataagcaatgagaattatgtgcctcacggattgaaagttgtgcagtgccactcacagggcggcctgcggagcctcatgcagctggaaagtaggtggcgtcagcatttcctcgacagcatgcagcccaaacacctgccacagcaatggagtgtcgatcacaaccaccagaagctcttacgtaaatttggggaggacctgcctatccagctgtcttag

SEQ ID NO: 29520 - DNA, 2631 bp, Artificial Sequence
  Description of Artificial Sequence: Synthetic coding sequence
atggacccgggggatccagccggagacccagctgctggagaaagacatcggatgggcagggatccactcctcttgctgcaggcactgcaaaccttgtggagtactcgagaacgcaagcagttgcgtgaagaagcttggagaggattcgcggccttagatgatccattagcaggccttctggatatgctggaatcatgtcgaggccagcgcggggaagggccgtcactcgccgcatggatttcacaccagttgcaatgctggttgcaggctcagccttgcccctccctggctcagcattcattaaggctcaaacagctacaggcccgcgccgtgaaggtgcttacagaatcacctcccagccttgccgctcccctcgcctcaatctttcagttgcaggacgctgataggagctgcctgttggcccacgttcatagacttcaccatgaaggtcgtttcagagaagcagccacgttgggggccacgctgaagctccaatccgagctaggcgtggagaagatgagtattcccctcctgctgcaggacaaggtcgctttggtggagcgctacgttgccggttttccagatctccagaggaggctgctggtcctgatggattcctggtgccagccaggttttgatataaaggacgtggcacgcagatatcctgaggtgaccagcctgtctctggaaaagctaagccctaaggccctctctcggcaggtgctccgcctccaggagcggtatggggtcgccccagccctttgtcccaatgcagctatccagcagaggttggcggccctgagacatttgtgtcacaaaaggtttgtggaaaagagtctatcccaggagaattggaccgaccacgttcaggggttagtcggacagagcccctggctgcaggagcagctctctcagctgcttgtgtctcacagcgaccctgtaacagcagcacaatgcgcgatggaacttctcctgcctgaagagagattacctgccgctgttgcggtggaactccgcaggtttcgcctgcagggtagagctaccgaggcagactctagactggaggttaaggatatgaaggatcgatattatcagcttccgatcccgcgagagaatgtccatctgttagcaagttgggaggacctgactaggcacgagggcgcccttctgcagtgtcatcaggtggtaggggtcgacgtggaatggaccccagttttcgtcgccggcggtcggccgcggccttcactcttacaagtagccgtggaggggcacgtcttcctgcttgatgttctggccctctcccagccaccaactggccagggcgcccaggcattcagccgtttggtggcacaacttctgagcgatccctccattaccaagctgggttacggcatggttggggacctgcagaagctgggcacgagctgtcccgctctggctcacgtggagaaacagatcttaggcggcatggacctcttgctcgtgcatcggcagatgcgcgtggccagcgttcccgccccagccgtggatcgtgcccgcgagctgagagggctttccctgcttgtacagcaggtcctgggtaccgcactcgataagacacagcagctatccaattgggaccggcggcccctgtgcgaagaacaggtgatctacgccgcagccgatgcttactgtcttttggaggtccaccaggccctctgcagagagccagccagatttcatctgagcgaggatctggccggttctaggcggccccggcacagagagcggcccggagctaggaagcctccaggactgcagaaagctagtgcccctgccgcgcctcgccaggttcctgtcgccgtggccgtcagcgagggcgcggcacctcaaatcccagccagggcctttcgggtggtatgtgataacatgctgcaggggctggcccgttccctcaggtgcttgggtgtggacgcgagaatgctcggtaatggagaggaccaccgtcgagccgcagaagtggctcgccaagaggggcggatcatcttgacctctgggcagcccttccacaaactcagggcccaggtgggagctggacggtgcctatcggttgactgcagcctgaaggctcaacagcaggcgaaagccgtccttaagcatttcaatgtgagggttacccatgctgatatttttagtagatgtcaggcctgtaattgcgatcagtacctgaaggttagccgagatatgatgaagcaactcatgtggctgagcagccaccaggagggacctaggagctccggtgatgaggccactcagagccaggctgtacaagagcctggacccgcacccgatgctgcgcctgaggggtgtacctatgaccggccatgtagatggctgcagatggccgatctgagagctgaaacacccgacatgttggcagacggaacacgactgcaactagccggggtgcctgtcggtgtgctgcggacccccgggcttcgttgcttttactgctgcacaggctgcggcaaggtgttctgggacggaagtcacttgggacgcgtggccactcatttccgcgatatgctggaaagtgccccctccccctgtgagccctccccagccccttcaccagctagctctcccttttag

SEQ ID NO: 29521 - DNA, 1545 bp, Artificial Sequence
  Description of Artificial Sequence: Synthetic coding sequence
atggagctcttgctgcccgaggagagattaccagctgcagttgcagtggaattgcgccggttcaggctgcagggacgcgccaccgaagcggactctcgcctagaagtgaaggatatgaaagatcggtactatcagttgccaattcctcgcgaaaacgttcacctgctggctagctgggaggacctgacgcgacatgaaggagctttactgcagtgccaccaggtagtgggtgttgacgttgagtggacccctgtgtttgtggctggcggtcgccctcgcccgagcttattacaggtggccgtcgagggacatgtattcctgcttgatgtcctcgctctgagccagccacctaccgggcaaggcgctcaggccttcagcagactggtcgcacaactcctttcggaccctagcattacaaagctcggatatggcatggttggggaccttcaaaaattagggactagctgtcctgcattagcccatgtggagaaacaaattctgggggggatggatctcctgttagttcatcggcagatgagagtcgcttcagtacctgcaccagccgtcgacagggcacgggagcttcgagggttgagtctactggtccagcaggttctgggcactgccctagataagacccaacagctgtctaattgggaccggcgaccactttgtgaagagcaggtgatctacgccgcggccgatgcgtactgtctgttggaagtgcatcaagctctatgccgggagccagctaggtttcacttatccgaggacttggccggctctcgaagaccgaggcaccgcgagcgacccggcgctcgaaaaccccccggtttgcaaaaagcatctgcacctgctgcaccacgccaggggctcgcccgttcgctacggtgtctgggagtggacgcaaggatgctgggtaatggggaggatcaccggcgagcagccgaggtggctcggcaagagggccgaattattctgacctccgggcagccctttcacaagctacgcgcccaggttggagccggtagatgtctgagtgtggattgttccttaaaagcccaacaacaagcaaaggctgtgctgaagcactttaatgtccgcgtgacccatgctgacatattctcccgttgtcaagcatgtaattgtgatcagtatctaaaagttagcagagacatgatgaagcagctgatgtggctgtcaagccatcaggaaggaccacgcagcagcggcccagccccagacgccgcaccggagggttgcacttacgatagaccctgcaggtggctccagatggccgacttacgcgcagaaacccccgacatgctcgctgacggcactagactgcaacttgccggagtgccggtgggcgtgctgcgaacccccggtctaagatgtttctattgttgcaccggctgcgggaaagtgttctgggatggatcgcacctgggcagagtcgcaacgcatttccgcgacatgctggagtctgcgccaagtccttgtgagccgtcacctgctccatcacccgctagttctcctttttag

SEQ ID NO: 29522 - DNA, 2682 bp, Artificial Sequence
  Description of Artificial Sequence: Synthetic coding sequence
atgacaccgccctcacgcgcagaggcaggggtacgccgtagtagagttccctcagaagggagatggagaggagccgaacccccgggcatatccgcaagtacccagcctgctagtgcgggacgcgccgcaagacattgcggcgcgatgtccggtgccagaggtgagggcccagaggccggagccgggggagccggggggagagccgcccctgagaatccaggaggggtgctgagtgtcgaattgcctgggttgttagcgcagctcgcaagaagcttcgctttgctgctgcctgtctacgcgttgggctacctgggactgtctttctcctgggtgctgctcgctttggctctgctcgcctggtgccggcgatcccgtgggctcaaggccctccgtctctgtcgtgccttggcattactagaggatgaggagcgcgtcgttcgcctaggagtgagagcctgcgacttgccggcttgggtgcactttccggacacagaaagggcggagtggctcaataagactgtgaaacatatgtggccttttatctgtcagtttattgagaagctcttcagggagaccatcgagccggcagtgaggggcgcgaatacacacctgtcaaccttcagttttacgaaagtggatgtcggccagcagcccttacgcataaacggtgtcaaagtttatacagaaaacgtggataagaggcaaatcattctcgatctccaaattagttttgtgggcaactgcgaaattgacctcgagatcaagcgatatttttgccgcgccggagtaaaatcgatccaaattcatggaaccatgcgggtgatactggagcccttgattggggacatgcctctggtgggagctctgtctattttcttcctgcgtaagccactcctcgagatcaactggacaggcttaacaaacctgcttgatgtaccagggcttaatggactgagtgacactataatccttgatatcatcagcaactatttggtgttacctaaccggataaccgttcccctggtgtctgaggtgcaaattgcccaactcagattcccggttcccaaaggcgtgctgcgaattcacttcattgaggcccaggacctgcaggggaaggatacctatctgaaaggactggtgaagggcaagtctgacccgtacggtattattcgggttggtaatcagatctttcagagtagagtcatcaaagaaaacttgtcccccaaatggaacgaggtgtatgaggctttggtctatgagcacccagggcaagagctagaaatcgaactgttcgacgaagaccccgacaaggacgactttctaggcagcctgatgattgacctgatcgaagtggagaaggaacgcctgctagacgaatggttcaccctggacgaggtccccaaaggcaagttgcatctgagactggagtggctcaccctgatgccaaacgcttctaacctggataaagttctgactgacattaaagctgataaagaccaggccaatgatggcctgagctctgctctcctgatcctctatctggatagcgcacgaaatttacctagcgggaaaaagataagcagcaatcctaatcctgttgtgcagatgagcgtggggcataaggcccaagaatccaagatccggtataaaacaaatgagcccgtctgggaggagaacttcaccttttttatccacaatccaaaacgccaggacctcgaagtcgaagttcgggatgaacagcaccaatgtagtctgggaaatttgaaggtcccactttcacaattgctgaccagcgaggacatgactgtgagccagaggtttcaactgagcaactctggtcctaacagcacaatcaagatgaagatcgccctacgggtgcttcacctcgagaagagggagaggccccctgatcaccagcatagtgcccaggtcaagcggccatccgtctcaaaagaagggcgcaagaccagtattaagagtcacatgagcggatcacctggacctggcggtagtaacaccgcaccatcaacccctgtgatcgggggctctgataaacctggtatggaagagaaggctcaaccacccgaggccggtccccagggcctgcatgacctcggacgctcttcctcctcacttctggcatcccctggacacatcagcgtaaaagaacccacccccagcatcgctagcgatatttccctgccaattgcaactcaagaactccgacagcggcttaggcagctcgaaaacggtacaacattagggcagtctcccctcgggcagatccaattaacaattaggcattcctcccagcggaacaaactcatagtagtggtccacgcctgccgtaatctgatcgcatttagtgaagacggctcggatccttatgtgcggatgtatctcctgccggacaaacgcagatctgggcgaagaaagactcacgtgagcaagaagactttaaatcccgtcttcgaccaatcattcgattttagcgtctctctcccggaagttcaacgcaggaccctggatgtggctgtaaagaatagcggtggctttctatctaaggataaaggactgctgggaaaggttctcgtagctctggcctctgaggagctcgctaagggctggacgcaatggtacgacctgaccgaagacggcacaagaccacaggccatgacctag

SEQ ID NO: 29523 - DNA, 672 bp, Artificial Sequence
  Description of Artificial Sequence: Synthetic coding sequence
atgcctgttttcccgccctgtgtgctgcaagttcgagatgagcaacaccaatgctcccttggcaatttaaaggtgcctctcagtcagcttctgacatccgaggatatgacagtatcacagcgcttccagctaagcaacagtgggccaaactcgaccatcaaaatgaagatcgctctcagggtgctgcacctggagaagcgagagcggcctccagatcaccagcactcagctcaggtgaaacgtccgtctgtttctaaagagggacgcaagacttcaattaagagccatatgtcgggcagccccggccccgggggcagtaacaccgctccctctactcccgtgattggcggcagtgataagccagggatggaagagaaagctcagccacctgaggcggggccccagggtcttcatgacctcggccgatcttcttcgagcttgctggctagtcctggccacatctccgtcaaagagccaacgccatcaattgctagcgatatcagtctccccatcgctacacaagagctcagacagaggctgagacagctagaaaatggaacaacattggggcagtcaccattagggcagattcagctaaccattagacattcctcacagaaacaagcttatcgagggcgtgcatgtctgcaaaagccccactgcctgctatag

SEQ ID NO: 29524 - DNA, 2829 bp, Artificial Sequence
  Description of Artificial Sequence: Synthetic coding sequence
atgactgcaaacagggacgctgcactgtcatcccaccggcaccctggttgtgcgcagcgtcctcgtacacctactttcgctagcagctcacagcgacggtccgctttcggatttgatgacgggaatttcccaggtctgggcgaacgcagccacgccccggggtcaagattgggcgcgcggcggagagctaaaactgccagagggctccgcggtcatcgacaaagaggcgccggcgctgggctgtctcgccctggttcggctcgggccccctctccccccaggccgggtgctccagaaaacccaggaggcgtgctgtccgttgaactgcctggcctccttgcccaactggctcgcagctttgctctgctgttaccagtttatgccctcggctacctgggattgagcttcagctgggtgctgttggccctggccctgctggcttggtgtcggaggtcacgcggactgaaggccctgaggctgtgccgtgcactggccttgctggaagacgaagaacgtgtcgtccggttaggggtaagagcttgtgatctgcccgcctgggtgcacttccccgatacagagagagcagaatggttgaataagactgtgaagcacatgtggcccttcatctgccagttcatcgagaaactattccgggagaccattgagcctgccgtgcggggcgctaatactcaccttagcaccttctcattcacaaaggttgacgtgggacagcagccacttagaattaacggggtgaaagtgtacaccgagaatgtggacaagcggcagattatcttggaccttcagatttcctttgtgggaaattgcgaaattgaccttgagattaagaggtacttctgtagggcgggcgtgaagtcgattcaaattcacggtacaatgcgggtcattttagagcctctgataggagatatgccgctcgtaggggctttatcaatctttttcctgaggaagcctcttttagagatcaattggactggattaaccaacctcctggatgttcctggcctgaacggtctttctgacacaatcatactggatataatttccaactacctggtcctgccaaatcgcatcactgttcctctggtgtcagaagtccagattgcccagcttcggttcccggttccaaagggtgtactgagaatccacttcattgaagctcaggatcttcagggcaaagatacatatcttaaaggtcttgtaaagggtaagagtgatccgtatgggatcatccgcgtgggcaaccaaatctttcagtcacgtgttattaaggagaatctctcgcctaaatggaacgaagtgtatgaggccctggtgtacgaacatcccgggcaggagttggaaatcgagctatttgatgaagaccctgacaaggacgactttctgggcagcctgatgatcgatttaatcgaggttgagaaagagagattgctggacgagtggttcaccctagacgaagtccctaaagggaaactgcaccttaggttagagtggctcacactcatgccaaatgcctcaaaccttgataaagttcttaccgacataaaagccgataaagaccaggctaacgacgggctatccagtgctctgctgatcttgtatctcgacagcgccagaaatctcccttcaaacccactggagttcaacccagatgtactaaaaaagacagctgtgcagcgtgctttaaaatctgggaaaaaaatcagttccaacccaaacccagtggtgcagatgagtgtgggccacaaagcccaggagagcaagatccggtacaaaacgaacgagcccgtgtgggaagagaatttcaccttcttcatccacaacccgaaaaggcaagacctggaggtcgaagtcagggatgaacagcaccagtgctccctaggcaatctaaaagtgcccttatcccaactactcacaagcgaggacatgacggtgagccaacgcttccagctgtctaacagcggccctaacagcaccatcaagatgaagatcgcactgcgtgtgctacatttggagaagcgcgagcggcctcccgaccatcagcacagcgcccaagtgaaacgaccctctgtgtctaaagaaggccgcaagacatccatcaagtcccacatgagtggctctcctggcccaggggggtcaaacacagccccatctacacccgttatcggtggatctgacaaacccggaatggaggagaaggctcagcctccagaagccggtcctcaggggctccatgatctggggaggtcttcgagctctctgctggcctcccctgggcacatctctgttaaggaacccactccttctattgcttcggacatttccctcccgatagctacgcaggagcttaggcagagactccgacagctggagaatggaaccaccctggggcagtctcccctcggccagatccaattgaccattcgacatagttcccagaggaacaagttgattgtagtggtccatgcctgtagaaatctgatcgcattcagcgaagatggatccgacccctatgttaggatgtacctgttgcctgacaagcgccgaagcgggagaaggaagactcacgtcagcaagaagacactgaatccggtgtttgatcagtcatttgacttcagcgtctcattgcctgaggtgcaacggcgaactctcgatgtggcagtaaaaaattctggcggctttctttctaaagataaaggcctattggggaaagtactagtcgccctggcctcggaagaacttgcgaaagggtggactcaatggtatgacctcacagaagacggtaccaggccacaggccatgacctag

SEQ ID NO: 29525 - DNA, 1584 bp, Artificial Sequence
  Description of Artificial Sequence: Synthetic coding sequence
atgtggcccttcatctgtcaatttattgagaagctgtttcgggagacaattgaacccgctgttagaggcgctaatacccacctgtcaaccttttcattcactaaagttgacgtgggacagcaacctctgcgaatcaatggcgtgaaggtgtacacagagaatgtcgataagcgtcagatcatactcgacctccagattagctttgtcggaaattgtgaaatcgatctggagattaagcggtatttctgtcgcgccggcgtgaagtctatacagatccacggcaccatgagagtcatactcgagccgctcattggggatatgcccttggtaggagcactgtccatctttttcttaaggaaaccactattggagataaattggacaggcctcactaaccttctggacgttccaggcctaaacgggctctcggacactataatcctggatatcatctccaactacctagtcctacctaaccggattaccgtgcctctggtctcagaggttcaaattgctcagctccgttttcccgttcccaaaggggtcttgaggatccactttatagaggcccaggacctgcaaggtaaagacacctacttgaagggtctcgtgaaaggtaagagcgatccttacggcattattcgcgtgggaaaccaaattttccagtctcgtgtgatcaaagagaatttgtccccgaaatggaatgaagtgtatgaagccctcgtgtacgaacacccagggcaggaacttgagatcgaactgttcgatgaggatccagataaggatgacttcctgggatctctaatgatcgatctcatagaggtggagaaagagaggctcctcgatgagtggtttacactggatgaggtccccaaggggaaactgcacctgaggcttgagtggctgaccttaatgccaaatgcttcaaacctcgacaaggtcctgactgacattaaagctgacaaggaccaagccaatgacggtctcagctccgctctgctgattctctatttggacagtgctcgaaatctgcccagcggcaagaagataagcagtaaccccaatcccgtcgtgcagatgagtgtggggcacaaggcacaggaaagcaaaatcaggtataagaccaacgagcccgtctgggaagagaactttacattttttatccacaaccccaagcggcaggatttggaagtggaggtaagggatgagcagcaccagtgttcacttggtaatctgaaggtgccattgagtcagcttttgacatcagaagacatgaccgtcagccagcggtttcagctctccaattccggccctaactccaccatcaaaatgaaaatagccttaagagttctacatctggagaaacgcgagcgaccaccggaccaccaacactccgcccaggtgaagcgcccaagtgtgtcaaaagaaggacgaaaaacctccatcaaaagtcacatgtccggctccccagggcccgggggaagcaacacagcccctgcaacctcccagtcaaggtcaagacctcctgcatctccccggacctcccgttgccctagccccccccgatcttgtggtaagggctag

SEQ ID NO: 29526 - DNA, 987 bp, Artificial Sequence
  Description of Artificial Sequence: Synthetic coding sequence
atgcctgtgttcccaccttgcgtactgcaagtccgcgacgagcagcatcagtgttccctgggtaatttaaaagttcccctttctcagctgttgacttcagaggatatgacagtctctcaaagatttcaactttcaaatagcggcccaaatagtacgattaagatgaaaatagccctaagggtcctgcacctcgagaagagagaaaggccaccagaccaccagcatagtgctcaggtaaagcgaccatctgtgtcaaaagaagggagaaaaacttccataaaatcccacatgtccggcagccctggaccgggtggctccaacacggcccctagcaccccagtcatcggaggctccgacaagccaggcatggaagaaaaggctcaacctcctgaagcgggccctcaaggcctccatgacctaggtaggagcagttcatctctgctagcgtcgccgggccatattagtgtgaaggagccaaccccatccattgcttctgacatctccttaccaatcgccacccaggagttacgacaacgtctgcggcagctggagaatggcactacacttggtcagtcacctcttggacagatccagttgacaataaggcattcttcccagcggaataagttaatagtcgtggtacacgcctgccggaatctaatcgctttctcagaggatggatcagatccatacgtgcgcatgtacctcctgcctgacaaacgccgaagcggtcggcgcaagactcatgtgagtaaaaaaactctgaatcccgtcttcgatcaatccttcgacttcagcgtgagcctgccagaggtccagaggagaaccctggatgtggccgttaaaaacagcggcgggttcctgagtaaggataagggtttgctaggcaaggtgctggtcgccctggcttccgaagaattagccaagggttggacacaatggtacgacctgacagaggacggcacgcgtccacaggcgatgacatag

SEQ ID NO: 29527 - DNA, 2487 bp, Artificial Sequence
  Description of Artificial Sequence: Synthetic coding sequence
atggcaggccgcgggtggggcgccctatgggtgtgcgtcgccgctgctactcttttgcacgcaggcggattagccagagctgattgttggctcatcgagggcgataagggattcgtctggctggccatttgttcacaaaaccagcctccttacgaggcaattccccaacagataaatagcaccattgtggacctccgtctcaacgaaaacagaatccggagcgtacagtatgccagtctgtcaaggtttggaaacctcacttatctgaacctgactaagaacgagattggctacatcgaggatggggcttttagcggtcagttcaaccttcaggttctacagctggggtacaaccggctgcgcaacctcactgaagggatgctgcgagggctgggcaagttagaatacctctaccttcaggcaaatctgatcgaggtggtgatggcaagttccttctgggaatgccctaacattgtgaacattgacctgagcatgaacaggattcagcagttgaacagcggtaccttcgctggcctggccaaactgtccgtgtgcgaactatactccaatcccttttactgctcctgtgagcttctgggcttcctccggtggttagccgcgtttacaaacgctacacagacctatgacaggatgcagtgtgagtctccgcccgtatattctgggtactacctcctagggcagggcaggcgcgggcatagatccattttgagcaagctgcaaagcgtgtgtaccgaagactcatacgcagctgaagtggtgggcccaccgcgacccgcctccggcagatcgcaacccgggcgctcgccaccccctcctcctccgcccgaaccgagcgacatgccttgcgctgatgacgagtgctttagtggcgatggaactaccccacttgtcgcacttccaactctggcaacccaggctgaggcaagacctttaattaaggtcaaacagctcactcagaattctgctacaataacagtgcaacttccctcaccctttcatcgaatgtacaccctggagcacttcaataactctaaggccagcacagtcagcagactcaccaaagcacaggaagaaatcagactgacaaatctgtttacactgaccaattacacgtactgtgtcgtaagtacgtctgccggcttaagacataatcatacttgtctgacaatttgtctccccaggctcccaagcccccctggcccagtgcctagcccaagcacagcaactcattacattatgacgatcttggggtgcttgtttgggatggtcctggtcttaggcgcagtgtactattgcctgcgtagaagacggagacaggaggaaaagcataagaaggcggcctcagccgccgctgccgggagcttaaagaaaaccataatagagctcaaatatggtcccgaacttgaagcccccgggctggcaccactctcgcagggcccactcctggggcccgaggccgttacccgaatcccttacctaccagctgccggggaggttgaacagtataaactggtagagagtgccgacactcctaaggcttcgaaaggatcgtatatggaagtgaggaccggtgatcctcccgaacgccgcgactgtgagctgggtcgccctgggcctgactcacaatccagtgtggccgagatatctaccatagccaaagaagtagataaggtcaatcagattataaataactgcattgacgctctgaaatctgaatccacttcttttcagggagtgaaaagcggcccggtgtctgtcgctgaacctcccttggtacttctttccgagcctctcgctgcgaaacatggcttcttggcacccgggtacaaggatgcatttggccatagcctgcagcggcatcattctgtggaggcggctggaccgcccagggcctccacatccagttcagggagcgtccggagcccaagagcttttcgcgcagaagctgtgggagtacacaaggccgccgccgctgaagccaaatacattgagaagggaagcccagccgcggatgcaatcttgaccgtcacaccagcagcagctgtattacgggctgaagccgagaagggacgccagtacggagagcacaggcactcatacccggggtcacaccccgccgagccccccgccccccccgggcctcccccccccccacctcatgaggggctgggacggaaggcttctatccttgaaccgctgaccagacctagaccacgggaccttgcctacagccaacttagtcctcaataccactccctgtcatactccagttctccagagtatacctgtagagcctcacaaagtatttgggagcggtttagactaagtagacgccggcataaagaagaggaggagtttatggccgccgggcacgcgctgcgcaagaaggttcagtttgctaaagacgaggatttacacgacatccttgattactggaaaggcgtatccgctcaacataagagttag

SEQ ID NO: 29528 - DNA, 2487 bp, Artificial Sequence
  Description of Artificial Sequence: Synthetic coding sequence
atggccggtagaggatggggtgccctgtgggtatgtgtcgctgccgccacactactccatgcaggcgggctcgcccgggccgactgctggctgattgaaggggacaaaggcttcgtgtggcttgccatttgtagtcagaatcagccaccctacgaggctatcccccagcagataaactcaacaatcgtcgatcttcggctgaacgaaaatcggattcgaagcgtgcagtatgcctcgctcagccgctttggaaacctgacctatcttaacctcaccaaaaacgaaattggctatattgaggacggcgccttttcaggtcagtttaatctccaggtgcttcagttgggatataaccgattgcgcaatctcaccgaggggatgttaagaggactgggcaaactcgagtatctgtacctgcaggcaaatctcattgaagtagtgatggcctcatctttctgggaatgtccaaatattgtcaacattgatctctctatgaaccgcattcaacaacttaattccggaaccttcgccggtctagctaagcttagcgtctgtgagctgtacagcaaccccttttattgtagttgtgaactcctggggttcctgcggtggctcgccgcctttacgaacgctacacagacctacgatcgcatgcagtgcgaatccccgccggtttactctggctactacctactggggcaaggacgtagaggccatagaagcattctctcaaaactccaaagcgtgtgtactgaagactcctacgcagctgaggtagtcgggccccctcgccccgctagtggtcggtcgcagccaggaagaagtccgccaccccctccccctccggagccgtccgatatgccttgtgccgacgatgagtgttttagcggggacggaaccacacccctggtcgcgctgcctaccctagctacccaggctgaagccagacccctgatcaaagtcaagcagctgactcagaatagtgccaccataactgtacagctcccctcaccatttcaccgcatgtacactttagagcacttcaataatagcaaagcctccactgtgtcccgtctgaccaaagctcaggaggaaatacggctaactaatctttttacactaaccaactacacgtattgcgtcgtgtctacgagtgccggactgcgccataaccacacgtgcctgacgatttgtctcccccggctgcccagcccccccggtccggtgccttctcctagtactgccacccattatatcatgaccatcctcggatgtctgttcgggatggtgttagtcctgggagccgtgtattattgtctccgcagacgtaggagacaggaagaaaaacataagaaagccgcctctgccgccgctgctgggtccttgaagaagactattatcgagcttaagtacggaccagaacttgaggccccagggctggcgccactgtcacaaggtcctctactcggccctgaagccgtcacgcgcatcccctacctgcctgctgccggtgaagtcgaacaatacaaactagtcgagagcgccgacacgcctaaagcgtccaaaggaagttacatggaggtcaggaccggagaccctccggagcgacgcgattgtgaactgggtaggcctggaccagactcccagtcctctgtagcagaaattagtactattgcaaaagaggtggataaggtaaatcaaataatcaataattgcatagatgcactgaaatccgagtccacctcgtttcagggggtgaagtccggacccgttagcgtagccgaacccccactcgtgctgttatccgaacccttggctgcaaagcatggtttcttggcccctgggtataaggacgcattcggtcacagtctgcagagacatcattctgtggaggccgctggtcctcccagagcctctacctcctcctcaggtagcgtcagatcgccaagggcctttagggccgaggcggtcggggttcacaaggccgccgcagcagaggcgaaatacattgaaaagggaagccctgccgccgatgccattctcacagtgacacctgcagccgccgttctccgagccgaggccgaaaaggggaggcagtacggagagcatagacatagttacccaggatcccatccagctgagccgccagccccccctggccctcctcctcctcctccccatgagggacttgggagaaaagcatctatccttgagccgttgacccgccctcgaccgcgggatctggcctactcgcagctaagcccgcaatatcattcactgagttattcgtctagccctgaatatacatgccgggccagtcaatctatctgggaacgctttcgactttcacggcgccggcataaagaagaagaggaatttatggcggccggtcacgccctgcggaaaaaggtacagttcgcgaaagacgaggaccttcatgatatactggattactggaaaggcgtgtccgcacagcataagagttag

SEQ ID NO: 29529 - DNA, 495 bp, Artificial Sequence
  Description of Artificial Sequence: Synthetic coding sequence
atgctgcagcaggattccaacgatgataccgaagacgttagtctttttgacgcagaggaggagactactaacagacctcggaaggcaaagatacgccatcctgtagcttctttcttccacctcttcttcagggtgtccgccattatagtttgcctcctgtgcgaactgttatcctcatctttcatcacatgtatggtgacaataatcctgttgctgtcttgcgatttctgggctgtgaaaaacgtgaccggacggctgatggtgggacttaggtggtggaatcacatagatgaagacgggaaatctcactgggtcttcgaaagcagaaaagaatcctcacaggaaaacaagaccgtctctgaagcagaatccagaatattttggctaggtctaattgcttgctctgtcctatgggtaatctttgcattcagtgcgttgttttcattcaccgtgaagtggttggaaagtgagcccgtcatgttgagaaaccagtag

SEQ ID NO: 29530 - DNA, 534 bp, Artificial Sequence
  Description of Artificial Sequence: Synthetic coding sequence
atgtcagtgaatatggatgaactcaagcaccaagtcatgattaatcagtttgtgctgacagctggctgcgctgccgaccaggctaagcagctgctacaggccgcccattggcagttcgaaaccgctctctccgcctttttccaggagaccaatatcccctactcccatcatcatcaccagatgatgtgtactcctgcaaacactcccgccacgcccccaaacttccctgatgcactcaccatgttcagccgtctgaaagcctcggagagtttccacagtggcggttcaggctccccgatggctgccactgcaacctctccccccccacattttccacacgcagctacatctagctccgctgccagctcctggcctacagctgcctccccaccgggaggcccgcagcatcaccagccccaacccccactgtggacacccactccacccagccctgcttcggactggcctcccctggctccacagcaggctactagcgagccccgggctcaccctgcaatggaagccgagcggtag

SEQ ID NO: 29531 - DNA, 495 bp, Artificial Sequence
  Description of Artificial Sequence: Synthetic coding sequence
atgtctgtgaatatggatgaactaagacaccaggtgatgatcaaccagttcgtgcttgccgcaggttgtgcagccgaccaggcaaaacagctgctccaggccgcacactggcagttcgaaactgccttgtccacattcttccaggagacaaatatcccaaatagccaccatcaccaccagatgatgtgtactccatcaaacacccctgccacacctccgaacttcccagacgccttggccatgttctccaagttgcgtgcatccgaaggcctccagtcatctaactcccccatgaccgctgcagcttgcagtccccctgccaacttctcacctttttgggcctccagccccccaagtcaccaggccccctggatccctccgtcctctcctacaacgttccatcatcttcacaggcctcagcccacctggccgcccggcgcccaacagggcggcgcgcagcaaaaagctatggctgctatggacggtcagaggtag

SEQ ID NO: 29532 - DNA, 435 bp, Artificial Sequence
  Description of Artificial Sequence: Synthetic coding sequence
agcccggcatccctgcctctcgctcctggatgcgcgttgcgtctctgcccattgagctttggtgaaggagtggagttcgaccccctgccacccaaagaagtgagatatacttctctggtcaagtatgactctgaaaggcacttcattgatgacgtccagctgcctctaggcctcgcggtggcctcttgtagccagactgtgacctgtgttcccaacggcacatggaggaactataaagctgaagtgcgtttcgagcctcgtcacaggcctacgcgctttctgagcacgactattgtgtacccaaaataccccaaggctgtctacacaacgacgcttgactacaattgccggaaaactctaaggcgattcttgagctccgtggaacttgaagccgcagagcttccagggtctgacgatctttctgatgagtgctag

SEQ ID NO: 29533 - DNA, 408 bp, Artificial Sequence
  Description of Artificial Sequence: Synthetic coding sequence
atgcggcctcggatgctccccgtcttttttggcgaatcgataaaggtgaatccagagccaacacatgagatccggtgcaactcagaggtgaagtacgccagtgaaaagcactttcaggacaaggtgttttacgcgccagtgccaacagtgacagcttattcagaaacgatcgtcgccgcaccaaattgcacatggagaaattaccgttctcagctgactcttgagccccgccctagggccctgagatttagatcaaccacaatcatttttccaaaacacgcacggtccacctttcggaccactctccactgttcattaggtcgcccgagccgctggttcaccgcaagcgtgcagctacagctttgccaggatcctgctccaagcctgctgggtcccgcgacactatag

SEQ ID NO: 29534 - DNA, 408 bp, Artificial Sequence
  Description of Artificial Sequence: Synthetic coding sequence
atgaggccccgcatgctgccagtgtttttcggggagtcaatcaaggtcaaccccgagccaacacatgagatccgctgcaattcagaggtgaagtatgccagcgagaaacatttccaggacaaagtgttctacgcacctgtaccaacggtcacagcctatagcgagacaatagttgcagcccccaactgcacatggcgcaattatcgtagccaattaaccctcgagccacgccctagagccctgcggtttagaagcacaaccattattttccccaaacatgctcgatctacctttaggacaaccttgcattgcagtctcggcagaccatctcgatggttcacagcttcagtacaactccagctctgccaagacccagctccatctctattgggaccagccaccttgtag

SEQ ID NO: 29535 - DNA, 651 bp, Artificial Sequence
  Description of Artificial Sequence: Synthetic coding sequence
atggttggtcatctgcatctgcagggcatggaagacagtctgaaggaacagggaagagagggactgcttgattcgccagactctggcctgccaccatctcccagtccaagcccgcctttctatagtctggctcctggtattctcgacgcgcgtgccggtggtgccggagcaagctctgaaccaccgggtccaagcgaggcccgagcccctccaagccagctgcccaatcctcccgctagcgaaatgaggccaagaatgttacccgtgtttttcggtgagtctatcaaagtgaacccagagcctactcatgagataagatgtaattccgaggtgaagtatgcaagcgaaaaacacttccaggacaaggtcttttatgcaccggttcctaccgtgactgcctactccgaaacaatagttgccgctccaaattgcacatggcgaaactacagatcacagctgacattagaaccccggccgcgtgctctgcgatttcggtcgactacaatcatctttcctaaacacgcgaggtcaacatttaggacaacactccactgttccctcggaagacctagccgatggttcaccgcctctgttcaactgcaactgtgtcaggaccctgccccttctctgttggggcctgctacactatag

SEQ ID NO: 29536 - DNA, 369 bp, Artificial Sequence
  Description of Artificial Sequence: Synthetic coding sequence
atgcggcctagaatgctcccggttttttttggcgagagtatcaaggtgaatcctgagcccacacacgagattcgatgcaattctgaagtgaagtacgcctctgagaagcacttccaggacaaagtgttttatgcccctgtgcctaccgtgactgcatactctgaaactatcgtagctgcccccaattgcacttggcgtaactaccggagtcgatggttcaccgccagtgtccaactccagctttgccaggaagctggtcgagaagccgcaagaccccgcaccagagtagaaggcggcgggagcccactccccgccctgacctatcgcctggggggcggtttgctggtactggtgagcagaacccagtag

SEQ ID NO: 29537 - DNA, 408 bp, Artificial Sequence
  Description of Artificial Sequence: Synthetic coding sequence
atgcggccaagaatgctgccagtgttcttcggtgagagtatcaaggtgaacccggaaccaacacacgagattaggtgcaactctgaagtcaaatacgcttccgagaaacacttccaagacaaggtgttttacgctcccgtgcccacagttacagcttattctgaaacaatagtagccgcccccaactgtacttggcgtaattaccgatcccagctcacattagaaccccgcccgcgggcgctacggttcaggagtacaaccatcatcttcccgaaacacgctagaagtacgtttagaacaacccttcattgcagtctgggtaggccgtcccggtggttcacagcctctgttcaactgcagctctgccaggatcctgcgccctccctactcgggcctgccaccctgtag

SEQ ID NO: 29538 - DNA, 435 bp, Artificial Sequence
  Description of Artificial Sequence: Synthetic coding sequence
tcccccgcttccctcccactagcccctggttgtgctctccgactctgccccctcagtttcggtgagggcgtggaattcgatccacttcccccgaaggaggtgcggtatacatccctggtcaagtacgactcagagagacacttcatcgacgacgtacagctcccgcttgggctcgctgtcgcgagctgttctcaaacagtgacctgcgttcctaacggtacatggagaaactacaaagccgaggtcaggtttgagcctagacaccggcctacgaggttcctatcaacaactatcgtgtatccgaaatatcccaaggccgtgtatacaactacactggactacaactgtagaaagaccctgaggagattcttatcctctgtggaacttgaagcagcggagctgcctggctccgacgacctctctgacgaatgctag

SEQ ID NO: 29539 - DNA, 1083 bp, Artificial Sequence
  Description of Artificial Sequence: Synthetic coding sequence
atgatgaagaaaaaaaaattcaaattcaaagttgattttgagttggaggaattgagctcggttcctttcgttaacggagttctattctgcaagatgagactgctggacgggggctccttcaccgcggagagctcccgggaggtcgtacaggccaactgcgttagatggcgtaagaagttctcattcatgtgtaagatgtccgcaagcgctgctacagggatattggatccctgcatctaccgggtgtctgtgcggaaggaactcaaaggagggaaggcttacgccaagttgggatttgcagatctgaacctggcagagttcgctggtagtggcaatactacacggaggtgtctgctggagggctacgacacaaagaacactcggcaggataactctatccttaaagtcttgatatccatgcagctaatgtccggagacccatgttttaaaactcccccatcaacctccatgtctatacccattgctggcgaatccgaatcgctacaggaagataggaaaggcggagagactctcaaggtacatctagggatagccgacttgtccgccaagtctgctagcgtgccagacgagctcggggcttgtggacattccagaacatcttcttatgcatcccagcagagcaaagtgtccggatacagcacgtgccatagccggagcagctcatttagtgaactgtgtcatcgtagaaacacaagtgtcggaagtacgagcaccggggtggaaagtatattggagccttgtgacgagattgagcagaaaatcgccgagcccaacctggatactgcggacaaagaggatacagcctcagaaaagctcagcagatgcccagtgaagcaggattctgtcgagagccagctaaagcgggttgatgatactcgggtcgatgccgacgatatcgttgaaaaaattctgcagagtcaggacttcagcctcgacagcagcgccgaggaggaggggctgagactgtttgtcggtccgggcggatcaaccacatttggaagtcaccacttacccaaccgcgttggatccggagcctacgagcaggtggtcattaagagatag

SEQ ID NO: 29540 - DNA, 1068 bp, Artificial Sequence
  Description of Artificial Sequence: Synthetic coding sequence
atgatgaaaaagaagaagtttaagttcaaagtggatttcgagctggaagagctgagcagcgtgccttttgtcaacggcgtcctcttctgcaagatgaggctccttgacgggggctcattcactgctgagtcctcacgtgaagtcgtgcaggcaaactgtgtgcgatggcgcaaaaaattttcttttatgtgtaagatgtccgccagtgcagccaccggcatattagacccctgtatttatcgggtcagcgtgcggaaagaactcaagggcggcaaggcatacgccaagctgggattcgccgatttaaatctcgccgagttcgccgggtctggcaacacgactagacggtgccttttagaggggtacgacacaaaaaacactcgccaggacaattccatcctcaaggtgcttatttccatgcagcttatgtccggggatccctgtttcaagacacctccctcgacctctatgagcattccaatcgccggggaatcagagtccttgcaggaagatcgaaaaggtggcgagacactgaaggtccacctcggcattgctgaccttagcgcaaaatcagcatcagtcccagatgagctgggcgcctgcggacattcgagaacatcttcatacgcttcacagcagtctaaggttagtggctattcaacctgtcactctcgctcctcgtccttcagtgagctctgccaccggaggaatacttctgtgggctcgaccagtaccggggttgagtcaatcctggagccatgtgatgagatcgagcagaagatcgcagagcctaatcttgacaccgctgataaagaggacactgcatcagagaaactgtcccgttgccctgttaagcaggatagtgtcgagagtcagctcaagcgcgtggacgatactcgagtggacgccgatgatatagttgaaaagatcctccagtcccaggatttcagcctggatagtagcgcggaagaggagggcctgaggctgtttgtgggcccgggaggttcaaccaccttcggatctcatcacctccctaactccttcctgaacagtggaagcctgatatag

SEQ ID NO: 29541 - DNA, 357 bp, Artificial Sequence
  Description of Artificial Sequence: Synthetic coding sequence
atgaccgatactgccgaagcagtccctaaatttgaagaaatgtttgccagccggttcaccgaaaacgacaaagagtatcaggaatacctgaagaggccccctgagtcacccccaatcgtagaagaatggaacagtcgggccggaggtaatcaacggaatcgcgggaaccggctgcaggataataggcagttccgagggcgggataatagatggggttggccaagcgacaacaggtccaatcagtggcacggaaggagctggggcaacaactaccctcaacatcgccaagagccttactatcctcagcagtacggtcattatggctataatcagcgtccaccatacggttactactag

SEQ ID NO: 29542 - DNA, 141 bp, Artificial Sequence
  Description of Artificial Sequence: Synthetic coding sequence
atgggcggctgtcctgttcgcaagcgccgccgtaatggctcgaaagagggaaatcaccattcgacacaaccaaagcggaataaacgtaatcctatcttccaggacagtcaggacaccgaagtggccatcttcatggagtag

SEQ ID NO: 29543 - DNA, 339 bp, Artificial Sequence
  Description of Artificial Sequence: Synthetic coding sequence
atgacatgtaggaagagaagacgtaacggcagcaaggaggggaatcaccacagcacccaacccaaacgcaataagagaaaccccatttttcaagactcccaggatacggaattttcatggagtgacaacgagaggtctagctctagaataaacattcctgagagagcaagcggccccgagggcaacctcaatcagatcgtcactgagccggacgcaaacttcccccagttcctgcacgaggggtacgtgccatgtcaagggctttattctcatattaatcagactctgaaagaggcacattttaactctcttcaacagcgcgggcaagctccaacgtag

SEQ ID NO: 29544 - DNA, 345 bp, Artificial Sequence
  Description of Artificial Sequence: Synthetic coding sequence
atgttagtcctgtggctcaagaggagaaggaacggcagtaaggaaggcaaccaccactccacccagcctaaaagaaataagcgtaacccgatatttcaggactcacaggatacagagtttagctggtccgataatgagcggtcctcttcacggattaacatccccgagcgtgccagtggacctgaggggaatctcaaccagattgtgaccgaaccagatgcaaatttccctcaatttctgcacgagggctacgtaccgtgccagggtctgtactcccatatcaaccagactcttaaagaggcgcactttaatagcttgcagcagagaggccaggcgccaacgtag

SEQ ID NO: 29545 - DNA, 561 bp, Artificial Sequence
  Description of Artificial Sequence: Synthetic coding sequence
atgggaggacgcggcgccgatgctggctcttccggggggaccggtcccaccgagggttactcacctcccgcagcttccacaagggccgcagcccgggccaaagcccgcggaggagggcgggggggacgccgaaacaccactccaagcgtaccatccctccggggcgcggcgccacgaagctttcatccccccgccgcgatgagcgagagattgagaccccgcaagagaaggcggaatggaaatgaggaagacaaccatctccctccacagactaagcgctcctcccgaaatccagtcttccaggactcctgggatactgagagctccggctcagattcaggcggaagctctagcagctccagcagcagcattaattctccagatagagcctccgggccagagggatctctcagccagacgatggcgggatccagtcccaacacgcctcagcctgtgcctgaacaatctgcgctgtgtcaaggtctgtatttccacattaatcagacactgagggaggcccacttccacagcctgcagcatagagggcgcccactgacctag

SEQ ID NO: 29546 - DNA, 624 bp, Artificial Sequence
  Description of Artificial Sequence: Synthetic coding sequence
atgggagggcgaggggcggacgccggttccagcgggggcactggccctacggagggatatagtccccctgccgccagcactagagctgctgcgagagccaaagccagaggcggtggccgtggaggtcgccgcaatacgactccttctgttccctctcttaggggagcggccccacggagcttccatccgcctgccgccatgagcgagagactcaggccccgcaaacggagaagaaacggcaacgaggaggacaatcatctgccacctcagaccaagaggtcgagcagaaaccccgtctttcaggactcatgggacaccgagaccgttcccgtaatgagaaattctaaagagaataggttgaggggcaacaaagccttttgtgctagttctggatcagactcaggaggcagttcttctagctctagtagcagcataaactcccctgatagggcctcgggcccggagggcagcctgtctcagaccatggccggcagctcacccaatacaccccaacctgttccggaacagtcagctctctgccagggactttacttccatattaaccagacattgcgcgaagcacattttcactctttgcagcaccgtgggcgacctcttacgtag

SEQ ID NO: 29547 - DNA, 351 bp, Artificial Sequence
  Description of Artificial Sequence: Synthetic coding sequence
atgggaggctgtcccgttaggaagcggcgtcgcaatgggtctaaggaaggcaatcaccacagtactcaaccaaaaaggaacaagagaaatcccatcttccaagatagtcaggacaccgaggttttttcatggagtgacaacgaacggtcatccagcagaataaatatccctgagcgcgcaagtggtccggagggaaatctgaaccagattgtgactgaacctgatgcaaatttcccacagtttctacatgaggggttgtcaaagccagtgtacgtgatcaattggtttatgtccttcggtcctgagattaaattgaacacatcacaacaggggaggaatcaggccgtgtag

SEQ ID NO: 29548 - DNA, 348 bp, Artificial Sequence
  Description of Artificial Sequence: Synthetic coding sequence
atgggggggtgtcccgtgaggaaaagaaggcggaacggaagtaaggaggggaatcaccactccacccagccaaaaaggaataaacgtaaccccatctttcaagattcccaagacacggaatttagctggtccgataacgaacgatcttcatccaggatcaatatccccgaacgcgcctccgggccagaaggcaaccttaatcagattgtcaccgagcctgacgctaacttcccccagttcttacacgaaggactgtctaaacctgtgtatgtgatcaactggttcatgtctttcggccctgagattaagctgaatacgtcccagcaggggagaaatcaggcggtctag

SEQ ID NO: 29549 - DNA, 351 bp, Artificial Sequence
  Description of Artificial Sequence: Synthetic coding sequence
atgggtggatgtccagttcggaagcgaaggcgtaacgggtcaaaagaagggaatcaccacagcacacaaccaaaaagaaacaaaagaaatcccatcttccaggactcacaggataccgaagtcttcagttggtccgataacgaaaggagctcgagtcggatcaatattccggaacgcgcatctggcccagaagggaacctgaaccagatagtcactgaacctgatgccaattttcctcaattcctgcacgaaggatacgtgccgtgtcaggggctctattctcatatcaaccagactctgaaggaggcacattttaactctctccagcaacgagggcaggcccccacttag

SEQ ID NO: 29550 - DNA, 1071 bp, Artificial Sequence
  Description of Artificial Sequence: Synthetic coding sequence
atggccgctacacggagcccaacacgagccagggagcgcgaacgcagtggggctcccgctgcaggatccgatcaagtgcattcatggatgttggccacgagtcaggccctagacacggtgtggcggatggctaaaggatttgtgatgctcgccgtgtccttcctcgttgcggccatatgttattttaggagacttcatctctattctgggcacaagctgaaatggtggatcgggtatctgcagcggaagttcaaaaggaacctgtccgtagaagctgaggttgaccttctgtcttactgcgcgagggagtggaagggtgagacaccaaggaacaagttaatgcggaaggcatatgaagagttattttggcggcaccatattaagtgtgttcgccaagtacgccgcgataactacgatgctcttcggtccgtgctgtttcagattttctcacagggcatttcctttccctcttggatgaaagagaaagatatcgtcaaactcccggaaaaacttttattctcccagggttgtaactggattcaacagtactcatttgggcccgaaaagtatactgggtccaatgttttcgggaaattgagaaagtacgtggagcttctgaaaacacagtggacggagtttaacggaatccgcgactaccataaacggggaagtatgtgcaatacgctgttcagtgacgccatcttggagtacaaattgtacgaggcactgaagttcattatgctgtatcaagtcacagaggtttacgagcaaatgaaaacaaagaaggtcattccctcactgtttagactgttgtttagccgcgagacgtccagcgatccactcagctttatgatgaaccatttgaattctgtgggcgatacgtgtgggttagagcagatcgatatgtttatactgggttatagtctggaggtgaaaataaaagtcttccggctttttaagtttaatagtcgagatttcgaagtgtgttatcctgaggagcccctaagagattggcctgaaatctcgctactgaccgagaacgatcgacactaccatatcccagtgttttag

SEQ ID NO: 29551 - DNA, 1059 bp, Artificial Sequence
  Description of Artificial Sequence: Synthetic coding sequence
atgagccggggaacaatgccacagcctgaggcctggccgggagcaagctgtgcagaaacaccagccagggaggcagctgccaccgccagggatggggggaaggcagccgcctcaggccaaccccggcccgagatgcaatgtcccgctgagcacgaagaggacatgtacagggccgcagacgaaattgagaaggagaaggagcttctgattcacgagcgaggagcatctgagccccggctctccgtggcacccgaaatggatatcatggattattgtaaaaaggagtggcgaggaaacactcagaaagcaacatgtatgaaaatgggttatgaggaggtttctcagaaatttacaagcataagaagagtccggggcgataactactgtgccctgagagctaccctttttcaggccatgagccaagccgtgggactcccaccctggctccaagatccagagcttatgctgttaccagaaaagctgatttccaaatacaactggattaaacagtggaagctggggctaaagttcgacggaaaaaatgaggatctagtcgacaagattaaagagagccttacattgcttcggaagaaatgggcgggactcgcagagatgcgcacagccgaagcccgccagattgcttgcgatgagctctttacaaacgaggctgaagagtactcgttatacgaggccgtcaaatttctgatgctcaaccgcgccatcgaattatacaacgacaaagagaagggtaaggaggttccattcttttctgttctcctgttcgctcgggacacttcgaatgatccaggccagcttctccggaaccacttaaatcaagtaggccataccggcggactcgagcaagtcgagatgttcttgctggcttatgccgtgagacatacaattcaggtctatcgactgtccaagtataacaccgaagaatttatcaccgtctatcccacagatccccccaaagattggccggtggtgaccttgattgccgaagacgatcgccattacaatatccctgtccgcgtgtgcgaagaaaccagcctgtag

SEQ ID NO: 29552 - DNA, 510 bp, Artificial Sequence
  Description of Artificial Sequence: Synthetic coding sequence
atgctgccctcaactatgtttctggtgcatctgccgttatccacaaataggctccactgtttacgtaacaccagcctggaatcgtacctgtgctccttcgtgcacctaaatcacccactgcacatctcggaccgggtgatactcatttccctgcatgaggcagtcaggttttccttcgcgttctcttttccacgtggtaccctgtcaattgcttattgcctgatgtcttctgtttcaacttccagcgaagctattatgagcaccgagcttctggctaattactgtcatagctcgttgcacgtctgtatctgtatctcttcatttcctaacgaaacaggcaatcacgattcatttcccggtgccgtggtgtccatcagcgatcaacctacggatcagtgcaaactagctgccaaagagctgcctctccgaaaccttttggaatgtcgatttttcgactgcatgggggaagaagaccttattaacctgggcgtgatcggcacagaacggtag

SEQ ID NO: 29553 - DNA, 510 bp, Artificial Sequence
  Description of Artificial Sequence: Synthetic coding sequence
atgttaccaagcaccatgtttttggtgcacctccctctttcaaccaatagactgcactgcctgcggaatacctccttagagccatgcttgtgcagttttgtgcatttaaaccaccctttgcacatttccgaccctgttattctgatcagccttcacgaggccgtgcggttcagctttgccttctcatttcctcgcgggaccctgtctattgcctactgcctgatgtccagcgtcagcacaagctcagaggccattatgtctactgagctgctcgccaattattgtcactcttcactgcacgtgtgcatctgtattagttcattccctaatgaaactgggaaccacgattcttttcccggagccgtggtcagtatttcagaccaacctaccgaccagtgcaagttggcagcgaaggaactgccacttagaaatctccttgagtgccggtttttcgactgcatgggcgaggaagatttgatcaacctaggtgtgatagggacagaacgctag

SEQ ID NO: 29554 - DNA, 921 bp, Artificial Sequence
  Description of Artificial Sequence: Synthetic coding sequence
atgtctacctggaaggctcggctgacaaagcgcttaaagtcgccaagtcgttctatgcaccccttcccctgttcagccctcctagcatgctttggaaacacccgcgagtccgcttcgtttaaccagagcggcgtcgctgatactcacagcacggtcagagttcagcccgtggcaaaggccggtaggcagccacgacatcctagtgccgagggcgctcccgagaagcgtcaagatagctccacccatgcagagcgaaatgggagtgcaaaccggaactcgtctcacagaacagcggcccaacctgcggagacccccgaggacgtgccaggttcccttgatgacggcgctgattgcgaggccgtggtgttccatgcatcaatcccccggcccagtattatcgacaccccaaaagaggaggagtttcgtgaagaacctaaatgcctggagctagaacagaagatgactagcgacagtccccccgaggacatcgatcacaaggatagttacctaatcaccagatccatcatggctgaacccgactacattgaagatgacaacccggagctgatcaggccccagaagttaataaatcctgtcaagacaagccggaaccaccaggatcttcaccgcgagctactgatgaaccagaagcgagggttagcccctcagaacaagccagaattgcaaaaggtgatggagaagcgtaagagagaccaggttatcaagcaaaaagaagaggaagcccagaagaagaaaagcgatctagaaatcgagttgctcaagaggcagcagaaactggagcagctcgaactcgaaaaacagaaactgcaggaggaacaagagaatgctcccgagttcgtaaaggtaaaagggaacttgcgccgtacaggccaagaggttgcccaggcccaggagtcgtag

SEQ ID NO: 29555 - DNA, 396 bp, Artificial Sequence
  Description of Artificial Sequence: Synthetic coding sequence
atggctgaaccagattatatcgaggacgacaacccggaactgatccgcccccagaaacttatcaaccccgtaaagacgtcacggaatcaccaagatctgcaccgggagttactcatgaaccaaaagcgcggtctcgcccctcagaacaaacccgagttgcagaaagtgatggagaaaagaaaaagggatcaggtgattaaacagaaagaggaggaggcacagaagaagaaatcagacctggaaatagagctgttgaagcgccaacagaaactggagcagctcgagttggaaaagcaaaagttacaagaggaacaagagaatgcccccgagttcgtgaaagttaagggcaacttgcgcagaacaggacaggaggtagcccaagcccaggaaagctag

SEQ ID NO: 29556 - DNA, 396 bp, Artificial Sequence
  Description of Artificial Sequence: Synthetic coding sequence
atggcggagcctgattacatcgaagatgacaatcccgagctgatccgcccccagaagctcatcaacccagtgaagacttcccgcaaccatcaagacctgcatagagagcttctgatgaatcagaagagaggccttgcgccccaaaacaagcctgaactacagaaggtcatggagaaacgaaagagagaccaggttataaagcaaaaggaagaggaggcgcaaaaaaagaaatcagacctggaaattgagctgctcaagagacagcaaaaactcgagcagctagagctcgagaagcagaaactacaggaggagcaagagaatgcacccgaattcgtgaaggtgaaaggtaatctgagaagaacagggcaggaagtggctcaggctcaggaaagttag

SEQ ID NO: 29557 - DNA, 396 bp, Artificial Sequence
  Description of Artificial Sequence: Synthetic coding sequence
atggccgaaccggactatattgaggacgataaccccgagttgatacgaccgcaaaaactaattaaccccgtcaagacctcaagaaatcatcaggatcttcatcgcgaactgctgatgaaccaaaaaagaggcctggcgccacaaaacaaaccagaattgcagaaagtgatggagaagagaaagcgcgatcaggtgataaagcagaaagaggaggaggcacagaagaagaaaagtgacctggagatcgagctgctgaaaagacaacagaaactggaacagctggaactggagaagcagaaacttcaagaagagcaagaaaacgccccagagtttgtgaaggtaaaagggaatttaaggcgaacggggcaagaggtcgcccaggcgcaggagagttag

SEQ ID NO: 29558 - DNA, 396 bp, Artificial Sequence
  Description of Artificial Sequence: Synthetic coding sequence
atggctgaacctgactatattgaggacgataaccctgaactcattcgccctcagaagctgattaaccctgtaaaaacatcccgcaaccatcaggacctccatcgtgaactgctcatgaatcagaagagagggctggcgccccagaacaagccagagctacagaaagtgatggaaaagcgtaaacgtgaccaggtgattaaacagaaggaagaagaagcgcagaaaaagaaaagtgatcttgagattgaactgttgaaacggcaacagaagctggagcagctcgaacttgaaaagcagaaactccaggaggaacaggagaacgcaccagagttcgtgaaagtcaagggtaatttaagacgcactggccaagaggtcgctcaggcacaggaaagttag

SEQ ID NO: 29559 - DNA, 396 bp, Artificial Sequence
  Description of Artificial Sequence: Synthetic coding sequence
atggctgaacccgattacatcgaagatgacaatcctgagctcatcagaccacagaagcttataaatccggtgaagacgtcacgaaaccatcaggacctgcatcgagagctgctaatgaatcagaagcgagggctggcacctcagaataagcctgaacttcaaaaagtcatggaaaagcgcaagcgagaccaggttattaagcaaaaagaagaggaggctcagaagaaaaaaagtgacttagagatcgagctgctgaagcgtcagcagaaactggaacagctggagctggagaagcagaagctacaggaggagcaggaaaacgctcctgaattcgtcaaggtgaagggaaaccttaggcggaccggacaggaagtggcgcaggcacaggagtcttag

SEQ ID NO: 29560 - DNA, 396 bp, Artificial Sequence
  Description of Artificial Sequence: Synthetic coding sequence
atggctgagccggactatatagaagacgataatccagagctcatccgcccccagaaactgatcaaccccgtgaaaaccagtaggaatcaccaggacctgcaccgggaattattaatgaaccagaagcggggcttggctccccagaacaagccagagctgcagaaggtcatggagaaacggaagagggatcaggtcatcaaacagaaggaagaggaggcgcaaaaaaaaaagagcgacctggagattgaactgctcaaacgccagcagaaactggagcagctggaactagagaagcagaaattgcaggaagagcaggaaaacgctcccgagtttgtgaaggtcaaggggaacctccggcgtaccggtcaggaggtagcacaggcgcaggaatcatag

SEQ ID NO: 29561 - DNA, 273 bp, Artificial Sequence
  Description of Artificial Sequence: Synthetic coding sequence
atggccgagccggactacatagaagatgataaccccgagctcatcagacctcagaagttaattaatcccgttaaaacctctcgtaaccaccaggacttacatcgagagcttctgatgaatcagaaaagggggctggcccctcagaacaaacctgagttacagaaggttatggagaaacgcaagcgtgatcaagtcataaagcaaaaggaggaggaggcccagaagaagaaatctgatctggaaatagagttactgaagagacagcagaaatag

SEQ ID NO: 29562 - DNA, 387 bp, Artificial Sequence
  Description of Artificial Sequence: Synthetic coding sequence
atggcagagcccgactatatcgaggatgacaaccctgaactgattcggccacagaaactaattaacccagtgaagacgagcaggaaccaccaagatctgcaccgggagctgttaatgaatcaaaagcggggcctggcccctcagaacaaacctgaattgcaaaaagttatggagaagcgcaagagagaccaggtaatcaaacagaaagaagaggaggcccaaaagaagaaatctgacctggagatcgaattgctcaagagacagcagaaactggagcagctggaactggagaagcagaaactacaagaggaacaggagaatgcgccagaattcgttaaggtgaagggcaacctgcgccgtacaggacaggaggtcgctcaagcatag

SEQ ID NO: 29563 - DNA, 396 bp, Artificial Sequence
  Description of Artificial Sequence: Synthetic coding sequence
atggccgaacctgattatatcgaggatgataatcctgaactcatcaggcctcaaaagttgatcaaccccgtgaaaacttccagaaaccaccaggatctccatcgggagctcctaatgaatcagaagcgagggctcgccccccagaataaaccagaactacaaaaggtgatggagaagcgcaagagggatcaagtaatcaaacaaaaagaagaggaggctcagaagaaaaagtcagacctggagattgaattgttgaaacgacagcagaaactcgaacagctcgagttggaaaagcaaaagctgcaggaagagcaagaaaacgcacccgagttcgtcaaggtaaagggaaatcttcgcagaacaggacaggaggttgcgcaagctcaagaatcgtag

SEQ ID NO: 29564 - DNA, 396 bp, Artificial Sequence
  Description of Artificial Sequence: Synthetic coding sequence
atggcagagccagattacattgaggatgacaaccccgagctgatcagacctcagaagctcatcaatccagtaaaaactagccgcaaccatcaggatttgcacagggaattgctgatgaatcagaaaagaggcctcgcgccacagaataaacccgaactgcagaaagtcatggaaaaacgcaaacgggatcaggtgattaaacagaaggaggaagaagcacagaagaaaaagagtgacctcgaaattgaactgctaaaaagacagcagaaactggagcagttagagttagagaaacaaaagcttcaggaggagcaggaaaatgcccccgaattcgttaaggtcaaagggaaccttcgccgaacaggtcaggaggtggcacaggcacaggaatcttag

SEQ ID NO: 29565 - DNA, 204 bp, Artificial Sequence
  Description of Artificial Sequence: Synthetic coding sequence
atggccgagccagattacattgaagacgacaaccccgagctcatccgccctcagaagctaatcaatcccgtgaaaacttcgcgtaatcaccaggatctccacagagagctgctgatgaaccagaagcgcgggctcgcaccccagaataaacctgaactgcagaaggtgatggagaaacgtaagcgcgatcaagtgataaaatag

SEQ ID NO: 29566 - DNA, 306 bp, Artificial Sequence
  Description of Artificial Sequence: Synthetic coding sequence
atggctgaacccgactatatcgaggacgataaccccgagctgataagaccccaaaagttaattaaccctgtcaaaacgagtagaaaccatcaagatcttcaccgcgagctccttatgaaccagaagcgcggtctggcgcctcagaacaagcctgaactacagaaagttatggagaagagaaagcgcgatcaggtcattaagcagaaggaggaggaagctcagaagaagaagagcgacttggagatagagctgttgaaaagacaacagaaactggagcaactagaacttgagaagcagaagctctag

SEQ ID NO: 29567 - DNA, 396 bp, Artificial Sequence
  Description of Artificial Sequence: Synthetic coding sequence
atggctgagcccgattatatcgaggacgacaatccagagctgattcggcctcagaagctgattaaccctgtcaaaacgtctcggaaccaccaggatctccacagagaattacttatgaaccagaaaagaggcttggctccccagaacaaacctgaattacagaaagtaatggagaagcggaagcgcgaccaggtgattaagcagaaggaagaggaggctcagaaaaagaaatctgacctggagatcgagctcctgaagcgacaacaaaagctagaacagttggaactggaaaagcagaagctgcaggaggaacaggaaaacgcgcctgagttcgttaaagtcaagggcaatctccgtagaacaggacaagaagtagcccaagctcaggaaagctag

SEQ ID NO: 29568 - DNA, 396 bp, Artificial Sequence
  Description of Artificial Sequence: Synthetic coding sequence
atggccgaaccggactacattgaggacgacaaccctgagcttatccgaccacagaaactcattaaccccgtgaagacatcaagaaaccatcaggatttacaccgggagctgttaatgaatcagaaacgtggccttgcaccgcagaacaaaccggaactgcagaaggtcatggagaagcggaagagggatcaggtgatcaagcagaaggaagaggaggcacagaagaagaaatccgacctggagattgagcttctaaaaagacagcagaagctggaacagcttgagttggagaagcaaaagctgcaggaggagcaagagaacgccccagaattcgttaaagtgaagggaaacctgagaagaacaggacaggaggtggcccaggctcaagagtcctag

SEQ ID NO: 29569 - DNA, 255 bp, Artificial Sequence
  Description of Artificial Sequence: Synthetic coding sequence
atggctgaacccgactacatcgaggacgataatccagagttgattaggccccaaaagttgatcaaccctgtcaagacaagccgcaaccaccaagatctccaccgggagttattgatgaatcagaagaggggccttgcaccacagaataagcccgagttgcaaaaggtgatggagaaacgaaagagggaccaggtgatcaagcaaaaggaggaagaagcacagaagaaaaaatccgacctggagatcgaactatag

SEQ ID NO: 29570 - DNA, 282 bp, Artificial Sequence
  Description of Artificial Sequence: Synthetic coding sequence
atggccgaaccagattatatagaagatgacaatcctgagttaatacgaccccagaagttaatcaacccagtgaagacctctcgcaaccaccaggatttgcacagggagctattaatgaatcagaagaggggactggcacctcagaataaacccgaactgcagaaagtgatggaaaaacggaaacgggatcaggtgatcaagcagaaggaggaagaagcccagaagaagaagtctgacctggaaattgaactcttaaaaaggcagcagaagctcgaacagtag

SEQ ID NO: 29571 - DNA, 381 bp, Artificial Sequence
  Description of Artificial Sequence: Synthetic coding sequence
atggcagagccagattacattgaagacgacaaccccgaactgattagaccacagaagttgatcaaccccgtgaaaacttcccgaaaccaccaggacttacatagggagctcctcatgaaccagaaaaggggactcgcacctcaaaataagcccgagttacagaaggttatggagaagagaaagagagatcaagtgattaagcagaaggaagaggaggctcagaagaagaaatctgacctagaaatcgagctccttaagaggcagcagaagcttgagcaactcgagttggaaaagcaaaaattgcaggaggagcaggagaacgcgcctgagttcgttaaagtgaaggggaacttaagacggaccggccaggaggttgcatag

SEQ ID NO: 29572 - DNA, 378 bp, Artificial Sequence
  Description of Artificial Sequence: Synthetic coding sequence
atggcagaaccagactacatagaggacgataaccctgagctcatacgcccccagaagcttattaaccccgtcaaaaccagcaggaatcatcaggacctgcacagagagctcctgatgaaccagaagagagggctggcaccccaaaacaagcctgaactccagaaggtaatggagaagaggaaacgcgatcaggtgattaaacagaaggaagaggaagcacagaaaaaaaagtccgaccttgagattgaactcttgaagagacaacaaaaactcgaacagctcgaactggaaaagcagaaactacaggaggagcaagaaaacgcacccgaattcgtgaaggtgaagggcaatttgagacgtaccgggcaggaggtgtag

SEQ ID NO: 29573 - DNA, 396 bp, Artificial Sequence
  Description of Artificial Sequence: Synthetic coding sequence
atggctgagcccgattacattgaagatgataatcctgagctgataaggccacagaaactgattaacccggttaagacatccagaaatcaccaggatctgcatcgcgaattgctcatgaatcagaaacgggggctggctccccagaataagcctgaactgcagaaggtcatggaaaaaaggaaacgggaccaggtcattaagcagaaggaggaagaggcccagaagaagaaaagcgaccttgagattgaactcctgaagcgccagcagaagcttgagcaattggaactggagaaacagaaacttcaggaggaacaagagaacgccccggaatttgtgaaggtaaagggcaacctccgacgaacaggtcaggaagtggctcaggcgcaggaatcatag

SEQ ID NO: 29574 - DNA, 990 bp, Artificial Sequence
  Description of Artificial Sequence: Synthetic coding sequence
atgcccgaaccaggaccacgtatgaacgggtttagcctcggagagctgtgctggctgttctgctgccctccgtgtccttcccgcatagcagcaaagctggcatttctgcctcccgagcccacatatactgtgttggcgcctgaacaaagaggggcaggcgcctctgcccctgctcccgctcaggcaaccgccgccgccgcagcggctcagcctgcccctcagcagccggaagaaggcgccggcgcaggccctggcgcctgtagcctccatctgtcagagagagccgattggcaatatagtcagcgggaactggacgctgtggaggtctttttttccaggaccgccagagacaaccgactgggctgcatgttcgtcagatgcgccccctccagccggtacacactgcttttctctcatggcaacgctgtggacttgggccagatgtgctctttctatattgggctggggtcccgtataaattgtaatattttctcatacgactattctggctacggcgtgagttctggcaaacctagtgaaaagaacctgtacgccgacattgacgccgcatggcaggccctccgcactcgatatggcgtctctcctgaaaacatcattctctacgggcagagcatcggcaccgttccgaccgtagacttggcctctaggtatgagtgcgcagctgtaatcctgcacagcccgcttatgagtggcctcagggtggctttccccgatactcgcaagacatattgttttgatgccttcccatcaatcgacaaaatttccaaggtgacctcaccagtgctcgtgatccacggcaccgaagacgaggtaattgacttctctcacggtctggctatgtatgagcggtgtcctcgggccgtcgagccattatgggttgaaggcgccggccacaatgatattgagttgtatgcacagtatctggaaaggctgaaacagttcatatcccatgagctgcctaatagctag

SEQ ID NO: 29575 - DNA, 888 bp, Artificial Sequence
  Description of Artificial Sequence: Synthetic coding sequence
atgcctgaacctggcccacggatgaacggtttctctctgggcgagctgtgttggctgttctgctgtcctccctgccctagtcggattgctgccaaactagccttccttccaccggagcccacctacactgtgctcgctccagaacaaagaggcgccggggcgtccgcacccgcaccagctcaggctacggccgctgctgcagcggcacagcctgcgcctcagcagcccgaagagggcgctggcgccggaccaggcgcctgcagtctacacttatctgagagggctgactggcagtattctcagcgggagctggacgctgtcgaagtgtttttctcccgaaccgcaagggataacagactgggatgtatgtttgtgcgatgcgccccctctagccgctatacccttctgttctcgcacgggaatgcggttgatctgggccaaatgtgctccttttacattggtctcggttcacgcataaattgtaacatcttctcatacgactactctgggtatggagtgagcagcggaaaaccttccgagaagaacctgtatgctgacatagatgccgcttggcaggccctgaggacacggtacggcgtcagtccggagaatataatcctatacggccagtccatcggaactgtgcccacagtagacctggccagttccatcgacaaaatcagcaaagttaccagtcctgttctcgtgattcacggcaccgaggacgaggtgattgatttcagtcatggccttgcaatgtacgaaagatgcccaagagccgtcgagcctctctgggtggagggggccggacataacgatatagagctttacgcccagtacctcgagagattgaagcaatttattagccatgaactgccaaatagctag

SEQ ID NO: 29576 - DNA, 816 bp, Artificial Sequence
  Description of Artificial Sequence: Synthetic coding sequence
atgctacttgctcccccttcgaccccctcaaggggccggactccgagtgcagtggaaaggttggaagccgacaaggctaagtacgttaaaactcaccaggtgattgctcggaggcaggaaccagctttgagagggagccctggacctctcacccctcacccttgcaacgaactgggccccccggcctctcctcggacgccacgacccgtgcgaagaggcagtggccggcggttgccacgaccagactctttaattttctatcggcagaagagagactgcaaggcatccgtgaataaggaaaacgctaagggccaaggcttggtgaggcgtttgttcctgggcgctccgcgtgacgccgccccgagctccccagctagtactgaaagacccgctgccagcggaggatgggcagcgcctcaggacgcccccgaggccgcggggaaacgtgccctgtgcccgacctgttccctacctctcagtgaaaaggaaagattctttaattattgcggcctggagcgggccctggtggaagtccttggtgccgagcgatttagtcctcagtcttggggtgccgacgccagcccacaggccggcacctcaccaccacctggctctggagacgcgtcagattggacttccagtgaccgaggcgtcgactcccctggaggcgccgggggcggaggtggctctgaggcggcgggtagcgccagggataggagacctccagtaagcgttgttgagcgcaacgctcgcgtaatccagtggctttacggctgtcagagggctaggggtcccccccgtgagagtgaggtttag

SEQ ID NO: 29577 - DNA, 1836 bp, Artificial Sequence
  Description of Artificial Sequence: Synthetic coding sequence
atgtcatgtaagaagcagaggtcacgcaagcactcagtgaacgaaaagtgtaacatgaagattgagcactacttctcgcctgtgtccaaagagcagcaaaataactgtagcacaagtctgatgcgtatggaaagtagaggagacccccgggcaaccacgaacacccaagctcagcggttccactccccaaaaaagaatcctgaagatcagaccatgccgcagaataggacaatctacgtaaccctgaaggtgaatcacagaaggaaccaggatatgaaactcaagcttacacattctgagaattcaagcctctacatggccctcaacacactacaggctgtgagaaaggagattgagactcaccagggacaagaaatgctcgtgcggggcactgagggaataaaggagtacattaatctggggatgcccctttcctgcttccctgaggggggacaggttgtaattacattcagtcagtcaaaaagcaaacaaaaagaagataatcacatatttggccgacaggacaaggccagtacggagtgcgtgaagttttacattcacgccataggtataggtaagtgcaaaagaagaatcgtgaaatgcggcaagcttcacaaaaaaggccgtaaactttgcgtctatgcctttaaaggtgaaaccataaaggatgccttatgtaaagatgggagattcttgagcttcctggagaatgatgactggaaattaattgagaataatgatacgatcttggagtcaactcagccagtggatgagctggaaggccggtactttcaggttgaagtggaaaagagaatggtgcccagtgcagctgcatcacaaaacccagagtcagagaagcgtaatacatgtgtcctccgtgagcagattgtggctcagtatccatcactcaaacgtgaaagcgagaaaatcattgagaatttcaagaagaagatgaaggttaagaacggcgagaccctgttcgaactgcaccgcactacctttggaaaagtgactaagaattcctcatcgattaaagtcgttaagctgctggtcagattaagcgactctgtgggctatctcttctgggattctgccactaccggatacgcaacatgcttcgtgttcaaggggttatttattctgacatgccgtcatgtaattgattcgattgtcggcgatggcatcgaaccctcaaagtgggctaccatcatcggacaatgcgttagggtaacattcgggtatgaagagcttaaggacaaggagactaattacttctttgtggagccgtggtttgagatccataacgaggagttagactatgctgtcctgaagctgaaggagaacggccagcaggtaccaatggaactatataacgggatcacacccgttcctttgtctggcttaatccatatcattggacacccctacggtgaaaagaaacagattgacgcatgtgccgttatcccacagggccaacgggccaagaagtgccaggaaagagttcagagtaaaaaagccgagtccccggagtatgttcacatgtacacccagagatctttccaaaagattgttcacaaccccgacgtgattacatacgatacggagtttttttttggggcctccgggagtccagtatttgatagtaaaggtagtttggtcgccatgcatgcggctggcttcgcctacacataccagaacgaaactaggagtattatcgagtttggctcgacaatggaatccatccttttagacattaaacagagacacaagccatggtacgaagaagtgtttgtaaatcagcaggatgtagagatgatgagcgatgaagacctgtag

SEQ ID NO: 29578 - DNA, 1836 bp, Artificial Sequence
  Description of Artificial Sequence: Synthetic coding sequence
atgtcgtgcaaaaagcagcgtagtcgtaaacactcagtaaatgagaagtgcaacatgaaaatagagcattactttagccccgtttccaaagagcagcagaataactgcagtacttcgctaatgcgcatggaaagcagaggggacccacgtgctactaccaatactcaggctcagcggttccattcacccaaaaagaatccggaagaccagacgatgccgcagaaccgaacaatatacgtgaccctgaaagttaatcatcggcggaaccaggacatgaaactgaaactcactcactcagaaaactcatcgttgtatatggctctgaataccctccaggcagttaggaaagagatcgagacacatcagggacaggaaatgcttgtgcgcggcaccgaggggattaaagagtacatcaacctgggtatgcccttaagctgcttccccgaaggagggcaggtcgtgatcacattctctcagtccaaatctaagcagaaggaggacaatcatatatttggaagacaggacaaggcgagtacagagtgtgtgaagttctacattcacgccatcgggattggcaagtgtaaaaggcggatcgttaaatgcggcaaattgcacaagaagggccggaaactctgtgtatatgctttcaagggcgaaactatcaaggatgccttgtgtaaagatggcagattcttgtcattcttggaaaatgatgattggaaactcatagagaataatgacaccattctggaaagtacacagccggtcgacgagctggaaggccggtacttccaggttgaagtggaaaagcgaatggtcccatccgccgctgcctctcagaatccagagtccgagaagcgcaacacttgcgtgctccgggagcaaattgtggctcagtacccttccctgaagcgtgaaagcgaaaagatcattgagaattttaagaagaaaatgaaagtcaagaacggcgagaccctctttgaactgcatagaacaacctttggaaaagttactaagaacagcagcagcataaaggtcgtgaagctccttgtgcgactgtctgactccgttggctacctgttctgggattctgcaaccaccggttacgcaacgtgttttgtgttcaaagggctcttcatccttacttgccgacacgtgattgacagtatagtgggagacggtatcgaaccgtcgaagtgggctactatcattggccagtgcgtgcgggttacgttcgggtatgaagagcttaaagataaggagaccaactatttctttgttgagccctggtttgagatccacaacgaagaactggattacgctgtgcttaaacttaaagaaaacgggcagcaggtgcccatggaactgtataacggaatcacacctgtgcccctttctgggcttattcacattatcggacatccatacggggagaagaaacagatcgacgcttgcgctgtgatcccgcagggccagagggctaagaaatgccaggaaagggttcagtctaaaaaggctgaaagtccggagtatgtgcatatgtacacccaacgatctttccaaaagatagttcacaaccccgacgtcattacgtacgatacggagtttttcttcggagcgtccggctccccagtgttcgattctaaaggcagcttagtggccatgcatgccgccggatttgcctacacttatcaaaatgaaaccagatccatcatagaatttggttctactatggaatcaatcctcctcgacataaaacagcgacataaaccatggtatgaagaggtcttcgttaatcaacaggacgtcgaaatgatgagtgatgaggacttatag

SEQ ID NO: 29579 - DNA, 552 bp, Artificial Sequence
  Description of Artificial Sequence: Synthetic coding sequence
atgtcttgtaagaagcagagatccagaaagcactccgtaaatgaaaagtgcaacatgaagatagagcactatttcagtcccgttagcaaagagcagcaaaacaactgttctacttccctcatgcgcatggaaagccgtggagatccacgagctacgacaaacacacaggcccagagattccactcacctaagaaaaaccccgaagatcagacgatgccccagaatcgaactatttatgtaaccctaaaggtaaatcatagaaggaatcaggacatgaaactgaagctcacccactcagaaaactcgagcctgtacatggccctaaacacccttcaggctgtcaggaaggaaatcgagacacaccaggggcaggaaatgctggtgcgtggaaccgagggtattaaagagtatatcaacctgggtatgccgcttagttgtttccctgagggcgggcaagttgtgatcactttctctcaatctaaaagcaaacaaaaggaagacaatcacatctttggacggcaagacaaagcaagcacggagtgtgtgaaatag

SEQ ID NO: 29580 - DNA, 1836 bp, Artificial Sequence
  Description of Artificial Sequence: Synthetic coding sequence
atgtcctgtaaaaagcagaggtctagaaaacattccgtaaacgaaaagtgtaatatgaagatagaacactacttctcccctgtgagcaaggagcagcagaataattgctcgacttcactgatgagaatggaaagccgaggtgatccaagagcgacaaccaatactcaggctcagcgctttcatagcccaaagaagaatccagaggatcaaacaatgccgcagaaccgcactatatatgtgaccttgaaagtcaatcatcggcggaaccaggacatgaaacttaaactcactcattccgaaaatagtagcctctatatggcccttaacactctccaggccgtgagaaaggagattgagacgcaccagggacaagagatgttagtcagaggaaccgaggggatcaaagaatatatcaacctcggcatgccactgtcctgctttccagaaggggggcaggtagtcatcacgttttctcaatctaagagcaagcagaaggaggataaccatatcttcgggaggcaggataaggcttcaaccgagtgtgtaaagttctatatacatgcaattggcataggcaagtgcaagcggagaatagtcaaatgcgggaagctgcataaaaagggaagaaagctgtgtgtgtacgcatttaagggcgagacaatcaaagatgctctgtgtaaagatggacgatttctctcttttctggagaatgacgactggaagttaattgaaaacaatgacacaattctggagagtacacagccagtcgatgagcttgagggaaggtactttcaggtagaggtcgaaaaacgaatggtcccaagtgccgcagcttcccagaaccctgaatcggaaaagagaaacacttgcgttctgagggaacagattgtagctcagtatccttcattgaagcgcgaatctgagaagattatagagaactttaaaaagaaaatgaaggtcaaaaatggagagactctgttcgagctccatcggaccacgtttggaaaagtcactaagaactcctcaagcattaaggtggtgaagctgcttgtgcgtctgtccgattccgtgggctacctcttttgggacagtgctaccacaggttatgcaacctgttttgtctttaagggtctgttcattctaacatgcaggcatgtcatagattccattgtgggggatggaattgaaccctctaagtgggctacaattatcggccaatgcgtaagagtgacctttggatatgaagaactcaaagacaaggagaccaactacttcttcgtggaaccgtggtttgagatacacaacgaagagctggactatgcagtcctcaaattaaaggaaaatggccaacaggtccctatggagctatacaatggaattactcccgttcctttgagtggcctgattcatattataggtcatccatatggggaaaaaaagcagattgatgcctgtgcggtcattccacaggggcagcgggctaagaagtgccaggaacgggtgcaatccaaaaaagccgaaagtcctgagtacgtccatatgtatacccagagatctttccaaaaaattgtccataaccccgatgtgattacctacgataccgaattcttcttcggggcatcgggtagccccgtatttgattccaagggtagcttagtggcaatgcatgcagcaggttttgcttacacatatcagaacgagaccagatccatcatagaattcgggtccactatggagtccatactgctcgatatcaaacaacgccacaagccctggtatgaagaggtgttcgttaaccaacaagacgtggagatgatgtccgacgaggatctttag

SEQ ID NO: 29581 - DNA, 1836 bp, Artificial Sequence
  Description of Artificial Sequence: Synthetic coding sequence
atgtcgtgtaaaaaacagcgttcaaggaaacacagcgtcaacgaaaaatgtaacatgaagatcgaacactatttcagtcctgtctcgaaggagcaacagaataattgttccacgagcttgatgagaatggagagtcggggagaccctcgggctacaaccaacacacaggcccagagattccactcccctaaaaagaatccagaagatcagacaatgccccagaaccggaccatatatgtcaccctgaaggtcaatcaccggcggaatcaggatatgaaactgaagctgactcatagcgagaacagcagcttgtacatggccctcaacactctacaagccgtgcggaaagaaattgagactcatcagggccaggagatgcttgtacgcgggacagaaggcattaaagaatacatcaacctgggcatgcccctttcctgctttccagaaggggggcaagtggtgataacattttcccagtcaaaatctaaacaaaaggaagacaaccatatttttggccggcaggataaggctagcactgagtgtgttaagttttacattcacgcgatcggtatcggcaaatgtaagaggcggatagtgaaatgtgggaaactgcacaagaaggggcgcaaactgtgtgtttatgcctttaaaggcgagaccattaaggacgccctgtgtaaagacgggagatttctgtctttcctggaaaacgacgattggaaactgatcgaaaacaatgacaccattctggaaagcacacagcctgtggacgaactcgagggccggtattttcaggtggaagtggagaagaggatggttccttccgccgctgcaagtcagaatcctgaaagcgagaagcgcaatacctgcgtgctgagagaacagattgttgcgcagtatccctccctcaagcgggagtccgaaaagattatcgagaacttcaagaagaaaatgaaggtgaaaaacggtgagacgttgtttgagctgcacagaactacctttggtaaggttactaagaattctagcagcattaaagtggtgaagctgctcgtgaggctctcagactcggtcgggtatctgttttgggattctgccaccactggttacgccacatgcttcgtctttaagggcttgttcatcctgacttgtcgccatgtcatagactccatcgttggtgatgggattgagccctcaaagtgggcaacaattattgggcagtgcgtgagagtgacttttggatatgaggagctgaaggacaaagagactaactacttcttcgtggaaccttggttcgaaattcacaatgaagaactcgactacgctgtgctgaagctgaaagaaaacggtcagcaggtgccaatggaactgtataacgggataactcctgttcccctttccggccttatacacatcatcggacacccgtacggcgaaaagaagcagatcgatgcttgtgccgtgatccctcaaggacaacgcgcaaagaagtgccaagagcgcgtccagagcaaaaaggctgaatcaccagagtacgtccacatgtatactcaacgatcatttcagaagatcgtgcacaaccccgacgtcataacttacgatactgaatttttcttcggggcatctggctcccccgtgttcgacagcaagggtagcctggtggccatgcacgctgccggttttgcttatacatatcagaacgaaacccgaagcattatagagttcgggagtacaatggagagcattctgctcgacattaagcagcgccacaagccttggtacgaagaagtatttgtgaaccagcaagatgtggagatgatgtctgatgaggacctgtag

SEQ ID NO: 29582 - DNA, 291 bp, Artificial Sequence
  Description of Artificial Sequence: Synthetic coding sequence
atgagttgcaagaagcagcggtcaagaaaacacagcgtgaacgagaaatgtaatatgaaaattgagcactacttctcgccagtcagtaaggagcagcagaataattgttcgacctctttgatgcgaatggagagcaggggggacccccgcgcaaccacaaatacccaagcgcagcggttccatagccccaagaagaatccggaagaccagacaatgccccagaaccggactatctatgtgacacttaaggtgaaccataggcggaatcaggatatgaagctgaaactgtag

SEQ ID NO: 29583 - DNA, 1836 bp, Artificial Sequence
  Description of Artificial Sequence: Synthetic coding sequence
atgagctgcaagaaacaacggagccggaagcactctgtgaatgaaaaatgtaatatgaaaatcgagcattactttagccctgtctccaaggagcagcagaacaattgttccacttcactgatgcgaatggagagtcggggggaccctcgggccaccacaaatacacaggcgcagaggttccattcaccaaagaaaaacccagaggatcagacaatgccacagaatagaactatctacgtgaccctaaaagtaaatcatcgccgaaatcaggatatgaaactaaaacttacccatagtgagaacagctcgctctatatggcactgaacacgctgcaggcggtgagaaaggaaatcgagactcaccagggccaggagatgctagtgcgggggacggaaggaatcaaggaatacattaatctggggatgccactttcttgttttccagaaggggggcaggttgtgattaccttctcgcagtcgaaaagcaagcaaaaagaggacaatcacatttttgggcgccaagataaggcatccaccgaatgcgtgaaattttacatacacgcgatcggcattggtaaatgtaaaaggcgaattgttaaatgcggcaaattgcacaaaaaaggccgaaaactatgcgtgtatgcattcaagggggaaaccatcaaagatgccctgtgcaaagatggtcgctttctctcattcctcgagaatgatgactggaaactcattgagaataacgataccatcctggagagcacccagccagtggatgagctggaaggaagatatttccaggttgaagtcgagaagcgaatggtgccaagcgcagccgcttctcagaaccctgaaagcgagaagagaaacacatgtgtcctcagagagcagatcgtcgcgcagtatcctagcctgaagagagaatccgagaagatcatcgaaaacttcaagaagaagatgaaagtgaaaaatggcgaaactctgttcgagcttcaccgaactacctttggtaaggtgacaaagaacagcagtagcataaaggtagttaaactgctcgtccgcctgtctgattcagtaggctatctgttttgggacagcgccacaaccggctatgccacttgcttcgtattcaaggggctgttcatcttgacttgtaggcacgtcattgacagcatcgtaggagacggtatagaaccgagtaaatgggcgacaatcattggccagtgcgtgcgggtaactttcggttacgaggagctgaaggacaaggagaccaattatttcttcgttgaaccatggtttgaaattcacaacgaggagctggactatgccgtgcttaaactgaaggaaaatggacagcaggttcccatggagttgtataatggtatcacacccgtgcctctctccggccttatccatatcatagggcacccatatggcgaaaaaaaacagattgacgcttgtgcggtcatcccgcagggacagagggcaaagaagtgccaggaacgggtccagagcaagaaggctgagtccccggagtacgttcatatgtatacacagaggagcttccagaaaatagtgcacaacccggatgtcattacttacgacacggaatttttttttggagctagtggtagtcctgtgtttgacagcaagggatcattagtggcgatgcatgctgctggatttgcctacacataccagaacgagacgagaagtatcatcgaatttggatctacgatggaaagcatcctgctggacattaagcagcgacacaaaccttggtacgaggaggtgttcgtgaatcagcaggacgtcgagatgatgagtgacgaagacttatag

SEQ ID NO: 29584 - DNA, 2205 bp, Artificial Sequence
  Description of Artificial Sequence: Synthetic coding sequence
atgaatagtatgaaaacagaggagaacaaatccttttctgcaatggaggacgaccagcggacccgccctgaggtgtcgaaagacacggtgatgaagcaaacccacgccgatacacccgtggaccactgtctttctggtattcggaaatgcagctccacttttaagctgaagtccgaggtcaataagcatgaaacagctttggaaatgcagaacccaaatctgaataacaaagaatgctgtttcaccttcacactcaacgggaactccagaaaactcgacagatccgtgtttaccgcttatggtaagccttcagagtccatttactctgcactgagcgcaaacgactatttttctgaaagaatcaagaatcagttcaacaagaacatcatcgtgtacgaagagaaaactatcgatggccacatcaatttgggtatgccgctgaagtgtctgccatccgattctcatttcaagataacgtttggccagcgaaaatcaagtaaagaagatggccatattttgcggcagtgtgaaaacccaaatatggagtgcattctgttccacgtggtggctattggccgtaccagaaaaaagattgtcaaaatcaacgagctacacgagaagggtagcaaactctgcatctatgccctgaaaggcgaaactatcgaaggggccctgtgcaaagacggtcgcttccgaagcgacatcggagaattcgagtggaagttgaaggagggccacaagaagatttacggaaaacagtctatggtcgacgaagtgagcggcaaagtgcttgaaatggatatttccaaaaagaaggccttgcagcaaaaggatatacataaaaaaattaaacagaacgagtctgcaaccgacgaaatcaatcaccagtccttaatccagtcaaagaagaaggtgcacaaaccgaaaaaggatggagagactaaagatgtcgagcattcccgggagcagatccttcctccccaggatttgtctcattacattaaggataaaactcgtcagactatcccccgcattcgtaattactatttctgtagcttgccgcgcaagtacaggcagattaactcccaggttcgaagaagaccccacttaggtcgaaggtacgctataaatctggatgtgcagaaggaggccattaatctcctgaagaattatcagacactcaacgaagctattatgcaccagtaccctaatttcaaggaggaggctcagtgggttcgcaaatatttcagggaggagcagaagcgaatgaacctttcccctgccaaacagtttaatatctataagaaagattttgggaaaatgacagccaactcagtttcagtagcaacctgtgagcagctgacctattacagcaagtcagtcggattcatgcaatgggataacaacggcaatacaggcaatgccacatgtttcgtgtttaatggggggtacatcttcacatgccgtcacgtggtgcatctgatggtggggaaaaacactcatccatcactgtggccagacatcatcagcaagtgtgctaaggttacattcacttacacagagttctgccccacacccgataattggtttagcatcgagccttggctgaaagtgagcaacgagaatctggactacgctatcctaaagctaaaagagaacggcaacgccttccctcccggattgtggcgtcagatcagtccacagccctcaacaggactaatctacctgatcggccatcctgagggtcagatcaaaaagattgatggttgcaccgtcattccattaaacgaaagacttaagaagtatcccaatgattgccaggacggcttagtggacctatatgacaccaccagcaacgtttactgtatgttcacacaaaggtcattcctcagtgaggtgtggaatactcacacactatcctatgacacatgcttctcagatggttctagtgggagccctgtgtttaacgccagtggcaaactggttgcactccacacctttgggctgttttaccagaggggatttaacgtccacgctctgatcgaattcggctacagcatggactcaattctgtgcgacatcaagaaaactaatgaaagtctatacaaaagcttaaacgatgagaaactggagacgtatgacgaggagaaaggtaaacaggagtcctcactacaagaccaccagattgaaccaatggaatgttag

SEQ ID NO: 29585 - DNA, 2115 bp, Artificial Sequence
  Description of Artificial Sequence: Synthetic coding sequence
atgaaacagacccacgcagacacgccagtggatcactgtctttccggaatacgaaaatgttccagcacttttaaactcaagagtgaggtaaataaacatgagaccgcactcgagatgcaaaaccccaacctcaacaataaggaatgctgttttacctttacactgaacggtaattcgagaaaactcgatcgctctgttttcaccgcctatggcaagccgagcgagtctatctatagtgcattgtcagccaacgattatttctctgagcgaattaaaaatcagtttaacaaaaatattatcgtttacgaggagaagacaatagatggacatattaacctgggtatgcccctgaaatgtttgccttctgactcgcacttcaagatcaccttcgggcaacgaaaatccagtaaggaggacggccacatcctccgccagtgtgaaaaccctaatatggaatgcatcttgtttcacgtggtagccatcgggcgcacgcggaaaaagattgtaaaaattaatgagcttcatgaaaagggatccaagctctgcatatacgccctaaagggcgaaacaattgaaggggccctttgtaaagatggaagatttaggtccgacataggcgaatttgagtggaaattgaaagaagggcacaaaaagatctacggaaaacaaagtatggtggacgaggtgagtgggaaagtccttgagatggacattagtaagaagaaagcccttcaacagaaggacatacacaagaaaattaaacagaacgagtccgccacagacgagattaaccatcaatccctgatccagtcaaaaaaaaaggtacataagcctaagaaggacggtgaaactaaagatgttgagcattctcgtgaacagattctgccaccacaagacctgtctcactatattaaagacaaaacaagacaaactatccccagaattcgcaactactatttctgctccctgccacgaaagtatcgccaaatcaactcacaggttcgccggcggccgcacttgggacgccgctatgcgatcaatttagacgttcaaaaggaagccatcaacctgttgaagaattatcagactctgaacgaggctattatgcatcagtaccctaactttaaggaggaagcacaatgggttcgaaagtattttagggaggagcaaaagcgaatgaacttgtcacccgccaagcagttcaacatatacaagaaggatttcggaaagatgacagcaaacagcgtgtctgtagccacatgcgagcaactgacctactacagcaaatcagtgggctttatgcagtgggacaacaacggaaacacgggcaatgcaacctgtttcgtgttcaacggaggctacattttcacctgccgccacgtggtgcaccttatggtcggaaaaaacactcacccgagcctgtggccggacataattagtaaatgcgccaaggtcactttcacgtacacagagttctgtcctacccctgataactggtttagcatcgaaccttggctcaaggtgagcaatgagaatctggattatgctatcctcaagttgaaagaaaacggtaacgctttcccccctggattgtggaggcagatttccccccagccaagcacaggtctgatctatctgattggccacccagaaggtcagatcaagaagatcgacggctgcactgttatcccactgaatgagaggttaaaaaagtatcctaatgattgccaggatggccttgtcgatctgtacgacacaacaagtaacgtgtattgtatgtttacccagcggtccttcctcagcgaggtgtggaatacacatactctgagttacgacacctgcttttccgacgggagctctgggtcacccgttttcaacgcctcgggcaagctggtggccctacatacgtttggcctcttttatcagcgtgggtttaacgtgcatgctctgatcgaattcggatattcaatggactcaattctgtgcgacatcaagaagacaaatgagtctctgtacaaatctttaaatgacgaaaaactggagacatatgacgaagaaaaagggaagcaagagtctagcctccaggatcaccagattgaaccgatggaatgctag

SEQ ID NO: 29586 - DNA, 2115 bp, Artificial Sequence
  Description of Artificial Sequence: Synthetic coding sequence
atgaaacaaacccacgccgatacgccggttgaccattgcttatcgggtattcgcaagtgtagcagtacctttaaactaaaaagtgaggttaataaacacgagaccgcacttgaaatgcagaacccaaatttgaacaacaaggaatgctgcttcacttttacattaaatggaaactcgcggaaacttgaccgctccgtcttcacggcttacggtaaaccctcagagagcatttattcggccctcagcgccaacgattattttagtgaacgtattaaaaaccagttcaacaaaaatatcatagtctatgaggagaaaaccatcgacggccacattaacctggggatgcctctcaagtgtttaccctctgactctcacttcaaaatcacctttgggcagagaaagagtagtaaggaagatggtcacattctgcggcagtgtgagaatccaaacatggagtgcatcctgtttcatgtcgttgcgattggccgcacacgaaaaaaaatcgtcaagattaatgagctccacgagaagggcagcaagctgtgtatctatgcgctgaagggcgagacaatcgagggagctttgtgtaaagacgggaggtttcgctcagacatcggcgagttcgagtggaaacttaaggaaggacataagaagatctacggcaaacagtctatggtggatgaagtcagtgggaaagtgctcgaaatggacataagcaaaaagaaggcactgcaacagaaggacatccacaaaaaaattaaacagaatgagtccgccactgatgaaattaatcaccagagcttgattcagagcaagaagaaggtccataaacctaaaaaggacggtgagaccaaagacgtggagcactcacgcgagcaaattttgcccccacaggacctgagccattacatcaaagataagacccggcaaaccattccccgtatacggaattattatttctgttctctaccccgaaagtacaggcagatcaatagccaggtacgccgtaggccacatctgggccggcgctacgccataaatctagacgtacagaaggaagccatcaatcttctgaagaactaccagactctgaacgaggcgattatgcatcagtaccctaattttaaagaagaagcacagtgggtcagaaaatacttccgtgaagagcagaagcgcatgaatctctcgcccgctaaacaatttaacatctacaagaaagacttcgggaagatgaccgcaaatagtgtctccgtggccacctgtgaacagttgacttactactccaagagtgtggggtttatgcaatgggacaataatggaaataccggaaacgcaacctgcttcgtgtttaacggcggctatatctttacctgcaggcacgtggtgcacctgatggtgggcaagaacacccacccatccctatggcctgacatcatctctaaatgcgcgaaggtgacgttcacatacacagaattctgcccaactcccgataactggttctccatagagccttggctgaaagtgagcaatgaaaacctggactacgctatcctcaagctcaaggaaaacggtaatgcctttcctccaggtctctggcggcagatctccccacagcctagcactggtcttatctacctcatcggccacccggaaggacagatcaagaagatcgatgggtgcaccgttattccgcttaacgagcggctgaagaagtaccccaacgattgccaggacggtctggttgatctgtacgataccacctccaatgtatattgcatgttcactcagcggtctttcctcagtgaggtttggaatacacacactcttagctacgatacttgtttttctgacggttccagcggatcgcctgtcttcaacgcctccggcaaactcgtagcactccacacctttgggcttttctaccagaggggattcaatgtacacgctcttatcgagtttggatattcgatggattcaatcctctgcgatattaagaagactaatgagagtctgtacaaaagcctgaacgacgagaaactggagacctatgacgaggagaaagggaaacaggagagcagcctgcaggatcaccaaattgaacccatggaatgttag

SEQ ID NO: 29587 - DNA, 489 bp, Artificial Sequence
  Description of Artificial Sequence: Synthetic coding sequence
atgaagcagacccacgcagacacccctgtcgaccactgtttgagtggcattcgcaaatgctcatcgacctttaagctaaagtccgaagtcaataagcatgaaacagcacttgagatgcagaatcccaacctcaataataaggaatgctgttttacgtttactctcaatggaaatagcagaaagctcgaccggtctgtgttcaccgcatacggcaagccttctgagagtatttacagcgccctgagcgccaatgattatttttcagaaagaataaagaatcaattcaataagaacattattgtgtacgaggagaaaaccatcgacggccatatcaatttaggtatgcctctcaagtgcctgccatctgattctcatttcaagattacatttggtcagaggaagagctctaaggaggacggccacatactacgacagtgtgagaatcccaatatggagtgtattctcttccatgttgtagccattggctag

SEQ ID NO: 29588 - DNA, 1212 bp, Artificial Sequence
  Description of Artificial Sequence: Synthetic coding sequence
atggtgttttgcctgtcgagcgaggagcctaggcgccccttacgcagtgatatggtccactttcaggcctcagaagtgcaacagctgctccacaacaaatttgtagtgatcctaggcgacagcatccagcgcgccgtgtataaagatctcgtgctcttgctgcagaaagattccctgctcacagccgctcagctgaaggctaaatatctggaagacgtgctggaagaactcacctatgggcctgcgcctgaccttgttatcattaattcttgtttgtgggacctgtctagatacggacgctgttcaatggaaagttacagagagaacctcgagcgagtcttcgttcgcatggaccaggtcctacctgactcatgcctgctagtatggaatatggctatgccgttaggcgaacgcatcaccggtggctttctgctgcccgaacttcagccgctcgctggctcactgagaagggatgtcgttgaaggaaacttctattccgccactcttgcaggagatcattgttttgacgttttggacttgcactttcatttccggcacgcggtccagcatcgccaccgtgatggcgtccattgggatcagcatgcccaccgtcacctcagtcatctgctgctgacccacgtggccgacgcttggggtgtagagctcccaaaacgcggctatccacctgacccgtggattgaggactgggcagagatgaatcatcctttccagggatcccatcgccagactcctgattttggtgagcacctggccctgctgcctccaccacctagctcgctgcctccacctatgccctttccctaccctcttcctcagccgtcccccccacccttatttccacctctcccgcaggacacaccattcttccccggacagccgtttcctccccatgagtttttcaattataacccggtcgaggacttcagcatgccaccacatctgggatgcggcccgggagtgaattttgtacctggaccactcccgccacctatacctggccccaaccctcacggccagcactggggtccagtggtccacaggggaatgccaagatacgtgccaaatagcccctaccacgtaagacgcatggggggcccatgcagacaaagactcagacactccgagcggctcatacatacatataagctggaccggagaccacctgctcattccggtacatggccaggctag

SEQ ID NO: 29589 - DNA, 1365 bp, Artificial Sequence
  Description of Artificial Sequence: Synthetic coding sequence
atggtgttctgcctatcctctgaggagccaagaaggccactgagatccgacatggttcattttcaggcgtccgaggtccagcagctgctgcataataaattcgtagtgatccttggcgatagtatccaacgtgccgtgtataaagacttggtgctgcttctccagaaagacagtctcctgacggcggcccaactgaaggcaaaaggagagctgtcgtttgagcaagaccagctggttgcaggaggtcagcttggcgagttgcacaacgggactcaataccgagaagtgcggcagttctgttctggctctgggcaccacctcgtgcgtttttactttctgacacgcgtgtatagtgaatacctggaggacgttctcgaagagttaacttacgggccggcacctgacctggttattatcaactcatgcctgtgggacctttccagatatgggcggtgcagcatggagtcctatcgtgaaaatctggagagagttttcgtgcgcatggatcaggtgttaccagactcttgcctgctcgtctggaatatggctatgccgctcggtgagagaatcaccggtggttttctgctccccgagctccagccactggctgggtctctgaggagagatgtggtggagggcaacttctatagcgcgacgctcgccggggatcattgcttcgacgtactggatttacattttcatttccgacacgctgtacaacaccggcatcgggacggcgttcactgggaccaacacgcgcaccgccatctgagtcatctgctcctcacccatgtagcagacgcttggggagtggaactgccaaagagggggtaccctcctgacccatggattgaagattgggcagagatgaatcatccatttcaaggttctcatagacagactcccgactttggagaacatctggccctgcttccccccccaccttcgtccctccccccacctatgcccttcccttacccactgccacagccctcacctccgccactgtttcctcctctccctcaggataccccgttttttccggggcaaccattccctccccacgagttcttcaactacaatccggtagaagatttctccatgccaccccacctcgggtgtggacctggggtcaatttcgtgccggggccacttccacccccaatccctggccctaatccgcatggacagcactgggggccggttgtgcataggggcatgccgagatatgtcccaaacagcccctaccatgtgaggcgcatgggcgggccatgccgccagagattgcggcacagtgaacgcctaatccatacttacaaactagaccggagaccaccggcacactctggtacctggcctggttag

SEQ ID NO: 29590 - DNA, 465 bp, Artificial Sequence
  Description of Artificial Sequence: Synthetic coding sequence
atggtgttctgcctgagctctgaagagcctcgccgcccactgcgaagcgacatggttcacttccaagcttcagaagtacagcagctcctgcacaataagttcgtggtgatactgggcgacagcattcagcgggcagtttacaaggatttggtgcttttgctccagaaagattctctcttgaccgccgcacagctcaaggcaaaaggtgagctgtcctttgagcaagatcagttggttgctggcgggcagctgggagaactgcataacggcacacagtatagggaggtccgccagttctgcagtgggagtgggcaccatctggtgcgattctattttctgacccgagtgtactctgagtacctcgaggacgttctcgaggaactaacctacggcgcctctcccagtcaccctatgaattctagcaccataattcagtggcgaacgtctaggtgtcatccaacctag

SEQ ID NO: 29591 - DNA, 843 bp, Artificial Sequence
  Description of Artificial Sequence: Synthetic coding sequence
atggtcttctgtctctcctctgaggagccaaggcgtcccctccggtccgacatggtgcatttccaagcctctgaggtgcaacagctgcttcataataaattcgtagtgatcctcggagactctattcaacgcgcagtttacaaggatctcgtcctgctgttacaaaaggacagcctcctcaccgcggcccaactcaaagctaagggcgagctgtcttttgagcaagaccagctggtggctggaggccagttgggtgaactgcataatggcacccagtatagagaggtgagacagttttgtagtggttccgggcatcacctcgttcgattctattttctgactcgcgtttactccgagtatctagaggacgtactggaggaactcacctacggtccagctcccgatctcgttatcatcaattcctgcctgtgggatctgtcaagatacggcagatgcagtatggagagttacagggaaaatctggagagggtttttgtgcgtatggaccaggttcttccggactcctgtctcctcgtgtggaatatggcaatgccgttaggagagaggatcacgggaggcttcctcctgccagaactccaacctctcgccggcagtctcagaagggacgttgtggaggggaacttttatagcgctaccctggcgggggaccattgttttgacgtgcttgatctacattttcacttcaggcatgcggtgcaacacaggcacagagatggggtacattgggaccaacacgcacacagacatctttcccaccttttgctcacccacgtcgccgacgcctggggggtggagctgccaaaacggggctatccaccttag

SEQ ID NO: 29592 - DNA, 690 bp, Artificial Sequence
  Description of Artificial Sequence: Synthetic coding sequence
atggttttttgtctgtcatcggaggaaccacgccggcccctccggagcgacatggtccatttccaggcaagcgaagtccaacagttgctccacaacaagttcgtggtcatccttggtgatagcatacagcgggcggtctacaaggaccttgtcctcctgttacagaaggattctctgttgacagccgcccaactcaaagcaaagtacttggaagacgtgttagaggagttgacatacggccccgcgcccgatcttgttattattaattcgtgcctgtgggatctgagcaggtatggaaggtgctcaatggagtcctacagagagaatctggagagagtttttgtgcggatggaccaggtgcttcctgattcctgtttgctggtgtggaatatggcgatgccactgggtgagcgcatcacagggggatttctgctgcctgagctgcaaccactggctggttctttgaggcgcgacgtggtagaaggcaacttttatagcgcaaccctggccggtgaccactgcttcgacgtactcgatctccatttccactttcgtcacgccgtgcagcatagacacagagacggcgtgcactgggatcagcacgcccaccggcacctgtcgcatctgctgctcacccatgtggcggatgcctggggggtggagctacctaagaggggctatccaccttag

SEQ ID NO: 29593 - DNA, 840 bp, Artificial Sequence
  Description of Artificial Sequence: Synthetic coding sequence
atgaattcctgtttgtgggatatcagccggtacggccccaacagttggcgatcctatctggaaaatctcgagaatctttttcagtgtttaggccaggtgctgccagaatcttgcctgctggtgtggaacaccgctatgccagtgggtgaggaagttactggaggttttctcccccctaagcttagacgtcagaaggccacttttctcaaaaatgaagtcgttaaggccaattttcacagtgcgaccgaagcacggaaacacaacttcgacgttctcgacctgcactttcatttccggcacgctcgggagaatctccattgggacggggttcattggaatggacgggttcatcgatgtctgtcccagctgctcctggctcatgtcgccgacgcctggggagtcgagctacctcatcggcatcctgtgggtgagtggataaagaagaaaaaacccggtcctagagtcgagggtccccctcaggctaataggaatcaccccgcccttccactgtccccgccgctaccgtctccaacatataggcctctgctaggcttcccccctcagaccattctcagtagccggatcaactctattgcaattcagatgtccccccaccaacccatgcaggtatcaagtagtaaaacaattttatggctggtgctatcatgcctctgcccttcaagtccccaccccgtcataagtggattaccccagtggtatatcggtgtgctggctgggatagtgcccgttgctcccatcaggcctggggattcgggtctcgacctgcagcgcgaaggcccccagccaattctctcacagggcctgaaccgtcggacttag

SEQ ID NO: 29594 - DNA, 1299 bp, Artificial Sequence
  Description of Artificial Sequence: Synthetic coding sequence
atgatacttctaagagcttctgaagtgagacagctgctgcacaacaaatttgtggtgatcctgggggactcagtgcatagagcagtttacaaggacttggtgctgctcctgcaaaaagataggttactgacaccaggccagttgcgggcccgcggcgaattaaatttcgaacaggacgagctcgtggatggtggccagcgcgggcacatgcacaacggtctgaattaccgcgaagtcagagaattccggtccgatcaccatctagtccggttctactttctaacaagggtttacagtgactatctgcagaccatcctaaaggagctgcagtccggagaacacgcgccagacctggtcattatgaactcctgcctgtgggatatatcgcgttacggccctaattcctggaggagctatttagagaacctggaaaacctgttccaatgcctaggacaagtgctacccgaaagctgtctgctggtttggaacaccgccatgcctgtcggcgaggaggtgacgggcggcttcctccctccaaagctcagacggcagaaagccaccttcctgaaaaatgaggtggtcaaggccaatttccacagtgctactgaggcccgaaagcacaacttcgatgtcctggacctccactttcattttagacacgcacgcgaaaatctacactgggatggcgtacactggaatgggcgtgtgcatagatgcctgtcccagcttctgttggcccacgtcgccgatgcctggggagtggaactcccccacagacatcccgtcggagaatggattaagaagaaaaagcccggtccccgtgttgaagggcctcctcaggcgaatcggaatcacccagcactgcccctctccccacccctgcccagtcccacctacaggccactgctcggcttccccccacaaaggttgcctctgttacccctcctcagtccgcagcccccccctccgatcctacaccaccaagggatgccccgctttccccagggccctccagatgcttgcttctcctcagaccacactttccagtctgaccagttctattgccattcagatgtgccctcatccgctcacgcaggctttttcgttgaggacaacttcatggtgggaccccaactcccgatgcctttctttcctaccccaaggtatcagcgtcctgccccagtcgtccaccgaggctttggacgatatcgcccacgaggtccatacacgccttggggtcagaggcctaggccaagcaagaggcgcgctcccgccaaccctgagccccggcctcagtag

SEQ ID NO: 29595 - DNA, 1299 bp, Artificial Sequence
  Description of Artificial Sequence: Synthetic coding sequence
atgatcttgcttcgggcctctgaggtgcggcagctcctccataacaaatttgtggttattctgggtgactctgtccatagggccgtctacaaggacctcgtgctccttctacagaaagataggctgctaactcctggtcaactaagggcaagaggcgaactgaattttgaacaagacgaacttgttgatggcggacagcgagggcatatgcacaatggacttaattacagggaggtccgggagttccggagcgaccatcatctcgtcaggttctacttcttaacaagagtgtattcagactatttacagacaatcctaaaagagctacaatctggtgagcatgcccccgatttggttattatgaactcatgcttgtgggacattagccggtatggacccaactcctggcggtcttatttagaaaatctggagaacctgtttcagtgcctggggcaagtgcttccagagtcgtgcttactggtttggaacactgccatgcctgtgggggaagaggtcacaggcggattcctccctcccaagctgcgtcgacaaaaagcaacatttttaaagaatgaagtcgttaaggctaatttccactccgccaccgaggcccggaaacataacttcgacgttttagacctgcatttccatttccggcacgcccgcgagaatctgcactgggacggggtacactggaatgggagagtccaccgttgtctgagccagctgctgttggcccatgtcgccgatgcctggggagtcgagctgccccatcggcatcccgtgggggagtggataaagaaaaagaaacctggtccccgtgtcgaggggcctcctcaggctaaccggaatcatcctgcgctacctctaagcccacccctcccatctcccacctaccggcctctcctgggctttcctccacagaggctgccacttctgcctctcctgtccccccaacctccccctcctatcctgcaccatcaggggatgccaaggtttccgcagggccctcccgacgcttgcttttcgtcagaccacacatttcagtctgatcagttttattgtcacagtgacgtcccctccagcgcccatgctggcttcttcgtggaggataacttcatggtcggacctcagctgccgatgcctttcttcccaaccccaaggtaccaacgccccgccccagtggtgcacagggggtttggacgctatcggccacgcggcccatatactccatggggacagcggccccgaccttccaagagaagggctcccgccaatccagagcccagaccccagtag

SEQ ID NO: 29596 - DNA, 504 bp, Artificial Sequence
  Description of Artificial Sequence: Synthetic coding sequence
atgatccttcttcgagctagcgaagtccgccagctgttgcataacaagttcgtggtaatccttggggactctgtgcacagagccgtatacaaggacctggtcctgctgctccagaaggataggctacttacacctgggcagctccgggcccgcggcgagctcaacttcgagcaagacgagctcgttgatgggggccaacgggggcatatgcacaacggactcaattacagagaagtccgcgagttcagaagcgatcaccatttggtgcgcttctactttctgacgcgtgtgtacagcgattatttacagaccatactgaaggaactccagtcaggggagcacgcccccgacttagttattatgaacagttgcttatgggatatctcccgctatgggccgaattcctggcgctcttatctggaaaaccttgagaacctttttcaatgcctcggccaggtgcttccagaaagttgcctgctggtctggaacactgccatgccctag

SEQ ID NO: 29597 - DNA, 507 bp, Artificial Sequence
  Description of Artificial Sequence: Synthetic coding sequence
atgattctactgcgagcgtcagaagtgcggcagttgctgcataataagtttgtcgtgattctaggggactcagtgcatcgcgcagtatacaaggatctcgtgcttctgcttcagaaggaccgccttctgacgccaggacagcttagagctcgcggagagttgaactttgagcaggacgaactggtagatggcggacagcgaggacatatgcacaacggcttgaactaccgagaggtgcgagaatttaggtccgaccaccatctcgttcgtttctatttcctgaccagagtgtattccgattacctgcagacgattctgaaggaactccagtccggcgaacacgctcctgatctagtgataatgaatagttgcttatgggatatcagtaggtacggaccaaacagttggcgtagctacctagagaatctggaaaacctgttccagtgtttgggacaggtactccctgagagctgtctcctggtgtggaacaccgcaatgcctgtgtag

SEQ ID NO: 29598 - DNA, 177 bp, Artificial Sequence
  Description of Artificial Sequence: Synthetic coding sequence
atgatccttttgagggccagcgaggtgcgacaactgctgcacaataaattcgttgtcatccttggcgatagcgtacaccgggccgtatacaaggatcttgttctcttgctgcagaaggatcgcctgctgacaccaggccagctgcgcgcccggggggagctgaatttcgaacagtag

SEQ ID NO: 29599 - DNA, 1518 bp, Artificial Sequence
  Description of Artificial Sequence: Synthetic coding sequence
atgtctgacaaggatgacatcgagacacctctgctgactgaggctgcgccaatcctagaggacggcaattgcgagcccgcaaaaaactcagagagcgtcgaccagggtgccaaaccagagtccaaatctgagcccgttgtgtccactcgcaagcgaccagaaacgaaaccatcctctgatcttgaaacatctaaggttctcccaatccaagataacgtcagcaaggatgtgccccagacaagatggggatattgggggtcatggggcaagtccatcctttcttctgcatctgccacagtagctaccgtgggccagggcatcagtaatgtcattgagaaagccgaaactagcctgggaattcccggacccagtgaaatttccaccgaggttaagtacgtggcgggggaaaccaatgctaaagagaatgagaactctagccccgtggcgggagcctttggcgtgttcagtaccatttccaccgcggtgcagtctacaggtaaatctgttatttcaggtggccttgacgccctggaatttattggaaagaagaccatggatgtcatagctgagggagaccctggtttcaaacgaacaaagggactgatgaaccgcaatgccacactctcacaagtgctcagagaagccaaagagaaggaggaaattaggacctcaaatgaagtaaccgttgagacagacaagaaaactcactatggcttactgtttgatgaattccaaggcttaagtcatttagaggctctcgaaatgctgtcacaggagtcagagatcaaggtaaaaagtatattgaactccctgtcaggtgaggaactggaaactctcaaagtggaactggagcagctgaaagaaactttcagcctagctgagttttgtgaagaggaagaagaagagaagaaaggggatgaagactttacaaaagatatcaccgaactgtttagccagctgcacgtgagttccaagcctgagaagctggcaagggcacgtaatactgctcatgagtggattaggaagagcctcactaagccattggccgagaacgaagagggagaaaagcagagcgaggccgagaacactgagcaggtgaacaagaatagtatcgaagacattcacgcattcgccattcgctctctggccgagctgaccgcctgttctattgaacttttccataaaaccgctgccctcgttctacatggacggaaacaggaagtcactgccatcgagagaagtcagaccctgtcccagatgactatagtcctttgtaaagaactgtcttcgctgagtaaggaattcacaacctgcttaactaccgccggcgtcaaagaaatggcagacgtactcaacccactgatcactgcggtgtttctggaagcctcaaacagcgctagctacatccaggacgcttttcaactgttgctccccgttctggagatttctttaattgagaacaaaattgagagtcatagacacgagctgcaaggtcagaagccccttctagagcactag

SEQ ID NO: 29600 - DNA, 750 bp, Artificial Sequence
  Description of Artificial Sequence: Synthetic coding sequence
atgagtgacaaggatgatattgagaccccactcttgaccgaagctgctcccatccttgaggacggcaattgtgagcccgcgaaaaactccgagagcgtggatcaaggagcaaagccagagtccaagagtgaaccagtcgtttctaccaggaaaagaccagaaactaaaccatcctctgacttggagacatctaaagtactccctattcaggacaatgtcagcaaggatgtcccacagacccgttgggggtattgggggtcctgggggaaatctattctgagttccgcttctgctaccgtcgctactgttggacaaggtatatctaatgtaattgagaaagccgaaactagtctaggtataccgggccctagcgagatctctacagaagtgaagtacgttgccggggagaccaacgccaaagaaaacgaaaattcgagccctgtcgccggtgcctttggagtgttctccactatcagcacagccgtgcagagcaccggcaagtccgtgatcagtggaggcctggacgccctggaattcatcgggaagaaaacgatggacgtgatcgcagagggggatcctggcttcaagcggacgaaaggactcatgaatagaaatgccactctctctcaggtgcttagagaagctaaagaaaaagaggagattcgcacctcaaacgaggtcaccgtggagactgacaaaaaaacccactacgggttgttattcgatgaatttcagggattacacatttag

SEQ ID NO: 29601 - DNA, 195 bp, Artificial Sequence
  Description of Artificial Sequence: Synthetic coding sequence
atgtctgacaaagatgatattgagacaccactgctcactgaggccgctccaatccttgaagacggcaattgcgagccagccaagaatagtgagagtgtggatcagggagccaaacccgaatctaaaagcgagcctgtggtgagcacacgaaagagacccgaaactaagccatcatcagacctggagacgtcatag

SEQ ID NO: 29602 - DNA, 312 bp, Artificial Sequence
  Description of Artificial Sequence: Synthetic coding sequence
atgtccgacaaagatgacattgaaacccccctactaaccgaggctgctcccattttggaagatgggaattgcgaacccgctaaaaatagcgaatctgttgatcagggcgcaaagccggaatccaagtctgagcccgttgtgtcaacacgaaaacggcctgagacaaagcccagttcggacctggaaaccagcaaagtgctgcccattcaggataatgtgagtaaggacgtgcctcagacaaggtggggctactggggtagctgggggaagtccattctctcatctgcctctgccaccgtggcgaccgtctag

SEQ ID NO: 29603 - DNA, 378 bp, Artificial Sequence
  Description of Artificial Sequence: Synthetic coding sequence
atgagcgataaggatgatatagagacacctttactgacagaggctgcccctatactcgaagacggtaactgtgaaccagctaagaacagtgagtcagtggatcaaggagccaaacctgagtctaagagcgagcccgttgtaagtactaggaagagacccgaaactaagccttcctcagatctggagactagcaaggtgctcccgattcaagacaatgtgtcaaaggatgttcctcaaaccagatggggatactggggctcatggggtaaatcaattctgagctcagcctctgctacagtggccactgttggccaaggtatatctaacgtgatcgaaaaagccgagacctctctaggaattcctggcccctctgagtag

SEQ ID NO: 29604 - DNA, 1518 bp, Artificial Sequence
  Description of Artificial Sequence: Synthetic coding sequence
atgtcagacaaggatgacattgagacaccactattgactgaggccgcacctatcctggaggacgggaactgtgagcccgccaaaaactccgagtccgtggatcaaggcgccaagcccgagagcaagagcgaaccggtggtgtcaacacgtaaacgcccagagactaagccttcatcagatctcgagacgtcaaaggttctccccattcaagataacgtttctaaggatgtgccccagactagatggggttattgggggtcctggggaaagtctatcttaagtagcgcatccgcaaccgtagctacggtgggccagggcatctccaatgttatcgaaaaagccgagacgtctctggggataccggggccaagtgagatttccacagaagtgaagtacgtagcaggtgagacgaacgccaaagagaacgaaaattcctctccagtggctggagccttcggtgttttttctacgatatctactgccgtgcagtctacaggcaaaagcgttatttctggcggactcgatgcattggagttcatcggaaagaaaaccatggacgtcattgccgaaggcgacccaggttttaagcgtacaaagggcttgatgaacagaaatgctacactatcccaggtactgagggaggcgaaggagaaagaggagatcagaacctcaaacgaggtgacagtggagaccgataagaagacacactatggactgctgttcgatgagttccaagggctgtctcatctcgaggcacttgagatgctgtcacaggagagcgagatcaaagttaagtcgatcctgaacagcctctctggagaggaattagaaacgctaaaagtcgagctggaacagctgaaggaaacattcagcctggccgaattttgtgaagaagaagaggaagaaaagaagggtgatgaggatttcacaaaagatataactgagctattctctcagttgcacgtcagcagcaaaccagaaaagctcgcgcgggctaggaacacagcccacgaatggatccggaagtccctaactaaacctctggccgaaaacgaggagggcgaaaagcagagcgaagcggaaaatacagaacaggtgaataagaactccatcgaagacatacacgcattcgctatacggtctttagctgaactgacagcctgttctatcgagctgtttcacaagaccgcagcactggtgctccacggcaggaaacaagaagttacagccatcgagcggtcccagacactgtctcagatgaccattgtgctttgcaaggagcttagctcactgagcaaagagtttaccacctgcctgaccaccgctggcgtgaaggaaatggcggatgtcttaaaccccctcatcaccgccgtctttctggaggcatccaacagcgcctcttacatccaggatgctttccagttgctgctccccgttctggagatctctttaatcgaaaataagattgaatctcatagacacgaacttcagggccagaagccgctactcgagcattag

SEQ ID NO: 29605 - DNA, 633 bp, Artificial Sequence
  Description of Artificial Sequence: Synthetic coding sequence
atgagtgataaagacgacatcgaaacaccgctgctgaccgaggctgcccccatccttgaagatggaaattgcgagcccgccaaaaacagcgaaagtgtggaccagggcgccaaacctgaatccaagagtgaaccggtggtgtctactcgaaagaggcccgagacaaagcccagttcggatctcgaaacgagcaaagttctgccaatccaggataacgtgtctaaggatgtgccacaaacgaggtgggggtattggggatcatgggggaaaagcatcctgtcaagtgcctcggctacagtcgccaccgtggggcaggggatttcaaacgttattgaaaaagcagaaacaagtttggggattccaggaccatccgagatcagcacagaagtcaagtacgtggcaggggagacgaatgctaaggaaaatgagaactctagtcctgttgccggagcttttggcgttttctctactatttccacagctgtgcagtctactggaaagtcggtgatctcgggaggacttgacgcattagaatttattggcaaaaagaccatggacgtgatcgccgagggggatcctgggtttaaaaggaccaagggcttgatgaacagaaacgcaaccctgtcacagtag

SEQ ID NO: 29606 - DNA, 240 bp, Artificial Sequence
  Description of Artificial Sequence: Synthetic coding sequence
atgtcggataaggatgatatcgaaaccccactcttgacagaggctgccccaatccttgaagatggaaattgcgagccagcaaaaaacagcgagagtgtggatcagggtgctaaaccggaaagtaagtcggaaccagtagtcagtacacggaaacgtcccgaaaccaaaccgtcatcagacctggagacttcaaaagtactccccattcaggacaacgtcagtaaggatgtgccacagtag

SEQ ID NO: 29607 - DNA, 1518 bp, Artificial Sequence
  Description of Artificial Sequence: Synthetic coding sequence
atgagcgacaaggacgacattgaaacaccactgctcaccgaagccgcccccatcttagaggacggcaactgcgagccagccaagaattcggagagtgtcgaccagggtgcaaaacccgaatcaaagagtgaaccggtggtgtccacgcgcaagcgcccagaaactaaaccgagttcggaccttgagacctcaaaagtcttgcctatccaggataatgtgagtaaagatgtcccacagacccggtggggatattggggctcctgggggaagagcatcctgtcaagcgctagtgctactgtggccactgtgggacaaggaatctccaatgtgattgaaaaagcagaaacttcactcggcatccctgggccttctgagatttctactgaggttaaatacgtggcaggagaaaccaacgcaaaggagaatgagaactcctcaccagtggctggcgcttttggggtcttttcaaccataagcactgccgtgcaatctaccggcaagtccgtgatctcgggcgggctggatgccctggagtttattggtaagaaaacaatggacgtcatcgctgagggcgatcctggctttaagagaactaaaggcctgatgaaccggaatgccactctctctcaggttctgagggaggccaaggagaaagaggaaattcgcacttcaaatgaggtcacggttgagactgacaaaaagactcactatggattattatttgatgagtttcagggacttagccacttagaggcactggagatgctgtcccaggaatcggagataaaggtgaaaagtatcctaaacagtctgagtggcgaagaactagagacgttgaaggttgagttagaacagctgaaggaaacattttcgctggccgagttctgtgaggaggaagaagaggaaaagaagggggacgaggactttaccaaagacattactgaactattttctcagctacacgtttctagtaagccggagaaactggctcgcgccaggaatactgcccacgagtggatccgaaaaagcctaactaagcctctagccgagaacgaggagggcgagaagcagtctgaggcggagaacacagagcaggtgaataagaatagtatcgaagacatacatgcttttgctatccgatccctcgcagaactcacagcgtgctccatcgaactgttccataagactgctgctttagtcctgcatggacgcaagcaggaagtgaccgccattgaaagatcgcaaactctgtcccagatgacgattgttttgtgcaaggagctgtccagcttaagcaaagaatttactacatgcctgacgacagcaggtgtcaaggagatggcagatgtgctgaaccctctgataacagctgtgttcttggaggcctcgaacagcgcctcctatatccaagacgcatttcaactgctcttaccggtgctcgagattagcctcatcgagaacaagatcgagtcacataggcacgagttacagggccagaagccgctgctcgagcattag

SEQ ID NO: 29608 - DNA, 501 bp, Artificial Sequence
  Description of Artificial Sequence: Synthetic coding sequence
atgagtgataaggatgatattgaaacacccctgctgacagaggccgctccgatcttagaagatggcaactgtgaaccggctaaaaacagcgagtccgtggatcagggcgcgaaacctgaaagtaagagtgagcctgttgtttcgaccagaaagcgacccgagaccaagccatcttcggacctggagacttctaaggtcctgccgattcaggacaacgtcagcaaggatgtcccccagacacgctgggggtattgggggagttgggggaagtccatcctttcttccgcctccgccactgtggctacagtgggtcaggggatttccaacgttatagagaaggcagaaacttcacttggtattccgggtccttccgagatttcaacagaggtgaaatatgtcgccggcgagacgaacgctaaggagaacgagaattcttcacccgtcgccggcgcctttggggtgttcagcacaatcagcacagccgtgcagagcacgggatag

SEQ ID NO: 29609 - DNA, 48 bp, Artificial Sequence
  Description of Artificial Sequence: Synthetic coding sequence
atgagcgacaaggatgacatcgagactccactactgacagaggcatag

SEQ ID NO: 29610 - DNA, 2760 bp, Artificial Sequence
  Description of Artificial Sequence: Synthetic coding sequence
atggcgacccccagcgcggctttcgaggccctgatgaatggagtgacctcctgggacgtcccagaagatgcggtgccttgcgaactactgttgattggtgaggcttcatttcccgtgatggtgaacgatatggggcaggtgcttatcgcagcttcaagttatgggcgcgggagactggttgtggtgagccatgaggactatttggtagaagcccagctgaccccgttcctgctgaatgccgtcggctggttgtgcagctcccccggagctcctatcggtgtccacccttcattggccccactcgccaagatcctcgaaggctctggagtcgatgctaaggtcgaacctgaggtaaaagactccctgggggtctattgtatcgacgcctataatgaaaccatgacagaaaagctggtcaagttcatgaaatgcggcgggggactcctgatcgggggccaggcatgggattgggccaatcagggagaagacgaaagggtcctgtttacattcccaggaaacctggtgacctcggttgctgggatatactttacagataacaagggcgatacttctttctttaaggtgtcgaagaagatgcctaagattcccgtactcgtatcctgcgaggacgacctgtctgatgatagggaggagctcctgcatggcatttcggaactcgatatctcaaatagcgattgttttcctagccaactgctggtccacggggctttggcatttcccttagggctcgactcatatcacggttgcgtcatcgctgctgcaagatatggtaggggtcgcgtcgttgtaaccgggcacaaagtgctcttcactgtgggcaaactcggcccattcctgctgaatgcggtccgatggctggacgggggcagacggggtaaggttgtggttcaaactgaactgcgcacgttgtcgggcctcctagcagttgggggaatcgatacgtctatagaaccaaacctgacctccgacgcttccgtctattgtttcgaaccagtttccgaagtaggcgtcaaagaactgcaggagtttgttgccgaaggaggtggcctcttcgtcggcgctcaggcgtggtggtgggcttttaagaacccgggagtcagtcctctcgctcgctttcccgggaacttgcttttaaatccgttcggtattagcatcacaagtcaatccctgaaccccggcccctttcgcactcccaaggcggggatacgtacctaccactttcgatctaccctagccgagttccaagttattatgggtcgaaaaaggggtaacgtcgaaaagggatggcttgcaaaactcggacccgacggcgccgcatttttacagattccagccgaggagatccccgcttacatgtcagttcaccgtctcctgcggaaactcctgagtcgctatagattgccagtcgcaacccgcgaaaaccctgtaatcaacgattgctgtagaggagcaatgctcagtctcgcaacagggctggctcattcaggaagtgacctgtccctgcttgtgcctgaaatagaggacatgtacagcagtccctaccttcgaccaagcgaatctccaatcaccgtggaagttaattgcacgaacccaggaacaagatattgctggatgtctaccggcttgtacatccccggtcggcagattatcgaggtttcactgcctgaagctgcggcatcagcagatctcaaaatccagatcggttgtcacaccgacgacctgacaagagcatctaagctctttcgcggtcccctagtaatcaaccgctgctgccttgataagcctaccaagtctattacctgtctttggggcggcctgctctacattatcgtgccacaaaacagtaaattaggctctgtgcctgtgactgttaagggagctgtccacgcaccatattacaaactcggtgaaaccaccctggaggaatggaagcgccgcattcaagagaaccctggaccttggggcgaactcgccaccgataacatcattttgacagtgccaacagctaacctcaggacactggagaatccagaaccgctcctccgactctgggacgaagttatgcaggctgtagctcggctgggcgcagagccatttcctctcagactcccccagagaatcgttgccgatgtacagatctccgttggctggatgcatgccggctacccaattatgtgtcaccttgagtctgttcaggagctaataaatgagaaacttatcaggacaaaaggactttggggcccagtccacgagctggggcgcaaccagcagagacaggaatgggagtttccgccccataccacagaggccacctgcaatctgtggtgcgtatacgttcatgaaaccgtcctggggatcccccgtagcagagctaacatagccctatggcctcccgttagggagaagcgagttaggatctatctgagtaagggcccgaacgtcaagaactggaacgcctggaccgccttggaaacctatctacagctgcaggaagcattcggatgggaaccttttattagactatttactgaatacaggaaccagacaaatctgccaacagagaacgttgacaagatgaatctgtgggttaagatgttttctcatcaggtgcagaagaatcttgcacccttctttgaagcctgggcctggccaattcaaaaggaagttgcaactagcctggcatacttgccggaatggaaggaaaacatcatgaagttgtacctgctcacgcagatgtag

SEQ ID NO: 29611 - DNA, 504 bp, Artificial Sequence
  Description of Artificial Sequence: Synthetic coding sequence
atggccaccccatcggctgcattcgaggccttaatgaatggagtaactagctgggacgttcccgaggatgccgtcccttgcgagctattgcttatcggggaggcctcttttccagtgatggtgaatgatatgggacaggtcctgattgcagcctcttcatacggtagaggccggttggttgtggtgtcccacgaggactacctggtcgaggcccagcttacaccattcctgctcaatgcagtgggctggctgtgtagttcgcctggggctcctatcggcgtgcacccgtccctcgcaccactggctaaaatcctcgaagggagtggggtcgatgccaaggtggagcccgaagtcaaggactcactgggcgtctactgcattgacgcgtataatgaaaccatgaccgagaaactggtgaagttcatgaagtgcggaggcggactgctgattggaggccaggcgtgggattgggctaatcagggtgaggatgaacgggttctctag

SEQ ID NO: 29612 - DNA, 441 bp, Artificial Sequence
  Description of Artificial Sequence: Synthetic coding sequence
atggctaccccttctgcggcattcgaagcactgatgaacggggtgacatcctgggacgtgcctgaagatgcagtcccctgcgagctcctactgatcggagaagcctcctttcccgtcatggtgaacgatatgggccaggtgctcatagctgcaagcagctatggcagggggcgtttggttgtcgttagccacgaggattacctagtggaagcacagctgacaccatttctcctcaatgccgttggatggctttgtagctcacccggcgcccccattggggtgcacccgagcttggccccactcgcaaaaatacttgaaggatcgggtgtggatgccaaggtcgagcccgaagtgaaggatagcctgggggtgtattgtattgatgcctacaacgagactatgaccgaaaaacttgtcaagtttatgaagtgcgggggatag

SEQ ID NO: 29613 - DNA, 2766 bp, Artificial Sequence
  Description of Artificial Sequence: Synthetic coding sequence
atggctactccctctgcagccttcgaggcactgatgaacggggtgactagttgggacgtgcccgaagatgcagtgccctgtgaactgcttctcatcggagaagcatcctttccagtgatggtcaatgacatgggccaggtgctgatcgcagcttccagttacgggcggggcagactcgtggtggtgagtcatgaggattacctcgtcgaggcacagcttacccctttcctactcaatgcagtgggctggctctgttcttcacccggagcaccaattggcgtgcacccttctttggctcccctcgccaagatattggagggatccggtgttgacgccaaggtggaacccgaagtcaaggactctctgggagtgtactgcattgacgcttacaacgaaactatgacagagaagctggtcaaattcatgaagtgcggcggaggcctattgatcggcggtcaggcctgggactgggcgaatcaaggagaggatgaaagagtactttttaccttcccaggaaaccttgtgactagtgtggccggcatctactttacagacaacaaaggtgacacttctttcttcaaagtgtcaaagaaaatgccaaaaattccagtgctggtttcttgcgaggacgacctgagtgatgatcgagaagaactcctccacgggatctcagagctcgacatcagtaacagcgactgcttcccgtcccagttactagtgcacggtgcgttggccttccctctcgggctggactcctatcacggctgcgtgatcgccgccgctaggtacggaaggggaagggttgtggtgaccggtcacaaggtgctatttacagtcggaaagctgggaccgttcctcctgaacgccgtccgatggctggacggtgggaggcggggaaaggttgtggtgcaaaccgaacttagaacactaagcggtcttctggcagtgggtgggattgatacgagcattgaaccaaatctgactagtgacgcgtcagtgtattgttttgagcccgtaagtgaagtgggcgtcaaggagctgcaagaatttgtagctgagggaggagggctgttcgtaggtgcccaagcctggtggtgggctttcaagaatcccggagtgagtcctctggcacgatttcctggtaacctgttgctgaacccgtttggtatcagcatcacatctcaaagcttgaatcctgggcccttccgcaccccaaaagcaggaatcaggacttatcactttaggagcactctggcagagtttcaggtgattatggggcgtaagagaggaaacgtcgagaagggttggctggcaaaattgggacccgatggcgctgcattccttcagatcccagctgaagaaatcccagcttacatgtctgtccaccggctgctgagaaagctgcttagcagatataggctaccagtggcaacgcgcgagaatcccgtcatcaatgactgttgtagaggtgcaatgttgagcctagccaccgggctagcacattctggttctgacttgtccctactggtacccgagattgaagacatgtactcaagtccttaccttcggccctctgagtcgccgatcaccgtcgaggtcaattgcactaatccagggaccagatattgttggatgtccacagggttgtacataccaggaaggcagattatcgaggtgtctctcccagaagccgcagccagtgccgacctcaagattcaaattggatgccacacagacgacctgacaagagcgagcaagctgtttcgaggtcctctggttataaatcggtgttgcctggataagcccaccaagtcgatcacctgtttgtgggggggattgctgtacatcatcgtacctcagaattctaagttgggaagtgtgcctgtgaccgtgaagggcgcagttcacgccccttactataagttgggtgaaaccacactggaggagtggaagcgtagaatccaggagaatccaggcccatggggcgagttggcaaccgataacattattctcaccgtgcccacagctaacttaagaacgctggaaaaccccgaacctctgttacgcttgtgggacgaggtgatgcaagccgtcgcccgcctgggagcagaaccttttccgctgaggctccctcagaggatcgtggccgacgtgcagattagcgtgggctggatgcatgctggataccccatcatgtgccatctggagagcgtccaggaactgattaacgagaagctgattcggacaaagggtttgtggggcccagtgcacgagctgggccggaatcagcaacggcaggagtgggagtttccgccccacacaactgaggccacttgtaatctatggtgcgtctatgtgcatgagaccgtccttgggattccccgatcgcgcgccaatatcgcactgtggccacccgtccgcgagaagcgggtacggatttacctgtccaagggaccaaacgtaaaaaactggaacgcctggaccgcgctggaaacctatctccagttacaagaggcttttggctgggagccattcattaggcttttcacagaataccgcaaccagaccaatctccccacagagaatgtggataagatgaatttgtgggtgaagatgtttagtcaccaggtccagaagaatttggccccttttttcgaggcatgggcctggcctatccagaaagaggtggccacttccctggcttacctacccgaatggaaggaaaatatcatgaagttgtatcttttgactcaaatgccccactag

SEQ ID NO: 29614 - DNA, 228 bp, Artificial Sequence
  Description of Artificial Sequence: Synthetic coding sequence
atggccactcccagtgcagcctttgaagcattgatgaacggtgtgacatcttgggacgttccagaggatgcagtgccgtgtgaactgctgctaatcggggaggcctcattcccagtgatggttaacgacatggggcaggtcctgattgcggcatcaagctatggacgagggcgattggtcgtcgtgtcacatgaagattatcttgtggaagcacagctgaccccatag

SEQ ID NO: 29615 - DNA, 453 bp, Artificial Sequence
  Description of Artificial Sequence: Synthetic coding sequence
atggccactccttccgcggcctttgaggctctgatgaacggtgttacatcctgggacgtgccggaggacgcagtcccttgcgagctgctgctgatcggagaggccagcttcccagtcatggtcaatgacatgggccaagtattgatcgctgcatctagttatggccggggtcgacttgtggtggtttcgcacgaagattacctggttgaagcacagcttacgccattcctgctgaatgcagtgggttggctgtgctcctcccctggcgctcctatcggagtgcacccgtccttagcccctttggcaaaaatcctggaaggctcaggagtcgatgcgaaagtggagcctgaggtaaaggatagcctcggggtatactgcattgatgcctacaatgagacaatgacagaaaaactggtaaaattcatgaaatgtggaggcggcttactgatctag

SEQ ID NO: 29616 - DNA, 2538 bp, Artificial Sequence
  Description of Artificial Sequence: Synthetic coding sequence
atggcaacaatcgcagccgccgcattcgaggccttgatggacggggtcacctgctgggacgttcctaggggacctataccctccgaattattactgatcggggaagcagcattccctgttatggtgaatgacaaaggacaagttctgattgctgcctcttcatacggacgcggcaggttggtggtggtcagtcatgagggctacctgtctcacactggcttagctccttttctcctgaatgccgtttcctggctttgcccttgtcccggagctcccgtcggcgtccacccctccttagctccactggtcaatattctgcaggacgcgggactggaagcccaggtgaaaccggagcctggcgagccactgggcgtgtattgcataaatgcttacaatgatacactcaccgccactttaatccagttcgtcaagcacggcggggggcttctgattgggggacaggcatggtattgggctagtcagcatggtccagataaggtcctaagcaggttccctggcaataaggttacttctgttgctggggtctactttacggacacctatggcgatcgtgaccggttcaaagtttcaaagaaggttccaaaaattccactgcacgtgagatatggtgaagatgtgaggcaagatcagcaacagcttttggaggggatcagcgaactggacataagaacagggggcgtcccatcacagcttcttgtgcacggtgctctcgccttcccgctcggtctggacgcaagccttaactgctttcttgcagccgcccattacgggagagggcgagtggtgctggcagctcacgaatgtttactatgtgctccgaagatgggccctttcctactcaacgcggtgagatggttggctcgcggtcagactggtaaagtgggtgtgaacaccaacctcaaagatctttgcccgctgttatccgaacatggcctgcagtgttcccttgagcctcatctcaactcagacctctgcgtgtattgctgtaaagcatatagcgacaaggaggctaaacagctgcaggaattcgtggcggaggggggcggactgctcattggtggccaggcttggtggtgggcaagtcaaaacccaggccactgcccactcgctggcttccctgggaacattatcttgaattgctttggactttctatacttccgcagactcttaaagctggctgtttccctgtgccgacccctgaaatgagaagttaccactttagaaaagcattgtcccagttccaagcaatactgaatcatgaaaatggaaacctggagaagagttgcttggctaagctacgagtggacggtgccgctttcttgcagattcctgccgaaggggtcccagcctacattagcctgcataggttactccgaaaaatgctgagagggtcaggtcttccggctgtctcacgcgagaatcccgtggccagcgattcctatgaagccgctgtcctttccctcgccacaggcctggctcactcagggacagactgctctcagctagcccagggacttggaacatggacttgctcctcaagcttatatccaagtaagcatccaatcactgttgaaatcaacggcataaaccctggcaacaatgactgttgggtgagtactggactttatctcctcgaaggacagaacgccgaagtatccctctccgaggccgcagcgagcgcgggcctgagggtccagatagggtgccatacagacgatctgactaaggcgcgaaagctgtctcgggccccggtggtgactcaccagtgctggatggacaggacagagcgctccgtgtcctgtctgtggggaggtctgctgtacgtgatcgtgcctaagggatcccagctggggcctgttcccgtaacgattagaggcgcagtccccgccccctattacaaactcggaaagacatctttagaggagtggaagcgtcagatgcaagagaatctggccccttggggcgaactcgccaccgataatataatactcacggtgccaacaactaaccttcaggccttgaaggacccagaacctgtcttgcgcctctgggatgagatgatgcaggcggtggctaggctggccgccgaaccatttccattccgcagacctgagaggattgtagccgacgtgcagatctcagctggatggatgcattcagggtaccccatcatgtgccaccttgaatccgtcaaggagataattaatgagatggatatgcgctcacgcggagtatggggacccatccatgagctgggccataaccagcaaaggcacggatgggaatttcctccacataccactgaggccacgtgtaatctgtggtctgtgtatgtgcacgaaactgtactgggcattccccgggcacaggcacacgaggccttgtcccctccggagagagagcgtagaatcaaggctcacctgggaaagggagcccctttatgcgattggaatgtgtggacagcactagaaacgtacctacaagtgctgtcccgcaattccggcaggaggggctag

SEQ ID NO: 29617 - DNA, 2448 bp, Artificial Sequence
  Description of Artificial Sequence: Synthetic coding sequence
atgaaaatatttcaaaaggaattcaagttcatcctgaaaaaatgtacgcctattcagaaataccgggaggagaacggaaatagttccagtagtcctcaccaccagttgcagtcacacgcaagcggacctcgatacggggaagacgtgagacaggaccagcaacagctcctggaggggatttcagagttagacatccggaccggcggcgttccctcccaactgcttgttcatggcgctctagcctttccgctcggcctagacgctagcctaaactgtttcttggctgcggcgcactacggacgaggtcgcgtggtcttggccgcccacgagtgtttactgtgtgcgcctaaaatgggccccttcttattgaatgccgtgcgatggctggccagaggtcagaccggcaaggtgggagtcaacacaaatctgaaggatctttgccccctgctttcggaacacggtttgcagtgtagcctggaaccacaccttaatagcgacctctgcgtgtactgttgcaaggcctactcggataaagaagctaagcagttacaggagttcgtggcggaagggggcggccttcttatcggaggccaggcatggtggtgggcgtcgcaaaatccagggcattgtcccctcgcaggattccccggaaacatcatcctgaactgcttcggcctctccattctgccgcagacgctcaaggccggctgcttcccagtgcctacacctgagatgcgttcctatcactttaggaaggctctgtcacagttccaggctatcctgaaccatgagaacggcaaccttgagaagagctgtttagcgaagctccgggtcgacggcgccgcctttctccaaatccctgctgaaggggtgcctgcctacatttcgctccaccgcctgctccggaaaatgctcagaggatcgggactgcccgcggtctcccgcgaaaacccggtggcgtcagatagctacgaggcggccgttctatctctggccactgggctggcgcattctggaacggattgctcccaactggctcagggactgggtacatggacatgtagctccagtctgtatcctagcaagcaccccattacagtggaaatcaacggcataaacccggagtcacactccgtcattcaggtcgggatgcaatggagagacttaagttcttgcaacctccaccttctgggcctttctaattcatccctgtccgcaagctgcgtggccgggaccacaggtactcggcatcatgcatggctcatctttgtgttcctcgttgagcgggagtttcatcggaaggggaacaacgactgttgggtgtccactgggttgtatcttctagagggacagaatgctgaggtctctctcagtgaggccgccgcctcagctggccttcgggtgcagattgggtgccacacagatgatctcacaaaggcccggaagcttagcagagcccccgtggtaacacatcaatgttggatggacaggacagagcggtcagtgtcctgtctatgggggggcttattatacgtcatagtccccaaagggtctcagctgggtcctgtcccagttaccatccgcggagccgtcccagctccctactataaactgggaaagacatcccttgaggagtggaagaggcaaatgcaagaaaacctggcaccctggggcgaactcgctaccgacaatatcatactgacagtccccaccaccaatttgcaggctttaaaggaccctgagccagtgctgaggctgtgggatgagatgatgcaagcggtggcacggttggcagccgagccctttcctttcaggagaccagaaagaatcgtggccgatgtacagatatctgccggctggatgcactccgggtatcctattatgtgccatctggaatccgtgaaggaaatcatcaacgagatggatatgagatctcgaggagtctgggggccaatccacgagctgggccacaatcagcagaggcacggttgggaattccccccccacactaccgaggcgacttgtaacctgtggtccgtctacgtgcatgagactgtcctcggcatcccaagagcgcaggcccatgaggccctctcccctccagagcgtgaaaggagaatcaaggctcacttaggtaaaggggcaccgttatgtgactggaatgtgtggacggccctggaaacatatctccagctccaggaagcttttggctgggagcctttcactcagttatttgccgaatatcagacactgagccatctgcctaaggataacactgggcgaatgaacttatgggtcaagaagttcagcgagaaggtgaagaagaacttagttcccttttttgaagcttggggctggcctattcaaaaagaggtggccgatagcctagcctctttgcccgagtggcaggagaatcctatgcaggtctacctcagggctaggaagtag

SEQ ID NO: 29618 - DNA, 1695 bp, Artificial Sequence
  Description of Artificial Sequence: Synthetic coding sequence
atgggccccttcctcctgaatgcggtaagatggctggctagagggcagaccggaaaggtaggcgtgaacaccaaccttaaggatctttgtcccctcctctctgaacatggcttgcagtgctcccttgagcctcacctgaactccgacttgtgcgtgtattgttgcaaagcttacagcgacaaagaagccaaacagcttcaggagttcgtggcagaaggcgggggactactcataggtgggcaagcgtggtggtgggcttcacagaatccggggcactgcccactggctggattccctggtaacatcatccttaactgtttcggattaagtatcctcccacagactctcaaggctggatgttttcccgttcctacaccggaaatgcgcagctatcatttccgaaaagcattatcccagtttcaggccattctcaatcacgagaacggcaatttagagaagtcttgcctggctaaattaagagttgacggagccgctttcctgcagatccccgccgaaggcgtccctgcatacataagcctgcacaggctgctgcgtaagatgctgagagggtcagggctacccgcagtcagccgagagaatcccgtcgcctctgactcatatgaagcagcagtgctctctttggctaccggattagctcacagcggtacagactgtagccagttggcgcaggggctcgggacttggacttgttctagctccctgtacccctcaaaacatcccattaccgtggagatcaacggaatcaatcctgggaacaacgattgctgggtgtccactggtttatacttgctagaaggccagaatgctgaggtgtcgctgtcagaggcagccgcttcggcgggcctgcgcgtacagatagggtgtcatactgatgaccttacgaaggctagaaagctgtctcgcgccccagttgttacgcaccaatgctggatggataggacagagcgtagcgttagctgcctgtggggggggttgctttatgtaatcgtcccgaaaggaagccagcttgggccagtgcctgtcacgatacgtggcgctgttccagccccatattacaagctcggaaaaacttcactggaggaatggaagagacagatgcaggaaaacctggcaccatggggagagttagccactgataatatcatcctcactgttcctacaactaatctgcaggctctgaaggatccagaacctgtcctgaggttatgggatgaaatgatgcaggctgtagcccgtctggcagctgagccttttccattccgccggccagagcgtatcgtggcggatgtgcaaatcagtgccggatggatgcatagcggctatccaattatgtgtcacctcgaaagcgtaaaggaaatcatcaacgagatggacatgaggtcacggggggtgtggggccccatccacgaactgggacacaatcagcaacgtcacggatgggagtttccacctcatacaacagaggccacctgtaacttgtggagcgtgtatgtccatgagaccgttctgggaatacctagagcacaagcacacgaggctttgtctccccccgaaagagaacgcagaatcaaagctcacctcggcaagggcgcacccctctgtgattggaatgtttggaccgcactcgaaacgtatctccaagtgctgagtcggaactcgggacgcagaggctag

SEQ ID NO: 29619 - DNA, 1695 bp, Artificial Sequence
  Description of Artificial Sequence: Synthetic coding sequence
atgggtccttttctcttaaacgctgtaagatggctcgcacgaggacagaccggtaaagttggtgtgaacacaaatctgaaggacctgtgtccattactcagtgagcatgggcttcagtgttcccttgagccccacctaaacagcgacctgtgcgtgtactgctgcaaagcgtacagcgacaaggaagctaagcaacttcaagaattcgttgccgagggaggaggactgttgattgggggccaagcgtggtggtgggcatcgcagaatccgggacattgtccactggcgggatttcccggcaacattattttgaactgttttgggttgagcatcctgccacagactctgaaggcaggctgtttccctgtgcctacgccagaaatgcgaagttatcattttcgaaaagccttatcccagtttcaagccatcctgaaccacgaaaacggcaacctggagaaaagctgcttggccaagttgcgagtggatggggctgcatttctccagatacccgctgagggcgtcccggcatatatcagcctgcacaggcttctgaggaaaatgttgagaggcagcggtctgccggccgtgtctcgcgagaatcccgttgcgtcggattcttacgaagccgcagtgctttccctggcaaccggactggcacattccgggacagactgcagccagctcgcccaagggctggggacctggacgtgttccagctcgctgtacccttctaaacatccaattaccgtggagatcaacgggattaatccgggaaataacgactgttgggtctcgactggactgtacctccttgagggtcaaaatgctgaggtctccctgagcgaagcagcggcatctgcaggcttacgggtgcagattggttgccacactgacgatctcaccaaagcaaggaagcttagccgcgcccccgttgtaactcaccaatgctggatggataggactgagcgtagtgtgtcttgcctgtggggcggcctcctgtatgttatcgtccctaagggctcccaactgggccctgttcccgtaacaattcgcggagctgtaccagccccgtattataagctaggaaaaaccagcctggaggaatggaaacggcaaatgcaggaaaatctggcaccgtggggcgagcttgccacagataacattattttgaccgtgcctacaacaaacctacaagctctgaaggatccagaacctgtactcaggctgtgggacgagatgatgcaggccgtggctagattagccgcggagccgttcccctttagacggccagagaggattgttgccgacgttcagatcagcgcgggctggatgcactcaggctacccaataatgtgccatctggaaagtgttaaggagataatcaacgagatggacatgagatcaaggggcgtttggggaccaattcacgagttaggccataatcagcagcgccatggttgggagttcccgcctcacacgactgaggctacatgcaacttgtggagcgtgtacgttcacgagaccgtcttgggaattccacgcgcacaggcccatgaggctctgagtccgccagaacgtgagagaaggattaaggcacatctgggaaaaggtgccccattgtgtgactggaacgtgtggactgccctggaaacttaccttcaggtgctgtctcggaatagcggaaggagagggtag

SEQ ID NO: 29620 - DNA, 2760 bp, Artificial Sequence
  Description of Artificial Sequence: Synthetic coding sequence
atggcaactatagccgctgctgcttttgaagccctgatggatggtgtcacttgctgggatgtgccacgtggccctataccaagcgagctactgctcatcggcgaggctgcatttcccgtgatggtgaacgataaaggtcaagtactcatcgccgcctctagttatggacgggggaggctcgtcgtcgttagccatgagggttatctatcccataccggtttggctccttttttgctgaatgctgtgtcatggctttgcccttgcccaggtgctcctgtgggcgtgcacccatccctcgctcccctcgtcaacatccttcaggacgccgggctggaggctcaagttaagccagagcctggcgaacctcttggtgtctattgcattaatgcctataatgatactcttactgcaacgctgattcagtttgtgaagcacggggggggacttcttattgggggtcaggcttggtactgggccagccaacatgggccggataaagttctctcaaggtttcctgggaacaaagtcacatctgtagccggtgtgtactttacagatacttatggcgatagggaccgtttcaaggtctctaaaaaggtgcctaaaattccgttacacgtcaggtatggagaggatgtccgccaggatcaacaacaattgctggagggtatctcagaactggacatcagaaccgggggtgtgccttctcaactgctggttcacggagcgctggccttccccctcggtctggacgcttccctgaattgttttcttgctgcagctcattatggacggggacgagtcgtgttggctgcacacgaatgtctactgtgtgctcccaagatggggcctttcttgttaaatgcagtgcgctggctggcacggggccagaccggtaaggttggagtcaatacaaatctaaaggatctgtgtcctctcctctctgagcatggattgcagtgctcattagaacctcacctgaactccgacttgtgcgtgtactgttgtaaagcctatagcgacaaggaagcaaagcaactgcaggaatttgtagcagaggggggcgggttactgattggaggccaggcctggtggtgggcatcccaaaatccaggacactgtcccttggcagggttccctgggaacattattctgaactgcttcgggctctctattctgccccaaacattgaaggcgggctgcttccctgtgccaacacctgagatgcgtagttatcactttaggaaggcgttaagccagttccaagcgatcctcaaccatgaaaacggtaatctcgagaaatcatgcctggctaagctcagagtggacggcgctgccttcttacagatccccgctgaaggggttcctgcctacatttctttacaccggctgctgagaaagatgcttcgaggctctggcttgcccgctgtaagccgcgaaaacccagttgcctctgactcatatgaagcagcagttctctccctcgccacaggtctggcccactctggcactgattgctcacagctggcccagggcctgggtacatggacatgctcttcgtccttgtatcccagcaaacatccaatcaccgttgaaataaatggaattaatccaggaaacaacgactgttgggtgtcaaccggattgtatcttctggagggacagaatgcagaagtgtccctgtcggaggcggcggctagcgccggactgcgggtgcaaatagggtgtcacaccgatgatcttacaaaagcacgcaagttgagtagagctcccgttgtgacgcaccagtgctggatggaccggacagagagatcggtgtcatgtctctggggcggccttctgtatgtcatcgtcccgaagggctcccagctgggccccgtgcccgtcacgatccggggagcggtgcccgcaccatactataagctgggcaagacttcactggaggagtggaaaagacaaatgcaggagaatctcgccccatggggtgagctggccaccgataacattatcctaaccgtgccaacaaccaaccttcaggccctcaaagatcctgagccagtattgcgcctgtgggacgaaatgatgcaggcggtcgcgaggcttgctgccgagccttttccatttcgtcggccagaaaggatcgtagccgatgtgcagataagtgcaggatggatgcatagtgggtaccccatcatgtgtcatttagaatccgtaaaggaaatcatcaacgagatggacatgagaagccggggtgtatggggccccatccacgagctggggcacaatcaacagcgacacggctgggaattcccaccgcataccacagaggccacttgtaacttgtggtccgtttatgtgcacgagaccgtgctgggtatccccagagcccaagcacacgaagctctctcccctcccgagagggaaagacgcataaaggctcaccttggaaagggggcccctttgtgcgactggaatgtttggacagctctggaaacgtacttacagctacaggaggcctttgggtgggagcccttcactcagttgtttgcggaatatcaaactctcagccatttgccaaaagacaacacaggtaggatgaatctgtgggtgaagaagttctccgagaaggtgaagaagaatttggtgcctttctttgaggcatgggggtggcctatccagaaggaagtcgctgatagcctcgcatccctgcccgagtggcaggagaatcccatgcaggtttacctaagagcacgaaagtag

SEQ ID NO: 29621 - DNA, 2538 bp, Artificial Sequence
  Description of Artificial Sequence: Synthetic coding sequence
atggcaacgattgccgcagccgccttcgaggccttaatggatggggttacttgttgggacgtgccaagaggaccaattcctagtgagttgcttctgatcggggaagcagcctttcccgtgatggtcaatgacaagggccaggtgctgattgctgcaagctcatacggcagaggtcggttggtggtcgtcagccatgaggggtacctgagccataccggcttggcgccattcctattgaatgccgtgtcttggctctgtccatgtccaggtgcccccgttggagttcacccaagtttggccccactggtgaacatactccaggacgctgggctcgaggcccaagtgaagcccgagccaggagagccactgggtgtgtattgtatcaatgcctacaacgacacattgacggccacactgattcagttcgtgaagcacggggggggtcttctgattggaggccaggcctggtactgggcaagccagcacggcccagacaaggtcttatctcgtttccccggtaacaaagtgacatctgtggccggggtttactttacggatacttatggcgacagggaccgttttaaggtgtcaaaaaaggtccccaaaattccactccacgtgcggtatggcgaggatgttcgacaggatcagcagcagctgcttgagggtatttcggaattagatatacgaacgggaggtgtacccagtcaactactggtacacggcgccctagcgttccctcttggccttgacgccagtttgaattgcttcctcgctgccgctcactacgggcgaggtagggtggtactggctgcccacgagtgcctcctgtgtgcccccaagatgggcccctttctgctaaatgcagtgagatggctcgcccgcggccagaccgggaaggtgggagtcaacaccaatctcaaagacctctgccctctgttgtctgagcacggtctccagtgcagccttgaaccccacctgaattctgatctgtgtgtttattgctgtaaggcatacagcgataaggaggccaagcagcttcaggagttcgttgcagaaggcgggggtctgctgatcgggggacaggcttggtggtgggcatcgcagaaccctggccattgcccgcttgcggggttccctggaaatatcattctgaactgttttggactttctatcctgccccaaacgttaaaggcaggctgttttcccgtcccgacaccggagatgagaagctatcactttaggaaggcactgtctcagtttcaggcaatcctaaaccacgagaacggaaacttagagaagtcctgccttgccaagttgcgcgtagatggcgcagccttcctgcagatacctgccgaaggtgtccctgcctacattagtttacatcggctcctccgcaaaatgctccgaggatcaggtctccctgcggtgtccagggagaatccggtggcgagcgactcctacgaagccgccgtgctgtcacttgctaccgggctggcccactcggggactgactgttctcagcttgctcagggcctgggcacctggacatgcagctcatcgctatatccgagcaagcacccaatcactgtcgaaataaatggcattaaccctgggaataacgactgttgggtgagcacagggctgtacctccttgagggacaaaacgctgaagtaagcctgtcagaggctgcggcaagcgccggccttcgggttcagataggctgccatacagatgacctcaccaaggctaggaaattatcgcgggccccggtcgttacccaccagtgctggatggaccgcaccgagagaagcgttagctgcctctgggggggcctcctgtacgtgattgttcctaaaggttctcagctgggtccggtgcctgtgaccatcaggggggcggttccggccccctattacaaattgggcaagacatcacttgaggaatggaaacgacaaatgcaggaaaacctggccccttggggggagctcgccaccgataacatcattttgacggtgccgaccaccaatcttcaggccctgaaagaccccgagccagtcctcagactgtgggacgagatgatgcaagcggtcgcacgcctggccgcagagcctttcccgttccgacgtcccgagcggatcgtggcagacgttcagataagcgcaggatggatgcactccggctaccccattatgtgccacctggagtctgtgaaagaaatcatcaacgaaatggatatgagatcacgaggagtctggggacccattcatgaactaggacacaatcaacagaggcacgggtgggagtttccacctcacacgacagaggcgacatgtaacttgtggtccgtatatgtgcacgaaaccgtgttaggcattcctcgggcccaagcccacgaggccctttcgcccccagaaagagagaggcgaatcaaagcccacttgggcaagggcgctccactttgcgattggaacgtatggactgctctcgaaacatacctgcaggtcctgtcccgaaactctggtcgcagagggtag

SEQ ID NO: 29622 - DNA, 1827 bp, Artificial Sequence
  Description of Artificial Sequence: Synthetic coding sequence
atggcccttcgcggtcccgccggactcggtcccgggtcacggcgacccctggacgaggccgtggcaggtgcggaaggaagggaagcacctgccctggtggccgcgggcggggctcccgaagatgatgaagaagacgatggaagaggtagaggtctactacgctgggacagcttcagtgcttggctgcactgtgtctgtgtggttggtttcgacctcgagctcgggcaagcagtggaagtcatctaccctcaacatagcaaattgacagatagagaaaaaacgaacatttgctatctatccttccccgattccaactccggatgcctgggcgatactcagttctgcttcaggttcagacagagctccggacggagggtgtcactccactgcctgctggatcagttcgacaaagacctgcctgtgtacctgaagaaagaccccgcgtacttctatgggtacgtctacttcaggcaggtgagagataaaacactgaaacgggggtattttcagaagagtctggtcctgattagtaaacttccttacattcacttcttccacactgtgttgaagcaaatagctccggaatactttgaaaaaaatgaaccctacctggaggcagcatgcaacgatgtggatcgctggcctgcccccgtgccaggcaagacactacatctgcccattatgggagtcgtcatgaaggtgagaattcctacttgccacgataagccgggaaccacacaaattgtgcagcttacacaacaggtggatacaaacatatcggtaatacttcctaccgtacacgaggtcgacatcttcagatgcttctgtccagttttcctgcatagtcaaatgctgtgggaacttgttctgctgggtgaacctctcgtcgtcatggcccctagtccctccgaatcatcagagacagtgctggccctggtgaactgtatttccccacttaaatactttagtgattttcgtccctactttaccattcatgattcagagtttaaagaatacacaacaaggacccaggctcctccgtcagtgattcttggcgtaacgaatccattttttgccaagacactccagcattggccccacataatccggatcggcgacctaaagccaaccggcgagatcccaaagcaggtgaaggtcaaaaagctgaaaaatttgaagactctggattccaagcctggcgtgtatacaagctacaagccttatttgaaccgagacgaggaaatcatcaaacagttgcagaagggtgtgcagcagaagcggccttcagaggctcagagcgtcattctaaggaggtatttcctcgaactgacgcaatcattcattattcctctggagcgatacgttgcctcccttatgcctcttcagaagtctatcagcccatggaaatccccccctcagcttcgccagttcctccctgaagagtttatgaaaacactggaaaagactgggcctcaacttactagtcggattaagggcgactggatcggactgtaccgccactttctcaagtcgccaaatttcgacgggtggtttaagactaggcgaaaagagatgactcaaaagctggaggcactgcatcttgaggcactctgtgaagaagacctgcttctatggatccagaaacacaccgaagtggagactgtagatcttgtgcttaagcttaagaacaagctcctgcaggcagacagggagcatttgcctgtcaagccagacacaatggaaaagctgagaactcatattgacgccataattcttgccctgccggaggatctgcaaggaattctgctaaagactgggatgacctag

SEQ ID NO: 29623 - DNA, 1758 bp, Artificial Sequence
  Description of Artificial Sequence: Synthetic coding sequence
atggatgccttactgggcaccgggccaaggagggcgagagggtgtctcggcgctgcggggccaaccagcagtggccgagcagctcgaaccccagctgccccctgggcacggttttcagcctggctggagtgcgtgtgcgttgtaaccttcgacttggagctggggcaggcactggagttggtctatcctaatgacttccgactgaccgacaaggagaagtcctccatttgctatctgtcttttcctgacagccactctggctgcctgggcgatacccagtttagctttcgcatgcggcagtgtggagggcagaggtcgccatggcacgctgacgacagacactataactctagagcaccggtagcgcttcagcgagagcctgctcattactttggctatgtgtacttcagacaggtaaaagactcatcggtcaaaagaggttactttcagaagtcacttgtgttggttagccggcttcccttcgtgaggctctttcaggccttattgtcattgatcgcacctgaatatttcgataaattggccccttgtctggaagctgtctgcagtgaaatcgatcaatggccagctccagcccctggccagacactgaaccttccggtgatgggcgtagtggttcaggtcagaatcccgtcacgggtggataaaagcgaaagctccccacccaaacagtttgaccaggaaaacctactgcctgcacccgtcgttctggcttctgtgcacgagctggacctcttccgctgctttcggcctgtgcttacacatatgcaaactttgtgggaattgatgctcctgggtgaacccctcctcgttcttgccccatcaccggatgtgagcagtgaaatggtactggctctgacctcttgtttgcaacccctccgcttttgttgtgattttaggccttattttactatacatgactctgagttcaaggaattcactacaagaactcaggcacccccaaacgtggtcctaggagtgaccaatcccttcttcattaagacactgcaacattggcctcacattctcagggtgggcgaacccaaaatgagcggggatttaccgaaacaggtgaaactgaagaaaccttcacggttgaaaacactcgacaccaaaccaggattatacacggcatatacagctcacctgcaccgggacaaagccctgctgaagcggttattaaaaggagtgcagaagaagaggccaagtgatgtccaaagtgctctgctgcgtagacatctcttagagctgacgcagtcctttattatccccctggagcactatatggcctccctcatgcccctgcagaaatctatcacaccatggaaaactcctcctcaaatacaacccttcagccaggacgactttcttcggagtctagagcacgccggcccacagctcacttgtattcttaaaggagactggcttggattgtatcgcagattcttcaaatcccctcatttcgatggttggtaccggcagcgccataaggaaatggccctaaagctcgaagcgctgcacctggaagctatttgcgaagcaaatattgaaacatggatgaaagacaaatcagaggtggaagtggtcgacctcgtgctgaaattaagggaaaaacttgtgcgcgcccagggccaccaactaccagtgaaggaagcaacactgcagcgggcacaactgtacatcgagactgtcatagggagcctccctaaggacctccaggcagttctatgtccaccgtag

SEQ ID NO: 29624 - DNA, 1362 bp, Artificial Sequence
  Description of Artificial Sequence: Synthetic coding sequence
atggcaggagccgccgcggggggtaggggaggaggcgcatgggggcccggcagaggaggggctggaggcctgcggagaggttgtagtcctccagcgcctgccgggtctcccagggcgggattacagcccctccgcgctacgattccatttcagctccaacagccacatcagagacgggatggtggcggccgcgctgcttcggtgccatgtagtgtggccccggaaaaatccgtgtgcaggcctcagcccctgcaggtaaggagaaccttcagtctggacaccattctcagtagttacctattaggccagtggcctagagatgcagacggggcctttacttgctgtaccaacgacaaagccacccagacacccctctcatggcaggagctcgaaggcgaacgtgcttcaagctgtgctcataagcgaagcgcttcttggggatccactgaccaccgaaaggagatttcgaaactgaagcagcaactgcagcgaaccaagcttagccgaagcggtaaggagaaggagaggggctctccactgttgggcgaccatgctgttagaggtgctcttagagcgtcccctcccagttttccctctggctctcccgtgctgagactctcaccatgcctccacagatctctggagggactgaaccaggagctcgaagaggtcttcgttaaagagcagggagaggaagaattgcttcgtatcctggatattcccgatggccacagggcaccagctccaccacagtccggttcttgcgatcaccctttgctgttgctggagccaggtaacttagccagctctcctagcatgagcctcgcgtcccctcagccttgcggcctggcatcacacgaggagcaccgtggtgctgctgaggaactagcttcaacgccaaacgacaaggcttcttctcctggccacccagcctttctcgaagacgggtcaccctcccctgtgctggctttcgccgcctccccacgacctaaccatagttatatcttcaaacgcgagccacccgaaggctgtgagaaagtaagggtcttcgaagaagccacttctccaggtcctgatttggcctttctcacttcttgccccgacaagaacaaagtgcacttcaaccccaccggctccgctttctgcccggttaacctcatgaagccacttttcccgggtatggggtttatcttcagaaactgcccatcaaatcccggatcccccctgccgcccgcttcccctcgaccacccccgaggaaggatcccgaggcgtccaaggcctcacctctgccattcgaaccatggcagagaacaccccctagcgaagagccagtcttgtttcaatccagtctgatggtgtag

SEQ ID NO: 29625 - DNA, 1038 bp, Artificial Sequence
  Description of Artificial Sequence: Synthetic coding sequence
atgagagacaaagccacccagaccgaaagcgcatgggcggaggagtactccgagaaaaaaaaaggatcacataagcggtcagctagctggggctctaccgaccagcttaaggaaattgccaagttgcgtcaacagctgcagaggagtaagcactcatctcggcaccacagggacaaggagcgccagagtccttttcatggcaaccatgcggcaataaaccaatgccaagcgcccgtacccaaatctgcccttatccccgtgatcccgataaccaaaagtaccgggtctagattcaggaactctgtggaagggctgaaccaagagatcgagatcatcataaaggaaaccggggaaaaggaggagcagctgatcccccaagacatcccagatggccacagagccccaccccccttggtccagagatcatctagtacccggtccatcgacactcagacgcccggaggggcagataggggctcaaataattcttcccggtcccagtccgtgagtcccacctcattcttgacgattagtaatgaaggatctgaggagagcccatgcagtgcagacgacctcttggtcgatcctagagacaaagaaaacgggaataattcccctctaccgaaatacgcaacgagtcccaagcccaacaactcctatatgttcaaacgggagccccccgaagggtgtgagcgcgttaaagtgttcgaggaatgctctcctaaacaactccacgagattccagccttctactgtcctgataagaataaggtcaattttatccctaaatcaggctctgccttctgcttagtcagcattctgaagcctttacttccaacccccgatctgaccctcaaggggtccggacacagcctcacagtaactacgggcatgaccactaccctgctgcagccaatcgcagtggcctccctatccaccaatacggaacaagaccgggtgtccagggggacaagcacggtcatgccatctgcaagcttacttcctccccccgagccaatcgaggaagcagagggttag

SEQ ID NO: 29626 - DNA, 1770 bp, Artificial Sequence
  Description of Artificial Sequence: Synthetic coding sequence
atgtcccagcgagtcaggcgcaacggctctcctacacccgcaggatcactcggcgggggcgcggttgcaacagcaggcggccctggcagtcgcttacagcccatgcgtgcgacggtccccttccaactgaaacagcagcagcagcagcagcacggatcccccacccgcagcggaggcggagggggggggaacaacaacggcggatgctgtggaggcgcttcggggccagcgggggggggagggggtggcgggccccggaccgcaagccgctcgactagccccaccaggggcggaggaaacgctgccgccaggactagtccaactgtggctacacagaccggcgcgtccgccactagtacacggggtacctccccaacgcgaagtgcagcaccgggcgcccgaggatcgccacccaggccacctccaccacctccattgttgggaacagtcagcagtccctcttcgtctccgacccacctgtggaccggagaagtgtccgcggcacctccacctgcacgcgtgcggcacaggcgccgcagtcctgagcagagccgctccagccccgagaagagatcacccagcgcaccagtatgtaaagccggagacaagacccgtcaaccaagctcgagcccttccagtataatacggcgcacctcaagtctggatacattagcggccccatacctggccgggcactggccccgcgattcccatgggcaggccgccccgtgtatgcgggacaaggccactcagacagagtccgcttgggcagaagagtatagcgagaaaaagaaggggtctcacaagcgctccgctagctggggaagtactgatcagttgaaggagattgccaaactcagacagcagctccagcgaagcaagcactccagccgccaccaccgagacaaggagcgacagtcaccatttcatgggaaccatgcggccataaatcagtgtcaggcacctgtcccaaagtccgccctgattccggtgatacctataactaagagcacaggttctaggttccggaacagcgtggagggactcaatcaagagatcgaaattattatcaaagaaaccggcgagaaggaggaacagcttattccgcaagatataccggatgggcacagggctcccccgccgttggttcagcgctcatctagcacgcgcagcatcgatacccaaacaccgggaggggccgatagagggtccaacaacagctctagatcccagtccgtctcacctacctctttcctaaccatctcaaacgaagggagcgaggagtccccatgcagtgcggatgacctgctggtcgatccccgcgataaggagaatggaaacaactcaccactgcctaagtacgcgacgtctcctaagcccaataacagctacatgtttaaaagagaaccccccgagggctgcgaaagagttaaggtgtttgaagaatgttcacctaaacagctgcatgagatacctgccttttactgcccagacaaaaacaaagtaaattttatcccgaagtccggaagtgctttttgcctcgtaagcattctgaagccgctattgcctactcccgacctgacattaaagggatctggccactcgctgaccgtcactactggcatgaccactacattgctccaacccatcgccgttgcaagcctgagcactaatacagagcaagacagggtgtccaggggaacaagcactgtcatgccttccgcgagcctcctgcctcctccggaaccaatcgaagaggctgaaggttag

SEQ ID NO: 29627 - DNA, 1056 bp, Artificial Sequence
  Description of Artificial Sequence: Synthetic coding sequence
atggcctccactgggtcccaagcctcagacattgacgagatcttcggatttttcaatgacggtgaaccccctacaaagaagccccgtaaactgctgccaagcctcaaaacgaaaaaaccaagagaactggtgctcgtgatcggtaccgggatctctgctgccgtggctccacaggtaccggccctaaagtcctggaaggggcttatacaggccctgcttgatgccgccatcgacttcgatttgttggaggacgaggaatctaaaaaatttcagaagtgtctccatgaggacaagaatctggtccacgtcgctcacgacttgatccagaagctgagcccccggacaagcaacgtgaggtccacttttttcaaagattgcctgtacgaagtgttcgatgatctcgagtctaagatggaagactctggcaagcagctcctgcagtctgtcctgcacctgatggaaaacggggctctggtgctgacaacaaactttgacaaccttctggagctttatgctgctgaccagggcaagcagctggagtctcttgatctgaccgatgagaagaaggtgctagagtgggcccaagaaaaacgaaaactcagtgtgctccatatacatggcgtctatactaatccttcgggaatcgtcctgcaccccgccggctaccagaacgtgctccggaacacagaggtcatgagagaaatacagaaactgtatgaaaataagtcttttcttttcctcggatgcggatggacagtggatgatacaacttttcaggcattgtttctggaggccgtcaagcacaagtccgacctggaacacttcatgttggtcaggcgcggtgacgtggacgagtttaaaaagcttcgggagaatatgttggataagggaattaaagtgataagttacggtgacgattatgcagacctgccagaatacttcaaacggctcacatgtgagatttctacaagagggaccagcgctgggatggtgcgcgagggacaattgaatggctcctcagccgctcattcggaaatccggggctgtagcacatag

SEQ ID NO: 29628 - DNA, 222 bp, Artificial Sequence
  Description of Artificial Sequence: Synthetic coding sequence
atgaggctgatcctcaacctctgcaggggagccggttgcaacagacaggccgtggctggccagctactgcctagcacatggtccctccatgctcacggtttagccaaggaggcccctatattgcctgtcaaaaaaattagtagaagctgcagcgttaataacaaagtcagcaagaaaaccactaagccgccaacactgcggtcattcctcagtccaatttag

SEQ ID NO: 29629 - DNA, 771 bp, Artificial Sequence
  Description of Artificial Sequence: Synthetic coding sequence
atgggtaaaactaaggacattggtgacgatgatactgtcgcctccgaattttggtctggcgccctgagtcagccttcgagtgtcccaacacggccacgaacaccaaacagagattcctggagacgggcttgggccgcccgggggctgcatccccgcccaagcatactgcagcccgggcccgcgcgtctatctagagccagggccggaggcaccaggtgtccccagcgccgtcatgggagagccactttctgcgccctggggcggggaatcggagtccggagaggtccaggcccaagacctgccaggatccctggcctgactctcacttggaagcgaatgtctgcgcggcgcatgcaatgggccatgcagactggtggaaggaaccaaacttttggcgggggcgtgccactgttttggacttggttaaccatttgctgcgccgtttggcgttccctgccctgtcgcttgacccactcctgctcacgggcgtttagcagcgctcctctaaagaagactaagagctcgatgctaccaccaaaacaggctctggctagcgccgcacggaacctgtgccgtggcgccggatgcaaccggcaagccgtggccggacagttgttgccttcgacttggtccctgcatgcacatggcctggctaaagaagcaccaatcctaccagttaagaaaataagcaggtcttgttccgtgaataacaaggtgtcaaaaaagacaactaagccgcctactctccgtagtttcttgagtcccatttag

SEQ ID NO: 29630 - DNA, 816 bp, Artificial Sequence
  Description of Artificial Sequence: Synthetic coding sequence
atggcacaagagaaaatggagttagatttagaattgcctcctggtaccgggggatcccccgccgagggcggagggtcggggggcggtggcggtctgcggagatcgaacagcgctccgttgatccacggtctgtcagatacaagccccgtgtttcaggccgaggcccccagtgcaagacggaattccactacttttccatctcgtctgcatcaaattaagcaggaggaagggatggatcttatcaaccgagagacagttcacgagagggaggtacagaccgcaatgcagatcagtcacagctgggaagagtcattcagccttagcgacaatgacgtggagaagtccgcatcacccaaacgaattgacttcatcccagtttccccagcaccaagccctacacgcggaatcggcaaacagtgtttttcaccaagcctccagtctttcgtgagcagcaatggactgcccccatcccctatcccgtcacctaccacaaggttcactaccagacgcagtcagtccccaatcaattgcattcgtccttctgtgctgggacctctaaaacggaagtgcgaaatggagactgaatatcagcctaaacggttctttcagggcattaccaacatgctgagcagcgacgtggctcagctctcagaccctggggtctgcgtgagtagcgatacccttgatggcaactccagttcggccggtagtagctgtaatagccccgcgaaggtcagtacaaccacagactctcccgtctctccagctcaagcagcttctccttttatccctctggacgagttgtccagtaagtag

SEQ ID NO: 29631 - DNA, 864 bp, Artificial Sequence
  Description of Artificial Sequence: Synthetic coding sequence
atggctcaggagaaaatggagttagaccttgagctaccaccagggactggggggtccccagccgaagggggcgggagtggcggcggaggggggctgcggcgctcaaatagcgccccactgatccacggcctctctgacacgagtccagtgtttcaggctgaggcaccctctgctcgccgcaacagtactacttttccatcaagacacggactgctattgcctgcctcacctgtgcgcatgcatagttctcgcttgcaccagatcaaacaagaggaggggatggacctgattaatagagagactgtccacgaacgagaggtgcaaaccgctatgcagatcagccacagctgggaagaaagctttagtctttctgacaacgacgtagagaagtctgcctcaccgaagagaatcgacttcatccctgtgtcccccgctccaagcccaaccaggggaatagggaaacagtgtttcagtccgtccttgcagtcatttgtgagctctaacggcttgccaccctcaccgatcccaagccctaccacccgatttactaccaggagatcacaatcccccatcaattgcatccgcccatcagtgttgggcccccttaagcgaaagtgcgagatggaaactgagtaccagcccaagaggttctttcagggaataacgaatatgctgtctagcgacgtcgctcagctgagtgaccccggcgtctgcgtgtccagtgacacactggacgggaattccagtagcgccggcagcagctgtaacagtcccgccaaggtttccactaccacagatagtcctgtatcaccagctcaagcagcaagtccatttattccgctggacgagttatctagcaaatag

SEQ ID NO: 29632 - DNA, 726 bp, Artificial Sequence
  Description of Artificial Sequence: Synthetic coding sequence
atggctcaggagaaaatggagttggacctggaacccgacacttcctacggcgggacattgaggagatcctcatcggctccccttattcatggactgtctgaccttagccaagttttccagccatatacgcttagaaccaggcgcaactcaaccaccatcatgagtcgtcatagtctgctgctcagtagtagccccaatcggatccctagctcacggttacatcagatcaaaagagaggaaggccttgacatggtgaatagggagaccgcgcacgaaagagagatgcaaaccgccatgcagatcagtcagagttgggacgaatccctgagtctctccgacagcgactttgataagccggagaaactttacagcccaaaacgaatagactttacccccgtgtcccccgcccccagccccacaagaggttttgggaagatgtttgtgtcttcatccgggctgccaccttctcccgttccctcccccagacgatttagccgcagatcacagtctcccgtgaaatgtatccggcccagtgtgctaggaccattgaaacgcaagggcgagatggaaacagaaagccaaccgaagcgactcttccagggcacaaccaacatgctgagtccagatgctgctcaactatcagacctcagcagttggtggtgctatcaaggcgaagagattcccgctctgactcggtgtgttgaacatctgcaaatgaacgaatag

SEQ ID NO: 29633 - DNA, 801 bp, Artificial Sequence
  Description of Artificial Sequence: Synthetic coding sequence
atggcccaggaaaaaatggagctggatctggagccagacacctcatacggaggcactctccgacggagttcaagtgcaccccttatccatgggctctctgatctgtcacaggtgtttcagccctatacattacgcaccagaagaaattccacaacaattatgtcccgacacagtttactgctgtcaagcagccccaatcgtatacctagcagtcgactccaccaaattaaaagggaggagggattggacatggtgaacagagaaactgcccacgaaagggaaatgcagacagctatgcaaatctcacagtcttgggacgagtcactttctctgtccgatagcgactttgataaaccagaaaaactatacagtcctaagagaatcgactttacccccgtgagccccgcaccctcacctaccagaggctttggtaaaatgttcgtatcttcgtccggcttacccccatcaccagtgccgtcaccgcgacggtttagcagaagaagtcagtcgccagtcaagtgcatccgccccagcgtactgggccctctaaagcgcaaaggagagatggagacagagagccagccaaagcgccttttccagggcacaacaaatatgctgagtccggatgctgcacagcttagtgatcttagcagttgttccgatatacttgatggatcatcaagctcgtcaggactttcatcagaccctttagcaaaaggctctgccactgctgaatcgccagtagcttgttctaatagctgcagctcatttattctgatggacgatctgtctccgaagtag

SEQ ID NO: 29634 - DNA, 198 bp, Artificial Sequence
  Description of Artificial Sequence: Synthetic coding sequence
atggctcaggagaagatggaactggatctcgagccagacacctcatatggggggactttgcgccggtcatcctctgcacccctgattcatggccttagcgacctgagccaggtgttccaaccttacaccttaaggacccggcgcaattccaccacaattatgtcacggcacagcctgctgcatatatggcacttttag

SEQ ID NO: 29635 - DNA, 744 bp, Artificial Sequence
  Description of Artificial Sequence: Synthetic coding sequence
atggcccaggagaagatggagctcgatctggagccagatacctcatatggcggcactcttaggcgctcttcatccgcgcccctgatccacggcctgagcgatctcagccaagtctttcaaccctacacgctgcgaacccgcaggaatagtaccaccattatgagtcgccattccctagaagagggattagacatggtgaaccgagagaccgcccacgagcgggagatgcagacggctatgcagattagtcaaagctgggacgagagcttgtccctgtcggattccgactttgacaagcccgagaagctttactctcctaaacggattgactttacacccgtgtccccggcgccttcccctacccgtgggtttggcaaaatgttcgtgtcctcatctggactgcctcctagcccagtcccttctccacgcaggttttctcgtaggtcgcagtctcccgtgaagtgcatcagaccgtccgtgctggggccactcaaaagaaagggagaaatggagactgaatcacagccgaagagactgttccagggaaccacgaacatgctgagtcccgatgccgcccagctttcagacctgagctcttgctctgatattctcgacggcagctcttcctctagcggcctgtcgtccgaccccctggctaaaggatcagcaacagctgaaagcccagtggcatgttcaaattcctgctcttcttttatccttatggatgacctgtcccctaagtag

SEQ ID NO: 29636 - DNA, 336 bp, Artificial Sequence
  Description of Artificial Sequence: Synthetic coding sequence
atggcccaagagaagatggaactggatctcgagccggacaccagctatggtggaaccctccgaaggagctctagcgccccgcttatccacggcctgagcgatttatcacaggtctttcaaccctatactctgcggacgaggcgaaactctacaacaatcatgtcaaggcattcactgctattggtgccaaagggctacatggagagagtggataagatctacaagaggcatcaggaggagggtttggatatggtgaaccgtgagaccgcccatgagagagaaatgcagaccgcaatgcaaattagccaatcatgggacgagtcactatcactgtag

SEQ ID NO: 29637 - DNA, 747 bp, Artificial Sequence
  Description of Artificial Sequence: Synthetic coding sequence
atggcccaggaaaaaatggagctggacctcgaaccagatactagctatggtggcaccctgaggaggagctcttctgcaccgctcatccacggattgagcgatctgtctcaggtgtttcagccctacactttgcgtacaagacgtaacagtacaaccataatgtcgcgacacagcctagaggaggggctggacatggtcaatcgcgagacagcacatgaaagagaaatgcagactgcaatgcaaatcagccaaagttgggacgagtccttgtcactgtccgacagcgactttgataaacctgaaaaactctattcgcctaaacggattgatttcaccccagtatctccggcccccagccccaccagggggtttggaaagatgttcgtgagctcttcaggcctgcctcctagcccagtgcctagtccccgcagattctcctcccgccggagccagagtcccgtcaagtgtattaggccatctgttttggggcctctaaaaagaaagggagagatggagacagaatctcagccaaaaaggctgtttcaaggtacaactaacatgttatcacctgatgcggcccaactgtctgatctgtctagctgctcagacattctcgatggcagctcttcatcctctggactctcatccgaccctctcgctaaagggtccgccactgctgagtcacctgtggcctgttccaactcctgcagttcattcattctgatggacgacctctctcctaaatag

SEQ ID NO: 29638 - DNA, 588 bp, Artificial Sequence
  Description of Artificial Sequence: Synthetic coding sequence
atggcacaggaaaagatgaaactcggtttcaagtcccttccaagctccactacagcagacggcaacatacttcggcgcgtcaactctgcacctctaattaatggcctgggttttaattcccaggtattacaggctgacatgctacgcatcaggacaaaccggactacctttagaaataggaggtctctcctcctccctccccctcccttccacggtagcatctcaagactccaccagattaaacaggaggaggcaatggacctaataaaccgagagactatgtccgaatggaaactccagtccgaaattcagataagtcacagctgggaggaagggcttaaactcgtgaagtggcactttaatattaaccagaagagattctctaaagcacaaccaacatgcttcctgctcattctgcccaattgtcagaagatcatgtgtatctactttcaattgctgcttatggagactaccgctatgctggatctgttagtaattaggcagttgaaatccgctctgtcacagacccttttatgccacctgttgatactggtcttgatctgtagcagtcgccagacattcaattag

SEQ ID NO: 29639 - DNA, 459 bp, Artificial Sequence
  Description of Artificial Sequence: Synthetic coding sequence
atggctcaggaaaaaatgaagctcggatttaaaagcctgccctcaagtaccacagccgacggtaatatccttcgcagagtgaactccgccccattgatcaacgggctgggcttcaactcccaggtacttcaagccgatatgcttaggatccgtaccaacaggactaccttcaggaatcgcagaagccttctcttacctccaccccccttccatggcagtatcagtagactccaccaaatcaagcaggaagaggcgatggatctgatcaacagggaaacaatgtctgaatggaaactccagtcagagatacagatttctcacagttgggaggaaggcctgaaacttaatgataatggcctgcagaagtccagtagtctaaaatgtatcgatctgacaccagttagtagcatggcttcctcaatcaagaaaacggggaaatccacatctagctacttctag

SEQ ID NO: 29640 - DNA, 348 bp, Artificial Sequence
  Description of Artificial Sequence: Synthetic coding sequence
atggcatactttcccggaacggggagaacagatcaggaaactcagttggacctgagcctctgcgggagggaaccagaatcattggagaatctgttcttggaccctgacatggcccaggaaaagatgaaactcggcttcaagtcattgccttcctccaccaccgctgacggtaacattctccgaagagtgaatagtgcccccctgattaacgggctcggattcaactctcaagtgttgcaggccgatatgctcaggattcgcaccaatcgcacaacctttcggaacagaagaagtctggagatcacgtctcccacgagcgttgaacagaaacccaaagacttgttttag

SEQ ID NO: 29641 - DNA, 558 bp, Artificial Sequence
  Description of Artificial Sequence: Synthetic coding sequence
atggatctcattaacagagagactatgtcagaatggaagctccagtcagagatccaaatctcccacagttgggaggaaggtcttaagctaaatgataacggcctgcagaagagtagctcactcaagtgtatcgacctaacccctgtctccagcatggctagctcgatcaagaagaccgggaaacaatgcttctcgccatcactccagacgtgtgtttcttgcactgggagtccctcctccccaatcccaagtccaatgcaacaatacatcatccgctctcagaatcccacaaatataattcggccttcaatactggggccccttaagaggaaaggagaaatggccttccagtaccagcctaaaaagatctttcagggtacaacaaatatgctatcaagcgataccagccagctctctgagaacaacgtctaccttctcccagcgacctttgacggaaatgatagcaacgcaggcagctctgggaattccagtgctgagattggcaccgtgacgaattcacccgtgtccccctcagatacgggctcccatttattttag

SEQ ID NO: 29642 - DNA, 1659 bp, Artificial Sequence
  Description of Artificial Sequence: Synthetic coding sequence
atggaaacgagccggtcgcgcggaggtggcggcgcagtgtccgagcgaggaggagccggggccagcgtcggcgtgtgtcgtcgcaaggccgaggcaggagctggcacaggaactctggctgcggacatggacttgcactgcgactgtgctgctgagacacctgccgcagagccaccgagtggcaaaattaataaggccgcgttcaaactgttcaagaagcgcaagtccggtggcacaatgccatcaattttcggtgtaaagaacaagggggatggaaagtcttcaggcccaaccggcctggtgcggtcccggacccacgacggcttagccgaggtgctggtgcttgaatccggccggaaggaggagccgcgaggcgggggcgacagtggagggggaggaggaggcagacctaatccagggccaccaagagccgcaggcccaggaggtggctcgcttgcctcctcgagcgtggccaagagccatagtttcttcagtctcctgaagaagaatggccgcagcgaaaacggtaagggagaaccggtggatgcaagtaaggcaggcggtaagcagaagaggggattaagaggattattctctggaatgaggtggcatcggaaagacaaaagagcgaaggccgaggccgccgaagggcgggcgcccggagggggactgattcttcccggcagtcttaccgccagcctcgagtgcgtcaaggaggagactccaagggccgcaagggaaccagaagaaccttcccaggatgcgcccagggatccagctggttgtggggacataattgcagatcaggaagaggaggcaggccctagctgcgacaagcacgttccagggcccggcaagcccgccctctctaagaaaaaccccggggtggtggcctaccagggtggtggcgaggagatggcaagtccggacgaagtggacgacacgtaccttcaggagttctgggatatgctttctcaaacagaggaacaaggcccggaaccgcaggaaggagccgccaaggtggccgctgcactggagaccaaggtcgtgccagagacccccaaagacacacgatgcgtggaggctgctaaagacgcatcaagtgttaagcgtcgcaggttgaataggatccctattgaacctcaccctaaggaggagccgaagcacccagagaaggaacagcaggaaggcgtcccaaatagtgacgagggctactgggactctaccactcccggcccagaagaggactcttcctcttctgggaagaaggccggaatcccacgtgactcatattcaggagacgcactgtacgatctctatgctgatcccgacggctctcccgctacactcccgggaggaaaagataatgaagagacatcatctctgtcccggcttaaaccagtgagtcctggcacgataacctgccccctgcgaaccccagggtctctcctgaaggactccaagatccccatctccatcaagcaccttactaatctgccctcctctcatcccgtagtccatcagcagccctcaaggagtgaaatgcccagaactaaaatcccagtgtccaaggtactcgtcagacgcgtgtcaaaccgaggcctggccggcactaccatcagggccacagcctgtcatgatagtgccaagaagctctag

SEQ ID NO: 29643 - DNA, 1659 bp, Artificial Sequence
  Description of Artificial Sequence: Synthetic coding sequence
atggagacctctagaagccgcggcggaggaggtgcagtgagtgagcgtggcggcgcgggggctagcgtgggcgtatgccggcgcaaggccgaggcaggagccggcacaggcaccctggcagcggatatggacctgcactgcgattgtgcggctgaaacgccggccgccgagccgcctagtggcaaaattaacaaggcagctttcaagttattcaaaaaaaggaaatcggggggcacaatgccgtccatcttcggagttaagaacaagggagatggtaagagtagcggaccaacgggcctcgtgaggtccagaacacacgacggcctggccgaagtcctggtgctggaaagtggccgcaaggaggaacccaggggagggggagattccggaggaggaggcggtggccggccaaacccaggccccccacgagccgccggcccaggcgggggaagcctggcttccagttctgttgctaaaagtcacagcttcttcagtctcctgaaaaagaatggacggtcggagaatggtaagggcgagccggtagacgctagtaaagccgggggaaaacaaaagcgcggacttcgcgggttgttcagcgggatgagatggcatcggaaggacaaaagagccaaggccgaggcggctgagggacgggcacccggcggtgggctgattctgcccggtagtttgaccgcatccctagagtgcgtcaaggaggagactccccgggcggccagggagcctgaggaaccctcccaagacgcccctagagatccagccgggtgtggcgatatcattgcggatcaggaagaggaagctggccccagttgcgataagcacgtccctgggcccggtaagcccgccctgagtaaaaagaatcctggcgtagttgcataccagggtgggggcgaggagatggcctctccagatgaagtagatgatacctatctgcaagaattttgggatatgctgtctcagacagaagaacagggtccagaacctcaggaaggagcggctaaggtcgccgcagctttggagacgaaggtcgtcccagaaactcctaaggatacacggtgtgtggaggcagccaaagacgcttcctccgtcaagagacggaggctgaatcgcatccctatcgaacctcatcccaaagaggaacctaagcacccagagaaagaacagcaggaaggggtccccaattctgatgagggctattgggatagtaccacgcctggccccgaagaagatagctcctcatctggaaaaaaggcgggaatccctcgtgattcctacagcggtgatgctctatatgacctctatgccgacccagatggctcccccgctactctgccaggtggcaaggacaacgaagaaacatcttccctgagccggcttaaacccgtgagcccggggaccatcacatgcccgttgcggactcctggttccctgttgaaggactccaaaataccaatcagtattaagcacctcaccaatctgccctcctcacatcccgtggtccaccagcagccgtcaaggagcgaaatgccccggactaagattcccgtcagcaaggtgttggtccgacgggtcagcaaccggggactagctggcaccacaatccgcgcaaccgcatgccacgatagtgccaagaaattatag

SEQ ID NO: 29644 - DNA, 2016 bp, Artificial Sequence
  Description of Artificial Sequence: Synthetic coding sequence
atggaaacaagtcgctccaggggtggaggcggagctgtgtccgagaggggtggagcaggggctagcgtcggagtatgtagacgaaaggccgaagccggcgccggcaccggtacactggccgcagacatggacctgcattgcgactgcgctgctgaaactcccgccgctgaacctccatccggcaagatcaacaaagccgctttcaaactgttcaagaagcggaagagtggcggcaccatgccatccatatttggcgtcaaaaataagggcgatggtaagagttccggaccaacgggactcgtaaggtcccggacccacgatggtctcgcagaggtactcgtcttggagtcaggaagaaaggaggagccgcgcggggggggcgactctggaggtggcggaggaggacggcctaatcctggacccccccgagcagcaggacccggcggcgggagccttgcaagctcctccgttgcgaaatctcattcattcttcagcctgcttaaaaaaaatggaaggagtgagaatggtaaaggggaacctgtggatgcttctaaagctgggggaaagcagaaaagaggactgagaggacttttcagtggaatgaggtggcatcgcaaggacaagagggcaaaagccgaggctgctgagggcagagcgccaggaggaggactaatccttcccggtagcctgacagcatctctggagtgcgtgaaggaggagacgcccagggccgctagggagcctgaggaaccttctcaggatgccccgagggaccccgcaggcgagccagctggaggcgaggaggtgcctgcacctgcagaccgtgcgcctgcacggtcttgcagagaagccgaggggttggcacatccaggtgacacaggtgctcgcggagaggacgcggcaggccaccgccgcgccgaaccaggccccggagaggtccgaacagccgaggacgcaagcaggaccggggctgtacccgtgaagacagtcccactggtcgacagcgagggaggctcaggacgagccccagctgcacctgatcccgcttctgtggacccacctagtgacccgagcgctgatcggatttgcctgatgtttagtgacgtcacttccctgaagagtttcgactccctaactggctgcggtgacatcattgcagatcaggaagaggaggctggaccctcttgcgataagcacgtgcccggccctggaaagccagctctctctaaaaagaaccctggtgtggttgcatatcagggcggaggagaggaaatggccagtcccgatgaggtggacgacacctaccttcaggagttttgggatatgttgtcccagaccgaggaacagggtccggagcctcaggaaggtgctgcgaaggtggcggctgcactcgaaaccaaggtggtgcccgaaacacctaaagacaccaggtgcgtcgaggccgccaaggacgccagcagcgtcaaaagaagaagactgaaccggattcccatcgagccgcacccaaaagaagagccaaagcaccccgagaaagaacaacaggaaggagtgccaaattccgacgaaggatactgggactcaaccaccccaggccctgaggaagattcgagctctagcgggaagaaggcaggaattcctagagattcatactctggggatgccctctatgacctctacgctgaccccgacggctcgccagcaacactccccggcggtaaagacaatgaagagacaagctctttatcacgtttaaaacccgtaagtcctgggaccattacatgcccgctcagaacacccggcagcttactaaaagactctaagataccaatcagcataaaacaccttaccaatctcccttcatcacatccagttgtccaccagcaacccagcagatccgagatgccacggacgaaaattcccgtcagtaaagtcctggtgaggagagtttcaaacagaggccttgctgggacaacaatcagagccacagcttgccacgattcagctaaaaagctttag

SEQ ID NO: 29645 - DNA, 2586 bp, Artificial Sequence
  Description of Artificial Sequence: Synthetic coding sequence
atggagctaaagcgcgggaaaactttcataaagagtagtctccaggtatctcacgagaaaccgcctgaccctgccgccgtcgccgcggcccgagagggaacgggtccatggtccgtactgccaggtggccaacagaggcctcactccgaaaaaggtccccaggcgagcccatcggctcaagagtatgatcggtgcccaaataaaggcgcacaactcgatcctaagggaggacccgctgctctgtgcggggctaccttcaaaccagttagaaaatgcaagacccatgacagcatgagtggcgccggccgggctactgctgccaccgggcagctggtgggttcagccagttttcccgggagtccgggttcaagacggatgatcgactaccggcacttcgtaccgcagatgccattcgtgcccgccgtggccaagagtattcctagaaaacgcatctctctcaaaaggcctaaaaaatgctttaggaatctctttcatattcggagaaataagaccgaagatctggcctcccttgcagcggaggggaagtccctgccgtccccaggcgacccttctgatccgggtgggcggcggagtaaagccttcttacctcctggcgagggcccaggactcgatggactgtgccaggacctcttagattctgagctcttggcagacgcaagtttcggactttgcagggcactctgtgaggacgtagcctcactccaaagcttcgacagccttacagggtgcggcgaggtgtttgctgacgaaagttctgtgcctagcctggagctcaatgaaggtccggagtctcctacgcaggctgctcagggcctggagagcaaggtgcctaggggacccctccaaggatccgttgagcaacttgcttcgcctgcccagaacgaggccagcgatttcacacgcttctgggattcagtgaatagatcagtgcgacagcagcaaagagccctgctgggcccttggctctctggaccccagggaacggatagggatcagtcacggctggatactgctggactcgccgaactgccgctgtgtccctgccgcgaccctagaagcggttcaaaggcaagcagcatcgacacaggcacacccaagtcagaacagcccgaatcagtttccacttccgacgaagggtattatgacagcttctctcccggcctagaggaggacaaaaaagaggccgagagccctggtactcctgcggcaacctttcccagagactcttacagcggggatgcactgtacgagctgttccatgaccccagcgaaggccctttaggtccgagtccggacgacgatttatgtgtgagcgagtcactatccggccccgcgttagggactcccttatcaatctgttcttttagagtgggcgccgaagaaaatctggctcctgcaccaggtcctgacctgctaagccagggatttctgcagtcttcatggaaagggaaagagtgcttgctgaagctgtgcgataccgagttggcaattaccatgggcatcgtcagttggttgagacgaggaccgacaccgagggctccccctacaccaggacagcccgcagccccccctggatctcagggcgcaccccgggctcctacagagaagcttgggggacgcgaggggctggcttctgacgcgggaggggctacagtctgttccgccccgagccggcaggaattgtgggcccacccgggcaccactggtttactggctggcgagagcaaggccctgggcggagccactcagggcacaggcacactgagccgggatgccagccgggaagaggaaaccagaggacactcggagggattattctccagcatggagagcgcagctacttccacaactgacacgtctggaaagaacaaggcgcctgtccctagtacatggccctgttcccagaaagaaccaggccctcccggcgtgctcggatgttttaggggtccttggcgaccgggacatgggggtgatacactggacgctgaacctatgctcgctggttgtgtcgcgcgagtagctgccctgaaaatttcatccaatgagcagcctccagctgcttggcccccaaggcaagatatggggagtggcctgttcggacagagatgggcccggggcccggatatgctcgagcagaaacaatcaagtagttcgccttcaatgacaaccattcacggtctgccttacagcgccagcacgcaggaccaacggtgccgcgaccgtgtgcaggatctgagttggctgcgggtggagccaacgggcctgggtgtgcaggcttgggcatcagtagaggatcagccgctccagctatcaaccgaagcagtggagcaggtagctcatggctcacagctggacagcgagcctcggtcagcgcctgccgcccgatggtctagtcaaggacaccatccagagagcctggggctgacactcaactctcagcaggagggcggggtatctgcttccgcaccggaatgtcggtgcagcctcctggcccgagagggattgctgtgcgggcagcccgaagtcggcgctagcggccccgctatggcagagccacacctttag

SEQ ID NO: 29646 - DNA, 2586 bp, Artificial Sequence
  Description of Artificial Sequence: Synthetic coding sequence
atggaactgaagcggggaaaaacttttataaagtcgtccctgcaagtatctcacgagaagccacccgaccccgcagccgtggctgccgccagggaggggacgggcccgtggagtgtgttgcctggcggacagcagcgtccccatagcgagaagggtcctcaggcaagcccttccgcccaagagtatgatagatgtccaaacaagggcgcccagctcgaccctaaaggcggtcctgctgctctttgtggcgcaacttttaaaccggtgcggaagtgcaaaacccacgacagcatgtccggggctgggcgtgctactgctgccaccgggcagctggtgggatccgcctccttccctggctctcccgggtccagacgcatgatagattatcggcatttcgttccccaaatgccctttgtgccagcagtcgccaaaagcattcctcgcaaaaggatttcgctgaagcggcccaaaaaatgctttaggaaccttttccatattcggcgaaacaaaaccgaggatcttgcatcactcgctgccgaaggcaagtccttacccagcccgggtgatccttctgatccgggcggtaggagatccaaggcattcttgcctcccggtgagggtccaggcctggacggcctctgccaggatctcttggactctgagcttttggctgatgcttcgttcggcctctgcagggcactgtgcgaggacgtcgcatcactgcagtcctttgactcacttaccggctgtggggaagtcttcgccgacgaatcgtccgttccgagcttggagctaaatgagggacctgagagccccactcaggctgctcagggtttagagtctaaagtgccccgcggcccgctccagggctctgtggaacaattggcctctcccgcccaaaatgaagcatcagattttactcggttttgggatagtgttaatcgtagtgtgcggcagcagcaaagagccctgctcgggccttggctgtccggtcctcagggcaccgatcgagatcagagcaggctggacacagctggccttgctgagttgcccctgtgcccatgtagggatccccggtcaggaagtaaagcttcctctattgacactggaacgccaaagtccgagcagcctgaatcagtgtcgacgtcagacgaaggctactacgactccttcagccctgggctggaagaagacaagaaagaggcagagtcccccggcacccccgctgctacttttccaagggattcctattccggggatgccctgtacgaactgttccacgatccatcagaagggcccttaggcccgagtccagacgatgatctatgcgtctctgagtccctttcaggacccgcactaggcactcccctgagcatttgtagcttccgcgttggtgctgaagagaacttagcacctgcccccggtcccgatctcctgtcacaaggattcttgcagtctagttggaaaggtaaggagtgccttctcaagttatgcgatacggaactggccattaccatgggcatcgtatcctggttgagaagagggccaaccccccgggcgccacccactccaggccagcccgccgccccgccaggcagccagggggcgccccgggcaccaactgagaaactggggggtagagagggcctcgctagcgacgctggcggtgctacagtttgcagtgccccatctcgccaggaactgtgggcccatccaggtacaaccgggcttctagccggtgaatctaaggcgcttggcggcgccacgcaaggcacaggaacactcagccgtgatgcgtctcgcgaggaagaaacccgagggcactccgagggacttttctccagtatggagtccgccgccaccagcactactgataccagcggtaagaataaggcacctgttccaagtacgtggccttgcagccaaaaggaacccggcccccctggagtgctgggttgctttaggggcccatggcggccagggcacggcggagacaccctggacgctgagcctatgttggcaggatgtgtggcaagggtcgctgccctcaaaattagcagcaatgaacaacccccagctgcctggccccctagacaagatatgggcagtgggctgttcggccagcggtgggccaggggacctgacatgttggaacaaaaacagagctcaagttccccttcaatgaccactatccacgggctcccctactctgctagtacccaggatcagcgatgtcgggatcgcgtgcaggacctgtcatggctgcgcgtcgagcccaccggtctaggagtgcaggcctgggcatccgtcgaggatcagcccttacaattaagcaccgaggccgttgaacaggtggcacatggaagccagctagacagtgaaccgcgatcggcccccgccgcacgctggagttctcagggacatcaccctgagagtttggggctgaccttgaattcgcagcaggaggggggagtttcagcgagtgctccggagtgcagatgttcgctcctggcaagggagggactcctgtgcgggcagccggaggttggtgccagcggccccgcgatggccgaacctcacttgtag

SEQ ID NO: 29647 - DNA, 429 bp, Artificial Sequence
  Description of Artificial Sequence: Synthetic coding sequence
atggagctaaaaagaggaaagaccttcatcaagtcctccctccaggtttcacacgaaaagccgccggatccagccgccgtggcggctgcacgcgaggggactggcccatggtcagtactgccagggggacagcaacgcccccatagcgaaaaagggcctcaggccagcccaagtgctcaggagtacgaccgctgtcccaataagggggcccagctggaccctaagggaggtcctgcagctttatgcggggcgacattcaaacccgtgcgcaaatgtaagacccacgactctatgtccggtgccggacgcgccacggccgccaccggccagctggtgggaagcgccagcttcccggggtctccagggtcacgacgcatgattgactacaggcattttgtgcctcagatgcctttcgtcccagctgtgtag

SEQ ID NO: 29648 - DNA, 543 bp, Artificial Sequence
  Description of Artificial Sequence: Synthetic coding sequence
atggagcttaagcgcggtaagaccttcataaagagcagcttgcaggtcagtcatgaaaaaccccccgatcctgcagctgtcgctgcagcccgagaggggacgggcccttggagcgtccttcccggaggccagcagaggcctcacagtgaaaaggggcctcaagcaagtcccagcgcacaggaatacgacagatgcccaaataagggggcccagctcgatccaaagggtggacctgcagctctgtgtggcgccacttttaaaccggtgaggaaatgcaagacacacgattcaatgtccggggccgggcgcgccactgccgcgaccgggcaactggttggatctgcatccttccctggctctccaggctcccgtaggatgattgactaccggcactttgtgccacagatgccttttgtcccagcagtggctaaaagtatcccaagaaaaagaatttccctgaaacggccaaaaaagtgcttccgaaatctgttccacattagacgaaataaaacagaggatctggcctccctcgctgccgaatag

SEQ ID NO: 29649 - DNA, 1749 bp, Artificial Sequence
  Description of Artificial Sequence: Synthetic coding sequence
atggaccctaaagccggcggcgggggagaggaggatgactgtgtcgactctggcgctgagacagggggcagcgactactctcacctttctagcacatctaatgggttctctacatggcgcatgccctgttgcctgttcctgtactgtacccatggagataaggagaaaggtagatggtccctgcaggtcgaacatacgtggccgtctggagagctgagtgtggaagaggcacaggatcctttcctggtctcgattcacattatagctgatccaggcgagtcccaacccctgcaggaggccattgataatgttctcgcttggattcaccccgatttaccattatttagagtctcagaaaggcgagccagtaggcgaaggcggaaaccgccaaagggcgcacagcctgcgctggctgtcgtgctctttctgcaagaggaatacggagaggaacagattttacagctgcacagaacacttcagcaaccaccgtggcgccaccatcataccgaacaagtgcatggaaggttcttgccctacttgccgtgtagccaggacttcttcactctggcgcctggcaccccgttgtgggccattaggccggtgcactacggcaaggagatcgttcgatttaccgtttattgtagatacgataactacgcagatagtctgagattttatcagctcatcctgcgccgctctccgtctcagaaaaaagccgacttctgcatattcccaattttcagcaacctggacgtagacattcagttcagcctgaagagactcccttgcgaccagtgcccagtgcccactgactctagtgtgctggaatttagggtgcgtgacatcggcgaactggtgcccctgctcccaaatccatgtagccccatctccgaaggtcgctggcaaactgaggaccacgatggtaacaaaatcctgctccaggctcagagagtgcacaagaaattcccaaaacctggccgcgtgcaccacgcatctgagaaaaagaggcactcaacaccactgccctccaccgcagttccaagtcacacacccggatcatctcagcaaagcccattaaactccccccaccctggaccaattcgcactgggttacctcctggacatcaacaggaatttgcggggcgcgcgaacagtactcctaatccgccttggagcttccaaaggtctaagtctctgttctgcttgccgaccgggggaccatccctggcttcaagtgcagaacctcaatggtttagtaatacaggagcacccggccatagagccagtgagtggcgacatgggcacctgttgagcatcgatgacttagagggagcgcaagagactgatgttgataccggcctgcgcctgtccagctcggacctaagtgttgtgtcagcgtattctgccccttcccggttctgttcaacagtcgagacacctctgcccagtgaaagatgcagctcacattgggctgcccacaaggactctagggaaggtcctctgcctacagtctcccgggtgaccactgaggccagttgggcctcactcccattcttcaccaaacgcagtagttcttctagcgctacggcacgggccgctccacccgccccgagtacttctacacttactgacagcagccctcagctcccctgcgatacccccaaagttaaacaaactgatggcgacatgccgcctccccccggctccgccggccctggcgacaacgacatggaagagttctatatctag

SEQ ID NO: 29650 - DNA, 1641 bp, Artificial Sequence
  Description of Artificial Sequence: Synthetic coding sequence
atggaccctaaggccggaggtggcggcgaggaggatgactgtgtggatagcggggctgaaactggaggatcagattattcccatctgagctcaaccagttcagaacttagtgttgaggaggcccaagaccctttcctcgttagtatacacattattgcagacccaggtgaaagtcaaccattgcaagaagccatcgacaacgtgctggcctggatccatcccgacctacccttgtttcgagtttcggagaggagggcctccagacggcgcagaaaaccccccaaaggagcccaaccagcactggccgtggtgttattcttgcaggaggagtatggagaggagcagatactgcagctccacagaacattgcaacaaccaccctggcggcaccatcacactgaacaggttcatggtaggttcttaccatatctaccctgctcccaggatttctttaccctagcacctggcacgccattatgggctatccggcccgttcactacggaaaggagatagtgcgttttactgtgtactgtcggtacgataactacgctgactccctccggttttaccagctgattctccgcaggagtcccagccagaaaaaggcggatttttgcatttttccaatcttcagcaatctggacgtggacattcaattttcactgaagcgccttccatgcgatcagtgtcctgttcccactgactcaagcgtgttggagtttagagtaagagatatcggagagctggtgcctctccttccaaacccgtgctcacccatctccgaagggcgctggcagaccgaggatcatgatggtaacaagatcctgcttcaagcccagagggtgcacaaaaagttccctaaacccgggagagtccatcacgcctccgagaagaagcgacactcaacccctctgcctagcaccgctgtcccttcccatacgccgggctcttcccagcagtctcctttgaactctccacatcctggtcctattcggacgggactgccacccggtcatcagcaggagtttgcaggacgtgcgaattcgacccccaaccctccttggtcctttcagcgcagtaaatccctattttgcctgcctacaggaggccctagcctggcctccagcgctgagccccagtggttctctaacactggggcccccggacacagagcatccgaatggaggcatggacacctattatccattgatgatctggaaggcgcgcaggagacagatgtcgatacagggcttcgcctgtccagttcagacctctctgttgttagcgcgtactccgccccctctagattctgttctacagtagaaactccgctgccatccgagagatgtagctcccactgggccgctcataaagactcgcgggaggggccactccccactgtcagccgcgtgaccaccgaggccagttgggcctctctccctttctttacaaagcggtccagcagtagttctgccactgctcgagctgccccccctgccccttctactagcaccctgacagactctagtccacagctcccctgcgacacaccaaaagtgaaacaaactgacggggatatgccccctccgcctgggtctgctggccctggcgacaacgacatggaagaattttacatctag

SEQ ID NO: 29651 - DNA, 819 bp, Artificial Sequence
  Description of Artificial Sequence: Synthetic coding sequence
atggacgagactcagggccccctggccatgaccgtacacttgcttgcaaacagcggacatggttccctcttgcagaggacgctcgaccagctgctagactgtatatgtccggaggtcagactgtttcaggtgagcgagagagccagtcctgtgaaatattgtgagaagagccattccaaaagatcacgtttccccggcatgtcagttctgttgtttctccacgagtccccaggagaggaccggctgttccgagtgctggactcactccagcatagcccctggcagtgctacccaactcaggacactaggggcaggctgtgtccatattttttcgctaatcaggagttctacagtctggacagccagcttcccatatggggagtgcggcaggtccactgcggctctgaaatcctccgcgtcacactgtactgctcgtttgataattatgaagatgctatcagattatacgagatgatcctacagcgcgaagcaacccttcagaagagcaacttctgcttctttgttctgtacgcttccaaatcttttgcactgcagctatctctgaagcagctgccacctggtatgtctgtggaccccaaggagagctcagtgctacaattcaaagtgcaggagatcgggcagctggtgcccctgctgccaaacccctgtatgcctatcagttcgacgcggtggcagactcaggactatgatggcaacaagatacttctgcagcgctgggaatcaagctctgtcgcacagacgcgggtgcgctggtgtcaccacagtagcctgcgttcctccccttccggctttaagtag

SEQ ID NO: 29652 - DNA, 819 bp, Artificial Sequence
  Description of Artificial Sequence: Synthetic coding sequence
atggacgagactcagggcccacttgctatgaccgtacatctcctcgcgaacagcgggcacgggtctttactccagaggacactggaccagctgctggactgtatctgtcccgaagtccgcctgtttcaggtgagcgagagggcttcccctgtcaaatactgcgaaaaatctcattccaaaagatcgagatttcctggtatgagcgtgctgctgtttctgcatgagtccccaggtgaagatagactgttccgggtcctggattctctccagcatagtccatggcaatgttacccaacgcaggacaccagaggaagactctgcccttatttcttcgcaaaccaggagttctactctcttgattctcagttgccaatctggggagtgcggcaagtacattgtggttctgagatcttgcgcgtgaccttatattgtagctttgataattacgaagacgccattcggctttacgagatgattctgcagagggaagccacactgcaaaagtccaacttttgtttttttgttctttatgccagcaagtctttcgccctgcagctttcattgaaacaattgcctccggggatgtcagtggaccccaaagaatccagtgtgctgcagtttaaagtccaggagattggccagttagtgccactactgccgaacccatgcatgccaatttccagtacacgatggcaaacacaggattacgacggaaataaaatcttgttacaacggtgggaatccagctccgtagcacagactcgagtccgctggtgccaccactctagcctcaggagttcccccagcgggttcaaatag

SEQ ID NO: 29653 - DNA, 1368 bp, Artificial Sequence
  Description of Artificial Sequence: Synthetic coding sequence
atggacgaaacacagggaccccttgcaatgacagtgcatttgctcgctaatagtggccatgggtctctgctgcaaaggaccttggaccagctactcgactgtatatgtcccgaagtgagattgtttcaggtgtcggagagggcgtcacctgtcaagtactgcgaaaagtcacattccaagcgttcaaggtttcctggcatgagcgtcttgttattcctccatgaatcccccggagaagatcgccttttccgagtgctcgattcattacagcacagcccctggcagtgttacccgactcaagacacgaggggccggctgtgtccctacttttttgctaaccaggaattttacagcctcgatagccagcttcctatctggggagtacgacaggtgcactgtggctccgaaatcttgcgggtgaccctttactgcagtttcgataactatgaagacgccatacgcctctatgaaatgatccttcagcgtgaagcgaccttacaaaagtccaacttttgtttcttcgtgctctacgcatccaagtcattcgctctacaactctcattaaagcaactgccgccagggatgagcgtggatcccaaggagagttccgtactgcaattcaaggtccaggagattggccagctagtcccacttctgcccaatccgtgcatgccaatcagtagcacccggtggcagacgcaggattatgacggcaacaagatactactgcaagtacagcttaaccccgaacttggggttaagaacggcatcctgggcgctggcatgctgcctctggggtcgaggctgacctccgtgtcggccaagaggaccagcgagccgagatcacagcggaatcaaggaaagagatctcaggggcattccctggaactgccggaaccctctgggtctcctacttccgatcgctgcgcaggcaccagctggaaatctcctgggcggtcatttcaggtctcatcaccagctatgggagcccatttgcacttatcctcacaccacctggaatctggggcaagaatgaaagtgttaaacagggagaacagtttccaaaagctggaggctgagacaaacgtggacacaggactgacaatcattaactccgagccacgacagacttatttcggaggtttcccccgcgacctgcagactagtcagccacctttctgcctaccagcatcttctctgggggtggctacctcaaagaacaatagtgttctcaaggaacgcgtgagccccctcccccttgctgggcagcgagacctgggcacacggaaaactattagcgaatgcctgttgcatcttcaggtccagggcgaagaaaaagaggaagacgaagaagaattttttatctag

SEQ ID NO: 29654 - DNA, 1593 bp, Artificial Sequence
  Description of Artificial Sequence: Synthetic coding sequence
atgctagggacagacagatgtgtcgttgaggagtggctctcagagtttaaagccttacctgacactcaaatcacttcatatgccgccacacttcacaggaaaaagacacttgtccctgccctgtacaaagtgattcaagactctaacaacgaactactggaaccagtctgtcatcagctgtttgaactgtacaggagctctgaagtccggttaaaacgatttaccctccaatttctgccggagctgatgtgggtgtacctgcggttgacagtgagcagggacagacaatctaatggctgtatcgaagccctgctgctgggaatttacaacctggaaatcgctgacaaggatggaaataataaggtcctttctttcacaatcccaagtctgtcgaagccgagcatataccacgagccaagtactattgggtcaatggcactgaccgagggtgctttgtgccagcatgatctgatcagggtggtctattccgatctgcatccgcagcgcgaaaccttcacagcccagaacagatttgaagttctctctttcctgatgctgtgctacaactctgcaatcgtgtacatgcccgcctcctcataccaatccctctgccggatgggtagtagggtgtgcgtcagtgggttccccaggcagcatgagaagcactggaaggaactgtgcgggcgaatcgtgctcgaccctgaatttatggtacagctgctgacaggggtatattacgccatgtacaacggacaatgggacttgggacaagaagtcctcgatgatatcatttacagggcccagctcgagctgttctcacaacccctcttggtggcaaacgccatgaagaactccctccctttcgacgcccccgacagtactcaggagggccagaaagtgctaaaggtggaggtgacaccaacagtcccaagaatcagtagaaccgcgattaccactgccagtatcagacggcatagatggaggagggagggcgcagagggcgtgaacgggggcgaggaatctgttaacctgaacgacgccgacgagggttttagtagtggcgcaagcctgagcagccagccaataggtacaaagccctccagctcatctcaacggggttccttaaggaaagtcgccaccggtcggtccgccaaggacaaggaaacagcctctgctatcaaatcttcagagtcccccagagacagtgtggtgcggaagcaatacgtacagcagccaaccgatctctccgtggactccgtggagctgacccctatgaagaagcacctgagtctgcctgcagggcaggtggtgcctaaaatcaatagcctgtccctgattcgcacagcttcagcgtctagctcgaagtccttcgattatgtaaatgggtctcaagctagtaccagcatcggcgttgggacagaaggaggcacgaacctggcagcaaataacgctaataggtactccacagtgtccttacaggaggatcgtctcgggcaggctggcgaagggaaagaactccttagcccaggagcacccctcactaaacagtcacgcagcccatccttcaatatgcagctgatcagtcaggtgtag

SEQ ID NO: 29655 - DNA, 627 bp, Artificial Sequence
  Description of Artificial Sequence: Synthetic coding sequence
atgctgggcacagataggtgcgtagtggaagagtggcttagcgagttcaaagccttaccagacacgcagatcacttcgtatgctgcgaccttgcaccgaaagaagaccctcgtgccagctttgtacaaggtgatacaggactccaataacgaactattggaaccggtttgtcaccagctgttcgagctatataggtcatccgaggtccgtttaaaacggtttactttgcagtttttgcccgaacttatgtgggtctacctccggctcaccgtctctcgcgaccggcagtcaaatggatgtattgaggcactgctccttggcatttataacctggagattgccgacaaggatgggaacaataaggtcctttctttcacaatccctagcttatccaaacccagcatttatcacgaaccctccaccatcggcagtatggcccttacagagggcgcactctgccagcatgatttaattagagtggtctattccgacctgcatccccagcgagagacattcacggcacagaatagatttgaggtgctgtctttcctcatgttgtgctacaattctgccattgtgtacatgcctgcctccagttaccagagcctgtgtagaatgggctcatag

SEQ ID NO: 29656 - DNA, 264 bp, Artificial Sequence
  Description of Artificial Sequence: Synthetic coding sequence
atgttaggtactgatcgttgtgtggtggaggaatggctcagcgagtttaaggctttgcccgacacccagattaccagctatgcggctacgctccatcgcaagaaaaccctagtgcctgctctgtacaaggtgatccaagattctaacaacgaattgctggaacccgtctgtcatcagctcttcgagctctatcgttccagcgaggtgcgcttgaagcgttttaccttacagtttctccccgagctgatgtgggtgtacctctag

SEQ ID NO: 29657 - DNA, 342 bp, Artificial Sequence
  Description of Artificial Sequence: Synthetic coding sequence
atggatgggcgggtccagctcatgaaggcactcttagctggaccactgcggccagctgccaggcggtggcgaaaccctatccccttccccgagacttttgatggggacacagatcggcttcctgaatttattgtccagacttcatcttatatgttcgtggacgagaacaccttcagtaacgatgcgctcaaggtcacctttttaattaccaggttaacaggccctgcgctgcagtgggtaattccctatattcgaaaagaaagcccacttcttaatgattataggggctttctagcagagatgaagcgggtgttcggatgggaggaggacgaagatttctag

SEQ ID NO: 29658 - DNA, 342 bp, Artificial Sequence
  Description of Artificial Sequence: Synthetic coding sequence
atggaaggtcgggtgcagcttatgaaagctctcttggccagaccattacggcctgccgctcggaggtggaggaatccaataccctttccagagacttttgatggcgacaccgatcgcctgcccgaatttatagttcagacgtcaagctacatgtttgtcgatgaaaacactttctcaaacgacgctttgaaagtcaccttccttatcactcggttaacaggcccagctttgcagtgggtcatcccatacatcaaaaaggagagccctctcctctcagattataggggctttctggccgaaatgaaaagggtgttcggatgggaggaagacgaggatttttag

SEQ ID NO: 29659 - DNA, 627 bp, Artificial Sequence
  Description of Artificial Sequence: Synthetic coding sequence
atgggagggggcagaggtctccttggccgcgagaccctcggccccggagatagatgcagcggtaagggtcccctttgttattggcccccaccaggctcccctccagcaccaagtttgagagcgagcttgccactcgagccgcctcgctgccccctcagatcatgtcctctgccaagaagtgcctgcttatgcagtaggaactctgcccctggttcctgttgtaggccctgggcttcactgtggagcggactgcctcctcccagtagggccagctccgcgcccccaatgcacatctggacattgtcatgtgccccagtcgcccaggccgagctgttgctgcacaccgatcgacctctcccaccactgcctacccctctcctcctgacacgcttgccagatgactatatcatgctgcccaccgacctcaggtgccactgtcaccggcaccccagtcatagtactgacagactgctcctgctcgtgatttgcacccacctgggtggcatctgggccgggcacagtccctggacaatgatccaaactgcaggatgccctagtcgggatcttttgccttcagcgcgccctatttctagccccatccccgagacattttgtgcccccgcgtag

SEQ ID NO: 29660 - DNA, 1782 bp, Artificial Sequence
  Description of Artificial Sequence: Synthetic coding sequence
atgggcccagatcggaaggaagtcccactctctagagggacccaagcagtcgtagtgggaaaaggtcgaggtgccccaggcgatgacagcagcatggggggtagaccctcatcacctctggataaacagcagcggcagcacctgcggggccaggtggataccctgctgaggaatttcctgccgtgctataggggtcagctcgctgcatcagtgttgaggcaaatcagtcgcgagctgggaccacaagaacctacagggtcacagctgctgagatccaaaaaacttccgcgcgttcgcgaacatagaggccccctcactcagcttagaggccacccccctcgttggcaaccgatcttttgtgttctgcgtggcgatgggaggctcgaatggttttcccataaagaagagtatgagaacggtgggcactgtctggggtctactgctctcaccgggtacacactactgacctcccaacgggagtacctgcggctgctggatgcactgtgtcccgaatcactcggcgaccacacacaggaggagccagactctctcctggaggtccccgtgtccttcccactcttcctccagcatccatttagacgtcacttgtgcttcagcgcagctacgagagaggctcaacacgcctggagactcgctcttcagggcggcattagattgcagggcatcgtgttacagcggagtcaggctcctgctgctcgggcattcctagatgccgtacgcctttaccggcaacaccagggccactttggggacgacgacgtgacattaggttcagacgcagaggtcctgaccgctgtactcatgcgtgagcagctcccggcactcagggcccagacacttcccgggcttcgcggggcagggcgcgcacgtgcttgggcctggacggagcttctagacgccgttcacgccgcagtcctcgcaggcgctagtgctggtttgtgcgccttccagccagaaaaagacgaactgctggcttccctggaaaaaactataagaccagacgttgaccagttgcttcgtcagcgtgcaagggtggcagggagacttcgaacagatatcagaggccctctcgaatcctgtctgcggagagaggtggaccctcaactgccaagagtcgtgcagaccctgttgcgcacagtggaggcttccctggaagctgttagaactttgctggctcaggggatggaccgcctcagccatcgcctgcgccaatcgccctccggtacccgactgagacgggaggtatattcctttggagagatgccttgggacctggccctcatgcagacgtgttacagggaggctgaaaggagcagaggccgcctcgggcagctggctgctcctttcggatttcttgggatgcagtccctcgtgtttggcgcgcaggacctcgctcagcaattaatggctgacgctgtggcgaccttcctacaactggccgatcagtgtctcaccaccgccctgaattgtgatcaggctgctcagaggctggagcgcgtacgcggaagggtgctgaagaagttcaaaagtgacagcgggcttgcacagcgtagatttatccgcggatggggcttgtgcatttttctgcccttcgtcctgagccagctggaacctgggtgcaaaaaaaccgagtcccacagtgttgctcaagcggtagtgcagtggtgcgatcttggtagtctgcagccgccaccccctcggtttaagagaagcagccaccttagtttgccatcaagctgggactaccgtcacccgctgtag

SEQ ID NO: 29661 - DNA, 1956 bp, Artificial Sequence
  Description of Artificial Sequence: Synthetic coding sequence
atggggcctgataggaaggaagttcctctgtcccgtggcactcaggccgttgtagttggcaaggggcgcggggcccccggagacgactcatctatgggaggcagaccctcctcccctttagacaagcaacaaagacagcacttaagggggcaggtggacacactactcaggaattttctgccctgctaccgcgggcagttggcagcatcagtactgagacagataagcagggagttggggccgcaggagccaaccggcagccagctcttacgcagcaaaaaacttccacgcgtgagagagcacagggggcccctgacacaacttaggggacacccaccacggtggcaacccatcttctgtgtcctccgtggcgacggccgactcgaatggttttcccataaggaggaatatgaaaatggaggtcactgtctgggatccacagcccttaccggttatacacttttgacttcccagcgagaatacctaagactactcgacgctctgtgcccagaaagtctaggcgatcacacccaggaagagcccgactctctcctcgaagtcccagtgtcctttcctctctttctccagcaccccttcaggagacatctgtgtttttcagccgcaacccgcgaggcgcagcatgcctggagactcgccctgcaaggggggatccgtctgcaggggatagtgctccagaggagccaagccccagcagctcgcgcgttccttgatgctgtgaggctgtatcggcagcaccagggacatttcggggatgatgacgtgactctcggttctgatgcggaagtgctgacggccgtactgatgcgggagcaattgcccgcactacgcgcccaaaccctccccggcctccgcggcgctgggagggctagggcctgggcttggaccgagttgttggatgcggtgcatgccgcagtactggcgggggcaagcgccggtctttgcgccttccagccagagaaagatgaattgttagccagcctggaaaagaccattcgcccagatgtggatcaactcttaagacagcgtgcgcgagtcgccgggcgcttacgcactgacatacgcggccctttagagtcttgcttacgccgcgaggttgatcctcagctgcctcgcgtggtgcaaaccctcctaagaacggtagaagcgagtctggaggctgtgcgcactttactggcccagggtatggatcggctgtcccatcgactgagacagagcccgtcaggtaccagactcaggagagaagtgtacagtttcggagaaatgccttgggacctagcactgatgcagacatgttatcgcgaagctgagcgcagtcgcggacgcctgggccaattagctgcccctttcgggtttttagggatgcagagcctcgtattcggggcccaggatttggctcagcaacttatggccgatgctgttgccacgtttcttcagttagctgatcaatgtctaactaccgcactcaattgcgaccaggccgcccagcggcttgaaagggtgcggggcagggtacttaagaagtttaagtccgattccggcttagcacaaagaaggttcatacgcgggtggggcctctgtatttttctgccattcgtactttctcaacttgagcctggctgcaagaaggagctccccgaattcgagggcgatgttttagccgtgggcagccaggctctgactacagaaggcatctacgaagatgtcatccgcgggtgtctgctgcaacggatcgaccaggagcttaagaagactctaggcgctaacgatgtgagctgcactcttgatggctgtctggaggttccgtgggaacaagaaggggctgatgaagaaactgaagctgaaagggagggaggagcctgcccaagacagcctgatagtggcgcccagatccagcccctctgtcctcccccaagcccagggactttcagatcgtag

SEQ ID NO: 29662 - DNA, 2094 bp, Artificial Sequence
  Description of Artificial Sequence: Synthetic coding sequence
atggggcctgacagaaaagaggtgcctctgtcccgagggacccaggccgttgtggtggggaagggcagaggagctcccggagatgactcatctatgggcggaaggccttccagtcctctcgataagcagcagaggcagcacctgaggggacaggtcgatactttgctgcggaacttcctgccatgctatcggggccaactcgcagcttcagtcctaagacagatatcaagggagcttggtccacaggagccaaccggcagccaactcctgagatctaaaaagctgcccagagtgagagaacatcggggccccctgacccagctgaggggacatcctcctaggtggcagccaattttttgcgtcttgcggggagacggacgactggagtggttttcacacaaggaagaatacgagaatggcggacactgtctgggcagtactgcactcacaggctacacccttctgacatcacagagggagtacctgcgcctactcgatgccctgtgtccagaatccctcggcgaccacacccaggaagaaccagattccttactcgaagtcccggtgtcttttccccttttcttgcagcatccatttaggcggcatctgtgcttttcagccgcgacccgagaggctcagcatgcatggaggcttgcccttcagggagggatacgcctgcaaggcatagtgcttcagcgctcccaggctcccgctgctcgagccttcctagacgccgtgcggttgtacaggcaacaccagggccattttggtgacgatgatgtgaccctggggtccgatgctgaggtcttaacagcagttctcatgagagagcagttgccggctctgcgcgcccagactctgcccggcctgcgcggagccggccgagcccgcgcatgggcatggactgaactgctggacgctgtgcacgccgccgtactagccggcgcttctgcaggactgtgcgcctttcaaccagaaaaggacgagctcctggcaagtttagagaagacgattagaccagacgtggaccaactgctgcggcagagggcaagagtagcagggcggttacgcacagatataagggggcccctggagagttgcctgcgccgagaagtggacccacagctcccaagagtagtccagacactgctgagaacagtcgaagcctcactcgaggcagttagaaccctgcttgcccagggtatggatagattgtcccaccggctgcggcaatctccctccggtactaggctgcgccgcgaggtgtactcttttggcgaaatgccttgggatctggctctcatgcaaacttgctatagagaggctgaacggtcccgtggaagactgggccagctggcagctccgttcgggtttctcggcatgcagagcctggtttttggcgcccaggatctcgcccaacaactcatggcagatgccgtagctaccttcctgcagctcgccgaccagtgcctcactaccgccctgaattgcgatcaagctgcacagaggctggagcgggtgcgcggaagagtgttgaagaagttcaagagcgacagcgggttagctcaaagaaggttcattagaggctggggactttgtatcttcttacctttcgtgctgtcacagcttgagcctggatgtaagaaggaactccccgagttcgagggcgatgttttggcagtggggagtcaggcccttactactgaaggcatctacgaggacgttatcagaggctgtctgttacagaggatcgaccaagagctgaaaaaaaccctgggggccaacgacgtgtcctgcacactggacggctgtctggaagtgccatgggaacaagaaggagcggcccctaatctcaacctcgtgtcttctttcctggccggaaggcaggcttttactgattttctatgccttccagccaagtcttcagctaactggattctcgcagcatctctgctttcctgctcatgcttcaggtctgggttccatcgggactctagagtttttctggtccagctcgccgaagggttaagccactcccttgagaccgtatcatctcatagtgtgtggtccttccgcccgacaccgcggcagtag

SEQ ID NO: 29663 - DNA, 1848 bp, Artificial Sequence
  Description of Artificial Sequence: Synthetic coding sequence
atgggcccagaccgcaaggaagtgcccctatcaagaggcacgcaggctgtggtcgtgggtaagggaaggggagcacccggtgacgactcctctatgggcggtcgcccgagctcccctctagacaagcagcaacggcagcacctgcgcggccaggtcgacacgcttctgagaaattttctgccgtgctatagaggacaactcgctgcatcagtcctgaggcagatttcccgcgagctcggtccccaagagcctactggcagccagctcctgcggtcaaaaaaactgccacgcgtgcgggaacatcggggacctcttacacagctccggggtcacccgcccaggtggcagcctatattttgtgtactgcggggtgatggccggttggagtggttctcccataaggaggagtatgaaaacggaggtcattgcctcggttcaactgctctgacaggttacaccctcttaacctcacagcgggaataccttagactattggacgccctatgcccggagagcttaggcgaccacacacaagaggagccagactccttactcgaagttcccgtttcctttcctctatttcttcaacatccatttaggcgccacttatgtttctccgcagcaacacgggaggcgcagcatgcttggaggcttgcactgcaggggggaatccgtctgcaggggatcgtgctgcagcgctcacaagcaccagcagcgagagcttttcttgacgctgtgagactttatagacagcaccaggggcacttcggcgacgacgatgtcactctcggtagcgacgctgaagtgttgactgctgttctcatgcgggagcagctgcctgctctccgggcccaaactctccctgggctaaggggggcaggacgtgcccgcgcttgggcatggacagagctgctggacgcagtgcacgctgccgttttggcaggcgcctcagccggactgtgcgcgttccaacctgaaaaagacgagcttcttgcctcgctggagaagacaatcaggcctgacgtggatcagttgttaaggcagcgagccagggtggccggccgcctccggacagatattaggggccccctggaatcttgtctgaggagagaagtagatccccagttacctcgggtggtacagacactgctcagaaccgtggaggccagccttgaggctgtgaggactctactcgcacagggaatggataggctgagccacaggctaagacagtcacccagtggcacgcggctccggcgtgaggtttatagttttggagaaatgccgtgggaccttgcgctgatgcaaacctgctatcgggaggctgagaggtccaggggccgacttgggcaattggcagccccctttgggttcttgggcatgcagtctttggtgtttggagcgcaggacctggcacagcagctgatggcagacgcagtggctacattcctgcagctggctgaccagtgcttgacaacggcactcaactgtgaccaggccgctcaaagactggagagagtacgcggtcgtgtccttaaagaactgcctgaattcgagggggacgtgctggctgtcgggtcccaggcactcacgacggaaggcatttacgaggatgtcatcaggggctgcttgctccagcgtatcgatcaggagctgaagaagacactgggcgcaaatgatgttagctgcacactcgatgggtgtttggaggtgccgtgggaacaggagggcgctgacgaagagacggaagcggaaagagagggcggtgcatgtccacgacagcctgattcaggtgcccagattcagccgctgtgtccacctccaagcccaggcacatttaggtcatag

SEQ ID NO: 29664 - DNA, 1710 bp, Artificial Sequence
  Description of Artificial Sequence: Synthetic coding sequence
atgggagggcgtccatcatcccccctggacaaacagcaaaggcagcacctgcgcgggcaggtggatacacttctgaggaattttttgccttgctatcgaggtcagctggctgccagtgtgcttcctcgagtgagggaacaccggggcccacttactcagctgcgtgggcatccaccccgttggcagcctatattttgcgtgctgcggggagatggccgtctggaatggtttagccacaaagaggaatatgaaaacgggggccactgtctcggttctaccgcgctgacaggctataccctgctgaccagccagcgagagtatctccggctgctcgatgctctatgccctgagtcactgggtgaccacactcaggaggagcctgactcgctgttggaggtccccgtctctttccctctatttcttcagcacccttttcgacgtcatctttgttttagcgcagcaacaagagaagcgcaacacgcatggagacttgccctccagggcggcattcggcttcaaggcatcgtactgcagcgtagtcaagcccccgcagcccgagcgtttttagacgcagtacggctgtaccgccagcaccagggccactttggagatgacgatgtgactcttgggagcgacgctgaggtgctgacagctgttctgatgcgggagcagctgccagctctcagggctcagaccctgcctggccttcgcggtgccggccgcgcccgagcatgggcatggacagaactgctcgacgctgtgcacgctgcagtactcgcaggcgcctctgccggcttgtgcgcctttcagcccgagaaggatgaactgttagcctcgttggaaaagacaatcaggcccgatgttgatcaactacttagacaacgtgcgcgagtcgcaggacggctgcgaactgacattaggggtcccttggaaagctgcctacggcgtgaagtcgatccccaacttcccagggtcgtgcaaacactgcttcgaaccgtagaggcctccctcgaagccgtgcgtactctgctggcccaggggatggatcggctctcccatcgcctgcggcagtccccaagcggaactaggctgcgcagggaggtttattccttcggagagatgccgtgggatctggccctgatgcaaacttgctacagagaagctgagagaagtagaggtcgtcttggccagctggcggccccctttgggtttctgggcatgcagtccctcgtgtttggtgcccaggacctcgcgcagcaacttatggcggatgcggttgcgacttttttacaactggcagaccaatgtctcacgacagccctgaactgcgaccaagccgcacagaggcttgagcgagtgcggggccgggtgctcaagaagtttaagtctgattcaggactcgcccaacggcgattcattcgcggatggggattgtgcattttcctgccatttgtgctgtcccagcttgagcccggctgtaaaaaggaactgcctgaatttgagggcgacgtactggcagtcggatcgcaagcactgaccaccgaaggtatttacgaagacgtgattcggggctgccttttgcagcgcattgatcaggacgaggaaaccgaggcagagcgggagggcggggcttgccctcgtcagccggatagcggggcccagatccagcctctgtgcccacccccttcgccaggcacatttagaagctag

SEQ ID NO: 29665 - DNA, 1272 bp, Artificial Sequence
  Description of Artificial Sequence: Synthetic coding sequence
atgagggaacagctgcctgccctacgcgcacagaccctgcctggactgcgaggagccggccgcgccagagcttgggcctggactgaacttctggatgccgtccacgccgccgttctggcaggggcttcagccggactatgcgcattccagcccgagaaagatgagctgctcgcaagtctagaaaagacgattcgacctgatgtagatcagttactgagacagcgggctcgcgtggctgggaggttgagaacagacattcgcggtccgctggagagctgtctgagacgggaagtcgacccacaactgccccgggttgtgcagacattgcttagaactgtggaagcaagcctggaggccgtaagaaccctgctggcccaggggatggatcggctcagccatcgtttacgccagtccccaagcgggacaagactccggagagaagtgtatagcttcggtgagatgccatgggatctggcgctgatgcaaacctgttatcgagaagcagagcgttctagaggtaggcttggccagctcgctgccccctttggctttcttggcatgcaatcgctggtcttcggcgcacaagatctggcccagcagctcatggctgatgccgtggctaccttcctacagctggcggaccagtgtctgacaacggctctcaattgcgaccaggcagcccagcgtctggagagagtgagaggtcgcgttctcaagaagtttaagtcagattccgggttggcacaaaggaggtttatccgcggctggggtctgtgcatttttctaccatttgtcctttcacagcttgagcctggttgcaagaaggagttaccagagttcgagggagatgtgctcgcggtcggaagtcaagcactaacaacagaggggatctacgaagacgtcattcgcggatgcttacttcagcgaatagatcaggaactcaagaagactttgggcgccaatgacgtcagctgcacattggatgggtgcctcgaagttccctgggagcaggaaggggcagcgccaaacctcaacctggtgagctcctttcttgctggacgacaggctttcacagacttcctatgccttccagccaagagctctgccaattggatcctggccgcctcccttctgagctgctcttgctttaggagcggctttcacagagatagtagagtgtttctggttcagctagcggagggcctcagccactcactcgagaccgtgagtagtcatagtgtttggtcatttcgacctactccgcggcagtag

SEQ ID NO: 29666 - DNA, 2748 bp, Artificial Sequence
  Description of Artificial Sequence: Synthetic coding sequence
atgagaaaaagctccagccctagtttgtcaaattgcaacagcgtgctggctaacaaaattttcggaatccctcttgacgagttacagcaaggaggccatcccgacaatgaggttccattcattgttcgccacgtagtggattatatcgaggaacatggcggactcgagcagcagggcctgttccaggtgaacggcaatgccgagactgtggagtggctaaggcagcgatatgatagcggcgaagaggtcgatctcgtgaaagaagccgacgttcctagcgcaattagcctgctgaggttttttctccaggagctccccgagcctgtcatcccggggagtctccatattcatctgatgcagctgagccaggactacaataatgaagatgagttcggccggaagctcagatttttactgcagcagttacctcctgttaattattcattgttaaagttcctgtgtaggtttcttgccaatgtggcaagccatcacgaggagatttggtcagccaatagcctggctgcagtgttcggcccggacgtgttccacatctacactgatgtggaggacatgaaggaacaagaaattgtgtcacgtatcatggcgggcctgcttgaaaactactacgagttcttcgagaacgaggaagaggactttagctccaatgacctaagctctataacagagcaggtgaacgagctctcagaggaagaggaagaagatgaaaaattagagcacattgaggagctgcccgaagagggtgcggaaaagtccaacgatatgccagaagtggtgcaattgcggatgactgaaaacattctggaaagtaacagtgtcactgctaccagtacccacatctcccccattagtatactaccggcttccactgacattctggaacgtacaatcagggccgccgtggagcagcatctattcgatctccagtcctccatcgaccacgacctgaagaatctgcagcaacaatcagttgtgtgcaacaatgaggcggagtctatccattgcgatggagaaggctctaacaatcaaatcgacattgccgacgacataatcaacgcgagcgagtccaacagagactgctccaaacctgtggcctccaccaatctcgacaatgaagccatgcaacaagactgcgtcttcgagaatgaagaaaatactcagagcgtagggattctcctggaaccttgctctgatcggggtgactctgaggatggctgccttgagagggaagagtacctactgtttgatagcgataagctgagccacctcatcctggatagcagcagtaagatttgcgatcttaatgctaacactgagagtgaggtgcctggaggtcagtctgtaggggtgcagggagaagccgcgtgtgtgagcattccgcatctggaccttaaaaacgtgagcgacggggacaagtgggaggaacccttccccgccttcaagagctggcaggaggattcggagtccggtgaagcgcagttgtccccccaagcaggcagaatgaaccaccatccactcgaggaggactgccctcctgtgttgagtcaccggtccctggacttcgggcaaagtcagcggtttctgcacgaccctgagaaactcgactccagcagtaaggctctgtcattcactcgcatcagaagatcttccttctcttccaaagacgagaaaagggaggataggacaccctaccagctggtgaagaaattgcagaagaagatcaggcaatttgaagaacaatttgagcgggagcgcaattccaagccatcttatagtgatatcgctgcaaacccaaaggtccttaagtggatgacagagctgacaaagctccgaaagcagatcaaggatgcaaagcacaagaactcagatggagaattcgtcccacagaccagaccaaggagtaataccctgccaaaatccttcggctcaagcttagatcacgaggatgaagagaacgaggacgagccaaaagtgatacagaaggaaaagaagccatccaaggaggcaaccttggaactgatcctgaaaaggcttaaagaaaagagaattgagagatgcttgcccgaggacataaagaagatgacaaaagaccacttagtcgaagaaaaggcctcactgcagaagtcattactgtactatgagtcgcaacacgggaggccagtgacaaaagaagaacggcacattgttaagcctctatacgaccgataccgcctggtgaagcagatgctaacgcgcgcatctataaccccagtgctggggagcccctctacaaagagacgcggccaaatgctgcaacccatcatcgaaggcgaaactgctcactttttcgaggagatcaaagaagaagaagaagatggggtgaacctctcttcagagttgggagacatgttaaagacggccgtgcaagtccagtcttccctggagaactcggagagtgacgtggaagaaaatcaagaaaaactggccttggacctgcgtctcagctcgtcccgcgcagcctcaatgcccgaattgttagaacagctctggaaggcacgggcagagaaaaaaaaattgagaaagactctgcgggagttcgaggaggccttttatcagcagaatggtagaaacgcgcaaaaagaggatagagtacccgtgctcgaggaataccgcgagtacaagaagataaaagccaagctcagactactggaggtgcttatctccaagcaggatagctcaaagagtatttag

SEQ ID NO: 29667 - DNA, 2664 bp, Artificial Sequence
  Description of Artificial Sequence: Synthetic coding sequence
atgcgcaagtcgtcgagtccgtcactaagcaactgcaactccgtcttggccaacaaaatttttggtattcccctggacgagttacagcagggaggacatcccgataatgaggtgcccttcatcgtccgccacgtcgtggattatatcgaggaacatggcggccttgagcagcagggcctctttcaggtcaacggtaatgctgaaactgtggaatggttgcgtcagaggtacgattcaggtgaagaggttgacctcgtgaaggaagcagatgtgccgagcgctatttcacttctgcggttttttctgcaagagcttccagaaccagttatcccagggtctctccacatccacctgatgcagctatctcaagactacaacaacgaagacgaatttggtcgtaagcttcggtttctgttacaacagttgcctcccgtcaactactctctcctgaaattcttatgtcgctttctggccaacgtggctagccaccatgaggagatctggagtgctaactcccttgcagcagtttttggccccgatgtgttccatatttacacagatgtcgaagacatgaaagagcaggaaattgttagcagaatcatggcaggcctcctggagaactactatgaattttttgaaaacgaggaggaggacttttcctcaaacgacctctcatccatcactgagcaggtcaatgagttatccgaagaagaggaagaggatgagaagctagagcacatcgaggagctgcccgaagaaggggccgaaaaatcaaacgatatgcccgaagtggtgcagttacgcatgacagagaacatcctggaatccaatagtgttacagccacgagcacacatattagcccgatcagcatcctcccagcatccacggacatcttggagagaactattcgagctgccgtagaacagcacctctttgacctgcagtccagcatcgatcatgacctaaaaaacttacaacagcagtcagtcgtctgcaacaatgaagcagagagcatacattgtgacggcgaaggatcaaataaccagattgacatcgctgacgatataatcaacgcctcagagtcgaacagagattgcagtaagccagtggcttccaccaacctagacaacgaggccatgcagcaagactgtgtatttgagaacgaggagaatacccagtcagtgggcatactcttagaaccctgtagtgacagaggcgactctgaagatggatgcctagagagggaggaatacttgctgttcgatagcgataaattgagccacctgatccttgactcctcctctaagatttgcgacctgaacgcaaacacagaatccgaggtgcccggaggccagtccgtgggagtacagggcgaggccgcatgtgtgagtattcctcacttggatcttaaaaacgttagtgacggcgataaatgggaagaacctttcccggcctttaaatcgtggcaggaagatagcgaatccggcgaagcccagctctcaccccaggccggacggatgaatcatcatccactggaggaagactgccctccagtgctatcgcatcgttctctggatttcggccagtctcagcgctttctccacgatcccgaaaaactggacagttcgagcaaagctcttagcttcacccgcatacggcgcagctctttttcttcgaaggatgaaaaacgcgaggacagaaccccttaccaacttgtgaagaaattgcaaaagaaaatccgccagtttgaggaacagttcgagcgggagaggaatagcaaaccaagttatagcgatatcgctgctaacccaaaagtcctgaaatggatgaccgaactgaccaaacttcgcaaacagattaaagatgccaagcacaagaacagcgacggcgagttcgtaccccagacacggcctcgcagtaatactctccctaaaagtttcggttcctccctcgatcatgaggacgaagaaaacgaagatgagcccaaggttattcaaaaagagaagaagccctctaaggaagctacactggaactgatcctgaaaaggctgaaggaaaagaggatcgaaagatgcctgcccgaggatatcaaagtgacgaaggaggaacgtcacatcgtgaaacccctctacgatcggtaccgcctggttaagcagatgttaaccagagcctctattacgcccgttctgggcagtccctccaccaagaggcgcggccagatgctgcagccaataatcgagggtgaaacagcacatttctttgaagagatcaaggaagaggaagaagatggtgtgaacctgagcagcgagctgggggacatgctgaagacggccgttcaggttcaaagtagtctggaaaattcggaaagcgacgtggaagagaatcaggagaagctggccctagatctccgcctctccagcagccgcgcagcgtcgatgcctgaactgcttgagcagctgtggaaggcaagagccgagaagaagaagcttagaaaaacattgcgcgaattcgaggaggcattctaccagcaaaacggacgaaacgctcagaaggaggaccgagtgcccgtgctggaggaatatcgcgaatacaaaaaaatcaaagccaagctgcgactcttggaggtgctgatatctaagcaggactcatcaaagtcgatatag

SEQ ID NO: 29668 - DNA, 2376 bp, Artificial Sequence
  Description of Artificial Sequence: Synthetic coding sequence
atgcaactcagccaggattacaataatgaagatgaatttgggcgcaaactgaggttcctgttacagcaactcccgccagtgaactactccctgctgaagtttctctgccggttcctggcgaatgttgcatctcaccacgaggagatttggtccgcgaacagtttggctgcagtgttcgggccggatgtgtttcatatctatacagacgtggaagatatgaaagaacaagagattgtctcgcgtataatggcgggactcctggagaactactatgagttctttgagaatgaggaagaggatttctctagcaacgacttgtcctcgattacagaacaggtgaatgaactcagcgaggaggaggaggaagatgagaaactggaacatatcgaagagctccccgaagagggggcagagaagtccaatgatatgccagaagttgtgcagctgcggatgaccgaaaatattcttgagagcaatagtgtgactgccacgtctactcacatctccccaatctccattctgccagcctctactgatatcctggaacgcactatcagagccgcagtagaacagcacctgtttgatttgcaaagctccattgaccacgatctcaagaacttgcagcagcaatccgtggtctgtaacaacgaggccgaatccattcattgcgacggcgaaggctccaataatcagatcgatatagccgacgacattattaatgcatccgagtccaaccgcgattgctccaaaccagtggcaagcacaaatctcgacaatgaagcgatgcagcaagactgcgttttcgagaatgaggagaatactcagagcgtcggcatcctgttagaaccatgcagcgaccggggcgattccgaagacggttgtctagaaagggaagaatatttattatttgactccgataagctaagccacctgatccttgactcttcttctaagatttgcgatctcaacgccaacacggagtcggaagtgcctggcggacagtctgtaggagtccagggcgaagctgcttgtgtctctattcctcacctcgatcttaaaaatgttagtgacggggataaatgggaagcctcatgcccaattaccttcccattgatcgactttaaaacaatgcacctacagagagacggagaggagcctttccccgcctttaagtcttggcaggaagactccgagtccggggaggcccagctgagccctcaggcagggagaatgaatcatcacccgctggaggaagattgcccaccagtgctctctcaccgctcgctggatttcgggcagtcccagcgattcttacatgatccagaaaagctggattcttcctccaaagccctgagttttacgagaatcaggaggtcctcattctcatccaaggacgaaaaacgggaggacagaaccccctaccagctggttaagaaactgcagaaaaaaattcgccaatttgaagagcagttcgagcgagaaaggaatagcaagccatcctacagcgacatcgccgcgaatccaaaagtactgaaatggatgactgagctgaccaagcttcgcaagcagattaaagatgccaagcacaagaatagcgatggcgagttcgtcccacaaacgcgtccccggtcaaacactcttccgaagagcttcggaagctcactagaccacgaggatgaagaaaatgaggatgaaccaaaggtgatccagaaggaaaaaaagccaagcaaagaagctaccttggagcttatattgaagcggctcaaagagaagagaattgaaaggtgcctcccagaggacattaaggtcacaaaagaggagcggcacatcgtgaagccattatatgacagataccgactggtgaagcagatgttaactcgagcctcaattacccccgtgctcggcagcccatctactaaaagaagagggcagatgctgcaacctattattgaaggtgagacggcccacttcttcgaagaaataaaagaggaagaggaggatggggttaatctgtcgtccgagttgggggacatgctgaagactgccgtgcaggtgcagagttccctggagaatagtgaaagcgatgtcgaggagaaccaggagaaactcgcactggatctgaggctgtcctctagtcgcgccgccagcatgccagagctgctggaacagctgtggaaggctcgcgccgagaagaaaaaacttcggaaaaccttgcgagagtttgaagaggcattttaccagcagaacgggcggaatgctcaaaaggaggacagagtccccgtattggaagagtaccgcgagtacaaaaaaataaaagcaaaacttcggcttctggaagttctgatctcaaaacaggattccagtaagagcatttag

SEQ ID NO: 29669 - DNA, 288 bp, Artificial Sequence
  Description of Artificial Sequence: Synthetic coding sequence
atgaggaagtcctcgagcccttcgctttccaactgtaattctgtgctggctaataaaatattcgggatacctctcgatgagctgcagcagggcggacaccccgacaatgaagtgccatttattgtacgccatgtcgtcgactacatcgaagaacatggtggcctagaacagcagggcctctttcaggtgaatgggaatgctgagactgttgaatggctccggcagcgttacgattctggagaagaagtggacctcgtgaaggaagcagatgtcccttcagccatctag

SEQ ID NO: 29670 - DNA, 159 bp, Artificial Sequence
  Description of Artificial Sequence: Synthetic coding sequence
atgagaaaaagtagttctccctccctttccaattgtaactccgttctcgccaacaagattttcggcatccctttagatgagctacagcagggtgggcacccagacaatgaggtgccattcatcgtcagacatgtggtcgactatatagaggagcactag

SEQ ID NO: 29671 - DNA, 195 bp, Artificial Sequence
  Description of Artificial Sequence: Synthetic coding sequence
atgaggaaatcatccagccccagcctctcaaactgcaactcagtccttgccaataagatcttcggcattccactggacgagctccaacaaggcgggcaccctgacaacgaggtacctttcattgtgaggcatgtggtggactacatcgaggagcacggcggactcgaacagcagggactgttccaagtgaactag

SEQ ID NO: 29672 - DNA, 264 bp, Artificial Sequence
  Description of Artificial Sequence: Synthetic coding sequence
atgcgtaaaagctcaagcccttcgctgagcaattgcaattccgtgctggccaataaaatcttcggaattccactggacgagctccaacagggggggcatccagacaatgaagtgccatttattgtgaggcatgtcgtggactacatcgaggagcacggagggcttgagcagcaaggcctgtttcaggtcaatgggaacgctgagacagtggagtggcttagacagcgttacgactctggcgaagaggtggatcttgtgaagtag

SEQ ID NO: 29673 - DNA, 429 bp, Artificial Sequence
  Description of Artificial Sequence: Synthetic coding sequence
atgcggaaaagctcctcccccagcctctcaaactgcaactcagtgctggcgaacaagatattcggcatacccctggacgagttgcagcagggcggacacccggacaacgaagtgccatttatcgtgcggcatgtggttgattatatcgaagagcacggaggactggaacaacagggactctttcaggtgaatgggaacgcggagacagtcgagtggctccgccagcgctacgattcaggggaagaggtggatctggtgaaggaggcagacgtgcccagtgcaatctcgttacttaggtttttcctgcaggagcttccagagccggtgattcccggaagcctgcacatccatctgatgcagctcagccaagattataacaacgaggatgagttcggccgaaagttacggttcctgctgcagcagctctag

SEQ ID NO: 29674 - DNA, 1506 bp, Artificial Sequence
  Description of Artificial Sequence: Synthetic coding sequence
atgggcaactttaagtcccgtaaacccaagagtatctttaaggccgaaagcgggaggagtcatggagaaagccaagaaaccgaacatgtggtgtcgtcacagagcgagtgccaggtacgcgctggcactccagctcatgaaagtccccagaataatgcctttaagtgtcaagaaactgtccggttgcagcctcgaatcgaccagcgaacagccatctctcccaaggatgccttcgagaccaggcaggacctgaatgaggaggaagcggctcaggtgcacggcgtcaaagaccctgcacccgccagcactcaaagtgtccttgccgacggcactgatagcgccgaccccagccccgttcacaaggatggacagaacgaagccgactccgctccagaagacctccatagcgtgggcacctcgcgattgctctatcacattacagatggagacaacccgctgctcagccctcggtgttccatctttagccagagtcagcggttcaacttggacccagaatctgcaccatctcctccgtcaactcagcagtttatgatgccaaggtctagctcccggtgttcctgcggcgacgggaaggagccacagactattacccagctgaccaaacacatccagtcactgaaaagaaaaatcaggaaatttgaggaaaaattcgagcaggagaagaaatatagaccatcacacggcgataaaacctctaacccagaggtgctgaaatggatgaacgacttagctaagggccgcaagcaactaaaggaactgaagctgaagctgagcgaggaacaaggttcagctcctaagggcccaccgcgcaatctcctctgtgagcagccaaccgttcccagggaaaacggcaagcctgaggccgcgggaccagagccctccagctccggggaagagacgcctgacgctgcactcacttgcctgaaagaacgccgcgagcagctgcccccccaggaggattctaaggtcaccaagcaggacaagaatctgatcaagcctctttacgataggtaccgtattataaagcaaattctttccacaccctccttgatccctactatcgaagaggaggactccgacgaggacaggccacagggctcacagcagcccagcctcgctgatcccgcttctcacctgccggtgggggaccacctgacttacagcaatgagactgagcctgttagagccctgctgcctgatgaaaaaaaggaggttaagccaccagctctgtccatgagtaatttgcacgaggcgacaatgcctgtattgctggatcacctgagagaaacccgggccgacaaaaagcgcttgcgcaaggcactacgagagttcgaagaacaatttttcaagcagacaggaagatccccgcagaaggaggaccgcatccctatggcagacgaatactacgaatataaacatataaaggccaagttgaggttactggaggtgctcattagtaaacaggatgtcgctaagaccatttag

SEQ ID NO: 29675 - DNA, 1758 bp, Artificial Sequence
  Description of Artificial Sequence: Synthetic coding sequence
atgtttagttgcttttgtttcagcctgcaggacaatagtttttcttctacaaccgtgactgaatgtgatgaggatcccgtctctctgcatgaggatcagacggattgtagttctttgcgggacgagaataataaggaaaactatcccgatgccggcgcgctagtagaagaacacgctccaccatcatgggagcctcagcagcaaaatgttgaagcaaccgtgctggttgattccgtgcttcgcccctccatgggtaacttcaaaagcaggaaaccaaagtctatatttaaagctgagtccggccggagtcacggcgagtctcaggagacagagcacgtggtgtcttctcagtccgaatgccaggtcagggcgggcacgcccgctcacgaatctccacagaacaacgcctttaagtgccaggagacagtaagactacaaccccggatagaccagcgtactgcgataagcccaaaagacgctttcgagaccagacaggatctgaatgaagaagaagcagctcaggtgcacggtgtcaaagaccccgcccctgcatctacacaatcagtacttgccgatggtacggatagtgctgatccatccccagtccataaggatggtcaaaatgaggctgattctgctccagaggacctgcacagcgtgggaactagccgtctgttgtatcacattactgatggtgacaatcctctattatctccacggtgttccatcttcagtcagtcacagcggtttaacctggatcctgagtccgcgccctctcctcctagtacccagcaatttatgatgccaaggtcatcaagcaggtgcagctgtggcgatgggaaggagcctcagacaattacacaactcactaaacacatacagtcattaaagagaaaaatccggaaatttgaagagaagtttgaacaagaaaagaagtaccgcccaagccatggtgacaaaacctccaatcccgaggttctcaaatggatgaacgatttagccaaggggaggaaacagttgaaagaattgaagctgaagctgtccgaggagcaagggtccgccccaaagggccctcccagaaatctcctttgtgaacaacccacagtgcctagagaaaacggcaaaccggaggccgccggaccagaaccatcatcatccggagaggagacgcccgatgcagccctgacctgtctaaaggaacggagagagcagttaccccctcaggaagactcaaaagtcactaaacaggacaaaaacctcatcaaaccactctatgaccgctaccggattataaaacagattttaagcaccccctccctaatcccaactatccaggaggaagaggattccgacgaggataggcctcagggatcccaacaaccttccttggctgatcccgctagccaccttccagtcggggaccacctgacgtactccaatgagaccgaaccagttcgtgctctgctgcctgacgagaagaaggaggtcaaaccacctgctttatctatgtccaacttgcatgaagcaacaatgccagtgctcctcgaccacttgcgcgaaaccagggccgacaagaagaggcttagaaaggcactgagggaattcgaggaacagttcttcaagcagacggggagatctccacagaaggaggaccggatccccatggcggacgagtactatgaatacaagcacataaaggcaaagttgaggctgctggaggtactcatctcaaaacaggatgtggcaaaaaccatctag

SEQ ID NO: 29676 - DNA, 1464 bp, Artificial Sequence
  Description of Artificial Sequence: Synthetic coding sequence
atgtttagttgcttctgcttctcactccaggataactctttttcgagtactactgttaccgagtgtgatgaggaccccgtaagcctccacgaagaccagaccgattgcagctctctacgtgatgagaacaacaaggaaaattatcccgatgcaggggctctggttgaggaacatgcaccccccagttgggaaccgcaacaacagaacgtggaagctaccgtgcttgtcgatagtgtgctgcggccctctatgggcaacttcaagtcccggaagcccaaatctatcttcaaagccgagagcggacgctcacatggcgagtctcaggaaacagagcacgtggttagtagtcagtcagagtgccaagttcgggctggaacacccgcacatgaaagccctcaaaataatgccttcaagtgtcaagagacggtacggctacaaccgcggatcgatcagagaacagctatcagtcccaaagacgctttcgagacgcgccaggacctgaacgaggaggaggcagcccaagtgcatggggtaaaggatccagcgccagccagcacgcagagtgttctggccgatggaaccgacagcgctgacccaagtcccgtgcataaggacggacagaatgaggctgattccgcccccgaggacttgcactctgtaggtacttcccggttgctctaccacatcactgatggggataatcccctgctgagccctagatgttcaattttctcacagagccagaggtttaacttagatcccgagagcgcaccatctcccccaagcacgcagcagttcatgatgcccaggtcatccagtcggtgcagctgcggagatggaaaagagccccagactattacccaactaaccaaacatatacagtcactcaagagaaagataaggaagttcgaagaaaagttcgaacaggaaaagaagtaccgcgtaacaaaacaagacaagaatctgatcaagccgctgtacgatcgttatcgtattatcaaacagatcctctctactcctagtctgattcctacaattcaagaggaggaagattccgacgaagaccgcccacagggatcccagcagcccagccttgccgacccagccagccacctgcccgtgggagaccatctgacctatagtaacgaaacagagcccgtgcgggcattactgcctgatgagaaaaaggaagtcaagcctcctgctttatctatgtcaaacttgcacgaagccacgatgccggtcttactcgatcatctcagggagactagagccgacaaaaagaggctgaggaaagcgctccgggagttcgaggaacagtttttcaaacaaacaggaaggtccccccagaaggaagatcgaatccctatggcggacgaatattacgaatataaacacattaaggctaagctcaggctcctcgaagtactgatctctaaacaagacgtggcaaagacgatctag

SEQ ID NO: 29677 - DNA, 1377 bp, Artificial Sequence
  Description of Artificial Sequence: Synthetic coding sequence
atgttttcctgcttctgcttttctctccaggataacagtttctcctccactaccgtgaccgaatgtgatgaggaccccgttagcctgcacgaggaccagactgactgcagttccctgagagacgagaataacaaagaaaactacccagatgctggagcactggtcgaggaacatgctccaccttcttgggagcctcagcagcagaacgtcgaagctactgtcctggtggacagtgttttgagaccttcaatgggaaattttaaatcgaggaaaccaaagagcatctttaaagccgaatctggtcggtctcacggagagtcgcaggagacagagcacgtggtgtcctctcagtccgaatgccaagtcagggctggaacaccagcccacgagtcacctcagaataacgcgttcaaatgccaggagactgtgagattgcagcctagaatcgatcagcgcacggctatcagtcctaaggacgcattcgagactcggcaagacctgaatgaggaggaggctgcacaggtgcacggcgtcaaggatccagcacccgccagtacccagagcgtcctggctgacggaacagacagcgccgatccttctcccgttcacaaggacggacagaatgaagcggactccgcgccagaggacctgcattccgtcgggacatctagactgctatatcacattacggatggggataatcccctcttgtccccaagatgcagcattttctctcagtcacaacgattcaatcttgacccggagtctgctccaagccctccatctacccagcagtttatgatgcccaggtcctcaagtcgctgctcctgtggagacggaaaagaacctcaaaccatcacacagctgacaaaacacatccagtctctgaaacgaaagattcgaaaattcgaagagaaatttgagcaagaaaagaagtatcgcccatcacatggagacaagaccagcaatccagaggtcctgaagtggatgaatgatttagctaagggacggaaacagctgaaagagcttaagctaaaactttctgaggagcagggttctgctcctaagggaccccccagaaatcttttgtgcgagcagcccaccgtccctcgggagaatggcaagccagaggccgcagggccagaaccatcatccagcggcgaggagaccccagatgcagctctcacctgtctcaaggagcgcagagaacagttgcctccccaagaagacagcaaggtgaccaaacaagacaagaacctcattaaaccgctgtacgatcgctaccggataattaagcagattttgtctacaccttccctgattcctacaatcgttagccaagacacttgcatgcttctactctgcaccgatgtatag

SEQ ID NO: 29678 - DNA, 1509 bp, Artificial Sequence
  Description of Artificial Sequence: Synthetic coding sequence
atgggaaacttcaaatcaaggaaacccaagtccatttttaaggcggaatcagggcggagccacggcgaatcccaggaaacagagcatgttgtgtcctctcagtcagaatgccaggttcgcgccgggacacctgcgcatgagagtccccaaaataacgcattcaaatgccaggaaaccgtgagactccagccaagaatcgatcagaggaccgctatatcccccaaggatgccttcgagacccgacaagacctgaatgaagaagaggccgcccaagtccatggagttaaggatccagcaccagctagtactcaaagcgttttggccgacggaaccgattcggccgacccgtcaccagtgcacaaggatggacagaacgaagccgatagtgcacctgaggacctgcattctgtgggtactagtcggctgctgtatcatataactgatggggacaacccattactgtcacctaggtgttcaattttttcgcagtcccagaggttcaatctggaccccgagagcgctccttccccacctagcacccaacaattcatgatgcctaggtcttcctctcggtgtagctgtggtgatggtaaggaaccacagactattacgcaactcactaagcacattcagtctcttaaaaggaaaatcaggaagttcgaagagaaatttgagcaggagaaaaagtatcgcccatcacacggtgataagacctcaaatcccgaggtgctgaagtggatgaatgacctggccaaggggagaaagcagctcaaagagctgaagctgaagctatccgaagaacagggatctgcgccaaagggtccacctcggaaccttctttgtgagcagcctaccgtgccacgcgaaaacgggaagcctgaagccgccggcccagaacccagctcaagcggcgaggagacgcccgacgcagccttaacttgcctaaaagagaggcgagaacagttacctcctcaagaggacagcaaagtcacaaaacaggacaagaatctgataaaacctctgtatgacagatatcgcatcatcaagcagatcctgtctacgccctccttaattccgactatacaggaggaagaagatagtgacgaagaccgcccccaaggcagccaacagcctagtctcgctgatcctgccagccacctccctgttggagaccatctaacctactctaacgagactgagcctgtccgggcactgctcccagatgagaagaaggaagtaaaacctcccgccctttcaatgtctaatctgcacgaagcaacaatgcctgtattactggaccacttgcgcgaaaccagggccgataaaaagcggttacgtaaggccctgagggagttcgaggagcagtttttcaaacagaccggccgctctcctcagaaagaggaccgcatccctatggcggacgaatactatgagtataagcacattaaagcgaagctgcggctgttagaagtactgatctcgaagcaggacgtcgcgaaaacaatatag

SEQ ID NO: 29679 - DNA, 18 bp, Artificial Sequence
  Description of Artificial Sequence: Synthetic coding sequence
atggggaattttaaatag

SEQ ID NO: 29680 - DNA, 78 bp, Artificial Sequence
  Description of Artificial Sequence: Synthetic coding sequence
atggggaacttcaagtcacggaagccgaagtccatttttaaagctgagtcaggaaggagccacggggaatcacagtag

SEQ ID NO: 29681 - DNA, 999 bp, Artificial Sequence
  Description of Artificial Sequence: Synthetic coding sequence
atggattcaacgtcttcgttgcatgggtctagcctccatcggccttcaaccgaacagaccaggacagacttttcgtgggacggaattaatctgagcatggaggacacaacatctattctgcctaaactgaaacggaactccaacgcatacgggatcggagctctcgctaagtcttctttcagtggaattagtaggtcaatgaaagaccacgtaacaaagcccaccgcaatggggcagggtagagttgcccacatgattgagtggcaggggtggggcaagacccccgcggtgcagccacagcattcacatgagagcgtgcggagagatactgatgcatattctgatctttctgacggcgaaaaggaggcacggttcttggctggcgtcatggaacagtttgcaatctccgaggccacactgatggcgtggtcttcaatggatggagaggacatgtcagtgaacagtacacaggagcccctgggctgcaactactcagacaactatcaggagctgatggatagccaagacgcactggctcaggccccaatggacggttggcctcactcatacgtcagccagggtatgtattgcctggggagcagtgacgcatgggaagcgtccgaccagtcacttatagcatcacccgccactggcagctacttggggccggctttcgacgacagccagcctagcctccacgagatggggccctcacagccagcttctggctacagcgccctagagcctccaccacttctgggcggtgacactgactgggcccccggcgtgggcgccgtcgatcttgcccgcggcccagcagaggaagagaagcggccccttgccccagaggaggaggaggacgcaggctgcagagacctagagtcattatctcctcgtgaagatcccgaaatgtccaccgcactgagccgtaaggttagcgatgtgacctcttctggtgtgcagtcttttgatgaagaggagggcgaggccaataactag

SEQ ID NO: 29682 - DNA, 999 bp, Artificial Sequence
  Description of Artificial Sequence: Synthetic coding sequence
atggactctacttccagtcttcacggatcatcactacacagaccctctaccgaacaaacccggacagacttcagctgggacggcatcaacttgagcatggaagacaccacctctatcctacccaagttaaagcggaattccaacgcatacggaatcggtgccctggccaaatcctctttttctgggatcagtagatcgatgaaagaccacgttactaaaccaacggccatgggtcaggggcgggtggcacatatgatagagtggcagggctggggcaagaccccggccgttcagcctcagcatagccacgagtccgttcgtagagatacagacgcatactccgacctcagcgacggggagaaggaagcccgcttcctggctggcgtcatggagcaatttgctattagcgaagcaaccctgatggcttggtcctctatggatggcgaggatatgtcagtgaacagcacccaagaaccactgggatgcaattactctgataattatcaagagctaatggacagtcaggacgctctggcccaggcccccatggatggttggccgcacagctatgtatcccaaggaatgtattgcttgggatcctctgatgcatgggaagccagcgatcagtcattaatcgcttccccagctacaggatcatacctaggccccgcttttgacgactctcaacctagcctgcatgagatgggcccctctcagcctgcgtctggatactcggctcttgaacctcctccactgttgggaggtgacacagactgggcaccaggggtcggagctgtcgatctggcccgggggcccgccgaagaggaaaagcgcccattggcacccgaggaagaggaggacgccggctgtcgggatctggagagcctgtcacctagggaggacccagaaatgagtacagctttgtcccggaaggtgagcgacgtgacatcttctggagtccaaagtttcgacgaagaggaaggggaggcgaataactag

SEQ ID NO: 29683 - DNA, 999 bp, Artificial Sequence
  Description of Artificial Sequence: Synthetic coding sequence
atggactcgacttcctcattacacgggagttcactccaccgtccttcaacagagcagacaagaaccgacttcagctgggatggcatcaatctgtccatggaagacaccaccagtatcctgccgaaattgaaaagaaattcaaacgcctacggcatcggcgccctcgcaaagtccagcttctccggcataagtcgcagcatgaaagatcatgtgacaaagccaacagccatgggccaggggcgcgtcgcccacatgatcgagtggcaggggtggggaaaaacccctgcagtgcagccccaacattcccatgaatcagtaaggcgggacacggatgcgtacagtgacctgtcggatggagagaaagaggccaggtttttggcgggagtgatggaacagtttgcaatcagtgaggctacccttatggcctggtcctcgatggacggtgaagacatgagcgtgaacagtacccaggaacctctgggctgcaattacagtgataattaccaggagctgatggactcccaggacgccctggcccaagccccaatggacggctggcctcactcttacgtcagtcaaggaatgtattgcttggggtcttccgatgcctgggaagccagcgatcagagccttatcgcttctccagccactggctcgtacctcggaccagcatttgatgactcacaaccatccttgcacgagatgggaccctcccagcctgcctctggatactctgctctggagcccccaccgctgctcggcggcgatacagattgggccccaggcgtaggcgcagtagatctggccagaggtcccgcagaagaagagaagagaccccttgctcctgaagaggaggaagatgcgggctgtcgggatctcgagagcctgtcccctcgcgaggacccggagatgtccacggccttgtccagaaaagtcagtgatgtgactagctctggcgtgcagtctttcgacgaggaggagggcgaagccaataactag

SEQ ID NO: 29684 - DNA, 1083 bp, Artificial Sequence
  Description of Artificial Sequence: Synthetic coding sequence
atgggatgtattggctccagaactgtcggcaacgaagtgatcgccgtggactggaagggtctgaaggacgttgaccagatcaacatggactctacctcctccttgcatggatcatcactccatcgcccctctaccgaacagacccggaccgatttcagctgggacgggatcaatttgtctatggaagacactacctcgatactcccaaagctcaaaaggaactcaaatgcctacgggattggtgctctggctaagtcgagcttctctggcatctcacgctctatgaaggaccacgtcaccaagcccactgccatgggacaggggagggtcgcccacatgatagaatggcagggctggggtaaaactccagccgtgcaaccacagcactctcacgagagcgtccgccgcgacaccgatgcctattctgatttatcggacggcgaaaaagaggcaaggttcctggcaggcgtgatggaacagttcgcaatctcggaagccacgctcatggcctggtcttcaatggacggcgaagacatgagtgtcaactcaactcaggagcccctgggttgcaattattctgataactatcaggaacttatggattcccaggacgccctggcacaggcacccatggatgggtggcctcacagctacgtgagtcagggaatgtattgcttagggtctagcgatgcatgggaagctagcgaccagtcgttaatcgcttcaccggctaccggcagctatcttggcccagcattcgatgattcacagccttcattacatgaaatggggccgtctcagcctgccagcgggtattcggctctggagcccccaccattgcttggaggcgacacggattgggcacccggcgtgggtgccgttgacctcgctcgagggcccgctgaagaggagaaaagacctctggctcctgaagaggaagaggacgccggatgtcgcgaccttgagtcactctccccaagagaagaccctgagatgagtaccgcactgtccagaaaagtctcggacgtgaccagctcgggagtgcagtccttcgacgaagaggagggtgaagccaataattag

SEQ ID NO: 29685 - DNA, 1011 bp, Artificial Sequence
  Description of Artificial Sequence: Synthetic coding sequence
tttctgctgggccgacaccagagaaccgtgtccacccacgttctaaacctatgtcccagcttccccgaacattggggctatatccctccatgggattcctggctgtccatggaggatactactagcatcctgcctaaattaaagagaaactccaatgcttacggaatcggagccttggccaaatcctcttttagtgggatatctcggtccatgaaagaccacgtcaccaagcccaccgccatggggcagggacgggtggcccatatgatcgaatggcaggggtggggaaagactcctgcagtgcagccccagcatagccacgagtccgtgaggagagacaccgacgcgtactcagatctctcagatggagagaaggaagcacgcttcctggctggggtgatggagcagtttgccatctccgaggcaacacttatggcctggagcagcatggacggggaggatatgtctgtgaatagcacccaggagcctttgggttgcaattactcggacaactatcaagaactgatggacagtcaggacgccttggctcaggcgcccatggatggctggccacattcatatgtgtcacagggcatgtactgcctcgggtcatctgacgcttgggaggcctccgaccagtctctgattgcttctccagccacgggctcttatcttggccccgcatttgacgatagtcagcccagccttcacgagatgggacccagccaacccgcctcgggatattctgcactggagccgccccctctgttgggaggagatactgattgggcccctggagtcggcgcagtggacttagcccgcggtccagctgaagaggaaaagcgtccactggctccagaggaagaagaagacgctggatgtagggatctggagtccctgagtcccagggaagatcccgagatgagcactgccttgagccggaaggtctctgacgtgaccagtagcggagtgcagtcttttgacgaagaggaaggcgaagcaaataattag

SEQ ID NO: 29686 - DNA, 843 bp, Artificial Sequence
  Description of Artificial Sequence: Synthetic coding sequence
atgggatcatgcgtgagcagggacttattcacctctgcacacaaaaactgtccaatgccgcagggagctgaccctctgaaccctgacctgccatcagggcgaactccaaccgtggccccagattgtgttattggaaaagacaaacaaatggatttttgctgggacccatggcagcgttgtttccagaccactaacggatacctttccgactctcgctcgagaccgggcaattataacgttgccgcgctggcaacctccagcctagtgggagtggtgcagtctatcaaggatcacataactaagccaacagcaatggctcgtggccgcgtggctcacctcatagagtggaaaggatggagcgcacagccagccggatgggagctgtctcctgctgaagacgagcactactgctgccttcctgacgagcttcgggaggcccgcttcgctgcaggtgtggcggagcaatttgccatcactgaggctacactgtccgcttggagcagccttgatgaggaggagttgcatcccgagaattctccgcaggggattgtccagctgcaagatcttgagagtatctatttacaggactccctgcccagcggcccatcacaggacgatagcctacaagccttttcctccccgagcccctccccagacagttgccctagccctgaggagccaccctcaacagccggcattccccaaccaccttcaccagagctccaacacagacgcaggctgcctggggcccaggggcctgagggtggaacccacccgcctggcagccttccttccatggattcaggctccctttgggaggaggacgaggtgttttataactag

SEQ ID NO: 29687 - DNA, 747 bp, Artificial Sequence
  Description of Artificial Sequence: Synthetic coding sequence
atggggaagcgcgacaatagggttgcctacatgaacccaatcgcgatggcaaggtggcgggggccaactcagagtgtcggccctactatccaagactacctgaaccgacctaggccgacatgggaagaagtgaaaaaacagctggaaaataaaaagacagggtctaaggcactggcggagttcgaagagaagatgaatgagaactggaagaaggagctggaaaaatcaagggaaaaactcctgagtggcaacgagagctcttcaaagaaacgcgagcgcaagaagaaaagaaaaaaaaaatcttgtcgcagttcgtcctcttcatccagctcagacagctccagctcatccagcgacagcgaggacgaagaaaagaagcaaggtaagagacgcaaaaagaagaaaaatcggtcctacaaatcatcacagtcctcaacacacgagtctgagtccgagagtaaggagtccgtaaaaaaaaaaaaaaaatccaaggacgagacagagaaggagaaggacgttaggagcttgagcaagaaacggaagaaaagttatccggatgacaaaccactcagcagcgaaagcagcagcgaaagcgattatgaggaggatgtccaggccaaaaaaaagcgtcgctgcgaggaaagagagcaggcaaaggagaaggtaaaaaaaaaaaagaaaaagcagcacaagaagcactctaaaaagaaaaaaaagaagtctggtagctcacacaagagcagatag

SEQ ID NO: 29688 - DNA, 747 bp, Artificial Sequence
  Description of Artificial Sequence: Synthetic coding sequence
atgggaaaacgtgacaacagagtcgcttacatgaatcctatagccatggcgcgctggcgaggaccaacccagtcggtaggccccacaattcaggactatcttaacagaccccgacccacatgggaagaggtcaaaaagcagctcgaaaataagaaaacaggctcaaaggctctagccgaatttgaggagaaaatgaacgagaactggaagaaggaactggagaagtccagggagaaactgctgtctgggaacgaatctagctccaaaaagagggaaagaaagaagaagcgaaaaaagaagagttgcaggtcttcttcaagttctagcagtagcgactcctcttccagctcaagtgatagtgaggacgaagagaagaagcagggtaaacgccgaaagaagaagaagaataggtcttacaaatctagccagagtagcacacacgaaagtgaatcagagtcaaaagagtcagtcaaaaagaaaaagaaaagcaaagacgaaaccgaaaaggagaaggacgtccggagtctgagcaagaaacgtaagaagtcatatcccgacgataaaccgctctcctcggagagctcttccgagtccgattatgaggaagatgttcaggccaaaaagaagcgccgctgcgaggagagggagcaagcgaaagaaaaggtcaagaagaagaagaaaaagcagcataaaaagcattctaagaagaaaaaaaagaagtcagggagctcacataagtcaagatag

SEQ ID NO: 29689 - DNA, 747 bp, Artificial Sequence
  Description of Artificial Sequence: Synthetic coding sequence
atgggaaagcgtgacaatcgcgtggcgtacatgaatcccatagctatggcacgctggcgaggcccgacccagtcagtggggcccaccattcaggactacctgaatcgaccccggccaacctgggaagaagtgaagaaacagctggaaaacaagaaaactggttcaaaggccctagctgagttcgaggagaaaatgaacgaaaattggaaaaaagagctggaaaaaagcagggagaagcttctctctggaaatgagtcaagctcaaagaagcgagagcgcaagaagaagcgcaagaaaaagtcctgccgatcaagctccagctcatcctcttctgatagctcttcaagcagctcagattctgaggatgaagagaagaaacaagggaaacgcagaaagaagaagaaaaaccgctcctacaaaagcagccaatcaagcacacatgagtccgaatcagagtcaaaggagtctgtcaagaagaagaaaaagagtaaagatgagactgagaaggagaaggatgtgcggtcattgtctaaaaagagaaagaagtcataccctgatgataaacctctgtctagtgaaagcagttccgaatccgattatgaggaagacgttcaagccaagaagaaaaggagatgcgaagagagggagcaggctaaggaaaaagttaagaagaaaaaaaaaaagcagcataagaagcattcgaagaaaaagaaaaagaagagcggctcgtcgcacaagtccagatag

SEQ ID NO: 29690 - DNA, 747 bp, Artificial Sequence
  Description of Artificial Sequence: Synthetic coding sequence
atgggcaagcgggacaacagagtggcctatatgaaccccatcgctatggctcgctggagagggcctacccaatccgtgggccccaccattcaggactatctgaatagacctcgccccacatgggaagaagtcaaaaagcaactggaaaacaaaaagacagggtccaaggccctcgccgagttcgaagaaaaaatgaacgagaattggaagaaagagcttgagaagagtagagaaaaactcttgtcaggtaacgagtccagcagcaagaaaagagagcggaagaaaaaaagaaaaaagaaaagttgccgttcctcctcctcaagctcttctagcgatagttcaagctcaagtagcgacagcgaggacgaagagaagaagcaaggcaaacggaggaagaaaaagaagaacaggtcatacaagtccagccaatcttcgacacacgagagcgagtctgagagtaaggagtccgtgaaaaaaaagaagaaaagtaaagatgaaacagagaaagaaaaagacgtccggtcactcagtaagaaacggaagaaaagttatccagatgataaaccactgtcatccgaaagctccagtgagagcgactatgaggaagatgtgcaggccaaaaaaaaaagaagatgtgaggagagggagcaggccaaagagaaggtcaagaagaagaagaagaaacagcataaaaagcactccaagaaaaagaagaagaagtctggatctagtcacaagagtcgatag

SEQ ID NO: 29691 - DNA, 714 bp, Artificial Sequence
  Description of Artificial Sequence: Synthetic coding sequence
atgaacccaattgccatggctcgcagtcgtgggccgatacagtcatcaggtccaacaatccaagattacctcaatagaccacgcccaacctgggaggaagtcaaggagcaactggagaagaagaaaaaaggatccaaggcattggccgaattcgaagaaaaaatgaacgaaaattggaaaaaggagctggaaaaacatcgggagaagcttttatccggttcagaatccagctcaaaaaagaggcagagaaagaaaaaagagaagaagaaatcgggcagatactcttcaagcagctcaagcagcagtgatagttcctctagtagtagtgattccgaagacgaggataagaaacagggaaagcggcgaaaaaaaaagaagaacagaagccataagtccagcgagtcctctatgtcagaaacagaatccgactctaaggattctctcaagaagaaaaagaaaagtaaggatggtaccgagaaggagaaggacattaaagggctctcgaagaaacggaagatgtactcagaagacaagcctttgtcttccgaaagtctcagcgagtctgagtacattgaagaagtcagagctaagaagaagaaaagctcagaagaaagagagaaagccaccgaaaagacaaagaaaaagaagaagcacaaaaagcactctaaaaagaagaagaagaaagctgcatcttcttccccagattctccgtag

SEQ ID NO: 29692 - DNA, 714 bp, Artificial Sequence
  Description of Artificial Sequence: Synthetic coding sequence
atgaatcccatcgccatggcaagatctcggggcccaattcagtccagtggccccaccattcaagattacctcaacaggcctagaccaacgtgggaggaggtcaaggaacagctggagaaaaaaaaaaagggcagcaaggcgctggctgagttcgaagaaaagatgaatgagaactggaagaaggagcttgagaagcacagggagaagctcctttctggctcagaaagctccagcaagaagaggcagcggaagaagaaggagaagaaaaaaagcgggagatattcttccagtagtagttcttcatcggatagctcgagcagtagtagcgactccgaagacgaggataagaaacaagggaagcgaaggaaaaagaagaagaaccggtcacacaagtcctccgagtcctccatgagcgaaacagaaagtgactctaaagatagcctgaaaaagaagaaaaagtcaaaggacggaactgagaaagagaaagatattaaaggactctccaaaaaacgcaaaatgtacagcgaggacaaaccactgtctagcgagtccctttctgagagcgaatacattgaagaggtgcgggccaagaagaaaaaatcatccgaggaaagagagaaggcaactgaaaagacaaagaagaagaaaaagcacaagaagcactctaagaagaaaaagaagaaagccgcaagttctagcccagacagtccatag

SEQ ID NO: 29693 - DNA, 744 bp, Artificial Sequence
  Description of Artificial Sequence: Synthetic coding sequence
atgggtaaaagagataatcgggtcgcatacatgaatcccattgcaatggctcggagtcgtggacctatccaatcctctgggcccacaattcaggactatttaaatcgcccccgccctacatgggaagaggttaaggaacagctggaaaaaaaaaagaagggctctaaggcactagcagaatttgaggaaaagatgaatgagaattggaagaaggagcttgagaaacatagagagaagcttctcagcggatctgaaagctcatcaaaaaagcggcagaggaagaaaaaagaaaagaagaagagtgggaggtactcttcctcaagttcatcatcatccgactcgtcatctagcagcagcgactctgaggatgaagacaagaagcagggcaaacggcgaaaaaagaagaagaacaggtcacacaagtcatctgagagcagcatgtccgagacggaatccgatagcaaggacagcctcaagaaaaagaagaagtcaaaggacggcacagagaaagaaaaggatattaaaggtttgagtaagaagcggaagatgtacagtgaggacaagccccttagttctgaatcactgagtgagagcgaatacatcgaggaggtgagggcaaagaagaagaagtccagcgaagagcgggaaaaggccacggagaaaaccaaaaagaaaaaaaagcacaaaaagcactccaagaagaagaagaagaaggcggcatcttctagtcccgactccccctag

SEQ ID NO: 29694 - DNA, 93 bp, Artificial Sequence
  Description of Artificial Sequence: Synthetic coding sequence
atgaatccgatcgcgatggcccgaagcagaggtcctattcaaagttcagggcctactattcaggattatcttaaccggccccgaccgacctag

SEQ ID NO: 29695 - DNA, 258 bp, Artificial Sequence
  Description of Artificial Sequence: Synthetic coding sequence
atgttactgaccatagaaactaagtcccactacgtggcacaggcagggttggaactcctggccagctcagatccccccacatcagcctctcaatccgtgggaattattgacatgtcccactgcacttggccgacgctggggaagtttctgaatccctcaaagcctcactttagccccattaccaaaggcaaggacggaaacatcttccctacaaagtttctcagcgatgccttgacagagctacgcctgtgtacttag

SEQ ID NO: 29696 - DNA, 225 bp, Artificial Sequence
  Description of Artificial Sequence: Synthetic coding sequence
atgcttcttacaattgaaactaagtcccactacgtggcacaggccggcttggaactcctggcctcctcagaccctcctacaagcgcgtcacagtctgtaggaattatcgacatgagccactgtacctggcctaccttaggcaagttcctgaatccctcaaagccccacttctcacccattactaaagggaaagacgggaatattttccccacgaaatttctgtag

SEQ ID NO: 29697 - DNA, 258 bp, Artificial Sequence
  Description of Artificial Sequence: Synthetic coding sequence
atgctcctgacaatcgagactaaaagccactacgtggcacaagccgggctggaactattggcatcctccgacccgcctaccagtgcgagtcagagcgtgggtatcattgacatgagccactgcacttggcccacattgggcaaatttctaaacccctccaaacctcatttctcacccatcacgaaaggaaaagacggcaacattttccccacgaaatttttgtccgacgcgctgacagagctgcgcctgtgtacctag

SEQ ID NO: 29698 - DNA, 258 bp, Artificial Sequence
  Description of Artificial Sequence: Synthetic coding sequence
atgttactgacaattgaaactaagtcccactatgtggcccaggctggcctcgagctgttggccagtagcgaccccccaacttcagctagtcagtcagtaggaatcatagacatgtctcactgcacatggcctacgctcgggaagtttttgaacccatctaagcctcatttttctccaattactaaaggcaaggatgggaatattttcccaaccaagtttctaagtgacgcgttaacagagctgcgtctctgcacctag

SEQ ID NO: 29699 - DNA, 1287 bp, Artificial Sequence
  Description of Artificial Sequence: Synthetic coding sequence
atgaataggcagggaaatcggaagaccacgaaggagggctctaacgatctcaagtttcagaacttttccctgcccaagaaccgatcttggcctagaatcaattccgccaccggacagtatcaacggatgaacaaacccctgttggattgggagcggaactttgcagctgtactcgacggcgcaaaaggacactcagacgacgactacgatgatcctgaactgagaatggaggaaacttggcagagcattaaaattctcccagctagaccaattaaggaatctgagtacgcagacacacattatttcaaggtggcaatggatacacccctccccctagatacaagaacctcaatttctattggtcagcccacttggaatactcagactaggctagagagagtggacaaaccaatcagtaaggacgtgaggagtcagaacataaagggcgacgccagcgttaggaaaaacaagatacccctacctcctcctaggcctttgatcacattgccgaagaaataccaacccctaccacccgaacctgaaagtagtcgcccgcccctgtcccagcggcatacattccctgaggtacaacggatgccttcccagatctctttacgggacctgtcggaagtgttggaagcagaaaaagtaccccacaaccagaggaagcccgagtctacccatttgctcgaaaaccagaatacacaggaaatcccgctggccatctccagctcctcttttacaacttcaaatcactctgttcagaacagggaccacagaggtggcatgcaaccatgctccccgcagcgctgtcagccaccggcctcatgttccccacatgaaaacatcctgccttataagtatacttcctggaggcccccttttcctaagcggagcgacagaaaggacgtccagcataatgagtggtacataggggagtactcacgacaggccgtggaagaggccttcatgaaggagaataaagacggctcatttttggttcgcgactgtagcaccaaatccaaggaagaaccctacgtcctggccgtgttctatgagaataaggtctataatgtaaagatccgattcctggaacggaaccagcaattcgcactcggtaccggcttaaggggtgacgaaaagtttgatagcgttgaagatatcatcgaacactacaagaactttcctatcattcttatagacggcaaggacaaaaccggggtgcacaggaagcagtgccacctaacccagccactaccattgacacgtcatcttttgccactgtag

SEQ ID NO: 29700 - DNA, 2322 bp, Artificial Sequence
  Description of Artificial Sequence: Synthetic coding sequence
atgaaggctgctgtgctagatctagggagcctgcttgccaagttgttcgaaacatctaccgccccaccagcgggcccgagctcccggccatccgggggcgctgctgctgccggaagtggaggctcgagggccggtacgccactgggaactgcgcccacattgttacgggccctcgcccctgactcgccctcagcttctcgcaggtctcctgctcccctccttagttccccatactctagaggttctgcggcttctagggctgccggtgcagtggggactctgttgtcatggccaagttcccctcgggccgggaaggcacccccacagcctccaacgccaagtggaggcgggtgtagtcctgcccgcctggtggtgcccgctcggccccccagcggaccaggcggcgtgtgggctgccctgccccggaacccccttcaaccaggacccggagaacgcgaactgggcgcttgcgtggcacccggcgcaggacctcgcacactcttcttgacactgccagacatcggcgaggagggtgcttccgacggggacagcggcgacggagaagcgaggggcctgtccgagggacgtcgtcgacacggcttcaccgtgcggtccaaagactccctgcctacacacttcaccagaaacgtgcagaaggcaattgataaatacacatgtaagtctcttagtagcttttcatccagtggctctcatactcctacaggggcacacaccagctggtcgggctccgctactcaatcctcaacaacggggtctagcaccgaacgaggaagcgtgtactcatggagagatgacgaatttgatgaggccagcagccaaagtgtgcagcggctcctctgggaggtggaggagatgctgttcgagggcaaggtgaatcctcaaacgcaaagtctcctagctgaatgtggcgaatggactcgcagaagcttacacctgagggttttaggaagacagctgattctgcctaccgacaagggggtgcagcacttccagggaagtacacccgctagtgccgtgcataggcctcctctctcagcatgtggtcacagcagtaacataagagagttatgcatctccggaagccagattgtcccagccgccttatccgcctctgcccttcctggcccagatgataccggcgtcgccgacctgacagccaggtctagccttgaagaggaggtatatcacgttgatggcaagattgaggagtacttcgccttcgatcggaaggaggatgacgatgagtgccttgaacagaaacctgcccagcccggtagaaagtggcgaaaattgggtcttccaccggtttcaccacgggactgcgttaaggatgctgtcgctgctgaagtgttcgaccatgtttggacaaatatggttgaattgctggaggagctgatacgaaaacactgggagactactcttaccgagggcaaaaagcagcgcgaaactctgaaagtcgctggtaatcgcttcccccatgttttggtgccacatgcgcacgccgacggcgcctccggaccaccttctggccacgctgaagctcatggcatctctctggctagtagacttaacccaccgcagattcatcatttctcttcatctttctactctgacatgaatggtgtgatgacaattcaggcaaaacctctgcagcgaagacccgcgtatttcgctgacagaacacagaacgagaaggaggacaaggcgtccggtggaggagccggagcattgagctcagcgccacaccggttggggagggcaagtgacacccatggcctgtctccaagcgcgaaaaagaccccagtgccatggcgactgccttctctagcttctgattcccaacggctcaagacccctaacatatatagcgatgaagtccttcgcggcactaaactgcccaccggcgtggaccacatggccagtcccctagtgcaaacttcaaggagtcggtttccacccttggtgactgagacacgagggcaaaataccgccgtccctggatgtcgactggtctcctacaggggccggcacctgcagaatagagtgctcagcgccatgccagatggcactgagaggagccgcctgagggaaaggaccgcgacgctcgaaaggctgtcccgcccaagcacaacgcacacattccgccagagtgacacacctcggaaatccagcctaacccagatggagtttgctgcccacacatggacagggcagtccatcctcaccggatcacagtacgtcccaaagtcgtttcagcgcaccacactgaccttcaagcgaaggttccaggtaactagctag

SEQ ID NO: 29701 - DNA, 1449 bp, Artificial Sequence
  Description of Artificial Sequence: Synthetic coding sequence
atgctgttcgagggaaaagtcaacccgcagacacaatctctgctggccgagtgcggggagtggactcgacgatccctgcacctgagagtgctcggtaggcagctgattctgcccaccgataaaggagtgcaacacttccagggaagcacgcccgcaagcgccgtacatcggcccccactgtccgcatgcggacactcttctaacatacgggagctatgcatttccggtagccaaattgtgcccgccgctctctccgccagcgccttgcccggtccagacgataccggggtcgccgatctgaccgcccgttcgtccctggaagaggaagtgtatcacgtagatggaaaaatagaggagtacttcgcctttgaccggaaagaggatgatgacgaatgtctggaacagaaacctgctcagcccgggagaaaatggcgcaagctcggtctgcctccagtgtccccgcgcgactgtgtcaaggacgcggtcgcagcggaggtttttgaccatgtttggaccaacatggtggaactcctggaagagcttatccggaagcactgggagacaaccctgactgagggcaagaagcagagagagacactaaaagtcgctgggaaccgcttccctcacgtcctggtaccgcacgcacatgcagatggagcctctggcccacccagtggtcacgcggaggcccacggaatttctctagcgtctcggctgaaccctccgcagatccatcacttcagctcatctttctattcagacatgaacggtgttatgacaattcaggcaaagcccctgcagaggaggcccgcttatttcgctgataggacacagaatgaaaaagaggacaaggcaagcgggggaggggctggggccttgtcatccgcccctcatcgcttgggacgagcatctgacacgcatggcctgagccccagcgctaagaagacccccgttccttggagactgccttccctagcaagtgactctcagcggctgaagacaccgaatatttacagcgatgaagtcctgcgcgggaccaaactcccaaccggtgtggaccacatggcaagtcctttggttcagacttcaaggtcccggttccccccattggtcaccgaaacgcgggggcagaatacggccgtacctggctgcaggctagttagctaccggggacgtcacctccaaaaccgggtcctgagtgcaatgccagatggaaccgagcgctcgaggctccgagagcgtaccgctaccctcgaaagactctctcgaccctctacaacacacactttccggcagtcagacaccccaagaaaatcatcattgacacagatggaatttgccgcacacacatggactggacagagcattctcaccggttcacagtacgtaccaaagagcttccagcgcaccacacttaccttcaaaaggcgattccaggtgaccagctag

SEQ ID NO: 29702 - DNA, 1449 bp, Artificial Sequence
  Description of Artificial Sequence: Synthetic coding sequence
atgctgtttgagggaaaagtcaatccccagactcagtccctgctggcagaatgcggcgagtggacccgcagatcgctgcaccttcgggtcctggggcgtcaactgattctgccaactgacaaaggcgtacagcactttcaaggatccacacccgctagtgcagtccaccggcctcctctttccgcctgtgggcactcctccaacattcgggagctgtgtatctccgggtcgcagattgtgcccgccgcgctgagcgcttcggcactgcccggaccagacgatacaggagtcgcagaccttacagccagatcctctttggaggaggaagtctatcatgtggacggaaagatcgaggaatactttgcattcgacaggaaagaggacgacgatgagtgcctggagcagaagcccgctcagcctgggaggaagtggaggaagttgggcttaccccctgttagccctagagattgcgtcaaagacgcagtcgcggcagaggttttcgatcacgtgtggacaaacatggtggaactgctcgaggagctcattcggaagcactgggaaacaaccctaacggaggggaagaaacagcgtgagacattgaaagttgctggcaatcgctttccacatgtgctcgtcccccatgcccacgccgacggggcttcaggtccaccatccgggcacgccgaggcccatggcatctcccttgcctctcgccttaatccaccacagatccaccacttttcgtcctctttttattccgatatgaacggcgttatgacaattcaagctaagcctctccagcgacggcctgcatactttgctgaccgaacgcagaacgagaaggaggataaagccagcggcggcggcgctggtgctctctcaagtgccccacatcggttaggtagggcatcagatacccacggcctgtcacctagtgccaaaaaaacccctgtcccttggcggctgcctagcctcgcctctgattcccagcgtctgaagacaccaaacatttacagcgatgaagtgctgcgtggaaccaagctgccaaccggtgtggatcacatggcctctcctctggtccagacttcccgctcacgttttccccctctggttacggaaacccgaggccaaaataccgcagtgccaggatgtcggctggtgagctaccgcggtagacacctgcagaaccgagtgctctcagctatgccggacggtacagagaggtcacgcctgagagaaaggaccgctacattggaacgtctgagcaggcccagcaccacccatacgttccgtcagtccgacacgccccgtaagtcatctctcacccagatggagttcgctgctcatacatggaccgggcagtccatcctgaccggttcacagtacgtaccgaagagttttcagcggacaacgctgactttcaagagaagattccaggtgacctcttag

SEQ ID NO: 29703 - DNA, 186 bp, Artificial Sequence
  Description of Artificial Sequence: Synthetic coding sequence
atgttgttcgaaggtaaggtgaatccacagactcagagcctgctcgctgagtgtggggaatggacccgccgctcattgcatctcagagtgctggggcgccaacttattctgccaacagacaagggggtacagcattttcagggcagcactccagcgtccgccgtgcaccgcccacctctgtcttag

SEQ ID NO: 29704 - DNA, 1749 bp, Artificial Sequence
  Description of Artificial Sequence: Synthetic coding sequence
atgatctctagatacaccaggaaggcggtgccgcagagtttggagctcaaggggataaccaagcatgctctcaaccatcaccctccccccgagaagctggaggagatttctccaacttcagatagccatgagaaggatacatcaagccagagcaaatcggatattacccgagagtcctcttttacatccgcagatacaggcaacagcttatctgcattccctagctacacaggcgctggcatttccacggagggttcctccgacttttcctggggctacggggagctcgatcagaacgccacagaaaaagtgcagacgatgtttaccgcaatagacgagctgctgtatgagcaaaaactcagcgtgcacactaagtccctccaagaggagtgtcagcaatggactgcctccttcccccacttgcgaattctcggcagacagatcatcacaccaagcgaaggttacaggctgtatccaagatctccctccgctgtctcggcttcttacgagacaaccctcagccaggaacgagactctacaattttcggtataaggggaaaaaagctgcacttttcctcctcttacgcccataaggccagtagtattgctaaaagtagctcgttctgctccatggaacgggacgaggaggactccatcatcgtctccgaaggcatcatagaggagtacctggccttcgatcatatagacatcgaggagggctttcacggaaaaaaatccgaagccgcgacagaaaaacagaagctgggctatccacctattgcaccgttctattgcatgaaagaggacgttttagcttatgtgttcgacagtgtgtggtgcaaggtggtcagttgtatggagcagctgactcgaagccactgggagggattcgcttctgacgacgaatctaacgtggctgtaacaaggcccgattccgagtcatcctgtgtactgagtgagctccacccactggtgctgccgagggttcctcagtccaaagtgttgtacattacctcaaaccccatgtccctgtgccaggcctctcggcaccagccaaacgtcaatgatctcctagtacacgggatgcctcttcagcccagaaacctgtctctgatggacaagttgctggatctcgatgacaagcttctgatgagaccagggtcctcaaccattctctctaccaggaactggcctaacagggccgtggagttttctacaagctccctgtcctatactgtgcagtccacccggcgacgaaatccacccccacgcactttacaccctattagtacctcacatagctgcgcggaaacccctcgctctgttgaggagatcctgagaggtgcccgcgttcccgttgccccagatagcctgtcctccccgtccccaacccctctcagtcgaaacaatctattacctcccattggaaccgccgaagtggagcacgtctccaccgtcgggccccaacggcagatgaaaccccacggcgatagcagtcgtgctcagtccgccgtggtggatgaaccgaattaccaacagccccaggaacgtcttctgctgcccgatttttttccaagacccaatactacacaatccttcctgctggacacccagtatcgccgatcatgcgctgtggaatacccacatcaggctaggccagggcgtggctcagccggcccacaactgcacgggtctacaaagtcccagagtgggggcagaccagtcagccggacgagacagggtccatag

SEQ ID NO: 29705 - DNA, 1410 bp, Artificial Sequence
  Description of Artificial Sequence: Synthetic coding sequence
tagttcacctccgctgatacaggaaactctctctccgctttcccctcttacactggagccggaatatccacagaggggtcttctgatttctcatggggttacggggaactggatcagaatgcaaccgagaaggtgcaaactatgttcacggcgatagacgagttgctctacgaacagaaactgtccgtgcacacaaagtcactacaggaggagtgccagcaatggaccgcaagttttccccatctgcgcatcctgggccgtcagattatcacccctagcgagggatataggctctatccccggtccccctctgccgtgtctgcaagctatgagacaaccctaagccaagagcgggactcgacaatattcggtatccggggaaagaagctgcactttagcagcagctacgcgcataaggctagctccattgccaagagtagctctttttgcagcatggaaagagacgaggaggactccatcattgtctcagagggaataatcgaggaatatctagctttcgatcacattgacatcgaagagggatttcacggaaagaagagtgaggcagccacagagaaacagaagctgggatacccacccatagcccctttttactgcatgaaggaggatgtccttgcatatgtattcgactctgtatggtgcaaagtagtgtcatgtatggagcaactgaccaggtcccactgggaggggttcgcttcagacgatgagagtaacgttgcagttacacggcctgactccgagtcgtcatgtgtgctgagcgagcttcaccccctggtgctgccaagggtgcctcagtcaaaaatgtccctgtgccaggcgagcaggcatcaacccaacgtcaacgacttgctggtgcacggaatgcccctgcagcctagaaatctctcactgatggacaagctgttggatttggatgacaaattgcttatgcgtccgggcagttccacaatcttatccacccggaactggccgaaccgggcggtggagttcagcacttcctcactttcttataccgtccagtcaacccgccggcgcaacccacctcctagaacattgcaccctatttcgacatcccactcatgtgctgaaacccctcgatcagttgaggaaatcctgcgcggtgctcgagtccctgtcgctcccgacagcttgtctagcccgtccccgacaccattatctcggaataatctgctccctcccatcggaaccgcagaggttgaacatgtatctaccgtcggtcctcaacggcaaatgaaacctcacggagacagcagtagggcacaatccgctgtggtggacgaaccaaattatcagcagccacaggaaaggctgctgctgccagactttttccccaggcccaacaccacccagagcttcctcgtggagtag

SEQ ID NO: 29706 - DNA, 993 bp, Artificial Sequence
  Description of Artificial Sequence: Synthetic coding sequence
atggagagagatgaagaagacagcatcatcgttagcgagggcatcatagaagagtatctagcattcgaccatattgacatcgaggagggctttcatggaaagaaaagcgaagcggccaccgagaagcagaaattggggtacccccccattgcaccattttattgcatgaaggaggacgtacttgcctatgttttcgattctgtgtggtgcaaagtggtgtcctgtatggaacagctgacacgaagccattgggaaggctttgcttctgacgatgaatcaaacgtagcggtgacaagacctgactccgaatccagctgcgtcctgagcgaactacatcctttggtgcttccaagggtgccacagtccaaggtactgtacatcacctctaaccccatgagtctctgtcaggcatctagacatcagcccaatgtgaacgaccttctggtccatggcatgccgctgcagcctaggaatctgagtctcatggataaattgctcgacctggacgacaagctgctgatgcgacccgggagttccacaatcctcagcacacgcaactggcccaatcgcgcggtggagttttctacatccagcctgtcatatactgtccagagcacaaggcgtaggaacccacctccaagaactctgcaccccatttcgacctctcattcttgtgctgagaccccacgttcagtcgaagagattctgcgcggcgcacgggtgccggtggcccccgactctctgagtagtccatcgcctactcccctctcccgcaataacctcctaccgcctataggtacagcagaagtggaacacgttagcacggttggaccccaacgtcagatgctagacacgcagtacaggcggtcctgcgctgtggagtaccctcaccaggcaaggccaggtagaggaagtgctggaccacagcttcacggatctacaaagtcccagagtggggggcggcctgtgtctagaacgcgacagggaccatag

SEQ ID NO: 29707 - DNA, 1008 bp, Artificial Sequence
  Description of Artificial Sequence: Synthetic coding sequence
tccagcttctgtagcatggaacgcgacgaggaagacagtatcatcgtctcagaaggaatcatcgaggagtacttggcctttgaccatatcgacatagaggaaggctttcacggaaagaaatccgaagccgcaaccgaaaagcagaagttggggtaccctccgattgctccattttactgcatgaaagaggacgtgctcgcatacgtgtttgattccgtgtggtgtaaggtggtttcctgcatggagcagctcacaaggagtcactgggagggcttcgccagcgacgacgaaagcaatgtggccgtgactcgtccggactcagagtccagttgcgttctgtcggaactccaccccttggtgctgccgagagttccccagtcaaaggtgctgtatatcacctctaacccaatgagtctgtgccaagcaagcaggcaccagccaaacgtaaacgaccttctggtgcatgggatgccactgcagccgaggaatttaagtttgatggacaagttgctggacttggacgacaaactgctgatgaggcctggctcttcaaccattctctcaacccgcaattggccaaacagagccgtggagttctctacctcttccctgtcttatactgttcagagtacccgccgccgcaatcccccacccaggacactgcatcccatttctacctcacacagttgcgcagagaccccacgatccgtagaggagattttacggggggcacgggttccagtagctcccgatagcttaagctcaccatccccaacacctctgtctagaaataacctgctgcccccaatcggaacagccgaggtggaacatgtttcaaccgttggccctcagcgccaaatgctagacacccagtatagaagaagctgcgccgtcgagtatcctcatcaggcaaggccaggcaggggttccgctgggccccaactccacggttctacaaaatctcagtccggcggaagaccagtttcccgcacacggcagggaccctag

SEQ ID NO: 29708 - DNA, 831 bp, Artificial Sequence
  Description of Artificial Sequence: Synthetic coding sequence
atggcagcttcagccggaggaccgggatcatggtctgagaacatactagaatacttcctgagaaattctcagatcaccgccgaagacggggccgagataacctggtatcacgccgccaaccataaagctcaaaccaacgaagctctcaagtcaacagcccacatgattgaggcagatgttctgctgccatcagacgggagcgagcacagtcaacctattatggcccatccacccgaaactaatagcgacaacacgcttcaggaatggttaaccgaagtcatgaagagtaacaagggcatcaaactcgattttaagtcccttgctgttgtggagccttctatgatgcttttggagaatgtgaagcgccacctgaaaagacccgtgtggattaatgcggatatcctgccgggaccaaacggcaatagcaaagtgatagatgccaagcccttcctcgatacggttatttcattttttcctgatgtgacattctcattagggtggaccacaggctggcacccagaaaaagtcaatgaaggctactcttggaccatggtgaaagagatggagtacatttgtaacgaactctctcaacctgtcactttccccgtgcgcgcggccctcgtaaggcagtcgtgtagccagttactatggcttcttaaaaaaagcaataggtacagcctgaccatctggacaggcaagaacgataactactctgtagaggacctcctctacatcagagatcacttcgataaaaagcaggtcttttacgatattctcgagccccaaaatcatgaatttaagcaagctatcggaatcaaagtcaacttatag

SEQ ID NO: 29709 - DNA, 435 bp, Artificial Sequence
  Description of Artificial Sequence: Synthetic coding sequence
atggtagataaggacactgaacgggacattgagatgaagcggcagctgagacgcctcagggagctgcatctgtacagcacctggaaaaaataccaagaagccatgaaaacttcactaggagtcccccagcgcggcgacctggaagatcttgaggaacatgtcccagggcagaccgtgtccgaagaagccaccggcgtgcatatgatgcaggttgacccagccacactcgctaaacagttggaggatagcacgattaccggttctcaccagcaaatgtctgccagcccaagctccgctcccgccgaagaggccaccgagaaaaccaaagtggaggaggaggtcaagacccgcaagccaaaaaagaagacccggaagcccagtaaaaagtctcggtggaacgtccttaaatgctgggacatcttcaacatcttttag

SEQ ID NO: 29710 - DNA, 1164 bp, Artificial Sequence
  Description of Artificial Sequence: Synthetic coding sequence
atggggtgcgtgtatagctgctgcctggaagtgtgttgtggagaggacgagattgtttatccaaggatgccgggcgagtcaactgtgtgtcacagggagagagaaaaaccaatcacctaccactggtaccactggcatcctggacatatttatcctcggatcgctagtatggaggattatgacgaagacctggtccaggaggcaagcagcgaagatgtgctgggggttcacatggtcgacaaggacacagagagggatatcgagatgaagcggcagctcaggaggctgagagagctgcacctgtattcaacctggaaaaagtatcaggaagccatgaagaccagtcttggcgttccacagtgtgaaagagatgaaggctctttgggcaagccgttgtgtccacctgagatcttgagcgaaacgctccctgggtctgtgaagaaaagagtgtgtttccccagtgaagatcatcttgaagagtttatcgcggagcacctccccgaggcttctaatcaaagccttctgactgttgcccacagcgagcgcggtattagtttttcctgcgaccttgaagacctggaggaacacgggcctggtcagactgtgtccgaggaggccacagaggtccacaccatggagggcgaccccgacaccctagcagagttccttatacgtgatgtcttacaagagctgtcctcatacaatggcgaagaggaggaccccgaagaggtgaagacatctttgggcgtgcctcaacgaggagacctcgaggaccttgaagaacatgtccccgggcagacagtgtccgaggaggccaccggcgttcacatgatgcaagtggatcccgctaccctggctaagtccgacctggaagatctggaagagcatgtgcccgaacagactgtgtccgaggaagccacgggggtccatatgatgcaagttgaccctgctacacttgccaaacaattggaggattccacaatcaccgggtcgcatcagcagatgagcgcgtcccccagttccgcgcccgccgaggaggccaccgaaaagactaaagttgaagaggaagtgaaaacaaggaaacctaaaaaaaagacgaggaaaccctctaagaagtcccgatggaatgtactgaaatgctgggacatcttcaacatcttctag

SEQ ID NO: 29711 - DNA, 1164 bp, Artificial Sequence
  Description of Artificial Sequence: Synthetic coding sequence
atgggctgcgcctattcctgctgcctggaggtgtgttgtggggaagacgagatcgtgtatcctagaatgccgggcgagagtaccgtgtgccaccgcgagcgggaaaagcctataacttatcactggtaccactggcatcccgggcacatttatccccgtgttgcctccatggaggattatgacgaagatctcgtgcaggaggcttcctccgaggatgtgctaggtgtgcatatggtggacaaggataccgaacgggatatcgagatgaagcgccagcttcgccgactgcgggaactacacctatattctacttggaagaagtatcaagaggccatgaagacgagcctgggggtgcctcaatgcgaacgagacgaaggctccctgggaaagccgctttgcccccctgagatcctcagtgagacgctccctggatcggttaaaaagcgcgtctgtttcccatcagaagaccacctggaagaattcattgcagagcatctacctgaggcctcaaatcagagtctgttgacagtggctcacgcagacactggcatccagactaacggagacctcgaggatttggaagagcacggacccgggcaaacagtgagcgaggaggcaactgaggtgcatatgatggaaggtgatcccgatacccttgcagagttgctgatccgcgacgtgttacaagagcttagctcatacaacggagaggaggaggaccccgaagaggtgaaaacatccctgggtgtgccccagagaggagacctggaggatttggaggagcatgttcccggacagactgtgagtgaggaggctacaggtgtgcacatgatgcaagtcgatcctgcaacacccgccaaatccgacctggaagacctggaggaacacgtgccaggtcagaccgtctcggaggaagccactggcgtgcacatgatgcaggtcgatcccgccaccctggccaaacagttggaagatagcactataaccggatcacatcagcagatgagcgcctccccatcctccgcacccgcagaggaggctactgaaaaaactaaagtcgaagaggaagtcaagactcgtaagcctaagaaaaaaactaggaagccaagcaagaaaagcagatggaacgtactgaagtgctgggatatcttcaatatcttttag

SEQ ID NO: 29712 - DNA, 933 bp, Artificial Sequence
  Description of Artificial Sequence: Synthetic coding sequence
atggtcgataaagacacagagcgcgacattgagatgaagcggcaacttaggagactgagggaattgcatttgtacagcacctggaaaaagtaccaggaggcaatgaagacaagcctcggagttccccagtgcgagcgcgatgagggctccctgggtaagcccctttgcccgcccgagatcttgtcggagactcttccgggaagcgtgaaaaaaagagtgtgttttcccagcgaggaccatttggaggaattcatcgccgagcacttacctgaagctagcaaccagtctctactcactgtcgcacatgctgacaccggcattcagacaaatggggacctggaagatctagaagaacatgggcctggtcagaccgtttcggaggaggctacagaggtccatatgatggagggggacccagacacgctggccgagctgctgatacgagacgtcctgcaggagctatcttcctataacggcgaagaggaggatcctgaggaagtgaagacttctctcggcgttccccagaggggggatctggaggacttggaagaacatgtgccagggcagactgtatccgaggaggcaaccggggtccacatgatgcaggtagatcccgccacaccagccaaaagcgacttggaagacctggaagagcacgtccccgggcagacagtgtcagaggaggctactggggtgcatatgatgcaggtagatcctgctaccctagccaagcaattggaggactcgacgattaccggttcacaccagcaaatgagcgcaagtccaagcagtgctcccgctgaggaggcgactgagaagactaaggtggaggaggaggtcaaaactcgcaagcctaaaaaaaaaactcgaaagcccagcaaaaaatcgaggtggaatgtgttaaagtgctgggacattttcaatattttttag

SEQ ID NO: 29713 - DNA, 933 bp, Artificial Sequence
  Description of Artificial Sequence: Synthetic coding sequence
atggtggacaaagatacggagagagatatcgagatgaagaggcagctgcggcgcctacgcgagttacacctttactctacatggaaaaagtaccaggaggcaatgaaaacctctctcggagtgccccagtgtgaacgggatgaaggcagcctgggcaagccactctgtcccccagaaatcctaagcgaaacacttccaggctcagttaaaaaaagagtctgtttcccgagtgaggatcatttggaagaattcatcgcagaacacttacccgaggcttccaaccagtctctcctcactgtagctcacgcagacactggaattcagacgaatggcgacctggaagatctggaagagcatgggcctggacaaaccgtcagcgaggaggctactgaagtccacatgatggaaggagatcccgacactttggctgagctgcttattcgcgatgtcctgcaggagctttcatcttacaatggggaggaagaagatccagaggaagtaaaaacttcgttgggcgtgcctcagcggggggatctagaggacctagaggaacatgttcccggtcagacagtttcagaggaggcaaccggagtgcacatgatgcaggtggacccagcgacaccagcaaagagcgacctggaggatcttgaagagcacgtcccagggcagacggttagcgaggaggccactggagtacacatgatgcaagtagaccctgctacccttgctaagcagcttgaagactcaacgatcaccggaagccaccagcagatgagcgcaagtccttcaagcgctccagcagaggaggccaccgaaaaaacaaaggttgaagaggaggtcaaaacgagaaagcccaagaaaaagacacggaaaccgtccaaaaaatcacgttggaacgtgctgaaatgttgggatatctttaacattttttag

SEQ ID NO: 29714 - DNA, 345 bp, Artificial Sequence
  Description of Artificial Sequence: Synthetic coding sequence
atggttgacaaggatacagaaagagatatagagatgaagcggcaattgaggcgactgcgagaactgcacctatacagcacctggaagaagtaccaggaggctatgaagacctccctgggcgttccacagcgaggcgacctcgaggatctcgaggagcacctgccaggccagacggtttccgaagaggctactggagtgcacatgatgcaggtagatcccgcaactcctgcaaagaagctagaggattccactattaccggatcccaccagcagatgtccgcctccccctcttccgcccccgcagaagaagccacagaaaaaactaaagtcgaggaagaggtgtag

SEQ ID NO: 29715 - DNA, 120 bp, Artificial Sequence
  Description of Artificial Sequence: Synthetic coding sequence
atggtcgacaaggacactgagagagatatagagatgaagcgacagcttagacggctgagagagctgcacttgtattcgacctggaaaaaataccaggaagctatgaaaacctccctatag

SEQ ID NO: 29716 - DNA, 435 bp, Artificial Sequence
  Description of Artificial Sequence: Synthetic coding sequence
atggtggataaagacactgaacgtgatatagagatgaaaaggcagcttcgaaggctgcgtgagctgcacctctattccacatggaagaagtaccaggaggcaatgaagacaagcctgggggtcccacaacgaggcgacctggaggatcttgaagaacatctgccaggccagactgtgtccgaagaagccaccggcgtgcatatgatgcaggtggacccagctacccctgctaaaaagctcgaggattctactataacggggagtcatcaacagatgtccgcatctcccagctccgccccagcggaggaagccacagaaaaaactaaagtggaggaggaagtaaaaacacggaagcctaagaagaaaaccaggaagccttcaaaaaagtctcgctggaatgtcctgaagtgttgggacatctttaatatattttag

SEQ ID NO: 29717 - DNA, 1425 bp, Artificial Sequence
  Description of Artificial Sequence: Synthetic coding sequence
atgaaaacaaagtgtatttgtgagctttgttcctgtgggcggcatcactgccctcatttgccaacgaaaatttacgataagaccgagaagccctgtcttctgtcagagtatacagagaattatccattttatcactcatacctcccacgggagagcttcaagccacggcgcgaataccaaaagggtccaattcctatggagggattaacaacatcccgaagggactttggacctcacaaggtggcccctgttaaggtccaccagtatgatcagttcgtcccaagcgaagaaaacatggatctgcttactacatataagaaggactacaatccatacccagtgtgccgtgtggaccctattaaacctagggacagcaaatacccttgttcagataagatggaatgtctgccgacatataaggccgactatctgccttggaaccagccaagaagggaacctctgaggctggaacataaatatcagccggctagtgtcaggttcgataaccggacaacccaccaggatgattacccaatcaaaggacttgtgaagacaatctcatgtaaacctctggccatgccaaagctctgcaacatccccttagaggatgtgaccaactataagatgagctatgtcgcacatcccgttgagaaacgttttgttcatgaggcagaaaaattccgaccgtgtgaaatacctttcgagagtctcaccacccaaaagcagagctatagaggtcttatgggagaacccgccaaatccctgaaacccctggcgaggccgccaggactggatatgcctttctgtaacaccacagagttcagggacaagtatcaagcgtggccaatgccgcgaatgttttcgaaggcacctattacctatgttcctccggaagataggatggatctgctgaccactgtgcaggcccactacacatgcccgaaaggcgctcctgcccagagctgtaggcccgcactgcagattaagaagtgcggtcggtttgaggggtcatctaccaccaaagacgattacaagcagtggtcttcaatgcgcactgaaccagtgaaacccgtgccacagctagacctgcccacagaacctctcgactgtctgactaccactagggcccactatgtgccccacctccctatcaacacgaaaagttgcaaaccccactggtcagggcctcgtggaaatgtgcctgtcgaatcccagaccacctacacaataagtttcaccccaaaagagatgggacgctgccttgcctcgtaccccgaaccacctggttatacttttgaggaggtggatgccttggggcaccggatttataaacctgtcagccaggcaggcagccagcagtcctctcatctgtctgttgatgatagtgagaatcccaaccagcgtgaactagaagtcctggcctag

SEQ ID NO: 29718 - DNA, 849 bp, Artificial Sequence
  Description of Artificial Sequence: Synthetic coding sequence
atgcccaaactttgcaatatacccctggaggacgttacgaattacaagatgtcctatgtagcccacccggtggaaaagaggtttgtgcatgaggccgaaaaatttcgtccatgcgagatcccgttcgagtctctaactacacagaaacagtcttatagagggctcatgggcgagccagctaagagcctcaagcctcttgcgagaccccctgggctcgatatgcctttctgcaatactacggagtttcgggacaaataccaggcttggccaatgcctcgcatgttttccaaggcccccatcacgtatgtcccccctgaagatcgcatggatctgctgactaccgtgcaggcccattatacatgccctaagggagccccggcccaatcctgccggccagctctgcagataaagaagtgcggccgctttgaaggtagctccaccacaaaggacgactacaagcagtggagttctatgcgcactgagcccgtgaaacccgtacctcaacttgacctacccactgaacccctcgattgcctgaccacgacgagggcacactatgtgccacacctgcctatcaacacaaaaagctgcaagcctcactggagcggcccaagaggcaacgttcctgtggaaagccagaccacttacaccatcagctttacacctaaggagatggggagatgtctagcatcctaccccgagccgcccggttacaccttcgaggaggttgacgccttgggccatcgaatctataagccagtgagccaggccggctcgcaacagagtagccacctgagtgtcgatgactctgagaacccaaaccaaagggaattggaagtgctggcctag

SEQ ID NO: 29719 - DNA, 1197 bp, Artificial Sequence
  Description of Artificial Sequence: Synthetic coding sequence
atgggggcaaaaagcatgagatcctggtgcctctgccaaatttgctcgtgcggttcggattactgtccctacgagattgtcaaacaacccagacatgttcctgaagaatacaaaccaaaacaaggaaagatagaccttgggacaacctacaaaagggacctaaatagctataaggtccagcctgtagcgatagtccgtcctctggagcgccaggtaaaaaagggaaagttggacacggttcctacatacaaagacgattaccgcgcttgggatctgcataaaagcgagttgtacaaacccgagcaaacatatcacccacctactgttaagtttggaaattctacaacttttcaggacgactttgttccccaggaaatcaaacctcgccagagtttcaagccctcatcggttgtcaaaaggagcacggcaccatttaacggcatcaccagccaccgcttggattacatccctcaccagctggagctcaaatttgagcgacccaaggaggtgtacaagccgacagatcagagatttgaggacctcacgacacatagatgtgatttccagggcctgatcggcgagactgctaagctatgccgacctgttcatacccgggtgacgcagaatgcactgttcgaaggtagcaccgagtttcgggaaagcttccaaccgtgggagatcccacccccagaggttaaaaaagtgcctgaatatgtccctcccacaggttcgatgcttttgaatagcacatctcacctagattatgtcccttatcaagccaaccacgtggtgcccatccgacccgtcagccagaagcggagcaataacttcccatttcaagggaagagcattatgaaagaggatttcccagcttgggagagctgccgacagggacttatcaaaaaacagcagcagattcccaacccatctggaaagttcgacgggctgagcaccttcagatctcactacgtaccacatgaattgattcccactgaaagttgcaagcctctcaatatcgcctttaaatccagtgtgccatttgatgatgtgacaatgtactctgtggagtacaccccaaagaggcaggaaatttgtccagcgtcgtatccctcccctcccggatacatttttgataataccaattcacagggtcataagttctttagaaaaatcatccctgctgtgaaagccttctag

SEQ ID NO: 29720 - DNA, 1152 bp, Artificial Sequence
  Description of Artificial Sequence: Synthetic coding sequence
atgccttggtccgactactgtccttacgaaattgtgaaacagccccggcatgtgccagaggagtataaacctaagcaaggaaaaattgacctcggcactacatacaaacgagatctaaattcctataaggttcagccagtagctatcgtccgtccactagaaagacaagtgaagaagggcaagcttgataccgtccccacttataaagacgactaccgagcatgggatctgcataaatccgaattatataaaccagagcaaacttatcacccccctacggtgaagtttgggaactctacaaccttccaggacgattttgtaccacaggagatcaagcctcgtcaatcatttaagccttcttcggtggtcaagcggtccactgcacctttcaacgggattacatcccatcgcctcgattatattccacaccagttggaactgaaatttgagaggccaaaggaagtgtacaaacctactgaccagagattcgaagatcttactacacacaggtgtgattttcaaggcttaattggggagactgctaagttgtgccgtcctgtgcacacgcgggtgacacagaacgcgctgttcgagggcagcactgaattccgagaatcctttcagccttgggagattccccccccagaagttaaaaaagttcccgaatatgtgccgcctaccggaagcatgctgttgaatagcaccagtcacctagattacgtgccttaccaggctaatcacgtcgttcctatcaggcccgtgtcacagaagaggagcaacaacttcccattccaaggaaagagcattatgaaagaagattttcctgcttgggaatcttgtagacaaggtctcataaaaaagcaacagcaaatccccaatccctctgggaagtttgacggcttgtcaacattccgaagtcactacgttccacacgagctcatccccacggaaagttgtaagccgctgaatattgccttcaaatctagtgtgccatttgatgacgtgaccatgtatagcgtcgagtacactcctaaaagacaagagatttgtccagccagctacccctcaccccctggctacattttcgataatacaaactcccagggccacaagttctttcgtaagataatcccagccgtcaaagccttctag

SEQ ID NO: 29721 - DNA, 1152 bp, Artificial Sequence
  Description of Artificial Sequence: Synthetic coding sequence
atgggtcctctgtttacaactatccccggcgcccacagtggccctatgaggccccttccaaagaagcatgtggagcccatggctgtgagacagctgttattaggcaattctaccatgataaggcacacttgccctatgagcgttcctcttagtagacaggtcaaggaagtcgccgcccaaaagccatctgaggacatctataagaactggcagcaacagcagcaacagcagcagcagcaacagcaacagcagctcgacctcctattccatcagcggatacagatcagcctttggccgcgtaaacaaaagaggaggaagactgaacagcactcccatcccttcgttaaaaaagccttccggttctccgcaggtagcggatgcggccggccctccagcaataagatgctacggagcatgggaggcgggcagagaccaacaggacttggttccgaatttttccggctattgcacgatctacacctgctggcctttgccatgaagagaatctggattcaccgaagaggagaggctacagctcggcccagggctcctgaacacccagccccacctgctaccgcagttaggggccgagacgctgcgtcccagaacctaaaacgaagacccggctctggcacagacggcctccggctccaaggggccgagcccagtcggctcttaagaacttacgcaggaggcgctgtcatccccaccggtacacccgaacgggcccaaccaccaccacctcaggatcctcttggaagaagaaggtggttgagtagaaacacatgggggccatggccggggacgactcagcccccaagcccccagctgctgaggaatgattggggcagttgcggctttatggtgcccgaagccgcacggggaaaggtcttccaggatagtcaggagggggcacacatccgtcgcgagacagtgtccaaatctgtctgcgccgagccatggcgccatcagcgggcacgcgaccccgctcctaccaatttccctctgagatgtcagaaacaaagaggcgcctccgccagcagcgggcagcacgaggggcgagttaacctcgttttcttcatcggcagcccaaccgttattgctgtgcctgacctgcagtgtcccacaaagtatagcggaatgctgtactag

SEQ ID NO: 29722 - DNA, 954 bp, Artificial Sequence
  Description of Artificial Sequence: Synthetic coding sequence
atgttccaagccgcggagcggccccaggaatgggccatggaggggccccgcgacggattaaaaaaggagagactgctggatgatagacacgactccggcctcgacagcatgaaggatgaggagtacgagcaaatggtcaaggaacttcaggaaatacgtctcgagccacaagaggtacccagaggtagtgaaccatggaaacaacaactcacagaggatggagattcattcttgcacttggccatcattcatgaggagaaggcactcacaatggaggtgattagacaagtcaaaggcgacctggcattcctgaattttcagaataacctgcagcagactcccctccacctggccgtcattactaatcagcctgaaatcgcagaggccttgctgggcgcagggtgcgacccagagctgcgggactttaggggaaatacgccactccacttagcttgtgagcagggatgcttggcatcagtgggtgtcttaactcagtcttgcaccacgccccacctgcacagtatcctgaaagctaccaactacaatggacatacatgtctgcacttagctagcattcatggctacctggggatcgtagagctccttgtgtccctcggagcagacgtgaacgcgcaggaaccatgcaacggaaggaccgcactgcatcttgcggtggatctgcagaatccagatttggtttcactcctcctgaaatgtggcgcggatgtgaaccgggtgacctatcagggctactcaccataccagctgacttgggggaggccgtcaacaaggatccagcagcaattgggacagctcactctggaaaatttacagatgctgcctgaatcagaagatgaagaatcctacgatacagagtcagagtttacggagttcacggaggacgaactgccttatgatgactgtgttttcggcggacagcgcctcactctgtag

SEQ ID NO: 29723 - DNA, 627 bp, Artificial Sequence
  Description of Artificial Sequence: Synthetic coding sequence
atgggggaggtagaaatctctgccctggcatacgtaaagatgtgcctgcacgcagctcggtacccgcacgctgctgtcaacggactatttctggcacctgccccaaggtctggtgagtgtctctgtttaactgactgcgtgcctctgtttcactcccacctggccttatccgtgatgctcgaggtagcattgaatcaggtggacgtgtggggggcccaggccggcttggttgttgccgggtattatcatgcaaacgccgcagtcaatgaccagtctccaggtccattggcactcaaaattgccggcagaattgctgagttctttccagacgcagtgctgataatgttagacaaccagaagctggtgcctcaaccgcgcgtgccccccgtgatcgtgctcgagaatcagggattacggtgggtacccaaggataagaacttggtaatgtggagggattgggaggagagtaggcaaatggtcggtgcactgctcgaggacagagcccatcagcatctggtggactttgattgccatcttgatgacattcgacaggactggacaaaccagagactcaatactcagattactcagtgggtgggtccaacaaacggaaatggcaacgcatag

SEQ ID NO: 29724 - DNA, 483 bp, Artificial Sequence
  Description of Artificial Sequence: Synthetic coding sequence
atgtctgaggccagcagactgtgctccggctattactcactgaatcaaagcttcgtcgagccctttcagtgtcccagacgtggagaaggcgcagcactgcaatattgctgtggatttgccgacctgaagtattgttgttcggaacccggatcatattttccatacaaacactcctacatgtggtccctgagcatcggggccctcattggtcttggcatagcagccctggtgctgctcgcgtttgtaatctccgtttgtgtgttgtgctatttatttctgtacaccaagccacagaggttggatacaggtctcaaactccagcacctagaggcctcttcgacgcaggagggcaagagcaatggtaagacgaaagcactgaactctaacgccgcaagcaacgcaacgaacgaaacatattatgaagccgatgatatcattcaggaaaagaccatggatgcgacacagatccatattgcttattag

SEQ ID NO: 29725 - DNA, 3123 bp, Artificial Sequence
  Description of Artificial Sequence: Synthetic coding sequence
atgatgagttcagtatccacagagagcaagttacaacaggctgtgtccctgcaaggggtggaccctgagacctgcatgattgtgtttaagaatcactgggcccaggtggtgaaaattctggagaaacacgaccccctgaagaacacacaggccaaatacgggagtataccccctgacgaggcatctgcagtccagaattacgtcgagcatatgctctttctcctgatcgaagaacaggccaaagacgccgcaatgggcccaatcctggagttcgtggtgagtgagaacattatggagaagctctttctgtggtccttgcggcgggaattcaccgatgagactaagatcgagcagctcaagatgtatgagatgctggtgacccaaagccaccagccattacttcaccacaaacctattctcaaacccctgatgatgctcttgagttcatgctcgggtacgacaacccccacagtcgaggaaaaacttgtggtccttcttaaccagctgtgctctatcctggccaaagatcctagcattctggaactgttcttccatacttccgaagatcagggggccgccaattttctgatctttagtttgctcatcccatttatccatcgcgaaggcagtgttggtcagcaggcacgcgacgctctcctgtttataatgagcctgtcagctgagaatacaatggtggcccaccacattgtcgaaaatacctacttttgtcctgtgctggcgaccggccttagcggtctttattctagccttccaactaagctcgaagagaagggggaggagtggcattgtttgctcaaggacgattggctcctgcttcctagtctggttcagtttatgaatagtttagaattttgtaacgctgtgattcaagtggcccacccacttatcagaaaccaattggtgaattatatttataatggctttctggtacccgtgttagcccccgcattgcacaaggttactgtggaggaagtcatgacgaccaccgcctaccttgatctgttccttaggagtatttctgagcctgctctacttgaaatctttctgagattcattctgcttcatcagcacgagaatgtgcacatcctggacactctgacgtccagaataaacacaccatttaggctctgtgtggtgtctttggctctcttccgcaccctgatagggctgcactgcgaggacgttatgctgcagctggttttaagataccttattccatgcaaccatatgatgctctctcaacgctgggccgtaaaagaacgggactgttactccgtgtcagccgccaagcttctcgccctgacacccgtatgttgcagcagcggtatcactctgacactcggcaaccaagagagggactacatcttgtggtcaaagtgtatgcacgataccagcggcccggtcgaacgaccctttcccgaggccttctctgaaagcgcttgcatcgtggaatacggtaaggccctcgatataagttacctgcaatacctttgggaagcacacaccaatatcctgcgatgcatgagggactgcagggtatggagtgcattatatgatggcgattctcccgaccctgagatgttcctacaaagcttgacagaagagggctctgtgtcgtctgcttgccctgtattcggcctcccccagcaattgcccagaaaaacagggcctcagcttgctcctaggaaggataagagccagactgaactcgaatgggacgatagttatgataccggcattagttccggggccgacgtggggtccccaggcccatatgacgacctggaagtgagcggccctcctgcccctattgaccctcctaagcacatccaggaaatgaagaaaaacgccctcctcctcttcaaaggctcatatatagaagagagcgacttccaggatgacgtgatggtctatcgcctctgtgcagaaaaggacagcgaagatatgaaagattcccaagaggaagcagctaggccccccgctgaagcacaggctgaagtccagagcgtgcccatcaataacggacctctgttgagcacccagccggaaaccgactccgaagaagagtggaatagggataactctgacccttttcattcagaaccgaaggaacctaaacaggagagggaacccgaggcagccccagagtcaaactctgagttggcctcgcccgcccccgaagcagaacattcttccaacctcacagcagcccaccctgagagcgaggagttaattgcgcaatatgatcagattattaaggaactggattccggtgccgaaggtctgatggaacagaactacccaacccccgaccctttgctgctgactaaagaggaggaaggcaaggaagagtcaaaaggcgaaaaggaaaaggagggtaagaaagagctcgaggatgaggaggatgattttgactcctttattgccgagatgcccgcggtagaaaccgtcccgtcccccttcgttggccgggacgaagctgcatttgcatcaagacaccctgtacgcactcagtctacgccttttaccgggccatttatcagcgtcgtactgtctaagttagaaaatatgctcgaaaacagcctacacgtaaatcttctcctcataggtattattacccaactcgcctcatatccccagcctctgctaagaagcttcctgttaaataccaatatggtgttccagccgtctgtccgatccctctaccaggttctcgccagcgtgaaaaataaaattgagcagttcgcaagcgtggagcgggattttcccggcctgctcattcaggcccaacagtacctgcttttcagggttgacatgagtgatatgactcccgctgcactgacaaaggaccctatccaagaggcttccaggacaggatctggcaagaatttgttagatgggcctccccgcgtgttacaaccatttctgacacaccggaccaaggtggcagaggcacctcccaacctgccgctgcccgtgagaaaccctatgctggctgccgcgctttttccagaatttctcaaggagcttgccgctcttgctcaagaacactccattctctgctataagatcttgggcgatttcgaagatagctgttgttag

SEQ ID NO: 29726 - DNA, 123 bp, Artificial Sequence
  Description of Artificial Sequence: Synthetic coding sequence
atgatgtcttctgtgtctacagaatccaagctgcagcaggcagtgtcactgcagggggtggacccagaaacctgcatgattgtattcaaaaaccactgggctcaagtagttaagattctgtag

SEQ ID NO: 29727 - DNA, 3123 bp, Artificial Sequence
  Description of Artificial Sequence: Synthetic coding sequence
atgatgtcttccgtttccaccgaatctaaattgcagcaggcagtgagcctgcaaggggttgatccagaaacttgtatgatcgtgttcaagaaccattgggctcaagtggtgaagatcttggaaaaacacgacccactgaaaaacacccaggctaagtacggttccattccaccagatgaagcgtcagctgtgcagaactatgtcgaacatatgcttttcctgcttattgaagaacaggcgaaggatgcggcaatgggcccaattctggaatttgtggtatcagaaaacatcatggaaaaattgtttctctggtccctgcgccgggagtttacggatgagactaagattgaacagcttaagatgtacgagatgctggtcacccagtcacaccaacctctgttgcaccacaagcccatcttgaagccactaatgatgctgctttcttcatgctctggtactacgacacccactgtggaggagaaacttgtggtactactgaatcagctgtgtagcattctcgcaaaggatccttccatactggaactgttcttccacacatccgaagaccaaggggctgccaacttcctgatttttagcctccttatcccttttatccatagggagggatcagttggtcagcaggcacgcgacgcactgctgtttatcatgagtctctcagctgagaatacaatggtggcccatcatattgtggagaatacatatttctgtcccgtgctggcaaccgggctgtcaggactgtactctagtcttcctacgaagttggaggaaaagggggaggagtggcactgtctgctcaaggacgattggctgctccttccatccttagttcagtttatgaattctcttgagttctgcaacgcagtaatccaagtggcccatccccttattcgcaatcagctagtgaactatatatataatggattcctggtgccagtgcttgccccggccctccacaaggtaactgtggaagaagtcatgaccacaaccgcatatttagacctgtttctgcggtccattagtgaacctgcactgctggagatctttcttaggttcatactgctgcaccaacatgaaaacgtgcacattctggacactcttacatcgcgcatcaacaccccctttcggctgtgtgttgtctctctcgccttgttccggaccctgataggcttacactgcgaggatgttatgctgcaattggtcctgaggtacctcataccttgcaaccacatgatgctatctcagaggtgggctgtgaaggaacgtgattgctacagcgttagcgcagccaagttactcgcgttaacccctgtctgctgctcttcaggcataacacttacactgggaaaccaggagagggattatattctctggagtaaatgtatgcatgacacctcaggaccagtggagaggccattccctgaagcattctcagagagtgcctgcattgttgagtacggcaaagctctcgacatcagctacctgcagtatctgtgggaagctcataccaatatactgcgatgcatgcgggattgcagggtttggtccgctctgtacgacggagattcgcccgatcccgagatgtttctgcagtctctcacggaagaaggtagtgtgagttcagcatgccctgtgttcggcctaccacagcaactcccccggaaaacagggcctcaactcgccccacgcaaagataagagtcagacagaactagaatgggatgatagctacgatacaggcatctcttccggggcagacgtggggtcccccggtccctacgatgatctggaagtcagcggcccacctgcaccaattgacccacctaagcacatccaggaaatgaagaagaacgctttgctgctcttcaaaggatcatacatcgaggagtccgattttcaggacgacgtgatggtgtacaggttatgtgccgagaaagactcagaggatatgaaagacagtcaagaagaggccgcccgccccccggctgaggcgcaagccgaagttcagtcagtgcctatcaacaatggacccttgctgtcaacccagccagagacagactctgaggaggagtggaaccgtgacaattccgatcccttccattccgagccaaaagagcccaaacaggagcgggagccagaggccgcgcctgaatccaattcggaactggcttcaccagcgccggaagcagaacactcaagcaatctaaccgcagcacatcctgaatctgaggaattgatcgcgcagtacgaccagattattaaagaactcgactccggcgcggagggtttaatggaacaaaactaccctacaccagacccactgttgctgacaaaggaggaggagggcaaggaggagtctaaaggcgagaaagagaaagaaggcaaaaaagaattggaggacgaggaggatgattttgattcattcattgccgaaatgccagcagtggagacggtgccttcccctttcgtgggacgtgatgaagccgcatttgccagtaggcaccctgttagaacgcagtcgaccccctttaccggccctttcatcagcgtcgtcctgagcaagctcgaaaatatgcttgaaaactcattacatgtgaacctgctactgatcgggatcatcactcagttggcaagctatcctcagcctctcctgcggtccttcctgcttaacaccaacatggtgttccaacctagcgtcagatcactgtatcaggtccttgcatcagtcaaaaataaaatagagcagtttgcctcagttgagagggatttccccggcctgttgattcaggctcagcagtaccttctgttccgagtcgatatgtccgacatgactccagctgccttgactaaggaccctatccaggaagcttcccgtaccggcagtggaaagaacctgctggacggccctcccagggtactgcagccatttttaacccacagaaccaaagtggctgaggccccgccgaatctgccattaccagttcgcaaccctatgctggccgccgccttattccccgaattcctgaaggagctggccgctcttgctcaggaacactccattctgtgctacaaaatactgggcgactttgaagactcttgctgctag

SEQ ID NO: 29728 - DNA, 183 bp, Artificial Sequence
  Description of Artificial Sequence: Synthetic coding sequence
atgatgagcagtgtttctaccgagtcaaaactgcagcaggcagtatccctgcaaggagtggacccggagacgtgtatgattgttttcaagaaccactgggcccaggtcgtgaagatcttggaaaagcacgatcccctgaaaaacacacaagccaagtacggcagtatcccgccagacgaatag

SEQ ID NO: 29729 - DNA, 42 bp, Artificial Sequence
  Description of Artificial Sequence: Synthetic coding sequence
atgatgtcctcagtgagtacggagagcaagttgcaacagtag

SEQ ID NO: 29730 - DNA, 129 bp, Artificial Sequence
  Description of Artificial Sequence: Synthetic coding sequence
atgatgtccagcgtttctactgaaagcaagttgcagcaggctgtgagcctccagggggtggaccctgaaacctgcatgatagtattcaaaaatcattgggcccaggtcgtgaaaatactcgagaagtag

SEQ ID NO: 29731 - DNA, 306 bp, Artificial Sequence
  Description of Artificial Sequence: Synthetic coding sequence
atgttttccaagttcacttctattctgcagcacgccgtggaggctctcgcgccatcgctgcctttgcaggaggatttcgtctaccactggaaggctattacgcattattacattgaaaccagtgacgataaggccccagtgacagacacaaacattccttctcacctcgagcagatgttagatattctggtccaggaggaaaacgagcgcgagagtggcgagaccgggccgtgcatggagtatctgcttcaccataagattctggaaactctctataccttaggaaaggctgatgtaagtagctag

SEQ ID NO: 29732 - DNA, 2298 bp, Artificial Sequence
  Description of Artificial Sequence: Synthetic coding sequence
atgttcagtaaattcacatcgatactccagcatgccgtggaagccttggcgccttcactgcccctccaggaagattttgtgtatcactggaaagcgattacacactattacattgagaccagcgacgataaggccccggtaactgacacgaacattccttcccatctggagcagatgctagacatactagttcaggaagagaatgagagagagagcggggaaaccggaccctgcatggagtacctactgcatcacaagattcttgagaccttgtacaccctcgggaaagcagactgtccacccgggatgaagcagcaggttctggtgttctataccaaactcctgggccgcataaggcagcccctgctccctcacatcaacgtgcaccgacctgtacagaaactcattagactatgcggcgaagtattggctaccccaaccgagaatgaagagatccagttcctctgcatagtttgcgcaaaactcaagcaggatccttatctcgtcaacttttttctggaaaacaagatgaagagccttgctagtaagggtgtgccaaatgtaatttcagaggacactctgaaaggacaggactcattgagtacggacacaggtcaatcccgccagcctgaggagttatcgggggccacagggatggaacagactgagttggaggatgagccgcctcatcagatggatcatctgtcgacctcactggataatttgtcagtgactagtctgcctgaagcttctgtggtgtgtccaaatcaggattataacctggtgaattccttgctgaacctgacgcgctcacctgacggtcgtatcgcggtcaaggcgtgcgaggggctaatgctgttagtcagcctgcctgagcccgccgcagctaagtgtctgacacagtcaacttgcctgtgcgagctcttgaccgacagactggcctcgctgtacaaggccttaccgcaaagcgtggatccactggatatagaaacagtcgaagccatcaactggggcttggactcatatagccataaggaagatgcttctgcattccctggtaagagggcactgattagttttttaagctggtttgactattgcgatcagctgatcaaggaggctcagaagacggcagccgttgctttagcaaaagcagtgcatgagagatttttcattggagtgatggagccccagctcatgcagacttctgagatgggcatcctgaccagcacagctttgcttcaccggatagtcagacaagtgacgagcgacgttctgcttcaggagatggtattcttcatactcggcgagcagagggaacccgagacactcgcagagatcagcagacaccctctgcgccaccgacttatagaacattgtgaccacatttccgatgagatatctatcatgactctgaggatgtttgaacacctgctccagaagccgaatgagcacatcctgtacaatctcgttttgagaaacctggaagagaggaattacacagagtacaaacccctgtgtcccgaggacaaggacgtcgtggaaaacggtctgatcgctggtgccgtagatctggaggaggaccccctgtttacagacatctctcccgaaaacacccttccaaaccaggagtggctgtcctcttcaccgcccgctacccccgatcaccctaagaatgacgggaagactgaggttcataagatcgttaatagcttcctctgcctggttcctgatgatgccaagtcatcttaccatgtcgagggcaccgggtatgacacctacctgagagatgcacaccgccaattccgggattattgtgccatttgcctgcggtgggaatggcccggaagccctaaagctctggagaaatgcaatctagaggcagctttttttgaaggacattttcttaaagtgctgttcgaccggatgggccggatcctcgaccagccctacgatgttaacctccaggtgacctctgtcctctctcggctttcactgttccctcacccccacatccacgagtatttgcttgatccatacgtgaacctggcaccgggttgtaggagtcttttcagcgtgatagttagggtcgttggcgatctgatgttaaggattcagaggattcaagacttcacacctaagcttctgctggtccgcaagagactgctcggccttgagccggagggccccattatcgatcacatcaccctgctcgaaggcgtgatcgtgctggaagagttttgtaaggaattggcagctattgcctttgtcaaataccacgcatcttccacaccctag

SEQ ID NO: 29733 - DNA, 2217 bp, Artificial Sequence
  Description of Artificial Sequence: Synthetic coding sequence
atgttctcgaaatttacatcaatcctccaacacgccgttgaagccttggctcctagtctccccttacaggaggactttgtgtatcattggaaggccattacccactactacatcgaaacgagcgacgacaaggctccagtgaccgacaccaatattccttcccaccttgaacaaatgctggacatcctggtccaggaggagaatgaacgagagtctggggagaccgggccttgtatggaatatcttctccatcacaaaatactggaaacattgtataccctcgggaaagccgactgtcctcccggaatgaaacaacaggtgctcgtgttttataccaagctcttaggccgcatacgacagccattgctgccacatattaacgtgcaccggcccgtgcaaaagttgattagactgtgcggtgaagtgctcgcgactcctaccgagaacgaagaaatccagtttctgtgtatcgtctgtgctaagttgaagcaggatccttacctcgtgaatttctttctggagaataagatgaaatcactcgctagtaagggtgtgcctaacgtaatctccgaggatacactaaaggggcaggactccctgtccacggacaccgggcagtccagacaacccgaagagttgtccggcgccacggggatggagcagaccgaactcgaggatgagccgccgcaccagatggaccatctgtccacaagcctcgataacctgagcgtgacgtcgctgccggaggccagcgtggtatgtcccaatcaagactacaaccttgtgaattctctattaaaccttaccaggtcaccagatgggcgaattgctgttaaggcctgtgaaggtctcatgctgcttgtatcactaccagagcccgcagctgccaaatgtctaactcagagcacttgtctttgtgaacttctgactgatcgcctggctagcctgtacaaggctctgcctcaatccgtggatcctctcgacatcgagacggttgaagccattaactggggcctggattcatatagccataaggaagatgctagcgcatttcccggcaagagggctctgataagtttcctgagttggtttgattactgcgaccagctgatcaaggaggcccagaaaaccgccgccgtggccctcgctaaagcagttcatgagaggtttttcatcggagtgatggaaccgcagctgatgcaaaccagtgagatggggatactgaccagtactgccctgctgcacagaatagttcgacaagtcaccagcgatgtcttactccaggaaatggtctttttcatcctcggggaacaacgagaacccgagacactcgctgagatctctcgccaccccctgcgacatcgcttgatagaacactgtgaccatattagcgatgagatcagcatcatgacactcaggatgtttgagcaccttctgcaaaaacctaacgaacacattctctacaacttggtgctgcgaaatttggaggaacgcaactacaccgaatacaagcccctctgtcccgaagataaggatgtggtggaaaacggcctaatcgctggagcagtcgacctggaggaggatccccttttcaccgacattagcccggaaaacactctccccaatcaggaatggttaagctcttccccgcctgctacccccgaccatccaaagaacgacgggaagactgaggttcataagatcgtcaactcattcctttgccttgttcccgatgacgctaaaagcagttatcacgtggagggcacaggatacgacacctacctacgagatgcacaccgtcaattccgggactactgcgctatatgtctcaggtgggaatggcctggaagcccaaaagcacttgagaagtgcaacctagaagcagcattctttgagggccatttcctgaaggtgctgttcgatcggatgggacggattcttgatcaaccctatgacgtcaacctgcaagtcacgtctgtgctctctaggctgtcactgtttcctcacccacatatacatgagtatttgctcgacccttatgtcaatctggctccaggctgccggtctttgttcagcgtcatcgtccgcgtagtcggtgacctgatgctgaggatccaaagaatacaggatttcacccccaagttacttttggtaagaaagaggttgctcggcttggaaccagagggaccaatgcaaacgctgcccagctggtggtag

SEQ ID NO: 29734 - DNA, 252 bp, Artificial Sequence
  Description of Artificial Sequence: Synthetic coding sequence
ctgtcactgttccctcacccccacatacacgagtatttgctggacccatacgttaacttagcgcctggctgtagatccctcttttccgtgattgtgcgggttgtaggggatctaatgctgcgaatccagcgaatccaggactttaccccaaaattgcttctcgtgcgcaaacgcttattaggactggagcctgaagggcctatatccgatctagaaccggtggaagccctcaccgtttcaagcatttgctag

SEQ ID NO: 29735 - DNA, 2232 bp, Artificial Sequence
  Description of Artificial Sequence: Synthetic coding sequence
atgctgagccgacttggcgccttattacaggaggccgtgggcgcccgcgagccgtctatcgatctcctccaggccttcgtggaacactggaagggtattacccactactacatcgagtccacagacgagagcacaccagccaagaagaccgacatcccatggaggctcaagcagatgcttgacatactggtgtatgaggagcagcagcaggccgcagctggggaggccggtccctgtcttgagtatctcttacaacacaaaatactggagactttgtgcaccctgggcaaggccgagtaccccccgggtatgaggcagcaggtatttcagttttttagcaaagtgctggcacaggtacagcaccccctcctgcattatctttccgtccacagaccggtccagaaactgttgagactgggggggaccgcatcgggttccgttacagaaaaagaagaggtgcagttcactaccgtcttgtgctccaaaattcaacaggacccagagctgctggcgtatatactggaaggtaagaagatcgtcggtaggaagaaggcttgcggcgaaccaacagcactcccgaaagataccacatcgcatggggataaggattgtagtcatgacggggcccctgctaggccgcagttggatggtgagagctgtggggcccaggcactgaatagtcacatgcccgccgaaaccgaggagttggacggaggcacgaccgagtcaaatctcatcacatcactgctgggcctgtgccagtctaagaaatctagggtcgcattgaaagctcaggagaatctgctcctgctggtcagtatggcttctcccgccgccgccacttacctcgtgcagagctctgcttgctgtcccgctatcgtccgacacctatgtcaactctacaggtccatgcctgtattcttggatccggcagacatcgcgacattggaaggcatttcgtggaggctgccttctgcgccaagcgatgaggcctcttttccaggaaaggaagccctggccgcctttcttgggtggtttgattactgcgaccacttaattactgaagctcatactgttgtggcagacgcgctagccaaagctgtggctgaaaatttttttgtggagaccctgcagccacaactactgcatgtatctgaacagtccattctcacctctacggctctgcttaccgccatgctcaggcagctgcgctcaccggctctcctgcgcgaagccgtcgctttcctgctgggaactgatcgacagccagaagcgcccggagacaacccgcatacgctgtatgcccatttgatcggtcattgcgatcacttgtctgatgaaatttccattactaccctgcggctcttcgaggaattgctccagaaaccccacgagggtatcatccatagcctggtattacggaacctcgaaggtaggccctacgtggcctggggctcccctgaacctgagagttacgaggacacactcgatcttgaggaggacccatatttcaccgactcgttcctcgactctggcttccagacgcctgccaaaccacggctggcaccggccacaagttatgacggcaagacagcagtcaccgaaatcgtgaactctttcctctgcctggttccggaggaagcaaaaacatctgcttttctggaagaaaccggctacgacacctatgtgcatgacgcttacggcctgttccaggagtgttcatcacgcgtagccagctggggctggccattaactcccaccccacttgacccacacgagcctgagcggcctttctttgagggccacttcttgcgcgttttgtttgaccggatgagtcgaattctcgaccagccttactcactcaacctgcaagtgaccagtgtgctctctaggctcgccctgttcccccacccccacattcacgagtacctgctggacccctatatttctctggcccccggctgcaggtcattattcagcgttctcgtgcgcgtcatcggggacctgatgcagaggattcagagggtgccccagtttcctggcaagttactgctggtccgcaagcagctgactggtcaggccccgggggagcagctcgatcaccagacgctgctccagggagtggttgtgctggaggagttctgtaaggaactggccgcaattgctttcgtcaagttccctcctcacgacccgcggcagaatgtttcccccgcccctgaggggcaggtctag

SEQ ID NO: 29736 - DNA, 486 bp, Artificial Sequence
  Description of Artificial Sequence: Synthetic coding sequence
atgctttctaggctgggagctttgctgcatgagcccgagcgtccgtttttcgaaggacattttctccgggtgctgttcgaccgaatgagtcgtatacttgaccagccctactctttgaacttgcaggtgacttccgtgcttagccgcttggcacttttcccccaccctcacatccacgagtacctcttagacccctatatcagcctggctcccggatgcagaagcctgttttccgtcttggtaagagtgattggtgacctcatgcaaagaattcagagagtgcctcagtttcccggtaagctgttattggttcgcaaacagttaactggccaggcccccggcgaacagcttgatcatcaaactctcttgcagggcgtggtggtcctggaggaattttgcaaggaactggccgctatagcttttgtgaagtttcctcctcatgatccccggcaaaatgtgtcccccgcccccgagggccaagtctag

SEQ ID NO: 29737 - DNA, 2133 bp, Artificial Sequence
  Description of Artificial Sequence: Synthetic coding sequence
atgcggggagagaataggcccatcggcaaacgcactctgccccctagagcaggatggatcggaggatgtcctgggtctcagcccgatgccaaggcccgaaaggggtggactctcgcacctcattcgtcaagatgccaccgatgctgtcattacaggtgccattgtcggtgctgtctgtgcccagcagagatgactgtaggccgcccggaaggggcacctggcggagcagagggctcccgacagatttttccgcctgagtcatttgcagacacagaggctggagaggaactctctggtgacgggctggttctgccacgggctagtaaactcgatgaattcctgtccccggaggaggagatcgactcaactagtgattccaccggttctatttatcagaaccttcaggagttgaaacaaaagggacgctggtgcctcttagagagcctgtttcagagtgacccggagagcgatgaaaatctctctgaggacgaggaagacttagaatctttcttccaggacaaggatagggggatggttcaggttcaatgcccccaagcgttgaggtgcggcagtactcggcgatgtagtagcctgaacaatctgccttctaacattccacgaccccaaactcagccgcctagtgggagccgccctcctagtcagcaccgctccgttagcagctgggcgagtagcatcactgtccccaggccattcaggatgacactgagggaagcgagaaaaaaggctgagtggttggggtcgcccgcgtcctttgaacaagagcggcagcgcgcgcagcgacagggggaggaagaggccgaatgccatagacaatttcgcgcccagcccgtgcctgcacacgtttatctgcccctctaccaggagatcatggaaagatctgaagcgaggaggcaggccggcatacaaaagcgtaaagaattactgctgtccagtctgaagccgttcagctttctggagaaggaggaacagcttaaagaggccgctagacagcgcgatctggccgcaacagctgaagctaaaatatccaagcagaaagccacgcggcgcatccctaagtccatactagagcccgctcttggcgacaaactgcaggaggccgaactcttccgcaagatccgaattcagatgagagctttggatatgttacaaatggcttcttctccaattgccagcagctcaaatagggctaatccccagccgcgcaccgctacgcgcactcagcaagaaaagctgggcttcctgcataccaattttagattccaaccaagagtcaaccctgtggtgcccgattatgagggtctttataaggcgtttcaacgtcgcgccgccaaaagacgcgagacccaagaggcaactagaaacaagcctttcttactcaggaccgccaacctgcggcacccccagcgcccatgcgacgcagccaccaccggaaggaggcaggactccccccaaccccccgccacacccctgccacgttctaggtcattgagcggcctggctagtctgagtgccaacaccctgcccgtacacatcactgatgccacacgaaagcgggagagtgcggtgcggtccgctctggagaagaaaaacaaggccgacgaaagtattcaatggctcgagattcacaaaaagaaatctcaggctatgtctaaatctgtcacgctgcgggctaaagccatggacccccacaaatccttggaggaagtgttcaaagctaagcttaaagagaacagaaacaacgatcggaagagggccaaggagtataagaaagaactcgaggaaatgaagcagcggatacaaacacgcccttacctctttgaacaggtggcaaaagacctagctaagaaggaagctgaacagtggtacctcgacacactgaaacaggcgggcttggaggaggacttcgttaggaataagggccaagggactcgggctgtgcaggagaaggagacaaagatcaaggactttccccgcttccaagagactaccaaactctccataagagatcccgagcaggggttagagggaagccttgagcagcccgcctctccaagaaaggtgttagaagagctctctcatcagagcccagaaaatctggtctctttagcctag

SEQ ID NO: 29738 - DNA, 1944 bp, Artificial Sequence
  Description of Artificial Sequence: Synthetic coding sequence
atgaccgtcgggaggcctgagggagcccctggcggcgcagaggggtccaggcagatttttccacccgagtcatttgcagatacggaagccggggaagaattgagcggcgatgggttagtactgccacgggcctccaagctggacgagtttctgagccctgaagaggagattgattccacatcagatagcacaggaagcatatatcagaatctacaggaactgaagcagaaggggcgctggtgtctcctggagtccctgttccagagcgacccagagtctgatgaaaacttatccgaggatgaagaggatttagagagcttcttccaggataaagaccgcgggatggtgcaggtccagtgcccccaggccctcaggtgcggaagcacccgccggtgtagttcgctgaacaacctgccgtccaatattccaagaccccagacacagccaccatctggctcgcggccccctagccagcaccgtagcgtctcatcgtgggcatcttctatcactgtgccacgtccgttcaggatgactcttcgtgaagcccggaaaaaggccgaatggttgggatctcccgcttccttcgagcaagaacgccagcgcgcccaaagacagggcgaagaggaggccgaatgtcaccggcagttcagggcacagcctgtgcccgcacacgtgtatctgcctctatatcaagaaatcatggaacgctccgaagccagacggcaggccggcatacagaagagaaaggagttgctactttctagccttaagccgttctcctttctggagaaagaggagcagttgaaggaggctgccagacagagagatcttgctgccaccgctgaggccaagatttcaaaacagaaggctacaagacgtattcccaaaagtatccttgaaccggcgctgggcgacaaactgcaggaggctgaactcttcaggaaaattcgtattcagatgagagcacttgatatgctgcaaatggcttcaagtcccattgccagttcctccaatcgggccaacccacagccgcgtaccgccaccaggacacagcaggagaagctagggtttcttcatacaaactttaggttccaaccccgtgtaaacccggtagttccagactatgagggactctataaggcattccagcggcgtgcagcaaaacggcgcgagactcaggaggccacgcgtaacaagcccttcctcctccggactgcaaatctcagacatccacaaagaccatgcgatgcggccaccaccgggagacgacaggacagccctcagcctcctgctacacccctgccccgatcccggtcattgtccggactcgccagcttatccgctaatacccttcccgttcatattaccgatgccaccagaaagcgtgagagtgccgtccgcagtgccctagaaaaaaagaataaagctgacgagagtatacagtggctcgagatacacaaaaagaagagccaggcaatgagtaagagtgtgaccctgcgcgccaaagccatggacccacacaaatccctagaggaggtcttcaaggcaaagctcaaagaaaatcgcaataatgatcgtaaaagggcgaaagagtacaaaaaagagctcgaggagatgaaacaacgtatccagacgcggccatacctatttgaacaggtggcgaaagatctggccaagaaggaggccgagcagtggtacttggacacgctcaaacaggccgggctagaagaggactttgtcagaaacaagggacagggcactcgagctgtgcaggagaaagagaccaaaataaaagattttcctcgcttccaggagactacaaaattaagcattcgtgaccctgagcagggccttgaggggtcccttgagcagcccgctagtccccgaaaagttctagaagaactctcccaccagtctccagagaatctcgtgtcgctagcatag

SEQ ID NO: 29739 - DNA, 978 bp, Artificial Sequence
  Description of Artificial Sequence: Synthetic coding sequence
atggaaggcctggaagaaaacggcggagtagttcaagttggcgaactgttgccctgtaagatctgcgggcgcaccttttttccggtcgccctcaaaaagcacggaccaatctgtcaaaaaaccgcaactaaaaagagaaagacctttgactcctctcgacaacgcgccgaaggaacagatatcccgaccgttaagccccttaagcccagacccgaaccaccaaagaaaccatccaattggcgccggaagcacgaggaatttatcgccactatccgagctgctaagggacttgaccaggcccttaaggagggggggaagctgccacccccacctcccccttcctacgaccccgattatatccagtgtccatattgccagcggcgcttcaacgaaaatgctgcagacaggcatattaacttttgtaaggagcaggccgcacgcatctcgaacaagggaaaattttctactgacaccaagggaaaaccaacttctcgcacacaagtgtataagcctcccgcactgaagaaaagtaactcccccgggacggcatccagcgggtcatcacgcctgccacagccaagcggtgccggaaagactgttgtgggggtgccatccggcaaggtctccagttcaagtagttcactgggaaacaaactgcagaccctgagtccctcacataaaggcattgctgcacctcatgccggggccaatgtgaagcccagaaattccaccccaccgtccctcgcaaggaacccggctccgggggttctgacaaataaaagaaagacatatacagaatcctatattgcaaggcctgacggcgactgcgcatcaagtttgaacggggggaatattaaggggattgaaggccactcccccggaaatttgcccaaattttgccacgaatgcgggactaagtacccagtcgaatgggcgaagttttgctgcgagtgcggtattagacgcatgattttgtag

SEQ ID NO: 29740 - DNA, 828 bp, Artificial Sequence
  Description of Artificial Sequence: Synthetic coding sequence
atggccggtctgcaacgcctggctagccacctgcctgtaggtgtaatgttaccgcataacactactgaagcacctgggccgcacagcgcaaaacaggactcatacgagcaaggagactcttcccaacaatccctgaaggggcacctgcgaaataacttccaaaaacagctcctctcaaacaaagagctgatccttgataaggtttacacccatcctaagtggaacacccagacaaaggctcgaagttacagctacccacattgtacaggtatatctcaacaagatcccgagagcgacagtcaggggcagggtaacgggttgttttactcgagtggcccacaaagctggtatccaaaggcaaataaccaagacttcataccattcactaagaaacgggtgggcgtcgatcgcgcttttccactgaagcccatggttcatcggaaatcctgctctactggcgaagctgggaccgatggggatcataatgtgtacccacgccctccggagcccagggaattcagttcccggaactttggcgtgagaaaccaaggaaatttctccgtggtcggaactgtgctggctgcgacacaggctgagaaggccgtagccaactttgatcggaccgagtgggttcagattagaagactcgaagccgcaggggaatccctcgaggaggaaattagacggaaacagatcttactccgggggaaactgaagaagacggaagaggagctgaggagaatccagacacagaaggagcaagctaaggaaaatgagaatggcgagctgcagaagattattctgccccgatccagggtgaaggggtag

SEQ ID NO: 29741 - DNA, 1371 bp, Artificial Sequence
  Description of Artificial Sequence: Synthetic coding sequence
atggccggccttcagcggttggcatcacacctaccagtgggtgtgatgcttccccataacaccacggaggcccccgggccacactctgctaagcaggattcctatgagcagggcgattccagtcagcaaagccttaagggacatctgcgaaataactttcaaaaacagcttttgagcaataaagaactaatactcgacaaagtatacacacatcccaagtggaatacacaaaccaaggcacgctcatatagctatccccactgcaccgggatcagccaacaggacccagagagcgactcccaaggccagggtaatgggcttttctacagtagtggcccccaatcctggtatcccaaagcgaacaatcaagatttcattcctttcactaaaaagagagtgggggtagaccgagccttccctcttaaacctatggtgcatagaaagtcctgcagcacaggcgaagccggcacagatggtgatcacaacgtgtacccacgcccgcccgagcctagggaatttagttcaagaaacttcggcgtcagaaatcaagggaatttttctgtggtgggcaccgtcctcgcggccactcaagccgagaaggccgtggccaactttgacagaactgaatgggtccagatccgacgacttgaggccgcaggagagtccctggaagaggagatacggaggaaacagatccttctgagggggaaacttaagaagaccgaggaggaactcaggagaatccagacccagaaagaacaagccaaggagaatgagaatggggagttgcagaagataatcctgccaagatcccgcgtgaaagggaacaagagcaacacaatgtacaagccaatcttctcacccgaattcgagttcgaagaggaatttagtagggacaggagagaagatgagacctggggcagatcccagcagaatagtgggccttttcagttttccgattaccgtattcaacgcttgaaacgagagagactggttgcatcaaacaacaagatacgggaccccgttagcgagccatccgtggagaagttcagtccaccctctgaaacgcccgttggagccctgcagggtagcgccagaaactcgtccttgtcaatggccccagactcaagcgggtcatcagggtctattgaggagccacagctgggcgagtgcagccattgtgggcgcaaatttctgagcttccgcctggaaaggcatagcaacatctgctcgcggatgcggggcagcaagaggaaggtgttcgatagctcgcgcgcccgcgcgaaggggaccgagctcgagcagtatctaaattggaaaggccccgctagtgccaaagcagaaccaccccagaagtccaactggcggtag

SEQ ID NO: 29742 - DNA, 279 bp, Artificial Sequence
  Description of Artificial Sequence: Synthetic coding sequence
atggcaggacttcaaagacttgccagccacttacccgttggtgtgatgctgccccacaacacaacagaagctcccggaccacattccgccaaacaggactcatacgagcagggcgacagctcccaacagagtctgaagggccatctccggaataatttccaaaagcagcttctttcaaacaaagagttaatacttgataaagtttatacgcatcctaagtggaacacccagaccaaagctcgcagttattcttaccctcattgtacaggcatctcctag

SEQ ID NO: 29743 - DNA, 516 bp, Artificial Sequence
  Description of Artificial Sequence: Synthetic coding sequence
atggccggcctccagagactggcctcccatttgcccgtcggagtcatgcttccacataatactaccgaggctccagggcctcacagtgccaaacaggatagttatgagcagggggattctagccagcagagccttaaaggtcacctgcgaaacaactttcagaagcagcttctaagtaacaaagaactcatccttgataaagtgtacactcaccccaagtggaatacacagaccaaagctcgcagttattcttatcctcactgcaccgggatatcacagcaagaccccgagagtgacagccagggacagggtaatgggctgttttacagcagtggacctcaaagttggtaccccaaagccaataatcaagacttcattccgttcaccaaaaagcgggtgggggtggatcgggcctttcccctgaagccgatggtgcataggaaatcttgtagcacaggagaagctggcacagatggggatcataatgtttatccccgccctcccgagccccggtag

SEQ ID NO: 29744 - DNA, 282 bp, Artificial Sequence
  Description of Artificial Sequence: Synthetic coding sequence
atggctggcctgcagaggctcgcgtcacatttacccgttggagtcatgcttccacataatactacggaagccccaggaccccactctgccaaacaggactcctatgagcagggggacagttctcaacagagtctgaaagggcatctccgtaacaactttcagaagcagctgctaagcaacaaagaacttatcctggataaagtctacactcaccctaagtggaacacacaaactaaagccagatcctacagttacccacactgcaccggaatctcccagtag

SEQ ID NO: 29745 - DNA, 486 bp, Artificial Sequence
  Description of Artificial Sequence: Synthetic coding sequence
atggccggcctgcagcgtttggctagccacctgcctgttggagtgatgctgccacacaacacaaccgaggcaccggggcctcatagtgccaagcaggattcctacgagcagggagattcctctcagcagagtctgaagggccacctgaggaacaattttcagaagcaattactctctaacaaggagttgatcctcgataaagtgtatactcacccgaagtggaacacgcagaccaaagcccggtcctactcgtatcctcactgtactgggatttctcagcaggacccggagagcgatagtcaagggcaaggaaacgggttgttttactctagcggaccccagtcgtggtacccaaaggcgaacaaccaagactttattcccttcaccaagaaaagggtcggcgtggatcgcgctttcccgctaaaacctatggtgcacagaaaatcttgttcgaccggcgaagccggcaccgacggggaccactag

SEQ ID NO: 29746 - DNA, 828 bp, Artificial Sequence
  Description of Artificial Sequence: Synthetic coding sequence
atggcagtcgcctccacatttatacctgggttgaaccctcagaacccacactacattcccggatacacaggccactgccccctccttcggttcagcgtcgggcaaacctacggacaggtcacaggacagctgctcagaggccccccagggctggcttggccacccgtccatagaactctgctgccaccgatccgccctccacgctccccagaggtgccacgggagtctctgccggttcggcgcggacaggagcgtttgtcatcatccatgatccctggatatactgggttcgttcctagggcccagttcatttttgccaagaactgctcccaggtatgggctgaggctctcagtgattttacgcatctccatgagaagcagggctctgaggaacttccaaaggaggcaaaaggcaggaaggatacggaaaaggaccaggtccccgagcccgaaggccagctggaagagcctaccctcgaggtggtagaacaagctagtccatattctatggacgatagggatccgcggaagtttttcatgtctggatttacaggttacgtgccctgcgcccgatttctgttcgggagttccttccccgtgcttaccaatcaagccctgcaggagttcgggcaaaagcactccccagggagtgcccaggaccctaagcacttacccccactgcccaggacataccctcagaacctcgggctgctgcccaactacggtggatacgttcctgggtacaaatttcagttcgggcatacgtttggacacttaacccacgacgctttaggcctgagtacgtttcagaaacagttgctcgcttag

SEQ ID NO: 29747 - DNA, 651 bp, Artificial Sequence
  Description of Artificial Sequence: Synthetic coding sequence
atggcagtggcctcgacattcatacctggcctgaatcctcagaacccacactacatccccggatataccggccattgcccccttctgagattctcggttggtcagacatatggtcaggtgactgggcagctgttgcgggggccaccggggttggcttggccccctgtgcatcgcacattacttccaccaatacgaccaccaagatcacctgaagtgcctagggaatcattgccagtccgaagagggcaggagagactttcatccagcatgatccccggatatactgggtttgtaccaagggcccagttcatttttgcaaaaaattgcagccaggtgtgggcggaagctctgagcgactttacccatctgcatgaaaaacaaggtagcgaggaactcccaaaggaggccaaaggtaggaaggacaccgaaaaagatcaggtgcccgaacccgagggtcagctggaggagcctaccctagaggtagtggagcaagcctcaccctactcaatggacgaccgtgatcctagaaaattcttcatgagtgggaccgccggcatctgggcagaggccctgacccggcaatgtccgggcccacagacatccccacccaccagtcagaatatcccttctgagccagggtcattcacatag

SEQ ID NO: 29748 - DNA, 954 bp, Artificial Sequence
  Description of Artificial Sequence: Synthetic coding sequence
atgaccacgacccagaagcacgatctgttcacgcctgagcctcattacgtgccaggctacgccggtttttttcctcagctcagatatcaggtaggaaacacatacggccgcacaactggacagctgttgactgaccccagcgtgcagaagtccccatgctcggtgttgtcaccaatgtcaaagccaaaatttattgaggacttctctcagagcaaaccccccagagtgccatgccaagacctgactgagccatacatcccacactacacttcactgaagccatcgaagaacttcgagattctggggcaactcccgcctttagaggtggacgcacaggagccccctggcgttgagaacattccacgccagatcctgctaccagcggggtttacacctgacaccccccaccccccatgtccccctggcaggaaaggagacagtagagacctgggtcacccggtgtacggcgaggaggcctggaaatcggccacccctgtgtgcgaggctccgcgtcagcaccaattgtaccactgccagcgcgacgaataccccccgcctgctcgccggcagcaggagaccctcgacgttggcagttttcagaggctccctcaactggaccatccaaatttgattcagcgcaaagccatttcaggctacgccggcttcattcctcggtttacctgggtgatggggctcaattaccgggacggcgtgatgcaagcgatggacgaattcgacaagtcccagtttttgttccggaacccacactgtgatctcggagagaaactgcctgggactcattggccaagcaatcacatctatagctcacagggtctcatcccgttttacatgggttttattcccgccatgcaggacaactacgccctgacctttggcaactccacaaggcgagcttattggaaggaatgggctaaacgaaatcataccctctag

SEQ ID NO: 29749 - DNA, 816 bp, Artificial Sequence
  Description of Artificial Sequence: Synthetic coding sequence
atgaccacgactcaaaaacatgatctgttcacccccgaacctcactatgtcccaggatatgcaggctttttcccccagctgcggtaccaggtcggcaacacttatggcagaaccacgggtcagctgctgacagatccctcagtccaaaagagcccctgctcagtcctctctcccatgtccaaaccaaaattcatcgaggatttttcccaatcaaaaccgccgagagtgccttgccaggatctgactgaaccctacataccccattataccagccttaaaccatcgaaaaacttcgagatcttgggccagctgccccccctcgaggtggatgcccaggagccacccggggtcgaaaacatcccacggcagattctccttccagctgggttcaccccagacacccctcaccccccatgcccgcctgggcgaaagggggatagtagggatctgggacatccagtctacggagaggaagcatggaagtcagccacgccagtctgtgaggctcctcgtcagcaccagctgtatcactgtcaaagggatgagtaccccccccctgcccgccggcagcaggagactctcgatgtggggtctttccagaggctacctcagctggatcatccaaatttgatccagcgcaaagctataagcgagcaagcctcaggcctgggcgggcctcccctacctccctcctgctttcaagaaccctccttcagccaggatgaggccgtgccctgcttgcccgtgcctatctggccccaccagactgtggccaatgtccaggggactaaagggtcactcgcttggttgccctag

SEQ ID NO: 29750 - DNA, 780 bp, Artificial Sequence
  Description of Artificial Sequence: Synthetic coding sequence
atggcagtcgcctccacatttatccctggactcaaccctcagaacccccactatattcccggatacactggacattgtccgttattaaggttttccgtgggccagacatacggacaggtgaccgggcagcttctgagaggtcctcctggtctcgcctggcctcctgttcataggacactactgccacctattcgccccccaagatcgcccgaagtgccccgggagtctctgcccgttcggcgtggccaggagcgtctgagtagctctatgataccaggctacacaggttttgtgcctcgcgctcagttcatatttgcaaagaattgctcccaagtgtgggccgaagcactgtcagatttcacccatctccacgagaaacagggatccgaggaacttcctaaagaagccaagggccggaaggataccgaaaaggaccaggttcctgagcctgaaggccagctggaggaacctacacttgaggtcgtagagcaggcttccccctacagcatggacgatagggatcccaggaagttttttatgagtgcttttctgtgctcacctaccaggcactgtcggaatctgggaaggagcacacatcaagctgtgccaaggacacctaatatctccccacattttccggaacacactctccggacatgggtcttttataattatggtggatacgtccccggttataagttccagtttgggcacacattcggtcacttaacacatgacgctttgggactttctacttttcagaagcagttactagcgtag

SEQ ID NO: 29751 - DNA, 492 bp, Artificial Sequence
  Description of Artificial Sequence: Synthetic coding sequence
atgagcctggggctactgaaattccaggccgtgggtgaggaggacgaggaggacgaggagggggaatcccttgactcagtaaaggccctgacggctaaactgcagctccagacgcggagaccaagttacttggagtggactgctcaagtgcagtcccaagcctggagaagagcacaggccaaacccgggccgggtgggcctggagatatatgcgggttcgactcaatggattctgctctcgaatggctccgtagggagctgagagagatgcaggcccaagatcggcagctcgctggccagctgctgcgcctgagggcccagcttcatcgtctgaaaatggatcaggcttgccaccttcaccaggagctgctggatgaggcggaactggagctggaactcgaacctggcgccggactggcactggcccccctcctgagacacctaggcctgaccagaatgaacattagcgcgcgccgattcacactgtgctag

SEQ ID NO: 29752 - DNA, 735 bp, Artificial Sequence
  Description of Artificial Sequence: Synthetic coding sequence
atgaaccccgtgtattctccagttcaacccggagccccatatggaaatccaaaaaacatggcatatacaggttaccccacagcctatccggcggctgccccagcatacaatccaagtctctatcctacgaactctcccagctacgctcccgagttccagtttctacactccgcctacgcaaccctgctgatgaaacaggcctggccgcagaacagcagttcgtgcggcaccgagggtacgtttcatctgcccgtagacacggggaccgaaaatcgtacttatcaggccagttccgccgctttccgctataccgccggcaccccctataaggtaccacccacccaatctaacacagcacctccgccatacagtcctagcccaaacccttaccaaacagctatgtaccccattcgatcagcctacccacagcagaatctgtacgcacagggcgcttactatactcagccagtgtatgccgcccagccacacgtaatacaccacacgacagtagtgcaacccaactctatacccagcgctatctatcccgcacctgttgcagcaccgcgtaccaatggggttgccatgggcatggttgccggaaccaccatggctatgtccgcaggaacactcctcaccactcctcagcacactgcaattggcgcccacccagtcagcatgcccacctatagagctcaaggcacgccggcttattcatatgtgcccccgcactggtag

SEQ ID NO: 29753 - DNA, 708 bp, Artificial Sequence
  Description of Artificial Sequence: Synthetic coding sequence
atgaatcccgtctatagtcctgttcagcccggggccccgtatggcaatccaaagaatatggcatataccggttatcccactgcctatccggcggccgcccctgcatacaacccgtccctgtacccaacaaacagcccctcttacgcccccgcgaccctgctgatgaagcaggcatggccacagaacagcagcagttgtggtacagaagggacctttcacctcccggtggatactgggaccgaaaaccgcacataccaggcctcaagcgcagctttccgctacacagctggtacaccatataaagtacctcccacgcagtccaacaccgcacctcccccatattctccgtctcccaatccctatcagacggccatgtaccccattcgctccgcgtatccccaacagaacctgtacgcccagggagcctattatacccaacctgtgtatgctgctcagccccatgtgattcatcacactacagtggtgcagccaaacagcattcccagcgctatttatccggccccggttgccgcgccccggaccaatggcgtcgcgatggggatggtcgcaggaactaccatggccatgtccgcaggcacgctacttactaccccccagcacacggcaatcggagctcatccggtgagcatgcctacttatagagctcaaggcaccccagcctatagttacgtgcctccgcattggtag

SEQ ID NO: 29754 - DNA, 390 bp, Artificial Sequence
  Description of Artificial Sequence: Synthetic coding sequence
atgaaccctgtatattcgcccgtacaacccggtgccccctacggtaacccaaagaatatggcctacacaggatacccgaccgcgtatccagcagccgcgcccgcctacaatccttccctatacccaacaaattccccttcctatgctccggcaactttgctcatgaagcaggcatggccccagaacagtagctcttgcgggaccgaagggacattccacctccccgtagacacggggaccgagaaccgcacgtatcaggcttcatccgctgcattctccactcttcttaccacccctcagcacactgcaattggggcccatcccgttagcatgccgacctaccgggcacaggggactcccgcgtatagctacgtcccccctcactggtag

SEQ ID NO: 29755 - DNA, 372 bp, Artificial Sequence
  Description of Artificial Sequence: Synthetic coding sequence
atgaatcccgtctactcacccggatctagcggggtcccgtacgcaaatgcgaaaggaattggctatccagccggcttccccatgggttacgcggctgctgctcccgcttatagtccgaacatgtatcccggggccaacccaaccttccaaaccggctacacacctggaaccccctataaggtctcctgcagtccaactagcggcgccgtgcccccatactcaagtagtccgaatgctgtgccgatgtcgccatgtgcagatcagtgggcaaggcagctgggccagatcagtgggcaaccatttgtcctcctcgcgggtctcttatgttggccacacggcgaagccctggaatcacttatggattgtaattag

SEQ ID NO: 29756 - DNA, 588 bp, Artificial Sequence
  Description of Artificial Sequence: Synthetic coding sequence
atgaaccctgtgtacagtccaggttcctcaggggtgccttatgctaatgctaaaggtatagggtaccccgcggggttccctatgggctatgccgcagcagcacccgcctacagtcctaacatgtatcccggagctaaccctacctttcaaaccggctacacacccggcactccatacaaggtctcttgtagcccgacgtctggagccgttcccccatattcgtcttccccaaatccgtatcagactgctgtgtacccggtgagaagtgcatatccacagcagtccccctatgcccagcagggcacatactatacacagcccctgtacgccgcccctccacatgtgatacaccacaccaccgtggtacagcctaatggaatgccagccacagtgtatcctgcaccaattccccctccgagagggaacggtgtaaccatgggcatggtcgccggcactactatggctatgtctgctgggaccctgttgactgctcacagtcctactccagtggcgcctcatcccgtgacggttcccacgtatcgcgctcccggcaccccgacttattcttacgtcccgccgcagtggtag

SEQ ID NO: 29757 - DNA, 588 bp, Artificial Sequence
  Description of Artificial Sequence: Synthetic coding sequence
atgaatccagtgtactcacctggatctagtggcgtcccttatgcaaatgccaaaggtatcggttaccctgccggctttccaatgggctacgcggccgccgcgcctgcgtattcccccaacatgtaccctggtgccaaccctacctttcaaaccggatatacccctgggacaccttataaagtgtcctgttctcccacatctggcgctgttccaccctacagctcgtctccaaatccataccagaccgccgtgtaccctgtccggagtgcatacccacagcagtccccctatgcacaacaggggacatactacacacagccgctatatgcagcacccccgcacgtcattcaccacaccactgtggtccagcccaatgggatgcccgcaaccgtctaccctgcccctatccctccacctcgtggcaatggcgtgaccatgggcatggtggcaggcacgactatggccatgagtgccggcaccttgcttactgctcattccccaacaccagtggcaccacaccctgttaccgtgccaacctacagggcccctggcactcctacctacagctacgtcccgccgcagtggtag

SEQ ID NO: 29758 - DNA, 384 bp, Artificial Sequence
  Description of Artificial Sequence: Synthetic coding sequence
atggcattccctgtggatatgctggagaattgctcacacgaagagctggaaaattccgccgaggactatatgtctgatctgagatgcggcgatcctgaaaatcccgagtgcttcagtcttctcaatatcacaatcccaatcagcctgtccaacgtaggcttcgtccccctctacggtggcgatcagacccagaagatcctagccctgtttgcacccgaagattccctgaccgcagtcgccctatacttagccgatcagtggtgggccatagacgacatcgttaaaacaagtgtgcccagcagagaaggccttaaacaggaagcatacgtcccacttttcttgccgaaagtcacaaactgtcagttcctgatccagtgtttctag

SEQ ID NO: 29759 - DNA, 2013 bp, Artificial Sequence
  Description of Artificial Sequence: Synthetic coding sequence
atggcttttcccgtggacatgctagagaactgtagtcatgaggagttggagaactcagctgaggattatatgtctgacttacgatgcggagatccagagaatcccgaatgctttagcctccttaacataactattccaataagcttatccaacgttgggttcgtgccactttacggcggtgaccagacccagaagatactagccctattcgcgcctgaagattccctaaccgccgtggccctctatcttgccgatcaatggtgggcaatcgatgatatcgtgaagacctctgtgccctcccgggagggcctcaaacaggtctcaacgctgggtgagagagtggtgctatatgtgctgaatagaataatctatcgtaaacaagagatggagcgcaacgaaattcccttcctctgtcactcatcaactgactatgctaaaatactgtggaaaaaaggggaggcaattggtttttattctgtcaaacccactggttccatatgtgcatcatttctaacccaaagctatcagttgcctgttttggacacgatgtttttgcgcaagaaataccgcgggaaagacttcggccttcacatgctggaggattttgtcgactcattcacagaggacgctctgggactgcgctatcctttgtcctctctcatgtacacagcgtgtaagcagtacttcgagaaatatcctggggaccatgagctgctgtgggaagtagagggtgtgggacattggtatcagcgcatcccagtgacccgcgcgctgcagcgcgaggctctgaagatcctcgctttgtctcagaatgagcctaaaaggcctatgagtggtgagtatgggcctgcttcagtgcccgaatacgaagctagaaccgaggataatcagtctagcgagatgcaacttacaatcgatagcttaaaagacgcctttgcctccaccagcgagggacatgacaagacaagtgtatccacccacacacgctctggtaatctcaaaagacctaagattggcaaaagattccaggactcggaattctcatcatcgcagggagaggacgagaaaacttctcagacgtccttgacggcctctatcaacaagctcgaatccaccgctcgcccaagcgagtcctcagaggaattcctggaagaagagccagagcagaggggcatcgaattcgaagacgagtcaagtgatcgagatgcccggccggctttagagacacagccgcaacaggagaagcaggacggagagaaggagtccgagctggaacccatgaatggagaaattatggatgatagcctcaagacatcactcatcacagaggaggaagacagcacctcagaagttttggatgaagaattgaaacttcagcccttcaactccagcgaagacagcaccaacctggtgcctctggtcgtcgagagtagtaaacctcccgaagtggatgcaccagataaaaccccgaggatacccgactcagagatgctgatggacgaaggcaccagcgatgagaaggggcatatggaagagaaattgagtctgctgcccagaaaaaaggcacacctcggcagtagtgacaatgttgccaccatgtcgaacgaagagaggtcggacggtggtttccctaacagcgtgattgccgaatttagcgaagagccagtgtcagagaatctgtccccaaacaccacatcctctttagaagatcaaggagaggagggggtcagcgagcctcaggagactagtacggccctgccccagagtagcctgattgaagttgagcttgaggacgtcccgttttcgcagaacgccgggcagaagaatcaatcagaggaacagagcgaagcctcgagtgagcagcttgaccaattcactcaatcggcagagaaagccgtggacagtagctctgaggaaattgaggtagaggtcccggtggtagaccgacggaacctgcgccggaaagccaagggccataagggccccgctaaaaagaaagctaagctgacttag

SEQ ID NO: 29760 - DNA, 261 bp, Artificial Sequence
  Description of Artificial Sequence: Synthetic coding sequence
atggccttccccgttgacatgctggagaattgttcccatgaggagcttgagaattccgctgaagattatatgagcgacttgagatgcggagaccccgagaacccggagtgtttctccctgctgaacattaccatccctatctctctctccaatgtgggattcgtccctctgtacggaggtgatcagacacagaaaatacttgcacttttcgcacccgaagattccctgacggccgtcgctctttatctagccgaccagtag

SEQ ID NO: 29761 - DNA, 672 bp, Artificial Sequence
  Description of Artificial Sequence: Synthetic coding sequence
atggcattccctgttgatatgctggaaaattgttcgcatgaggagctggagaattctgctgaggattatatgagcgatctgaggtgcggcgatcctgagaatcccgaatgtttcagtctgctgaatataacaatacccataagcctttcgaacgttggttttgtgccactctacggtggtgatcaaacccagaagatcctagcattattcgctccggaggacagcctgacagccgttgccctatacttggccgatcaatggtgggctatcgacgatatcgttaagaccagcgttccatccagagagggactaaaacaagtcagcacccttggtgagcgggtcgtgttgtatgtcctcaatcgcataatttacagaaagcaggagatggagcgtaatgaaatcccattcctttgccatagctcaacggactatgcaaaaatcctctggaagaaaggtgaggccatcggattttacagcgtcaagccaactggatccatctgcgcctcatttctgacccagtcctatcagctaccggtccttgataccatgttcctcagaaaaaaatatcgcggaaaggatttcggtcttcacatgctcgaagacttcgtggactcctttacagaagacgccttgggtttacgctaccccttgagctcacttatgtatacctag

SEQ ID NO: 29762 - DNA, 528 bp, Artificial Sequence
  Description of Artificial Sequence: Synthetic coding sequence
atggccttccccgtagatatgctggaaaactgctcgcatgaggagctggagaattctgcagaggactacatgtctgaccttaggtgcggcgacccggagaaccccgaatgtttcagcttgcttaatatcaccataccaatcagcctgagtaacgtgggctttgtaccactttacggcggtgatcagacgcagaagatcctagctctcttcgctccagaggattccttgaccgctgtagctctatacttggcagaccaatggtgggctattgacgatattgtcaaaacgagtgtgccaagccgcgaggggctgaagcaagtttccaccctgggagagcgtgtcgttttatacgtgctgaatagaatcatttatcggaagcaagaaatggaaaggaacgagatcccctttctctgtcactccagtactgattatgccaagattctgtggaagaaaggtgaggccattgggttttacagcgtgaagccaactggtagtatatgcgctagctttctgacgcagagctactag

SEQ ID NO: 29763 - DNA, 579 bp, Artificial Sequence
  Description of Artificial Sequence: Synthetic coding sequence
atgaaagtccaatcatttggtgagagggtcgtgttgttcatcctcaacgcaatcatattcgggcgtttagaacgcaacctcgacgacgacgacatgttctttcttccccacagtgtcaaggagcaggccaagatcctctggagacggggagctgcggtgggattctacaccacaaagatgaaggggagactttgcggggacggcaccggcgcctgttatttacttcccgtgttcgacacagttttcatccgacgcaaacactggcaccggggtcttggaactgccatgctgagagatttttgtgagacattcccggaggatgaagctttgggggtttcctgtagtatgtcacccgccatgtatcaggctcaccctggtaacagcgaagatgtctcgcgccatgcccgaactagccagaatgatcggcctaggcaacccgcccccggagacggaagcaaggagcggatgtgtggtgaggagctggaagatacaaaagacgaccctgaatgcggcgtggaagaggaggacgccggactagccggccagccgccgggtaaactgactagatcatctccatag

SEQ ID NO: 29764 - DNA, 579 bp, Artificial Sequence
  Description of Artificial Sequence: Synthetic coding sequence
atgaaagtccagtcttttggcgaaagggtcgtgcttttcattctcaacgccatcatctttgggcgtttagagaggaacctggacgacgatgatatgttttttttacctcactccgtgaaagaacaggctaagattttgtggcggcggggcgccgccgtgggcttctacaccacaaagatgaaagggagactgtgtggggacggcacaggagcttgctatctgctcccagtgttcgacacagtgtttataaggcgtaagcattggcacagggggctgggaaccgctatgctgcgggatttttgtgagactttccctgaagatgaagcactcggggtgtcctgctccatgtctcctgctatgtatcaggctcaccctggtaatagcgaagatgtgtcgagacatgcaaggacatcccaaaatgacagaccacgccagcctgcacctggcgatggttcgaaggaaaggatgtgcggggaggagctcgaggacaccaaggacgatcccgagtgtggggtggaagaggaagatgccggcttggccggacagcctccgggtaagctgacacgatcctctccttag

SEQ ID NO: 29765 - DNA, 990 bp, Artificial Sequence
  Description of Artificial Sequence: Synthetic coding sequence
atgaagcggaggcaaaagagaaagcacctggagaatgaggagagccaggaaactgcagaaaagggtggcggaatgagtaaatcccaggaggacgcactccagcctggatctacccgggtagccaagggttggagtcaaggtgtgggcgaagttacaagcacctcggagtattgcagctgtgtgtcctcctccaggaaacttattcactcagggatccagagaatacaccgggacagtccgcagccacagagtccactggcgcaggttcaagagaggggcgaaaccccccccaggtctcaacatgtgagcctgagttcttattcaagctacaagacttgcgtcagttctttgtgtgtgaacaaggaagaaagaggaatgaagatttactacatgcaggttcagatgaacaaaggtgtcgccgtctcctgggaaacagaggaaaccttggaaagcttggagaaacagcccagaatggaggaagtaactctgtccgaggtggtgcgggtcggcacaccgccgtctgacgtgtctacccgcaacttactgtccgactctgagccaagtggggaggagaaggaacatgaggagcgaactgagtccgacagtctgccggggtcaccaacagtggaagacactccccgtgccaagaccccagattggctcgttacaatggaaaatggattccgatgtatggcttgctgcagagtctttacaacaatggaggccttgcaggagcacgtccaatttggaatccgggaaggattcagctgccatgtatttcacctgactatggcccaactcacgggcaacatggaatctgagagtacacaggatgagcaggaagaggaaaacggtaacgagaaggaggaggaagaaaagcctgaagcgaaagaagaggagggacaacccaccgaggaggacctcggactccggcggtcgtggagtcaatgcccgggctgcgtttttcactccccaaaggaccgtaactag

SEQ ID NO: 29766 - DNA, 849 bp, Artificial Sequence
  Description of Artificial Sequence: Synthetic coding sequence
atgaagaggcggcagaagagaaagcacttggagaatgaagagtcccaggaaacagccgagaaaggcggaggtattcagaggatccaccgagattcaccacagccacaatccccgttggcgcaggtgcaggagcggggtgaaacccccccccgcagtcagcatgtgagcctgtcctcctactcatcctacaaaacctgtgtatccagcctgtgcgttaacaaggaagaacggggcatgaaaatctactacatgcaggttcagatgaacaagggagtggcagtgtcatgggaaacagaagaaactcttgagagcctggagaagcagccccgtatggaagaagttacactaagcgaggtggtacgcgtgggtacccctcctagcgacgtttccacccggaatctgctgtcggattcagaacccagtggagaagagaaggaacacgaagagcgaaccgagagcgactccctccccggctccccaacggttgaagatacgcctcgggccaagacacccgactggttggttactatggaaaatggcttccgctgcatggcttgttgcagggtgttcaccacaatggaggctctgcaggagcacgtgcagttcggaatacgggagggcttttcttgccacgtcttccatttgactatggctcaattgactggtaacatggaatctgaatctacccaggacgagcaagaagaagaaaacgggaacgagaaggaggaggaggagaaaccggaagctaaagaagaagaagggcagcccaccgaagaggatcttggactgcgccgaagttggagccagtgtccaggctgtgtcttccactctccaaaagaccgcaactag

SEQ ID NO: 29767 - DNA, 735 bp, Artificial Sequence
  Description of Artificial Sequence: Synthetic coding sequence
atgaaaaggcggcagaaaagaaaacacctggagaacgaggagtcacaggagaccgcggagaagggcgggggtattcagcgaattcatagggactcaccccagcctcagtctccgttagcgcaagtgcaggagcgcggcgagacaccccccaggtctcaacatgtgagcctgtcatcctactcatcatacaaaacatgtgtgtcttctctatgcgtgaacaaagaagagcgcgggatgaaaatctactacatgcaggtccagatgaataagggcgtggctgtgtcttgggagacggaggaaacgctggagtccctggagaagcagcctcggatggaagaggtgactctttcggaggtagtgcgcgttggcacccccccatcagatgtgtcaacacgcaatctgctgtccgattccgagccgtccggggaagagaaggaacacgaggagcggaccgagtctgacagcctgcccggctccccaacagtggaagacaccccaagagccaagaccccagactggttagtgacaatggaaaacggatttcgctgtatggcttgttgtcgcgtattcaccaccatggaggcattacaagagcacgtgcagtttggtattcgagaagggtttagctgtcctaaaatgtcacggcgcaggaagatggaaatgaggcggcggcgaaaacgcaaccagaagcagcgtagaagacgcggctctcctcagaaaaaaacccttgcttag

SEQ ID NO: 29768 - DNA, 993 bp, Artificial Sequence
  Description of Artificial Sequence: Synthetic coding sequence
atgaaaaggagacagaaacgaaaacatctggagaatgaagagagtcaagaaactgccgaaaaaggggggggcatgagcaagtctcaggaggacgccctgcagcctgggagcacacgtgtggccaaaggctggtcccaaggcgtgggggaggtcacctcaacttcagaatattgtagttgcgtctcatcttccagaaagctcatacattctggcattcaacgtatccatcgcgattctcctcagcctcagtcgcctctggcccaggtccaggaacggggggaaacgcccccacggagccagcatgtttctttgagctcgtacagcagttacaagacctgcgtgagttccctctgcgttaacaaagaggaaagaggcatgaaaatttactacatgcaggtccaaatgaacaaaggggtcgcggtttcatgggaaactgaagagactctggaaagtctggagaaacaacctcgaatggaggaggtgacgctgagcgaagtggtgagagtgggcactccaccgagcgatgtgtcaactaggaacctactcagtgattccgagcccagtggggaggagaaagaacatgaggagagaactgagtcagacagcttacctggctctcccactgtggaagatacacccagggcaaaaacccccgactggcttgttacgatggagaatggattccggtgcatggcctgctgtcgagtttttactactatggaagcgctgcaggaacatgtgcaattcggaatcagagagggtttctcatgtcacgtcttccatctgactatggcacaactgactggcaacatggaatctgaatccactcaggacgaacaggaagaggagaacggaaatgagaaagaagaagaagaaaaaccagaggcaaaagaagaggaggggcagccaaccgaggaagaccttggattacgacgtagctggtcccaatgtccgggttgcgtgttccacagtcccaaggatcgcaacagctag

SEQ ID NO: 29769 - DNA, 852 bp, Artificial Sequence
  Description of Artificial Sequence: Synthetic coding sequence
atgaaatgctactttacggatcaccgcggagagcagagtccaactgatgggactactctctcgctaacgtctcccgagtctacagaggaaagtgtggaggtcttctggccaggcactatccagagggaaggctcctctcccagaccagggccagccattccgagagaagagggcctctattttgcagctcgggatcgtgggatgagggattggtccagctcacccagcagcgaaagtagcgagtatcagagctatagccaatatcagtcatgctgttcttgcatgtgcgatgaagataacgctgcgcctcagtctgtgtgtgctttttacactcacgttcaaacagttcggggagtagcagtggcctgggaaacggaggctgggtttgagcccgtaaccagaaagccaaggatccacgaggcacagttcatcaaacgccagcggtggaatggctcatcgtttgaaatggcatccaacacagacatgaggtgggatctggaagcatgcaaaagcaattgttccccagagcctgaagatatagacctgctcgagtgctgcctacaagagctaagggaaccccccgactggctcgttacaacaaactacggcgtgcggtgtgttgcctgctgccgggtgctaccaagccttgacgctcttctggagcatgctcagcacggcatccgagaaggtttttcatgtcagatcttttttgaagagatgctggagcgaagacgggcccaaggccaggcccacgaccagcagctcgaggaggaacagtctccctctgataactctgagtgtagcagaccgcagggggaagtcctctctgcacagcagcaggagaaacagtag

SEQ ID NO: 29770 - DNA, 498 bp, Artificial Sequence
  Description of Artificial Sequence: Synthetic coding sequence
atggacgccccgaggagagacatggaactgttgagtaattctctggctgcctatgcccatatcagagccaatcccgagagcttcgggctttattttgttttgggggtttgcttcggtttactgttgacgctgtgtctgttggtcatatccattagctgggctcctcgccctagaccaagaggtcctgctcagcgtcgggaccctcggagtagcaccctggagcccgaagacgatgatgaagatgaagaggacaccgttactagactgggccccgatgacaccctcccaggccccgagctgtctgctgaacctgatgggcctctcaatgtcaatgtattcacatccgctgaggagctggagagggcccaacgcttggaagagagggagcggattttgagggagatctggcgcacaggtcagcccgacttgttaggcaccggcacactgggaccaagccctaccgccacgggcaccctggggaggatgcactactactag

SEQ ID NO: 29771 - DNA, 711 bp, Artificial Sequence
  Description of Artificial Sequence: Synthetic coding sequence
atggaggtgggacttccagctatcacattattcctgactagtgccagcagcccagtggttgcaaccactatggatcaagagccagtggggggagtcgaacgcggagaggccgtggccgctagtggcgctgccgctgcagcagccttcggggagtccgccggtcagatgtcaaatgaacgaggcttcgagaatgtcgaacttggtgtaataggcaaaaaaaagaaggttcctaggagagtcattcatttcgtatccggggaaacgatggaggagtactccaccgatgaagatgaagtggacggactcgagaaaaaagacgttctgcctactgtggaccccaccaaattgacatggggcccctatctgtggttttatatgctcagggccgcaacgtctactctgtccgtttgtgactttctaggcgaaaagatcgcgagcgtgctcggcatctccactcctaaatatcaatatgccatcgatgagtactatcgaatgaagaaagaggaggaagaggaagaagaggaaaatcgaatgagcgaggaggccgagaagcagtatcaacaaaataagctccagaccgatagcatcgtacagactgatcagcctgagaccgtaatcagttccagtttcgtcaatgtaaacttcgagatggagggtgattctgaggtgattatggagtccaagcagaacccagtgtcagtgcctccttag

SEQ ID NO: 29772 - DNA, 642 bp, Artificial Sequence
  Description of Artificial Sequence: Synthetic coding sequence
atggaccaggagcccgtgggtggggtggagcgaggcgaagcggttgctgcctcaggagccgccgccgcagccgcctttggcgagagcgcaggacagatgagtaatgaacgtggatttgagaatgtggagttgggagtgatcggcaagaaaaagaaagtaccacgaagggttattcacttcgtcagtggagaaacaatggaagaatacagcaccgatgaggacgaggtcgatggactggagaagaaggacgtcctccctaccgtggacccaaccaagctgacatggggcccttatctttggttctatatgctccgtgcagcaacatcaactctgagtgtgtgcgactttttgggtgaaaagattgcttctgttctaggcataagtacgcctaagtatcaatacgctatcgacgagtactacagaatgaagaaggaagaagaggaagaggaagaggaaaatcgcatgtcggaagaggccgaaaaacagtatcagcaaaataaattgcagactgattccatcgtgcagacagaccagcctgaaaccgttatcagtagttcattcgtgaatgtgaattttgaaatggagggagactcagaagttattatggagtctaaacagaacccggttagcgtccccccctag

SEQ ID NO: 29773 - DNA, 642 bp, Artificial Sequence
  Description of Artificial Sequence: Synthetic coding sequence
atggaccaggagccagtcgggggagtggaaagaggagaagccgttgctgcctctggtgccgccgccgccgcagctttcggtgagagtgcaggtcagatgtccaatgagagaggttttgagaacgtggaactcggagtgatcggaaaaaagaagaaggtacctaggcgcgttatccacttcgtctccggggagactatggaggagtattccaccgacgaagatgaggtggatggacttgaaaagaaggacgtcctccctactgtcgacccgaccaagctgacatggggcccgtacttgtggttctacatgctccgggctgctactagtaccctcagcgtgtgcgattttctcggagaaaagattgctagtgtgcttggcattagcaccccaaaatatcagtacgctatcgatgaatattaccgaatgaagaaggaagaagaggaagaggaggaagagaatcgcatgtccgaggaggccgaaaagcagtaccagcagaacaagctgcagaccgattccatcgtgcaaactgatcagccagagacagtcatttccagcagctttgtgaacgtgaattttgagatggaaggagatagcgaggtgattatggagtctaagcagaatccggtctcagtgcccccttag

SEQ ID NO: 29774 - DNA, 231 bp, Artificial Sequence
  Description of Artificial Sequence: Synthetic coding sequence
atggaccaggaacctgtaggaggggtcgagcgtggggaagctgtcgccgccagtggcgcagctgctgcggctgcgtttggcgagagtgccggccagatgagcaatgagcgcggctttgagaacgtggagctaggggttatcgggaaaaaaaagaaagtcccgcgccgggtgattcactttgtctccggagagactatggaggagtacagtactgacgaggacgaggtgtag

SEQ ID NO: 29775 - DNA, 477 bp, Artificial Sequence
  Description of Artificial Sequence: Synthetic coding sequence
atggagatagatgggttccagcagttggaccttgagaagtccgtgccgtccaaaaaaacaaccccaaaaagaattattcacttcgtggatggggatattatggaggaatattcaactgaggaggaggaggaagaggagaaggaggaacagtcaacaaactctactctcgatccctccaaattgtcctggggcccctatctccgattctgggccgggcggattgctagtacatcattcagtacctgcgaatttttaggcggtagattcgcagtgttttttggcctgacccagcctaaataccagtacgtgttgaacgagttttacaggattcagaacaaaaagtctgataacaaaagcgagcggaggggaagtaaggcccaggctgccgaggtccctaacgagaagtgccacttagaggccggagttcaggagtacggtacaatccagcaggatgtcactgaggctattcctcagtag

SEQ ID NO: 29776 - DNA, 303 bp, Artificial Sequence
  Description of Artificial Sequence: Synthetic coding sequence
atggaaatcgacggtttccagcagctggatctcgaaaaaagtgtaccttcaaagaagacaacacccaaacgaatcattcattttgtggatggtgatataatggaagagtactccaccgaagaagaagaggaagaagaaaaagaagagcagagcaccaatagcaccttggacccaagcaagctgagttggggcccttacctgcgcttctgggccgggcgcattgctagcaccagcttctcaacatgcgaattcctgggcggcaggttcgctgttttcttcgggctcacccagcccaagtattag

SEQ ID NO: 29777 - DNA, 477 bp, Artificial Sequence
  Description of Artificial Sequence: Synthetic coding sequence
atggagatcgacggatttcagcagctcgaccttgagaaatccgtaccatccaaaaagactacccccaagcgcataatccactttgtcgatggcgacattatggaagaatacagcacagaagaggaggaggaggaggagaaagaggagcagagcacgaattctactctggatccatccaaactaagttggggtccatacctgcgtttttgggctggaagaatagcctccacttctttttctacatgcgagttcctgggagggcgtttcgctgtattctttgggctcacccagcctaagtatcagtatgtgctcaacgaattctacagaatccagaacaaaaagagtgataataaatccgaaagacgaggtagcaaggcccaggcggccgaagtgcctaatgaaaagtgccacttggaagctggcgtgcaggaatatgggacaatccaacaggatgtgaccgaggccatccctcagtag

SEQ ID NO: 29778 - DNA, 300 bp, Artificial Sequence
  Description of Artificial Sequence: Synthetic coding sequence
atggaaatagacggatttcagcagctcgatctggagaaatctgtgccttcaaagaaaaccactccaaagcgcattattcattttgtagacggagatattatggaagagtactcgaccgaagaggaggaggaagaggaaaaagaggaacagagcaccaactccacattagacccaagcaagctgtcctgggggccatatctgcgcttttgggcaggcaggatagctagcacctcctttagcacatgtgaatttttaggagggagatttgctgtcttctttggtcttacccagcccaaatag

SEQ ID NO: 29779 - DNA, 1944 bp, Artificial Sequence
  Description of Artificial Sequence: Synthetic coding sequence
atggccggtccgcaggagacggtgctggccctccctctgagagagggtgtgcaggccgcggccacagtgccaattctgctgtataacttagaagacggcttgagcgaccaccctctggaccaagggccccgctgccctgctcgacgaccgtgctccccagccagtgcacccgcgccgacctcacccaaaaagccaaaaatccaggcccctggcgaaacctttcctacagactggtccccgcccccggtcgaattcctgaacccgcgtgtgctccaagccagccgagaagcccctgcccagaggtgggttggagtggtcgggcctcaggggctgcggcgtctcgccggagagctgccagaggaattggaacaggagcatctggatctggaccctaagagagggctggcactgccagaaaagcttttttggaatacaagcgggctgagccagcaagctgcagctcccgagttcagctggggaggctctgggagttactttaataacttggattatttgctgcaggaaaagagagaacaggccctggagcaggagcgagaaagactccttcttcaggaatgtctcaacctgaattcactggatctggacgaggaagaagtcccactgacacctgagcacagaatgttggtcgagaaatacagcgtgtctctgcagaccatcccccccgtgcatccaggcgaaactgtgtttctgcccaggtgccacccgctcccatgtattctggattcttcgctgctaaaacctaggtcccacctcgagggcttgttccttagcagtccccccgcacagcagttgtcttttctgagatccggcctgctcaacattctctacctacatatgccagactgccccgtcagtctgctgcagtggctgtttcagctgctaacatggccccccgagaccagcctaggtgcctttggcttgctttgggacctcatcgtggacgggatatttttgcagcctgacgaggataagcatctctggtgcccctctctccaagaggtgcgggaggcatttcattctctaggtgcccactctccagcattgtatcccctcgggccgttctggcacggaggccgggtgcttcctggcgaggcaggcctgaacgagaatgaagagcaggacgctccacaggaaattgccctggacattagtcttggccatatctacaaatttctcgccctgtgcgcccaggcccaacctggagcttatactgacgaaaatcttatgggactcatcgagcttctctgccgcaccagtctcgatgtgggactgcgcctgctgcctaaagttgacctgcagcaactcctgcttcttctactggaaaacattagggagtggcctggcaagctccaggaactttgttgtactctgtcctgggtgtccgatcaccaccataacttgttagccctcgtgcagtttttccctgatatgaccagccgatcaagacgtctccggtcccagcttagtctggtcgtcatagcccgaatgttgggtcagcaggaaatgctacccctgtggcaagaaaagacacagctatcctcgctgtctcgcctacttggtctcatgcgtccgagctctctacggcagtacttagatagcgtgccactgcccccgtgtcaggagcagcagcccaaggcatctgccgagcttgatcataaagcctgctacctgtgccactccctcctcatgcttgccggcgtcgtggtgagctgccaggatattaccccagatcagtggggagagctgcagctcctgtgtatgcagctcgatagacacatctctacacagattagagagagcccacaggctatgcatagaacaatgttgaaggacttggcgacacagacatacatccggtggcaggagctgctgacacattgtcagccccaagcccagtacttcagcccatggaaagacatttag

SEQ ID NO: 29780 - DNA, 360 bp, Artificial Sequence
  Description of Artificial Sequence: Synthetic coding sequence
atgcgcccctcctccctaaggcagtatcttgacagtgtacccctgccgccatgccaagagcagcagccaaaggccagcgctgagctggaccataaggcatgctatctttgccatagcctgcttatgctggccggcgttgttgtgagctgccaagacataactccggaccagtggggggaactccagctcttgtgtatgcaattagacagacacatctccacacaaatccgggaaagtccccaggcaatgcaccggacgatgttaaaggacttagccacccagacctatattaggtggcaagaactcctgacccactgccagccccaggcccagtacttcagtccttggaaggatatttag

SEQ ID NO: 29781 - DNA, 2484 bp, Artificial Sequence
  Description of Artificial Sequence: Synthetic coding sequence
atggctcatgagagagagatcctgaaagggatgtacgaagaactgaaagagaagagccataaacctgacgtcgagctcattcaacatcgcgcatggcgaatcgatatggtatctaccgaactggagtctttccgaaaagcctcttacatcgaatctggccctgaggaattctatcagcgctttaagaagtgcttctctgccacccatatcttcatctcgataaagggcaaagatagccagaatacagctcacggctacctgatcctgaacaggacattgcaccaacagttgaaaattaagaaccccttcctagctccttcttcagaagctgtgagaatcccagcaactctaccacaccccggagcacttccttttccaccctatgtcgctaaggctagctcggacgagctgctcaaccttcagaagccccttcagtccgctctgggattcgtaatactgcgctcttcccagaattggaatagcaagaatcgacagcggtggtcacggactaaagcaggccaaatgagccatgggctgcaaatggctgggccccaggagactgtccttgcgctaccactgagagagggagttcaggctgctgctaccgtgcccatcctgctgtataacctcgaggatggcctctctgatcaccccctggaccaagggccaaggtgtcctgcaagaaggccttgttctccggcttctgcaccggcacccacttcccccaagaaacccaaaatacaagccccaggcgaaaccttcccaactgactggagcccaccaccggtggagttcctgaatccccgcgttctgcaggcaagtagagaggcgcctgcccagagatgggtgggcgtcgtcggcccccaggggctgcgaagactggctggggaactgcccgaggaactggagcaagagcatctggacctggatcccaaaagggggctggcattgcctgagaagctgttttggaacacaagtggtctgagccaacaggccgcagctccagaattctcctggggcgggagcggctcttattttaacaatctagactatctgctgcaggaaaagagggaacaggctctggaacaggaaagagagcgactactgctccaggagtgcctgaacttgaattccttggatctcgatgaagaagaggtgccccttacacctgagcacagaatgctggtggaaaaatatagtgtgagtctccaaacgatacctcccgtccacccgggagagaccgttttcctgccacggtgccatccccttccctgtatccttgattcatctctcctcaagccgagatcacacctggaagggctattcctgtcttcaccacctgctcagcagctgtccttcctgcggagcgggctactgaacatattgtacctccatatgccagattgcccggtctccttacttcagtggctgttccaactcttgacttggccccctgaaacctccctaggtgcattcgggctgctgtgggacttgattgttgacggcatatttctccagccggacgaagacaaacatctgtggtgtccaagcctccaggaggtaagagaggctttccatagtctcggggctcattcccccgcgctgtacccacttggcccattctggcacgggggcagagtgctgccgggagaggcaggtctgaacgagaacgaagaacaggacgctccacaagagatcgccctggacatctccctagggcatatttacaagttcctggcactctgtgcgcaggctcagcctggcgcttataccgatgagaatctgatggggctcatagaactgctttgtagaaccagcctggatgtcggcttgagactgctcccaaaggtcgatctgcaacagctgctcttgctcctcttggagaatatcagagagtggcccggaaagctgcaggagttgtgctgcacactcagttgggtatcagaccatcatcacaacctcctggcccttgtgcaattttttcctgatatgacttcccgatcaaggaggctgaggtcccagctatcactggtggtcatcgctagaatgctgggacagcaggaaatgcttcccttgtggcaggagaagacccaattatcctccctgtcaaggctccttgggctgatgcgcccctcctcactccggcaatatctcgacagcgtaccccttcctccctgccaggagcaacagccaaaagccagtgctgaactggaccacaaggcgtgctatttatgtcactccctactaatgctggccggggtggtggtgtcctgccaggacattacacccgaccaatggggcgagctgcagctgttatgtatgcaactggacagacatatcagtacccagataagagaaagtccccaggctatgcaccgtaccatgctgaaggatctggcgacacaaacctatattaggtggcaggaactgctgacccattgccagccacaggcacagtacttttctccctggaaggacatttag

SEQ ID NO: 29782 - DNA, 2040 bp, Artificial Sequence
  Description of Artificial Sequence: Synthetic coding sequence
atgtggcctcgactgcctggtgccgggttggccccgcagctcagacggcaggatcagaggctccatttcaccggtcagatgagccacggcttacagatggccggcccccaagaaaccgttcttgccctgcccttgagagagggtgtccaggccgccgccacggtcccaatattgctgtacaatctggaggacggcctctccgatcatcccctggaccagggcccaagatgcccggcaagacgaccctgttcaccagcatctgctcctgcccctacctcacctaaaaagcccaagatccaggcccccggcgaaaccttcccaaccgattggtccccccctcctgtcgagtttttaaaccccagagtgctccaggccagccgggaggcaccagcccagaggtgggttggtgtggtcggacctcaggggttgaggcgactcgcgggggaattgcccgaggaactggaacaggagcatcttgatttggatccgaaaaggggtttagccctgccggagaaactgttttggaacacctcaggattaagccaacaagcggccgcgcctgagttcagctggggtggatcgggatcctacttcaataacctggactaccttctgcaggaaaagcgggagcaggcgctcgaacaggaaagagagagacttttactgcaggagtgcttaaacctaaacagcttggaccttgatgaagaagaagtcccactgacacccgagcatcggatgctggttgaaaagtacagcgtctctttgcagacgatcccccctgtccatccaggggagacagtttttcttccgcgctgtcatcccttaccctgtatcctggattcgagtttacttaagccaaggtcccacctggaggggctctttctgagttccccgccggctcagcagcttagctttcttcgcagcggactcttaaatatattgtatctgcacatgcctgattgccccgtgtcactacttcagtggctgtttcagttactcacctggcctccggaaacaagccttggcgcatttggcctgctgtgggaccttatcgtggatggaatcttcctgcagcccgacgaggataagcatttatggtgccccagccttcaggaggtgcgcgaggcgtttcacagcctcggggcacattcccctgccctatatcccctcgggccattctggcacgggggaagagtgctgccaggagaggcgggattgaacgagaacgaggaacaggatgctccccaggaaattgctctcgacatttccctgggacacatttacaaattccttgccctgtgtgcacaggcccagcctggagcctacactgatgaaaacctcatggggctcattgagctgctgtgccgtaccagtctggatgtcgggctgcgacttctgcccaaagtggatctgcagcaactcctactgctcctgttggagaatatcagggagtggcccggaaagctccaagagctctgttgtaccctcagctgggtatccgaccaccaccataacctccttgccctggtccagttttttcccgatatgacatccaggagccgcagactgcggagtcaactctctctggtggtcatcgcgaggatgctgggacagcaggaaatgttgccattatggcaggagaagacccagctcagttcccttagccggttgctggggctgatgaggcctagtagccttagacagtacctggactccgtaccactccccccttgccaagagcagcagccaaaagcctcagccgaactagaccacaaagcatgctacctgtgtcattctctgctgatgttggctggtgtggtggttagttgtcaagatattacacccgaccagtggggggagctgcagctcttgtgtatgcagctcgacagacatatcagtactcagatccgcgagtccccccaggccatgcataggactatgttgaaggacctggctacccagacgtatatccgctggcaggaacttcttacccattgtcagcctcaggcccagtacttcagcccttggaaggacatctag

SEQ ID NO: 29783 - DNA, 3060 bp, Artificial Sequence
  Description of Artificial Sequence: Synthetic coding sequence
atgggaacccgtgatgatgtacctgaggctaaagtcctggtgcctgttgcagtatattgcggcagcatcccaaggacaagtgccgggccgcgcgtactaccaccaggctccattaatagctctctgcctcatggggagggctctctccagcctgaacctagagctctgctgaataacgaggaaccatcccaactgctccggggattggggcaattgggcggactgaaacttgatacaccctccaaggggtggcaagcccgcaatggccatcccagaaacctgagggctctgtctctgggtgaccagcccctggtgctcttgccttcccctgagtctgaagccaactcggtcgcgagagatactattcagatcaaagacaagcttaaaaaacgccgcctgagcgaggggctagccgcgtctagccgcgcctctctggaccccggtggtggcccacagggagtccctctgcactcaacaatccccagagcaactagccagcgcctcctaagagtcccccgaccgatgcccttgatccagagcatccctaccactccagaagcatctggagtgaaagagaaaggcctcgacttacctgggagcatacccggcccacatgagctcagaccgggagcacaagaagcccagattagctggcagtacttacattgtaacgacgaaaagatgcaaaaaagcctgggagcaatcgtcattccccctattcccaaggcaagaaccgtggcagcaacccccagccgggtcccagggtccttgcccagtcccctgcccccaggtcagggggtgctaactgggttgcgggccccacgcacacgtttggcccgcgggagtggaccaagggagaagacccctgcatcccttgaaccaaaacctttggcaagccctattagagatagacctgctgccgcaaagaaacctgccctgccgtttagccagagcgcacccactttaactgccttctccttcgactgcgctcgtgaggcctgcccacccttaaaagaggaagatcagaaggaaataggcactaagattcaagtgactataagcaagagtgccagagagaaaatgcaactgaaacagatgaaagagatggagctattgcgccggcttgaggagcctcgcaccggccaggagctgaccagccagtgtctgggctctcagcgggcattcatgaaggagggactgttgccactacgagggtcggggactcttagcgtgcctactcggctgagcggtccttgtcggaacgatgtttcaattatattgcgcaaatgggcgtcccgggcctcccttccctcgatcccgataagcaggcaggaaccccgtttcgcaaggcacgcgagtgccaacagccttccagctgtgttaaccctgggttccccagagtgggaagaagaggaagaaatggacttgagggcctgtaaggagctacgccccttctccaaccccgaacttggcttgagggatgcactgcagtgtttaaatagttctgattggcaaatgaaagagaaaggactggtttccattcaacgacttgctgcctgtcactccgaagtgttgaccggcaaactgcacgacgtctgtctcgttgtgaccggcgaagtgactaacctgcgtagcaaggtgtctcacctggctatctctacattaggcgacctttttcaggcgttgaagaaaaatatggatcaagaagctgaggagatcgccagatgtctgctacagaaaatggcagataccaacgagtttattcagagagcggctggtcagagtctgcgagctatggtggaaaacgttacgctcgctcggtctttggtggtgttgacaagcgccggggtgtaccaccgcaatccactgattaggaaatatgcggccgagcatctgtccgcggttctggagcaaataggagctgaaaagcttctgtccgggactagggatagcacggacatgcttgtgcataatcttgtccgattggctcaggatagcaaccaagacacgcgtttttatggacgcaagatggttaatattctcatggctaacacaaaatttgatgctttcttaaagcagtctcttccctcatacgatctgcaaaaagttatggccgcaatcaaacaacagggcatcgaagacaacgacgaactcccaagcgctaaaggaaggaaggttcttagatctttggtggtctgcgagaatgggctacctatcaaggaggggttgtcctgtaatgggcctagactcgtgggcctgaggtccaccttgcagggcagaggggagatggtagagcagctcagggagttgactcgccttctcgaggcaaaagacttccgttctaggatggagggcgtcggtcaattacttgagctgtgtaaggccaaaactgaactggtcacagctcacctggttcaggtgttcgacgcttttaccccacgtctacaggacagcaacaagaaagtgaatcaatgggctctggaatctttcgctaagatgattccactgttgcgggagtccttgcaccccatgctcctaagtatcattataaccgtggccgacaacttaaactccaagaacagcggaatctacgccgctgcggtggctgtgttggacgccatggttgagagcctggacaatctctgtctgttgccagccctagctgggcgggtgagattcctatccggacgagctgtgctcgacgttacagatagactggctgtactggtggcatctgtctatcctcgcaaaccccaggctgtggaaaggcacgtcctcccaatcctttggcatttcctcaataccgcaacgaggaatggcaccctgcccggaccctccggcaatatccgcggggtggtttgtcgactgtcccggtccctgcaggagcatatgggctcccgactgctcgatttcgcagcaagccagccaaagcacgtgctcaagaccctccaagagctcctggatagcgaatccctgggggggtcgagaaaagcaaccgataggggagtggctcccgactccaagaccacgggtagctcatacccattccagttggactag

SEQ ID NO: 29784 - DNA, 2895 bp, Artificial Sequence
  Description of Artificial Sequence: Synthetic coding sequence
atggggactagagatgacgtgccagaggccaaggttctagtacctgtggctgtatactgcggaagcatacctaggacgtccgccggtcccagagttttaccccctgggtctatcaacagctctctccctcatggggaaggctcgctccagccggaacctagggccttactaaataacgaagaacctagccagctgttaagggggcttggacaattgggtggtctcaagctcgatacaccttctaaggggtggcaggcaaggaacggacacccccgcaatctaagggccctcagtttgggtgatcagccattagtgctgttgccctccccagaaagcgaggcaaactctgtcgctagggacacaatccagattaaggacaagttaaagaaacgcaggcttagcgaaggcctggccgcatccagtagagcttcactggaccctggcggcggcccgcagggtgttccactccatagtacaattcctcgggcaacaagccagaggctgctgcgggtacctcgtccaatgccgttgatccaatccatcccgacgacaccagaagcgagtggagttaaggaaaagggcctcgatttgccgggtagcattccaggccctcacgagctgagaccaggggcccaagaagctcagatcagttggcagtatctccattgcaacgacgaaaagatgcaaaagtctttgggcgcaattgtgatccccccgatccccaaagcccgaacagtggcagctacgccctcacgcgtaccagggtccctcccttctccactcccacctgggcagggggtccttaccggtttacgcgcgcccaggacgagactagcccgcggtagcggcccacgcgagaaaactccggccagcttggagccaaaacccctggcatcacctattagggaccgacccgcagctgcgaaaaagccagccctgccattcagccagtctgcacccactctcaccgcattctccttcgactgtgcccgggaggcctgcccacctttgaaggaagaagaccaaaaagagataggcaccaagatccaagttactatctccaaaagcgctcgagagaagatgcagcttaagcagatgaaggagatggagcttttgcgcagacttgaagagcctaggacaggccaggagcttacttcacaatgcctggggtcccaaagagcctttatgaaggaggccaactctcttccagccgttcttactctgggcagcccagaatgggaggaggaagaggagatggacctgagagcctgtaaggagttgaggcctttctcaaaccccgagttaggcctgcgagacgccctccagtgcttaaactcaagtgactggcagatgaaagaaaaaggacttgtgtctattcagcggctagccgcttgccattccgaagtgctgaccgggaagttacatgatgtctgcctcgtcgtgacaggcgaagtgacaaatctgcggtccaaggtgagccaccttgccatctccacactaggtgatctgttccaggcactcaagaagaatatggaccaagaagccgaggaaattgcaaggtgcctgcttcagaagatggctgataccaatgaattcattcaacgtgcagctggacaaagccttagagccatggtggagaacgtgaccctggcaaggtccctggtcgtcctgacttctgcaggtgtctaccaccgcaacccactgattcggaagtacgcggccgaacacctgagtgcggtcctggagcagatcggtgctgagaagctgctcagcgggacaagagattccacggatatgcttgtgcacaatctggtgagattggctcaggacagtaaccaggacactcggttttacggtagaaagatggttaacatccttatggctaataccaagttcgacgctttcctgaaacagtctctgcctagttatgatctgcagaaagtcatggctgccatcaagcagcagggcattgaagataatgacgaacttccttccgccaaggggcggaaagtactgcgttctctggtggtttgtgagaacggcctgccaataaaagagggactcagctgtaacggaccgcgcctggtggggctcagaagcactctccagggcagaggtgagatggtagagcagctgcgagagctgacaaggctgctagaagcgaaggattttagatctagaatggaaggcgtcggacagcttctagagctctgtaaagctaagactgagctggtgaccgcccacctggttcaggtgtttgacgcattcacacctcgactccaagattcaaataaaaaagtcaaccagtgggcactggagagtttcgcgaaaatgatcccactgttgagagaatcactccaccctatgctcctgagtatcattataactgtagccgacaaccttaatagcaagaactctgggatctatgcggcggctgttgcagtcctcgacgctatggtcgaatcacttgataacttgtgtctgttgcctgcacttgccgggcgggtgagatttctctcaggcagggcagtcctggacgtgactgacaggcttgccgtgttggttgccagcgtatatccccgcaagccacaagctgtagagagacacgtgctccctatattatggcattttctaaatacagctactcgtaatgggaccctacccggcccgagtggcaacattcggggggtagtgtgccggctgagtcgctctctgcaggagcatatgggttctagattgctggactttgctgcaagccagccaaagcacgtgctgaagacactgcaggaactgcttgacagcgaaagtctgggaggaagtcgaaaggccaccgacagaggagtcgcgcccgattccaagaccaccggctcaagttaccctttccagttggactag

SEQ ID NO: 29785 - DNA, 210 bp, Artificial Sequence
  Description of Artificial Sequence: Synthetic coding sequence
atgggcacacgagacgacgtccccgaggcaaaggtgttggtgcctgtggcagtatattgtggcagcattcctcgaacctccgccgggcctagggttctgccccctggctccattaattcctcactaccgcacggtgagggctccctccagcccgagcctcgcgcattgttaaataacgaagaaccctctcagttgttgcggggcctgtag

SEQ ID NO: 29786 - DNA, 5163 bp, Artificial Sequence
  Description of Artificial Sequence: Synthetic coding sequence
atggcagcagccccctctgctctgctgctcttaccaccctttccagttctgtctacttacaggctgcagagtaggtcccgtccgtccgcccctgaaaccgacgactcgagggtgggtggcattatgcggggcgaaaagaattactattttaggggcgccgccggggatcacggatcgtgtcctaccacaacttcacccctggctagcgcccttctgatgccgagcgaagctgtgtcaagctcttggtcggagtcaggaggggggctctctggaggggatgaggaggacactcggcttctgcagctgctgagaactgctcgggatccttccgaggcgttccaggctttgcaagcagctctgccccggcgcggcggaaggctgggatttccccggcgaaaggaagcactgtatagagctctcgggagagttctcgtggaagggggcagcgacgagaagcgcctatgcctccaattgctcagtgatgtccttcgcgggcagggagaggccggccagctggaggaggcattctctctggccctcttgccacagctggtagtgtcccttcgggaggagaatcccgctctccgcaaagacgccctgcagatcctacacatatgcctcaaaagaagtccaggggaggttttgaggacactgattcagcagggcctggaaagcaccgatgccagactccgagcttccactgcactgctgctgccaattctcctaaccacggaagatctgctcctcggcctggacctgactgaagttatcatcagcctggctcggaagctcggtgaccaggaaaccgaggaagagtcagaaacagcgttttccgccctccagcaaatcggagaaaggttgggccaggacaggtttcagagttacataagcagattaccttcagccctccgccggcactataacaggaggttggaaagccagttcgggtcacaggttccgtattacttggagctcgaagcgagtgggtttccagaggacccactgccatgcgccgtcacactgagtaattctaacctgaagttcgggattattccgcaggagctgcatagccggctgctggatcaggaggattacaagaacaggacccaggcagtggaagaactgaaacaagtcctgggaaagtttaatccatccagtactccccacagcagcctcgtcggcttcatttcactactgtataatctgctggacgacagcaacttcaaggtagtgcacggtactctggaagttctgcatctgctggttatccgcctgggagaacaggtgcagcaattcttgggccctgttatcgccgccagtgtcaaggtgttggctgacaataaactcgttatcaagcaggaatacatgaagatctttctcaaacttatgaaggaagttggtccgcagcaggtcctctgcttgctgctcgagcacctcaaacataagcactcccgcgtgcgcgaggaagtggtgaatatttgcatttgttccctgctgacttaccctagcgaggacttcgatctgccgaaattgagctttgacctggcacctgccctggtagatagtaagagacgcgtccggcaagcagctctggaggcttttgctgtgctggcttcatcaatgggtagcggaaagacctctattctgtttaaggctgttgataccgtagagctgcaggataatggcgacggcgtaatgaatgcggtccaggctagactcgcacggaaaactctgccacgtttgaccgagcagggcttcgtagaatatgcggtgttaatgcccagctccgcaggtgggagaagcaaccatctagctcacggggcggatacagactggctactggccggcaacagaacacagtctgcacactgccattgtggagaccacgtccgcgacagcatgcacatttatgggtcttacagtcccaccatatgcacgcgtcgggttctgagtgccggcaagggcaaaaataagttgccatgggagaacgagcaacccggaatcatgggcgagaatcagacctccacttccaaggatatcgagcagttttcaacgtacgattttattccaagcgccaaattaaagttgagtcaaggcatgcctgtgaacgacgatctctgttttagtaggaagagggtgtcccggaacctgttccagaattcacgggattttaacccagactgtctcccattgtgtgcggcaggcactacaggcacccatcagactaacctgtcgggtaaatgtgcccagttgggctttagtcagatctgcggcaagaccggctccgtgggatctgatctgcagtttttggggacgacaagttcccaccaggagaaggtgtatgcgtctttgaattttggaagcaagacccagcaaacctttgggagccagacagaatgcacatcctcaaacggccaaaacccatcccccggagcttatattcttccttcgtaccctgtctcctctcccaggactagcccaaagcacacctcacccctgataattagcccgaaaaaatcccaggataatagtgtcaacttctcaaacagctggcccctgaaatcgttcgaaggcctgagcaagcctagtcctcagaaaaaattggttagccagaaaagttctgatccaacagggcgcaatcacggcgaaaacagtcaggaaaaaccgcccgttcaactgaccccagcccttgtgcggagcccgagctcgcggagaggactgaacgggaccaagcctgtgcctcccataccaagaggcatctctctcttaccagataaagccgacctctccactgtgggccacaaaaagaaagaacccgacgacatttggaaatgtgaaaaggactcactccccattgacctcagcgaattaaattttaaggacaaagatctggaccaggaagagatgcattctagcctacggtctctcaggaattctgctgccaagaagagagcaaaacttagtgggagcactagcgacttggaatcacccgactcggccatgaaactagatctgacgatggactcccctagtctgagcagtagtccgaacatcaactcctactccgagagcggcgtatattcacaggagtcattaacaagctctctgagcaccactccacagggaaagcgaatcatgtccgacatttttccaacattcggcagtaaaccctgccctacacgacttagcagtgcaaagaagaaaatctcgcacattgctgagcagtcaccatctgctgggtcttcgagtaatccccaacagatttcttcttttgacttcaccacaactaaagccctgagcgaggactcagtagtcgttgtcggcaagggcgtgttcgggagcctttcaagcgcccctgccacatgcagccagtccgttatcagctctgtggagaacggcgatacgttctcaatcaagcagagcatcgaacctcccagcggcatctacggccgctctgtccaacagaacatttcatcatacctagacgtcgagaatgaaaaggatgcaaaagtgagcatctccaaatccacgtataacaaaatgcgtcagaagcggaaagaagagaaggaattatttcacaataaggactgtgagaagaaggagaagaactcttgggagcgtatgaggcacaccgggaccgagaaaatggcatccgaaagtgagacgcccacgggcgctatttcccagtataaggaacggatgccatccgttacccacagccccgagataatggacctgagtgaattgagaccctttagtaaacctgagatcgcccttaccgaagcactgcgcctgctggcagacgaggattgggaaaagaaaatcgaagggctcaattttattagatgtctcgctgcttttcattccgagatcctgaacactaaactgcatgaaaccaactttgcagtggtgcaggaagttaagaatctgagatcaggcgtgtccagggcggcggtcgtctgcctgagcgacttgttcacctatctgaagaagtcgatggaccaggaattagatacaactgtgaaagttctgctccacaaggccggagagagtaatacttttatacgagaagacgtagacaaggcacttagggcaatggtcaacaacgtgactccagcgagagctgtcgtgtcactaattaacggaggccagagatactatggacggaagatgcttttttttatgatgtgccatccaaacttcgaaaagatgctggagaaatatgtgcctagcaaagatcttccctacattaaggactctgtgcggaacttgcagcaaaagggactcggcgagattcctctggataccccctcggccaaagggcgcagatcccatactggatctgtggggaacacacggagttcaagtgtaagcagagatgccttcaattccgccgaacgcgctgttaccgaagtgagagaagtcacccggaagagcgtgcctcggaattctctagagtccgccgaatacttgaaactgatcacgggtctgctgaacgccaaggacttccgtgatcgcataaacggcatcaagcagttattgtcggataccgaaaacaaccaggacttggtcgtgggaaatattgtgaaaatcttcgatgcctttaagagtcgactgcacgactcgaactccaaggtgaacttggtagcactggaaactatgcacaaaatgatccccctgttgagggatcatctgagtcccatcatcaatatgctcataccggcaattgtggataacaacttgaatagtaagaatcctggaatatatgccgccgctactaacgtagtacaagcgctctcacagcacgtggataactacctcttgttacagcctttctgtacaaaagcacagtttctcaatgggaaagctaagcaagacatgaccgagaaattagccgacatcgtgactgaactataccagagaaaaccccatgccacagagcagaaggtgcttgtagtgctgtggcatctcttggggaacatgacaaactcaggtagccttccaggagccgggggcaatattaggaccgctacagccaaattgtctaaggccctttttgcacagatggggcagaacctgcttaatcaggccgcctctcagccccctcacattaagaaaagtcttgaagagttgctggacatgaccattttgaatgagctgtag

SEQ ID NO: 29787 - DNA, 2988 bp, Artificial Sequence
  Description of Artificial Sequence: Synthetic coding sequence
atggccgcagctccatcagccctgctgttactgcctccatttcccgttctctccacttataggctccagtcccgctcaagaccatcagctccagaaacggacgactcccgagtcggcggcattatgaggggagaaaagaattattactttagaggggccgctggggaccacggtagctgtcctactactacttctcccctcgcttcagccctgctcatgccgtccgaggccgtgtcatcatcctggtcggagtctggaggcggactttcaggcggggatgaggaggatactagactgttgcagctgctccgtacagcgagggatccttcagaggcatttcaggcattgcaggccgccctgccgcgccgcgggggaaggcttgggtttccccggcgaaaggaggccctatatcgggccttggggcgcgtcttggtggagggggggtcagatgaaaagagactatgcctacagcttctcagcgacgtccttagaggtcagggcgaggccggacagctggaggaagctttctccctcgccctcctgccgcagctagttgtatctctgcgagaggagaaccccgccctgcgaaaggacgccctgcagattttgcatatttgtctgaaacgctcccctggggaggtgctgcggacccttattcagcagggacttgagagtacagacgccaggctcagagctagcaccgccctactgcttcccattctgttaacgactgaggatctgctgctgggattggacttgaccgaagttatcatctcattggcccgcaagctgggcgaccaagaaacagaagaagaaagcgagactgctttcagcgcattgcaacagataggagaaaggctgggtcaggaccgattccagtcatacatcagccggttgccaagcgctcttcggcgccactacaacagacgactcgagagtcagttcggctcacaggtgccttactacctggagttggaggcctcaggctttccggaggacccacttccctgtgccgtgaccctttctaacagtaatctgaaatttgggattataccacaagaactccactccagactgctggaccaggaggactataagaaccggactcaggctgtggaggaattgaaacaggtcctgggcaagttcaaccctagctccacgccccattcctcgctggtcggattcatcagtctgctgtataacctcctcgacgacagtaattttaaggtggtgcacggcacactggaagttctgcatctgctggtaattagactgggcgagcaggtgcagcagttcctcggaccagtcattgcagcctccgtgaaggtactggccgataacaagctcgttattaaacaggaatatatgaagattttcctcaagctgatgaaggaggttggcccccagcaggtgctttgtctcctgcttgagcatctgaagcacaagcatagccgggtgcgggaagaggttgtcaatatctgtatctgcagcttactgacttacccttctgaggactttgacctccccaagttatcctttgacctcgcccccgcgctcgtggatagtaagcggagagtgcgccaggctgctctggaagctttcgctgtgttggcaagtagcatgggatctggtaagacatccatactattcaaagccgtggacacagtagagttgcaggataatggcgatggtgtcatgaatgctgtccaggcaaggcttgccaggaaaactcttcctcgcttgactgagcagggcttcgtggagtacgccgtgctcatgccctcaagcgccggcggccgaagtaatcatttagcacacggggctgacactgattggctactggccggtaacagaactcagagcgcacattgtcactgtggagaccatgtgcgcgactcgatgcatatttatgggtcttattcacctactatttgcacgcgccgggtcctgtcagccggaaaaggaaaaaataaactgccatgggaaaacgaacaaccaggcatcatgggcgaaaatcagacatccaccagtaaagatatcgaacaattcagtacctacgattttatcccctctgcgaagctgaaactgtctcaagggatgcccgtgaacgatgatttatgtttttcacgcaagagggtctcacggaacctgttccagaattctcgggactttaacccagattgtttgcccttgtgcgctgctgggacgacaggcactcatcagactaacttgagcggaaagtgcgcacagcttggcttttcacagatttgtggtaaaacagggtccgtgggctctgatctgcagtttctgggtacaaccagcagccatcaggaaaaggtctatgccagtctgaacttcggctcaaagacccaacagaccttcggttcacaaacggagtgcacgtcaagcaacggtcaaaacccgtcccctggagcatacattctgccttcctacccggtctccagtccaagaacatcccctaagcacacgtcccccctgattatctctcccaaaaaaagtcaagacaattcggtcaattttagcaactcctggccattgaaatctttcgaagggctgagtaaaccttctccgcagaaaaaactcgtgtctcagaagtcttcggatccaaccgggagaaatcacggggaaaattcccaggaaaaaccccctgtgcaattgacgcccgccttggtccgttcgccttcctcccgacgggggctcaatgggacaaaacctgtcccaccaattccacgcggcatttctctcctgcccgacaaggctgatctttccactgtagggcacaagaagaaggagcctgatgacatctggaagtgcgagaaggatagccttccgatcgacctgagcgaactgaactttaaggacaaggacttggatcaggaagaggtgagacatatcagcaatatctgggttaaaacgctgtcgaacaaaacctttttctgtaaagagaagaacttcagttactgttag

SEQ ID NO: 29788 - DNA, 3483 bp, Artificial Sequence
  Description of Artificial Sequence: Synthetic coding sequence
atggccgcagctccatcggccttgctgctgttgccgccatttccggtgttaagtacctacagactccagagccgcagtaggccatcagccccagagaccgatgactctcgcgtgggggggattatgcggggggagaaaaactactattttcgcggtgcggctggagaccacggaagctgtccaactacaaccagtcctctggcttctgctcttcttatgccaagcgaagctgttagctcgtcctggtccgagagcggcggaggactttccggtggcgatgaggaggatacgagactcctgcagttgttgcgaaccgctagagacccctcggaagccttccaggccctacaggcggccttgcctcgccgcggtgggcggttaggattccccagacgaaaggaagcattgtatcgcgcactgggccgcgtactcgttgaaggtggttctgatgagaagagactgtgtttacagttgttgagcgatgtcctgagaggccaaggcgaagctggacagttagaagaggcgttcagtctggccctactgcctcaactggtggttagcttgcgggaggaaaacccggcactgaggaaagatgccctgcagatccttcacatttgcctcaaaagaagcccaggtgaggtcctgcgaaccctgatccagcaaggactggaaagcaccgacgccagactgcgcgcatctactgcactgctgctgcccattctgttgactactgaggacctgctgttgggattagacctcaccgaagtcataattagccttgcaaggaagctaggtgatcaggagacagaagaagaaagcgagaccgccttcagcgcactgcagcagataggtgagagacttggccaggaccgatttcagtcatatatttccagactccctagtgccctccggaggcattacaacagaaggttggagtctcagtttggaagccaggtcccatactacttagaactggaggcatccggtttccctgaggatccattgccttgtgcagtgaccctgagcaacagtaacctcaagttcggaatcattccccaggagttgcattcaaggttgctcgaccaggaggactacaagaacagaactcaagccgttgaagagctcaagcaggtgttgggaaaattcaacccctccagtaccccacacagctctctggtcggcttcatttctctgctgtataaccttttggacgactccaacttcaaagtggttcacgggactttagaagtgcttcacttgctggtgataaggctgggcgaacaggtgcagcagttcctcgggccagtaattgccgcttcggtgaaggtgctagccgataataagttggtcattaaacaggagtacatgaagatatttcttaagctcatgaaagaagtcgggccacagcaggtgctgtgtctgctcctagagcacctcaagcacaagcactcacgagttcgcgaggaagttgtaaacatctgtatctgtagtctgctcacttacccttcagaagactttgacctgcctaagctgtcattcgatctcgcccccgccttggtggattccaagcgaagggtgagacaagctgcactggaggcttttgctgtacttgctagctcaatgggaagtgggaagacttccattctgtttaaagctgtcgacaccgtcgagctgcaggataatggcgacggtgtgatgaacgcagtgcaggcacgattggccaggaagacgctgcctcggctaaccgaacagggatttgtggaatacgcggtgctgatgccatcaagtgctggcggtcggtctaatcacctggcccatggcgcagacactgattggctgctggctggtaacaggacccagagcgctcattgtcactgtggcgatcatgtgagagactccatgcacatctacggaagctatagtcctacaatatgcacacgtagggtgttgtcagctggaaaaggcaaaaataaactgccctgggagaacgagcagcccggcatcatgggcgagaatcagaccagcacatccaaggacatagagcagttcagcacatacgatttcattcctagcgctaagttgaagttatcccagggcatgccagtcaatgatgatctgtgtttctccagaaagcgcgtgtcacggaacctgtttcagaactctcgagactttaacccagactgcctgcccctctgtgctgccggaacaaccgggactcatcagacaaatctttccggcaagtgtgcccagctgggattctcccagatatgcggtaagacgggtagtgttgggtccgacctacaatttctcggcaccacatcgagtcaccaggaaaaggtctatgcttcactcaacttcggttctaaaacgcagcagacgtttgggagccagactgaatgtacttcctccaatggacagaacccgagcccaggggcctacatcctgccaagttaccctgtgtcttctccaagaacctctcctaagcacacatctcccttgatcatttcccccaagaagtcccaagataacagtgtgaacttttcgaattcttggccacttaagtcttttgagggattaagtaaaccctcaccccagaagaagctggtatcgcagaagtccagcgatccaacaggccgaaaccatggcgaaaacagccaggagaaaccgcctgttcagctcacgccagcactggtccggtcaccatcttcccgtagaggactgaacggaaccaagcccgtgcctccgattccacgcggtattagcctccttcctgataaagccgatctatctacagtggggcataagaaaaaggagcccgatgacatttggaaatgcgagaaggacagtctccctattgatctgtccgagttgaactttaaagataaagatctcgaccaggaggaaatgcactcaagtctccgaagcttgaggaattctgccgccaagaaacgggccaaactgtcagggagcactagtgacctagagtcaccggattctgctatgaaattggacctgacaatggactcccccagcctttcttcttccccaaatataaactcatactctgaatcgggcgtgtattctcaggaatccctcacaagctccctgtcaaccactccacaggggaagaggataatgtcggacatctttccaaccttcgggtccaagccctgtcctacccgattaagctctgccaagaaaaagatctctcatatcgcagaacagtctccatcggccggtagttcatcaaacccacaacagatcagcagctttgattttaccaccacgaaggccttgtccgaggatagtgtggtcgttgtcgggaaaggggtgtttggctctctgtcctcagcaccggcaacatgctcgcagtctgtcatctccagtgtggaaaatggagacaccttttcaattaagcaatctattgagcccccctctggcatttatgggcgttccgttcagcagaatttcataatttcttag

SEQ ID NO: 29789 - DNA, 1032 bp, Artificial Sequence
  Description of Artificial Sequence: Synthetic coding sequence
atgaagctactgcagatgttattacgggggaatccatgttgcccccagcccgagatctcccctcagggatcctcagtaccattcctcggtgcagccggccaccagcagtctctgcctagctcttggaaggcttcatgttcaggacctttagttatggcctcagactctgacgtgaaaatgttgctcaactttgtgaacttggcatcttcagacattaaggctgccctggacaaatctgcgccatgtcgccgtagcgtggaccacaggaaatacctgcaaaagcagcttaagagattttcacagaaatactcccgcctgcctcgtggacttcctggacgcgccgccgaaccctatttgaaaaggggcagcgaagatcggccacggaggctgctgttagatctcgggcccgatagctccccgggaggcggcggaggctgtaaggaaaaagtactcagaaatccgtacagagaagagtgcctggctaaggaacagctgcctcagaggcagcacccagaagccgctcagccaggtcaggtgccaatgcgcaagcggcagctacctgcttcattctgggaagaaccccgcccaactcacagttatcatgtgggactggagggggggctcgggccccgcgaggggcctccctacgagggcaagaagaactgtaagggacttgaacccctgggaccagagacaactttggtaagcatgagccctcgcgcacttgccgagaaggaacctctcaaaatgcccggggttagtctggtcggacgggtgaacgcctggagctgctgtccattccagtaccacgggcaacccatctatccaggtcctttgggcgccctgcctcagtcaccagtacccagcctgggattgtggaggaagtcaccagcctttcctggggagctcgctcacctttgtaaggacgtagacggattgggacaaaaggtctgcaggcctgttgtgctgaagcctattccgaccaagccagcggtcccaccaccgatcttcaatgtttttggctatttatag

SEQ ID NO: 29790 - DNA, 1065 bp, Artificial Sequence
  Description of Artificial Sequence: Synthetic coding sequence
atgcctttggaggagcgccgctcttccggtgaaaggaacgatgccgcccccaccaaccaccggaggccgggggagaagcgggcaagtacagctaaacaagtcagcagcgtgccatttctgggcgcagccggacaccagcagagcctgccgtcaagctggaaagcctcatgctctggcccgctagtgatggcgagtgacagtgacgtgaaaatgttacttaatttcgtcaacctggcttcctcggatattaaagccgcacttgacaagagtgccccttgtcggcgatccgtggatcatagaaaatacctacaaaagcagctgaagcgtttttctcagaagtactctcggctgcctaggggtctgcccggtagagccgccgagccatatctgaagaggggatctgaggatcgacctcgacggttactcctcgacctcggccctgatagctctcctggcggagggggcggctgcaaagagaaggtcctgcgcaacccctaccgggaggaatgtttggcaaaggaacagctaccacagcgacagcaccccgaggccgcccagcctgggcaggtgcccatgagaaaacggcagctgcccgcgagtttttgggaagagccacgacccacacactcttatcacgtaggcctcgaagggggccttgggccccgagagggtccaccctatgaaggtaaaaagaactgcaaagggttagaacctctggggccagagactacactggtaagcatgtccccaagagcattagcagaaaaagaacctctcaagatgcctggcgtgtctttagtcggcagagtgaacgcgtggagctgttgtccgtttcagtatcacggacagccaatctaccccggacctctgggggctcttcctcagtcccctgttcctagtcttgggctgtggagaaagagccctgcatttcccggtgaactggcccatctctgcaaggatgtcgatggactgggccagaaggtctgccgccccgtcgtcctgaaacccatcccaactaaacctgcagtcccacccccaatttttaatgtgtttgggtacttgtag

SEQ ID NO: 29791 - DNA, 699 bp, Artificial Sequence
  Description of Artificial Sequence: Synthetic coding sequence
atggcgtccgactccgacgtaaagatgctgctgaacttcgtgaatctggcatcttctgatataaaggccgccctggacaagtcagcaccctgtcgtcggtcggtggatcataggaaatacttacaaaagcagttaaagcgtttctcacagaagtactcccgtctcccacgaggactgcctgggagagccgccgaaccgtatctcaaacgcgggtctgaggacaggccaaggcgtctgctgttagatctggggcccgatagttctcccggtggaggcgggggttgtaaggagaaagtgctccggaacccatatcgcgaggaatgtctggccaaggagcagttaccacagcgccagcatcccgaggcggctcagcccggccaggtccctatgagaaaaagacagctgcccgcttcgttctgggaagagccgcgccctacccatagctaccatgtaggattagagggcggtctcggccctcgtgaaggcccaccttacgaaggcaaaaagaattgcaaaggcctcgaacctctcgggccagaaacaaccctcgtcagtatgagtccccgcgctcttgccgagaaagagccattgaagatgccgggcgttagcctagttggcagggttaacgcatggagttgttgtccgtttcagtatcatgggcaacccatttatcctggcccgctgggtgccctgccatag

SEQ ID NO: 29792 - DNA, 879 bp, Artificial Sequence
  Description of Artificial Sequence: Synthetic coding sequence
atggcgagcgatagcgatgtcaaaatgcttctgaatttcgtaaatctggcttccagcgacatcaaggcagcccttgacaaatccgcgccatgtagaagaagtgtggatcatcgaaagtatctgcaaaagcagctcaagaggttctctcagaagtacagtcgactgcctagggggttacctggccgggcagcagagccttatctcaaacgcggttccgaagaccgcccccggcggctgttattggatttgggacccgatagctccccgggaggaggaggtggctgtaaagaaaaagtgctccgcaacccatacagagaggagtgtctcgctaaagaacagcttccccagcggcagcaccctgaggccgcccaaccgggacaggtgcccatgcgcaagagacagctccctgccagcttttgggaagagccccgcccaacgcatagctaccatgtgggcctggagggaggactggggccccgtgagggaccaccctacgaggggaaaaagaactgtaaaggtcttgaacccctaggacccgagaccactctcgtcagcatgagtccccgagccctcgcagagaaagagcctcttaaaatgcccggcgtgagcctggttggcagagtaaatgcatggtcctgctgccccttccagtaccatgggcaacctatttacccgggacctttgggtgcattacctcagtcaccagttccaagcctcggactgtggaggaagtcccctgcatttcctggtgagctggctcatctatgcaaagatgtggacggcttagggcaaaaagtgtgtcgacctgtcgtactgaagcctatccccactaaacctgctgtgcctccccctatctttaacgtgtttggatatctttag

SEQ ID NO: 29793 - DNA, 879 bp, Artificial Sequence
  Description of Artificial Sequence: Synthetic coding sequence
atggcctccgacagcgacgtaaaaatgctgttaaattttgttaacttggctagttccgatattaaagcggctctggacaagtctgctccttgtagacgctctgtagatcatcggaagtacctgcaaaagcaattgaagcggttcagccagaagtacagtcggctgcctagggggttgccaggtagagctgccgagccttacctcaagcgcggcagcgaggacagaccaaggcgtcttttacttgatctgggtcccgacagctcgcccggcggcgggggggggtgcaaggagaaagtcctgagaaatccatatcgggaagagtgcctggccaaggagcagttaccccagaggcaacacccagaagcagctcagcccggtcaggtaccgatgagaaaaagacagttaccggcttcattttgggaagagccccggccgacacattcctatcacgtcgggctggagggaggcctgggaccgcgagaggggcccccatatgaggggaagaaaaattgtaaagggctagagcctctgggaccagagacaactctggtaagcatgtcacctcgagccctggcagagaaggaacccctcaagatgccaggtgtgtcactcgtgggccgggtgaacgcatggtcttgttgcccttttcagtatcacgggcagcctatctacccagggcctttgggagctctgcctcagtctccagtgcctagcttgggactgtggcggaagtcacccgcattccctggcgaactggcccacttatgtaaagatgtggacggtcttggtcagaaggtctgccgcccggtggtacttaaaccaatcccaacgaagccagctgtgccaccaccgattttcaacgtgtttggatatctgtag

SEQ ID NO: 29794 - DNA, 1281 bp, Artificial Sequence
  Description of Artificial Sequence: Synthetic coding sequence
atggccgtgcaggccgctctgctgagcactcaccccttcgttcccttcggcttcggaggcagccccgacggattgggaggcgcttttggcgccctagataaggggtgctgcttcgaggacgatgagaccggggcccccgccggggctctgctgtccggcgcagaaggaggcgacgtgcgggaggcgactcgggacttgctgagtttcatcgacagcgccagttctaacataaagctggcacttgacaaacctggcaagtcaaagcgcaaggtaaatcatcggaaatacctccagaagcagatcaagcggtgctccggcctgatgggtgccgccccccccggtcccccctcccctagtgcagctgacacacccgccaaacgacccctggccgcccctagcgctcccacagtggcagctccggcgcatgggaaggccgctcctagacgagaggcttcacaagccgctgccgctgcgagcttgcagtctaggtctcttgcagctctgtttgattccttgagacatgtcccagggggggcagagccagctgggggggaagtggccgctccagctgccggactgggcggagcagggacgggcggggccggaggcgacgttgctgggccagccggcgccaccgcaatcccgggagcacgcaaggtgccgcttagggctcggaacttacccccgagctttttcacagaaccctcccgcgcgggagggggtggatgtggtcctagcggaccagatgtgtcgctgggcgatttggaaaagggggccgaggccgttgaattcttcgagctgctgggccctgactatggcgccggtactgaggctgctgtcctcctcgccgcagaaccgctggatgtgtttccagccggggcaagcgtcctgcgcggtcccccagagttggaacccggtttgtttgagcccccacccgcagtcgtgggtaatctgctatatcccgaaccttggtccgttcctgggtgctcccctactaaaaaaagtccgctgacagcgccgcgcggcggcttgactctgaacgagccactgtctccgctgtacccagcggcggctgatagtcccggcggagaagacggcaggggacatctcgcctcatttgctcctttctttccagactgtgctctgcctccccctcctccaccccaccaggtgtcttacgactatagcgctgggtactcccggacagcctacagctccctttggcgctccgacggagtttgggaaggtgcacctggggaggaaggtgctcaccgggactag

SEQ ID NO: 29795 - DNA, 465 bp, Artificial Sequence
  Description of Artificial Sequence: Synthetic coding sequence
atgcagggcatcgacagatggatcccatcaataccaccattgcagaatcacagtgcagttaatcggcggcacttttctgcgccccagaaattacatgctgattgcgagaaggaaatgctagatggcggagtgcctggaacaacggtccgcgtgtcctttgacttcagctgcctggagatggtgagggagctgtggatgtggaatgttgaggaggaagaacacgaggttggcatttccacttgggggggccagcattgtggttgcccggccaaatcactgcccggacctcaccccggcggggtctctgctccacagtcagcaagtcagttaatggtgaagctgctggtctggcagaaatctgtccacaaactacgtaaaatcgccgctcagtcagaagaatggtcatgcgtgctgaataaaatctcaacacatccgttcgtgagcaaggaacacgatgggacctag

SEQ ID NO: 29796 - DNA, 234 bp, Artificial Sequence
  Description of Artificial Sequence: Synthetic coding sequence
atggtgagggagctgtggatgtggaatgtggaggaggaggagcatgaagtggggattagcacttgggggggacaacactgtgggtgccccgcgaagtcgctgcctggccctcacccgggaggcgtatcggctccccagagtgcttcacagttaatggttaagctgctggtgtggcagaagtcagtccacaagttacgaaaaaacagaaatgcgtactcatgtgggcccttatag

SEQ ID NO: 29797 - DNA, 234 bp, Artificial Sequence
  Description of Artificial Sequence: Synthetic coding sequence
atggtgcgggagttgtggatgtggaatgtggaagaggaagagcacgaggtgggcatctgcacgtggggcgggcagcactgtggatgccctgccaagtctctcccagggcctcaccccggaggcgtgtccgctccccaatctgctagccagctcatggtcaagcttctggtctggcaaaaaagcgtgcataaacttaggaagaatagaaatgcctacagctgcggcccgctgtag

SEQ ID NO: 29798 - DNA, 405 bp, Artificial Sequence
  Description of Artificial Sequence: Synthetic coding sequence
atggccggccatccaaaagaaaaggtgatccccgatgaagtacatcagaatcaaattctgagggagctctatctgaaggagctgaggactcaaaagctgtacacacaatatcatgtgaacccgctccgtaaaatacatacagtcacacgcaagcccatgagctggcacgataatctggaagaaccagccgatgctcgctttcttaatttgattcatcacgccgcccaaggtcctagaaaaaagtaccccgagactcagaccgaaaatcaggaggtgggatgggatttggaaccacttattaatccagaaagacacgacaggcgtctgaatcacttcagagtgtgcagcgatataaccctctacaaggccaagacctggggtttaggcgatgatcaccacaagtag

SEQ ID NO: 29799 - DNA, 3423 bp, Artificial Sequence
  Description of Artificial Sequence: Synthetic coding sequence
atggccactcccggaatgtcctggcagcagcattattacggcggtagtgctgctaaatttgccccttcccctgcaactgctcagctggctggtcacagcatggattattcccaggaaatgcatcttaagatgagcaagaaaatcgctcagctgacaaaagtgatctatgcactgaatactaaaaatgacgaacatgagtccgctatacaggcccttaaagatgcacacgaggaggagatccagcagatcctggccgagactagagagaaaatcctgcaatacaaatccaaggtgaccgaagaattggaccttaggcgcaagatacaggtgctggagagttcactggaagatcacatcaagatgaaacagcaagctctcaccgaattcgaggcatacaagcatagggttgaggatatgcaactttgcgctgaggcacagcacgtacagcgaatcgtgaccatgtcgcgtgaggtggaggaaataaggaggaagtttgaggagaagctaaggtctttcggtcaactccaggtgcagttcgagaaagacaagaggctagctttagaagacttgcaggccgcccaccgacgggagattcaggagctgttgaagtcccaacaggatcattccgcttccgtgaataaaggtcaggagaaagctgaagagcttcatcgaatggaagttgaatcactgaataaaatgctggaggaactgcggctggagcgcaagaagctcatcgaagattacgagggcaagcttaacaaggctcagagtttctacgaaagggagcttgacactctaaagcgttcccaactgtttacagcggaatccctgcaggcctctaaagagaaggaggctgacctgagaaaggagtttcagggccaggaggccattctccgcaagactatcgggaagctaaaaactgagctgcaaatggtgcaggatgaggctgggagcctgctggataaatgccagaagctgcaaactgctctcgctatagccgagaataacgtacaggttcttcagaagcaactggatgacgcaaaagagggtgagatggcactcctctctaagcacaaagaggttgagtcagagttagccgccgctcgggagcggctgcaacagcaagcttctgatctggtcctaaaggccagccatattggcatgttgcaggccacacagatgacacaggaggtcactataaaagacctggagtcagagaaatcccgggtcaatgagaggctttcgcagctcgaagaagaacgagctttcctccgcagcaaaacccagtctctggacgaagagcagaagcaacaaatcctcgagcttgagaagaaagtcaatgaggctaagaggacgcaacaggagtactatgaacgggagctaaagaatttacagtctaggctcgaggaggaggtgactcaactgaacgaagcacactcgaagaccctggaggagttagcctggaaacaccacatggccattgaagccgtgcactcaaatgctatccgcgataagaagaaactgcagatggaccttgaagaacagcacaataaggataagctgaacctggaagaggacaagaaccagcttcagcaggagctggagaacctgaaagaagtccttgaggataaactgaacacagctaaccaggaaattggacacctgcaggatatggttaggaagagcgaacaggggttgggatctgcagaggggctgattgcctctttgcaggattctcaggagagacttcagaatgagttagacttaaccaaagactcattaaaggagactaaggacgctctcctgaatgttgaaggggagctagagcaggaacggcagcagcacgaagagacaattgctgctatgaaggaagaagaaaaactgaaagtggacaagatggcacacgatctggagatcaaatggaccgagaatttaaggcaagaatgttcaaagctgcgcgaggagctacgcctgcagcacgaagaggataagaaaagtgctatgagtcagctactccagttgaaggacagagagaaaaatgctgcccgcgactcttggcagaaaaaagtggaggaccttcttaatcaaatctccttgcttaagcagaacttggaaatccagctgagccagtctcagacaagtcttcaacagttgcaagcccagtttactcaggagagacaacggctcacccaggaactggaggagctggaagagcaacaccagcaaagacacaagtctttgaaggaagcccacgtactcgcttttcagacaatggaggaagagaaggaaaaagagcaaagagctcttgaaaatcatctccagcagaaacattccgccgagcttcagtcactgaaggacgcacatcgggaatcaatggagggattcaggattgagatggagcaggaactgcagacacttcgcttcgagctcgaggacgagggcaaagccatgctcgcctccctccggtccgagctgaatcaccaacacgcagccgcaattgaccttctgcgtcataatcaccatcaggagctggctgccgcaaagatggagctggagaggagtatcgacatctctcgccgacaatccaaggaacacatctgcaggataactgatctgcaggaggaactgcgtcatagggaacatcatatttcagaactggacaaagaagtccaacacctgcacgagaacatttctgctttgactaaggaattagaatttaaagggaaggagattctgcgcattcggagtgagtctaatcaacaaatacggctgcacgagcaagacttaaataaacgtctggagaaggagctggatgttatgacggcagaccacctaagggaaaagaacatcatgcgcgctgatttcaataaaactaacgagctgctgaaggagattaatgccgcattgcaagtgagcctggaggagatggaggaaaagtacctgatgcgggaatctaagccggaagacatccagatgataacggagctgaaagcaatgttaacagagagggatcagatcattaagaaactgatagaagataataaattttaccagttggagctggtgaatcgggagaccaattttaataaagtgtttaactcatcacccaccgtaggcgtgatcaatcctctcgctaagcaaaagaaaaagaatgataaatcccccaccaaccgtttcgtcagtgtgccgaacctcagcgccctggaaagcggcggagttgggaacggccatcctaacagactcgatcccatcccaaatagtccagttcacgatattgagtttaatagttcaaaaccactcccgcagcccgtaccgcctaaagggcctaaaacattcctgtcccctgcacagtccgaggcttcccccgtagccagccctgacccccagcggcaagagtggttcgcaagatattttacattctag

SEQ ID NO: 29800 - DNA, 2916 bp, Artificial Sequence
  Description of Artificial Sequence: Synthetic coding sequence
atgaagcagcaggccctgactgagtttgaggcctataagcatcgggtcgaggatatgcagttgtgcgctgaagcccagcatgtgcagcgcattgtgaccatgtcaagagaagtcgaggaaattagaaggaagttcgaggaaaagctcaggtcattcggtcagttacaggtccaattcgagaaagataagagacttgccctagaggatttgcaggcagctcaccgacgcgagatacaggaactgctcaagtcgcagcaagatcattcggcgagcgtaaacaaaggtcaagaaaaagccgaagagctacatcgaatggaggtggagtccctgaataaaatgctcgaagagctcaggctagagcgcaaaaagttaatagaagattacgaaggtaagctgaacaaggcccagagtttttacgaaagggagttggataccctgaaacgctcacagctcttcactgccgaaagcctgcaggcctccaaggaaaaagaagctgacctgagaaaggagtttcagggccaggaggcaattcttcgaaagacaatagggaagctgaagaccgagctgcagatggttcaagacgaggcaggttccctactggataagtgccagaagcttcagaccgcactggccattgccgagaataatgtgcaggtcctgcaaaagcagctcgacgacgcaaaggagggggagatggctttgctgtctaagcataaggaggtggaatcagaactggccgccgctcgtgagaggctccaacaacaggcctccgatctggtcctgaaggcctctcatattggcatgctacaggctacccagatgactcaggaagtgactatcaaagatttagaatcagaaaagtccagagtgaatgaacgtctgagccaacttgaagaggagagggcattcttgcgtagcaagacacagtccctggacgaagagcagaaacaacaaattctcgaactggagaagaaagtgaatgaagccaaacggacccagcaggagtattacgaaagagagcttaaaaacctgcagtctcgtctcgaagaggaagtaacacagttaaatgaggcccacagtaagaccctcgaggaactcgcgtggaagcaccacatggccatcgaggcagtccacagcaacgcaatacgcgacaaaaagaagctgcagatggatttggaagaacaacataataaggataagctgaatctcgaagaagacaagaatcagcttcaacaggagctggagaacctgaaggaggttctggaagacaaactgaataccgccaatcaggaaatcggtcatcttcaggacatggtgagaaagtccgaacaaggcctgggcagcgcggaagggctgattgcttcgctgcaggattctcaggaaagattgcagaatgagctagatctcactaaggattctctgaaagaaacaaaagacgccctgctgaatgtggaaggagaactcgagcaggagcggcagcagcatgaagaaaccatcgctgctatgaaagaagaagagaagcttaaggtcgataagatggcacatgatctcgagattaaatggacggagaatttgcgccaagagtgttccaagctgcgggaggagcttagactgcagcacgaagaggataaaaagtccgcgatgtctcagttgttacagctgaaggacagagaaaaaaatgccgcccgcgatagctggcagaagaaggtggaagacctcctcaatcagatctctcttctgaagcaaaacttggaaatccagcttagccagagccagacgtctttacaacagctgcaggctcaattcacacaggagcgccagcggctcacccaggagttggaggagctcgaagagcagcaccaacagcgccacaaatccctaaaggaggcacacgtgctggcctttcagactatggaggaggaaaaggagaaagagcagcgcgccctcgagaaccatctgcagcagaagcacagcgccgaattgcagagcctcaaggacgcccaccgggaaagtatggaagggttcagaattgaaatggagcaagaactccagacactccgcttcgagttggaggacgaggggaaagctatgcttgccagtctgcgtagtgagctgaatcaccagcacgcagcagccatagatctcctccggcacaaccaccatcaagaactcgccgccgctaagatggagttagagcggtcaatcgatatcagtcgacgccaatccaaagagcatatctgtcggattacagatctgcaggaggaattgaggcacagggagcaccacatctctgaactggataaagaggtgcagcacctccatgagaatataagcgcactaacaaaggagctggagtttaaaggaaaagagattcttcggataaggagtgagtccaatcagcagataagactcgaagagatggaggaaaagtacctgatgcgggaaagcaaacccgaagatattcaaatgattacggagctaaaagccatgttaacagagagggatcagatcattaagaagctgattgaggacaataaattttaccaactcgagctggtcaatagagaaacgaacttcaacaaagtgtttaattcttccccgactgtgggcgtgattaaccctctggccaaacagaagaaaaaaaacgataagtcacccactaacaggtttgtttctgtgccaaatctctcagccctcgagtccggaggggttgggaacggccaccccaaccgcctggatccgatacctaatagccccgtccacgacatcgagtttaactctagcaaacccctgcctcaacccgttcccccaaagggacccaagacatttttgagccccgcccaaagcgaggccagcccggtcgccagcccggatccccagcgccaagagtggttcgctcgctacttcaccttctag

SEQ ID NO: 29801 - DNA, 3183 bp, Artificial Sequence
  Description of Artificial Sequence: Synthetic coding sequence
atggcaagcgccttgaacagcaagattaacccaccggggacttgtcagggaagcaaggcagacgggggagccgggtggcggatggactgtgacccccagatgcatgtaaagatgtgcaagaaaattgcccagctgacgaaggtgatctatgctcttaacaccaggcaggatgaagccgaagcttctatggaggctctccgcgaggctcatcaggaggaactccagaatgcagtcgcagaaaccaaggcaaggttattgcaggagcagggttgcgcagaagaggaagccctgttacagcggatccaggccctggaatctgcccttgaactacagaagagactgactgaggaggctctggccgagagtgcctcatgtcggctcgagactaaggagcgggagctgagagtagaggcagagcacgccgaacgggtcctgacgttaagtcgggagatgctcgagctcaaggcagactacgagagaaggctccagcacctgactagccatgaggccaccccacaaggccggcttccacaggaatcccccgaaacgaagagtgagccaggacagggtccagaaatgcaagaagtgctactcgaagtccagagactgagagttgagaaccagcagctatctaaagattatgctagaaaggccgaagagttacaggcaacttatgagcgcgaaaatgaggcaatcagacaggctatgcagcaatccgtgagccaggccctctggcaatggcaggagaaagagagcgacctaagaaaaaacttccaagtgcaggagagtgcgctccaagctcaggttcgtaaactggagggtgatctggagcaccgtggcaggaagatctcagacctcaaaaagtacgcccagaaattgaaagaaagaattcaggatctagacgtgcaattaaaggaggctaggcaggagaatagcgaactaaaaggaacagcaaagaagttgggcgaaaagcttgctgtcgccaaagatcgcatgatgctccaagagtgcaggggtacgcagcaaactgatgccatgaagacagagctcgttagcgaaaacaaggtcctgagagaggagaacgacctcgaggccggcaatcttcatccccagcaggaccaatcgtgcctgaaagaatgtccctgcatgaaggggggtaccgatatgcagaccaagaaggaggcatcagccgagaccgagtatatgaagcaacaatacgaggaggaccttagaaagattaagcaccagacagaggaggagaagaaacaccttaaggaccaacttgttaaaagactggaagatttggtgaagaaacatacagtcgaaattaagagcgtgagaagctccgtagaagccgaacggaagaagttacagcgggaagtagaagcacagctggaagaggtgcggaaaaagtccgaaaaagaaattaagcagctggaggaagagaaggctgcacttaatgtgaagctccagaactctcttctggaggtcctgaggctggaagaatttatacagcagaacaaaactagaccaaccggggcagaggagtcccctcaggaactaggaagacagcactgctccattctcgagactcaggacccatgtttaaagctcgacgaaacctcaccccgcggtgaggagtatcaggataaactggcagccgaagaaggcacatcatctgacgaggaagagcggacgaaagttctcttaaaagaaggcagcgaccctcagcctcctctgggtagcctccttaaggagaagacatctaaaatccaacgacttgaggaggattggcagtctcagaaagcgaagctccaggctcaggtttcccagatgcagcaggcactggagcagtgtacatccaattacagggaagacctgcaggccttgaagcagttatccgatctggagagagaaaagctccagcgtgaactgcaggaaacgacccaacaaaatcatgccatgaaagcccagctggaggcaagccaccagcgggccttaagaatgctggagaaagccaggcaccaggagctgaaggctaccgaagagaggttaaagaaggagtcgagccacagtctgcagattcagcatcagacacacagacttgaactccaggccttggaagaaaaagcacggcaggagctgcaggaggagagagagcgtatgcaggctcagcaggctcttctcctcgaatccctcaggcaggaactgtctgaacagcaggctgcatgtagcgggcaccaaaaagacctcgaggccttgcaggctgagctgagagctctcgggcggcagcaggcttccagtcagtgcccaggggatagtaaagatcacataatcgccacggaggagaggggcggcccaggacaagctgggagccctccaggcgcagcaggccaggggtctggtgaaggctgtggcctttgggaagagaatgcccagctgcaagacgccgtgcgtagacttcgcgccgaagtggagcagcatcagcaagaggcccagaagctgcgggatcagcggcggttcctggaagagactcagcaggcgcagagggctagggaggtcgaaacattgcggcaggaacacaggaaggagatgcaagcgatggtagcggacttctcctcagcccaagcacagctgcaggcacggttagctgctcttgaggcagagctgaaagatagcggcgagaagcccggcaaaggagccagccgcccagaagacttacagcttattgggcgcttgcaaacccgcctgaaagagagagaggacatcatcaaacagcttactgaagagcgcaggttccattatgcggctttccctagcgcgatgagtcatcgcaaccggagtttttccttcaatccacacccggggtatctcacaccgagcatgaaaaagaagaaggtggaagacgtgccttcaagggtggtgtctgttcctaatctggctagctacgcaaagaattttctgtccggcgatttgtcctcacgcatcaatgcaccaccaattacaacttccccaagcttggaccccagcccaagctgcggcagaacgtataagccaaaccagagcactgacgctaaaacggctacacgcactcccgacggcgaaaccgcacaggctaaggaggttcagcaaaagcaggggagtccccaccaggaatggttcactaagtacttttctttttag

SEQ ID NO: 29802 - DNA, 828 bp, Artificial Sequence
  Description of Artificial Sequence: Synthetic coding sequence
atgctagctccatgttcagggtgggaacttggctgtttccggctctgccttcgccaggtcagattgtgggccggcgcgggtaggtgggcatgctgggcatgccaagccaggccatacagctctggcgggagcgagaggtggcctggttctgaaactgaagtccccccccctggcccaggccgccgcactcttaaagaatggaccttgcagggtcagaagcttcacgtccagactaaaggaggaaaggtaatctgcttgggaacagtttacggaaacatagacattcacgcctcagacaaatccgcggtcaccattgataagctgcagggcagctcggtgacagtctcaaccgaggacgggcttctcaaggccaagtacctatacactgaatcaagtttcctgagttccgcggcaggggacattacattagggtctgtgcacggtaacataactctgcaaagtaaaatggggaacattacggttgatagcagcagcgggtgcctaaaagcaagcaccaaccagggcgccattgacgtatatgttagccagctgggcaaggtggaactgaaatctcacaaaggttcaatcatcgttaaggttcccagctctctgcaggcccatctgcaactcagtgggaaggaggttgacgttaactccgaggtccacgtccaggagatggccgaggtgcggaaggacgatgtggttaccgttactggcctaatgaatcaggcttccaaaagagaaaaatggatcaaagcggacgcgcctaaagggactgtgagttttcgcagacagtcttggttccaaagcttgaagttacaagattag

SEQ ID NO: 29803 - DNA, 1179 bp, Artificial Sequence
  Description of Artificial Sequence: Synthetic coding sequence
atgctggcgccatgctcaggatgggaactcgggtgctttagactgtgtctccgccaggtgcgcctttgggccggtgcgggccgttgggcatgttgggcatgccaggctaggccttacagttctgggggctcggagagatggcctggtagcgaaacagaagttcccccacctggaccaggccgaagaacactaaaggaatggactttgcaggttagccccttcggacggctgcgagcaaggctcccctgtcatctggccgtgcgaccattagatccgcttacttaccctgatggagaccgcgttttggtggcggtgtgtggagtggaagggggcgtgagagggttggacggcctccaggtgaaatatgacgaagacctggaggaaatggccatcgtctccgatacgattcacccccaggcttcagtggaggtgaacgcccctcttaagtttgggctggatatcaagtcctctggctctggctgcgtcaaggttcaatccatcgagggcgacaactgtaaaattgaaactgaacatgggaccagcattctgcagtctgtgaaggggcaaaagttgcatgttcaaaccaaggggggaaaggtgatttgcctcggcaccgtgtatggtaacatcgatatccatgcctccgataagtctgctgtgaccatcgacaagctgcaaggctcaagtgtcactgtgtctacagaggatgggctgttgaaagccaaatatctatataccgagagtagctttctctctagcgccgcaggggatataaccctgggttctgtccacggaaatataaccttgcagagcaagatgggtaatatcaccgtggacagtagctccggatgcctgaaggcctcgactaatcagggcgcaatagatgtttacgtttcacaactgggcaaagtggagctcaagtctcataaaggttccattatcgtgaaggtccccagttctctccaagcccatctgcagctttccggcaaggaggtcgatgtaaacagtgaagtgcatgtgcaggagatggccgaggtgcgaaaggatgacgtggtgacagtgacagggttgatgaaccaagcaagcaaacgagagaagtggataaaagccgatgcaccaaaaggcacggtcagtttcaggagacagagctggttccagtccttgaagctacaagattag

SEQ ID NO: 29804 - DNA, 900 bp, Artificial Sequence
  Description of Artificial Sequence: Synthetic coding sequence
atgtttcgaacgccaagtcaggcaaaccgcttggccttggtctctgcaaacccagacctcaggttgctgtttgacttaaggaggcattcgggacaagtcgattggccctggcaggtcactctacccgtggctgagggcgtagatactgccgggctcgatatcaagtccagtgggtcaggttgcgtgaaggtgcagtctattgaaggagataactgcaaaatcgagaccgaacacggcacctccatactgcaatcagtgaaaggacaaaagctgcatgtgcagacgaagggtgggaaggtgatctgcctaggcactgtttatggcaatattgatatacacgctagcgacaaatctgctgtcactatagacaagctccagggttcaagtgtgacggtttccacagaggatgggctattaaaagccaaatatctgtacacggaatcatcatttctgagcagtgcagctggcgatataaccttggggtcagtacatggcaatattactctccaaagcaagatgggaaacatcaccgtggattcttcgtccggctgcctgaaggcaagcaccaatcagggcgccattgatgtatatgtgtcccaactgggcaaggtggagctgaagagtcacaagggcagcataattgtaaaggtgcccagttcgctccaggctcacctccagctaagcggtaaggaggtagacgttaattcagaagttcatgtacaggagatggcggaagtgagaaaggacgatgtcgtcactgtgaccggattaatgaaccaagcgtccaagagagagaaatggatcaaggccgacgctcccaaaggaacagagtggagtcgtagtcatattctgctgagccaggcctctcggtgtctcgcggcttctacatttagtccctag

SEQ ID NO: 29805 - DNA, 7056 bp, Artificial Sequence
  Description of Artificial Sequence: Synthetic coding sequence
atgttcttcaagatgaaaaatgagatcgataacgaccctgagtctgaaaaatgcatcaaagatagtactatcatgcgcagggaaccacagaacatcctgagccccctgatgctgcctaatttagagattcccttcagcgttaaggacattatcagccgtatagaaagggcgcagttacatcgtgccagagaggatattgacatgcagctgagtgagatcatgaataatgtacacagaatcatgacacgctataccctagtctttaattcctcaagtgaaaggaatgtgtctctgactgagcacaagaaaaaacagcggacaaatttcctggagaagatggctacatatgccaagacaattgaaattagggagaaaactttagctaatatccttgcttggcttgaggaatggaatgacgtgttgagtgagatgaccctaatggacgttgacgaacaccaccactggattgctcaaatggagctcctgccggatacccttaaagctattgagaacaacgttaaaattctctcccggttcagcacttcctttttagacgagaaaaagaaacaaaagaaaaagattctcagcaggggcaccctgtggaaatcgtggaaggaaagagtgattaagaggccttcaaccgctcgagccctaagaccagaccagatgatctccgatcagctggctacgaacacaaaggtgagtgaaatccagggcatgttacaggagcttattggcactaccatgttcagcaccctggagaacaacgccatcaaatacatttccagcacaattgtcaatttgagtacagccttgtctatgctcaacgatgagctgaaatgtgttaatttccagtcttccaccgtttacgcccatgaaacctcagaggccgagaaggaactgagtctaaagataattcgagacctctccaacgaaaacgagatgttgcagcaaaagctccaggacgcggaggagaaatgcgaacagctgatacgatccaaaattgtgatcgaacagttatacgcgaaactctcaaccagctctacactaaaggtcctaccaggtccgtctccacagtctagccgggctatcatcaaggtaggcgatactgaagacaatatggacaatatcctggataaagagctcgagaacatcgtcgatgaggtgcagcggaaagaaacaaaggacagcgggatcaaatgggactcgaccattagctatactgcccaggcggagcgcactcctgatttgaccgaattgcgacaacagcctgttgccagcgaggacattagcgaagacagcacgaaggacaacgtgtccctgaagaaaggagatttctaccaggaggatgagactgatgaataccagtcctggaagagatcccacaagaaagctacctacgtgtatgagacgagtggccccaacctgtcagataacaagtcaggccagaaggttagcgaggccaagcctagccaatattacgagctccaggtgctgaagaagaaacgcaaagaaatgaagagtttctctgaggataagtccaagagccccacagaagccaagcgtaaacatctatctcttaccgaaacaaagtcccagggaggtaagtccggcacctcaatgatgatgctggaacaattccggaaggtaaagcgagagtcaccttttgataagagacctacagcggctgaaatcaaggtagagcccacaacagagagcttggataaggaggggaagggggaaataaggtctcttgtggaaccgcttagcatgatccaattcgatgatacagccgaacctcagaagggaaagataaaaggtaaaaagcatcacatctcatcgggcacaataacttcaaaggaggagaaaaccgaggaaaaagaagagctgacaaaacaggtgaagtcccaccagcttgtcaaaagtctgagtagggttgctaaagaaacttcagagtccactcgcgttctcgagtctccggatggcaagagcgaacagagtaacttggaggaatttcaggaggcgatcatggctttcttgaagcagaaaattgacaatattggcaaggcattcgataaaaaaaccgtccccaaggaagaggagctgttaaagagagcggaggccgagaagctgggaataatcaaggccaaaatggaagagtactttcaaaaagtggccgagacggtgacaaagattctgaggaaatacaaggataccaagaaagaggaacaggtgggggaaaagcctatcaaacagaagaaggttgtgtcctttatgccaggtttgcacttccagaagagcccaatttctgccaagagcgagtctagcacactcctatcatacgagtctaccgaccctgtaattaataatctcattcagatgattctcgccgagatcgaaagtgagagggacattcccactgtatcaactgtacaaaaagaccataaggagaaggaaaagcagcgtcaggaacagtacctgcaggagggccaagagcagatgagcggtatgtcactgaagcagcagctgttgggcgaacgtaacttgctgaaagaacactatgagaagatctccgagaactgggaggaaaagaaggcctggttacagatgaaggaggggaagcaggagcaacagtcacagaagcaatggcaggaagaggagatgtggaaagaagagcagaagcaggcgaccccaaaacaagcagagcaggaagaaaagcagaagcaacgggggcaagaggaggaagaacttcccaagagctccctgcagcgactggaagaaggcacacagaaaatgaaaacacagggtctgttattggagaaggagaatggtcagatgcgccaaattcaaaaggaagctaaacacttagggccccatcggagaagagaaaaagggaaggaaaagcagaagccagaacggggcctcgaagacctggaaaggcagattaaaaccaaagatcagatgcaaatgaaggagacccagcctaaggagctggaaaagatggtgatccaaactccgatgacactcagcccccgttggaaatctgtcctaaaagatgttcagcggtcctacgagggtaaggagttccagaggaatctaaaaacactcgaaaatctcccagacgaaaaagaaccaatttccattacgccgcctccttcactacagtactcgcttccaggggccttaccaatatctggccaacccctaaccaagtgtattcacttaaccccccagcaggcccaagaggtgggtatcacccttacaccccaacaggcccaggctcaggggatcacccttaccctgcagcaggcccaggagctaggcatcccactaaccccacagcaggcccaggcgctcgaaattctcttcacgcctcagcaggcccaggccctcggtatccctctaaccccccagcagacacaggtccaggggattacactgacgccacaacaggatcaggcaccagggatttcccttaccacgcagcaggcccagaagctcggaattccgctgactccacagcaggcccaggccttggggatccctcttactcctcagcaggctcaggaactgggcattcccctcaccccccagcaggcccaggccctgcgagtgagcttgaccccccagcaggcgcaggagttgggaatcccccttacacctcagcaggcgcaagcactgggaatcactctgacccttcagcaggcacagcagcttggaatccccttgacgcctcagcaggcgcaggccctagggatcactctgacgcctaagcaggttcaggagctcggcattcctctgacccctcagcaggcccaggccttagggatcacactgacccccaagcaagcccaggagctcggaataccattgaacccccaacaagcacaaaccttaggtatcccactgactccaaaacaggcacaggcattaggtattccgtttacccctcaacaggctcaggcactggggattcctttgaccccacagcaggcacagactcaagagatcaccctgaccccacagcaggcacaggctctgggaatgcctctgactacacaacaggcacaggaactagggatccctctgacaccccagcatgctcaggcgcttgggatgccgctcaccactcagcaggctcaggagctgggcatccccctgacaccacagcaagcccaagccctcggcatgcctctgaccacgcaacaggcccaggaactgggaatccctctcacccctcagcaggcccaggagctgggaatccccttcacacctcagcaagcccaggctcaagaaattacgctcactccacaacaagctcaggccctaggaatgcctctgactgcccagcaggcccaagagttggggattacgcttacacctcagcaggcccaagaactcggaatacccctgacacctcagcaagcacaggccctgggcatccctttgattccaccccaagcccaggagcttgggatcccacttaccccccaacaggcgcaggctttaggaatcttgctcatacctccccaagcacaggagctgggaatccccttgacacctcagcaggctcaggcacttgggattcccctcattcctccacaggcccaggagcttggaatcccactaactccacagcaggtgcaggctctgggtatccctttaattccccctcaggcccaagagctggaaatacccctgacgccccagcaggctcaggcactagggattccacttacaccacagcaagcccaggaactgggcattcctttgacaccccaacaagcgcaggaattagggatcccattgacaccgcagcaggcccaggcacagggtattcctttgaccccccaacaggctcaggctctcggcatctccctgaccccgcagcaggcgcaggcacaggggattacactcacacctcagcaggctcaagcgttgggagtgcctattactccagtgaatgcctgggtaagcgccgtaaccttgacatcggagcagactcacgctttggaatcgcctatgaatctggagcaggcacaagagcagttgttgaagctcggggtgcctctgacccttgacaaggcccacactctcgggtctcctctcacactcaagcaggtccaatggtcccacagaccatttcagaagtccaaagcatctttaccgaccggccaatcgatcataagccgtctttctccatctctccgcctctccctggctagtagtgccccaacagccgagaaatcttccattttcggggttagctccacgccccttcagatctccagagtcccgctaaatcagggtccattcgcgcccggaaaaccactcgaaatggggattctgtccgaacccggcaagctcggggccccccaaaccctgaggtcctcaggacagacactggtgtacggcgggcaatcaacttcagcccagttcccagctccgcaggctccgccatcgccaggtcagctgcctattagcagagcaccaccgactcccggccagccttttatcgccggggttcctccgacttctggtcagataccatcactgtgggcccctctctcacccggccagccccttgttccagaagcatcctccatccccggagatttactggaaagcggccccctgacctttagcgagcagctccaggaatttcagcctcctgctaccgctgaacaatctccctatcttcaagccccatcaacgcctggacagcatctcgcaacatggacgctcccaggccgtgcctcatctttgtggatccccccaaccagccgacaccctcccacactttggccaagccccgctcctggcaagcctcagaagagctggtccccatctgtagctaaaaagagactggctatcatctcatcgctcaagagtaagagcgtgttaatccacccctctgctcctgattttaaagtcgcccaggtcccttttaccaccaagaagtttcagatgtctgaagtttcagatacttcagaagagacacagatactaagagatacctttgctattgaatcatttcggacattccagagccatttcaccaagtatcgtacccctgtttaccagactccttacactgacgaacgtgcactcctcactctgatgaaaccgaccacatccccctcatcgttaactactttgctgagaactagtcagatcagtcctctcgaatggtaccagaaatcgagattccctcccattgataagccatggatcctgagcagcgtgagcgacacaaagaagccgaaagtaatggtcccacccagttcgccccaggagctggaggagaagaggtatttcgtagatgtggaggcccagaagaaaaacctaatcttgttaaatcaggccattaaaacctgcgggctgccctcccaactgcatacaatggctcgcacactgatcatcgaaatcctgcacatggatacggtacagcttggttatctctttcgaaagtacatcgcctatagactcatccagcatgcacggaataacatcatgaaaaggcttaaggcaatacagaacaccgggaaagggtatgaagcccggaacctccacatgatgttgtcccggctcgatgactatggcaagaaagtgatgcaggtgtggacagaaaagcagaaaagcctgggacagaaaaggaaccagtgtctgaaaaagatgattcacgtattcaatcagctgaaaaaaatccacgagctcaacttgtctcaacctatcccattaatcatcgaggaaaagcagattccagcctccaccacgttcgtgcagaaaccctttttaaagttactgatggaggaggatcgtacttctgatatctgcaagaagttcagacaacaggaggatcaaacggaggccatttggaatgtcgacctgtccacctcatcctatccgatcgccgaaaagacaagtatgcactcgctatgggcccaactgggaggttatccagacattcccaggctgttgcagttggaggtccaatcaacctttcgaaagagtctagctagcctgcagagccgagtcaagaaaattccaaaatag

SEQ ID NO: 29806 - DNA, 1080 bp, Artificial Sequence
  Description of Artificial Sequence: Synthetic coding sequence
atgagtgaggtttcagacacttcggaagagacacagattctgagagacaccttcgccatagaaagtttcagaaccttccagagtcactttacaaaatatcgaactcccgtctatcaaactccgtatacagacgagcgggccctcctcactcttatgaaacccacaacatcaccatctagcttgaccacactcctgagaactagtcagattagtccccttgaatggtatcagaaatcccgattcccacctatcgacaaaccttggattctgagtagtgtgtcagatacaaaaaaacctaaagtgatggtccctccttccagcccccaggagctcgaagagaaacggtatttcgtggatgtggaagcacagaagaagaacctcatcctcctgaaccaggccattaagacctgcgggctaccgtcccaactacacaccatggcccgtacgctcataatcgaaattttacatatggacacagtgcagctcggctacctttttaggaagtacatagcctacagactgatccaacatgcacggaataatatcatgaagagactgaaggctatccagaacacagggaaagggtacgaggcacgaaacctgcatatgatgttatcacggctcgacgactatggaaagaaggtcatgcaggtatggaccgagaagcagaaaagcctcggacaaaaaaggaatcagtgtctgaaaaagatgatccatgtcttcaatcagctaaaaaagatacacgagctgaacttgtcccaacctatccctctgatcatcgaggaaaagcaaattcctgcaagcaccactttcgtccagaagcctttcctcaagctactaatggaggaagacaggaccagtgacatctgcaagaagtttcgccagcaggaggaccaaacagaagcaatttggaacgtggacctgtccaccagttcttacccaatcgctgagaaaacgtccatgcacagcctatgggctcagctggggggctatccagacatacctaggctcctgcaattggaggtccagagcacattccggaagagcttggcttcactccagagtcggagcagtggatag

SEQ ID NO: 29807 - DNA, 2682 bp, Artificial Sequence
  Description of Artificial Sequence: Synthetic coding sequence
atggaaaaggatgatcccccccagctagtcaccccaacctctgtcaaggccatcatcttaaggatcgaggcagctcagctcacccgggctcaggaggatattagcacccaactgtcagacatcttggacaacgtgaactgtgtaatcaatagatttcaagaggaattaggttatgacctcaaagagaacgcaaagagtcagcagcgcgaccccaaaggcaagaagaggtttattttacttgagaaaatcgcttcatttagcaaggatgccatgatgaaggaaaagcacctctatgatatcctccgatggcttggtgattggggcgacacactgacatacgagattgggccacgcaagtccgaggaggaggcagcagctctcgacgagtggattgaagtgacagaaaaggtgttgcccttgtccttgattgccacaaaaagggggattgagtcactaaccgccctctgctctactcttattgagggacagaaaaaacgaagtcaggtgagcaagcgtaccttctggcagggatggcaaggtcgctctccccagacttcaccttctcatccacagcctctgtctccagaacagatgctccaagatcagcataccatgaacaccaaggcatccgaagtgacatctatgcttcaagaactgctggattccaccatgttttctaagggtgaggttagggctatcagatacatggcaacagtagtcgagaatctcaacaaggcactgatccttcagcacaaggaaaatagatccttggaaacaaaataccggcatctgcaaatgcaggcaactaaagagttgagttcacagcggctgcattttcagcaatttatggaggttcttgagagccgccgtgacgctcttctgaagcaggtggaaattctgggagggcgttatcatgacctgctgttgatgaaacaggctttagaatttcaactgaaaaaggctcaaaacgctaccggacaggcagaagatctggctgaggtgagcgtggacagcccaggtccaagtgaacgggagaccctgcctagaaaagaaaccgtgatggaagaatcacaacaggagcctatgaaggaagagcagctgttctcaccgctgcctccatctccaatggccatgattcgtgattctggcgccatcgccgccggccaccagccactaagcaccatgacagttcgaagtagagtggccgatgtgttcggaagcaaggataccgagtcactcgagcccgtcttattgcccctagtggatagacgcttcccaaaaaaatgggaacggccggtggccgagagtttaggccacaaagataaagatcaagaggattacttccagaaaggggggcttcagatcaagttccactgctccaagcagctgtccctagagtccagccgccaggtgaccagtgaatcccaagaagaaccttgggaggaggaatttggcagagagatgaggcgacagttgtggctggaggaagaagagatgtggcagcagaggcaaaagaaatgggctctcctcgaacaggagcaccaggagaaattacgccaatggaatctggaggatctcgcacgggaacagcaaaggagatgggtgcagttagaaaaagagcaggagtctccccgaagggagcccgagcagctgggcgaggatgtggagcgccggatcttcactcccacaagtcggtggagagatctggaaaaggccgagctcagcctagtgccagctccgtcccgaactcaaagtgcccatcaatccaggcggcctcaccttcccatgtccccctctacacagcagcccgctcttggcaagcagagaccaatgagctctgtggaatttacttataggccacgaacccggagggtccctacaaagcctaaaaaatccgcatcttttccggtgactggaacatctattcgacgactaacttggccctctctccagataagccctgcgaacattaaaaagaaggtgtatcacatggacatggaggcccaaaggaagaaccttcagctcctgagcgaggagtctgagttaagactgccccattatcttcgctcaaaagccttagaactgactactaccaccatggaactgggagctctgcggctccagtacttgtgccataaatatatattctaccggagactacaaagcctccgccaggaagctatcaatcatgtccagatcatgaaagaaacggaggcctcttacaaggcacagaacctttacatcttcctcgagaacatcgacagacttcagagcctgcgattgcaagcctggacggacaaacagaagggattagaggagaagcatagggaatgtctaagcagcatggtaacaatgttccctaagctccaattagagtggaatgtgcacctgaacataccggaagttacttcccctaaacccaagaagtgcaaactgccagctgccagccccagacatattcggccttccggcccaacatataaacaaccatttctctctcgtcaccgggcctgtgtgccgctgcagatggcacgacaacaaggcaagcagatggaggcagtctggaaaaccgaagtggcgagcagctcttacgccattgagaaaaaaacgcccgcctcactgccaagggaccagctccgcgggcacccggacatccctcgcctcctcacattggacgtgtag

SEQ ID NO: 29808 - DNA, 1521 bp, Artificial Sequence
  Description of Artificial Sequence: Synthetic coding sequence
ggtcaccaacctctaagcaccatgactgttcgatctagagtcgcggacgtatttggaagcaaagacactgagtctctagagcctgtccttttacctctagtggatcgtcggtttccaaagaagtgggaacgtcctgtggccgagagcctgggccacaaggataaggatcaggaggactatttccagaagggcggtctgcagataaaattccattgttctaagcaactgagcctggagagctcccgccaggtaacatcagagtcccaagaggagccatgggaggaggagttcggcagggagatgcgaaggcagctgtggttagaggaagaagaaatgtggcagcagaggcagaagaaatgggcactgctggagcaagaacatcaggagaagctgcggcagtggaacctggaagacttggcacgcgaacagcagcggcggtgggttcagctagagaaagagcaggagtcgcctaggcgcgagcctgagcagctgggagaggacgtggaacgacgtatttttacacccacgtcccggtggagggatcttgagaaagccgagctctccctggtgcccgcccctagtcgcacccagtcagcccaccagtcacgacggccacatctgcctatgtccccatcaacacagcaacccgcgctcgggaagcaacgaccaatgtcaagtgtcgagtttacctacaggccacgaacacgacgggttccgactaagccaaagaagtctgcctcttttccagtcacaggaacctctattagacgtctgacatggccttcgttgcagatatctcctgccaatatcaagaagaaagtgtaccacatggacatggaagctcagcgcaagaatcttcagctgctttcagaggaatccgagctcaggctccctcattacttgagatccaaagcacttgagttaaccactacaacaatggaacttggtgctctcagactacagtatctatgccataagtacattttctatcgacgcttgcaaagtctacggcaggaggctatcaaccatgtgcagattatgaaggagaccgaagcttcctataaggcccagaacctctacatctttctggagaacatcgaccgactgcagtcgctgcggctgcaagcctggacagataaacagaaggggctggaggaaaagcatagagagtgcctgtctagcatggtgacgatgttcccaaaactccaactcgaatggaatgtgcatctgaatattcctgaggtgacaagccctaaacctaagaaatgtaagctccccgccgccagccccaggcacatcagaccgagcggaccaacatataaacaaccgttcctgagccgccatagagcttgtgtccccctgcaaatggcccggcagcaaggtaaacagatggaagcggtgtggaagacggaggtcgccagctccagttacgcaatagagaaaaagactccagcctctcttcccagggaccagttacgggggcatccggatataccacgcttgctcacgctcgacgtctag

SEQ ID NO: 29809 - DNA, 2346 bp, Artificial Sequence
  Description of Artificial Sequence: Synthetic coding sequence
atgatgaaagaaaagcatctgtatgatattctccgttggcttggagattggggtgatactttaacatatgagatcgggccccgaaagagcgaagaggaggccgccgccctggatgagtggattgaggtcaccgagaaagtgctcccactatccctgattgcaacaaagcgggggatcgagagccttactgcgttgtgtagcacccttattgaagggcagaagaagcgctcccaagtgtcgaaacgtacattctggcagggttggcagggacggtctcctcaaacatcacctagtcacccacagccattgagcccggagcagatgctgcaggaccagcacaccatgaatacaaaggccagcgaggttacttccatgctgcaggagctcctggactcaaccatgttctcaaagggcgaggtgcgcgccataaggtacatggccacggtagtggaaaatctgaacaaggctcttattctgcagcacaaagagaatcgctctctcgagacaaagtaccgacacctgcaaatgcaggctacgaaggagttgtccagccaacggctgcactttcaacagtttatggaagtcctggaatctcgccgagatgcgctcctcaagcaagtggaaatcttaggcggcaggtaccacgatctgttgctgatgaagcaggctctggaatttcagttgaaaaaggctcagaacgccaccgggcaggcagaggatctggcggaagtcagcgtcgactctccagggcctagcgaaagagaaacactgccaagaaaggagactgtgatggaggagagccaacaggagcctatgaaagaggaacagctcttctcaccactcccacctagtccaatggcaatgattagagattcgggcgccatcgcagctgggcaccagcctcttagcacaatgactgtacggtctcgcgtggccgacgtattcggatccaaggacacagaatctctggaaccggtcctgttaccactggtcgacaggcggttccctaaaaagtgggagcgtcccgtggccgagtccctgggccataaagacaaagatcaggaagattattttcagaagggtggattgcagattaagttccattgttccaaacagctgtctttggagtctagtcggcaagtcaccagcgaaagccaggaggagccctgggaagaggagttcggccgagagatgcggagacagttatggttagaggaagaagaaatgtggcagcagcgccaaaagaagtgggctctgttggaacaggaacaccaggagaaattgaggcaatggaatctcgaagatctggcccgcgagcaacagaggagatgggtgcagctggagaaggaacaggaaagcccccgcagggagcccgagcagctaggagaggatgtagaacgccgtatctttacccctacaagcaggtggcgcgacctggagaaagcagagttgtccctggttcccgctccgtctagaactcagtccgctcatcaaagccgacgaccacacctccctatgagtccatctacacagcagccggctttaggcaagcagcggcctatgtcgagcgttgagtttacatatagaccacggacccgacgagtgccaacaaaacctaaaaagagcgctagcttccctgttaccggcacatctatcaggcggctgacatggccttcactgcaaatatcccccgccaatattaagaagaaagtataccatatggacatggaggcacagcgcaagaatttacagctcctctccgaggagtccgagctgcgacttccccactaccttagaagcaaggctctggagctgactaccaccaccatggagcttggggcgctgagactccaatacttgtgtcataagtacatcttttacaggagattacagagtttaaggcaggaagcaatcaatcacgtgcagattatgaaagaaaccgaggcctcctataaggcccagaatctctacatttttctggaaaatatagatagactccagtctctgaggctgcaagcttggacggataagcaaaagggcctggaagaaaaacatagggaatgcctctccagtatggtgacaatgtttccaaagctccaactggagtggaatgttcatctcaatataccggaagtgacttccccaaagcctaaaaagtgtaagctgcctgcagcctccccccgccacattagaccaagcggcccgacctacaagcagccattcctgtcgcggcatagagcctgcgtaccactgcagatggctaggttgcttgcactgtgcctgcgcgggctcgtggcggaactcgctctggttatggaagattttgacctgctgcatgtattgtag

SEQ ID NO: 29810 - DNA, 354 bp, Artificial Sequence
  Description of Artificial Sequence: Synthetic coding sequence
tgatgtttgtctagtatggtgactatgttccctaagttgcaactggagtggaacgtacatctcaatatccccgaagtcacgtcacccaagcctaagaaatgtaaactgcctgccgccagccctcggcacatccggccttccggacccacgtataagcagccattcctcagtcggcaccgcgcctgtgttcccctccagatggccagacagcaggggaagcagatggaggcagtgtggaaaactgaggtggcaagcagttcttatgccatagaaaaaaaaacaccagcatctcttccaagagatcagctgagaggacatcccgacatacctcggctgcttaccttggacgtttag

SEQ ID NO: 29811 - DNA, 1242 bp, Artificial Sequence
  Description of Artificial Sequence: Synthetic coding sequence
atgcacctggcgttgacaaccgtcctcctttgggcatgggggctgcaggcctttgagatcgttgaaaaggagaacatttttcagcggacaccatgcccagccttcttgatgttcgaaaacgccgcgtacctggcagacatgtcttttgaactgccatgtcattgtaagccagaggaggtgcctgcagtcgtatggttctaccaaaagcatctgggttcgtcccacacgaaagttctgaccgacttcgatgggcgggtgctgactgaggctgctcaggttagagttgggtctgacatgctgacgcggtttagtataaggatgttttccttgctcgtgttccgtgcgcaatctgaggacagcgggctttacttttgtgggacaaggaagggagattacttttatgcttatgacgtggacatccagaattctgagggcatggtggccactttccaagacaagggacaggagccttttgctgacgagtactacggacatctccacgtgttcaccaccttctgggaatggacaccatgtgatcggtgcggtgtaagaggcgagcagtggaggataggcctgtgttatttgcaatccccagatttgagtcctcggtatctgaaagctgtgccagatgtagtctcttgtggtagtagggccgtaccaagaaagctgaggactaaggcaagagatcatacccctgaagtccttgtgagatcctgcttagttccttgtgagaaaacgaagacgatccgggagggagtgctcgcaataatcaattatgttagcaaagttggctctcggccctgggtgccccaagtgcccattcagtttcaccagcagaggctaggccacggcctgattatcagctgcccaggggcgcgcccagagcatgccgtggcatgggacaaggatcgccagcatctctatcgaacccagtatttaaagggggtaaacagatccatgcgcgttttcatcgatcacggcaaccagctgcatatcaggtttacacaactagacgacagaggcatatactactgctggcgccagggcgttctggttgccggatttcggcttggggtgacatctcacggccactacccagcaagtttttccgaccccgaaacccgttccgcagttgagctgactttaatcggatacctcctgatcactgctgtatttgtgacgattcacttttgcagatgctgttgttatttgttccattgttgtccttctttcagtccctag

SEQ ID NO: 29812 - DNA, 1242 bp, Artificial Sequence
  Description of Artificial Sequence: Synthetic coding sequence
atgcacttggccttgacaaccgtgctgctctgggcttggggactccaggcattcgagattgtggagaaagagaatattttccagcgcactccttgtcccgctttcctaatgttcgaaaacgcagcatatcttgccgacatgtcttttgagctgccttgccactgtaagccagaggaagtgccagcagtcgtgtggttctaccagaagcacttggggtcgagtcacacaaaggtgctgacagatttcgatggtagggtactgaccgaggcggcccaagtccgggttggttcggatatgttaaccaggttctcaatccggatgttctctctccttgtgtttagggctcagagtgaagacagcggcctttatttttgcggcacccgcaaaggagattacttttacgcatacgacgtcgacattcagaactcagagggcatggtggcaacatttcaggacaaaggtcaagagcccttcgcggacgagtactacggtcaccttcatgttttcacaaccttttgggaatggacgccctgtgaccggtgcggtgtccggggtgagcaatggaggattggtctgtgctaccttcagtcccccgatctgtctcccaggtatcttaaggcagtgcctgatgtggtgtcctgtggctccagagctgttccccgcaagcttcgcaccaaggcccgtgaccacactccagaggttttggtgagatcatgcctcgtcccctgcgaaaaaacaaagaccatcagagaaggagtgctggcaattatcaattacgtgtccaaggtgggtagccgcccatgggtccctcaggtccccattcagtttcatcaacaaagactggggcatggattgattatatcctgccctggcgctcgcccagaacatgccgtggcttgggataaggatagacagcacctataccgcactcaatatttgaaaggcgttaatcgctccatgagggtctttatcgaccacggtaaccagctccatatccgcttcacccagctcgatgaccgtggcatctactactgttggcgccaaggcgtgctggtggcaggcttccggctcggtgtcacctcccacggacattacccggcctcattttcagatcccgagacccgatccgcagtggaacttacactgatcgggtatttactcataactgccgttttcgttaccattcacttctgccgatgttgctgctatttattccactgctgtcccagtttctcgccttag

SEQ ID NO: 29813 - DNA, 2274 bp, Artificial Sequence
  Description of Artificial Sequence: Synthetic coding sequence
atggacagcctcttcgtggaggaagtagctgcctccctggttcgggagttcctctcccgcaaaggtttgaaaaaaacctgcgtcaccatggatcaggaacgtccaaggagcgatctctccattaacaatcgaaacgatctccggaaggtgctccacttagaatttctgtacaaggaaaacaaggccaaggaaaacccacttaagacttctctggagctgatcacccgatacttcctagatcattttggtaacaccgccaataattttacccaggataccccgattcctgcgctctccgttccgaagaagaataataaggtaccttccagatgctcagagaccactttggtgaatatatacgacctgtctgatgaggacgccggttggcggactagcctcagcgagacctcaaaggcacggcacgataacctagacggcgatgttcttggaaactttgtgtcttccaagagaccccctcataaatcgaagccaatgcaaaccgtccctggcgaaactccagtgctgacaagcgcttgggagaaaattgacaaactgcatagtgagccatcacttgacgtgaaaaggatgggcgaaaacagtagaccaaagagtggactaatcgtgcgggggatgatgtccggcccaattgccagctctccacaggatagcttccacagacattatttgcggcggagctcaccatccagttcgtcgacgcaacctcaggaagaaagccgcaaggtgcccgagctttttgtctgcacacagcaagatattctcgccagcagtaattcctcccctagccggacgagcctcggccagctctcggagcttactgtggagcgccagaaaacgaccgcatcctcacctccacacctcccaagcaagagattaccaccctgggaccgggctcgtccacgggacccatccgaggacacgcccgccgtggacggctcaaccgataccgatcgcatgccccttaaactttacctcccaggaggtaacagtaggatgacccaggaaagactcgagcgggcttttaaaagacagggcagccagcctgcacctgtgcgcaagaatcagttacttccgagcgataaagtggatggcgaactgggcgcattaaggcttgaagatgtagaagatgaactgattcgcgaagaggtgatcctctccccagttccatccgtccttaagctgcagaccgcaagtaagccgatcgatttgtcagtcgccaaggaaatcaagacattgctctttgggtccagtttctgctgctttaatgaggaatggaaacttcagtcattttctttttcaaacaccgcctccctcaagtacgggattgtccagaataagggcggcccatgcggcgtgctggctgcagtgcaaggatgtgtcctgcagaaactactgttcgagggcgactctaaagctgattgcgctcagggcctacagccatctgacgcccaccgtacacggtgcctggtgctggcattggccgacatcgtctggcgagctggaggacgggagagggccgtggtggcgctggcatccagaacacaacagttttcacctacaggaaagtacaaggctgatggggtcttagagacactcactctgcactctctaacatgctacgaggacctcgtaactttcctgcagcagagcattcaccaatttgaggtcgggccatatggctgcatcctcctcaccctctcagcaatattaagccggagcacagaactgatccggcaggacttcgacgtccccacaagtcacctaattggcgctcacggctactgtactcaggaactggtgaatttactcctgaccggtaaagccgtctcaaacgtctttaatgacgtcgtggaactggactcaggagatggaaatataacactactgcgtggcattgctgcccgaagtgatattgggtttcttagtctcttcgagcactacaatatgtgccaggtggggtgtttccttaaaacccctcggttccccatttgggtagtttgcagtgagtcacactttagtatactgttttccctgcagcccggcttgctccgggactggcgcactgagcgcctgttcgatctttattattacgatggattggccaatcagcaagagcagataaggctgacaattgacaccacacaaaccatcagtgaagatactgataacgacctcgtgccacctttggagctgtgtatccgaaccaaatggaagggagcatcagtgaattggaacggctctgaccccattctgtag

SEQ ID NO: 29814 - DNA, 1953 bp, Artificial Sequence
  Description of Artificial Sequence: Synthetic coding sequence
atgatgccaagccctagcgactcatctagaagcctgacatctcgcccctctacccggggcctgacccatctgaggttacaccgtccttggctgcaggccttgctgaccttggggctggtccaggtgcttctgggtatactggtggtgacattctccatggtggcttcttctgtcaccactacggagagcatcaaacgctcttgcccctcctgggccggcttctctataagtttcttttcattgcttagcgtactgtgcgtcatgttaagtatggctggcagtgtgttaagctgtaagaacgctcagttagcgcgcgacttccagcagtgctccttggaaggcaaggtgtgcgtctgttgtccttcagtgcccctgctgagaccgtgtccagagtctggccaagagttgaaggtggcccctaattcaacttgcgatgaagcgagaggcgctctcaagaatttgcttttttccgtctgcggattgaccatttgtgcagccatcatctgcacacttagcgctatcgtgtgttgtatccagatcttctccttagacctagtccatactcagttggctcccgagcgaagtgtctcaggccctctcggtcctctgggttgcacttcccccccccctgctcccctactgcacacaatgcttgacctcgaggagttcgtcccaccagtgcctcccccaccatactacccccctgagtacacatgtagctccgaaactgacgcgcaatctataacatataacggaagcatggatagtcccgtccccttgtacccaacagattgcccccccagttacgaggccgtgatggggttacgtggcgactcccaggccacactctttgatccccaacttcacgacggcagctgtatctgtgagcgagtcgcatcaattgtagacgtgagcatggattccggctcccttgtgttatcggccatcggggatctccctgggggcagtagcccctctgaggactcatgtttgttggagttgcagggtagtgtgcgcagcgtcgactacgtactctttcgaagtatacagcggagccgcgcaggctactgtctgtccctagactgtgggttgcgtgggcctttcgaggagtcgcctctgccccgccgaccccccagggcggcacggtcttattcctgctctgccccagaagcgccacctcccctgggcgctccaacagccgctagatcatgccaccgactggagggttggccaccctgggttggaccatgctttcccgaacttcgtaggcgcgtgccaagggggggagggaggcctgcagctgcaccccccactagggcgccaacccgacgcttcagcgatagttcagggtctttgacccctcctggccatcgacccccacatcctgcatccccaccacccctcctgttgccacggtcccatagtgatccaggtattacaacaagcagcgatacagcggatttcagggatttgtatactaaggttctcgaggaggaagctgctagtgtgtcatccgcagataccggcctgtgcagtgaggcctgcttattcagactcgccagatgccctagccccaagctgctgcgtgctcgtagtgctgaaaagagaagacctgtacccacgttccagaaagttcctctcccaagtggccccgcgccggcccacagcctcggggatctgaagggatcctggcccggcagggggctggtcactaggtttctgcaaatttccaggaaagcacctgatccaagtggcactggtgcacatgggcacaaacaggtccccagatctctgtggggcaggcctggacgggaatctcttcatctgagatcctgtggggatctgtcatccagcagcagtctccggagactcctttctggacggcgactagagcggggtacacgccctcattcattgagccttaatgggggcagtagagaaacaggtctttag

SEQ ID NO: 29815 - DNA, 2703 bp, Artificial Sequence
  Description of Artificial Sequence: Synthetic coding sequence
atgggcgattccggctcaaggaggagtactctggtgagccgcctgccgatcttccggagaagcattaatagacggcacgacagtctcccctcgagtccttccagttctaacaccgtgggcgttcatagctcttctccgtcaagcacaaacagctcctccgggtccacaggtaaacggcggtccattttcagaactccaagcatttcatttcaccacaagaagggctccgaacctaagcaagagccaacaaatcagaatcttagtatatccaacggcgcccagcctggccactcaaacatgcagaagctgagtttagaggaacacattaagacgagggggcgccactctgtgggcttctcctctagccgcaataaaaaaattacacgatctctgactgaagacttcgagcgggagaaagaacactccaccaacaagaacgtatttatcaattgtttatcttccggcaagagcgaaggggatgactccgggttcaccgaggatcagacgcggcggtcagtcaagcaaagcactaggaaactgctgccgaagtcctttagcagtcactacaagttctccaagcccgtcctgcagtcacagtccatctccctggtgcaacagtcagaattttcactcgaggtgacacagtatcaggagcgagaacccgtgttggtccgtgcgagccctagctgtagcgtggacgtcacagagagggccggatctagtctgcagtcacctctgctcagtgccgatctcaccacagcacaaacaccttctgagttcctcgcactcacagaggacagtgtgtccgaaatggatgccttctctaaatctgggtctatggccagccactgcgataattttggccataatgatagtaccagtcagatgtcactgaattccgccgccgtgacaaagacaacgaccgagctcactggcacggtgccctgcgcaatcatgagtccggggaagtaccggctggagggtcagtgctctaccgagagtaatagcctgcctgaaacttctgctgcaaatcaaaaagaagtgcttctgcaaatagctgaactgcctgccacatccgtgtcccacagtgagtctaatttgcccgccgacagtgaacgcgaggagaacattggccttcagaacggggaaaccatgctaggcacaaacagtccccgcaagctagggttctatgagcagcacaaggctatcgctgagcatgtaaaaggtatccaccctatctctgattctaagattatacccacttcaggagatcaccatatcttcaacaaaaccagccacggttacgaggctaaccctgcaaaggtgctcgcatccagcctttccccgttccgcgaagggagattcattgaaaggcggctgaggtcaagttcagaagggaccgccggctcctccaggatgattctcaagccgaaagatggtaatatcgaagaggtgaacagcctgcgaaaacagagagccggttcaagctcttcgaagatgaactctcttgacgttctgaacaaccttggtagctgtgaattggacgaggacgacctgatgttagacctcgagttcctcgaggagcaaagtctccaccccagcgtctgtcgcgaggattcctatcatagcgtcgtgagctgtgccgcagtggtgctgaccccaatggagcccatgatcgaaatgaagaaacgagaggaacccgaattccccgaacccagcaagcagaacctcagcctaaaacttacaaaagacgtcgatcaggaggccagatgcagtcacatctcaaggatgccaaatagcccgtcagcagattggccactgcagggagtggaagagaacggtgggatcgattcgttaccattcaggctcatgcttcaggattgtaccgcggtaaagacccttctgctgaaaatgaagcgtgtcctgcaagagtccgccgacatgtcccctgccagcagcactacgtcactccctgtgtctcccttgaccgaggagcccgtgccattcaaggatatcatgaaggacgaatgcagcatgctcaaactgcagttaaaggagaaggatgagctgatctctcaactgcaggaggaactgggtaaagttagacacctgcaaaaagcctttgccagtcgcgtggacaagagtactcagactgaactgctttgctacgatggcttgaacctcaagcggctggaaacagtgcagggaggccgggaggctacctatcgcaataggattgtcagtcagaacctatctacacgagataggaaagcgattcatactcccactgaggaccggttcagatattccgccgctgatcagacctccccttataagaacaagacctgtcagctgccaagtttgtgtctttccaactttctgaaggacaaggagttggctgaggtcattaagcactctagaggtacatacgaaacactcacctctgatgtgacacagaatctcagggctactgtaggccagtccagcctgaagccaaccgcaaaaaccgaaggcttatctacgttcttagagaagccgaaggatcaagtggccacagcccgtcagcattccacctttacgggccgctttgggcagccaccgcgcggtcccatcagccttcacatgtatagtcgtaagaacgtgttcttacatcacaacctccattccactgagttgcaaacacttggccagcaggatggctag

SEQ ID NO: 29816 - DNA, 2034 bp, Artificial Sequence
  Description of Artificial Sequence: Synthetic coding sequence
atgggcgattcaggatccaggcgtagcaccctcgtgtccagactacctatcttccgacgcagtatcaacagacgccacgattccctccctagttcgcctagcagttccaacacagtcggcgtgcacagcagcagcccgtcgtccaccaacagtagctcaggtagcaccgggaagaggcggagtatcttcaggacaccgagtatcagctttcatcataagaagggatccgaaccaaagcaggaacctaccaaccagaatctgagcatcagcaacggggcccaaccaggacacagtaacatgcagaaactctcgttggaggaacacatcaagacgcgcggcaggcactccgtcggtttttccagctctcggaataagaaaattaccagatccttgactgaggattttgaaagagaaaaggaacattcaacgaataaaaacgtcttcattaattgcctaagcagcggaaagagtgagggggatgattccgggttcaccgaggaccaaaccaggcggtccgtgaagcaatccactaggaagcttttgcccaaatcatttagctcccattacaagttctcaaagccagtgttacagagccagtctatctccctggtgcagcagtctgagttctcactggaggtgactcagtaccaagaacgggaacccgtcctggttagagcttctccgtcatgttctgtcgacgtaaccgagagggccggctcctccctgcagagtccacttctgtccgcagatctgacaactgcccagactccctccgagtttcttgccctgacggaagattcggtatccgaaatggacgccttttcaaagtcaggatcaatggcgtcccattgcgacaattttgggcacaatgatagtacctctcaaatgagtctgaactcggccgccgtgacaaagacaacaaccgagttgaccgggactgtgccctgcgctataatgagtcctgggaagtaccgcctcgagggacaatgtagcacagagtccaatagcctgcccgaaaccagtgctgcaaaccagaaagaagtgctacttcagatcgccgaacttcctgccacctcagtctcccactctgaaagtaatctgccggcagactcggaaagagaggaaaacatcggtctccagaatggtgaaaccatgctcggtacaaattctccacgaaagctgggcttttatgagcagcataaagccatcgccgaacacgtcaagggtatccacccgattagcgactccaaaattattccaaccagcggtgatcatcacatttttaacaagactagccacggatacgaggcaaaccccgccaaggtcttggccagcagcctgtcccccttccgagaaggccgttttattgagagacgcctccggagctcaagcgaaggaaccgccggatcttcacggatgattctgaagcctaaggatggaaacatcgaagaagtaaacagtctaagaaagcagagggctggaagcagttcatctaaaatgaacagtctggacgtgctgaacaatctcgggagctgtgagttggatgaggacgacctgatgctcgatctagagtttcttgaggagcagagtttgcacccaagcgtgtgcagagaggattcgtatcattctgtcgtgtcctgtgccgccgtagtactgactcccatggaacctatgatcgagatgaaaaagagagaagagccagagttccccgaaccatctaaacagaacctgtccctgaaattgactaaagacgtggaccaagaagccagatgcagtcacatatcgcggatgcccaattccccaagcgccgattggcctctgcagggagtggaggagaacggtggcattgatagtctgccattccggttaatgctgcaagattgcactgccgtcaaaactctcctcctgaagatgaaaagagtcctgcaggaaagcgcagacatgagcccagcgtcttccaccaccagtttgcctgtttccccattgactgaagaacccgtcccttttaagactacgtacccccgcgagttttag

SEQ ID NO: 29817 - DNA, 2034 bp, Artificial Sequence
  Description of Artificial Sequence: Synthetic coding sequence
atgggcgacagcggaagccgccggagcacattggtctcccggttgccgattttcaggcgttcgatcaatcgcaggcatgactcactgccatcttcaccaagtagttctaatactgtgggagtgcatagttcaagccccagttccaccaacagcagtagcggctcaaccggaaagcgacgctccatcttcaggacgccatctatatcttttcatcacaagaagggatctgaacccaaacaggagcctaccaaccagaatctgtcaatttcgaacggggctcagccgggccactcgaatatgcagaaactttctcttgaggagcacattaagacaagagggcggcacagcgtcggcttctcttcatctcgcaacaaaaagatcacacggtcactgacggaagactttgagcgggagaaggagcatagtacaaacaaaaacgtcttcatcaattgcttaagctccgggaaatcggagggtgatgattccggttttacagaagatcaaacccgtaggtcggtgaaacagtccacccgaaagctcctccccaagtctttcagctcacattacaaattctccaagcccgtccttcaatctcagtcaatctctcttgttcagcaaagtgaattcagtctggaagttacccagtaccaggaaagggaaccggtgctggtgcgagcctcacctagctgctctgtcgatgtcacagaaagggcaggcagcagtctccagtcgccactgttgtcagctgatctcacaacggcccagaccccatcagagttccttgccctgactgaagacagcgtatcagagatggatgcgttttccaaatccggatccatggcttcccattgtgacaactttggccacaacgattcgactagccaaatgtccttgaatagcgctgctgtaaccaagaccaccacggagcttaccggcaccgttccctgcgccattatgagcccagggaagtaccgcctagagggtcagtgcagcaccgagagcaacagcctgccggaaacctcagctgctaatcaaaaggaagtactgctgcaaattgctgagctgcccgctacttccgtctctcacagcgaaagtaatttacctgccgattctgagcgtgaggagaatattgggctgcagaatggcgaaaccatgcttggaactaacagcccaaggaaattagggttctacgagcagcacaaagcaatcgccgagcacgtgaaaggaatccatccgatttctgacagcaagattatccccacaagcggagaccatcatatattcaataagactagccatggatatgaggccaacccggcaaaagtgctggcctcttccctgtcaccatttcgcgagggacgttttattgagcgaagactgcggtcctccagcgaagggacagccggatctagtagaatgattctaaaaccaaaggacggaaacattgaggaggtgaactccctgcgcaaacagcgggcgggaagctcgtcatcgaaaatgaatagcctggatgtgctgaacaatctggggtcctgcgagcttgacgaggacgacctgatgcttgaccttgaattcctggaagagcagagtttgcacccatctgtttgcagagaagactcctaccacagcgttgtgagttgtgcagctgtggtactcacaccaatggagcccatgatcgagatgaagaagcgcgaggaacccgagtttccagaaccctccaagcaaaacctgtcccttaaactcactaaggatgtagaccaggaggcccgctgtagtcacataagccggatgcccaattctccctccgccgattggccgctccaaggggtcgaggagaacgggggtatcgatagcttacccttcagattgatgctccaggactgtactgccgttaagacattactgctgaagatgaagagggtactgcaggaatctgccgacatgtcccccgcttcgtcaaccacttccctccctgtgagcccattgacagaggaacctgtcccattcaaagattactacaaacggcctttttag

SEQ ID NO: 29818 - DNA, 2703 bp, Artificial Sequence
  Description of Artificial Sequence: Synthetic coding sequence
atgggcgactctggtagccgtcgatcaacgctcgtgtcaaggttaccaatctttaggcgctccatcaaccgtaggcacgactccctgccaagtagcccgtcttcgtcgaacaccgtcggggtgcactcaagcagcccgtcctcaactaatagctccagcggttccacaggtaaacggaggtctatattcagaacaccatctattagctttcatcacaagaaagggtccgaacccaaacaagagcctacaaaccagaacctgagtatctctaatggtgcccagccgggccactccaatatgcagaagctgtcactggaagaacatatcaagaccagaggacggcattccgtcgggttcagttccagtcgcaacaagaagatcacccgatctctgacagaagatttcgagcgggaaaaggaacacagtaccaacaaaaacgtctttatcaactgtctcagcagtgggaaatctgaaggcgacgatagcggtttcacagaggaccagacgcggcgctctgtgaagcagtcgacaagaaaactgctccctaagtccttttcctctcattacaaattttctaagccggttttgcagtcacagtctataagcctcgttcagcagtcagagttctccttagaagtcactcagtaccaggagcgggaaccagtccttgtgagagcatcccccagttgtagcgtggatgtcacagaaagggccgggagcagcctacagtctcccctgctcagcgctgatctgactaccgctcaaaccccatctgagtttctggccctgaccgaggactcagtttctgagatggatgcattttctaaatcgggctcaatggcctcccactgcgacaatttcgggcacaacgactcgacttctcagatgagcctcaacagtgccgcagtgaccaagaccacgaccgagctgaccgggacggtcccttgcgcaatcatgtctcccggtaaataccgactggagggtcagtgttccacagagtccaacagcctgcccgagacatccgctgccaaccagaaagaagtgctcctgcaaatcgcggagctgcctgccacctcagttagccattccgaatccaacctgcccgcagacagtgagcgagaggagaatattggcctacagaatggcgaaaccatgcttggtaccaactcccccaggaagctgggcttttacgaacagcacaaagctatcgctgagcacgtaaagggaatccatccaatctcagactcaaaaatcattcccactagcggtgatcaccatatctttaacaaaaccagtcacggttatgaggctaatcccgccaaggttctggcgagctcattgtcaccatttagggaagggcggttcattgagaggcgactacgcagctcttctgaagggactgctggttcttccagaatgatcctcaagccaaaagatggcaacatcgaggaggtgaattcactgaggaagcagagagcagggagtagctccagtaaaatgaactctctcgacgtgctcaacaatctcggctcctgcgagctcgacgaggacgacctcatgcttgatctcgaattccttgaggaacagtctcttcatccctccgtgtgccgggaagactcctatcactccgtggtttcttgcgccgccgtcgttctgacccccatggagcctatgattgagatgaagaaacgcgaagagccagagtttccagagcctagcaagcagaatttatctctaaagctgactaaagatgtggaccaggaggctagatgcagccatatatcacgaatgcccaatagcccaagcgcagattggccactgcagggggtggaggagaatggtggcatagacagcctcccctttcggctgatgctccaggattgtactgcagtgaaaactctcctattgaaaatgaaaagagtcctccaggaaagtgctgacatgtcaccagcgtccagtactacgagcctcccagtttctccactgactgaagaacccgtgccttttaaggatattatgaaggatgagtgcagtatgctgaagttgcaactgaaggagaaagatgaactcatcagccagttacaggaggagctcgggaaggtgagacatctccagaaggctttcgcctcccgcgtggataagtccactcagactgagctgctgtgctatgatggactgaatctgaagcgcctggaaaccgtgcagggaggcagggaggctacttacagaaataggatcgtatcacagaatctatcaacacgggacaggaaggcaattcatactcccacagaggaccgcttccgctacagcgctgcagatcagacttctccttataaaaacaagacatgccagctgccgtcactctgcctgtccaacttcctgaaggataaggaattagctgaagttattaaacatagcagagggacctacgagacccttacatccgacgttacccagaacctgcgcgccacggtgggccagtcttccttgaaacctaccgcaaaaaccgaaggactgtccacgttcttagaaaagccgaaagaccaagtagccaccgcccgacagcactcaacgttcactgggcggttcggacagcctccccgaggtccgatttctctgcacatgtacagtcgaaaaaacgtctttctccaccataacctgcattcaactgaactgcagaccttggggcagcaggacggctag

SEQ ID NO: 29819 - DNA, 10074 bp, Artificial Sequence
  Description of Artificial Sequence: Synthetic coding sequence
atgggaaggcacgtggctacgtcatgtcacgtcgcctggttgctggtgttaattagtggatgctgggggcaggttaatagacttccgttctttaccaaccacttctttgatacctacctcctcatctcagaggatacccctgtggggtcctcagtgactcaactgctagctcaggatatggataacgaccctctagtcttcggcgtaagcggggaagaggcatctcggttctttgccgtggaaccagatacaggagtcgtgtggctgagacagcccctggacagagagaccaaaagcgagttcactgtggagttcagcgtgtccgatcaccagggcgtcattacgcgcaaagtaaacatccaagtgggagacgtgaatgacaatgcaccgaccttccataatcagccttacagtgtgcgcatccccgaggtgggagccaccgggaatacccctgtgggcacacctatcttcatcgtgaatgcaacggacccagacctcggtgcaggcggaagcgtcttatattcatttcagcccccatcgcaattctttgcaattgacagcgccaggggaatcgttactgtgattcgagaacttgactatgagaccacacaggcttatcagcttactgtaaatgcaacagatcaagataaaacccgaccactaagcacactcgccaatctcgccatcattattaccgatgtacaggacatggacccgatcttcatcaacttgccctattccacaaatatctatgaacatagccctcctggaacaactgtcagaatcattaccgctatcgaccaagataaggggcgcccccgagggataggatataccatcgtatccgggaatactaactcaatttttgctctggactacattagtggggtgttaaccctaaacggcttactcgaccgcgagaacccattatatagccacggcttcattctgaccgtgaagggcacagagctgaatgacgaccgcacccctagtgatgctaccgtcacaacaacctttaacatcctcgtgatagacattaacgacaatgccccagaatttaactcgagcgagtacagtgtggccattactgaactagcccaggtcggcttcgcattgccactgttcattcaggtggtggacaaggatgaaggcctcaattcaatgtttgaggtctatctggtgggcaataactctcaccactttattataagccccaccagcgtgcaggggaaagctgacatcaggatacgagttgcgatccctctcgattacgagaccgttgaccgatacgacttcgacctcttcgcaaatgagtctgtgccagaccatgtggggtatgcgaaagtcaagatcacactcatcaatgagaacgacaaccgtccgatcttttcgcagccactgtacaacatctcgctctacgagaacgttaccgtgggtacctccgtactcactgttttggcaaccgataacgacgcgggtacttttggggaagttagctacttctttagtgatgatcccgatcgtttcagcctggacaaggatacgggccttataatgctgatagcgaggttggattacgagttaatccaacgatttacattgactatcatcgcccgggatggcggcggagaagagaccacgggtcgggtgcggattaatgtgttggatgtcaatgacaacgttccaacatttcagaaagatgcatacgtcggggctcttagggaaaacgaaccatcagtgacgcagttagtgcgcttaagggcaaccgatgaggactcccccccaaataatcagatcacttactccatcgtgtccgctagtgcctttgggtcctacttcgacatctcactctacgagggctatggcgtgatctccgtcagtcggccactggattacgagcagatatctaacggtcttatttacttgaccgtaatggcgatggatgctggcaatccgccactgaactcaacagtgccagtcacgatcgaggtgttcgacgaaaacgacaacccaccaactttcagcaagcctgcatactttgttagcgtggtggagaacattatggcaggcgcgaccgttttgttcttaaatgcgacagacttagaccggtcccgtgaatatggtcaggaaagtatcatttactctctagaagggtctacgcaatttcgaattaatgcaagaagcggagagattaccacaaccagcttgctggatcgcgaaacgaagtcggagtacatcttgattgtgagggctgtggatgggggtgtcggccacaaccagaagactgggattgcaacagtaaacattaccctgcttgacatcaacgataatcatccaacttggaaggatgctccatattatattaatttggtcgaaatgaccccccctgactctgacgtcacaacggtcgttgcagtcgacccggatttgggcgagaatgggacccttgtgtatagtattcagccacctaacaagttttattctctcaactcaacaactggaaaaatcaggactactcatgctatgctggatagggaaaatcccgacccccacgaggctgagttaatgcgaaagatcgtggtttccgtgactgactgcggacggccgccactgaaagccactagctcggccacggtttttgtgaatctgttagatctgaatgacaacgaccccaccttccagaatctgccatttgtcgctgaagtactcgaggggattccagctggggtgtctatctatcaggttgtggccattgacctcgacgaagggctgaatggactggtctcctacaggatgcctgtgggcatgccaagaatggactttctgataaattcttcctccggtgtcgtggtgacaacgactgagctggatcgggagcggattgctgagtaccagctgagagtggtggcctcggacgctgggacgcccactaaaagcagcacttctacgttaaccatccacgtcctggacgtgaacgacgaaactccaacgtttttccccgcggtctacaacgtgagtgtgtcagaggacgtgcctcgagagttccgagtggtgtggctgaactgtaccgataatgatgtcggcctgaatgctgagctctcttactttatcacagggggcaacgtggacgggaaatttagtgttggatacagagacgccgttgtccgcactgttgtggggcttgacagagaaaccaccgccgcctatatgctgattctcgaggctatcgataacggtcccgtggggaaacgtcacacgggcacagccaccgtctttgtgaccgtgctcgatgtcaatgacaacagacctatcttcctccagagctcctatgaggcctccgtaccagaggacatcccggaaggccacagcattctgcaactaaaagccaccgatgccgatgagggtgagtttggtcgtgtttggtatcggattctccatgggaaccacggaaataactttcgcatacacgtgagcaatggacttttaatgcgaggacctcgcccactggatagagaacgcaatagctcccacgtcctgatcgttgaggcctacaatcacgaccttgggcctatgcgaagctccgtgcgggtgattgtgtatgtcgaagacattaatgacgaggcacccgtcttcacccagcagcagtattctcggcttggcctcagggagacagccgggatcggaacatcagttattgttgtgcaagcgaccgaccgcgacagtggagatggcggactagtcaattatcgtatcctctcaggagcagagggaaagtttgaaatcgatgaatccactggccttattataacggtgaactatcttgattacgagacaaaaactagttacatgatgaacgtgtccgcaacagatcaggctcctccctttaaccaaggcttttgctcagtttacataaccctactcaatgagctcgacgaggccgtgcagttttccaacgcttcgtacgaagccgctattctggagaaccttgctctcggcactgagatcgtgagagtgcaggcctactcaatcgacaacctgaatcagatcacctacagattcaacgcctatacaagtacccaggccaaagccctgttcaaaatagacgctatcaccggggtcatcacagtgcagggcctggtagatcgcgagaagggcgatttttatacactgacagttgttgctgatgacggcgggcccaaggtagactcaaccgttaaggtctacattactgtgcttgacgaaaacgacaattcgccgcggtttgatttcacaagcgattctgctgtgagcatacctgaggattgcccagtggggcaaagggtggctacagtcaaagcatgggatcccgatgccggcagcaacgggcaggtggttttcagcctggcgtctggcaacatcgctggcgcatttgaaatcgtgaccactaacgacagcatcggcgaagttttcgtggcccgccccttggaccgggaagaactcgatcactatatccttcaggtcgtggcgtctgatagggggacacccccacggaaaaaggaccatatcctccaggtgacaatactagacatcaacgataaccccccggtgattgaatcaccgtttgggtataatgtctccgtcaatgagaatgtcggcggaggaacagcggtcgtccaagtgcgggcgacggatcgggacatcggtatcaactccgtcttatcttattacatcacagagggtaataaagatatggccttccggatggataggattagcggtgagattgcaacacgccccgccccgccagaccgagaaaggcagtccttctaccatctggttgctacagtcgaggatgaaggaacccctactctttctgccacaacccacgtttacgtcacaattgtggacgagaacgataacgctcctatgttccagcagccacattacgaagttctacttgacgaagggcccgatacacttaatacctccctgattactatccaggcgcttgatctcgacgaaggacctaacggtaccgtgacttacgccattgtggccggaaacatagtaaacacttttaggatcgatcgccacatgggcgtgattactgctgccaaagagttagactacgaaatttcccatggccggtatactctgatcgtcacagccaccgaccagtgtcctatcctaagtcaccggctgacctctaccaccaccgttctggtgaatgtgaatgacatcaatgataatgtgcccacctttccccgagactatgaaggcccattcgaggtgaccgaaggccagccgggccccagagtgtggacatttctggctcatgaccgagattctggaccaaacggtcaagtcgaatattccatcatggacggagaccccctaggcgagttcgttattagccctgtagaaggagtgcttcgcgtacgcaaagacgttgaactggacagggaaacaattgccttttacaacctgacgatctgcgcacgggatcggggtatgcctccacttagcagcactatgctggtgggaattcgggtccttgatatcaacgataacgaccccgttctgctgaacctgccaatgaatatcacgattagtgaaaatagcccggtgagctcctttgtggcccacgttctggcctctgacgctgactctggatgtaacgcaaggctgaccttcaacatcacggccggaaacagagagcgtgctttttttatcaatgccaccacaggcattgtgaccgtcaacagacctctggatcgcgaaaggattcccgaatacaaactcactatctccgtaaaagataaccctgaaaatccgaggattgctcgaagagattacgacctgctgcttatcttcctgagcgatgaaaacgacaatcatcctctgtttaccaagtcaacatatcaggctgaagtcatggagaactccccagctggcaccccactgaccgttttgaacggcccaatcctggccctcgatgcagatcaggatatctacgcggtggtgacctaccagcttctaggtgctcagtccggcctattcgacataaattcaagtactggcgttgtaaccgtgcgatcaggcgtgattattgatcgcgaagccttctcgcctcctattcttgagctcctgctgctagctgaggatatagggctgctgaacagcacagctcatctacttattaccattctcgatgacaacgataaccggccgacctttagccctgccacacttaccgtccacctgctggagaattgcccaccagggttttcggtattacaggtcacagctacggacgaggactcgggccttaacggcgagctggtatataggatcgaagctggcgcacaggaccgttttctaattcatctggtgaccggagtcatcagggtaggtaatgccactatcgaccgtgaggagcaggagtcttaccgtcttactgtggtggcgacagatagaggaactgttccgctgtccggtactgctattgtcactattctaatcgacgacatcaacgacagcagacccgaattcctgaaccctattcagacagtgtcagtactagaatcggccgagcctggcacagttatcgcgaacatcactgccatcgaccatgatttaaaccccaaactcgagtatcacattgtgggtattgttgctaaagatgacactgaccgactcgtgcccaatcaggaagacgccttcgcagtgaacattaacaccgggagtgtgatggtgaagtcacctatgaaccgcgaacttgtcgcaacatatgaagtcacattgtcggtcattgacaacgccagcgatctcccagaaaggagcgtgagtgtgcctaacgccaaacttacggttaatgttctcgacgttaacgataatacaccacaatttaagccgtttggcatcacctattatatggaacgtatcctggaaggggctacacctggcactacactcatcgcggtggccgcagtggatcccgataaagggttgaacgggctcgtaacctacaccctcctggacttagtgcctccaggttacgtccagctggaggacagttctgcaggcaaagtaattgccaaccggaccgtagattacgaagaggtacactggctgaacttcactgtgagagcatcggacaatgggagcccaccccgcgccgcggagattccagtctatctggagatcgttgacattaacgataataaccctatattcgaccagccgtcctaccaggaggcagtgtttgaggacgttccggtggggactatcattctgactgtaaccgccacagatgcagacagtgggaattttgcgcttatcgagtatagcttaggcgatggggaaagcaagttcgctatcaaccccaccactggcgatatttacgtactgtccagcttagatcgcgaaaagaaagaccactacatacttactgcactcgccaaagataatcctggcgacgtggcatccaatagacgcgagaattcagtccaggtggtgatacaagttttagacgtgaacgactgccggccccagtttagcaaaccccaattctccaccagtgtgtacgagaacgagcccgcgggaacctccgtgattactatgatggccaccgatcaagatgaaggtcccaacggagagctaacttatagccttgaaggcccaggtgtagaggccttccacgtggacatggactctggactggtgaccacccagagaccgctgcagagctacgagaagtttagccttactgtcgtggccacggacgggggggagccccccttgtggggaaccaccatgctgttggttgaggtgattgatgtaaatgacaacaggcctgtatttgtgcgaccacctaacgggaccatcctgcatatccgtgaggaaatccccctgaggagcaatgtttacgaggtttacgctacggacaaagatgaaggacttaatggcgcagttcggtacagtttcttaaaaacagctggaaatagggattgggagttttttataatcgaccccattagcggtctgattcagaccgcccagcgacttgaccgtgaaagccaggcagtgtacagtctgatcctagtggcctcagatctgggccaacccgttccctacgagacaatgcaacctctgcaagtggcactggaggacatcgatgacaatgaacctctatttgtcagacctcctaaaggcagtccacagtatcagctgcttacggttccggagcactcgccaaggggcacccttgtcggtaacgttacaggtgccgtcgacgctgacgagggacctaacgcaattgtgtactacttcattgctgctggcaacgaggagaagaactttcacctgcagccggacggatgtctactcgtcctgagggatttggatcgagagagagaggccattttttccttcatagtcaaagccagcagtaacaggtcctggacccccccaagaggcccatctccaacactggatctagtggccgatctgactctgcaggaggttagggtggttctagaggacattaacgatcagcctccgcgctttacaaaggctgagtatactgccggagtggcaaccgacgcgaaggtggggagcgagctgatccaagtcctggcacttgatgcggatatcggtaacaattctttggtgttctatagtatactcgccattcactatttcagagctttggccaatgactctgaggacgtagggcaggtgttcactatgggaagcatggacggaatattacggactttcgatctgttcatggcttactcaccagggtattttgttgtggacattgtagcccgcgatcttgccggccataatgacactgcaatcattggcatttatatactgcgggatgaccaacgggtcaagattgttatcaatgagatcccagaccgggtgcgggggttcgaggaagaattcatccatcttctctcaaacataaccggggccatcgtcaacaccgataatgtgcaattccacgtagacaagaaaggacgggtgaactttgctcaaaccgagctgttgatccatgtggtaaacagggataccaacagaattctcgatgttgaccgggtcatccaaatgatcgacgaaaacaaagagcaactgaggaacctgtttagaaattataatgtgctcgatgttcaacccgccatatctgtgaggctacccgatgacatgagcgctctccagatggccattatcgtgcttgccatactgcttttcctggccgccatgctgtttgtcttaatgaattggtactacagaaccgtccacaagagaaaactgaaggctattgtggcagggagcgcgggcaatagagggtttattgatatcatggatatgcccaacaccaacaagtacagcttcgacggtgccaaccctgtgtggctcgaccccttctgtagaaaccttgaactcgcagctcaggctgagcacgaggatgacttgcccgaaaatttgtctgagatagcagacctctggaattcgcccaccagaacccacgggaccttcggccgagagccggctgccgtcaagcctgatgacgaccggtacctccgcgctgcaatccaagagtacgataatatagccaaactcggccagattattagagaaggtcccattaagggcagcttgctgaaggtcgttctcgaagattatttacgcctcaagaagttattcgcccaacgaatggtgcagaaggcctcctcttgtcacagctctatcagcgagcttattcaaactgaactggatgaagagccaggcgaccactcacctggacaggggtccttacgtttcagacacaaaccccccgtggaactaaagggccccgatgggatccacgtcgtgcacggctctacaggcacgctactggctacagacctgaattctttgcctgaggaggatcaaaagggactcggccggtcactcgagactctaacagccgctgaggcgacagcttttgaaaggaacgccaggacagaatcagccaaaagcacccccctgcataagctgcgggatgtgatcatggaaaccccactggaaatcactgaactgtag

SEQ ID NO: 29820 - DNA, 3144 bp, Artificial Sequence
  Description of Artificial Sequence: Synthetic coding sequence
atggaggagaaaacccagatcaaaacttttctggggagtaagctccctaaatatggaactaagtccgtccggtctaccctccagccaatgcctaatggaactcccgtgaacctgttaggaacctctaaaaactccaacgtgaaaagctatattaagaataatgggtctgattgccctagttcacactcatttaactggcggaaggctaataagtaccaactgtgtgcccaaggcgtggaagaacccaacaacactcagaattctcacgacaaaataattgatcctgagaaacgggtgcctacccagggtatgtttgataaaaacggtattaaagggggcctgaagtctgtctccctcttcacttcaaagttagccaaaccatctactatgtttgtgtctagcactgaggaactaaatcagaaatccttcagcggaccatctaacctcgggaaatttaccaaaggaaccctgttggggagaacttcctatagctctatcaatacccctaaaagtcagctcaacggcttctacggaaaccggtcagcgggcagcatgcagcggcctcgggcaaattcatgcgccactagaagttcctcaggtgaatccctggcgcagagtcctgatagctccaaatctatcaattgtgaaaagatggttaggtctcagtctttcagccattctattcagaattctttcctaccgcctagctccattacacgttctcacagttttaatcgcgcagtggatctgacaaagccatatcagaaccagcagctttctatccgtgtgcctctgagaagctccatgctgacacgtaactcaaggcaaccagaagttcttaacgggaacgagcatctaggatacggttttaacagaccttatgccgctggcggcaagaaattagctctaccaaacggccctggcgtcacgtcaacactcggttaccgcatggttcatccgagcctccttaagagctccagatcccctttcagtggaaccatgaccgtcgatggaaacaagaactccccagcagatacctgcgtggaagaggatgctaccgtccttgccaaagatcgggccgctaataaagatcaagagcttattgaaaatgagtcctacagaacaaagaataaccaaaccatgaaacacgatgctaagatgcggtaccttagtgacgacgtcgacgatatctcgcttagttctctttcatcttcagataagaatgatttatctgaggacttcagcgacgacttcattgacatagaggacagcaataggactcggatcactcccgaagagatgagcctcaaagaagaaaagcacgaaaatggacctccccaagacatgtttgactccccaaaagagaatgaaaaggcattcagtaagaccgatgagtggatagatattagtgtgagcgatcgtagcgagtgcaccaagcacacgtccggtaacaacctggtcagcccagacaccgactatagagcaggatctagcttcgaacttagcccatctgattcctccgacggcacctacatgtgggacgaggaaggactggagcccattggcaacgttcaccccgtgggttcttatgagagctctgagatgaattccattgacatacttaacaatctcgagtcctgtgatctcgaagatgacgatctgatgttggacgtggatttaccagaagatgcgccactcgagaacgtcgagtgtgacaacatgaatcgattcgaccgcccagacaggaacgtgaggcagccccaggaaggattttggaaaaggccaccacagcgttggtccggtcaggagcattaccacctgagccatccggaccattatcatcaccatggcaaatccgacctatcaaggggatccccttaccgggaaagtccactaggccactttgagagttatggggggatgccgttctttcaggctcagaaaatgtttgtggacgtgccagagaacaccgtgattctggacgagatgactttgcggcacatggtgcaggattgtacagctgttaaaacccagcttttgaagcttaagagacttctgcaccagcacgacggtagtggtagcttacacgacattcagcttagcctcccttcatcaccagaacctgaggatggagataaggtctataaaaatgaagacctcctcaacgaaataaagcagctgaaggatgagattaaaaaaaaggacgaaaagattcagctactggagctgcagctcgccacccagcacatttgtcatcagaaatgtaaggaagagaaatgcacatatgccgataaatatactcagaccccctggagacgcattccgccccaggtgcttcaaccaagctctagcctgcccagaccaacagaccacactcagggtaagctcatcaaaccccagcggattgaggccagaagcgagtgttctattcaggacatgcaccagggaggggcacaccctgaagagagttttacacatgtcttacatcaggaatcaaactacggcctcgaagagcagcccttttcttccggtccccagctcaccatggatgtggctaaatctactccgagcgaggctaatctgaacatcaccgtgaatgctcaggaaccctatcatcttgccaacaatcagattagcgacatgcagtttatcccaacctccttacaaaccccccctgaaagtagcacagtcgatcaggctaaaagggtgggaaggaatcagagcccaccagtgggctacatgagccagcctaagtccctgcaactgttaaagccgtcgatactttctagtttagttcctccgcccgttagcgagtcaagtccttcgcggactccgacatgtaaaaagagtccgatcatcactacctgcaacagtgctaaactccagcctacttctagtcagactaatcttgccaacaatcagaacctgaaggcgtctaagctcagaccgcccagcgggtctttcaagcaaaagcaaaccaactctccccaattggaaccccagtcatttcaggcaaagaccagtattcccagacccctcacgcagaggaaagagattatgcagaacccgaacgggaacttgcatagcggcgactgtctcgcaagtaaccgttatagccggctccctaaacctaagattcactag

SEQ ID NO: 29821 - DNA, 786 bp, Artificial Sequence
  Description of Artificial Sequence: Synthetic coding sequence
atgaacagatttgacaggcccgatcgaaatgtgcggcagccccaggaggggttctggaagcgtcctccccagagatggagcgggcaggaacactaccacctctcccatcccgatcactatcaccaccacggtaaatcagacctctccaggggctctccctaccgagagtcacccttaggtcatttcgagagctacggggggatgccattttttcaagcccaaaaaatgttcgtggatgtgcctgagaatactgttattttggatgagatgacattgcgtcacatggtgcaggattgcactgccgttaagacacagttgctcaaactcaagagacttcttcaccagcacgacggtagcggctcgctgcacgacatacagctgtccttgccctcaagccccgagcctgaagacggtgacaaggtgtataagaacgaggatttactgaacgagattaagcaactcaaggacgagatcaagaagaaggatgaaaagatccagctcctggaactgcagctcgctacccagcacatatgccaccagaagtgcaaagaagagaaatgtacgtacgccgacaagtatacacaaaccccatggcgaagaattcctggcggttattctgcaccctccttttcaccatggcaggggtcattccagggaatccctcgcaccgttcctccccatagacgacagacatcctccacgacagcatttcaacagccaagccagacccatagaagtcaccccggtaagacaaacaaagccactacttatagaggccctcagtag

SEQ ID NO: 29822 - DNA, 3741 bp, Artificial Sequence
  Description of Artificial Sequence: Synthetic coding sequence
atgaaggtgcggcttttaaggcagttgagtgcagcagcgaaagtgaaggcgccaagcggtttgcagggacctccccaggcccaccagtttatttccctgctgttggaggagtacggagctctgtgccaggcagcccgctctatctcgaccttcttagggaccctggagaacgaacatcttaaaaaatttcaggtgacctgggaactgcacaataaacatctttttgaaaacctggtgttcagcgaaccattgttgcagtccaatttgcctgctctagtctcccagatacgtctgggtactacaacgcacgacacctgctccgaagatacatacagcacacttctgcagagatatcagagatcagaagaggagctccggcgagtagccgaggaatggctagagtgccagaaacgcatagacgcgtacgttgatgaacaggacctgcagacgtctgtaaataaaagcattgacactgggacactggtccagagttggctgcggggcgcagccatgaccatgaagaccaaacaacgcatgcttacagaagactgggaactctttaagcaacggcgctttatcgaggaacagctgactaataaaaaggctgtgaccggggagaataacttcacggacaccatgaggcacatgttgtcttctaggctctctatgcctgactgtccgaattgcaattatcgacggcgctgtgcttgcgacgactgctctctgagccacatcctgacctgcggtatcatggacccccctgttacagacgatattcatattcatcagctgcctctccaggtggatcctgccccagactatttggccgaaagatctcctccttccgtcagcagcgcctccagcggctccggaagttccagtccaatcactattcaacagcacccccgtctgatactcaccgatagcggaagtgccccaactttcgatgatgaggacgtggcacctcttagcgccaaattcgcagatatttacccgttaagtaattatgatgacaccgaggttgtcgccaacatgaatgggatccattcagagctcaacggcggcggcgagaatatggcccttaaggatgagtcaccccaaatttcgagtacatcatctagctcgagtgaagccgatgatgaggaggctgacggagaaagttctggcgaaccgcctggggcgcccaaggaagatggggtcttaggatcgcgcagtccccgcaccgaagagtccaaggccgactctcccccaccctcatatcctacccagcaggctgagcaagcaccaaacacctgtgaatgccacgtgtgcaaacaggaggcgtccggcctaaccccttccgcaatgaccgcaggggcactgcccccaggacaccagttcttgagcccagagaagccaacgcatcctgcactgcacctgtacccacacatccacgggcacgtaccgctccacacggtcccccatcttcctcgcccactcattcatcccacattatatgcaactccaccctttacgcactccaaagcactgcctccagcaccagtgcagaaccatacgaataaacatcaggtgttcaacgcgtctcttcaggatcacatctacccatcatgcttcgggaacactcccgaatggaattcctcaaaattcattagtctctggggaagcgaggtgatgaacgacaaaaattggaatcctggcacctttctgccagacacaatctctggaagcgaaatcctgggaccaaccttaagcgaaaccagacccgaggcactgccccccccgagcagtaacgagacccccgcggtgagcgattctaaggaaaagaaaaatgcagccaagaagaaatgtctctataacttccaagatgcgttcatggaagccaataaagtggtaatggccaccagctccgcgacaagctcggtaagctgcacagccacaacagtgcagtccagtaacagccagttccgcgtctcctccaagaggcccccctccgtcggagacgtattccacggcatttcaaaggaggatcacagacattctgctcccgccgctccccgtaactctcctacagggctcgcgcctctccccgcgctatcacccgcggcgctgtcccctgccgcattatcacccgcctcaactcctcacctcgctaatctggccgctccgagcttccctaaaacagccactactacgcctggtttcgtggacacacgaaaatcgttttgtccggctcctctgccgcccgctacagacgggagcattagcgcacctccctccgtatgctccgaccccgactgcgagggccatcgatgtgagaatggcgtgtacgaccctcagcaggatgacggagacgagagtgcagatgaggactcctgttctgagcattctagctccacatctaccagcaccaatcaaaaggaaggtaagtactgcgactgctgctattgcgagttttttggccatggcggtcctcctgcagctccaactagcaggaactatgcagaaatgagagaaaaacttaggctcaggctcacaaagcgaaaggaagaacagccgaagaagatggatcagatatctgagcgagagagtgtcgtggatcacagacgtgttgaagacctccttcagtttattaatagtagtgaaactaaaccagtgtcctctaccagggcggctaaacgcgccaggcataaacaacggaaactggaggaaaaagcaaggctagaagcagaggcaagggccagggaacatctgcacctgcaggaagagcagaggaggagggaggaggaggaggatgaggaggaggaggaggaccgctttaaggaagagttccagaggcttcaggagctgcagaagttgcgggccgtcaagaaaaagaagaaggaaaggccttcaaaagattgccctaagctggacatgcttacccggaacttccaggcggccacggagagcgtacctaattcaggtaatattcacaacggttcgttagagcagacagaggaaccagaaacatccagccactctccctcacgacacatgaaccattcggagcctcgcccagggctgggcgccgacggcgatgctgccgatccagtagacacaagggacagcaagttcctccttccgaaggaagtgaatggaaagcagcacgaacctctgagtttcttcttcgatatcatgcagcaccataaggagggtaacgggaagcaaaagctaaggcagacatccaaagcgtcctctgagcctgctcgtaggcccactgagcctcccaaagctacagaggggcagtccaagccacgggctcagaccgagtctaaagccaaggttgtggatctgatgagtattacagagcagaagagggaagaaagaaaagtcaacagcaacaacaacaacaaaaagcaattgaatcacattaaagacgaaaaatccaaccctacacccatggaacctacatcacctggggagcaccagcagaattccaagctggtcctggccgagagcccacagcctaagggcaagaacaagaaaaacaagaagaagaaaggggatcgcgtgaataattccatcgacgacgtgtttctgcccaaagatattgaccttgactccgttgacatggacgaaacagagcgggaagtagaatacttcaagcgattttgtctggattcagccagacagacccggcaacggctcagcatcaattggagtaacttcagcctcaagaaggctaccttcgctgcacattag

SEQ ID NO: 29823 - DNA, 3636 bp, Artificial Sequence
  Description of Artificial Sequence: Synthetic coding sequence
atgaaggttcgtctgctcaggcagctgtccgcagctgctaaggtgaaagccccttcaggcctgcagggccccccccaggcccaccaatttatctcgctcctcttggaagagtacggagccctgtgtcaagcggcgcgctccatatccacatttctgggcacactcgaaaacgaacacctgaagaaatttcaagtgacctgggaactgcataataaacaccttttcgagaacctggtgttcagtgagccattgctccagagtaacttaccggctttggtttctcagatcaggctcggcaccaccacccacgatacctgtagtgaggacacctattctactctcctgcagcggtaccagcggtcagaggaggaactccgtagagtcgccgaggaatggcttgaatgtcagaagcggatcgacgcctacgtagacgagcagatgaccatgaagacgaaacagcggatgctcacggaagactgggagctcttcaagcagcgtcgctttattgaagaacaactcacaaacaagaaggcagtgacaggggagaataatttcacagacactatgcggcacatgctttctagtcggctgagcatgccagactgccccaactgtaattaccggcgccggtgcgcctgtgacgattgcagtttgagtcacattttgacttgtgggattatggacccacccgtgaccgatgacattcacatacaccagcttccactgcaggtggatccagccccagattacctcgctgagcgctctccgccatctgtcagctccgccagcagcggctctggcagtagttctcccattacaattcagcagcacccaaggttaatcctgaccgatagcggatcagctcccacattctgtagcgatgatgaggacgtggcccccctgagcgctaagtttgccgatatttatccgttgtcaaactacgatgataccgaggttgtggccaatatgaacggaatccactccgagttgaatggcgggggtgagaacatggctctgaaggacgagtccccccagatctcctccacgagtagcagctcctccgaggcggatgatgaagaagcagatggcgagtcttcaggcgagcctccaggagcgcctaaggaagatggtgtgctggggtccagatctccaagaacagaggagagtaaagccgatagcccccccccttcatatcctactcagcaggcagagcaagcacctaacacttgtgagtgccacgtgtgcaagcaggaagcttctggcttaaccccgagcgccatgaccgctggggcgttaccccccggccaccagtttctcagccctgagaagcctacacaccctgcgttgcatttatatcctcacattcatggacatgttcctctccacactgttccccacttgccacgaccactgattcatcccacattgtacgcaactccgcctttcacccactcaaaggccctcccccccgcccctgtgcaaaatcacaccaacaagcaccaggtatttaacgcgagcttacaggatcacatttacccgtcatgcttcgggaacacccccgagtggaatagtagcaaatttattagcctgtggggcagtgaggttatgaacgacaagaattggaaccccggtaccttcctccctgatacaatatctgggtcagagatcctgggccccaccctcagtgagaccaggccagaagcacttccacccccatctagcaacgaaaccccagctgtaagcgatagtaaggagaagaaaaacgcggcgaaaaagaaatgcctgtataattttcaggacgcatttatggaggctaacaaggtcgtaatggccacttcaagtgcaactagctctgtgtcctgtactgctaccaccgtgcaatcatcaaattctcagtttcgggtgagttcaaaacgcccgcctagcgtaggagacgtgttccatgggatctctaaggaggatcatcgacacagcgctccagcagccccccggaattcccctaccgggttggcccctctccccgcactctctccagctgccttatcacccgccgctttgagtccagcttctacacctcatctcgcaaatctggccgcacccagtttccctaagacggccactacgacacccggctttgtggatactagaaaaagcttttgtccggcgccactgcccccagctactgatggctcaatcagcgctcccccttctgtttgcagcgaccccgattgcgagggacaccgctgtgagaacggcgtctacgaccctcagcaggatgacggcgacgaaagtgcggatgaggattcgtgttctgaacattcaagctctacctccaccagtactaaccaaaaagagggtaagtactgtgactgttgctattgtgagttcttcggccacggaggcccacctgcggcaccaacctctcggaactacgccgagatgagggagaagctgaggctgagactgactaaacggaaggaggagcagcctaagaagatggaccagatcagtgaacgcgagagcgtagttgaccatagaagggtggaggatctgttgcagttcattaactcttcagaaacaaagcccgtctcatccacaagagcagccaaaagagccagacataaacagcgcaagctagaggaaaaggcgaggctcgaggccgaggcgagggcccgcgagcacctgcatctacaggaggaacaacgcaggcgagaagaagaggaggacgaagaggaagaggaagataggttcaaggaagagttccagcgcttacaggaattgcagaagctgcgcgctgtgaagaagaagaagaaggagagaccttctaaagattgccctaagctcgatatgcttacaagaaacttccaggccgccacggaaagcgtgccaaattctggaaatatccataatggatcgctcgagcagacagaggagcccgagaccagctctcatagcccaagccggcatatgaatcacagcgaacccagaccaggcctgggcgcagacggcgacgcagctgatcccgttgatacccgtgattcgaagtttctgcttcctaaggaagtgaatggaaagcagcacgagccgttgtcgttcttctttgacattatgcagcaccataaggagggaaatggcaagcagaaactgagacagacatccaaagccagtagtgaacctgcacgacggcctactgaacctcctaaggctactgaggggcagtccaaaccccgtgctcagacggaatccaaggcaaaggtggtggatctgatgtccatcactgaacagaaacgcgaggaacgaaaggtgaactctaataacaacaacaagaagcagctgaaccatatcaaagacgaaaaatcaaaccccaccccaatggagccaacgtcccctggagagcaccagcagaattctaaattggttctcgctgagtctcctcaaccaaagggtaaaaataaaaagaataagaagaagaagggggacagagtaaataactccatcgacgatgtgttcttgcccaaggacattgacctggacagtgtggacatggacgaaactgagagagaggtggaatatttcaaacgagacggcgtgagcccccactgcccagggtggtcgagaactcccggcctaaagtag

SEQ ID NO: 29824 - DNA, 2469 bp, Artificial Sequence
  Description of Artificial Sequence: Synthetic coding sequence
atgacccgccgtcgctcacgcccttccggaggagctggtagacgcgagagagcccgcgccgcaggaccccagaaaccacaagccccggagcccccccctcctcctagtttggaggcgggcgccggtgccggtccaccggaagcccccgccgaacctgaccatgatgggccaagagaggatgatgaacccaacttggtgccgggcccacaggtgccacctgccagcagtcagccggtgcagacctgctgcctgctgtgccatagagagaggaaaggctgggaggaggggccatcccagaacgggttagtcctgcagggtgagaaattgcctccggactttatgcccaagctggtgaagaacctgctcggggagatgccactctgggtgtgtcagtcctgccgaaagtcaatggaggaggacgagagacagacaggcagggaacacgctgtggccatctctctaagccatactagctgtaaaagccagtcctgcggagatgacagccactcttcctcgagctcctctagctcctccagcagtagtagtagcagcagctgtccaggcaatagcggcgattgggatcctagctcattcctgagtgctcataaactgagcggactatggaatagccctcactcgtcaggggctatgcccggcagctctctggggagccccccgaccatcccaggcgaggcatttccggtgtcggagcatcaccagcacagcgatctgacagcacctcctaactcgcctactggccatcaccctcagccggcttccctcatcccatcccatcctagttcatttggctcccctccgcatccgcacttgctgccaaccacacccgctgcaccatttccagctcaggcatccgagtgtcccgtggccgccgctacagctcctcatactccagggccatgccagagttctcacctcccatctacttctatgccactgcttaagatgccacctcctttctccggctgttcacatccatgtagtggtcactgcggcgggcattgctccggtccactgctccctccaccctctagccaacccttaccttctacccatcgggaccctggctgtaagggacacaagtttgcacattccggcctggcctgccagctccctcagccgtgcgaggcagatgagggcctcggagaggaggaggattcatcctcagaaaggagctcttgcaccagttcttctactcaccagcgtgacggaaaattttgtgactgctgttattgtgagttctttggccacaacgctgagaaggagaaagcccagctggcagctgaagccctgaaacaagccaaccgcgtctccggttcccgggagcctcggcccgctcgagaacgcctgctcgagtggccagaccgcgaattggacagagtgaactccttcctatcctcacgcttgcaggaaatcaagaacactgtcaaagattctatcagagcctcattctcagtttgcgaacttagcatggacagtaacggattcagcaaggaaggggctgccgagccggaaccccaatctctgccacccagtaacctctcaggcagtagcgagcagcagcccgatatcaatctcgacctgagtcctctgaccctcggatctccacagaatcatactctgcaagctccaggtgaacctgcccctccatgggcagaaatgagggggccacaccctccttggactgaggtccgcggtcctcctccaggtatcgtccccgaaaacgggctggtaaggcgactgaatactgtcccaaacctgtctcgggttatatgggtcaagactcctaaaccaggttaccccagctccgaggaaccaagctctaaagaagttccatcctgtaagcaagaattgcctgaacccgtgtcatcagggggcaaaccccagaaaggcaaacggcagggatcccaggccaagaaatctgaagcctctcccgcacctaggccgccggcctcgctggaagttccttctgccaaggggcaggtcgctgggccaaagcagccgggtagggtactcgagctgcccaaggttggcagctgtgctgaggcaggagaagggtcacgcggaagtaggccaggtccgggatgggccgggtcccccaagacggagaaggagaagggcagttcctggcgtaattggcctggggaagcgaaagctaggcctcaagagcaggagtcggttcagccatctggacctgcgagacctcagtccttgcctcagggcaaaggtcggtccaggcggtcgcgaaataaacaagaaaagcccgctagctccttagatgatgtgtttctcccaaaggacatggatggagtggaaatggatgagaccgatagggaggttgaatattttaagagattctgcctcgattctgccaaacaaaccaggcagaaggtggcagtaaactggactaatttttccctaaagaaaaccacgccttctacagctcagtag

SEQ ID NO: 29825 - DNA, 3798 bp, Artificial Sequence
  Description of Artificial Sequence: Synthetic coding sequence
atgaaagtccggcttcttcgtcaactgagcgccgcggcgaaggtgaaagcacctagtggactccaagggccacctcaggcccaccaattcataagcctactcttggaggaatacggagctctgtgccaggccgctcgaagtatcagtacttttttgggaactctcgagaacgaacacttgaagaaatttcaggtgacctgggaactccacaacaagcatctgtttgagaatctggttttctcagagccccttctccagtcaaatttgcctgcactcgtttcccagatcagattgggaacaactacgcacgatacgtgctctgaagacacgtactccactctgctgcagcgatatcagagatctgaggaagaattgcggagagttgcggaagagtggcttgagtgccagaaacggattgacgcttacgttgacgagcagatgaccatgaagactaaacagcgcatgctgactgaggattgggagttattcaagcagaggaggttcattgaggaacagctcacgaacaaaaaggcagtgacaggcgagaataatttcaccgacaccatgcggcacatgctgagcagtagactctcaatgccagactgccccaattgtaactacaggagacggtgtgcgtgcgatgactgctccctcagtcacatactgacttgcggcataatggatccccccgttaccgatgacatccacattcaccagcttcctctgcaagtggatccggcacccgattacctggctgaaaggtctcccccgtccgtgtcctctgcgtcttccgggtccgggtcgtcttctccaataacgattcagcagcatcccaggctgatcttaacagactccgggtcggcccccactttctgcagcgacgatgaggacgtcgccccactgtccgccaagtttgccgacatctacccactgtcgaactacgatgacaccgaggtggtagcaaatatgaacgggatccactccgaactcaacggtggaggagagaatatggcactgaaggatgaatcacctcaaattagcagcacttcgagctcctcttccgaggccgatgatgaagaagccgatggagaatcttccggagagcccccaggggccccaaaggaggacggggtcttaggatcacgatccccccggactgaggagagtaaagccgattctccacccccatcgtatcccacccagcaggccgagcaggctcctaatacatgtgagtgccacgtctgtaaacaagaggctagtggactgaccccttctgcgatgaccgccggcgccttaccacccggccaccagtttctatcacccgagaaaccaactcaccccgccttgcacctgtacccacacatccacgggcatgttcccctccacacagtcccacacctgccccggccactcatccatccaaccctgtatgctacgccgcccttcacgcactccaaggcacttcccccagccccggttcaaaaccacaccaataaacaccaggttttcaatgcttctctccaggatcatatctatccgtcctgcttcggtaacacccccgagtggaactcatcaaaattcatcagcctatggggctctgaggtgatgaacgacaagaattggaacccagggacgttcttgcccgacactatttccggcagtgagattctggggccgacactgtctgagacacggcctgaagccctccccccaccaagctccaatgagaccccggcagtgtcagattcaaaagagaaaaagaacgcagctaaaaagaagtgcctgtataatttccaagacgcattcatggaagctaataaggttgtaatggccacatcgagtgccacttcatccgttagctgcaccgcaactacagtgcagagtagtaactcccaatttagggtgtcatcaaagcgtccaccaagtgtgggtgatgtgttccacggaatcagtaaggaagaccaccgacactccgctcctgcggcaccaagaaattctcccaccggactagcacctttgccagccctgagcccggctgctctctcaccagccgccctcagcccggccagcaccccacatctagcgaacttggccgcaccgtcatttcccaaaacagccacaacaaccccagggttcgtggatactcgaaagtcattttgtcctgctccactcccacctgccacagatggtagcatcagcgcccctccatctgtatgctcagaccccgattgcgagggtcacaggtgtgaaaacggagtgtacgatccacaacaagatgatggggatgagagtgccgatgaagatagttgttcagagcactcctcttcaacatccacttcgactaaccagaaagagggcaagtactgcgactgctgttattgtgagttttttgggcacgggggacctcccgccgcgcctacctcacggaactacgccgagatgagagagaagctgcgcctgcggctgactaaacgtaaagaggagcagccaaagaagatggaccagatctccgaacgtgagagcgtagtagatcatcgaagggtcgaggatttgctacaatttataaactcatctgaaactaagcccgtcagcagcactagggccgcaaagcgggcaagacataagcagcgcaaattagaggagaaggcaagactggaagcagaagcacgggcacgggagcatctgcacttacaagaagagcagagacggagagaagaagaggaagatgaggaggaagaggaagatcggttcaaagaggaatttcagcgtttgcaggaactgcaaaaactgcgcgctgtaaagaagaaaaagaaagaacggccgagtaaggattgccccaaactcgacatgctgacgcgcaattttcaggctgccaccgaatcagtccctaatagtgggaacattcacaatgggtctttagagcagaccgaagagcctgaaacaagctcacactcaccgagccggcatatgaaccactccgagcctcggcctgggttaggagcagacggtgacgccgctgatcccgtcgataccagagatagcaagtttttactgccaaaggaggtgaacggaaaacagcacgagccactgtccttcttcttcgatatcatgcaacatcataaagaggggaatggtaaacagaagctgcggcagacatcaaaggcctcgtcagagcccgccaggcgcccaaccgagcccccaaaagctaccgaggggcagtctaagccacgggcccagacggagtccaaagccaaagtcgtggacctgatgagtataacagaacagaagagggaggagcgcaaagtcaactcaaacaataataataagaagcaattgaaccacataaaagacgaaaaatcaaatccaactccaatggagcccacatctcccggcgagcaccaacaaaacagcaaactggttcttgcagaaagtccccagccaaagggtaaaaacaaaaaaaacaagaaaaaaaaaggggacagagtcaacaacagtattgatggtgtcagtttgctactgccctctctggggtacaatggcgcgattctagcccactgcaatttgcgcctcccagggtcatcagattgtgccgcttcagccagtcaggtggtgggaatcacagatgatgtcttcctgcccaaagacatcgacttagactccgtggatatggatgagaccgaaagagaagtcgagtattttaaacgattttgccttgactcagcccgccagacgaggcaaaggctttcgattaactggagcaacttcagcctcaagaaggcgacttttgccgcccactag

SEQ ID NO: 29826 - DNA, 3675 bp, Artificial Sequence
  Description of Artificial Sequence: Synthetic coding sequence
atgaaagtacgcttacttcgtcagctgtcagcagccgccaaagtcaaggctccaagcggactgcaaggtcccccccaggcgcatcagttcatcagcttgctgctcgaagaatacggtgctttgtgccaagctgcgagatccatctccaccttccttggtacgctggaaaacgaacacctcaaaaaattccaggttacctgggaactccacaacaagcaccttttcgaaaatcttgtgtttagcgaacctttactgcagtctaaccttcccgcccttgtgagccagatacggcttgggactacaactcacgatacctgcagcgaggatacttactccacccttctgcaaaggtaccagagatcggaggaagagctgcggagggtagccgaggaatggctagagtgccaaaaaagaattgacgcctacgtcgacgagcagatgactatgaaaactaagcagagaatgctcactgaagattgggaactctttaagcagaggaggttcatagaggagcagctcacaaacaaaaaagctgttacaggtgaaaacaattttacagacacaatgagacatatgctttccagtcgtttgagtatgccggactgtccaaactgcaattatcgacgtcggtgcgcctgtgacgattgcagcctttcccatatcttaacttgtggcataatggatcctccagtcaccgacgacatccatatacaccagctgcccttacaagtggacccagcgcctgattatttagccgaaaggtcacctccgtcagtaagttcggcttcttctggcagtggtagttcatcccctataacaatccagcagcaccctcggctgatcctgaccgattcgggtagtgctccaactttctgctccgacgatgaggacgtcgcgcctctctctgcaaagttcgctgatatctacccgctaagcaactatgatgacaccgaagttgtggcaaacatgaacggtatacactctgaactcaatgggggaggagagaacatggcactgaaggatgagtctccacagatctcctcaacaagctcctcctcatctgaggctgacgatgaggaagccgatggagaatcttctggcgagccaccaggcgcaccgaaagaggacggcgtgctcggttcaaggtcgccacggaccgaggagtctaaagctgactccccaccaccatcttaccctacccagcaggcggagcaagccccgaacacttgtgagtgtcacgtgtgcaaacaggaggctagcggcctcacaccatcggcaatgaccgcaggagcacttccgccagggcatcagtttctgtccccagagaagcccacacatcctgccctacacctgtatccccacatacatggacacgtacctctccacacagtgcctcacctgcctcgtccactcattcatccgacactgtacgccacccctccattcactcactctaaggctctgcctcctgccccggtccagaaccacactaataaacatcaagtgttcaacgccagtctccaagaccacatctatccatcctgctttggtaacacacctgagtggaattctagcaagttcatctcactttgggggtcagaagtgatgaacgataagaattggaacccaggcacatttctgcccgatacaatcagtggctctgaaatccttggtcccacacttagtgaaacacgtcctgaagccctacccccaccatcctcaaatgagacccccgctgtgagcgacagtaaagaaaaaaagaacgccgccaagaaaaaatgcctctataactttcaagatgcattcatggaggccaataaggtggtgatggcgacaagctcagcaacaagcagtgtgtcttgtactgccacaactgttcaatcctcgaatagtcagtttcgcgtgtcgtctaagcgaccacccagcgtcggcgatgtattccacggaatttccaaggaggatcataggcactccgctccggccgcaccacgcaattctccaaccggactcgccccactgccagcccttagcccagctgccctgtctccagccgcactgtcccccgcttcaaccccacatctagcgaatcttgcagccccgagctttccgaagaccgcaaccacaacccctgggttcgtggatacccgcaagagtttctgccccgctccactccctcccgcgaccgacggctctatctcagcccccccctccgtgtgctcagatcctgattgcgaggggcatcggtgtgagaacggcgtgtacgaccctcagcaggacgacggtgacgaaagcgccgacgaggactcatgtagtgagcactcttcctcgacttcaacgagcactaatcagaaggagggcaaatactgtgactgctgctattgcgaattcttcggccacggtggccctcccgcagcccctacctcacgcaactacgctgagatgcgggaaaagctaagactcagactgactaaacgaaaggaggaacaaccaaagaagatggaccaaatttccgagcgggaatctgtggtcgatcaccgacgagtggaggacttgctccagtttatcaattcttccgaaaccaagccagtgtcttctactagagcggccaagcgagctaggcacaaacagcgaaaattagaagagaaggcacgactggaagcagaggcacgagcccgggagcacctgcacctacaagaagaacagcgccgcagggaagaagaggaagatgaggaggaggaggaggatcgttttaaagaagagtttcaaagactccaggagctgcagaagcttagagctgtgaaaaaaaaaaagaaggagcgcccctctaaagattgccccaagttagatatgcttacgcggaactttcaggctgccacagaaagcgtgcccaactccggtaatatccacaacggatctctggaacagacggaggagcccgaaacctcctctcattctccaagcaggcacatgaaccattcagagcctagacctggcttaggcgccgacggcgacgccgcggatcccgtggacacgcgcgactccaagttcctgttgccaaaagaggtaaatggaaaacagcacgaacccctcagtttcttcttcgacattatgcagcatcacaaggaggggaacgggaagcagaagctcagacaaacgtctaaagcgagcagtgagcctgcccgacgcccaacagaacctcctaaagcaaccgagggtcagtctaagcccagggcgcagaccgaaagcaaggccaaagtggtggatctaatgtccatcaccgagcagaaacgggaggaacgtaaagtcaattctaataacaacaataagaagcagctaaaccacatcaaagacgagaagagcaatcccactcctatggaaccaacgtcacctggtgagcaccagcagaatagtaaattggtgcttgccgagtcccctcaacctaaaggtaaaaacaaaaaaaacaagaagaaaaaaggagatcgcgtcaacaactctattgatgatgtgttcctgccaaaagatatagatctcgactcagtcgacatggacgaaactgaacgggaggttgaatatttcaaacgcttctgcctggactctgccagacagactagacagcgccttagtataaactggtctaactttagtctcaaaaaagctacgtttgccgcacactag

SEQ ID NO: 29827 - DNA, 132 bp, Artificial Sequence
  Description of Artificial Sequence: Synthetic coding sequence
atgaaggtcagactgctgaggcagctaagcgctgcagccaaggtgaaggccccatctggcctgcagggcccaccacaagctcatcagttcatctctctgctccttgaggagtacggagctctgtgccagtag

SEQ ID NO: 29828 - DNA, 3021 bp, Artificial Sequence
  Description of Artificial Sequence: Synthetic coding sequence
atgacaatgaagaccaagcagagaatgctgactgaggattgggaactgttcaagcagcgccggtttatcgaggaacaacttacaaacaagaaggcagtgacgggagaaaataactttacagacactatgcggcacatgctgagctctcgtctttccatgcctgattgtcccaactgcaactaccgcaggaggtgtgcgtgtgacgactgtagcctgtctcatattctcacctgcggcattatggacccacctgtcactgacgacatccacatccaccagctgccccttcaggttgatccagcacccgactatttggctgagagatcaccaccgtcagtgtcctctgctagctctgggtctggatcatcgagccccatcactatccagcagcaccccagattaattttaaccgattccggctctgcacctacattttgtagcgatgacgaggatgtggccccactgtctgctaagttcgcggatatctaccctctctctaattatgacgacactgaagtggtcgctaatatgaatggtatccatagcgaattgaatgggggcggagagaatatggccctgaaagacgagtcacctcagattagctcgacatctagttcatcctccgaagcggatgatgaagaggccgacggcgagtcttcaggagagcctcctggtgcgccaaaggaagacggagtcttgggctccagatcacccaggaccgaagagtccaaagctgattctccaccaccttcgtacccaacacagcaggcagaacaggcccccaacacttgtgagtgccatgtatgtaagcaagaggcttcgggtttaaccccctcggccatgacagccggtgccctgccgcctggacaccagtttctttcacctgagaagcctacccatcccgcgttacacctgtacccacatattcacggacacgtccctctccacaccgtcccacatctgccaagacccttgatccaccctacactttatgccacaccccccttcacacattctaaggctctgccacccgccccagtgcagaaccatacaaacaagcaccaggtgttcaacgccagcctccaggaccatatttacccctcttgcttcggcaacacacccgagtggaactcctctaaattcatctccctctggggaagtgaagtgatgaacgataaaaactggaatcctggcacattcctcccagatacaatttcaggatctgaaattctggggccaacactttccgagaccagacccgaggccctgcccccgcccagctctaatgagacgccagcggttagcgactctaaagagaaaaagaacgccgcgaaaaagaagtgtctgtacaactttcaggatgcctttatggaggccaataaagtagtgatggcaacgagctccgcgaccagtagcgtctcctgcaccgccactactgtgcaatcctctaattctcagttcagagtctcatccaagcgacctccttcagtgggcgatgtcttccatggaattagcaaggaagaccaccgccactccgcacctgcagctcctcggaactccccgacaggactggctccccttcctgctctgagcccggcagccctttcccccgccgctctgagtccagctagtacacctcatttggccaatctagctgcccccagctttccaaagactgcaactaccactcctggcttcgttgataccagaaagtctttttgtcctgcccctctcccccccgccaccgacggcagtatatctgcaccaccaagcgtttgtagcgatcccgattgtgagggccaccgatgcgagaatggagtgtacgacccccagcaggatgatggggacgaatctgcggatgaggactcctgcagtgaacattccagctccacatccaccagcaccaatcagaaggaaggaaagtactgtgattgctgctattgcgaattctttgggcacgggggcccacccgccgctcctaccagcagaaattacgctgagatgagagagaagctgaggttgagactcacgaaaaggaaagaagagcaaccgaagaagatggaccagattagcgagagggaatctgttgtagaccaccgtagagtggaggatttattgcagtttattaactcaagcgagactaagccagtttcttcaaccagggccgctaagagggctaggcacaagcagcgcaagttggaggagaaggcccggttagaggctgaagccagagctcgagagcacctgcatcttcaagaagaacagaggcgccgagaggaggaggaggacgaagaagaggaggaggatcggttcaaggaggagtttcagaggctacaggaactccagaagctgcgggccgtcaaaaaaaagaagaaggagagaccctccaaggattgtcctaagttggacatgttaaccagaaatttccaagccgctacagagagcgtacccaattctgggaacattcacaacggtagccttgaacagaccgaagagccagaaacttccagccattctccatccaggcacatgaatcactcagagccccgtcctggccttggcgcagatggagacgccgctgatccagtcgatactcgcgactcaaagttccttttgccaaaagaggttaatggcaagcagcacgaacctctctcgttctttttcgacatcatgcagcaccataaggagggtaacggcaagcaaaagcttcgacagacctcaaaagcatcctcggaacctgctaggcggccaaccgagcctcctaaagctaccgagggccagtcaaaaccacgcgcacagaccgaatctaaggccaaagtggtcgatctcatgtcaatcactgagcagaagagagaagagcgaaaagtaaattctaacaacaacaataagaagcagctaaatcatattaaggatgagaaatcaaatcctaccccgatggaaccaacttcaccgggtgaacatcagcagaacagcaagctggtgcttgccgaatcgccccagcctaaaggcaaaaacaaatag

SEQ ID NO: 29829 - DNA, 3636 bp, Artificial Sequence
  Description of Artificial Sequence: Synthetic coding sequence
atgaaggtgcgactgctccgtcagttatcagcggctgccaaggtgaaggccccctctggacttcagggcccaccccaggcgcatcagttcatctctctgttgcttgaggaatatggcgctctgtgccaggccgcccgctcaattagtacgtttctgggtactctggaaaacgaacatttgaagaagtttcaggtgacctgggagctgcacaataaacatctcttcgaaaaccttgtcttctccgaacctctgcttcagagcaacttgccagccttggtctcacagattcggctgggtaccacaacacatgatacctgctctgaagatacttactcaacattactccagaggtatcagagatcagaagaagagctcagaagggttgctgaagagtggcttgagtgtcagaagaggatagatgcatatgtggacgagcagatgactatgaaaaccaagcagaggatgctgacggaggattgggaactctttaagcaacgtaggtttattgaggagcagctgaccaataagaaggccgtgaccggtgagaataacttcacagacactatgcgtcacatgttatccagtcgactatcaatgcctgattgccctaattgtaactacagaagaaggtgcgcctgcgacgattgctctcttagccatatattaacatgcggtatcatggatccaccggtcactgacgacattcacattcatcaattgccactacaggtggatcctgcccccgattatctagcggagagatcccccccctctgtgtcgagcgcgtcgtcagggagcggcagttcttctccaatcacgatacagcagcatccccgcctgatcctcacagattctggctccgcccccactttctgctcagatgacgaagacgtcgctcctctcagtgcgaagttcgctgatatctacccactgtcaaactacgacgacactgaagtggttgccaatatgaacggcatccactcagaactgaatgggggaggcgaaaacatggcactgaaagatgagtcaccacaaatttcaagtacttctagctcttcctccgaggcggacgatgaggaagctgatggagaatcctcaggggagcccccaggcgctcctaaggaggacggtgttttgggaagccgctctcctcgtaccgaagaatccaaagcagactcacctcctccttcctatcctactcagcaggcggagcaggcccctaacacatgcgaatgccatgtgtgcaagcaagaagcaagcggcctcaccccgtcagccatgaccgccggggcacttcctcccggtcaccagttcttatctccggagaagccgacacaccctgccctgcatctctacccgcatattcacggacacgttccactgcataccgtgccacacctgccaagacctttgattcacccaactttgtacgctactccacctttcacacacagcaaggccctgccgccagcccccgtacaaaatcacaccaacaagcatcaggtatttaatgcttcgcttcaagaccacatttatccatcatgctttggaaatacacctgaatggaactcatctaagttcatctctctctggggcagtgaggtgatgaatgataagaattggaatccaggcacatttctcccagacaccatatccggaagcgaaatcttgggcccgaccctgtccgaaacgcgacccgaggccctgccccctcccagctctaatgaaaccccagccgtttctgacagtaaggagaaaaaaaacgctgctaaaaagaagtgtctgtacaactttcaggacgcattcatggaggccaacaaggtggtcatggccacatcctccgctacctcctccgtgagctgtacggccactactgtgcagagctcaaattcccaatttagagtgtcctcaaaacgcccaccatccgtaggcgacgtgttccatggaatctcaaaagaggatcatcggcacagtgcccccgctgcaccgcgcaactcacccacagggttggcccccttgcccgcattgtccccagccgcactgtctcccgcagcactgtctccagcttctaccccacacctggcgaatctggctgctccatcattccctaaaaccgccactacaacaccgggtttcgtggacactagaaagtccttctgccccgcacctcttcctcctgccacagacggatcgatatcagccccccctagtgtatgcagcgacccagattgtgagggccaccgatgcgagaatggagtgtacgatccacagcaggatgacggagatgagagtgcagatgaagactcgtgcagtgaacattccagctctacctctacatcaactaaccagaaagagggcaagtactgcgactgttgttactgcgaattctttgggcacggaggccctccagcagcacctactagccgaaactacgcagaaatgcgtgagaagttgcgtttgagactcacaaagcggaaagaagagcagcctaagaagatggaccagatttcggagagagagtccgtggtcgaccatcggagggtagaggacctcttgcagttcatcaattcaagcgaaacgaagcccgtctcatccacgagagccgccaagagagcccggcacaagcagcggaagttagaggaaaaggcgcgactggaagcggaggccagagcccgcgagcaccttcacttgcaggaagagcaaaggagaagagaggaagaagaagacgaagaggaggaggaggaccgtttcaaagaggagtttcagcgcctgcaggagttgcagaaactcagagccgtgaagaagaaaaagaaagagcgacccagcaaggactgtcccaaactggacatgctgacccggaacttccaggccgcgaccgagtctgttccgaatagcggaaacatacataatgggtctctcgagcagaccgaggagcccgagacgtcttctcattccccaagccgtcacatgaaccattcggaaccaaggccgggactgggcgccgacggggatgccgctgatcccgtcgatacacgagattccaaattcctgcttccaaaagaggttaatggaaaacagcacgaacccctgagtttctttttcgacattatgcagcatcacaaagagggtaacgggaagcaaaagctgaggcagacgtctaaggctagctccgagcccgcccgccgccccaccgaacctcccaaggcaacagaggggcaaagcaagcctcgagcacagactgagtctaaggccaaagtcgtggatctcatgagtatcacagaacagaaacgggaggagcgtaaagtaaatagcaataacaataacaaaaagcagctaaatcatatcaaggacgaaaagtccaaccccactcccatggagcccacttcccccggtgaacaccaacagaattctaaacttgtcctcgctgaatcaccccagcccaaaggtaaaaacaaaaaaaataaaaagaagaaaggggacagggtgaataattctatcgacgatgtatttctgcctaaagatattgacttggactcagtggatatggacgagaccgaaagggaggtagagtacttcaagcgagatggcgtgagccctcactgcccggggtggtcccgaacacccggactcaaatag

SEQ ID NO: 29830 - DNA, 1347 bp, Artificial Sequence
  Description of Artificial Sequence: Synthetic coding sequence
atgaagggcgggaccctcggaggcatacccggggagcccgctgtggatcatagagatgttgatgagctcctggagttcataaatagtacagagcctaaagtgcctaacagcgcgagagctgcgaagagggcccgacacaaactgaagaagaaagagaaggagaaagctcagctcgccgcagaggccctcaaacaagctaacagagtgtcgggatctagagagcccaggcccgcccgggagagacttctcgagtggccagacagagagctggacagagtgaatagcttcctatcctctaggctacaggaaattaagaacactgtgaaagatagtataagggcctccttctctgtgtgcgagctctcgatggacagtaacggattttccaaggaaggtgccgccgagccagagcctcagagtcttcccccgagcaatttgagcggctcgtctgagcagcaaccagacattaatctcgatctaagccctctgacccttgggtcaccccagaaccacacccttcaggctcctggcgaacccgcccccccatgggctgagatgaggggaccccaccccccctggaccgaagtcaggggacccccccccggaattgtcccagagaacgggctggttagacggttgaacaccgtacctaatctgtcgcgagtgatatgggtgaagacgcccaagcccggttatcctagcagcgaagaaccatcttctaaggaagtgccttcatgtaaacaggagctgccagaacctgtgagctcgggcggtaaaccgcagaaaggcaaacggcaaggcagccaggctaagaagtcagaggcgtctcctgcaccccggcctcccgcatcgctagaagttcctagtgcgaagggccaagtggccgggcccaaacagcctgggcgtgtgctcgagctgcctaaggtcgggtcctgtgccgaagcaggcgaaggaagccgtggatccagaccaggcccaggatgggctggttctccaaagaccgagaaggagaaaggctcctcctggcgtaactggcctggggaagcgaaagctaggccgcaggaacaggagagcgttcagcccagcggcccagccagaccccaaagtctgccccaggggaaagggcggtcacggagaagcaggaataagcaggaaaagcctgcaagcagcctggatgacgtgtttctgcccaaagacatggatggggttgaaatggacgagaccgatagggaggtggagtacttcaagaggttctgtctggattccgccaagcaaacaagacagaaagtcgccgtgaattggacaaatttttctctgaaaaaaacaacccccagcacggctcagtag

SEQ ID NO: 29831 - DNA, 2370 bp, Artificial Sequence
  Description of Artificial Sequence: Synthetic coding sequence
atgccaaagctcgtcaagaacctgttaggcgaaatgcccctctgggtatgtcagtcctgcagaaaatccatggaggaggatgagcggcagaccgggagagagcatgccgttgccatatccctgagccacactagctgcaaaagccaatcctgcggagatgactcccactcttcaagctcgtcctcttctagctcctcaagttcttcatctagctcttgccccgggaactcgggtgattgggacccctcttcctttctgtctgctcacaagctgtctgggttgtggaatagtccccatagttctggagctatgcctggctcctccctcgggagtccccctaccattcctggcgaggctttcccggtcagtgagcatcatcagcactcagacctcaccgcgcccccaaacagtcctacaggtcatcatccacagcccgcgagcctcattccgagccatccttcctcctttgggtcaccgcctcatccccacctacttccgactactccagcggcccccttcccagcacaggccagcgagtgccctgttgcagccgccactgctccccacaccccaggcccctgccagtcttcccacctgcctagtaccagcatgccactcttgaagatgcctccaccattttcagggtgcagccatccatgtagcggccactgtgggggacactgctccggcccgctcctgcctcccccaagttctcaacccttaccaagcactcaccgtgatccagggtgcaagggccacaagtttgctcatagtggtctggcgtgtcagctaccacagccttgcgaggccgatgaggggctgggcgaggaggaggatagctcctcagagaggagttcctgcacctcgtcaagcacccatcagcgggacggtaagttctgtgattgctgttattgtgagtttttcggacacaacgcccctcccgccgcgccgacctctagaaactacacagaaattcgagagaagcttcggagccgacttacacggagaaaagaagagctgccaatgaagggcggcactctgggcggcattccaggggagccggccgtagaccaccgggatgtggacgaactgctggagtttatcaatagtactgagcctaaggttcccaattcagctagagcagcgaagagggcaaggcacaaactgaagaagaaagagaaggagaaggcccaactcgccgctgaggcgctaaaacaggcaaatcgtgtgtcaggctctcgggaacccaggccagcacgggagagactattagaatggccggatcgtgaactcgatagagtcaactccttcctcagttccaggctgcaagagatcaaaaacacagtaaaagactccattagggcatcgttctccgtatgtgaacttagtatggatagcaacgggttttccaaggagggagctgccgaacccgagccgcagtcactgcctccatcgaacctgtccggaagtagcgagcagcaaccggatatcaacctggatctgtcgcccctaaccctgggcagcccccagaaccatacactccaggccccaggggagccagctccaccatgggccgaaatgcgcggtcctcaccccccttggacagaagttcgaggaccacctcccggtatcgtgccagaaaacggactcgtcaggcggcttaatactgttccaaacctgtctagggtgatctgggtaaaaacccctaagcccggatatccaagctctgaagaaccctctagtaaggaggtaccttcatgtaaacaggagctacccgaaccagtctcgtcaggagggaagcctcagaagggaaagcgacagggatcacaggccaagaagagcgaagccagccccgctccaagaccaccagctagcttggaggtaccaagcgccaaaggacaagtggccggcccaaagcagcccggcagggtcttagaactccctaaagtagggtcctgtgctgaggcaggggaagggtcgcgcggaagtcgacccgggcctggatgggccggctctcctaagaccgagaaagaaaagggttcctcttggaggaattggcccggcgaagccaaggccagacctcaagagcaggaatctgtacagccctcgggccctgcccgtccacagagtttacctcaggggaaggggaggagtcgcagaagtaggaacaagcaggagaagccagcctcttctttggatgatgtgttcttgcctaaagatatggacggcgtggaaatggacgagaccgatagagaagttgagtactttaagaggttctgtctggacagcgctaagcagactaggcagaaagtagcagtgaattggacaaacttctcactgaagaaaactactccgtcgactgctcagtag

SEQ ID NO: 29832 - DNA, 1992 bp, Artificial Sequence
  Description of Artificial Sequence: Synthetic coding sequence
atggctcacctgcggagcccttcaggatttggcgaccccggaaaaaaggatcaaaaagagtcggaggaggagctcgaggaagaggaggaggaagaagaagtggaagaagaagaggaggaggtggaagaggaggaggaggaggtagaggaagaagaggaagaagtggttgaggaggagctcgttggagaggaacaggagctcgaagcccctgagactttttcggaagaatacctgtggaaggtcactgacatcggagattacgatgacgactttccggatgttaggccccgcctggcaagtatcgtgagcccctcattgacgtccacgtttgtgccaagccagagtgccacaagcacagaaacccctagtgctagccccccatcttctacctcttcccataaaagctttccaaaaatttttcagactttccgcaaggacatgagtgagatgtcaattgatcgaaacatccataggaatctgagcccaggaatccctgtgagcgtccagacggaggaatcttggcttcaagatctgtccgataaagttcagtccagaaaaaaagccagcaaagaaaaagctgagccggaatgtctggcatccaagctccgagaaaaatgggtgattaaccccgaagagtctaaactcaatatactctatgaactggagtttaaagaagactttatcaccttgttcgaacccagcctccgtaccttgccatcgatcggaccccccagcatactggcatataaagaggaatctagcaacctgggtatcaacttcaaagatgaggaagaagagaccagtccaaaatgtgaattctgcggctctgatttgagggccttcttttccaacgtggatgtgagcagtgagcctaaaggtcatgcttcatgttgcatcgcttttcaaaacctcattgattacatttacgaggaacagataaagaccaaaccgcctaaagcagagctgatcgctattgatccacacgccgcccatggttcagaagtggaccggctgaaggccaaggaaaaagccctccagaggaaacaggagcagcgcatggcaagacacttcgccattatttcaagggaacagacgcacttcagtgaggatgatagcaagaggcttaaaacaatcagttatcaattgtcagtagatatccctgagaaacagataatcgatgacatcgtgttcgattttcaactgagaaatagtaatatgagcataatctgctgtgactcaaggatcgcatgcggtaaggtggtgcgtaatgagctcctggagaaacattataagcacggttccaaattcctgactagtttccctgatggcactactcaaattttttacccttcagggaacctggccattataagagttcctaataaagtgaacgggtttacctgcattgtgcaagaagacatgcctaccaatccagctatactggccgttctggattctagtggccggtccagttgctaccaccccaacgggaacgtctgggtctatatcaacatcctcgggggacagtactcagaccaggccggcaaccggattagggcttggaattggtctaacagcatcacttcaagtccctttgtgtctttcaaacctgtgttcctggctctgaacaggtacatcggggtgcgaattctggagcaggacaagataagcatcactttcctggctatgggacaacaggcacggatcagcgtgggaacaaaggttaaactgcctaaccctgaggaaattcctattctcaggtatgtttcaggagacgatttgctgctactggctagcctgatcaagattcgccgactttttcataagctcgaaggctgcgtgaacttccccagttcccaggtctgggagaagttaaaacagccaagttatctgagttcactctcgctgaaactaattgcactgtgccactcttccggaattaaacaggacataatgaaaaccataaggaatattatcaatgaagagatatag

SEQ ID NO: 29833 - DNA, 1866 bp, Artificial Sequence
  Description of Artificial Sequence: Synthetic coding sequence
atggcacatctgcggtcaccgtcgggtttcggagatcccgggaagaaagaccaaaaagaatccgagcaagaactggaggcaccagagacctttagcgaggaatacctttggaaggtgactgatataggggactacgatgatgactttcccgacgtccggccacgtctagcctccatcgtctcaccgtctcttactagcacatttgttccttcccagtcagctacctcaaccgagaccccaagtgcttcacctccttccagcacttcttcacacaagagtttccctaagatctttcagacctttagaaaggatatgtctgagatgagcatcgacagaaatatccaccggaatctctcccctggaattccagtctccgtgcagacggaggaatcgtggctgcaggatctttctgataaggtgcagtcacgcaaaaaagcgagcaaagagaaggccgagcctgagtgcctggctagcaaacttcgcgagaaatgggttatcaaccccgaagagtccaaactgaacattctctatgaactagagttcaaggaagactttataacgctgttcgagccatctcttcgcaccttaccatccattggacccccatcaattctagcgtacaaagaggagtcatctaacctaggcatcaatttcaaagacgaggaggaggagacctcaccaaagtgtgagttctgcggaagtgacctgagggcctttttctccaacgttgatgtgtctagtgagcctaaaggccacgccagttgttgcatcgcgttccaaaatctgatcgactatatatacgaggagcagatcaagaccaagcccccaaaggccgagctcatcgccatcgacccccacgcggctcacggctctgaggtagacaggctcaaggcaaaggaaaaagccctgcagcgcaagcaagaacagagaatggcacgtcattttgccattatatcaagagagcaaactcatttttccgaagacgactccaaacgcctcaaaaccatctcttaccaactctctgttgatatacctgagaagcagattattgacgatatcgtgtttgattttcagttgcgcaatagcaatatgtccatcatttgttgtgacagccggatcgcttgcggcaaagttgtgagaaacgaattgctggaaaagcattacaagcatggttcaaagtttcttacctctttccccgatggcaccacccaaatattctatccatcggggaatctcgccatcattcgagtgccaaacaaagtcaacggcttcacatgcatcgtgcaggaggacatgcctacaaatcctgcgattctggcggtgctcgatagcagcggtcggagttcctgctaccatcccaatggcaacgtttgggtctacatcaacattctgggggggcagtatagcgaccaggccggtaacagaatacgtgcctggaactggtctaactctatcacgtcttctcccttcgtttcgtttaagcctgtcttcctagccctcaaccggtacatcggcgttcgaatcctggagcaggataaaattagtattacctttctcgctatgggacagcaagccaggatctcagtcggcactaaagtgaaactacccaacccggaggaaatacccattctgcgctatgtctcaggggatgatctcttgttactggccagcctaatcaaaatacggcggctgttccacaagctggaaggctgcgtaaatttcccttcgtctcaggtgtgggagaagctgaaacagccaagttaccttagctccctaagcttgaaactgattgccttgtgtcactcttcagggatcaaacaggacattatgaagaccatccgcaatattattaacgaggaaatctag

SEQ ID NO: 29834 - DNA, 2091 bp, Artificial Sequence
  Description of Artificial Sequence: Synthetic coding sequence
atgagcgctgagaacaatcagttatcaggtgcttcgcccccccaccctcctacgaccccccagtatagtacccagaatcttccatctgaaaaagaagatactgaggttgagctggatgaagagtccctgcaggacgagagcccattctcccccgagggggaatccttagaagataaggaatacctcgaagaggaggaggatctggaggaagaagaatatctgggcaaggaagaatacctgaaagaagaggagtatctggggaaagaggaacacctggaagaagaggagtatctcgagaaggctggctacctagaggaggaggagtacattgaggaggaagagtacttgggaaaagagggatacttggaagaagaggagtacctagggaaagaagagcatctggaggaagaggagtacttgggaaaggagggatatttagagaaggaggactatatcgaagaagtagattatttgggaaaaaaggcatatcttgaggaggaagaatacttgggaaagaagtcttatttggaagaggagaaggccttggaaaaagaggaaaatctagaggaagaagaggctttagagaaagaagagaatctggacggcaaagagaacttgtataaaaagtatctgaaagagccaaaagccagttatagtagccagactatgctcttgagagacgcccgttcccccgatgccggcccatcccaggttactacatttctcaccgtccccctcacttttgccacacctagccccgtgtctgagagcgcgactgagagttccgaattgttactgaccctgtacaggcgatcacaagcttcgcagactgactggtgctacgatagaacagccgtgaagtctctgaaatctaaatcagaaaccgaacaggagactaccactaagctggcccccgaggaacacgttaataccaaggtgcaacagaagaaggaggagaacgtgctggagtttgcaagtaaagagaatttctgggacgggattactgacgagtccatcgacaagctggaagtcgaagatctggacgaaaattttttgaatagctcctaccagactgtgtttaagacgataattaaggaaatggcagcccacaacgaactcgaagaagattttgatatccccctcaccaagctgctggagtcggaaaatcgatggaagctggtgatcatgctaaagaagaactacgagaagtttaaagagacaatcttgagaatcaagaggcgccgcgaggcacagaagcttaccgaaatgaccagcttcaccttccatctgatgtctaagccaactccagaaaaacccgaaacagaagagattcagaaaccccaacgtgtggtacaccatcgcaagaaactggaacgcgataaggagtggatccagaagaagaccgtggtgcaccagggagacggcaagttaattctgtacccaaacaaaaatgtgtatcagatattgttcccggacggcacagggcagatacattacccgtctggcaacctggccatgctgatcctttatgcaaagatgaagaagtttacctacattatcttggaagactcattggagggacgcattagagcactcatcaataactccggtaacgcgacattctacgatgagaattcagatatctggctgaacctgagctccaatctgggctattactttcctaaggacaagaggcagaaggcatggaactggtggaacctgaatatacacgtgcacgctcctccagttcaacctatcagtctgaaaatcaacgaatacatccaagtgcagataaggtcacaagacaagatcatcttttgtttcacatacgaacaaaagcagatatgtttaaacctggggacacgctacaaattcgttattccagaggtgctgtcagaaatgaaaaagaaaactatactggaagctgaacctggacctaccgctcaaaaaattcgcgtgctgctggggaagatgaataggcttctcaattacgctactactcctgatctggaaaattttatcgaagccgttagtataagcctcatggataataaatacttgaagaaaatgctgtctaagctctggttctag

SEQ ID NO: 29835 - DNA, 483 bp, Artificial Sequence
  Description of Artificial Sequence: Synthetic coding sequence
atgtatacgatcactaagggcccatctaaactggtcgcccagaggcggactggccctacccaacagcaagtggagggcagattgggcgagttgctgaaatgtcggcagccagcacccccaacatctcagcctccacgtgcacagcccttcgcacagccgcctggcccttggccccttagcagccccggtccacgtctcgtgttcaacagagtgaatggtagaagagctccatccacaagcccctcctttgagggaactcaggagacttacactgtggctcacgaggagaatgtgaggtttgtctctgaggcgtggcagcaagtgcagcagcaattggacggcggacctgcgggagaggggggcccccgacccgtgcaatacgtcgagaggacacctaacccccgcctgcaaaactttgtccccatagatctggatgaatggtgggcacagcagttccttgcccgcattacaagctgctcttag

SEQ ID NO: 29836 - DNA, 585 bp, Artificial Sequence
  Description of Artificial Sequence: Synthetic coding sequence
atgtataccattaccaagggcccctcaaagctggtagcccagaggcggacagggccgacacaacagcaggtagaaggaaggctgggagaactactgaaatgtaggcagcccgccccccctacatcccaacccccacgcgctcagccgttcgcgcaaccgccaggaccatggcctttaagcagtccgggtcctcgactggtgtttaatcgagtgaatggaaggagagctccttctacctcaccctcgttcgagggaacacaggaaacctacacggttgcccatgaagagaacgtcagatttgtgtcggaggcatggcaacaggtccagcaacagctcgacggtggacctgccggagaaggcgggcccagaccagtgcagtatgtggagcgcaccccgaatcccaggctgcagaacttcgtcccgatcgatctcgacgaatggtgggctgccgtcccaggcgagaaccaccagctgtttctagttgcagccggccgtggccggtgttacaccgcggacctgtccccgggggaaaaacacggggccctgcccactcactgtgcctggctgggggccgggcacacatag

SEQ ID NO: 29837 - DNA, 294 bp, Artificial Sequence
  Description of Artificial Sequence: Synthetic coding sequence
atgacaagctctccagtgagtagggtagtgtataatggcaagagaacgtcatcaccacgatccccaccctcttcgagtgagatttttacacctgcccacgaagagaacgtgagatttatttacgaagcctggcaaggcgtggagcgggatctccgaggacaggtgcctggcggagagcgcggtctggtggaagaatacgtggagaaggttcctaaccctagtctcaagaccttcaaacctatagatctgtcggatttaaagaggaggtctacacaggacgcaaaaaagtcatag

SEQ ID NO: 29838 - DNA, 294 bp, Artificial Sequence
  Description of Artificial Sequence: Synthetic coding sequence
atgacctcatcaccggtaagtcgggtcgtgtataatggcaagaggacatcttcaccccgcagccctccatcatccagcgaaattttcacccccgcgcacgaggaaaacgtgagatttatttacgaggcttggcagggggtggaacgcgacctgaggggccaggtgcctggaggtgagcggggtctcgtagaggaatacgtcgaaaaagtccctaatccgtccctgaagaccttcaagcccatcgacctgagtgacttgaaaagacgatcgacccaagacgcgaagaaatcatag

SEQ ID NO: 29839 - DNA, 1440 bp, Artificial Sequence
  Description of Artificial Sequence: Synthetic coding sequence
atggtgagtaaagacaccggcaaatgtatccttacaaccagtgaaagtgaagtggaaccggctgcttgtttggccttggagatgaagtatgctctcgaccctaatcgccaaattaaaaagagaaacaaagccctccaagtgaggttcaaagatatctgcgaggcacagaatgagcaacgcgacactcagctatcttccggccagctaggagagaaacgagaggccaagccggtgtcttgcagggctgcttaccggaagtatatgacagtgcccgcaaggcgttctattcctaacgtaaccaagagtacgggggtgcagaccagtccagacttgaagaagtgttatcaaaccttccccttagatagaaagaagggcaatttgaagtcattaccggcagccgatcccttcaaaagccagaataacggctttttgacggatgcaaaggagaaaaacgaggcaggacctatggaggaggctcggccctgtggggctggccgagttcataagactactgccctagtgtttcattcaaaccagcacatgaacacggttgatcaacccctgggagtaaattgtactgaaccctgcaagtctcctgagcccctttcctacggcgaagccgcgctccagaattccacccgcccacctagcgaagagcctgactatcagctccttggccgtgccaaacaggaccgtggacgtcctaacagcgaagagcctgcccctcctgctctccggagggtttttaaaaccgaggttgccactgtgtatgcgccagccttgagtgcacgggctccggaacccggcctgtccgatagcgctgctgccagccagtggagtctttgccctgcagacgacgagagacgacgggcaacacatttgaatgggctgcaggcaccaagcgaaacagctcttgcctgcagccctccaatgcagtgtctatcgcccgagtgtagcgagcagccatcacagacccataccccaccaggcttaggaaatcagccctccccaaccgccgtggcggcgggtgaagaatgccagcggatagtgcctcacacagaagtcgtggatttaaaggcccagctgcagatgatggagaacctgatctctagctctcaagagacaatcaaggtgttactgggtgtgatccaagaactggagaaaggtgaggctcaccgggagggattgagctaccgcaccgggcaggacactgcaaactgcgatacctgccgtaactcagcatgtattatctatagcgttgagttggacttcaaacagcaggaagacaaattgcagcccgtgctccggaagctgcacccaatagaagagacacaagtaattcctagtccatacagtcaggaaacatactctagcacccccaaacagaagagtaagaccgagtctaagaaacacggacggtggaagctctggttcctctag

SEQ ID NO: 29840 - DNA, 1608 bp, Artificial Sequence
  Description of Artificial Sequence: Synthetic coding sequence
atggctcagcagaacatgaaagtgcgccccgtgctcctgaagcggaatagccttgaatcagtggagttcgtgaagcaaccacatcataggaggtccaaatcccagcaggttcgttttaaggaggacggcacaacaaagaaccctactggccttgctgaggtagatgtgcagacccctgaggatcctgcagtgatgggaaagactcaggcaactcgccaccatcttcctcccacctacagcctgagtttcccccggtcccagaaagctgggggcttccgaaatattgcgattcaaacgtcgccatctctgcgtaagcacttcccggtgtttaaacgtaagcgcctgacagcctccaaatctcttgtagaaatgcctacagccagccagtctgctatacaggtgaatggcaacttatctgaacaagatatagtctcatcagacttggcttaccttcgtctggcgcagcatctggaagacggcccaagaagggtgaaggtttcccacgctttcctgcctcgagtgcccaaagtgcagtcgaatggccctgttagcatctgcctcgaggctggaacctggcgatctcttgaaaaggctactgccgccattcaggtgcctgacgacatctatcactcccccagctgggaggcacgcgagtcagccctctcacccgaccgctcagcagaagttagtaattcaatccatcctctggacgacacaagacccggggacgggagacgtgtgacacccttggattcagagaagagtacttcctgtctgaacgcaacatctgttgcttcacatacaccaggaaccgaggaattgaaacctgaacttctcctgcccaaagataatagcgatgataaagacttaggaagtttaagctcccaatcgaaggaaacatgcgtgccaagctctcctcggacccatagctcaccgtcacagggatcacactctcagccagctcatcccggccgagccagtgactgtcccagctctagtaacaatcaccagaacctggtaagcctgaagactaattccgcatctaagtccgcacctggttgtcaggagcagactgcaaacaatcccaccgagtctgatactctggagtttcccaattgccccgggagcaaccatcttccctcatctctctccaggagcgagacaaaattgcagtcaaaccgcgagatcagtgacatcaaccagatccacctggccagaggtgagctgtgtgacctacagggcaggctgcagagtgtcgaggagtctctgcatagcaatcaggagaagattaaggtattgctaaacgtgatccaggaccttgagaaagcacgggccctgacagagggccgcaacttttaccgtacgggccaggacttgaataattgttccacctgccagaatacagcttgtatcatttactctgtcgaatatgatttccgccagcaggaggggcggttccacgaggtactgcagtcacttgaggaggccgagccggtggaagaagcttcaccaccacccaagtcgcccgcagagccgcctgcacctgaaaagcaggatctgaggcggaagaccaagaaggttaaaaagaagtgtttttggtggatttag

SEQ ID NO: 29841 - DNA, 1167 bp, Artificial Sequence
  Description of Artificial Sequence: Synthetic coding sequence
atgtcagatgaagcaagcgccatcacttcctatgaaaagttcctcactccagaggagcctttcccacttcttgggccacctcggggcgtgggaacctgtcctagcgaggagcctggctgtctcgacataagtgacttcgggtgtcaacttagcagctgccacaggactgaccccctacataggttccatacgaatcgctggaacttaacctcttgcggaacttcggtggcctcttccgagggctcggaagagttgttctcatccgttagtgtcggcgaccaagatgactgctacagtctgctcgacgaccaggacttcacctcctttgatctgttcccggagggcagcgtgtgcagcgacgtcagttctagtataagtacgtactgggactggtctgactccgaatttgaatggcagctccctggatccgatatagcctcggggagcgatgtgctcagcgacgtcatcccaagcatcccttccagcccctgcctgctacctaagaagaagaacaagcatcgaaatcttgatgaacttccctggagcgccatgaccaatgacgagcaggtcgaatacatcgaatatctgtccaggaaagtcagtacagaaatgggcctccgcgagcagcttgacattattaaaatcatagatccttcagcccagattagtcccaccgactctgaatttatcattgagctgaactgcctaacagatgaaaaactgaaacaagtgcggaactatatcaaagagcatagccctagacagaggccggctcgggaggcctggaaacggagtaatttttcttgcgcctccactagcggggtgtccggggcttccgcatctgccagttcttccagtgcctcaatggtctcttctgctagctccagtggtagctccgtgggtaatagtgccagcaacagctcagcaaatatgtcccgggctcatagcgactccaacctgagcgcatccgccgccgagaggattcgagattctaaaaagagaagcaagcagcggaagttacaacagaaggccttccgcaagcggcaactgaaagaacagcggcaggcccgaaaagagcgcctgagcggactctttctgaatgaggaagtgctgtctttgaaggtgaccgaggaagaccatgaagcagatgttgatgtgctcatgtag

SEQ ID NO: 29842 - DNA, 1974 bp, Artificial Sequence
  Description of Artificial Sequence: Synthetic coding sequence
atggatcatttttttatcaagagaaaaagaaacagtgaggtgaagtacacagaggcctgttctagctcctcagtggagtctggcatagtcaacagcgacaacatcgagaagaacaccgattccaatctacaaacctctaccagctttgagccccactttaagaagaaaaaggtgtcggcacggaggtacaacgaggattacctgaaatatgggttcatcaaatgtgaaaagcccttcgagaacgacagaccacagtgcgtgatctgtaacaacatccttgccaacgaaagcctgaaaccaagcaaactcaaaaggcacctagaaacacagcacgccgagctgattgacaaaccactcgagtactttcaacgtaagaagaaagacattaaactctcaactcagtttctaagctgtagcacggctgtttctgagaaggccctgttaagttcttatctagtggcctatagagttgccaaagaaaagatcgcaaacacagctgcagagaaaattatcctcccggcatgtctggatatggtgcggacaatattcgacgataaatccgcagacaaattaaaaactattccaaacgacaataccgtgtccctgcggatctgtaccatagcagaacatctggagaccatgttaataaccagactgcaatctggcatcgacttcgccatacaactggacgaaagcaccgatatcgggtcttgtactaccctactggtatacgtccgctatgcttggcaagacgattttctcgaggactttctgtgttttttgaacttgacctctcatctgagcggccttgacatctttactgagctggagagacgcattgtggggcagtataaactgaattggaaaaattgcaagggaatcacgtccgatgggacggctaccatgactggaaaacattcacgagtaattaaaaagctgttggaagtgactaataacggtgcagtatggaaccactgcttcatacaccgggaaggtctggcctccagggaaatcccacagaatttgatggaggtgttaaaaaacgccgtgaaagtggtgaacttcattaaggggagttccctcaacagcaggctactcgaaaccttctgctccgaaattggtactaatcatacacacctactgtaccacactaagataaggtggctcagccaaggcaaaattttgtcccgggtctatgagctccgtaacgaaattcacttctttttaattgaaaaaaaatcacacctggccagtatctttgaagatgacacctgggtaaccaaacttgcttaccttactgatattttctccattttgaacgagctctccctgaagctgcaagggaaaaactctgatgtgttccagcatgtagaacgaatccagggtttccggaaaactctcctgctgtggcaagtcagactcaagtcaaaccgtccttcgtattatatgttccctcgctttctccagcatattgaggaaaacatcataaacgagaatatcctgaaggaaattaagctggaaattcttcttcatctgaccagtctgtcacagacattcaaccacttctttcctgaggaaaaattcgagaccctacgggagaactcttgggttaaggatcccttcgcattccgccatccagaatccatcattgagctcaacctagttcccgaggaggagaatgaattactccagctgtcctctagctacacactgaaaaacgattatgagacgctgtctctgagcgctttctggatgaaggtcaaggaagacttcccgctcctgtcacgaaagtccgttctccttctgcttccattcacaacgacctctctgtgtgagttggggttttccattttaacacagctcaagacgaaggagcgcaacgggctgaattgcgctgccgtgatgagagtggcactctcatcatgtgtccctgactggaacgaactgatgaacagacaggcccatccgtcatag

SEQ ID NO: 29843 - DNA, 468 bp, Artificial Sequence
  Description of Artificial Sequence: Synthetic coding sequence
atggggctcagagctgggagcaggtgtcgcgccgatcatttagcccagcctcagccccagggtcacctggcacctgtcctgagatgtggagagtgctggagagcccggggactccctggtggctgctgcctccataccgagggagggtgttctctaggggctcaggcgggatggcgaaccgctggctgggaagcccgagggagacgcgacctgggcctggaaacaacctcagctcactctcgttctctgctgcacttgtcctcatggagaaggccagatgtcggagaggctgcgggggctgagctgctccagcgggcccccctgcagcagcctgaccccgctcaggccgccgtggaaggaggcttactggctaggctgccacggccgcaggatcaggggtgcggccaacacaggcctcattctcctcgtctggtcgatatcgccctgccagggggaggctggacttag

SEQ ID NO: 29844 - DNA, 1173 bp, Artificial Sequence
  Description of Artificial Sequence: Synthetic coding sequence
atgggagaggcgggtgctggggcaggggcatctggtggtccagaggcctcgcctgaggcagaggttgttaaactcctccccttcctagcaccaggagctcgcgcagatctccaggccgccgctgtgagacatgtcttggcgctgaccgggtgtggcccggggagggctctgctggccgggcaggccgctttgttgcaggctctgatggagctcgcccctgcatctgcccccgcccgggatgctgcccgggcactggtcaacctggcggctgaccccggtctgcatgagacattgttggcagcagatcctggactgcctgcccgcttgatgggcagagctctcgatccccaatggccctgggccgaagaggcggcagctgccctggcaaatctgtctcgcgaaccagccccttgcgctgccttgatggcagccctggctgcagccgagccagctgacagcggactggagcggctggtacgcgctctgtgcacacctggttacaatgcacgcgcgcccttacactatctggcgcccctgctatccaacttgtcccagaggcctgctgcgcgggcctttctactggacccggacaggtgcgtcgtccagagactgttgcccctgacacagtacccagattcctctgtgagacggggaggggtcgtaggcacactgcggaattgttgttttgagcaccggcatcacgagtggctccttggccccgaagtagacattctgccctttctgctcctcccactggcaggtcccgaggacttctctgaggaggagatggagcgactgccagtggacctacagtatctccctcccgacaagcaacgtgagcccgacgccgatattcgaaaaatgctagtggaagctataatgctcctgacagcgaccgctcctggacgccaacaggtcagagatcagggagcatacctgatcttgcgggagctgcactcctgggagcccgagcctgatgtgcggacagcctgcgagaagttaatccaagtcctgatcggcgatgaacctgaacgagggatggagaacctcctggaggtgcaggtgccagaggatgtggaacagcagctgcaacagctggactgccgagaacaggaacagttggaaagggaacttgcccctgagccttgggttgagagagccacacctacatag

SEQ ID NO: 29845 - DNA, 1173 bp, Artificial Sequence
  Description of Artificial Sequence: Synthetic coding sequence
atgggagaagccggcgcaggggctggggcctccggtggtcccgaggcctcgccagaagctgaggtcgttaaattgcttccatttcttgcccccggcgcccgtgctgacttgcaagccgccgctgtccgccacgtactagctctcacgggttgtggccccggcagggccctcctggccggacaggccgccttgctgcaagccctgatggaacttgccccagcgtcagctcccgccagagacgccgccagagccctggtcaatttagccgctgaccctgggttgcacgaaaccctgttggctgctgacccgggcctgcccgcgcgtctgatgggtcgtgctctggaccctcagtggccttgggcagaggaagcagctgctgccctcgcgaacttgagccgtgagcccgccccatgcgccgcgctcatggccgcactcgccgccgctgagcccgccgactctggcctcgaaaggctggttcgggcactctgtacccccggctacaacgcaagggcacctctgcactaccttgcacccttactttctaatctttctcagagacccgcagctagggcctttctacttgatcccgacaggtgtgtggtgcagcggttactcccattgacccagtatcctgattcgtctgtccgccgggggggagtggtgggtactctcagaaactgttgttttgaacaccgacaccacgagtggctcttgggcccagaggttgacattctgccctttctactgcttccgctggccggccctgaggacttcagcgaggaggaaatgcagcgtctgcctgtcgatcttcaatacctgccccctgacaaacagagagagcctgacgccgatattcggaagatgctcgttgaggctattatgctgctgacagcgacagcccctggaagacagcaggtacgcgaccaaggggcgtatctgatcttgcgggagcttcatagctgggaaccagagcctgacgtacggacagcctgcgagaagctcatccaggtgttgattggagatgaacctgaacgggggatggaaaacctactggaggtccaggtgcccgaggacgttgaacaacagttacagcagctggattgtcgggagcaggaacagctggagcgagagttggcacccgagccttgggtggaaagagctacacccacatag

SEQ ID NO: 29846 - DNA, 456 bp, Artificial Sequence
  Description of Artificial Sequence: Synthetic coding sequence
atgtggagtgggttgcttccaccaggactgaacgagtccgatgcagagagcaacagcgaagacgaagcgacattggagaattcaggactgaatctgcaggaggacaaggaggacgagtccatcagaaagactgaaatcatagacttctctaccgatgagcctaagaccgaaacagagtcaaatgtaaatgcatatgaggagtgcccctctggtatcccaatcgacatgtggaacaaatttcaggaactgcacaagaagcacagcgaacagaaatccacaacgagcagattccggggcaaacgtcggaaacgaagtcggaaggacaagcttaaaaatgaaaaggagctgcattcagagccctcttcaaatgagactcagtggaaggagttaactcaatatttcggagtgaatgaccgttttgatcccccggttaagagaaagaaagtggagaagtag

SEQ ID NO: 29847 - DNA, 702 bp, Artificial Sequence
  Description of Artificial Sequence: Synthetic coding sequence
atgtggtcgggactactgccccccgggttgaacgaaagtgatgcagagagtaacagcgaggacgaagctactcttgagaacagcggactgaatttgcaagaggataaggaagatgagtcaattcgcaaaaccgaaattatcgattttagcacagatgagccaaaaactgaaacggaaagcaatgtgaatgcatacgaggagtgtcccagcggaataccaatcgatatgtggaataagtttcaagagcttcataaaaagcactcagagcaaaaaagcaccacttcgaggttcagaggaaagcggaggaaacgctctagaaaggacaaacttaagaatgagaaggaattacactccgaaccgtcatccaacgagacgcaatggaaagagttaactcagtacttcggtgtgaatgacaggtttgacccacctgtaaaaaggaaaaaagttgaaaaatctgggctagaaaagcgaatcgaccaggctgtcgaggaatggaacatcgagaaggccgaggagctgtctaatcagcttgccactcgcgagctcggagtgaaaattgctaaggctgtggcttgccataacttcgtgaaggccaaaaaagaagtcgagaacagccaggccgcccgcaagaaaaaaaaattggcttggggttttgaggcgaaaaaaagatgggagaccaagtcgaatatggggtacatgtag

SEQ ID NO: 29848 - DNA, 702 bp, Artificial Sequence
  Description of Artificial Sequence: Synthetic coding sequence
atgtggagcgggcttctacctccaggtctaaacgaatctgatgccgaaagcaactccgaggatgaagctacactcgagaacagcggcctcaacctgcaagaagataaagaggatgaatcaataaggaagaccgaaattatcgacttcagtaccgacgagcctaaaacagaaacagagagcaacgttaacgcttatgaggagtgccctagcggtatacctatcgacatgtggaataagttccaagagcttcataagaaacactctgaacagaaatcaacgactagtcggttcagggggaagagaaggaaacgctctcgaaaagacaagctgaaaaacgaaaaggagctccactctgaaccgtcctccaacgagacgcaatggaaggaacttacacaatattttggagtgaacgatagatttgatccgcctgtgaagaggaaaaaggtggagaaaagcggcctggagaagaggatagaccaagctgttgaagagtggaacatagagaaagccgaggagctctcaaatcagctcgccacgagagagctcggcgtgaaaatagccaaagcagtggcctgtcacaattttgtgaaggccaagaaggaggtggagaattctcaggctgcccgcaagaaaaaaaaactcgcttggggctttgaggcaaagaaaagatgggagaccaagtctaacatggggtacatgtag

SEQ ID NO: 29849 - DNA, 417 bp, Artificial Sequence
  Description of Artificial Sequence: Synthetic coding sequence
atgctatcgccaacctttgtgttgtgggacgtcggctaccccctttacacatatggaagtatttttatcgtgattgtcatcatttggcaggtcaaacgcagtcaccatgagctcaatctcgaagtcgagcgatcttgttgctggcgacaccagaaagtcagacagcgcgcgcgtgacgccgcttctaccgcaagaaggttgtcacaggaagaagaccagaaaccccaagaactgttctcagtaatgaagagagcagggttcccacaacgggaggtgtgcggcgagagctatgtgcagattccggtggccaagttcgctatgctgtggctgtggagattctcctcttgctggaggatgagaatgacacgctcccctcagctatgtcgtggggttcatcaccgaagccccctggcctag

SEQ ID NO: 29850 - DNA, 693 bp, Artificial Sequence
  Description of Artificial Sequence: Synthetic coding sequence
atgggcaaggtgcgagggctgcgggctcgtgtacatcaggcagccgtccgcccgaaaggagaagcagctcccggacctgccccacccgcccccgaagccaccccgcccccagcctccgccgctggtaaagattgggcttttatcaatactaacatcttcgcgcgtacaaagattgaccctagcgcactcgtgcagaaattagaactggatgtgcggagcgtcactagcgtgaggaggggcgaagctggaagcagtgcccgaagtgttccttctatccgtcggggtgcagaggctaaaacagtgctgcctaagaaagaaaaaatgaaattacgcagagagcaatggctgcaaaagattgaggcgattaaactcgccgagcaaaaacacagggaagaacgccgcaggagggccactgtggtagttggcgatctgcatcctttgcgagatgcgctgcctgaactgctggggttggaagcaggaagcagacggcaagccagatcgagagaaagcaataagccgcgccccagcgagcttagccggatgtctgctgcgcagcgccagcagctgctcgaagaggagcgcacgagatttcaggaactgcttgcaagccctgcttacagagcctctcctctggtagcaattggccagacactggctcgccagatgcagctggaagacgggggtcagctgtag

SEQ ID NO: 29851 - DNA, 648 bp, Artificial Sequence
  Description of Artificial Sequence: Synthetic coding sequence
atggggaaggttagaggccttagagcaagagtccatcaagcagcagttaggcctaaaggagaggcagcccctggccctgctcccccggctcccgaggccacccccccacccgcatcagccgctggaaaggactgggcttttatcaatacgaacatcttcgcccggactaaaattgatccgtccgcccttgtacagaagcttgagctcgacgtgcgcagtgtcacatccgtcagaaggggcgccgaagctaagaccgtgctccccaagaaggagaaaatgaaactccggcgagagcagtggctccagaaaatcgaagccatcaaactggctgaacaaaagcatagggaggaacggaggagacgcgctactgtggtggtgggagacctgcatcccttgcgggacgccttaccagagctcctgggcctggaggccggctcaaggcggcaggcccggtcgagggaaagcaataagccaaggccctcagaactttcccgcatgagcgccgcgcagcggcagcaactgctcgaggaggaacggactaggtttcaagaacttcttgctagccctgcgtatcgggcctcgcctcttgtggccataggtcagacactagcccgccagatgcagcttgaagacggcggccagctgtag

SEQ ID NO: 29852 - DNA, 4539 bp, Artificial Sequence
  Description of Artificial Sequence: Synthetic coding sequence
atggctaccgccgttgagaccgaagcatgtcagccaaccgatgcatcgtgggaaagcgggggggggggtgacgacgaaatgaagcaagccctgccagagcttgaaagtagtcagcaaaacggaggaggaggaggtttgaacattgctgagccgagtggaggggccggtagagaagaaaatgccggggccgaggcggcacagtctctcagccacgaacagccacaggactctagcgaggccggcgctgccgccctgcctcgggggcctgaagagccggagcggccagtgcggaggtcctttcagattccccgaaaatcaagggaaaagaaggccctcttccagcccctgacaccgggcagtcgagaattcgaggacgtagtcaacatcctacactcatcctatctggaacccaccagcgtgaccaacttcaattacaggcgggcctgcctggtgcataatgagctgctggaaaaagagttcacagagaaaaggcgggagctgaaatttgatggtcgtctagacaaggagcttagcgagagctacgctttcttgatggtcgatagatatcaagttcaaactatatgtgagaaggggctgcatgtgggtcagagtaagattaccatcctgggcagccctagtatgggagtgtacttatctcgctatgccgacttactgcaggcaaaccccctagacacgggagccatgggtgacgtggtcattttcaagatcatgaagggcaagatcaagagcatttatgaccctatgggagtgaaatcactggaaagcatgctgaacaagagcgcattggaccctacacctaaacatgagtgtcacgtgtcaaaaaatgcaaatagaataacgtctcttctcgcatatagggcctatgagctgacacagtattacttttacgagtatggttttgacgaactgaggcgcaggccaaggcacgtctgtccatatgcggttgtgagcttcacatataaagatgatattcagacaccaaaattcgttccttcctccaggtcaaacagctttaatactgacagaaatatagataaatataattatactctatggaaaggacagctgctaaataaagggaagcttctatgttatatctccttacggtcagcaaccagggcctttttgccaattaagcttcccgagaagttggacgttgagaccgtgatgtcaattgatcatctgaagcagaaaataccacccgccctgttttataaagaaacttacttaggcccaaacgaagtcctgaagaatggaatgtattgctcactgtatgaagtggttgaaaagaccaggatcggctcaaatatggagtcccttctacagaaactggacagggaaaagctggtcctcgtgaaaccactgggggatcgcggttacctctttctgctatccccttatcagatggtgcccccctacgaataccagaccgcaaagtctcgagtgttacacgccctcttcctatttcaagaaccacggagcatagtgacgtcgcaaaaaggttctactaacgctgcccctcaggagaggcacgaaagcatgccggacgtgttaaagatcgcgcagtttctgcagttttccctgatccagtgcagaaaagagtttaaaaatatttctgctatcaacttccattctgtcgttgagaaatatgtgtcagagttttttaagcgcggatttggatctggaaagcgcgagttcatcatgtttccctacgattcgaggttagacgataagaagtttctgtacagtgctccgcgaaataagtcccatattgatacttgtctccacgcttacatcttcaggccagaggtctatcagcttcccatatgtaagctaaaagaattattcgaggagaatcgtaagctgcagcaattcagccccctgtccgattatgagggtcaggaggaggaaatgaatgggaccaaaatgaagttcggaaaacgtaacaattcccggggggaggccataatctctggcaaacagaggagctcccattctctggactatgataaggaccgcgtgaaagagctgatcaacctgatccaatgtcggaagaaaagcgttggaggtgactcggatactgaggatatgagatctaagaccgtactgaaacgaaagcttgaagatctgccggaaaatatgaggaagctggccaaaacttctaacctgtcagagaactgtcacctttatgaggaatctcctcagccaattgggagcttgggacatgacgctgacctgagacgccagcagcaagatacttgcaattcagggatcgcagacattcaccgcctctttaattggctcagcgagacattagccaatgcccggcatagcgacgcctcccttaccgacaccgtgaataaagccttgggactgtctaccgacgatgcttacgaggaactgcgccagaaacacgagtatgagctaaactccacgcctgataagaaagactacgagcaaccaacatgcgctaaggtcgagaacgctcagttcaagggcacacaatcgttactgttggaggtcgacgccacatccaagtactcagttgctatttccactagtgaagtcgggaccgaccacaaactacacttgaaggaggatccaaatctcatctcagtcaataactttgaagactgttccctgtgcccaagcgtgcctatagagcacggtttcagacggcagcagagcaagtccaacaacgtagaggagaccgagatccactggaaacttatccctataactgggggcaacgcacgctcgcccgaagatcagctgggaaagcacggcgaaaagcaaacacccggcatgaaaagtcctgaggaacaattggtgtgcgtcccacctcaggaagcgttccctaacgaccccagagtgatcaacagacagcggtcttctgactaccagttcccttcgtctccctttactgatacccttaaaggtacaaccgaagacgacgttttgaccgggcaggtggaggaacagtgcgtcccagcagctgaagcagaaccgcctgccgtttccgaaaccaccgaaagaacggtgctgggagagtataatctgttctcccggaagatcgaggagatcctcaaacagaagaacgtgtcctatgtctccactgtgagtacacctatttttagtactcaggaaaaaatgaaacggctgtccgaatttatctattccaaaacctcgaaggcaggcgtgcaagaattcgtcgacgggctccacgaaaaattaaacaccattataatcaaagcttcagccaaaggtggaaacctgccacctgtgtccccaaatgatagcggtgccaagatagcaagtaaccccctggaacggcacgtgatacccgtgtcgtcaagtgattttaacaataagcatctgttggaaccactttgctctgatcctcttaaagacacaaattcagacgaacagcacagtaccagcgcactgacggaagtggaaatgaatcaacctcagcacgcgaccgagttaatggtaacatcagaccatatcgtaccaggcgatatggctagagaaccggtagaggagactacaaagagcccctccgacgtgaacatcagcgcacagcccgcactgagcaatttcatctcacaactggaaccagaggtgttcaacagtctggtgaaaatcatgaaagatgtacagaagaacacagtgaaattttacatacacgaggaagaggaaagcgtcttgtgtaaggagattaaggagtacctgattaaactggggaatactgaatgtcaccccgagcagttcttggagaggagatctaagttggataaactactgattatcattcagaatgaggacattgctggttttatccataagatccccggcctggtgacactgaaaaagctcccttgcgtgagctttgctggggtcgactcgttggacgacgtgaagaatcacacctataacgagctttttgtctcaggaggattcattgtgagcgatgaatccattctgaatccagaagtagtcaccgtggagaatctgaagaacttcctgactttcctggaggaactcagcaccccggagggaaaatggcagtggaaagtccactgcaagttccagaaaaaattgaaagagcttggccgacttaatgccaaagcactgagtctgctaaccctgttaaatgtctaccagaagaagcacctggttgaaattctcagctaccataattgcgattcccaaacaagaaacgctcctgaactggactgcctgatcaggctgcaggcccagaacatccagcagcgccatattgtttttcttacggaaaagaatattaaaatgctctcctcgtatactgataacggaattgtcgtggctaccgccgaggacttcatgcaaaacttcaaaaacttggtcggttaccataacagcataacggaggagaatcttccccagctaggggctaacgagaatttagagtctcagtctgatgccgtgctcacactgactcccctggagctcggagtgggcatttcacagcactag

SEQ ID NO: 29853 - DNA, 4830 bp, Artificial Sequence
  Description of Artificial Sequence: Synthetic coding sequence
atggccaccgcagtcgagactgaggcttgccaaccaaccgatgccagctgggaatccgggggagggggtgacgatgaaatgaagcaggcacttcccgagctcgagagctcacagcaaaatggcggaggcggcggtctaaatatcgccgagccatccggaggagccggacgggaagagaacgccggggcagaagccgctcaatctttaagtcacgagcagcctcaagacagtagcgaagcaggcgccgccgccctgccccgcggtcccgaggagcctgagagacctgtccgaaggtccttccagatacctcggaaatcccgggagaagaaggcactgtttcagcctctgacaccaggctcccgcgagtttgaggacgtggtgaacattttacatagcagctacctggagcctacgagtgtcacaaacttcaactataggcgggcttgtcttgtccacaatgaattgctagagaaggagttcactgagaagcgccgagagttgaagttcgatggacgccttgataaagagctcagcgaaagttatgcctttcttatggtggataggtaccaggttcagaccatatgcgagaagggcctccacgttggccaatccaagatcactatcttgggatccccgtctatgggggtctacctttccaggtacgccgacctgctgcaggctaatcccctggacaccggagccatgggcgatgtggttatattcaagattatgaaaggcaaaataaagtccatttatgaccccatgggcgtcaagtctctggagagtatgctaaataagtctgccctagatccgacaccaaagcatgagtgccacgtctcaaagaatgctaatcgaatcacatctctgttagcctaccgtgcgtacgagttaacacagtattacttttatgaatatggcttcgatgagctgaggaggaggccccggcacgtctgcccttatgctgtcgtttccttcacctataaagacgacatccagacccctaaatttgtgccaagctcacgtagcaattctttcaacacagacagaaatatcgataaatataattatactctatggaagggccagctgctcaacaaggggaaactactatgctacatatcattacgatcagccacgcgggcatttctacccatcaagctgcctgaaaagctggatgtcgaaactgttatgtccattgaccatctcaagcagaagatccctcccgctctgttttataaggagacctacctaggtcccaacgaggtgctgaagaacgggatgtattgcagtctgtacgaggtggtggagaaaacaagaatcgggagtaatatggaatccttgctacagaagctggacagggagaagttggttctagtaaagcctctcggggatagaggatacctcttccttctcagtccctatcagatggtcccaccatacgagtatcagacagcgaagtctcgcgttctacatgcactgttcctgtttcaggagccacggtcaattgtaacttctcagaaaggctctaccaacgctgctccacaggagaggcatgagtcaatgccagacgtcctgaaaattgctcagttcctgcaattcagcctgatccagtgtcgaaaagaatttaagaacatctcagcaataaactttcattcggtagttgagaaatacgttagtgagtttttcaagagagggttcggttcaggcaaaagggaatttattatgttcccatatgacagccgtttggacgacaagaagttcctttacagcgccccaaggaacaagtctcacattgacacatgcttgcacgcctacattttccgccccgaggtataccagctacccatctgcaaactaaaggagttgttcgaggaaaatcgtaagcttcagcaattcagcccgctgtccgactatgagggtcaggaggaagagatgaacgggactaagatgaagtttggtaagaggaataatagccgcggagaagccataataagtgggaaacagagatcaagccactctctcgattatgacaaggaccgcgtcaaagaactgatcaacctgatccagtgtcgaaaaaaatccgtcggcggggacagcgacaccgaggatatgcgtagcaagaccgtgctgaagaggaagctggaagacctgcccgaaaacatgcgtaagctcgccaagacctcaaatctgtctgaaaactgtcacctctacgaggagagtccacaaccaatagggagcctcggccatgacgcggacctcaggagacagcagcaggacacttgtaattctgggatcgccgacattcaccgcctctttaactggctgagtgagaccctcgccaatgctcgacattccgacgccagcctgaccgacacagtcaacaaggcactggggctgtccacagacgatgcatatgaggaactgaggcagaagcacgagtatgaactgaacagcacaccggacaaaaaggattacgagcagcctacttgtgccaaagtggaaaacgcgcagtttaagggcacccaatccctgcttctcgaggtagatgctacctcaaagtacagcgtcgcaatttccacttccgaggttgggacggaccacaaactccacctgaaagaggatcctaacttgataagcgtcaataatttcgaagattgctctctatgtccctcagttcctatagaacacggcttccggaggcagcagtctaagtccaacaatgtggaagagacagagattcattggaagctcatccccataaccgacactttgaagggtacaacagaagatgatgtactgacaggtcaggtggaggagcagtgtgtgcccgctgcagaggctgagccccccgccgtctctgaaacaactgagaggaccgtactgggtgagtataacctgttttccaggaagatcgaggaaatcctcaagcaaaaaaacgtttcttatgttagtactgtgtcgacacctatcttctccactcaggagaaaatgaaaaggctgtccgagttcatatattcaaaaaccagtaaggccggagttcaggaattcgttgatgggctgcacgagaaactgaacaccatcattatcaaggcctccgccaagggagggaacttgccccctgtatcaccgaacgacagcggggcaaaaatcgcgagtaatcctctagaaagacacgtgattcctgtctcaagctccgacttcaacaataaacacttactcgagccactctgtagcgacccacttaaggatactaactcagatgaacagcacagcacatccgctctcacagaagttgaaatgaaccagcctcagcatgccaccgagttaatggtgacgtccgaccatatcgtccctggcgacatggccagagagccagtggaggagacaaccaaatcacccagcgacgtaaatatttccgcccaacctgctctgtctaatttcatctcacagctagagcctgaggttttcaattcgctcgttaagatcatgaaagacgtccagaagaacactgttaaattctacatccatgaggaagaggaatcagtgctgtgtaaggagataaaggaatatctgataaagttaggcaacacagaatgccacccagaacagtttctggaaaggaggagcaagctggacaagcttctgatcataatacagaatgaggacatcgctgggtttattcataaaattcctggccttgttactctgaaaaaattgccgtgcgtcagcttcgcaggtgtagactctctggatgacgtgaagaatcacacatacaatgaactgttcgtgagcgggggattcattgtgtctgatgaaagcatattaaacccagaggtggtgaccgttgagaacttaaagaacttcctgaccttcctagaggaactttcaacccccgagggtaagtggcagtggaaagtacattgcaagttccagaaaaaacttaaggaacttggtcggctgaatgcaaaagccctatctctcctcactttgctgaacgtgtatcagaagaagcacttggtggagatcctgtcatatcacaattgtgacagccaaacacgaaatgctcccgaacttgattgcctgatcagactgcaagcccaaaatattcagcaaagacacattgttttcctgactgagaaaaacattaagatgctgtcatcgtacacagacaacgggattgttgtagccacagcagaagactttatgcagaacttcaagaacctagtgggatatcacaatagtatcaccgaggaaaatctgccccagctgggggccaacgagaacctggagtctcagtctgcccttcttgaaaacgacgagaaggacgaggaggacatgtcactggactcgggagatgagattagccacatcgaggtgtgcagtaatttccattctgagatttgggaaaaagagacaaaggggtctagagggacggaccagaaaaaaaacacacagatagaactgcaatcgtctccagatgtacaaaattctttattggaggataagacctacctcgactctgaagagcggacatcaattgatatcgtttgtagtgagggagaaaatagcaatagcacagaacaggacagttactctaactttcaggtctaccattcccagctgaacatgtcacatcagttttctcattttaatgtgcttacccaccaaaccttcctgggtacaccctatgccttgtcgagctctcagagtcaagagaatgagaattatttcctttcagcttatactgaatctctggatagagacaaatctcctccacctctttcttgggggaagagcgacagttccaggccctactcccaggaaaaatag

SEQ ID NO: 29854 - DNA, 3702 bp, Artificial Sequence
  Description of Artificial Sequence: Synthetic coding sequence
atgagcattgatcatcttaagcagaagattcccccagcactgttttacaaagagacatacctgggtccaaatgaagtgctaaaaaatggaatgtactgctcactgtacgaagttgtcgaaaaaacaaggataggcagtaacatggagtcactgctacagaaactggacagagagaagttagtcctggtgaaacctctcggcgaccggggctacttgtttctcctgagcccttaccagatggttcctccatacgaatatcagacagctaaaagccgcgttctgcatgccttattcttattccaggaacctaggagcatcgttacctctcagaaaggttcgactaacgccgcccctcaggagagacacgaatctatgccagatgtgcttaaaatcgcccaattcctacaattctcactgattcagtgcagaaaggagtttaagaacatcagcgccattaatttccacagcgtcgtcgagaagtatgtgtcggaattcttcaagagaggcttcggctctggtaaaagagaattcattatgttcccctatgatagccggctagatgacaaaaagttcttgtactctgctcccagaaacaagtcccacatagatacctgcctccatgcttacatttttcgccctgaggtctaccagcttcccatctgtaaactcaaggagctgtttgaggaaaataggaaattgcagcagtttagccccttgagtgactatgaaggacaggaggaggagatgaatggaaccaagatgaagttcggcaagcgaaacaacagccggggtgaagcgatcatctcgggcaaacagcggagctcacatagcctcgactatgataaggatagagttaaggaattgattaatctgatccaatgtcgaaaaaaaagcgtgggcggggatagtgacacagaggatatgcgaagtaagacagtcctcaagcgcaagcttgaagatttgccggagaacatgaggaagctggcaaagacctctaatctgagtgagaactgtcacctgtacgaggagtccccccagccaatcgggtcgctcggccacgatgccgacctgcgccggcagcaacaagatacatgcaattccggcattgcagatatccataggctcttcaactggttatccgagacactggctaatgcacgtcactctgacgcttccctaaccgacacggtgaacaaggccctgggcctctccactgatgacgcatatgaggaacttcggcagaagcatgagtacgagctcaattcgacacccgacaaaaaagattatgaacaacccacatgcgccaaagtggagaatgcacaattcaaagggacgcaatcattactcctcgaggtggatgccacctcaaaatattctgttgcaatatctacctctgaagttggcaccgaccacaagttgcacctaaaagaagacccaaacctgatcagcgtcaacaactttgaggactgctctctttgcccttccgttccaatcgagcacggctttcggaggcagcagagcaagtccaataatgtggaggaaaccgaaattcactggaagctgatccctataactggcggtaatgcccgttctcctgaggaccaactgggcaaacacggcgaaaaacagacacctgacactttgaaaggaaccacagaggatgacgtgttgaccggacaggtggaggagcagtgtgtgccagccgcagaggccgaaccacctgccgtgtctgaaactacagaacgtacggtgctgggagaatacaatctgttctccaggaaaatagaagaaatcctaaaacagaaaaatgtaagttatgtttccacagtgtccacgcctatttttagcacacaagaaaaaatgaagaggctgtctgagttcatctacagcaagaccagcaaggccggagttcaagagttcgtggatggccttcacgagaaactgaacactatcattatcaaggcatccgcaaagggcgggaacctgccacctgtgagcccaaacgacagcggggccaagatcgcctctaatccactggaacggcacgttattcctgtgagcagttctgatttcaacaacaaacacttgcttgagcccctttgcagtgacccactgaaagacaccaactctgacgaacaacactcgaccagcgcactcacagaggtggaaatgaaccagccgcaacatgctacggaactgatggttactagcgaccacatagtccctggtgacatggcccgggagcctgtggaagagacaactaagtctccctccgacgtcaatatctctgctcagccggcccttagtaacttcatatctcagctggagcctgaggtgtttaattcactggtcaaaataatgaaggatgtgcagaagaacaccgtcaaattttatattcacgaggaggaagagtcagtgctatgtaaagaaattaaggaatacctgattaaactaggtaacacagaatgtcaccctgaacaatttcttgaacgccgtagcaaactggacaagctcctgatcatcatacagaatgaggatatcgccggattcatacacaagatcccagggctcgttactcttaaaaaacttccctgcgtcagtttcgcaggagtggatagtctggacgacgtgaaaaatcatacatacaatgagctgttcgtttctgggggattcattgtatcggatgagtctatcctgaaccctgaggtggttacagtagagaacctcaaaaatttcttgacatttctggaagaattatctacaccagaaggaaagtggcagtggaaggtacattgtaagttccagaagaagttgaaggaactggggagactgaatgctaaggccttatccctcctgaccctcctaaatgtatatcagaaaaaacacctggtggagatcctttcataccacaattgtgactcacagactagaaacgccccggagctggactgtctgattagactgcaggcccagaatattcagcagcggcacatcgtctttctcactgaaaagaatatcaaaatgctctcaagctacaccgacaatggcattgtcgtggctacagctgaggacttcatgcaaaactttaaaaacttagtgggctaccacaactcaataaccgaggagaatttgccgcaactcggcgccaacgagaacctggagtctcagtctgccttgctggagaatgacgagaaagatgaggaggacatgagcctggattctggcgacgaaatctctcatatcgaagtgtgctccaattttcacagcgagatctgggaaaaggagacgaaagggtcaagaggaacagaccaaaaaaagaacacacagatcgagctgcaaagcagccctgatgtacagaattcgctcctggaagacaagacctacctcgattcagaagagcgcacatctatcgacatcgtatgcagcgaaggtgaaaactctaattcaaccgaacaggattcgtactctaactttcaggtttaccactctcaattgaatatgtcgcatcaattctcacactttaatgttctcacacatcagacatttctgggtaccccctatgccctctctagcagtcagtcccaggagaacgagaattacttcctttctgcgtatacagagagccttgatcgggataagtctcctccgccgttgagctggggcaagtccgacagctctcggccatattcccaggagaagtag

SEQ ID NO: 29855 - DNA, 7293 bp, Artificial Sequence
  Description of Artificial Sequence: Synthetic coding sequence
atggcaccaccagcacacaaaagtatcctcgaacggagcgagaatgtcctgatgagtccatggaaaggcaagctgattgtgcaggatcgtatgttatgtgacatcgctctttggtctacttacggagcgatgatcccaactcagctcccacaggagctggacttcaaatatgttatgaaagtgtcctcccttaagaagcgactccccgaagctgccttcagaaagcagaactatctggaggagaaggtgtgtttccaggacctctgcttcaacctgtacgaggtggaactctcaaataggcaaggggaaaacattgacaagttgaccgaatgcataaagaacaagcagttagctatcatcaaatgcctcgaggatagagggtttttcatccttctgacgtcctccgccctcttgagcgaacccgatttcggcggcaaacagatggggcttcatggcctgcacctctttaggtctccattaagcacgggagtcaaagaccttaaggtcgaagatgatatctccatgaaagttatccccatactctcaaccctgaattgcgctctccttgagacaaagaaaagcctgcccgaggaacgcatccatcctaacaccttggttaagaggcattttcaggaattatacaaggccgacaggtcgccgtccctgtctgtcgcacctcaagatcggatgaaagatcctacgtttctgggcaagctgcccagcggatttgatcttatcccaccagctgagaaatgtccctccgagagcttgacacagctgaactcttacttcagcgacccctctgcctacatcttggaggtgagtactgcacttgatctgctggccgaacatccccaatcaccctgcgtgagcgatggtatttgtgacgccgggttctctctggtgatgactccggatcccgagttcttagtctccgaagccgaagtcaggaaagaaactgaaacaaagaaagatagcgaagagatgctcaaggccaagaagcgagtctttccactcagccccgcttctaacctgcgcgtacagcccaagcgcaaagcatctatgcctcacatggtgcagtctaaaaaggtgaacctttgccggccatttcctaagaggactgcgtcgcgggctgacaactcttccgactcacctacaacactgaaactagtgaagggacagtttccacagaagcggaaacgaggagccgaagtgttaactgcccagttcgtgcaaaaaacaaagttagacaggaagaatcaggaggctcccattagcaaggatgtgccagttcctaccaacgctaagagagcgaggaagcaggaaaaatctccagtgaagactgtgccgagagcaaagcctcctgtgaaaaagagtcctcaaaaacagcgggtcaacatagttaagggaaacgagaatccaaggaacagaaagcaattgcagcctgtaaaaggggaaacagctagcaaactgcagtccgagatctcccgggggtgccaggaggatgggatatcgataaactctgtgcaacctgaaaacacaactgcagcccacaatgacctccctgaaaactcaatcgtaaattatgatagccaagctctgaatatgctggccgacctggccctgtcaagtgccacctcctctacacccgtgtctgaagctcggaatctccactgctccagcgagctgccccaaaacgatgtgcttctcagtaaggagaattccctgagaggcactagtgatcacgaataccacaggggagttaagacacagaagggcgagcttttgcctaaccccagttccgatagaaagagcaactcgggatcagatctcactgtgtctcaggacgaggaaagccttgtaccatgtagtcaggcacccgccaaggcccagagcgccttaacagaagaaatgctcgagtcctctgacgcgtctcagtccagcagcgtgagcgtggaacattcctacgctcttcttctaacggagcactctaaaaaacatctccaggagagggagatcttgtctcccctgtttccccgtaatggtaccaaatcacctgaggcggcaacccccgtcggaaaggtaatgccctttagacaccagcccggcctcttgctccagcagaaaccccctgatgatcccgtggtcaagcctaaagaccggcccccatcagccagggtgaaaaagtcttcttgcagtcggattgtgcttagttgcgacgattccgtgaaaatcacatttaagtgtgagactgagtatgccttttccttggattctaagtacacaaataaccccctggagaagaccgtggtacgcgccctccatgggccatggaatacagaccttccagacaacgtggaagaggtgaaactgctcctgcatatgtgggtggccctgttttactccaaccagaacaagatcatcagaagctcaaggaaggttgtggagcatagcaaccccgctaagtacgtgtccattaactccaccctggaaagctgcgaactcagggagattgaggaatctctcgggctcgagaagtgttccgctgactcacttcttgaaactaatgaaataagcagggcgcatgctgcagaagtgagctttagagaccccaactgcctcttgccattcataaagacgcctctgacacagggcctggaactctgcgtgcaaaatgaacagaaaaagaccttcgccagggagtgtgatccggacactcaggaggaccagaacttcatctgtagttacaataatgaagttaccggggaggaggccaagcaagagagcttggagacctcaaacctggtgctgtcaggcatcggttcgacacagactaatgggcctagtgtgcccagcgaagaggagattgtgcagcctttggatagcacgcgggtcgctagctactctgggaccgtgactcaggcaaccttcactcgcacctacgatggacccggaagtcaaccagtgatctgccagagttcggtgtatggaacattggagaataaggtcgacattctcgatgcggcggtgcagaccaagaccggaacactgcaggacttgatccaacacgggtctccgattaacaatgaatgtcacccatctctggagcgcaaagacgacaacatgggatgcgccgtgatcaatcctgagcctattacactgaccttcgagaagaatgcccatgtgcctattcagactgagggagtcaacacagccgatgagagaaccacattcaaaaaagagttgatcaagcaagtttctccagccgcgagcctgcggcacccggtatccaccagtgaaaacgcccgtacgcagggtcttcgcgatattcccagcttagtggtcgccgggcagaagggcacaaagtacctctgtgcctcttctgtggggggggaaactctggacaaagctgtctgttccctgcagaaggaaacccccctgccagttagcctgccttctgataagacaatggtgatggaggcgttatcattggccaagagctcttcccacctctctccttccgaagaagtgaggtgtactcaggactttctgtcgcagacccagtccttgttaggactctcttccgagggattacttgagctgacacaggtggaggtagatagctcttccgccagcactacgctgggtcggcagtgttccttaaactgtatcagttccggctgtcatacttcaggcgattcactggagctgcggaagaatcacaagaacggcccgaacactgagaacatgaacttggaagccttcgactccgtgttcatcaagcagacgtctctatctgtcagtagagaggtcagccttgagctgtcagaggaagatagtgacattgacctggccttgaccatcagtccacccactagcccaagagaagagatgcccgccggagaaattgaacaatttgaagaggctccgttctccaaccttgagttgcaggacgtcgccgaggagataggggaacctgaggaggtggctttgacagaatctagagaggtgtcttcagccgataatgtgtccgtgtacccctcagtctccgaggaacccgtagagaacaaggaaaggaagggagataatcttcagccagttaccctgattctctccaaagagaattgtactctcgagatcgcggaggaaattaacgtgacctccgattttcccttcgactctgtgattgaggaggttagtcccgcaagttcacccgagcctccggttcccgtcaaggagacgcgcccctatcaggccgtaacaccatgtattctgaagttgcatggcacccagtgtgagaaaagcaatcagataagccagtgcgagtcggaagatttgggaatcaccgagaaagaaaacgtatttgtcggacctacccaccccgtggggcaagacaatttcacccaggtacagcaaatgcaggttagcgccgaaatgccactgatcctaaccgatcaccccggccgcaccgggcgaccaacccttccaggaaaggtgacagaagaaatagtcagctccgagcacgatgaaggtttgtcttttagcggaaaggtacagtgctatggccgtgagctcaaccagcccgcctccgctgcaaagtgcactggcgactttagccctagccctgagaagctggtcaaatcgggcaaccccctccaacccgtgagcatagagaacagaaatctcgatctgaagcaccttgtcctggagtcttcagaaccaccattcgggcctaggaatgtgatcgagaataagagcttgagcgatacattggtgagcactaccgcaccgtcaggtattgtgaatgtgtccgttaagcagcagaccagccccaaaagttcccagaatcacctgtttcccggagaccttaagacagacgaaggaatttacctccaagtgaaaagcttaacggccgcctccgtggacggggcttatagtacacaagggtgcatgtgcagcgtagttcccacactgtgctcgagcagcgacaatgcgaccctaacccactatgtgaggcctataaatgcagagccggtcttccaggcacaggaaatcccggccgggagaatggcctccctcctaaagaacggcgaaccagaggcagagttgcacaaagaaaccaccggacccggaactgcagggccacaatcaaatacaacctcttccctcaaaggcgagcggaaagctatacatacgctccaggacgtttcaacatgcgaaacgaaggaactgcttaacgttggagtcagttcgttatgtgctgggccctaccagaacaccgctgacaccaaggaaaacctgagtaaggagccattggcatccttcgttagcgagagcttcgatacatccgtgtgtggcattgcaacggagcatgtcgagatcgaaaactcaggcgaaggactgcgagcggaggcagggtctgaaaccctgggccgggacggggaggttggcgtgaactcagacatgcattacgagctgagcggagacagcgatctggacctgttgggcgattgtcggaaccctaggctggatctcgaggattcctacactcttcgagggtcctacactaggaagaaggacgtgccaacagatggctatgagtcctccctgaactttcataataataatcaggaagattgggggtgtagcagttgggtgcctggaatggaaacatccctgccgcccggacactggaccgccgcagtgaagaaagaggagaaatgtgttcccccgtacgtacagatcagagatcttcatgggatcttgaggacttatgctaatttcagtattaccaaggaactgaaagatacaatgagaacctcccatggacttaggcggcaccccagttttagcgccaattgcggcctacctagctcttggacatccacctggcaagtggccgatgacttgacacagaacaccctggacttggaatacctaaggtttgcacataagctcaagcaaaccattaaaaacggagattcacagcacagtgctagttcagctaacgtgttcccaaaggagtcaccaacccagatctcaataggcgccttcccctccacaaagatctcagaggctccttttctccatccagcccccaggagcaggtctcctctgctggtgactgtcgtcgagtcagatccacggccccaaggccagccacgaaggggatacactgctagctcactcgacagttcatcatcatggcgggagagatgctctcacaatagggacctgcgtaactctcagcggaaccacacggtgagcttccatctcaacaaactgaagtacaattccactgtgaaggaatctagaaatgatatctctctgatcctcaatgagtatgctgaatttaataaggttatgaaaaactctaaccaattcatctttcaggataaagaactgaacgatgtgagtggcgaggcaactgcgcaagagatgtacctcccatttcctggtaggagtgctagctacgaagatatcattatagatgtttgcacaaacttacacgtgaagcttcggagcgtggtgaaagaggcatgtaagagcacttttctgttctatctggttgagaccgaagataaatcattttttgtgagaactaaaaacctgttgcgtaagggcggtcacacggaaatcgaaccgcagcatttttgccaggccttccatcgggaaaacgacaccttgatcatcattatccgcaatgaggatatctcctctcaccttcaccagattccgtctctgctgaaattaaagcatttcccgtcagttatattcgcaggagtggacagcccgggcgacgtcctagatcacacttaccaggaactgttcagggctggcggctttgtgatatctgacgacaaaattttggaagcagtcacgttggtccagctgaaggagattatcaagatcctcgagaagctaaacggaaatggccggtggaagtggctgctacattatagggaaaacaaaaaactgaaggaggacgagagagtggattcaactgctcacaaaaaaaatattatgctgaagagcttccagagcgctaacatcatcgaactgctgcactaccatcaatgtgactctcgtagctccacaaaggccgagatattgaagtgtctgttgaatctgcagatccagcacatcgatgccaggtttgctgtcctgcttactgacaaaccaacgattccccgggaggtcttcgagaactctggcatcttggtgaccgacgtgaataacttcatcgagaacatcgaaaaaattgcggccccctttaggagttcgtattggtag

SEQ ID NO: 29856 - DNA, 4878 bp, Artificial Sequence
  Description of Artificial Sequence: Synthetic coding sequence
atggctccaccagcccacaaaagcattttagaacggtccgaaaacgtgctgatgtctccttggaagggcaagctgatcgtccaggaccggatgttatgcgatatcgcactgtggtcaacctacggagccatgatccctacacagctgcctcaggaattagatttcaaatatgtcatgaaagtgagtagtcttaaaaaaagactcccagaagccgctttccgaaagcagaactacctggaggaaaaagtttgcttccaggatctgtgctttaatctgtacgaggtagagctgtcaaatcgccagggggagaatatcgacaagctgaccgaatgtataaaaaataagcagctagccatcatcaagtgcctcgaggatcggggtttttttatcctgcttacatcatcagcactattgagtgagccggatttcggtggcaaacagatgggacttcacggtttacacttatttagaagccccctgtctactggtgtgaaagacctgaaagtggaagacgatattagcatgaaggttattcctattctatccaccctgaactgtgccctcctggagactaaaaagtctctgcctgaggaacgaatccaccctaacacgctggtaaagagacattttcaggagctttataaggcagatcgatctccctcccttagcgtggctcctcaggaccgaatgaaggaccccactttcttaggaaagctccccagcggtttcgaccttatcccacctgctgaaaaatgccctagtgagtcactgacacagctgaatagctacttcagcgatccttcagcatacatcctggaagtgagtaccgcacttgacctgcttgccgagcacccgcagagcccgtgtgtgtccgatggaatctgcgacgcgggatttagtttagtcatgacaccagacccagaatttctcgtgtccgaggcagaagttcggaaggagaccgagacgaaaaaagattctgaagagatgctgaaggccgtttgtagcctccaaaaggagacacccctgcctgtgtctctgccttccgacaaaacaatggtcatggaggctctgtctctggcaaaatccagttctcacctgagtcctagcgaagaggtccgctgcactcaagattttctgtctcagactcagtccctactgggtctgtcctctgaaggtctgctcgaactgacacaggtcgaggtcgacagtagttcagcatcaacaaccctaggacgccagtgttctttgaattgcatcagtagtggatgtcacaccagcggggacagcctcgagctgcggaagaatcataaaaacgggcctaacaccgagaacatgaatttggaagctttcgacagcgtcttcattaaacagacgtctctgagcgtatcacgcgaagtttctctggaactctccgaagaagactccgatatcgatctggccttgacaatatcccccccaacttcaccacgcgaggagatgccagctggggagattgagcaattcgaagaggcccctttttcaaatctggagctacaggatgttgctgaagaaataggcgaacctgaagaggtggccctcactgagtctagggaggtcagttctgccgacaatgtgtccgtatatccatcagtcagtgaagagccggtcgaaaacaaggagcgcaagggcgacaacctgcagccagtgacactcatattgtctaaagagaattgcaccctagagatcgctgaggagattaacgtgaccagcgattttcccttcgacagcgtgattgaagaggtctcccccgcctccagtccagagccaccagtaccagtgaaagagacaagaccctatcaggctgtgaccccatgcatcctgaaactgcacggaacccaatgcgagaagtctaaccaaatttcacagtgtgagtctgaggatctcggaatcactgagaaagagaacgtctttgtaggacccactcatccagttgggcaggacaactttactcaagtccagcagatgcaagtgtcggccgagatgcccctcatcctgacagaccacccggggaggacaggtaggccgacgctccctggcaaagtgactgaggaaattgttagcagtgaacacgatgagggtctatcattctcaggaaaagtgcagtgctacgggagagagctcaatcagccagcgtccgcggccaagtgcaccggagacttttccccttcgccagagaagttagttaagtcgggaaacccactgcagcctgttagcatcgagaatcggaacctggacctgaaacatctggtcctcgaatccagtgagccaccgtttggcccccgaaatgtgatcgaaaacaagagcttgtctgacactctggtatctacgaccgccccttctggaatcgtgaacgttagtgtgaaacagcagacctcacctaaatctagccagaatcatctgtttcccggggatcttaagaccgacgagggcatctatctccaagtcaagtctctgacagccgcctccgtggacggggcctactccacccaagggtgtatgtgcagcgtggtccccaccctctgcagctcttctgataacgccacgctgacccactacgtaagaccaattaatgcagaacctgtgttccaggctcaggagataccagccgggaggatggcctctctcctgaaaaacggcgagcccgaggccgaacttcacaaagagacaacaggcccaggaacggcaggacctcagtcaaacacaacgtcaagcctcaagggcgagcgcaaggccatccacaccctccaggacgtgtccacatgcgaaaccaaggaattactcaatgtcggcgtaagcagtctgtgtgccggaccttaccagaacaccgccgatacaaaagaaaatctttccaaggaaccgcttgccagctttgtcagcgagtcttttgacacatctgtatgcggaatcgcgactgagcacgtggaaatcgaaaactccggcgagggactccgcgcagaggctggcagcgagaccctgggccgggatggtgaggttggcgtgaactctgatatgcattacgaactctccggggacagcgatctggacctgctcggggattgccgaaacccaaggctagatctggaggattcgtacactttacgcgggagctatacaagaaagaaggacgtcccaaccgacggatatgagagttccctgaattttcataacaataaccaagaagattggggatgcagctcctgggttcctggcatggaaacaagtctgccacctggccactggaccgccgctgtaaagaaagaggagaaatgcgtccctccctatgtgcagattcgcgaccttcatggcatattgaggacatacgccaacttctccataaccaaggagttgaaagataccatgcgcacatcgcatgggctgcggcgccatccgagtttctccgccaattgtggattaccctcatcatggacctcaacctggcaggtcgctgacgacctgacccagaatactctcgatctagagtacctgaggtttgcgcacaagcttaaacaaaccattaaaaacggggattcccagcattccgcttcttctgcaaacgtcttccccaaggagagtccaacccagatttcaatcggtgccttcccaagcactaaaatcagtgaagctccatttctgcatccagcaccacgcagccgctcccctctcctggttaccgtcgtagagtctgatcctagacctcagggccagccacgacgcggatacaccgcctcctctctggattcctcgagcagttggagggagaggtgtagccacaaccgcgatctcaggaatagccaacggaatcataccgtatcttttcatcttaataaacttaaatacaattcaaccgtgaaggagtcccgaaatgacattagtctgatactcaatgaatatgctgaatttaataaggtgatgaaaaactcaaaccaattcatttttcaggataaggaacttaacgacgtctctggagaggcaacagcgcaggaaatgtacttacccttccccggacgatcggcgtcgtatgaagacatcatcattgatgtgtgcactaacttgcacgtgaagctccgcagtgtcgtcaaagaggcctgcaagtcgacctttctgttctatctggtggagaccgaagacaagtcatttttcgtgaggacaaagaaccttctgcggaagggcggccacaccgagatcgaaccccaacatttctgtcaggcttttcaccgggagaacgataccttgattatcatcatcagaaacgaggacatctcgagccatttgcatcagatcccgtccctcctgaagctaaaacactttcccagcgtcatatttgcaggggtagattcccctggcgatgtgcttgatcacacctaccaggaactcttcagagccgggggatttgtcattagtgatgacaagatacttgaggccgtgacactggttcagttgaaggaaattattaagattctggaaaaactgaacgggaacgggcggtggaaatggctgctacactaccgcgaaaacaagaagcttaaagaagacgagcgggtggacagcaccgctcacaagaaaaacattatgctcaagagctttcaaagcgcaaatatcatagagctgctgcactaccatcaatgcgactcccgctcaagtaccaaggccgagatcctaaaatgcctgcttaacctccagattcagcacatagacgctagattcgctgtgctgttgactgacaaaccgactataccgcgtgaggtgttcgaaaattcaggtattctggtgacagatgtgaataacttcattgagaatattgaaaagatcgccgcccctttcaggagcagctactggtag

SEQ ID NO: 29857 - DNA, 27 bp, Artificial Sequence
  Description of Artificial Sequence: Synthetic coding sequence
atggcacccccggcccacaagagttag

SEQ ID NO: 29858 - DNA, 639 bp, Artificial Sequence
  Description of Artificial Sequence: Synthetic coding sequence
atggggaccagacagactaagggttccctcgcggagcgcgcctcaccaggagctgctcccggacccaggagggagcgtccagacttttgggcatcattacttctcagagcaggggataaggccggccgggctggcgctggaatgcctccgtatcatcggcgggtgggcatggtgcaggagctcctgaggatggtcaggcaggggcggagggaagaggccggtaccctgctccagcatctgagacaggatctagggatggaaagcactagtttggacgatgtgctgtatcggtatgcaagtttcaggaatctggtcgacccgatcacccatgatctcatcatctctctggccagatatatccactgccctaaaccgcctcaagggtgtccaggcagaaagcccccccggcaacacagcgggccagtgggcaacccgactgacctccctcggcccggggcgggcgaccagctgcccacggccctgtggggagctggtaggcagcgcggcgcgggattgcatagaccccatggcagacacgggcccgcagccgccgccagcacccagcaccctgctccccctcaccataccggaactcagtggcagccggtcgaccccggaagggctgctagacctcattag

SEQ ID NO: 29859 - DNA, 1035 bp, Artificial Sequence
  Description of Artificial Sequence: Synthetic coding sequence
atgggcacacgccagactaaaggctcactggccgaaagagcgtctcccggcgctgctcccggccctaggagagagaggcccgacttctgggctagtctgcttctacgggctggagataaagcgggtcgtgctggggccggaatgccaccgtaccacaggcgtgtgggtatggtgcaagagctcctacgtatggtgaggcagggcagaagagaggaagccgggacactgcttcagcacttgcggcaggatttagggatggagtccacttccctggacgatgtgctttatagatatgctagcttccgcaatctcgtggatcctatcactcacgatctgatcattagtttggcccggtacatccattgtcctaagcccgaaggcgatgctctgggagctatggagaagctgtgcaggcagttgacgtatcatctctccccacactcccagtggagacggcatagaggcctagtcaaacgaaaaccccaagcgtgtctcaaggcggtcctcgctgggtcgccccctgacaacacagtggatctgagtgggattcctctgaccagtcgagacctcgaacgtgtcacatcatacctccagcggtgcggagagcaagtcgactctgtcgaattgggttttacaggtctaaccgatgacatggtgctgcagctactccccgccctgtccactctgcccaggctcactactctggctttaaatggaaatagactgacccgggccgtcttgagagacctcacggacattttgaaagaccctagcaaattccccaacgtcacttggatcgatttggggaacaatgtggacatattcagcctcccccagccctttttgctgagtctcaggaagaggtctccaaaacagggtcacctgccaactattttggagttgggtgagggaccgggcagtggcgaggaggttcgcgaaggaaccgtggggcaggaagacccaggaggtgggcctgtcgctcctgctgaagatcaccacgagggcaaggagacagttgctgccgcacagacctag

SEQ ID NO: 29860 - DNA, 948 bp, Artificial Sequence
  Description of Artificial Sequence: Synthetic coding sequence
atgggcgcccggttaggccggcgggctggccccgaggcgggtagcgaagcgggcgccgcagcaggctgtggcccggcaccctacgagcggcgggtgcgctggcttagagaaatccagtccactctcagagaacgtcgtccggagcgcgctcgacaactgttgcgtttactgcgacaggatctgggcttggaaagaaccctgctcccggacattttatacagggacgtcgcctttctgaaccctgtcgatccaatcagtcacgatcttctggtaaatctcgcacgggatctccagtgtcctaaaaaggattacgaactctggaagagctctgataagatctgcaggcagctgatctaccacctcactccacactccaagcagcagcagggatctagtctccgtcagcgtaaaacacagagttgcttgaagtcctctctgcagaaaacactactggctggggaaaccgttgatttgtctggaattccactgtctacacaagatgtgcagcacataacgaggtaccttagttctcacggcgcagtgttggcagtgctggacctgagtttcaccggcctgtcagatgaactgctacacctgttgctgcccagcctctgggctctacctcgcttaactcagctcctgctgaatggaaatagattaactcgggcaactgccaggaagctgactgacgccattaaggatactacaaagtttccggctttggcatgggtggatctggggaataacgtcgatgttgcttccctaccccagcctctcttggtcggtttaaggaggagactctctcagaggacttccttgcctactatctatgagggcctcgatctggagccagaaggcagtgcggctggggctaccacgcctgcctccacgtgggattcgaccgctgccgggctcgggccagaaccccaggcctgttgcgcacgctag

SEQ ID NO: 29861 - DNA, 864 bp, Artificial Sequence
  Description of Artificial Sequence: Synthetic coding sequence
atggacatgcatagtgctcgacttgatagctttctctcgcaattgcgttgggagctgctgtgtggaagggataccggaagtccatctatgcccggccctttgcagcccacctcccagactgggccagacgtccagcccagtcatcagttgagggcatcaggtgctttagaagaagattccgtctgttgtgtcgaggaggaggaggaggaagaagaagaagccgtcgtcaccgaggaccgggacgctgcactgggagggcctagggaacacgccctagactgggatagtgggttctctgaggtctccgggagcacatggagggaggaagaactcccagtcagtcagcgtcctgcaccatctgctcagcctttaagaaggcagtgtctgtctgtgagcggccttcctatgccctcaagagccccagtcgcctccgtgccacctgtgcaccatcctcgcccgaaatctacacccgatgcatgtctggagcattggcagggtctggaagccgaagactggactgcagccctgttaaaccgcggtagatcccggcagccgttagtgcttggcgacaactgcttcgcagacctcgttcataactggatggaattacccgagacgggatctgaagggggcgatggcggtggacatagagcgagggcgcgccctcctcagtttttgctgggactgtcagaacagcttcgtaggaggttggcaagagcacgccgaacggcaatggccgggaagcgcctaagttgtcctcctagacccgaacccgagctacctgctgacgtgagccggttcgcagcgctgatgtcctgccgatcaaggcagccaataatctgcaatgacgtgagttacctatag

SEQ ID NO: 29862 - DNA, 894 bp, Artificial Sequence
  Description of Artificial Sequence: Synthetic coding sequence
atgactatggagtctagagagatggactgctatctgagaaggttgaagcaggaattgatgagcatgaaggaggtcggcgatggcctgcaggaccagatgaactgcatgatgggagcactgcaggaactgaagttgcttcaagtccaaactgcgttagaacagcttgagattagcggaggaggtccagtgcccggatcccccgaagggcctaggacgcagtgcgagcacccatgctgggagggcgggcgcgggcctgcccgccccaccgtctgctcccccagttcccagccctcactaggatcctcgacaaagttcccatcccatagatcggtgtgtggaagggatctagcacccctgccaagaacacagccccaccagtcatgtgcccagcagggtccagagagagttgagcctgatgattggacctccactcttatgtcacgaggtaggaataggcaacctctcgttctgggcgataatgtcttcgctgaccttgtaggaaattggcttgacctccctgagctcgagaaggggggcgaaaaaggcgagaccggtggtgctcgcgagcccaagggggagaagggacaaccccaggagttggggcgccggttcgctctgactgcgaatatcttcaaaaagtttctgcggtctgtgcgccccgacagagatagactgctgaaagagaagcccggatgggtgacccccatggtgcctgagtcaagaacaggacgctctcagaaagtcaaaaaacgatcactgtccaaagggtcagggcattttcccttcccggggacaggggaacacagacggggagaaaatcctcccacgagctgtcctaaagcattggagcacagtccgagcggcttcgatattaatacagcggtatgggtctag

SEQ ID NO: 29863 - DNA, 849 bp, Artificial Sequence
  Description of Artificial Sequence: Synthetic coding sequence
atgaggcagttgatgtctatgaaggaggtcggcgatggcctgcaggaccagatgaactgcatgatgggggctctgcaggagctgaaactgttgcaggtgcagacagcgttagagcaactggagatctctggcggcgggcctgtgccaggatctcctgaagggcccagaactcagtgtgagcatccttgctgggaggggggccgagggccggcccgccccaccgtgtgttccccaagcagtcaaccatcgctggggtctagcaccaagttccccagccacaggtcggtatgcggtcgggacttagcccccctgcccagaacacagccacaccagagttgtgcacagcaggggccggagcgggtagaacccgatgactggacctccacactaatgagccgggggcgtaaccggcagcctcttgtgttgggggacaatgtgttcgctgatctggtgggcaactggctggatctccctgagctggaaaagggcggcgagaaaggggagaccggcggggccagggagccaaagggggaaaaaggccagccgcaggaactgggaagacggttcgcactgaccgcaaatatatttaaaaaatttctgaggtcagtgagaccagaccgggaccggctgctgaaagagaagcccggatgggtcacccccatggtgcccgagagcaggaccgggcgatcacagaaagtgaaaaagagaagtctgtcaaaaggctcaggacattttcctttcccaggtacaggcgagcatcggcggggcgagaaccctccgaccagctgccccaaggctctggagcattcaccctctgggttcgatattaacactgccgtgtgggtgtag

SEQ ID NO: 29864 - DNA, 3231 bp, Artificial Sequence
  Description of Artificial Sequence: Synthetic coding sequence
atgaaacctgatcgggacacactcgacgagtacttcgagtatgatgcagaagagttcctggtcagcctggcgctgttaatcacagaaggtcgcacccctgagtgttctgtgaagggtcggaccgagagctttcactgcccgcccgctcagtcatgttaccctgtgacgactaagcacgagtgctccgacaaactggcgcaatgccggcaagccagacgcacaagatctgaggttacactgttatggaagaataacctccccattatggtggagatgatgcttctgcccgactgttgttactccgatgacggccccacaacagagggaattgatctgaatgatcctgctattaagcaggacgctctgttattagagcggtggattctggagcctgtgccccgtcagaacggagacagattcatcgaggagaaaactctcttgcttgcagtgcgctcatttgtcttcttctcccaactgagcgcctggttgtccgtttctcacggggctatccccaggaacattctttatagaatctcagcggctgacgtggatctacagtggaacttttcgcagacaccaatcgaacacgttttcccggtgccaaatgtgagccataatgtggccttaaaagtgagtgtacagtctctgccacgccaaagcaattaccccgttcttacctgttcaattcataccaatatcgggctttatgagaaacgcatccaacagcacaagctgaagacacaccagcaccacaatccaaacgaggcagagcagtgcggaacaaatagcagtcaaagactctgctctaaacagacctggaccatggctcctgagagtgtcctgcacgccaagtcaggacccagcccagagtatactgcggccgtcaaaaatatcaagctgtacccaggcacaggcagcaagagcgaccacgggacctcacaggctaacatactaggcttctcaggaatcggcgatattaagtctcaggagacgtccgtgcggacactgaagagtttctctatggtggattcatccatctctaacagacagtccttttggcaaagtgcaggcgaaactaatcctctgatcggaagtctcatccaggaacgccaggagattatcgccagaattgctcagcatctaatccactgcgacccttcgacctcccatgtgtcaggcagacctttcaacacacaggaatcctcctccctgcactccaaactcttccgggtctctcaagagaatgaaaatgtagggaaaggaaaggaggctttctcaatgacattcggttcccctgaatttagctccccagaagacaccaatgagggaaagattaggctcaagccggagactccgaggagcgagacgtgtatttcaaatgatttctactcccacatgcccgttggagaaacgaacccccttattggatccttgttgcaggagaggcaggatgtgatcgcacggattgctcagcaccttgaacacattgatccaaccgcttcgcacattcctagacagagttttaacatgcatgactcctcttccgtggcaagtaaagtctttaggtcctcctacgaggataaaaatcttttgaaaaagaacaaggatgagtcctctgtgtcaatttcgcataccaaatgctcactcctaggagacatcagcgatggaaaaaatctggtccccaacaagtgtttcactagctttaagaataactcgaaagagaagtgtagtttgaaacaccagactagaaaccagtgccaaaataacccctctgagattatccagagcacgtatcaggagacccagaacaagtcttcttctctgagtacaagctctatcctctcgcagcacaaggagaacaatctggatctgacaagtaggtttaaggagcaagagatgtccaacggcattgataaacagtattccaattgcacaacaatcgacaagcagatttgtactaataagtacaaggagaaaataatcaacgaaaactataatccaaagttctttgggaacctccagtccgatgattccaagaaaaacgacagcaagattaaggtgacagtccttgagatgtctgaatatctaaacaagtacgaaagcatgtcttcgaataaagattccaaacgaccaaagacgtgtgagcagaatactcagttaaactctattgaaaactatcttaataaggacaatgagggctttaaatgcaaaaagtctgaccaattgaagaacgaacaagataagcaggaagatccaacaaatgaaaagtcccagaattacagtcagagacgcagcattaaagactgtctgtccacatgcgaacagccgaaaaacactgaagtattgcgtaccacactgaagcatagtaatgtgtggcgtaaacataatttccactccctggatggaacctccacaagggccttccatccacaaacaggtctcccgctcctgtcaagccctgtgccacagcgtaagactcagagtggatgctttgatctggacagcagcctcctgcacctgaagtccttttcctcccgctccccacggccctgcctcaatattgaggatgatcctgatatccatgagaaaccattcttaagcagtagtgctccaccgataacctccctgtcattactggggaacttcgaggagtcagtgctgaactacagatttgaccccttgggcatagtggatggattcacggctgaggtcggcgccagcggagctttttgtcccacccaccttacgctccctgttgaggtaagtttttactcagtgagtgatgacaatgccccttcgccttatatgggggtcattacgctagagagtttgggtaagagaggatatcgggtacctccttcaggtaccatccaggtgacattgtttaatcccaataaaaccgttgtgaagatgttcgtcgtcatctacgacctgagggatatgccagcaaatcatcagacctttctgcggcaacggacgtttagcgttcctgtcaagcaggaggtgaagcgcagtgtgaataaggagaacattcgccacacagaagagagattacttagataccttatccacctgaggtttcaaagctcgaagagcggcaagatttaccttcatcgagatgtgcgactcctgtttagtaggaaaagcatggaggttgacagcggggctgcctacgagctgaaatcctacacggagtccccaactaatccccagttttcaccccgttgctag

SEQ ID NO: 29865 - DNA, 3231 bp, Artificial Sequence
  Description of Artificial Sequence: Synthetic coding sequence
attaggccgcggtcagacacactggacgagtacttcgaatatgacgccgaagagttcctcgtgtcactcgcactgctgattaccgagggccgaacacctgagtgctccgttaaagggcgtactgagtccttccactgccctcctgcccagtcctgctatcccgtgactaccaagcatgaatgttcagataagctggctcagtgcaggcaggctaggaggacccgctcagaggtgacgttactctggaagaataaccttcctattatggtggagatgatgctgctccctgattgctgctacagcgatgatggtccaacaactgaggggattgatctgaacgatcctgctatcaaacaggacgccctcctgctagagaggtggatactagagcccgtgccaagacagaacggagatcggttcatcgaagagaagacattgctgcttgccgtcagatcttttgtgttcttttctcagctcagcgcctggctgtctgtctctcacggtgcgatccccagaaacatcctttatagaatctccgcagccgacgtggacctacagtggaattttagccagacccccatagagcacgtgtttcccgttccaaatgtctctcataatgtcgcactgaaggtgtctgtgcagtcactgccacgtcaatctaattatcctgttctcacttgttcgattcataccaacataggcctgtatgagaaacggattcagcagcacaaacttaaaacgcatcagcaccacaaccccaacgaggctgagcagtgtggaacaaattctagccagcgattgtgctccaagcaaacctggacaatggctcctgagtctgtccttcatgccaaaagcggtccctcaccagagtatacagctgccgtgaagaacatcaagctgtatccagggaccggaagtaaaagcgatcacggaacctcacaggctaatatcctcggattttctggtatcggagacattaaatctcaagaaacatctgtgaggaccctgaagagttttagcatggtggatagcagcataagtaacaggcaaagcttttggcagagcgctggtgaaaccaatcccctcatcggctcactcattcaggaacgccaggagatcatcgctaggatcgcccagcacctaatccactgcgacccctccactagccacgtaagcggcagacccttcaacactcaggagtcttctagtctgcacagcaaattatttagagtgagccaagagaacgaaaatgtcggaaagggaaaggaagccttctccatgacttttggaagccccgagttctcaagtcccgaggacactaatgagggcaaaattcggctgaaacctgaaactcccagaagcgaaacctgcataagcaacgacttctatagccatatgcctgtcggcgaaacaaaccccctcatcggcagcctcctgcaggagagacaggacgtaattgcacgcatagctcagcacctggagcacattgaccccacagcgtctcatataccaagacagtcctttaatatgcatgattcaagcagcgtcgccagtaaagtgttccgatcctcctacgaagataagaacctgctcaagaaaaacaaagacgaaagtagcgtaagcatttcacatacgaagtgctccctactcggagatatatcagatggcaaaaacttggtgccaaataagtgttttacctctttcaagaacaatagcaaggagaagtgttcactcaaacaccaaactcgaaaccagtgtcaaaacaacccttccgaaatcatccaaagcacttaccaggagacccagaataagagctcctcactttcaacttcttccatactcagccagcataaggaaaataacctggacttgacatctaggtttaaggaacaggagatgtccaatgggatcgacaaacagtactcgaattgcactacaatcgacaaacagatctgcacaaataagtataaagaaaaaattataaacgaaaattataacccgaagttctttggcaacctgcagagcgacgactccaagaaaaatgactctaagatcaaggttacagtccttgagatgtctgagtatctgaataagtacgaaagcatgtcctccaataaggactctaagcggcccaaaacctgtgagcagaacacacagctaaatagcatcgagaactatctgaacaaggacaacgaaggcttcaagtgtaagaaatccgatcagctcaaaaatgagcaggacaagcaggaagatcccacaaatgaaaaaagccaaaattactcccagcgacgatcaattaaggactgtttgtctacttgtgaacagcccaaaaatacagaggtccttcgtacaacactcaagcattccaacgtctggaggaagcacaattttcatagtctggacggaacgtcaactcgagctttccaccctcagaccggtttaccattgctctcaagccccgtcccccagcggaaaacgcaatcagggtgctttgatctagacagcagcctcctccacttgaaatcattcagttcccgatcaccacgaccatgcctgaacatcgaggatgatccagacatccatgagaaacccttcctgtcttcctctgccccacccattaccagtctgtcattgctagggaatttcgaggagagtgtgctgaactatcggtttgatccattggggatcgtggatggcttcaccgcagaggtgggcgctagcggggccttctgccccacacacctcaccttgccagttgaagtgtctttctatagcgtttccgacgacaatgctccatcaccctatatgggagtgatcaccctggaatcactgggcaaacggggatacagagttccgccttcaggtacgatccaggtgaccctttttaatccaaataaaactgtggtcaaaatgttcgtggtcatctacgacctacgagatatgccagcaaaccaccagaccttcctgcgccagaggacattttccgttcctgtaaagcaggaggtcaagcgctccgtgaataaagagaacatccggcacactgaggagcgcctcctccgctatttaattcatttacgattccagtcctctaaatctgggaagatctatctgcatcgtgatgttaggctgctgttcagcagaaagagcatggaggtagactctggtgccgcctatgagcttaaatcatacactgaatcccctactaacccgcagttttccccgcgatgttag

SEQ ID NO: 29866 - DNA, 2877 bp, Artificial Sequence
  Description of Artificial Sequence: Synthetic coding sequence
cggccagacgccgataccctggatgagtatttcgagtatgatgctgaggaattcctggtctcccttgcccttctgattaccgaaggtcgtactcccgaatgcagcgttaaagggagaactgagagttttcactgcccccccgcccaaagctgttatcctgttacaacaaagcacgaatgcagcgacaaacttgcccaatgcagacaggctagacggacccgctcagaagtgactttattgtggaaaaataatctccctattatggtcgagatgatgctgttgcccgattgctgttacagtgacgatggccccacaacggaggggatcgatcttaatgatcctgcaataaagcaggacgctctactcctggaaagatggattctggaaccggtcccgaggcagaacggagatcggtttatcgaagagaaaacattactgctcgctgtccgatctttcgtcttcttctctcagctgagcgcttggttatcagtgtctcacggagccatcccacgaaatattctgtatcgaatctccgccgccgacgttgatttgcaatggaactttagtcagacacctatcgagcatgtttttccagttcctaacgtcagccacaatgtggcattaaaggtcagcgttcagagccttccaaggcagtccaactacccggtgctcacgtgtagtattcacacaaatatcgggttgtacgaaaagagaatacagcagcacaaattgaagacacaccagcatcataatcccaatgaggccgaacagtgcgggactaatagttcacagagactgtgctccaaacaaacttggaccatggcaccagagagcgtcctccatgctaagtccggaccttccccggagtatacagctgctgtcaagaacattaagctgtacccagggaccgggtcaaagtctgatcacggtacgagccaagccaatattcttggcttctccggcatcggggacatcaagtctcaggagaccagcgtccggactttaaaatcttttagcatggtggactcatcgattagcaaccgccaaagcttctggcagtccgccggggaaacaaaccccctgatcgggtctctaatccaggaaagacaggagattattgccaggatcgcccaacatctaatccattgcgatccaagtaccagccacgtttcaggtagacctttcaacacccaggaaagctcaagcctgcacagcaagctttttcgcgttagccaggaaaacgagaacgtagggaaaggcaaggaggcgttctctatgacctttggaagtccagagttttcatccccagaagacacaaatgagggaaagattagattaaaacccgagacaccccgctcggaaacttgtatctccaacgacttctattcccatatgccagtaggcgagacaaaccctttgatcggttccttgctccaggaacggcaggacgtgatcgccaggatcgctcaacacctagaacacattgatccaacagccagtcacattccccgccagtccttcaacatgcacgattcgtcaagcgtggcttccaaggtgttccggtctagttacgaggataaaaacttactgaagaagaataaggatgaatcctcagtgtccatctcccacacaaagtgtagcctgctcggggacatctccgatggcaagaatctagtgcctaataaatgtttcaccagcttcaagaacaactctaaggagaagtgcagcctgaagcatcagactcgaaaccaatgccagaataaccccagtgagataatccaatccacctatcaggagactcaaaacaaaagctcttcactaagcacgtcatctatcctttcacagcacaaagaaaacaaccttgatctgacctcaagattcaaggagcaggagatgagcaacggcatcgataagcagtactccaactgtacgactatagacaaacagatttgcacgaacaagtacaaagagaaaataataaacgagaactataacccaaagttcttcggcaacctgcaatcggatgattcaaaaaagaacgatagtaagatcaaagtaaccgtcctggaaatgtcagaataccttaacaaatacgaaagcatgagctctaataaagactcaaagagaccaaaaacttgcgaacagaatacgcagctgaactcaatcgaaaattatctgaataaagacaacgagggctttaaatgtaagaagtccgaccagctgaaaaatgagcaggacaagcaggaagatcccaccaacgaaaaaagtcagaactactctcagagaagaagcatcaaggattgcctatccacctgcgaacagccaaagaatactgaagtgttgaggaccacattgaaacacagcaacgtctggaggaagcataattttcatagcctggacgggacgagcactagggcctttcatccccagaccggcctacctctgttgtcctcaccggtgccacaaaggaagacccagtccgggtgcttcgacttagatagctctctcctacacctgaagtccttcagcagtcgcagcccacgcccttgcctgaacatagaggatgatcccgacatccatgagaagccctttctctcaagctcagcacctcctattacgagcctgtctctgctcggtaatttcgaggagagtgtattgaactatcgcttcgacccccttggcattgtggacggcttcactgccgaggtgggggcttctggagccttttgcccaacccacctgactctgcctgtggaggtgagtttctattctgtctccgacgacaacgcgcccagtccttacatgggagttatcaccctggaaagtctgggaaagagaggctatagggtaccacctagtggtaccattcaggtgtag

SEQ ID NO: 29867 - DNA, 3252 bp, Artificial Sequence
  Description of Artificial Sequence: Synthetic coding sequence
atggtgttttccggtaacaagggtcttcaccgggaggacacgctggatgagtatttcgagtacgatgcagaggaattcctagttagcctcgccctgctcatcaccgaaggcaggacacccgaatgttcggtaaaggggcggaccgagtcgtttcactgtcctcccgcgcagtcctgctacccagttaccaccaagcacgaatgctccgacaagcttgctcagtgccggcaggccagaaggacccggagtgaggttacacttctgtggaagaacaatcttcccatcatggtggagatgatgctgcttccggattgctgttactctgatgatggacctaccacagagggcattgacctaaatgacccggctatcaagcaagacgctcttttgctggagcgctggatccttgaacctgtgccccgccagaatggggacaggtttatcgaggaaaagactttgcttctcgcagtaaggagttttgtctttttctctcagcttagtgcatggctctcagtatcccatggagcgatacctcggaatatcttgtaccggatttcagctgcagacgtcgacctccagtggaatttcagccagaccccgattgaacacgtcttccccgttccaaatgtgagccacaacgtcgcgctgaaggtttcagtgcagagtctgccgcgccaatctaattacccagtcctcacctgctccattcacacgaacatcgggttgtacgagaaacggattcagcagcacaagcttaagacccaccagcatcacaatccaaatgaggccgagcagtgtggcacaaactcatctcagcgcctgtgctcaaagcaaacatggaccatggccccagaatctgtcctccatgccaagtcgggcccaagccccgaatacactgccgccgtgaagaatattaagctgtacccgggaaccggatcgaaatccgaccacgggaccagccaggcaaatatcctggggttcagtgggatcggagatattaagagtcaggagaccagcgttcgcaccctgaaatcgttctctatggttgacagttccatttccaatcggcagtcgttctggcagtctgccggtgagaccaatcccctgattggcagtctgattcaagaaagacaggaaatcatcgcccgcatagcacaacatctcatccattgcgatccgagtacttctcatgtttcgggcaggccattcaatacccaggaatcttcttcgcttcatagtaaacttttccgggtgtctcaggagaacgaaaatgtcgggaaaggaaaggaggcgttttctatgacttttggcagcccagagttttctagtcccgaagacacaaacgaaggaaagatcagattaaaacccgagacccccaggtctgagacatgcatcagtaatgatttctatagccacatgcccgtgggtgagacaaacccactcatcgggagtctgctccaggaacgccaagacgttatcgcccgtattgcccaacacctcgagcacatcgatcctaccgcatcccatatcccacgacaaagcttcaatatgcatgattcttcctcggtcgcatccaaagtgtttaggagttcttatgaagataaaaacctgctcaaaaagaataaggatgagtctagcgtgtctatctctcacactaagtgttctcttttgggggacatctctgacgggaaaaacttggtgccaaacaaatgtttcacttcttttaaaaacaattccaaagagaaatgcagtctcaaacaccaaaccaggaatcagtgccagaacaacccttctgaaattatacagagtacctaccaagagacccagaataaatcctcgagtctctccaccagcagcattctctctcagcacaaggaaaataatctagacctgacgtcccgctttaaagaacaggaaatgagcaatgggatagataagcagtactcaaactgtacaaccattgataaacagatatgcacaaataagtacaaagaaaaaataatcaatgaaaactacaatcctaaatttttcgggaacctccagtctgatgactcaaaaaagaacgacagtaaaatcaaggtgactgtattggaaatgtcagaatacctcaacaaatatgaaagcatgtcatctaataaggactctaagcgccccaaaacctgtgaacagaacacgcagttaaattccatagagaactacctgaacaaagacaatgagggtttcaaatgcaaaaagagcgaccaactgaaaaacgagcaggataaacaagaagaccccaccaacgagaagtcccaaaactactcacagaggcggtccattaaggattgcctgtcgacatgcgaacagccaaaaaacacagaggtcctgagaacgacccttaaacatagcaacgtctggaggaaacataactttcactccctagatggcactagcacccgtgctttccacccccagaccggcctgccactcctgtcgagcccagtgccccaacgtaagacccagtcagggtgtttcgatctggattcttcgctcctgcatctcaaaagcttttctagtaggagtccaaggccgtgcttaaatatcgaggacgacccggacatacacgaaaaacccttcctgtcctcaagcgcacctccaattacttcattaagccttctgggcaatttcgaggaatccgtgctaaactatagattcgacccgttagggatcgtggacgggtttaccgcagaggtgggtgcatccggggcattttgtccaacccatcttacccttcctgtggaggtttctttctattccgttagtgatgacaatgctccctctccatacatgggcgtgattacactggaatcactcgggaaacggggttaccgagtgcccccaagtggaactatccaggtcacattgtttaatcctaacaagaccgttgttaaaatgttcgtagtaatctatgatctgagagacatgcctgcgaaccaccagacctttctcagacagcggactttcagcgttcctgtgaaacaagaagtcaagaggtccgtcaataaagagaatataagacataccgaggagcgcctcctgcggtatctaattcatctgagatttcagtcgagcaagagtgggaagatatatctgcatcgagacgtcaggttactgtttagtaggaagtcaatggaggttgactccggagccgcttacgagctgaagtcttataccgagagcccaactaacccccagttctctccgaggtgttag

SEQ ID NO: 29868 - DNA, 1890 bp, Artificial Sequence
  Description of Artificial Sequence: Synthetic coding sequence
atggaagtgaaagggccaagcggtcgttccttctgttgcgaaagcgagggtcaattcaaaagctgccttaaacggcatacaccgtctcttctgctgccttccagctggaaaggaaattcgggtagttgcttgatggcgaaggccttgcatcgcatgagtcccacccctaactcctgccctcttcctctgccgttgtgtaggatgtcaggggtgttgtgtagtagaaatctatttacctttaagttcagcctcttccagctcgactcgggcgcctcaggggagcctgggcatagcttggggttaacactcggtttttcgcactgcggaaattgtcaaaccgcagttgtgtcagctcaacccgaggggatggcgagcaatggcgcctaccccgctctcggccctggggttactgcaaaccctggaacttccctctctgtttttacggctctccccttcacgactcctgccccaggtcccgcacatggcccactcttagtgaccgcaggagcccctccaggcggtccactggtattgagcaccttgccatcaactcctcttgtaactgagcaggacggttgtgggccgtctggcgccggagcaagtaacgtgttcgtccagatgcgaacggaagtaggccccgtgaaggctgctcaggcccaaacccttgtgctcacccaggccccacttgtgtggcaggcacccggcgcactctgtggcggggtggtctgccctccgccacttctgttggccgccgctcccgtagtcccagtcatggccgcacaggttgtgggtggaactcaagcttgtgaaggtggttggtctcaagggctgcctctgcccccacctccaccgccagctgcccagttgcctcccattgtatctcagggaaatgctggcccatggccccaaggggcccacggtgagggaagccttgcatcttcccaagcaaaagcaccgcccgacgattcttgtaacccacggtcagtttacgagaattttagattgtggcagcattataaacccctggcccgcaggcatctgcctcaatctcccgacaccgaagccctaagttgcttcctcattcctgtgttgcgatctcttgctcgaagaaaacccaccatgaccctggaggaggggctgtggcgggcaatgcgcgagtggcagcacacctcgaacttcgacagaatgatcttttatgagatggccgagaagtttcttgaattcgaggcggaggaggagatgcagattcaaaaaagccagtggatgaaagggccccagtgcctgccaccacccgcaacacctagactcgagccccgcggtcctcccgcaccagaggtggtcaagcagccggtgtatctgccctccaaagccggcccaaaagcccccactgcctgtctgcccccgcctcgtcctcagcgcccagtgaccaaagctagacgacctccccctcgacctcatagacgggcggagactaaagcccggctgccaccaccacggccccagaggcctgccgagactaaagtccccgaagagattcctcccgaagttgtgcaggaatacgttgacataatggaagaattgctcgggcctagcttaggcgcaaccggcgaacccgaaaagcagcgggaagaaggcgaagttaaacagccacaggaggaagattggaccccgccggatcctgggcttctcagttacaccgacaaactctgctctcagaaggatttcgttaccaaagtcgaggctgtgatacacccgcagttccttgaagagctgctgtcccctgaccctcagatggacttcctcgcattgtctcaggagctggagcaggaggaaggcttaactctagctcagggggccccgtctgacgctccaggaacagacagatgttag

SEQ ID NO: 29869 - DNA, 2637 bp, Artificial Sequence
  Description of Artificial Sequence: Synthetic coding sequence
atggaggtgaaaggcccttccggccggagtttctgctgcgaatccgaagggcagtttaaaagctgtctcaagcgtcatacccccagcctgctcctgcccagttcgtggaaaggcaactccgggtcttgtcttatggccaaggccctccaccgtatgagccctacaccaaatagctgcccacttccactgcctctgtgcaggatgagcggggtgctgtgtagccgcaatctatttacctttaaattctcgctgtttcagttagattccggagccagcggagaaccaggacacagcctgggactcaccctcgggtttagtcattgtggcaactgccagacagcagttgtctccgcacagcctgagggaatggcttccaatggagcctacccggccctgggccctggtgtgacggcaaatcccggcacatctctgtctgtgttcactgctttgccctttaccacacctgcccctggcccagcccacggcccactgctggtcacggctggcgctccgccgggtggcccccttgtcctttcgactctccctagtacccctctcgtcacggagcaagatggttgtggaccctcaggggctggtgcaagtaacgtcttcgtgcaaatgcgcaccgaggttggacccgtgaaggccgcccaagcccaaacgcttgttctcacgcaggctcccctggtctggcaggcccctggggcactatgcggaggagttgtgtgtccgccaccactgctcttggcagctgcccctgttgttccggtgatggcagcccaggttgtcggcgggacacaggcgtgcgaggggggttggagccagggcctcccgctgccaccaccgccccccccagctgcacaactgccacccatcgtgtcgcagggcaatgctgggccttggcctcaaggtgcccacggggagggaagcctggcctcatctcaggcaaaggcccctccagacgactcatgcaatccaaggagcgtgtacgaaaattttcgattgtggcagcattataaacctctggcgaggagacacctgccccaatctcccgacacggaagccctaagctgtttcctcatccctgttctgagatctcttgctcgacggaagcctactatgacacttgaagaggggttgtggcgtgcaatgcgcgaatggcagcacacttccaattttgataggatgatcttctatgagatggccgaaaagtttctcgagttcgaagccgaagaggagatgcagatccaaaagagccagtggatgaaaggccctcaatgcctgcctccccccgcgacccctagactggagccaagagggcccccagctccagaggttgtcaaacagccagtgtacctcccttctaaggcgggacctaaggcgccaaccgcgtgcctgccaccacccaggccacagcgaccggtgactaaagcgaggaggcccccgcctaggcctcacaggagagctgagactaaagcccggctgccccctccccgcccacagcgacccgccgaaaccaaagttcctgaggaaatcccgcccgaagtggttcaggagtacgttgatataatggaggaactgttgggtccctccctgggtgcaaccggcgaacccgaaaaacagagagaggaaggcgaggtgaaacaaccacaggaggaggattggaccccgccagaccccggtctgttgtcatacaccgacaagctctgctctcagaaggatttcgtcactaaggtggaagctgttattcaccctcagttcctggaagaacttttatcccccgatccacagatggattttctggcgctgtcacaggaacttgagcaggaggagggtctcacgctggcacagctcgtggagaagcggcttcttccccttaaagagaaacagcacgcaagggccgctccatcccggggtaccgcaagactcgactcgtcatcctctaaattcgcggcgggtcagggtgctgaacgggatgtgcccgtgccgcagcagggggtgggtatggaaacctgccccccccagaccaccgccagagacagccagggtagaggtcgagctcataccggcatggccaggagcaaagatagcgtcgtactgctgggctgccaggatagccctggcttaagagctgcacggcccacgtcgccccctcaggaccaccgccccacgtgccctggagttggcaccaaggatgctctcgacctgcctggggggtcccccgtgagagaatcccatggactcgcccaggggagctccgaagaggaagagctgccatccttggctttcttgctcggctcacagcacaaactgctgccatggtggctgccacagagtcccgtgcccgcatcaggtttgctgtcgcccgagaaatggggacctcaggggacccaccagtttccctcagctgagcgtcggggactgaacttagcacccagccccgccaataaggcgaaaaagcgaccactgtttgggagtctgagtcccgccgaaaagaccccacacccgggccctggtctgcgcgtgtctggagagcagtccctgacgtgggggctcggtggccccagccagagtcaaaagcgaaagggagatcctctggtgtcgcggaaagaaaaaaagcaaagatgcagccagtag

SEQ ID NO: 29870 - DNA, 2418 bp, Artificial Sequence
  Description of Artificial Sequence: Synthetic coding sequence
atgtttcaggagccagtgtactttcagattttcttccagcttgattccggggctagtggcgaacccggccatagcctaggcctgactttagggttttcacactgcggcaactgtcagaccgcagttgtgtccgcacaacccgaaggcatggcttccaacggagcctacccagccctggggccaggcgttacggctaatccaggcacttcattaagtgtgtttactgctctgccattcaccacacctgctccaggaccggcccatgggccacttctggtgaccgccggcgcaccacccggcggcccactggtgctgagcacactgccctctacgccccttgtaaccgaacaggatgggtgtggcccgtcaggggcgggcgcaagtaatgtgttcgtgcagatgcgcaccgaagtcgggccagtgaaggcagcgcaggcacagaccctggtactgacacaagcaccgctggtctggcaagccccaggagccctgtgtggaggcgtggtctgtccaccacctctgttactcgctgccgctccggttgtccctgtgatggccgcccaagtcgtaggaggcactcaggcctgtgaaggcggctggtcccagggactgcctttaccacctccaccccccccagctgcacagctgcctcctattgtttctcagggcaacgccggtccatggccacagggcgctcacggagaaggcagcctggctagttcccaggcaaaggcgcccccagatgatagctgcaatccccgaagcgtgtatgaaaattttcgcctgtggcaacattacaaacctctcgcccgaagacacttgcctcaatcccccgacaccgaagccctgtcctgctttctgatccctgttttgcgttctctggccaggagaaaaccaacaatgacccttgaggaaggcctttggagggctatgcgcgaatggcagcacacatcaaactttgaccggatgatattttacgaaatggcagagaaatttctggaatttgaggccgaagaggagatgcaaattcagaagtcccaatggatgaagggacctcagtgtttacctcccccagcaacaccaaggctggagccgaggggcccacctgcacccgaggtagtgaagcagccagtgtatcttccatcaaaagccggacctaaggctcccacagcctgcctgcctcccccacgtccacaacgtccagttacgaaagcaagaagacctcccccccggccacatcgcagggccgaaactaaggcaaggctgccaccacctagacctcagcggccagcggagaccaaggtgcccgaggagattccacccgaagtggtccaggagtacgttgatattatggaggaactacttgggccttctcttggggccacaggggaacctgagaaacagcgggaagagggcgaggtcaagcagcctcaggaagaggattggactccccccgaccccggcttgctatcctataccgacaagctgtgctcccaaaaggatttcgtgaccaaggtcgaggccgttatccacccacaattccttgaggaactgctctctccagaccctcagatggattttctggccctctcacaagaattggaacaagaagagggactgacattggcccagctcgtcgagaagcgccttctgccgctaaaagaaaaacaacatgcaagagctgcgccttcgcgcggaaccgcccgactcgactccagttctagcaaattcgccgcgggtcaaggagctgagcgagacgtgcctgtgcctcaacagggcgtgggcatggagacctgtcccccacagactaccgccagagattctcaggggcgaggacgcgcacatactgggatggcaagatcaaaggattccgtagtgctgctgggatgccaagactctcccggattgcgggcagcaagaccaacaagccctccacaggatcacaggcctacgtgcccaggcgtcggcacaaaagatgctctcgaccttcccgggggaagtcccgtccgggagtcacacggattggcccaaggctcatctgaagaggaagaacttccctccctggccttcctccttggctctcagcacaaactgttgccttggtggctccctcagagtccagtccccgcatcgggtcttctgagcccagaaaagtggggaccccagggtactcatcagttcccttctgccgaaagacggggtcttaatcttgccccaagccctgcaaacaaggccaaaaaacgcccactatttgggagtctgagccctgccgaaaagacaccccatccaggacctggactgcgagtgtctggagagcaaagtcttacgtggggactgggaggtccttctcagtcccagaagcgcaagggggacccgctggtttcacggaaggagaagaagcaaaggtgttcacagtag

SEQ ID NO: 29871 - DNA, 789 bp, Artificial Sequence
  Description of Artificial Sequence: Synthetic coding sequence
atggaagaactgctcggaccatccctgggagctacaggagagccagaaaaacagcgcgaagaaggcgaggtaaagcaaccacaggaggaagactggacaccaccagaccccggattactcagttacacagataagctctgtagccagaaggacttcgtgaccaaagtggaggccgttatccacccccaatttttggaggagctgttgtcccctgacccccagatggactttctagcccttagccaagaattggagcaggaggaagggctgactctcgctcagctggttgagaaacgtttgctgcctctcaaggaaaagcagcacgctagagccgcaccaagccgaggcaccgctcggctcgattcctcatcatcaaagtttgctgcaggccagggagccgagagagacgttcccgttccccagcagggagtcgggatggaaacatgcccccctcagacaacagcccgcgacagtcagggaagaggtagagcccacactgcgtccggcctactgagtcctgaaaaatggggtccccagggtactcatcaattcccgtcggctgagcgcaggggtctgaacctggcgccatcaccagcgaacaaagcgaaaaagcgcccactatttggttctctctcacccgccgagaagacaccgcacccaggtcccggattgcgtgtctcaggcgaacagtccctgacttggggcctgggcggacccagtcagtcccagaaacgcaaaggagaccctctggtctcaaggaaggaaaagaagcagaggtgttcccagtag

SEQ ID NO: 29872 - DNA, 1971 bp, Artificial Sequence
  Description of Artificial Sequence: Synthetic coding sequence
taactgactcaggctccattggtctggcaggcacctggagccctgtgcggcggtgtggtatgtccacctccattactgctcgctgcggcacccgtggttccggtcatggcagctcaagtggtgggaggtacgcaagcctgcgagggcgggtggagtcagggtttgccacttcctccaccgccaccacctgccgcccagctgccccctatagtgtctcagggcaacgctgggccatggccacaaggggcacacggggaaggatctttggcatcgagtcaggccaaagcccctcccgacgactcatgtaatccaagatctgtgtacgaaaatttccgtctctggcagcattataaaccgctggctcggcgacacttgcctcaaagtcccgatactgaggccctctcttgctttttgatccccgtgttacgaagcctggcaagaagaaaacctactatgactctcgaagaggggctgtggcgcgctatgcgggaatggcagcatacgtccaactttgacagaatgatcttttatgagatggccgaaaagttcttggagtttgaagctgaggaagagatgcaaattcaaaaaagccagtggatgaaagggccccagtgcctcccgcctcccgccaccccgcggctggaaccaagggggccaccagcacctgaagtggtaaagcagcccgtttacctacctagcaaggctggtccaaaagcccctactgcctgtttgccaccacccagacctcagcggccagtgacaaaagctcgtagacctccacctcgcccccaccggagagcagagaccaaagctcgcctgcccccgccacgtccacagaggcctgccgaaacaaaagtgcctgaagagataccacctgaggttgtccaagagtatgtggatattatggaggaattactcggtccgtccttaggcgctaccggcgagcccgaaaaacagagagaggaaggtgaggtcaagcagccccaagaggaggactggacgcccccggatccagggttactcagctacactgataaactgtgtagccagaaggacttcgtgacaaaagtggaggctgtaattcatcctcagtttcttgaggaattgctgtccccagatccacaaatggactttctcgcactgagtcaagagctggagcaggaggaaggcctgacactggcccagctagtggaaaaacgcctgctgccgttaaaggagaagcaacatgctcgagcagctccttctcgaggaactgccaggctggactcctcttctagtaaattcgccgcaggccagggcgcagaacgggatgtccccgtgccacagcagggggtggggatggaaacttgccctcctcaaaccaccgcgcgggattcgcagggtaggggtagggctcataccggtatggcgaggtccaaagactccgtagtgctccttggctgccaggacagcccaggtctgcgggctgctagacccacttccccgcctcaagaccataggcccacgtgccctggggtcggcaccaaagacgccttagacctccctggcggttccccggtgagggaatcacatggactggcacagggcagctctgaagaggaggagctaccgagcttggcttttctgctgggatcgcagcacaaactgctgccctggtggctgcctcagagtcccgttccagcctctggactgctgtcccccgagaagtggggacctcagggtacccaccaattcccgtccgccgaacgcagaggcctcaacttggcacctagccctgccaacaaagcgaaaaaacggccactctttggcagcctctcaccggccgagaagactccacacccaggaccagggctccgagtgagcggcgagcagagtttaacctgggggctgggtggaccatcccagagccagaagcgaaagggagaccctcttgtgtcccgaaaggagaaaaaacaacgatgttcacagtag

SEQ ID NO: 29873 - DNA, 1866 bp, Artificial Sequence
  Description of Artificial Sequence: Synthetic coding sequence
atggcggctcaggtggttgggggcacccaggcgtgcgaagggggttggtcacagggccttcccctgccccctccgcctccccccgccgcccaactacctcctatcgtgtcccaggggaacgctgggccatggccgcagggagcccacggtgagagctcactggcatccagccaagccaaagcgcctccagatgatagctgtaatccacgcagtgtgtacgagaattttagattgtggcaacattacaaaccccttgcacgcaggcatttgccacagtcaccagataccgaagccctgtcatgttttctgattccggtccttcggtccctcgccaggcggaagccaacgatgactctcgaagaaggactgtggagggctatgagggagtggcagcacacatctaactttgatcgtatgattttttacgagatggcagaaaaatttcttgaattcgaggccgaagaggagatgcaaatccagaagtcccagtggatgaagggcccacagtgtctgcctccccccgccacccctagactggaaccaagaggtcccccagcgcctgaggtggtgaagcaaccagtgtacttaccttcgaaagctggccctaaggcccctaccgcatgcttgccaccccccagacctcagcgaccagtgactaaagccagaagacccccccctagaccccatagacgagctgagacaaaggcacgccttcccccgcctagaccccagaggcctgccgaaacaaaggtgccggaggaaatcccacccgaagtggtgcaggaatatgttgatatcatggaggaactgctggggccctccttgggcgctactggcgaacctgaaaagcagagggaagaaggcaaggtgaagcagccccaggaggaagactggacaccacccgaccctgggctgctatcctacattgacaaactgtgcagccagaaggactttgttactaaggtggaggccgtgatccacccgcagttcctggaagagttgctctctcctgatccacaaatggactttctcgctctttcacaggatctggagcaggaggaaggcctaacattggcccagttagtagagaaacggctgccccccttaaaggagaagcagcacgcccgtgcagccccgtcacgcggaaccgctcggctagattctagtagttcgaaattcgctgcgggccagggcgccgaaagggacgtcccagatccccaacagggtgtcgggatggagacgtgtcccccccagatgaccgcacgcgatagtcagggacgcggcagggcacacactggcatggcgagatctgaagattcagtggtgctgttgggttgccaggattctcctggtcttagagccgcatggccaacctcccccccccaggaccacagacctacatgtcctggcgtaggtactaaagatgcattggacctgcccggagggagcccagttagagaatcacacgggctcgctcagggctcctccgaagaggaagagctcccttccctggcattccttctggggtctcaacacaagctgctgccatggtggctgccacaatctcctgtccccgcgagtggtctcctcagccccgagaaatggggtcctcagggcactcaccagtccccctccgctgaaagacgcggactgaatctggcacctagcccagccaataaagctaaaaagagaccactgttcggcagcttgtcaccggcggaaaaaaccccctatccaggcccaggcctgcgagtctcaggcgagcagtccctgacatggggcctgggaggtccgtcgcagagccagaagaggaagggggatcccctggtcagcagaaaagagaagaaacaacattgcagccagtag

SEQ ID NO: 29874 - DNA, 1689 bp, Artificial Sequence
  Description of Artificial Sequence: Synthetic coding sequence
atgagtggcgtgctctgtagccggaatctgttcacatttaaattctcgctattccagctggactccggcgcttctggcgagccgggtcacagcttggggctcacattaggcttttcttactgcggaaactgccagaccgctgttgtgagcgctcagccagagggcatggcgagtaacggagcatatcctgtgctaggccccggcgtgacagcgaaccctggaacaagtctgtctgtgtttacagctctcccatttaccacgcccgcaccaggccccgcccacgggccattgctagtgacagccggagccccccctggtggcccactggtgttaagtacttttccgtcaaccccactcgtcaccgagcaggatggttgcggaccttcaggggccggcgcgtccaacgtcttcgtgcagatgcggacagaggtgggtccagtgaaggctgctcaggctcagaccctggtcctaacgcaagcccccctcgtgtggcaggcacccggggccctgtgtggcggcgtggtatgtccccctccgctgttgctggccgctgctcctgtggtgcctgtaatggcagcccaggtggtcggtggcacacaggcttgcgaaggcggatggagtcagggtctgcctctgcccccgcctccccctccggcagcccaattgccacccatcgtctcacagggaaatgccggcccttggccccagggtgcccacggagagagctcattggcttcttcccaggccaaagccccccccgatgactcttgtaaccccagaagtgtatacgaaaacttcaggttgtggcagcactataagcctctggcgaggaggcacctcccccagtccccagacacagaagcattgtcatgtttcctcatccccgtgctgaggtctctcgcacgtcgtaaaccaacgatgactctggaagaagggctctggagggcaatgcgggagtggcagcatacgagcaattttgacagaatgatattctacgagatggccgaaaagtttttggaattcgaggctgaggaagaaatgcagatacagaagtcccagtggatgaagggtcctcagtgcctgccacccccagctaccccccgcctagaacctcgcggaccaccagctcctgaagtggtgaagcagcctgtgtacctccccagcaaggccggccccaaggcacctacagcctgcctacctcctcctcggccacaaagacccgtgactaaggctaggcgcccaccccccaggccgcaccggcgggctgagactaaagctcgcctcccccctcctagacctcagcgccccgcagagactaaggtcccagaggagattccaccagaagttgtccaggagtacgttgacatcatggaggaactactcggtccatcgttgggcgccacaggcgaacctgagaagcagagggaagaagggaaggttaagcagcctcaggaagaggactggaccccccccgacccaggccttctgagctatatcgataagctgtgcagccagaaggacttcgtaactaaggtcgaagcagtcatccacccacagtttttggaggagttgttgtcccctgacccacagatggacttccttgccctaagccaggacttagaacaggaggaagggctaactcttgcccagggtgcaccctcagatgcccccggtacagatagatgttag

SEQ ID NO: 29875 - DNA, 2637 bp, Artificial Sequence
  Description of Artificial Sequence: Synthetic coding sequence
atggaagtgaagggcccatcaggccggagtttttgttgtgagtctgaggggcagtttaaatcatgtttgaaaagacatactccttccttactcttaccctcctcatggaaaggaaattcagggagttgcctgatggccgaggcactgcataggactagccccaccccaaattcgtgtcccctccccctgccgctctgccgaatgtccggcgtgctttgcagtcggaacctctttacattcaaattctctctgttccagctggactcaggcgcgtcaggcgaacccggacattcccttgggttgaccctgggcttctcctactgtggtaactgccaaaccgctgtggtgtccgctcagcctgagggaatggcaagtaatggcgcctatccggtgctgggccctggtgtgaccgcgaatcctggcaccagtctgagcgtctttacggctctccccttcaccaccccagccccaggacccgcacatgggccccttctggtaacagccggtgcaccccctggtggaccattggtactctctaccttccctagcactcccctggtaacagagcaggacggctgcggacccagtggcgccggagctagtaacgtctttgtgcaaatgcgaactgaagtggggcctgtgaaggctgcccaagcgcaaacgctcgtactcacacaggcgccactcgtttggcaggccccgggagccctgtgcggcggcgttgtgtgcccgccacctctgctacttgccgcagctccagtggtgcctgtgatggcagcgcaggtggtcggggggacacaggcttgtgagggaggctggtctcagggcctcccactccctcccccgcctccacccgccgcgcagcttcccccgatcgtatcgcaggggaatgcagggccctggccacagggagctcacggtgaaagcagcctcgcctcatcacaggccaaggccccaccggacgattcctgcaatccgcggtctgtgtatgagaactttcggttgtggcagcattacaagcctttggcccggagacacttaccccagagtccagacacggaagcgcttagctgttttttaattccagtcctcagaagccttgcgcgccgtaagcccacaatgacacttgaagaaggattgtggagagctatgagagaatggcagcataccagcaacttcgacaggatgatattctacgagatggccgagaaatttctggaattcgaagcagaagaagaaatgcaaatccagaagtcacaatggatgaagggtcctcagtgtcttccacctcctgccacacctaggctcgagccccgcggaccaccggccccagaggtggtaaagcagcccgtctaccttcccagtaaggctggccccaaggcaccaacagcatgcttacccccccctagacctcaaaggccggtgacaaaggcaaggaggccgccacctcgcccacaccggcgggcagagactaaagcgaggcttccccccccaaggccgcagagaccggcagagacgaaagtgcccgaggagattccccccgaggtcgtccaagagtatgttgatatcatggaggagctactgggaccaagtttaggagctaccggtgagcctgaaaaacaaagagaggaaggaaaagtgaagcagccccaagaggaagactggactcctcccgaccctgggttgctatcctatattgacaagctgtgctcacagaaggatttcgtcacaaaggtagaggcggtgattcacccccagtttcttgaagagttgctgtctccggatccccagatggacttcttagcactgagccaggaccttgaacaagaggagggactgactcttgcgcagcttgtggagaaaaggcttcctcctctcaaggagaagcagcacgcaagagccgcacccagcagaggcacagcaaggctagattcatcatccagcaagttcgcagcagggcagggcgcagagagagatgtgcccgacccacagcaaggagtgggcatggagacctgcccaccccagatgacagcacgggattctcagggccggggccgggcccatactggcatggcgcggagcgaagattccgtcgttctccttggatgccaggacagtcctggtttgcgggccgcctggccaactagcccaccccaggaccatagaccaacctgccctggcgtcggaactaaggatgcgctggatttgccaggaggctcgccagtgagggaatctcacgggcttgcccaggggtccagtgaggaggaggagctgcccagtttagcctttctcctgggttcccaacacaagttactgccttggtggctcccgcaaagcccggtgccagcctctggcctgctatcaccagagaaatggggtcctcagggaacgcaccagtcacccagcgcagaacgcagaggcctaaatctggccccatcaccagctaataaagccaagaaaaggccactgtttgggagtctcagccctgccgaaaaaaccccctatcctggacccggcctgcgcgtctctggcgagcagagcttaacgtggggcctgggcgggcccagccaaagtcagaaaaggaagggggacccacttgtcagtcgcaaggaaaaaaaacagcactgcagtcagtag

SEQ ID NO: 29876 - DNA, 1890 bp, Artificial Sequence
  Description of Artificial Sequence: Synthetic coding sequence
atggaagttaaagggccgagtgggcgctctttctgctgcgaatccgagggacagtttaaatcgtgtttgaaaagacatacccctagtttgctgctgccttcctcatggaagggaaattcaggaagttgtctcatggctgaagctctgcacagaaccagcccaacacctaactcctgccctttgcccctgccattatgcaggatgtctggtgtgttatgctctaggaacctgtttacctttaaattctcactgtttcagctggacagcggggcctccggggaacccggacattcactgggattgacactggggtttagttattgcggaaattgtcagacagcagtagtgagcgctcagcccgagggaatggcgtccaacggtgcctacccagtgctgggcccgggagtgactgccaaccccggtacctcactctccgttttcaccgcgcttccatttaccacgcccgcgcccggtccagcacatggaccactgctagtgacagccggggcaccccccggtggtcccctagttctgagcacttttcctagtacaccactggtgaccgagcaggacggctgtggaccttctggcgctggagccagcaacgtgttcgtgcagatgcggacagaggtgggccctgtgaaagctgcccaggcccagacactcgtgttaacgcaggcacctctcgtgtggcaggccccgggggccctttgtggtggcgttgtttgtccgccaccactgcttctagccgcggcgccggtggtgccagtcatggccgctcaagtggtcggaggtacacaggcctgcgagggaggctggtcccaggggctgccgcttccccctcctcctcctcctgccgcccaactgcctcccattgtctctcagggcaatgccgggccctggccccagggtgctcacggtgaatcttcacttgcttcatctcaggcaaaagctccccctgatgactcctgcaatcctcgatccgtctatgaaaatttcagactctggcaacattataagccgctggctcgccggcacttgccacagtctccggatacagaagcactttcgtgttttctcattccggtacttcggtcacttgccagacgcaagcctacgatgacgctggaggaagggctgtggagagccatgcgggagtggcagcacacctcaaactttgatcgaatgatcttctatgagatggcagagaaatttcttgaattcgaggctgaggaggagatgcagatccagaagtcccagtggatgaagggaccccagtgcctgcctccacctgccaccccccgcctggagccgagaggccccccagcccccgaggtcgtcaaacagccagtatatctcccaagcaaggcaggacctaaagctccgaccgcgtgtctaccccctcctcggcctcagagacctgtgacgaaagcccggcgcccaccgcctcgcccccacaggagagccgagaccaaggccagacttcctcccccgaggcctcagaggcccgcagaaaccaaggtccctgaggagattccccctgaagtcgttcaggagtatgtggacattatggaggagctcttgggcccttcactgggggcaaccggtgagcccgagaagcaacgcgaggagggaaaagtcaagcagccccaagaggaggattggacccccccagaccccggcttacttagttacatcgacaaactttgttcgcaaaaggacttcgtgacaaaggtagaggcagtcatccacccacagtttcttgaagagcttctgtctcctgacccccagatggacttcttggccctgtcccaggatctcgagcaggaggagggattgaccttggcccagggcgcgccgtcagacgctcctgggacagaccggtgctag

SEQ ID NO: 29877 - DNA, 2634 bp, Artificial Sequence
  Description of Artificial Sequence: Synthetic coding sequence
atggaggtgaaggggccatccgggcggagcttctgttgcgagtcagagggccaattcaaatcgtgcctgaagcgccatacaccctccctccttctcccctctagttggaagggaaattccggcagctgtctcatggccgaagctcttcataggatgtcccctactcccaactcttgtccactgcctctccctctgtgtagaatgtctggcgtgctctgtagccgaaatctgttcacgtttaagttttcctttcagctcgattcaggcgcgtccggcgagcccggacatagcttgggcctaaccctcggcttttcacattgcggcaactgccaaacggccgtggtgagcgcccagcccgaaggtatggcttccaacggcgcctaccctgccctaggcccaggggttacagctaacccaggcacgagtctgtccgtgttcacagcactgccattcacaactcctgcccctgggcccgctcatgggcctttgctggtgactgccggagcaccaccaggagggcccctagtgctgagcaattttccaagcactccactcgttactgaacaggatggctgcgggccctctggtgcgggtgccagtaacgtgtttgtgcagatgagaacggaagtggggcctgtgaaagccgcgcaggcacaaaccctggtgctcacacagacacccctggtgtggcaggcccccggcgcgttgtgcggtggcgtggtatgtcctccaccgctcctcctggccgcagcaccggtcgtgcctgtgatggccgcacaggtggttggagggacacaggcctgtgagggtggctggtctcagggactgcccctgccaccccctccgcctcccgctgcacagttgccacccatcgtaagccagggcaatgcagggccatggcctcagggcgcccatggagaaggatcattggcctctagtcaggccaaagcccctccagatgactcctgtaatccccggtccgtttacgaaaatttccgactgtggcagcattacaagccattggccagacggcacttacctcagtcacctgatacggaagccttaagttgttttctgatacctgtgctgcgctcactggcaagacgcaaacctactatgaccctggaagaaggcctgtggagagccatgcgtgagtggcaacacacaagcaatttcgaccggatgatcttctatgagatggcagagaagttcctcgagttcgaagctgaagaagagatgcagattcagaagtctcagtggatgaaagggccgcaatgcctgccaccacctgctacccctaggctggagccccgaggtccgccggcgccagaagtggtgaagcagccagtctacctgccttctaaggctgggccaaaagcccctaccgcctgccttcctcccccacgcccccagagacccgtgactaaggcacggcgcccgcctccacgaccacatcggagagccgaaacaaaagctcggctgccacctccccggcctcagcggcccgcggaaaccaaagtcccagaggaaattccccccgaggtggtgcaggaatacgttgacatcatggaggagttgcttgggccgtcactgggagccactggagagccagagaaacagcgagaagaaggcgaggtgaaacaaccccaagaggaagactggacaccgcccgatcccggactgctctcatatacagataagctatgctctcagaaggacttcgtcaccaaggttgaagctgtgatccacccacagtttctggaggaactcctgtcccctgatcctcagatggattttctggccctctcacaggaattggagcaagaagagggactcaccttagctcagttggtggaaaaaaggctcctgcctctgaaggagaagcagcacgcccgcgccgcaccaagtcggggaactgcacggttggactcctccagttcgaaatttgccgccgggcagggcgccgagagggacgtgcccgatccacagcaaggggtgggtatggagacttgtccgccgcagaccacagcccgggatagccaaggcagggggagggcacatactggcatggcaaggagcaaggactccgtggtgctgctaggatgccaagactctccgggcttgcgcgcagcaaggcccacctcaccacctcaggaccacaggcctacctgtcctggagtgggcaccaaagacgcgttagacctcccaggaggctccccggtgcgtgagtcacacgggctggctcaaggctctagcgaagaagaggaactgccgtcgctagcattcttgcttggatctcaacataaactgctgccttggtggctcccacagagtccagtccccgcctcgggactcctctcccccgagaagtgggggccacaagggactcaccagtctccctcagccgagcggcggggccttaacctggctcctagtcctgccaacaaggcgaagaagcggcctctgtttgggtccttatctcccgccgaaaaaacacctcacccgggccccggactgagagttagcggcgaacagagtttaacttgggggctgggaggtccttcccaatcacagaaaaggaaaggggatccgctcgtgagtcgcaaagaaaagaagcagagatgcagccagtag

SEQ ID NO: 29878 - DNA, 789 bp, Artificial Sequence
  Description of Artificial Sequence: Synthetic coding sequence
atggaagagctgctcggcccaagcctgggcgcaactggagagccagaaaagcagcgagaggaaggcgaggtgaaacagccccaggaagaggactggacccctcccgatccaggtctgttatcatacaccgacaagctttgctcccagaaagactttgttacgaaggtggaggcggtgatccacccccagttcctcgaagaactcctgagtcctgatcctcagatggattttcttgccctgtcccaggaactagaacaggaagaaggcctaactcttgcccagcttgtagaaaaacgactgctccctctgaaagagaagcagcacgcacgagctgcaccatctcgcggaactgccaggttggactcgagctcttccaaatttgctgcaggacaaggagcagaacgggacgttccggatccccagcagggcgtgggtatggaaacctgccccccacaaacgacagccagggacagtcagggcagaggccgggctcacacagccagcgggctgctctccccagagaaatggggcccccaggggactcatcaaagccccagcgctgaacggcggggtctaaacctagctccatcccctgccaataaggccaagaagaggcctttgtttggatctttgtcacctgccgagaagaccccgcaccctggccctggccttagagtgtctggagagcagagtctgacttggggcttggggggaccctctcagtcccagaaacgcaaaggagacccactagtgagccggaaggaaaaaaagcagagatgcagtcagtag

SEQ ID NO: 29879 - DNA, 2421 bp, Artificial Sequence
  Description of Artificial Sequence: Synthetic coding sequence
atgttccaggaacccgtctatttccagatctttctttttcagctggactcaggggcttccggcgaacccggtcactctcttggcctgactctgggctttagtcactgtggcaactgccagaccgcggtggtcagtgcacaacccgaggggatggcctctaacggtgcctacccagccctgggtcctggcgtgaccgccaatccggggaccagcttgtccgtattcaccgccttgcccttcaccacgccagccccaggaccagcacatggccccctgttggtgactgcaggcgcccctcccggtggacctttggttttgagcaacttccccagcaccccgctcgtcacggaacaagacggctgcggaccctcaggcgctggggcctccaatgtgtttgtccagatgaggactgaggtggggcctgtcaaagcagcgcaggctcaaacactggtgctaacgcagacgcctctggtctggcaggcccccggggcactctgcggcggcgttgtttgccccccacccctgcttctggctgccgctcctgtggtccccgttatggcggcccaggtcgtcgggggtacacaggcttgtgagggaggttggtcccagggcttgccattgcctcctccccccccacctgcggcacagctgccccccatcgtgtcccaaggtaacgcggggccatggcctcagggagcgcacggcgaaggaagcctggcttcctcacaagccaaagctccacctgacgactcctgcaatccgcggtccgtttacgagaacttccgcctatggcaacattataagcctcttgcaaggcggcacctgccccaatccccggacactgaggcattgagttgcttcctgattcccgtgctgcggtctttggcacgccggaagccaacaatgactcttgaagagggcctctggagggccatgcgggaatggcagcatacttctaacttcgatcggatgatcttctatgagatggccgaaaaattcctcgaatttgaagcagaagaagagatgcaaatccagaagtctcagtggatgaaaggcccgcagtgcttacccccacccgctactccaaggttggagcctagggggcctcctgcccccgaggtggtgaaacagcccgtgtatctgcctagtaaggcaggacccaaagctccaaccgcttgcctaccacccccccgtccccaaagacctgtgactaaagcccgtagaccaccaccgcggccacatcgcagagctgagaccaaggcccggctccccccaccacgccctcagcgtcctgcggagaccaaagtgccagaggagatcccacctgaagtggtgcaggagtatgtggacatcatggaggaactgctcggacctagcctgggcgccactggtgaacccgaaaaacaacgggaggaaggcgaggtgaagcaaccccaagaagaagattggaccccaccagatccagggctcctttcttacacagataaactgtgctcacaaaaggactttgtcacaaaggttgaagcagttattcaccctcaatttctggaggaactcttaagtcccgatccacagatggactttctcgccctgtcacaggagctggagcaggaggaaggtttaaccctcgcccagttggtggagaaacgactactgcccctgaaagagaagcagcatgcccgcgcagctccttcacgcggaacggccaggctcgactcctcgagctccaagttcgcggcagggcagggagccgaacgtgatgtgccagaccctcagcagggagttggtatggaaacatgtccgccccagacaaccgcccgggactctcaaggccgaggccgggcccatacaggaatggcacgctccaaagatagcgttgtgcttcttggatgtcaggatagtccgggcctgcgcgcggctaggcctacatctcccccgcaagaccataggcctacctgtccaggggtaggcaccaaagatgcactggacttgcctggcggcagccccgtaagagagtctcatggactggcgcagggcagctcagaagaggaggaacttccctctctcgcctttttgctgggaagccagcacaaactcctaccatggtggttgccccagtcacctgtccccgcctccggtctgctcagtcctgaaaagtggggcccccagggcacccaccagagtccgtccgccgagaggagaggactgaacctcgctccttctccggcgaacaaagcgaagaaacgaccactctttggctctctctcaccagccgagaaaacaccccaccctggcccaggcctgagagtctcaggagaacagtccctcacttggggtctcggcggcccgtcacagtcacagaaaagaaagggggatcccctcgtgagcaggaaagaaaagaaacagcggtgttcccagtag

SEQ ID NO: 29880 - DNA, 1674 bp, Artificial Sequence
  Description of Artificial Sequence: Synthetic coding sequence
atgtttcaggagcctgtgtattttcagatttttctgttccagctggactctggcgcctcaggggagccagggcacagcctgggcctgacattgggattttcccactgtggaaattgtcagaccgctgtggtttctgcccaaccagagggtatggcctcaaacggcgcctatccggccttaggccccggcgtgaccgccaatcccgggacgtcactgtcggtgttcaccgccctgccattcactacacccgcccctggccccgcccatggcccacttctggttacggcgggcgccccgccaggcgggccattggttctgtccaacttcccctcaacccccctggtaacagaacaggacggatgcggcccaagtggagccggcgcctccaacgtattcgtgcaaatgcggactgaggttgggcctgtcaaggctgcccaggctcagaccctagtgctaactcagacacctctggtgtggcaagctccgggggctctgtgtgggggggtggtctgtccacctccactgctcctcgctgctgcccctgttgtacccgtgatggccgcacaggtagtcggcgggacccaggcctgtgaaggaggatggtcccagggactgccacttccacctccacccccacctgcggctcagttgcctcccatcgttagtcagggcaacgcaggaccatggccacagggggcccatggcgaaggctccctcgcttcctctcaggccaaggctcctccagacgactcctgcaacccccggtctgtctacgagaacttcaggctatggcaacattacaagccactggcgcggaggcatctgccacagagcccggatacagaggcactcagctgctttctgattcccgttctcagaagcctggcccggcgtaaacctaccatgacactggaggagggactgtggagggctatgcgcgagtggcaacacacttccaactttgaccgaatgattttctacgagatggccgagaaatttcttgagtttgaggctgaggaggagatgcagatccagaaatcacagtggatgaaggggccccaatgtctcccaccccctgccactcctcgactggaaccccggggaccgccggctccagaggtggttaagcagcccgtctacttgccatcaaaagcggggccaaaagctcccactgcttgcctgccaccgccacgaccccagcgccctgtgaccaaggctcggcggccacccccccggcctcatcgacgggctgaaaccaaagctcggctcccccccccccgccctcagagacccgcggagaccaaggtgcctgaagagattccaccagaggtagtccaagagtatgtagatataatggaagagcttttggggccgtcgctgggggccactggtgagcccgagaaacagcgcgaagagggtgaggttaaacagccacaggaagaagactggactcctccggaccctggtttgctgtcatacacagacaagctgtgttcacagaaagacttcgtgaccaaggtcgaagctgtgatccacccgcagtttctagaggagctactcagccccgatccacaaatggattttctggcgctgtcgcaggaacttgagcaggaggaaggtctcaccctggcacagggggcgccctctgatgcccctggaacagacagatgctag

SEQ ID NO: 29881 - DNA, 759 bp, Artificial Sequence
  Description of Artificial Sequence: Synthetic coding sequence
tgaacaggcgagccagaaaagcagcgggaagaaggtgaggtgaaacagccacaggaagaggattggaccccccctgaccctggcctcctcagttatactgacaaactctgttcacaaaaggactttgtgacgaaggtggaagcagtcatccacccacagtttttggaggagttgctctcgcccgatccacaaatggactttctggcgctgtcccaggaactggagcaagaggagggactgaccctggctcagctcgtggaaaagaggctgcttcccctcaaggagaagcagcacgcccgggcggccccatccaggggcaccgctcgtcttgatagctcttcaagcaagttcgccgcaggccagggagcagagagagacgtaccggatcctcagcagggagtgggcatggaaacctgccctccccagactaccgcacgtgactctcagggccgcggaagggcccatactgctagtggtcttttgagtccagagaaatggggtccccaggggactcatcagtccccaagcgccgaaaggcgcggcttaaacctggccccttccccagcgaacaaggcaaagaagcgcccactgtttgggagcttgtcccctgctgaaaaaactcctcacccaggcccaggactccgggtttctggcgagcagtcccttacctggggtttaggaggcccatcgcagtcacagaaaagaaaaggagatcccttggttagtcggaaagaaaagaagcaaaggtgtagtcagtag

SEQ ID NO: 29882 - DNA, 2637 bp, Artificial Sequence
  Description of Artificial Sequence: Synthetic coding sequence
atggaagtcaaaggacccagcggccggtcattttgttgcgaaagcgaaggccagtttaaatcatgcctgaaaagacacactccgtccctactcttgccctcaagttggaagggaaattcagggtcctgcctcatggcagaggcactgcaccgcacaagccccactccgaatagctgcccactgcccctccccctgtgtagaatgtcaggggttctgtgctccaggaacctcttcaccttcaaatttagcttattccagttagactctggcgcgagcggcgaacctggacactctttaggcctaaccctcggattctcttattgtggcaattgtcagacagccgttgtctcagcacagccagagggaatggcctccaatggagcgtacccagtacttgggcctggcgtgacagctaacccgggtacctccctttcggtcttcaccgccctaccctttactacacctgcccccgggcccgcccacggccctcttctggtgacagctggggcacctcccggcggacctctagtgctgagtacctttccatccaccccactggtcaccgagcaggacggatgctccccgagcggggctggcgccagcaacgtgtttgttcaaatgcgaaccgaggtgggaccggtgaaggccgctcaggcccagacactggtcctaactcaggcccccctcgtgtggcaggcccctggagccctttgtggcggggtagtgtgtcccccaccgctgttattggcagccgcaccagtagtaccagtcatggcggcacaagtcgtgggaggaacgcaggcttgtgaaggagggtggtcccaggggctcccactcccacctccaccaccacccgcggcacagctgcctcccatcgttagccagggcaatgccggaccatggccccagggagcacacggggagagtagcctggccagtagtcaggctaaggctccccccgacgactcctgcaaccctcgaagcgtgtacgagaattttaggttgtggcagcactataagccccttgcgcgcagacacttgccccagagtccggatacagaggctctgtcttgttttctgattcccgtgctccggtccttggctcgacgaaagccaacgatgaccctagaggaaggactatggcgtgcgatgcgggaatggcagcatacatctaatttcgaccggatgattttttacgagatggctgagaagttcctggaattcgaagccgaggaagaaatgcagattcagaagtcccagtggatgaaaggcccacagtgtcttccaccgccagctacccctaggctggaaccgcgaggcccccccgcccccgaagtggtaaaacaacctgtgtatctgccctcgaaagccggcccaaaagctcagacggcttgtctgcctcccccacggccccagaggcctgtcaccaaagcccgccgaccccccccccagccgcacaggagggccgagactaaggccaggctacccccacctaggccacagcggcctgcggagaccaaggttcctgaagaaatccctccagaggttgtccaggagtatgtagatatcatggaagagctcttaggaccttccctcggagcgaccggcgaacccgagaagcagcgggaagaagggaaggttaagcagccacaagaagaagattggacccccccagatccaggattattaagctacattgacaaactgtgcagccagaaggattttgtcaccaaggtcgaagctgttattcacccacagtttctcgaggagctgctctcccctgacccgcagatggacttcttagccctgtcgcaagacttggagcaagaagagggtctcacgctggctcagctggtggaaaaacggctgcctccgctgaaagagaaacagcatagtagggcagctcctagccgaggcacagcccgtttggactcttctagtagcaagtttgccgcgggacagggagccgagcgggacgttcctgatccccaggagggtgttggtatggagacctgccccccccagacaaccgctcgggactcccaagggcggggccgcgcccataccggcatggctcgatctgaggactccgtcgtcctgcttgggtgtcaggactcccccgggctccgcgccgcacggcccacatctcctccccaggatcaccggccaacctgccccggtgtgggaacaaaagacgccttggacctccccggcggctctcccgttagggaatcacatggtttggcccaggggtcctccgaggaggaagagttaccatcacttgcctttcttttgggttcccaacacaaattacttccctggtggctgccacaatcacccgtgcctgcgtcaggcctcctgagcccagaaaagtgggggccccagggcactcatcagagccctagtgcggaacgccggggactgaatctggcaccttccccagccaataaggcaaaaaaacagcctctctttggctccttaagtccagccgaaaaaactccccatcggggccctggtttacgagtgtcaggcgagcagagtttgacgtggggactgggcgggccttcccaaagtcagaagcgaaaaggagatcccctcgtgagcaggaaggagaagaagcaacattgctcgcagtag

SEQ ID NO: 29883 - DNA, 2271 bp, Artificial Sequence
  Description of Artificial Sequence: Synthetic coding sequence
atggccagcaatggcgcatatcctgttcttgggcctggcgtgacagtcaatcctggaacttccctgtcagtgttcaccgccctcccgttcgccacacctgcacctggccctgcccaccggccccccctggtgacagccgttgtgcctccagctgggcccctggtcctctcagccttccccagcacgcctctggtcgcgggccaagatgggagaggaccgagtggcgcaggcgcgtccaatgttttcgttcaaatgagaacagaagtaggaccagttaagccaccccaagctcagaccctgatacttacccaggcccccctggtgtggcaggcacccggtactctttgcggcggggttatgtgtcctcccccgctactattggccgccgctccaggcgtgcccgtcactagcgcccaggttgtcggtggaacccaggcctgtgaggggggctggtctcatggccttccactgcccccacctcctccggctgctcaggtggctccaattgtaagtcctggcaatgccaggccttggccccagggtgcccatggagaggggagcttggccccttcccaggcaaaggcccgcccagacgacagctgtaagcccaagagcgtttacgagaacttccgcctgtggcaacactacaaacctttggcaaggaggcacctcccacaatcaccagataccgaggcgctcagctgctttctcattccagttctcaggtcactcgctcggcggaagccaacaatgacccttgaggagggactctggcaggccatgcgtgaatggcaacacactagtaatttcgaccggatgatattttacgaaatggccgagaagtttttggaattcgaggcagaggaggagatgcagatccagaaatcccagtggatgaaaggccctcagtctctcccccccccagcccctcccaggctggaaccacgcgggccaccagcacctgaggtcgtcaagcagcctgtgtacttaccaagcaaggacggccctaaggccccaacggcatgtctgccaccgccacgaccacagagaccagcggagaccaaggcccacctacccccacctagaccacagcgcccagccgagaccaatgctcacctaccacctcctagaccccagcgccctgctgagaccaaagtccctgaagagataccgcctgaagttgtgcaggagtacgtggacatcatggaggagctgctgggtagtcacccaggagacaccggcgagcccgagggccagcgcgagaaaggtaaagttgagcaaccacaggaagaagatggcattactagcgacccagggctgcttagctatattgataagctctgtagccaggaggactttgtgaccaaagtggaagctgtcatccacccgcggttcctggaggagctactgtctccggatcctcagatggatttcctagccttgagccaggaactggaacaagaggaagggctcactctggcccagctggtggagaagcgactactcagcctgaaggagaaaggctgcggccgggccgccccacgtcacggaacggccaggttagactcgagtccgagcgaattcgctgctggacaggaagccgctagagaggtacccgatccccagcagcgggtgtccgtcgaaacctctcccccccaaaccgctgcccaggaccctcagggccagggccgggtacgcacaggaatggcccggtctgaagatccagccgttcttctcgggtgccaagactcgcccagattgaaagccgtgagaccgacctccccaccacaggatcataggcccacatgtcccggcctgggcactaaagatgctctcggactgcctggggaatcacccgtgaaagagtcccatgggctggctaaaggtagctccgaagagactgagctgccaggcatggtgtacgtcgtaggaagtcatcaccgacttcgaccatggcggctttcccagtcccccgtgccaagttccggtctgttgtctccaggcggtcgggggccacagggcgcactgcaatcaccaagcgcacagaagcggggtctttctccgagccctagccccgcatctaaaagcaagaagaggcccctgttcggctctccatcccccgccgaaaagacaccccatccaggacccggactgcgagtttccggcgagcaatctttagcttggggcctgggcggcccttcccagtctcaaaagcggaaaggggaccctctggccagccgtcgcaagaagaagaggcattgcagccagtag

SEQ ID NO: 29884 - DNA, 1479 bp, Artificial Sequence
  Description of Artificial Sequence: Synthetic coding sequence
atggcctccaatggagcatatcccgtgctcggaccaggcgttacagtgaatcctggcacttctctttcagtcttcacagcccttcctttcgccacccccgcacctgggcctgctcatcgcccacccctcgtaacggcagtcgttccccccgctggtcccctggttttgtcagctttcccttcaactcccctagttgcagggcaagatggccgcgggcccagcggggctggtgcgtctaacgtgttcgttcagatgcgcacagaagtgggacccgtcaaacctcctcaggctcagacactcatactgacccaggccccgctagtgtggcaagcaccgggaacactgtgtggaggggttatgtgtccaccgcccctactattagccgccgccccaggcgtgccggtaacatcagcccaggttgtgggaggcactcaagcatgtgaagggggatggtcccatgggctccctctacctccaccacctccagccgcccaggtggcccccattgtgtccccggggaacgctcgcccttggccacaaggcgcccatggagaaggcagcctcgcccctagccaggccaaagctcggccagatgactcttgcaagcctaagtcggtgtatgaaaacttccgcctgtggcagcattacaagcctttagcaagacgccacctgccacagtcgccagacacggaagcgctctcatgtttcctcattcccgtgcttcggtctctggccaggcgtaagcctacaatgaccctggaggagggactgtggcaagctatgagagagtggcagcatacctctaattttgaccgcatgatcttctacgagatggcggaaaagtttctagagttcgaggctgaagaggagatgcagattcagaaatcccagtggatgaaaggcccacagagtctgccgccacctgcccccccaagactggaacctaggggccccccagcacctgaagttgtcaaacagccagtctatcttccatccaaggatgggcctaaagccccaacagcttgtcttcctcctccacgtccgcaaaggccggctgagaccaaagcccacttgcccccacctagaccacagaggcccgctgagactaaggtgccagaagaaattcccccagaggttgtacaggaatacgtagatatcatggaggaattgctgggcagccacccgggcgacaccggggagcctgaggggcaacgagagaaagggaaagtggaacagcctcaggaggaagacggcataactagtgacccgggcctactgagctacattgataaactctgcagccaggaagattttgtcacaaaagtggaggccgtgatccaccctcgatttctggaagaactgctatcccccgacccacagatggactttctcgctctctcccaagagttggaacaggaggagggcctgactctggctcagggggctcctagtgacgcacttggaaccgaccgctgttag

SEQ ID NO: 29885 - DNA, 2226 bp, Artificial Sequence
  Description of Artificial Sequence: Synthetic coding sequence
atggcaagtaacggggcctacccagtgcttggacccggcgttactgtgaaccctggcacttctttgtccgtgtttacagctctcccattcgcaaccccggccccaggcccggcccacagacccccgctggtgaccgccgtggtaccccctgccggccctcttgtgttatccgcattccccagcacaccactcgtggcaggccaagatggaagaggtccaagtggcgccggagcctctaacgtctttgtgcaaatgaggacagaagtggggccagtgaaacctcctcaagcacagaccctcatcttaactcaagcccccctggtgtggcaggccccgggaaccttgtgcggcggcgtcatgtgtccaccacccttgctgctggcagctgcaccgggcgtacccgtcacaagcgcccaagtcgttggtggcacccaggcctgtgagggcggatggagtcacggattacctctgccccctcctcctccagctgcccaggtggctcccattgtctcacctggaaacgcacgtccttggccacagggtgcccacggcgaaggaagcctggccccaagccaggctaaggccagacctgacgactcatgcaaacccaagtctgtgtatgagaattttcgactctggcagcactacaaaccgctcgcacggcggcatctgccccagtcacccgacactgaggcactttcatgcttcctgattccagtgctgcgatctctggccagaagaaagcctactatgactcttgaggagggtctgtggcaggcaatgagagagtggcagcatacttctaactttgacaggatgattttctacgagatggccgagaaatttctcgaattcgaagctgaggaggagatgcaaattcagaaaagccagtggatgaaaggcccccagagtcttccacctcctgcgccgcctcggttggagccgaggggccccccggcacccgaggtggtcaagcagcccgtttatctgcccagcaaggacggccccaaagccccaaccgcctgcctgccaccccctaggccacaacgtcccgccgaaacaaaagctcatctaccccctcccagaccacagcggcctgccgaaaccaaggtacctgaagaaattcccccagaggtggtccaggaatatgttgatataatggaagagctgttagggagtcaccccggagatactggcgagcccgaggggcagagggagaaaggaaaggtggagcagccccaggaagaggacggaatcactagtgatccaggcttgttgagctatatcgacaagctctgttcccaagaggatttcgtgactaaagtggaagcagtgatacacccccgatttttggaggaactactcagtcccgatccgcagatggactttttggcactctcccaagaactggaacaagaggagggattgacgcttgctcaactcgtcgaaaagagactattatcactgaaggagaaagggtgtgggcgtgccgcaccacggcacggaactgcccggctcgactcttccccaagcgaattcgctgcaggacaggaagccgcacgggaggtgcccgacccacagcaaagagtgagcgtggaaacatctcccccacagaccgccgctcaggatccccaggggcaaggccgagtgagaaccgggatggcacgcagcgaagacccggccgtgttattaggctgccaggactccccaaggctaaaggccgtcagacctaccagtcctccccaggaccatcgcccaacatgcccgggactcggtactaaagatgccttgggcttgcctggcgaaagccctgtaaaagagtcacacgggctggccaaagggtcgtccgaggaaaccgagctgccaggaatggtttatgtcgtcgggtcacaccatcgcctgaggccatggaggctgtctcaatctcccgtcccatcatccggcctgctgagccctgggggtaggggccctcagggtgccctgcagtcaccgagcgcccagaaaaggggactgtctccctcaccaagtcccgcctccaaatctaagaaacggcctcttttcggctccccatcacctgcagagaaaactccacatcccggcccgggccttcgggttagcggtgaacaatctctggcttggggtttagggggcccaagccagtctcagaagaggaaaggagaccccctggcgagtcggcgcaagaaaaagaggcactgctcccagtag

SEQ ID NO: 29886 - DNA, 1773 bp, Artificial Sequence
  Description of Artificial Sequence: Synthetic coding sequence
atggcgtccaacggtgcttacccagtcttgggcccaggggtgacagtcaatcccgggactagtctgagcgtttttacggcattacctttcgccaccccggcaccagggccagcgcaccggccacccctggtgactgcagtcgtgccacccgcgggccctctcgttctctccgcttttccaagtacacctctggtcgccggccaggatggtagaggtccctccggagccggagccagtaatgtcttcgtccagatgcgcacagaggtaggacctgtgaaacctccacaggcgcaaacactgattctgacccaggcacctctggtctggcaagcccctggtaccctgtgcggcggggtgatgtgccctcccccactgctccttgccgcggcacctggcgtcccagtcacaagtgcgcaggtggtcggcggtacccaggcctgcgagggtggctggagccacggcctgccgctgcctcctcctccaccagcagcccaggtagctcctatagtgagcccaggtaatgcaagaccctggccccaaggagcccatggcgaaggatcactggccccgagtcaagccaaggcacggcccgatgatagctgcaagccgaaaagcgtgtacgagaacttccgcttgtggcaacactacaaaccattagctcgaagacaccttcctcagaaagtagttcaggagtacgtcgacatcatggaagagctcctgggttcacacccaggagatacaggagaacccgagggtcagagagaaaaagggaaagtggagcaaccacaggaagaggatgggatcacctcagatcccgggctgctctcgtacatcgataaactttgctctcaagaagacttcgtgactaaagtagaagccgtaatccacccccggttcctcgaagagttgttgagccctgatcctcagatggactttctcgccctcagccaggaactcgagcaagaagaaggtttgactctggctcagctggtggaaaagagactcctctcgctgaaagagaaaggatgtggcagagctgcccctcgccacgggacggcaaggttagactcttctccatcagagtttgcggccggacaagaggctgcccgggaagtccctgaccctcaacagcgggtttccgtggaaacctctccacctcagaccgcagctcaggaccctcaaggacagggacgggtaagaactggcatggcgcgcagcgaggaccccgctgttctgcttggctgtcaggattcccctcgccttaaggcagtgcgtccgacctcgccaccccaggaccatcgaccgacttgtcctggattaggaacgaaggacgcccttggccttcccggagagtcacccgttaaggaatctcatgggctcgctaagggatcaagtgaagagaccgaactccctgggatggtgtacgtcgtcggttcacatcaccggctgcgcccatggaggttgtcccagtcccctgtcccaagcagcggactcttgtcgcctgggggtcgtggtcctcaaggggccctccaatccccatcagcgcagaaaagggggctgtccccatctcccagtcctgcctccaagagcaagaagaggcccctgtttggatccccctcccctgccgagaagacccctcacccgggcccaggtctgagggtttctggggaacaatcgctcgcatggggtctgggaggcccatcacagtctcaaaagagaaagggggaccccctagccagccggagaaaaaaaaagagacactgctctcagtag

SEQ ID NO: 29887 - DNA, 1479 bp, Artificial Sequence
  Description of Artificial Sequence: Synthetic coding sequence
atggcgtctaacggagcgtaccctgtactgggaccaggagttactgtgaaccccggaacatcactgagtgttttcaccgccttgcccttcgctacgcccagtcccggaccaacacacaggccacctctagtcacagccgtagttccaccggcaggccccttggtcctgagtgctttcccttctaccccactggtcgccggtcaagatggtagaggcccgtctggtgcaggcgcctctaacgtgtttgtgcaaatgaggacagaagttggacctgtgaaaccaccgcaggcccagaccctcattttaactcaagctccgcttgtctggcaagctccgggaaccctgtgtgggggtgttatgtgtccaccccccctgttgctggcagcggcaccgggtgtccccgtgaccagcgcccaagttgtgggcggaacccaggcatgcgagggtgggtggtcacacggcctgcctctgccgcccccccccccagcagcgcaggtagcaccgatcgtgtctcctgggaacgctggcccttggcctcagggagcccatggcgagggcagcctggccccttcacaagccaaggccaggcctgacgacagctgcaagcctaagagtgtttacgaaaattttagactttggcagcattacaaaccattggcgagacgacacctccctcagtcccccgataccgaagcgctgtcttgctttctcatccccgtactccgaagtctcgccaggagaaagccaaccatgacactcgaagagggactgtggcgcgccatgagagagtggcagcacacatccaactttgatcgtatgattttttatgaaatggcggctaaatttctggagtttgaggcagaggaagaaatgcagatccaaaagtcgcaatggatgaaaggcccacagtcgctgcccccccccgcacctccgcgactagaaccgagaggacctcccgcaccagaggtcgtcaaacagccagtgtatttaccaagcaaagatggaccaaaagcacccacagcttgtcttccccccccaagaccccaaaggcccgccgagaccaaagcccacctgcctcctccacgcccacctagaccagccgagacaaaagtgccagaggagatcccgcctgaagtcgtccaagagtacgtggacattatggaggagcttttgggttcacaccccggagatacgggcgagcctgagggacagcgggaaaaggggaaggtcgagcaaccacaggaggaagatggcatgacctcagaccccggactactgagttatatcgacaaactttgtagtcaggaagattttgtgacaaaagttgaagccgtgatacacccaaggttccttgaagaactgctgtccccagatccacagatggactttttggccctatctcaggaactggagcaagaggaagggttgacgctagcccagggcgccccctcggatgcactgggaaccgatagatgttag

SEQ ID NO: 29888 - DNA, 2226 bp, Artificial Sequence
  Description of Artificial Sequence: Synthetic coding sequence
atggcatccaatggagcttatcctgtactgggtccaggagtgacggtcaaccctggtacctccctgtctgtgtttaccgccctgccctttgcaactcctagccctggccccacacacagaccccctctagtgactgccgttgtgcccccggccggaccactggtgctgtccgcgttccctagcacacccctagtggcgggacaggatggaaggggtccgtccggagctggcgcttccaacgtgttcgtgcagatgagaaccgaagttggcccagtgaagcctccacaagcacagaccctgatcctcacacaagcccctctagtgtggcaggctcccgggactctatgtgggggcgtgatgtgtcccccaccattactcctggcagccgcacctggcgttccagttacctccgcccaagttgtaggtgggactcaggcgtgtgaaggcggttggagtcacggtctgccacttcctccgccacctcccgctgcgcaagtggcaccaatagtcagtcccgggaacgcaggtccctggccccagggggcccacggtgaagggagtctggctccttctcaggcgaaagcccggccagatgattcctgcaagccgaagtccgtgtatgaaaattttcgattgtggcagcactataagcccctggctcggcgccatcttccacagtctccagatacagaggccctgagctgctttcttattcctgttctgagatccctggctaggaggaaaccaacaatgaccctcgaggagggactctggcgtgctatgagagaatggcagcatacttccaacttcgatcgaatgatcttctacgagatggcggccaaatttcttgaatttgaagcggaggaggaaatgcaaattcagaagtcacaatggatgaagggaccccagagcctgcctccaccagcccctccacggctagagcccaggggtcctcctgcccccgaagtcgtcaagcagcccgtgtacctgccgtctaaggatggaccaaaggcaccgaccgcctgtttacccccaccccgcccccagcgcccagccgaaacgaaggcacatctcccccctcctagacctccgcgacctgccgaaactaaggtgcccgaggagattccccccgaagtggtacaggaatatgtggacataatggaggaactgctgggctctcatccgggcgataccggtgaacccgaaggtcagcgcgagaagggaaaagtagaacagccacaggaggaggatggcatgactagtgatccagggctgctctcatatatcgataagctgtgtagccaggaagacttcgtcaccaaagtggaggcagtgatccatccccggttcctggaagagctgttgtcccctgaccctcagatggacttcctcgctctgagccaagaactcgagcaggaggagggcctgacactggcacaactcgtggaaaagcgactgctctccctaaaggagaaaggctgtggaagagctgctccccgtcatggcacagcacgcctcgattcaagtccttccgagttcgctgctggacaagaagcagcacgcgaagtgccagacccacagcagcgtgtttccgtcgagacctctccaccacagacagcagcacaagatccccagggccagggcagagtgcgtactggcatggcaaggagcgaagatcctgcagtgttgctgggatgccaggactccccacgcctgaaggccgtgcggccaacatccccaccacaggaccaccgtccgacgtgccccggactgggcaccaaggacgcccttggcctgcccggcgagtctcccgttaaggaaagccacggcctggctaaaggaagctctgaggagactgagcttccaggaatggtttatgtcgttggaagtcatcatcggctacgtccatggcggttgtcccagtcccccgtccctagttccggactgctgagccctggaggccgggggccgcagggcgccctccagtctccatccgcacagaagcgcggactgtctccctcgcccagccccgcttccaaaagcaagaagcgcccgctgttcgggtctccctcaccggctgagaaaacacctcaccccggccctgggcttcgggtgtctggtgaacaatcacttgcctggggactgggcggtccgagtcaatcccaaaagaggaaaggtgacccactcgcaagccggagaaaaaagaaacgacactgctctcagtag

SEQ ID NO: 29889 - DNA, 1869 bp, Artificial Sequence
  Description of Artificial Sequence: Synthetic coding sequence
atgtgtcctcctcctctgttgctcgcagctgcacccggagtacccgtcacctcggcccaggtggtaggcggcacgcaggcctgcgagggcgggtggtcccatggcctgccgctgccaccaccaccccctgcagcacaggttgccccaatcgttagtccaggaaatgctggaccatggccacagggagcacacggagaaggctctttggccccgagtcaggccaaagccagaccggatgactcgtgcaagcccaagtctgtctacgagaacttccggctctggcagcactacaagcccctggctcggcgacacctgccacaatctcccgacaccgaagcactgtcgtgcttcttgattccggtgctgaggtctctggctcgacggaagccaaccatgactctagaagaggggttgtggagagccatgcgggaatggcagcatactagtaattttgatcgcatgatcttctatgaaatggcagccaagttcctggagtttgaagccgaagaagaaatgcagatccaaaaatcacagtggatgaagggcccccagtccctgcccccccccgctcctccaagactcgagccgcgaggccctcctgccccggaggtggtgaaacagcctgtgtaccttccctccaaggatggtccaaaggctccgactgcctgcttgcctccaccacggccccaacgaccagctgaaaccaaagcgcatctcccacctccacggccccctaggcccgctgagaccaaggtgccagaggagattcctccggaggtggttcaggaatacgttgacatcatggaagagctcttgggttcccatcctggcgatacgggagagcctgaaggccagagggaaaaaggcaaggtcgagcagccgcaggaggaggatggcatgactagtgatccaggactcctcagctatatcgacaaactgtgcagccaggaggactttgtgaccaaggtggaggcagtcatccacccaaggttcctggaagagctgttaagccccgacccacagatggacttcttagctctgagccaagagctcgaacaagaagagggtctgaccctggcccagttggtggagaagagactcctttcccttaaagaaaaaggttgtggaagggccgctccacgacatggtactgcccgccttgactcctccccgagcgagtttgccgccggacaagaggctgcaagggaggtgcccgacccccaacagagagtatcagtcgaaacttcccccccccaaacagctgcccaggaccctcagggacagggacgcgtcagaactgggatggctaggtccgaagaccctgccgtactcttaggctgtcaggattcaccaaggctcaaagccgtgcgccctactagcccaccacaggaccataggccaacttgtcccggcctgggcacgaaggatgcactcggactccctggagagagccccgtcaaagaatctcatgggctggcaaagggcagttccgaggagacggagctgccaggcatggtgtatgttgttggcagtcatcataggcttagaccctggaggcttagtcagtcccctgtgccttctagtggccttctctctcctggaggaagagggccacagggtgccctgcagagtccctcagcccaaaagagggggctttccccttccccaagtcccgccagcaagagcaaaaaacgtcctctctttgggagcccgtctcctgccgagaagactcctcacccagggccaggcttgcgagtgagcggggagcagtccctggcttggggccttggtgggccaagtcagtctcagaagcggaagggtgaccccctcgcctctagacgcaaaaaaaagcgacactgttcacagtag

SEQ ID NO: 29890 - DNA, 1773 bp, Artificial Sequence
  Description of Artificial Sequence: Synthetic coding sequence
atggccagtaacggagcatatcccgtcctgggacccggagtgacggtcaaccctggaaccagtttaagcgtcttcaccgctctaccctttgccacacctagcccggggcctactcaccgaccacccctggttacagcagtggtgccacccgctggcccgttggtcctgagcgctttcccaagcactccgctcgtggcaggtcaggacggacggggcccttctggcgcaggtgcctctaatgtgtttgtacagatgaggacggaggttggacccgtgaaacctccacaggcacagaccttaatcctcactcaggcacctctggtgtggcaggcccccggcacactgtgtggcggcgtgatgtgtccgcctccgctcttattggctgcggcccccggagtgcccgttacatcagcccaagtggtgggtggaacacaggcctgtgagggtggatggagccacggcctgccacttcctcctccgccacctgccgcccaagtagcaccgatagtcagtcctgggaatgccggtccttggccccagggagcccacggtgagggaagtctcgcgccctctcaggccaaagcccggccagacgactcatgtaagcctaaatcggtgtatgaaaattttcgcttgtggcaacactacaagcccctggctcgacgccacctcccccagaaggtggtccaggagtacgttgacatcatggaggagttactgggctcccatcctggggacactggagaacccgaaggccaacgcgagaaggggaaagtggaacaacctcaggaagaggacggaatgacttccgatcccgggctgctctcctatattgataaattgtgttctcaggaggacttcgtgaccaaagtcgaggccgtgattcatccacgtttccttgaggaactgttaagtcctgatcctcaaatggatttcctggccttgagccaggagctcgaacaggaggaggggctcactctggctcaactcgtggagaagaggctgttgagccttaaagagaagggttgtggccgcgccgcccctcgccacggaacggccaggctggattcttctccctccgagtttgccgccggacaggaggctgctagagaggtgcccgatcctcaacagcgggtctccgtcgaaacctcgccacctcaaacagccgcccaagatccccagggccagggacgcgtacggacggggatggcccgctccgaagaccccgccgtcctcctgggttgtcaggacagccctagactgaaagccgtgcgacccacgtctccacctcaggaccaccggccaacatgtccaggacttggtacgaaggatgctctgggcttacctggggaatcccccgtgaaggagagccacgggctagcgaaagggtcatcggaagaaacggaactgcctggcatggtttacgtggttggatcacatcatagattgcggccctggaggctcagccagtccccagtccccagcagcgggctgctcagtcccggtgggcgcggaccccagggggcactacaatcaccctccgcccagaaacgtgggctcagtccttccccgtctcctgcgtcgaaatcaaaaaaaagaccattgtttggctctccatctcccgccgaaaagactccacatccaggcccagggctgcgggtatctggggagcagtcactcgcttgggggctcgggggacccagtcagtcccaaaagagaaagggggacccacttgcatcgaggagaaagaaaaaacgccattgtagccagtag

SEQ ID NO: 29891 - DNA, 1689 bp, Artificial Sequence
  Description of Artificial Sequence: Synthetic coding sequence
atgctggcttgtctgcctgggccgggggacctctcctttcaactgcttagccacacacagatgaacactggactgcaaaagtgggataccactcagaagatgaggaccgcccactacccaactccagccgagctggacgcttatgccaagaaggtggctaacaaccccctgactatcaagatctttccaaacagcgtcaaggtgccccaacgaaagcacgtgaggcggacagtaaatggacttgatacatccgcccagcggtactccccctacccaactcaggccgccactaaggctggacttctggctatagtgaaggtacccgctaagtcaattctcaaggatttcgatgggacacgggctaggctgctgcctgaagcgataatgaacccacccgtggccccatacgctacggtggccccaagcaccctcgcccacccccaggctcaggctctggcacgtcagcaggccctccaacacgcacagacgttagcccatgccccaccacagaccctccagcacccacaggggattccaccccctcaggccctgtcacatccccagagcctccaacagcctcaggggctgggccatccacagcccatggcacagacccagggtctcgtgcatccacaggccctggcccatcaggggctccagcaccctcacaatccattgctgcacggtggtcggaagatgccagacagtgacgccccacccaacgtgaccgtctccacaagcacaatcccattatcaatggcagccactctccagcacagtcagccacccgacctcagtagcatcgtgcatcaaatcaatcaattctgccagactagggctggaattagcaccactagtgtgtgcgaggggcaaatcgcgaacccctccccaattagccgttctctgttgattaatgcttccacgcgcgtctccactcacagtgtcccaaccccgatgccaagctgtgttgtcaaccccatggaacatacccacgccgcaaccgcagctctgcctgcagcaggcccagttaacctccccaccgggatcagccgggtgccgacggggtatccatccgatttaaagcctgtcacctggaatcagcaccagctggcacatctgcagcagatgtgctctgaggcctccgggacacctgcccccggtttgaccggcaagcacgcagcgggaagggagttggcgggacctgggtttgtgggaaaagccccagcgtatccccaggagctgtgtctcgcacagagttttcacctgaagcccccactcgagaagcctactccatctccacccgtgaatggtatggccgctcccctggcatatcctaatgggcactacttccagccactctggaacaacatcctgcccacacctaactcagattccagcggcagccaggacctggccatgcccttccacgggggccagcccactggggctccacttgactgcgcagctgcccctggtgctcactaccgggcgggtacaggaggaggccccgtggcctcccagaacagtctcatgcagacggtcgattatttgtcaggagactttcagcaggcgtgttttagagagcagtcactggccatgctctctaaggctcatagggcaccaggcaacagggctccagacccaacagagtctcgcagtctccatatacaacatcctggctatcgttag

SEQ ID NO: 29892 - DNA, 960 bp, Artificial Sequence
  Description of Artificial Sequence: Synthetic coding sequence
atgaagaacgtggatagtgatgacttggtaactggcaccctgcccaaactcaagtcctccaaagagtggctggagccaaagcctctttgcttcatggaggtgttagcgaaggaagacacagaggctgctatccagtccatcctgtataaggagaattccgtaattaaagaattggataaatatctgcagcaccacgcgtttctaaatgctcgcagaaaggagatgttgtacaagcgctgggtcgattgcgtggctgatcctttgcaaaagaagatcattgaaaaagtttgtagtcataaaaaaataaagaaacgaaggcaaggggagctcgatggattcctcaaacatgtgaataagaaagggaacgcatttattgaacactacgatcccaaagagtacgaccccttctacatgtcaaaaaaagaccccaactttcttaaagttaccattccgcccttccatgatccactgaagaaggcgcagtacgataaagataacgaaaagagaactctgctgcagtgtgagactggtaagatctacagcatcaaggagttcaaagaagttgagaaagttcagctacatagtaggttcccccagattagcaacagccgtcacttcattacacctaatgagtggcttaagctgcccacacggtatatagagagcgaattctgtcggcgcaggaggttaaaagttaaggtgaactttaatgactgcagctttgacctcaaacccttagcccgcgccccatacttgctggaaagtcaagaagaggaaaagacggtgatatacaagaataagggatctagcttcttggagcgggagccactgtgttatcaggagggtaacaatccttcagctaaggaggccatcagcgagggatacttcagcagtctttcgctcagtcggaacggccgcaagacaagaatgggactgccaccacgagtgtgggggtgctag

SEQ ID NO: 29893 - DNA, 318 bp, Artificial Sequence
  Description of Artificial Sequence: Synthetic coding sequence
atggccaaaatgttcgatcttagaaccaagatcatgataggtatcgggtcttcactgctcgtggctgccatggtgctgttgtctgtcgttttctgcctttacttcaaggttgccaaggcattgaaagccgctaaagatcccgatgctgtggctgtgaaaaatcacaacccagataaagtgtgttgggccaccaacagccaagcgaaagctaccacaatggaatcttgcccctccctgcagtgttgtgaggggtgcaggatgcatgcttccagcgactccctacccccttgttgttgcgatatcaacgaaggcctgtag

SEQ ID NO: 29894 - DNA, 291 bp, Artificial Sequence
  Description of Artificial Sequence: Synthetic coding sequence
tagacagtttgctgtcataccatgttgggaggtctgggcaagctggccgcagaggggctggcccatcgcacagagaaggcgactgaaggcgcgattcacgcggtcgaagaagtggtaaaagaggtggtcggccacgcaaaagagacaggggagaaagccatagccgaggccattaaaaaggctcaggagtcaggcgataaaaagatgaaagaaattacggaaaccgtaacaaacactgtgaccaatgccatcactcatgccgccgagagcttggataagctaggccagtag

SEQ ID NO: 29895 - DNA, 270 bp, Artificial Sequence
  Description of Artificial Sequence: Synthetic coding sequence
atgttgggggggctaggcaaactggctgccgagggattagcgcaccgcactgagaaggctactgagggggccatacacgcagttgaagaggtcgttaaagaagtggttgggcacgcaaaggaaaccggtgaaaaggccatcgccgaggcaataaagaaggcccaggaatccggcgacaaaaagatgaaggaaattacggaaacagtgaccaatactgtcaccaacgctataacccatgccgccgagtctctggacaaactcggtcagtag

SEQ ID NO: 29896 - DNA, 291 bp, Artificial Sequence
  Description of Artificial Sequence: Synthetic coding sequence
tgaaccgtctgctgccataccatgctgggcgggctggggaagctggccgcggagggcctcgcccatcgaaccgagaaagcaacagaaggcgcaatccacgcggtagaggaggtagtcaaggaggtggtgggccacgctaaagagactggggagaaggccattgctgaagccatcaaaaaagctcaagaaagtggcgataaaaagatgaaggaaattactgaaaccgtcaccaacacagttaccaatgctatcacccacgccgccgagagtctggataagctggggcagtag

SEQ ID NO: 29897 - DNA, 291 bp, Artificial Sequence
  Description of Artificial Sequence: Synthetic coding sequence
tgaaccgtttgctgccatacaatgctggggggacttggtaagttggccgcagagggcttggcccacagaactgagaaggcaactgaaggggctatccacgccgtagaagaggttgttaaggaagtggtgggacatgcgaaggagaccggtgagaaggctatcgccgaagcaatcaaaaaagcccaggaatcgggagacaagaaaatgaaggaaatcacggagacggtgaccaatactgtcactaacgccatcactcatgcagctgagagtctggacaagctcggacagtag

SEQ ID NO: 29898 - DNA, 270 bp, Artificial Sequence
  Description of Artificial Sequence: Synthetic coding sequence
atgttaggcggccttggtaagctggctgccgaaggactagcgcatcgcacagaaaaagccaccgaaggggccattcatgccgttgaagaggtggtgaaagaggtcgtggggcacgcaaaggagactggtgaaaaggcaatcgccgaggctataaaaaaggcccaggaaagtggcgataaaaaaatgaaagaaatcacagagaccgtgacaaacactgtcaccaacgctataactcacgccgccgagtcccttgataaactgggccagtag

SEQ ID NO: 29899 - DNA, 270 bp, Artificial Sequence
  Description of Artificial Sequence: Synthetic coding sequence
atgctcggcggccttggaaagctcgccgccgaagggctagcacatcgcacagagaaggctaccgaaggagctattcacgctgtggaggaggtcgtaaaagaggttgtcggccatgctaaggagacgggcgagaaagccatcgcagaagcgattaagaaggctcaagagtctggagacaaaaagatgaaagagatcacagagactgttaccaacacggtgacaaatgcaatcacacacgcagcggagtctttagataagctgggccaatag

SEQ ID NO: 29900 - DNA, 291 bp, Artificial Sequence
  Description of Artificial Sequence: Synthetic coding sequence
tgaaccgtgtgttgccacacgatgctgggcgggctcgggaaactggctgcagagggtctcgcccataggacagaaaaggccactgagggcgcgatacatgctgtggaggaggttgttaaagaggtcgtggggcatgctaaagaaacaggcgagaaagctattgcagaagccatcaagaaggcccaagaatctggcgacaagaagatgaaggaaatcaccgagaccgttacgaacaccgtcaccaacgctattactcacgcagcggaaagtttggacaagctcggacagtag

SEQ ID NO: 29901 - DNA, 204 bp, Artificial Sequence
  Description of Artificial Sequence: Synthetic coding sequence
atgcgcaagcctcaagcgggaacaggggaagcggccagagacccatctcttaggcctgcgagaaccgtcctagtcggcgatcaggacgagtacactgcggctgagaacaagtcccccagagggaccctgtgccccaccggagagcaacgcattcacgctagagaagacgcgtgcatcttctccagattgttttccgagaaatag

SEQ ID NO: 29902 - DNA, 204 bp, Artificial Sequence
  Description of Artificial Sequence: Synthetic coding sequence
atgcggaaaccccaggctgggacaggagaagccgcgagggatccctctctcaggcccgcaaggacggtcctggtcggtgaccaggacgagtataccgccgctgagaataagagcccgcgcgggactttgtgtccaactggcgagcagagaattcacgcacgagaggatgcatgcatcttttcacgcctgttctcagaaaagtag

SEQ ID NO: 29903 - DNA, 378 bp, Artificial Sequence
  Description of Artificial Sequence: Synthetic coding sequence
atggggattttccagctattgcgggaccggaggatttccagtaggggacccggactgcacactcccaaggctgaaccccgccgccgtaagggactgacaacaggtctgatgacacaggcagagcggcaaaagcaagctcatcagcgtcaggcaaccatgcgcgagaccgcactgtggtgcaccggccacattagaccacgcacccatatgcataccggcacacacacccagaccgacagagagcgggagcgcaacacacagcgcctcagagacagagaacggcgcgagaatggcagacacacacatattcatactcagacccaccgacagtcattgattgccaaggccctgaaggatacgcatcccggcaacccttag

SEQ ID NO: 29904 - DNA, 279 bp, Artificial Sequence
  Description of Artificial Sequence: Synthetic coding sequence
atgactaagccacaggccgaatcaggcgaggcagcccgccatccaatctttagaccggcccgaagagtgttcgggatcaaaatgacaacgctgcagccacggattaaggcgccccaagaactcacagtgctgcaggaacgctccaggcccacatccaaaaaaatggccgtctgttttcacggatctagcctgaggagcgaggccacaccaaggtatagcttagaagaagaggcccgaaacggcaggtggcagcaggccttatcttggtggcccctgtag

SEQ ID NO: 29905 - DNA, 2508 bp, Artificial Sequence
  Description of Artificial Sequence: Synthetic coding sequence
atgtcgggtggctcccaggtccacatattttggggcgcgcccatagcaccactgaagatcacagtcagtgaagacactgcatctctgatgagcgtagccgatccttggaaaaagatccagctgctctacagtcagcattcactgtatcttaaggatgagaaacagcacaagaacttagagaattataaagtgcccgagagcatcgggtcccctgatctttcaggacattttctggctaattgcatgaaccgacacgtccacgtcaaggacgactttgtgaggtcagtgtcagaaactcagaacatcgaatcccagaaaattcatagttccaggctttccgacatcacttcgtcaaacatgcagatttgcggtttcaaaagcacagtacctcactttactgaggaggagaaataccagaagctgttatccgagaacaaaattcgggatgagcaaccgaagcatcagccagacatatgtggcaaaaactttaatacaaatctgttccagctgggacataaatgtgctgcggtgttggacctggtatgctccacagagaagatcaatatcggcccagaagtggtgcagcgcgagtgtgtgcctaccgagtatcatgagatccagaaccagtgtcttggtttgttcagctcgaacgctgtggacaagagcaggtctgaggcagccgttcgcaaagtgtcggacctgaagatttcaactgacacagagtttctgtcgatcatcacttccagtcaagttgcttttctggcacaaaagaaggataaaaggagatcccccgtcaataaggggaacgtgaacatggagactgaaccaaaggcctcttacggggagattcggatccccgaagaaaattcaatccagctcgatggattcactgaagcctatgaatctggacaaaatcaagcctactccctggagctattctcccctgtgtgtccaaagacagagaactcaaggatacatattaatagcgataaaggcctagaagagcatactgggtcacaggagctcttctcctctgaagacgagcttccacctaacgaaatcaggatcgagctttgctcctccgggattttatgtagccagctgaatacatttcacaagagcgctatcaagcgctcttgtaccagtgaggacaaagtgggtcagtctgaagccctcagcagagttcttcaggtggccaaaaaaatgaagctgatctccaatggcggggattcagccgtggaaatggaccgccgcaacgtgtccgaattcaaatcaatcaaaaagacaagcctcatcaagaattgtgacagtaagtcacagaaatacaactgcctcgtgatggtgctgagcccctgccacgtgaaggagatcaatattaagtttggcccgaattcagggagtaaagtacctctcgcaacagtgacagtgattgaccaatctgaaaccaagaaaaaggtgttcctctggaggactgccgccttctgggcatttactgtctttttgggggacatcatcctgctcaccgatgtggtgatccacgaagatcaatggatcggggagaccgtgttgcagagcacctttagcagccagctgctgaatctgggctcttactcaagcatccagcctgaggaatactcctcggtggtttcagaggttgtccttcaggacctgctggcctatgtctcatctaaacattcctatctgcgcgacctacccccaagacagccacagagagtgaacagtatcgactttgtagagttagagcatctccagcccgatgtactggtccatgccgtacttcgggtggttgactttacaatactgaccgaggctgtgtattcctatcgaggccagaaacagaaaaaggttatgcttacagtggaacaggcccaggatcagcattacgccctggtcttatggggcccaggtgcagcctggtacccccagctgcaaagaaaaaagggcgttgtgttaatcaaagcacaaatttccgaattggcatttccaatcactgccagtcagaaaatcgctctaaatgcccacagctcgctcaagagcatcttctcttcattgcctaacatagtttataccggatgcgccaaatgtggattagagcttgaaacggatgaaaaccgcatctacaagcagtgtttctcctgtttgcctttcacaatgaagaaaatctactacaggcccgctctgatgacggccatagatggccgtcacgacgtgtgcattcgcgtggagtcaaagctaatcgagaagattcttctgaatataagcgctgactgtttaaatcgtgtcatagtgccatctagcgagataacttatggcatggttgtggctgacctttttcactccctgcttgcggtgtcagctgagccttgcgtactgaagatccagagtctttttgtccttgacgagaattcatacccccttcagcaggatttctcccttctggatttctaccctgacattgtcaaacacggtgctaacgctaggctgtag

SEQ ID NO: 29906 - DNA, 2715 bp, Artificial Sequence
  Description of Artificial Sequence: Synthetic coding sequence
atgagcggaggcagtcaggtgcatatcttttggggtgcgccaatcgccccattgaagatcaccgtcagtgaagacactgcatcattgatgtcggttgctgacccctggaagaagatccagctgctgtactcacagcactctctctacctgaaggacgagaaacagcacaagaatctggaaaattacaaggtgccagagtcaatcgggagccctgatctctctggccattttctcgccaattgcatgaatcggcacgtgcacgtcaaggacgatttcgtgcgtagtgtgtccgaaactcagaacatcgagtctcaaaaaattcacagctccagactttctgacattacgtcctccaacatgcaaatatgcggtttcaaatcgactgtcccacattttactgaagaagaaaagtaccaaaagctactttctgaaaataagattcgggatgagcaaccgaaacatcaaccagacatatgtggcaagaactttaacaccaatctgtttcagctcgggcacaagtgcgccgcagttctcgacctcgtctgcagcactgagaaaatcaacatcggacccgaagtggtgcaacgcgagtgtgtgcctactgaataccacgagatccaaaatcaatgcctcggactttttagctcaaatgctgtggataaatctaggagcgaagcagccgtgcgaaaggtaagcgacctgaagataagtacagacactgagttcctgtccatcatcacatcatcacaggtggcatttctggcccaaaagaaagataagagaaggagtcctgtgaacaaggggaatgtcaacatggaaacagagccaaaagctagctatggggagatcaggatccctgaagagaactccattcagttagatggctttaccgaggcgtacgaatccggccagaatcaggcctatagtttagaactcttcagtcccgtttgccccaagacagagaatagtagaatccatatcaactcagataagggactcgaggaacatactggatcccaagaactattttcctcagaggacgaactgccacccaatgagatcagaatagaattgtgtagttctggcattctctgctcccagctcaacacatttcataaatcggcgatcaagcggagctgcacaagcgaggataaggtgggtcagagtgaggccctgagtagggtcttacaagtagcaaagaagatgaagctgatctctaacggtggagatagcgcggtcgagatggaccgccggaatgtatccgaattcaaaagcattaaaaagacgagcttaatcaagaattgtgattcaaaatcccaaaagtacaattgcctagtcatggttctctccccttgtcatgtgaaagaaattaacatcaaatttgggccaaatagcggtagtaaggtccctctggcaacagtgacggtgattgatcagagcgagaccaaaaaaaaagtgtttctgtggcgcacagctgcattttgggccttcacagtctttctaggcgatataattctgttaaccgatgtcgtaatacacgaagatcagtggattggagaaacagttctccaatctacctttagcagtcagctgctgaacctgggctcctactcttccatccagcctgaggagtacagctcagtagtttccgaggtggtgttacaggacttgctggcgtacgtgtcatccaagcacagttatctgcgggatcttccaccgaggcagccccagcgggtcaatagcattgatttcgtggagctggaacacctgcagccggatgtgctggtccatgccgtgctccgggtcgtcgatttcaccatcctgactgaggctgtgtatagttatcgcggtcagaagcagaaaaaagtgatgctgaccgtggagcaggcacaggaccagcactacgccctggtgctctgggggccaggtgcagcctggtacccacagctgcagcgtaaaaaaggttatatctgggaattcaagtacttgttcgtccagtgcaattacactctggagaaccttgaactgcataccacaccttggtcatcttgcgaatgcctgtttgatgacgatattagggcaattacatttaaggcaaagtttcagaagtctgccccttcctttgtaaagatttctgacctggcgactcacctggaggataaatgcagcggggtggtgttaattaaagcccaaatctccgagctggcttttccaatcacggctagtcagaagatagccctaaacgcccactccagcctgaagtccatcttcagttcacttccaaacatagtatatacgggctgcgccaaatgcggactggagctggagactgatgagaatcggatctacaaacagtgtttcagctgccttccatttaccatgaagaagatctattaccggcccgcgctgatgacagctatagatggtaggcacgacgtttgcattcgagtcgagtcaaagctgattgagaaaattctgctgaacatatctgccgattgcctgaaccgcgtcatcgttccaagcagcgaaatcacttacggtatggtggtggcagacctgttccattccctattagctgtttcggctgagccttgtgtactcaaaatacaatctttgtttgtcctcgatgagaatagttatccactacagcaagatttttccctattagatttctatccggatatcgtgaaacacggtgcaaacgcacgactctag

SEQ ID NO: 29907 - DNA, 1680 bp, Artificial Sequence
  Description of Artificial Sequence: Synthetic coding sequence
taagacgagctccccccaaatgagattagaatcgaattgtgctcaagcgggatactgtgcagccaattgaatacttttcacaaatcagctatcaaacggagctgcacctcagaagacaaagtaggccagtccgaggcactgagtcgcgtgctgcaggtggcgaagaaaatgaagctaatcagcaacggaggcgactcggcagtcgaaatggatcgccgcaacgtgtccgaatttaagtcaattaaaaaaacatccttgattaaaaactgcgatagcaagagccagaagtacaactgtcttgtaatggtgttgtccccctgtcatgtcaaagagataaacatcaaattcgggccaaacagcggcagcaaggtgcccctagccacggttactgttatagaccagtcggaaaccaagaagaaagtgtttctatggcgcactgccgccttttgggcctttactgtgttcctcggggatataatactgcttaccgatgttgtgatccatgaggatcagtggattggggaaactgtcctgcagtccaccttctcttcacagttgctgaacctcggtagttactcatccattcagccagaagagtattcatccgtggtgagcgaagtggtcctccaggatttgttggcttatgtctcatcaaaacacagctatctgcgcgatcttcctccacggcagccacagcgcgtgaactctatcgactttgttgagttagagcacctgcagcccgacgtgttggtgcacgctgtgctgagggtcgtagacttcacgatcctcacggaggcagtttatagttaccgaggacagaaacagaagaaggtgatgctcacggtggaacaggcccaggatcagcactatgcgcttgtactgtggggccctggggcggcttggtacccacagctccaacggaaaaaaggttatatttgggaatttaaatatctgttcgtccagtgcaattacactctggagaacctggaactgcacacaacaccttggagctcctgtgagtgcctcttcgacgatgatatccgcgccatcacttttaaagccaagttccaaaaatccgcaccaagcttcgtgaagatctccgatctggctacccacctcgaggacaagtgtagcggtgtcgtgttaatcaaagcccagatctccgagctggccttcccgatcactgccagtcagaagatcgctctgaatgcccactcttcactcaaaagcatcttttcttcactgcctaatattgtgtataccgggtgcgcgaaatgtggactcgagctagaaaccgatgaaaatagaatttataagcaatgcttctcatgcctgccctttacgatgaagaagatttactaccgccctgccttgatgacggctattgatggccgccacgacgtctgcatcagagttgagtctaaattgatcgagaagatactcctgaacatcagtgctgactgcttgaacagggtgatagttccctcctccgagatcacttatggcatggtcgtcgcagacttgtttcatagtctgctcgcggtgtctgccgagccatgcgtgctgaagatccaaagcctgtttgtcttggatgaaaactcatatcctctccagcaggatttttcacttctcgacttctaccccgatatcgtgaaacacggggctaatgccaggctctag

SEQ ID NO: 29908 - DNA, 2508 bp, Artificial Sequence
  Description of Artificial Sequence: Synthetic coding sequence
atgtctggtggcagtcaggtgcatatattctggggcgcccccatagcccccctgaaaattacagtgagtgaggacacagcgtccttaatgtctgtcgccgatccatggaagaagatccagctgctgtattctcagcacagcttatatcttaaagatgagaagcagcataagaatttagagaactacaaagtgcctgagtccataggatcgccggacttaagcgggcatttcctggcaaactgcatgaatagacacgttcacgtgaaggacgacttcgtgagaagtgtgtcagaaactcaaaatattgagtctcaaaagatacactcaagtagactgtctgacataactagctccaacatgcagatttgcgggtttaagtcaacagtgcctcattttacagaggaggagaaataccagaagctcttatctgaaaacaagatccgcgatgagcagccaaaacatcagccggacatttgcggcaaaaacttcaacacgaacctgttccagctaggacacaagtgcgctgcagtcctggacctggtctgctccacggaaaagatcaacatcggccccgaggttgtacaacgggagtgcgtccctacagagtatcacgaaatccagaaccagtgtctggggctgtttagctcaaacgccgtcgataagtcccggtcagaggccgcggtccgaaaggtctctgatctgaaaatctctaccgatacggaatttctctcaatcattacctccagccaggttgcgtttctcgcccaaaaaaaagacaaacgaagatctccagtgaataaaggaaatgtcaacatggaaactgagcctaaagcctcatacggagagattcgcatccctgaagaaaattctatccagttagatggattcacagaggcttatgagtcaggccaaaaccaagcttactcccttgaactcttctcacccgtctgccctaaaacggaaaacagtaggattcacattaactccgacaagggcctggaagaacatacaggctcccaagaactgttcagctccgaggatgagctcccaccaaatgaaattcgcatcgaactctgtagctccgggattctctgctctcagctgaacaccttccacaaaagcgccattaagagaagttgcacaagcgaagataaggtgggccagtccgaagccctcagccgggtgttgcaggttgctaagaagatgaagttgatctcaaacggtggcgatagcgccgtagaaatggataggcgcaacgtcagcgagtttaaatcaattaaaaagactagtctgatcaagaactgtgactccaagagccagaagtataattgccttgtgatggtcctctctccttgtcacgtcaaggaaattaatattaagtttgggccaaactccggttccaaagtccctctcgcaacagttacagtgattgatcagtctgagactaaaaaaaaagtgtttctttggcgcactgctgcattctgggcgtttacagtgtttttgggtgacattatactgctcaccgatgtcgtaattcatgaagaccaatggatcggcgagaccgttcttcaaagcaccttctcttcccaactcctgaaccttgggtcttacagttccatccaacctgaagagtacagttctgttgttagtgaggttgtgctccaggacctgctcgcctatgtaagctctaagcattcctacctgagagatctgccccctcggcagccacagagagtgaactccatagactttgtcgaattggagcatttacaaccagacgtgttagtacacgctgtgctcagagtggtggacttcactatcctgaccgaagctgtctattcatatagaggccagaagcagaaaaaagttatgttaacagttgaacaagctcaagaccagcattacgccctagtactctggggcccaggcgccgcttggtatccacagctacaaagaaagaagggcgttgtcttgatcaaagcccagatctctgaactcgcatttcccattaccgcttcacagaagatcgccttgaatgctcactcctctctgaaatctattttctcctcactccctaatatagtttacacaggctgtgccaagtgtggcctggaacttgagaccgatgagaacaggatatacaagcaatgtttctcatgcttacccttcaccatgaaaaaaatatattacaggccagccctgatgacggccattgacggaaggcacgacgtgtgtatccgagtagagtccaagctgatcgaaaagattctcttgaatatttcagctgattgcctgaatcgcgtcatcgtgccatcaagcgaaatcacgtacggcatggtggtggctgacctgtttcactcacttctggcagtttctgcagaaccctgcgtgttgaaaattcagagcctcttcgtcttggatgagaattcgtaccctctgcagcaggatttctcgctcctggacttctatcctgatattgtaaaacatggcgctaacgcccgcctgtag

SEQ ID NO: 29909 - DNA, 732 bp, Artificial Sequence
  Description of Artificial Sequence: Synthetic coding sequence
atgttgacagtcgagcaggcccaggatcaacattatgcacttgtgctctggggccctggcgccgcctggtatcctcaattgcaacggaaaaaaggctacatttgggaatttaagtatctttttgtgcaaaggaactataccctagaaaacctggaactacacactaccccttggagctcctgtgaatgtctgttcgatgatgacatacgagccattacattcaaagcaaagttccagaaatcagctcctagcttcgttaagatctcagacctagctacccaccttgaggataagtgttcgggagttgtgctgattaaggcccagatcagcgagctcgctttccccttgactgcagcccagaagattgctctgaatgcacactcttcacttaaaagtattttctcttcgctgccaaacattatatacaccggatgtgccaaatgtggactggaactggagaccgacgaaaaccgcatctacaaacagtgtttttcttgtctgccctttactatgaaaaagatctattaccgccccgctctgatgactgctgtcgatgggagacacaatgtgtatatacgcgttgaatccaaactcattgagaagattttgctgaacattagcgctcattgtctcaacagggtaattggtaacatttctcgctctccaatggggtggctgtggcagacatgttccacaccatgctggcagtccgcacagaatctcgtgtattag

SEQ ID NO: 29910 - DNA, 639 bp, Artificial Sequence
  Description of Artificial Sequence: Synthetic coding sequence
atgctgaccgtggaacaggcccaagaccagcattacgccctagttctctgggggccaggcgctgcctggtatccccagctgcagagaaagaaaggtgtcgttctcatcaaggcccagatctcggagttggcattccccctgaccgccgcccagaagatagctctgaatgcccacagtagtttaaaaagcattttctcctctctgcccaacatcatctacactggatgtgccaagtgcggcttggaactggagacggatgagaacaggatctataagcagtgtttttcatgcctacccttcacaatgaagaagatctattacaggcctgccctgatgaccgcagtcgacggtcggcataatgtgtatattcgggtcgaatcaaaactgattgagaagatcctgctgaatattagcgcccactgtctgaatcgggtcattgtgccatcatccgagatcacttatggcatggtcgtggcggatcttttccattcccttctggccgtttcggcggaaccctgcgtcctcaaaatccagtcactgttcgtattggacgaaaattcctaccccctccagcaggactttagccttctggacttttatcccgacatggtgaaacatggagccaacgcccgcctgtag

SEQ ID NO: 29911 - DNA, 2505 bp, Artificial Sequence
  Description of Artificial Sequence: Synthetic coding sequence
atggaggatcctgcagcacctggaacgggagggccacccgccaacgggaatggaaacggtggaggcaaaggaaagcaagctgccccaaaaggacgcgaggcgtttcgctcacagaggagagaaagcgagggctcagtggattgtcctaccctggagtttgagtatggcgatgcagatgggcacgcggccgagctgagtgagctgtatagctacactgaaaacctggagttcacgaataaccgaagatgctttgaagaggactttaaaacccaggtgcagggcaaagagtggctagagctggaggaggatgcacagaaggcgtatatcatgggcctgctcgaccggctggaagttgtttcacgcgagcggcgactaaaagtggcccgagccgtgttatatctcgctcaaggcaccttcggcgagtgtgattccgaggtcgatgtacttcactggtctcgctataactgcttcttattgtatcagatggggacattcagtacttttctagagctgttgcatatggagattgataactcacaggcgtgttcgtccgccctcaggaaacctgccgtctccatcgccgacagtaccgaactgagagtgctgctgagcgtaatgtatctgatggtcgagaatatacgactggagcgcgagacagatccctgcggatggagaacagccagggagacattccgtacggaactcagtttttcaatgcataatgaagaaccatttgccctactccttttttccatggtgacaaaattctgttcaggccttgcgccacactttccaatcaaaaaggtccttctgctactttggaaggttgtgatgttcacacttggaggctttgaacacctgcaaactttgaaagtgcagaaaagagcagagctgggcctccccccgctcgctgaagatagtattcaagtggttaagagtatgcgcgccgcctccccccccagctacactctggacctaggagaatcccaactggctcctcccccctctaaactgagggggcggcggggcagtcgtagacagctcctcaccaagcaggatagtctggacatatataatgaaagggacctctttaagacggaggaaccagcaaccgaggaggaagaggaaagcgctggggacggggaacggaccctggacggcgaattagatctgctcgagcaggatccactggtgcctccaccaccttcacaggccccattgtctgccgaacgcgtagctttccctaagggcctaccttgggctcccaaagttaggcaaaaagatatagaacattttctagagatgtccaggaacaaattcattggattcactctgggccaagacacggatacccttgtgggcctgccaaggcctattcacgagagcgttaaaacactgaaacaacataagtacatttctatcgccgacgtccaaataaagaatgaggaggaactggagaaatgcccaatgtccctgggggaagaggtagttccagagacaccctgcgaaatcctgtaccaggggatgctctacagcctgccgcagtatatgatagccctgctgaaaatacttctggctgcggctcccacaagtaaggctaagacggactcaatcaatattctggctgatgttttacccgaggagatgcctatcaccgttttgcaatccatgaagttagggattgacgtgaacaggcataaagagatcatcgtcaagagtatttcaaccctcctcctgctgttgttgaagcattttaaactcaatcacatttaccaattcgaatacgttagccagcatcttgtgttcgcgaattgcattcccctgatcctgaaatttttcaaccaaaatatcttgagctacataacagccaagaattccatcagcgtcttggactacccctgctgcacaatccaggacctgcccgaattaacgaccgaatctctggaggcaggagataactcgcaattttgttggagaaatcttttctcttgtatcaatctcttgcgactactgaataaacttactaagtggaagcactcccggacgatgatgcttgtggtattcaaatccgcccctatcctgaaaagggcactgaaagtcaagcaagcgatgctgcagctgtacgtgctgaagttgctcaagctccaaacaaagtatctaggaaggcagtggaggaagtctaacatgaagacaatgagcgccatctatcagaaggtcagacacaggatgaacgacgactgggcttatggcaatgatatcgatgccaggccctgggattttcaggccgaggagtgcactcttagggctaatattgaagcattcaacagccgccggtacgatagacctcaggatagcgaattctcgcctgtcgataactgccttcaaagtgtattgggccaaagactggacctcccagaagactttcactattcttacgagctatggcttgaaagggaagttttcagtcagcccatttgttgggaggagctgcttcagaaccactag

SEQ ID NO: 29912 - DNA, 2277 bp, Artificial Sequence
  Description of Artificial Sequence: Synthetic coding sequence
atggaggatcccgccgctcctggcacagggggcccgcccgctaatggcaacggtaatggcggggggaagggaaaacaagcggccccaaagggcagggaagccttccgatcccagcgcagggagtcagaaggcagtgtcgactgtcccacgctcgaattcgaatacggcgatgcagacggacatgccgctgagctgtcagaactgtactcatacaccgagaatctcgaattcacaaacaataggcggtgctttgaagaagatttcaaaactcaagtacaggggaaggagtggctggaactggaggaggacgcccagaaggcctatataatgggcctattggaccgactcgaggttgtgagtcgcgagcgccgccttaaagtggcccgggcagtgctctatttggcccagggcacttttggcgaatgtgatagtgaggtcgatgtccttcattggtcccgctataattgtttcctgctctaccagatgggtaccttttccacattcctggagttgctgcacatggaaattgataactcacaagcctgctcttccgccctgagaaaaccagccgtgtcgatagccgactcgacggagttacgggtcttgctttctgtgatgtacctgatggtggaaaacattcggttggagagggaaactgatccttgcggctggcggaccgctcgcgagaccttccgaactgagctttccttctccatgcacaacgaggaaccgtttgccctgctgctgttcagcatggttacaaaattctgttccggcctggcaccccatttcccaatcaagaaagtgctgctcttactgtggaaagtcgtcatgttcacacttggaggattcgaacatttgcagaccctcaaagtacaaaagagggcggagttaggcctgccgcccctggcagaggacagcatacaggtggtaaaatcgatgcgggcagccagcccgccaagctacaccctggacttgggggagtctcagctggctccacccccctcaaaactccgtggtcgccgggggagtaggcggcagctcctcacgaagcaggacagcctggatatttataacgaacgggacctgtttaaaacggaggagcctgctacagaagaagaggaggagtccgccggggacggagagagaacactggatggagaacttgacttgctggaacaggacccactggttccccctccaccatcccaggctcctttatccgccgagcgggtcgcatttccgaagggtctaccctgggcacccaaagtcagacagaaagacatcgaacactttcttgagatgtcccgtaataagttcatcgggttcactcttgggcaagacacggacactctggttggtctgccacgtcccatacatgagagcgtgaagaccctgaagcagcacaagtacatctccatagcggacgtccaaataaagaatgaagaggaattagagaagtgcccaatgagtctcggcgaagaagtcgtgccagagaccccctgtgagatcttgtaccagggcatgctttattcactgccgcagtacatgatagcattgctgaaaatcctgctagccgcggcacccacaagtaaggccaaaacggacagcataaacatactggcagatgtgctcccagaggagatgcccattaccgtcctgcagagcatgaaacttggtatcgacgttaatcggcataaggagattattgtcaagtctatcagcactctgctgctcttgctgctcaagcattttaaattgaatcacatctaccagtttgagtatgttagccagcatctggttttcgccaattgcatcccccttatacttaaattcttcaatcagaatatcctgtcatacattacggccaagaacagcatctccgtgctagattacccttgttgcactatccaagatctccccgagctcactacagagtctttagaagcaggcgataactctcagttttgctggaggaatttgttttcttgtatcaaccttctcaggttgctgaataagctcaccaagtggaaacactccagaactatgatgcttgttgtatttaagtccgcgcccatcttaaaaagagcattgaaagtgaagcaggcgatgctgcaattatatgtcctgaaacttttgaaactgcagaccaaatacctgggcaggcagtggcgaaagagcaatatgaagaccatgagcgccatttatcagaaggtgcgccaccggatgaacgatgactgggcttacggcaatggcgagtcatctcagagtagctag

SEQ ID NO: 29913 - DNA, 636 bp, Artificial Sequence
  Description of Artificial Sequence: Synthetic coding sequence
atgttttcccagggtctctgttcagactcgatgttccccgagatgtggcgccccgtagatatgggctggccgcagacaaggatgccaagagttcgatccctccatgcctacccgccgttttttcctttacaacagttactgactaagcaagactcactggacatttacaatgagagagatctcttcaagaccgaagaaccggccaccgaggaggaggaggagagcgcgggagacggggagcggacgctagacggcgaactggatctgccctgggcccccaaagtgcggcagaaggatattgaacatttcctggaaatgagtcggaataaattcatagggtttactctggggcaggatacggatactctggtgggcctgccgcggcccattcatgagtccgtcaagacactgaagcagcacaaatacatctccatagccgacgtccagattaaaaacgaagaggaactggagaaatgtccaatgagtttggtcagccaagggtcccctacacaggaggaatcccggcgcaaaccagtgttcagtgtggtcactgagcacgtgtgcatgcattcattttctatcttaggatgtaactgtgtgccaggaggaagaggagggactagggacgccatgtag

SEQ ID NO: 29914 - DNA, 1272 bp, Artificial Sequence
  Description of Artificial Sequence: Synthetic coding sequence
atgctgccttggaagaagcacaaattcgagttactcgcagaagcaccccctcggcaagctagtaagccaaagggctacgctgtgagccttcactacagcgcccttagttctctggcaagggcttgccctgagggggcactgtccagagtcggttcaatgtttcgtagcaaaaggaaaaagctgcatatcacctccgaagatcccacctacacggtgctgtacctgggtaatgccaccacaatccaggcaaggggggacgggtgtacggaccttgctgtggggaagatatggtcaaagtctgaggcgggaagacagggcaccaagatgaagctgacagtgagcgcacaggggattcggatggtccatgcagaggaacgcgcacttcgcagacccggacacctgtatctgctccaccgtgtcacatattgtgtcgcagatgcccgcctgccgaaagtttttgcctgggtgtatcggcatgagctcaagcacaaagcggtgatgctgcgctgccacgccgtgctcgtcagcaagccagaaaaagctcaagccatggccctgttgctgtatcaaacaagtgccaatgcactcgccgaatttaagaggttgaagcggagggacgacgcaagacaccagcagcaggaactggtgggagctcatacaattccactcgtgcccttacggaaactgctgctccacggaccctgctgttataaaccaccagtggagaggagtagaagcgcccctaaattgggctccataaccgaggacttgcttggagaacagttagaacaagagctgcaggaagaggaagaggaggagcaaccagaagggtgccccgaagaggaggagaatagggcagccgaaggcgatccggccgaagaagaagctgaggcccaaagagctttggtcgtggctatgcactttgagtgcggcgacctgttggacaccttagagaatggcaggggggaggccctgggcggcggcgggggcagtctcggtccgggcgcaggcccaccacccctcttgctcgggtcagcaagcgatatgaaggctgagctgagccaacttatctctgatctcggcgaactgtcttttgggaacgacgtacgcaccttgcaagccgatctccgggtgacacgactgctgtctggagattcaactgggtccgagagtagtattgaaggcggaggacctgacgcaacttccgccacggccggtgattcatcccgacaggctgacggcgcgtccgccgacgagcctcactccgggtag

SEQ ID NO: 29915 - DNA, 990 bp, Artificial Sequence
  Description of Artificial Sequence: Synthetic coding sequence
atgctgccctggaggcgaaataagttcgttctcgtggaggacgaggcaaagtgtaaggcaaaatcactgagtcctgggttggcctatacctctttactttcttcgttcctgcgctcttgtccagatctcctcccagattggccgctcgagagactgggaagggtttttaggagtcgaaggcagaaagttgagttgaacaaggaggatcctacttacacggtctggtacctggggaacgctgtcacactgcacgctaagggggacggctgcactgacgacgctgtgggcaaaatctgggcgcgctgtggtcctggcggaggcactaagatgaaactgaccctcggaccacacggcattcggatgcaaccgtgtgaacggagcgctgctggcggatcaggcggccgaagaccagcccacgcatacctgctaccccgtatcacctattgcacagctgatggtcgccacccgagagtatttgcctgggtataccgtcatcaggcacggcacaaggctgttgttcttcggtgccacgccgtgttattggccagggcccacaaggcaagagctctggcacgccttctccggcaaaccgccctggccgccttcagtgattttaaacggttgcaacggcagagcgacgcacgacacgttcgccagcagcatttgcgcgccgggggcgctgctgcttctgttccacgcgctccacttagacgcctgcttaacgcgaaatgcgcgtatcgccctcctccgagcgagcgctcacgcggcgctcctcggctgtccagtatccaggaggaggacgaggaagaggaagaagatgatgctgaagaacaagaagggggggtcccccagagagagagaccagaagtccttagtctcgctcgtgaactgcgaacctgcagtctgaggggcgcccctgccccgcctcccccagctcaaccaaggcggtggaaagctggcccccgagaacgcgccggacaggctcggtag

SEQ ID NO: 29916 - DNA, 1074 bp, Artificial Sequence
  Description of Artificial Sequence: Synthetic coding sequence
atggcagcggctgaagtcgcggacacccagctgatgcttggcgtgggcttaatagaaaaggatactaatggcgaggtgctttgggtgtggtgctacccatcaactacagctaccctccggaacctgttactgagaaagtgctgcctaaccgatgagaacaaactgttgcatccctttgtgtttggccagtatcgacgcacatggttttacatcactactattgaggtgcccgactcgtccatactcaagaaagttacacatttttccattgtgctgacagcaaaagattttaaccctgaaaagtatgccgcattcacccgtattctttgccgtatgtacctgaagcatggaagccccgtgaaaatgatggagtcttacatcgcggttctgactaaaggcatctgtcagagcgaggagaatggctcgttcttgagtaaggactttgatgcaaggaaggcgtacctggccggttccatcaaagacatcgtgagccaattcggaatggagacggtaatactgcacacagccttaatgcttaaaaagagaatagttgtgtaccatcctaaaatcgaggctgtccaggaatttaccagaactctgcctgccctcgtgtggcatcgacaggattggaccatcctgcactcatatgtacatctgaatgccgacgaactagaggccctgcagatgtgtacaggctatgtggctggttttgtcgatctcgaagtcagcaacaggcctgatctgtacgatgtcttcgtgaacctcgcggaaagtgagatcacgatcgcccctctagcgaaggaagccatggctatgggaaagctgcataaggagatgggccagttgatcgtgcagtctgcggaggacccagagaagtcagagtctcacgtaatccaagacattgctctgaagactagggagatcttcactaatcttgcgcctttctccgaggtgagcgctgatggagaaaaaagggttttgaatttagaagctctgaaacagaagaggtttccccccgccacagaaaacttcttgtatcacctagccgccgccgaacagatgctgaagatttag

SEQ ID NO: 29917 - DNA, 603 bp, Artificial Sequence
  Description of Artificial Sequence: Synthetic coding sequence
atggccgcagccgaagtggcagatactcagttgatgttgggcgtgggtctgatcgagaaggatacaaatggtgaagtattgtgggtgtggtgctatcctagcacgactgccaccttgagaaatctcttgttgcgaaagtgttgtctgactgacgaaaacaagttgctgcatcccttcgtgtttggccagtaccggcgcacttggttctatataactaccatcgaagtacctgactcttcgatactgaagaaagttacccatttctcgattgtgctgactgctaaagacttcaaccctgagaagtacgctgcgtttacacggattctctgtagaatgtacctgaagcatggttctcccgtgaagatgatggaatcgtacattgccgtactcacaaagggcatctgtcagtcagaagagaacggctcctttttgtctaaagattttgacgctagaaaggcttacctggcagggagtatcaagggcctttgtctgccttggtgtgggaccgatcggacagggccttccttcactctgacctgtacctcaactcccatgagctggaagccatgtagatgcgcacaggttacctctcttgatctttag

SEQ ID NO: 29918 - DNA, 621 bp, Artificial Sequence
  Description of Artificial Sequence: Synthetic coding sequence
atgctgccgtcactgggctattgtgttgatatcgtgagccagttcggcatggaaacagtcatcctacacacagcattaatgttaaagaaacggattgtggtctatcacccaaagattgaagcggtgcaggaattcactcgtaccctgccagcgttggtgtggcacaggcaggattggaccattttgcatagctacgttcatctgaacgcagacgagctggaagctttacagatgtgtacaggatacgtcgccggattcgtggacttagaggtgagcaatcggcctgacctgtatgatgtgttcgtcaatctcgctgaatccgaaatcacaattgctcccctggcaaaagaggcaatggcaatggggaagttgcacaaggaaatgggtcagctgatagtacagagcgccgaagacccagaaaagtctgaatctcatgtcatccaggacattgcactgaagacacgcgaaatcttcactaacctcgctcccttctccgaggtgtcagctgacggagagaaacgcgtgcttaatcttgaggcactcaaacaaaagcgcttccctcctgccacggagaacttcttgtatcacctagctgcagctgaacaaatgttaaagatttag

SEQ ID NO: 29919 - DNA, 666 bp, Artificial Sequence
  Description of Artificial Sequence: Synthetic coding sequence
atggctgcagccgaagtcgctgatactcaactgatgttaggggttggcttgatagaaaaagacactaacggcgaagtgctctgggtctggtgctaccctagtaccaccgcaaccttgcgcaatctgctcctccgcaaatgttgtctaacagacgagaataagctacttcatccatttgtgtttgggcagtacaggaggacatggttttacatcaccactatcgaagtccctgattcctcgatacttaaaaaggtgacgcacttttcaatagtactaacagcaaaagatttcaaccctgaaaagtacgctgctttcacacgaatactgtgtaggatgtacctgaaacacggctcccctgttaaaatgatggaatcctatattgccgtgctcactaaggggatttgtcaatcggaagagaatggcagcttcttaagcaaagattttgacgcaaggaaagcctatctggccgggtcgatcaaagacatcgtatcgcagttcgggatgaactgttatttaacgcattctacagatgccaaggaaaaaaattgcggagtgtcgccacaagatagatctgggcccggggtccaccaggattctgcctgccccggggtagctcctaccgggctggatcatccctccctgctgagagcgcctcagcggcgctag

SEQ ID NO: 29920 - DNA, 1386 bp, Artificial Sequence
  Description of Artificial Sequence: Synthetic coding sequence
atgcaccagagatacttttggaccgaccaaggacaggtggcgcttggaggccactacatggccgagggcgaggggtattttgcaatgtccgaagacgagctggcttgttctccatatatccccctgggtggagactttggcgggggcgacttcggtggcggggactttgggggaggggatttcggcgggggggggtctttcggtggccactgcctagactactgtgagtccccgaccgcccactgtaatgtgctcaattgggagcaggttcaaagactggacggaattctaagcgaaaccatacccatccacggtcgcgggaatttccccactctggagctgcagccgagtctcattgtgaaggttgtgaggcggcggctggctgaaaaacgtatcggggtgcgcgacgtaaggctgaacggaagcgctgcatcccacgtgttacaccaggattccgggcttggttacaaagacctcgatctcattttttgtgccgaccttcggggggaaggagagtttcagaccgttaaagacgtggtcctcgattgccttctggactttcttcctgaaggcgtgaacaaggagaaaatcacacctctgactctgaaggaggcatacgtacagaaaatggtgaaagtgtgtaacgactcggaccgatggtcattgattagtctgtcaaataactctggtaagaatgtcgaactgaagttcgtggacagcctgcggcgacagttcgagttcagcgtggatagctttcagatcaagttggactctctgctgctcttctacgagtgcagcgagaatcctatgaccgaaaccttccatcccacgattataggagaatctgtctatggggacttccaggaagcttttgatcacctatgcaacaagataattgccactcgtaacccggaagagattcgcggggggggattgctcaaatactgcaatctcctggtaaggggatttcgacctgctagcgatgaaataaaaacattgcagaggtacatgtgcagccgcttttttattgatttctcagatatcggagaacagcagcgcaagcttgaaagctacctgcagaatcattttgtagggctggaggatcgaaaatacgagtacctaatgactttgcatggggtggtgaatgagtcaacagtatgcctaatggggcatgaaagacgacagacgttaaacctgattacaatgctggcaattagggtgctcgcagatcaaaatgtgatccccaatgtggcgaatgtgacctgttactaccagccagccccctacgtggccgacgccaacttcagtaattactacattgcgcaggtgcagcctgtttttacatgccaacagcaaacttactctacatggttgccatgcaactag

SEQ ID NO: 29921 - DNA, 1572 bp, Artificial Sequence
  Description of Artificial Sequence: Synthetic coding sequence
atgcagatgagacgcgtctggaggacatgtcggagtggcccgcgcaaacgccgggaagctaggtataagaaatcgacagaagacatttttcccgctcagttattgaaactgcagagacatgaacgcgtgtggcagcaagagcctcccgtgcgagaccacagatcatggggaggatctggcgctgggggcgtggcaggccgagagtggacagatcagggtcaggtggctctagggggacactacatggcagaaggtgagggctactttgcgatgtctgaagatgagctcgcatgttctccctacattcccttgggcggggacttcggtggcggcgacttcgggggcggagacttcggcgggggcgatttcggcggcggcggcagcttcggagggcattgtctcgactattgtgagtcacccacggctcactgcaatgtgctgaattgggaacaggtgcagagactggatggaatactgagcgaaacaatccccatccacggcaggggaaatttccctactctggagctgcaaccaagcctgatcgtgaaagttgtgaggagacgccttgctgagaagagaattggcgtccgcgacgtccggcttaacggaagcgccgcgtctcacgtcttgcaccaagactccggactggggtataaggacttagaccttattttctgtgctgacctaagaggtgaaggcgaatttcagaccgtgaaagacgtcgtactggattgccttctggatttcctccctgaaggagtcaataaggaaaagattaccccactaaccctgaaagaggcctacgtacagaaaatggtgaaagtgtgtaacgattccgaccgatggagcctcattagtctgtccaataattctgggaagaatgtcgagttgaagttcgtggactcactgcgccgccaatttgagttttccgtagactcattccagataaagcttgacagccttctcttgttctacgagtgctctgaaaaccccatgactgagaccttccatcctaccattattggagaatcggtgtacggtgactttcaggaggcctttgatcacctgtgtaataaaataatcgccacaaggaatcctgaagagatcagaggggggggattgctgaagtattgtaaccttcttgtgagaggcttccgtcctgcttctgacgaaatcaagaccctgcagcgatacatgtgctcacgcttttttattgacttctccgatatcggtgagcagcagcgaaagctggagtcctaccttcaaaaccactttgttgggctggaagatagaaagtatgagtacttgatgaccctgcacggtgttgtgaacgagtccacagtgtgtctcatgggccatgaacgccgacagaccttgaatctgatcacaatgctggccatccgcgtgcttgccgaccagaacgtaataccaaacgtcgccaacgtgacatgttactatcagccagccccttacgtggctgatgctaacttttctaattactatattgcccaagtgcagccagtgttcacatgccaacagcagacgtatagcacgtggttgccctgtaactag

SEQ ID NO: 29922 - DNA, 267 bp, Artificial Sequence
  Description of Artificial Sequence: Synthetic coding sequence
tagaaacggatcggagtccgggatgtgcgcctgaatggctccgccgcatctcatgtcctacaccaggatagtggcctgggatataaagatttggacctcatattctgcgcagacctgagaggcgagggagaatttcagacagtaaaggacgtggtgctggactgcctgctggactttcttcccgaaggggtgaataaggaaaagattacacccttgacacttaaggaggagagccatacaacaacgtacttcttgaacatctcgtag

SEQ ID NO: 29923 - DNA, 261 bp, Artificial Sequence
  Description of Artificial Sequence: Synthetic coding sequence
tagcaagactccggcctgggatacaaggatctggacctgatcttctgcgcagacctcagaggggagggtgaatttcagacggtgaaagacgtggtgcttgattgtttattagattttcttcctgaaggagtcaacaaagagaaaattacccctcttaccctaaaggtatttcaccgattacttcgccactggcgggctgctgaaaagaccggcgtgcttttcgccgagcccctgtgcggcatcggaaggcctcaggtgtag

SEQ ID NO: 29924 - DNA, 1278 bp, Artificial Sequence
  Description of Artificial Sequence: Synthetic coding sequence
atgatgccatcagagtcaggcgcggagagacgcgacagggccgcagctcaggtgggaacagccgcagcaaccgccgtggctaccgctgccccagcaggaggaggtccggaccctgaggccctatcagcattcccaggcagacacctcagtgggctctcatggcctcaggtaaaaaggcttgacgctctgctgtctgagcctatcccaattcatgggcgtgggaactttccaaccctgtccgtccaacccagacagattgtacaagtggttcgctccaccctagaggagcaaggattgcatgtgcacagtgtgcgactgcatggatccgctgcctcccatgtgttgcacccagagtctggtcttggctataaggacctggatttggtttttagggttgaccttagaagtgaggctagtttccagttgaccaaggccgtggtgctcgcctgcctgcttgacttcctcccagccggtgtgtcgcgtgctaagataacccccttaactctgaaggaagcctacgtccagaaattggtgaaagtgtgtacagacagcgataggtggtcattgatcagcttgtctaacaagagcggcaaaaatgttgaattgaaatttgtggacagtgtcagacggcagttcgagttttccattgactcttttcagattatcctcgactccttgctgttatttggccagtgttcaagtacccccatgtcagaggcattccatccaacagtcaccggggaatcattgtacggggattttacagaggcgctggagcatctccgacacagggtgatcgccacccgaagccccgaagagatcagaggcgggggccttctgaaatactgtcacctcctggtgcgcggatttaggccccgcccttcaactgatgttagagcccttcaacgctatatgtgctcgaggttcttcatcgactttccagatttggtcgaacaacggaggactctggagaggtatctcgaggctcacttcggaggagctgacgcagctagaaggtatgcatgcctggtgacgctgcatagggtcgttaatgagtccactgtgtgcctgatgaatcacgaaaggcgtcagactctagacctgatcgctgccctcgcactccaggctctggcggaacaggggcctgcagccaccgctgccctcgcgtggcgtcccccaggcactgatggcgtggtgccagctacagttaactactacgtgacccccgtgcagccactgctggctcatgcatatcccacctggctgccttgcaattag

SEQ ID NO: 29925 - DNA, 1170 bp, Artificial Sequence
  Description of Artificial Sequence: Synthetic coding sequence
atgtccgagattagattcaccaacctgacctgggaccaggtcataacactggatcaggttctggacgaagtcatacctatccacggcaaagggaattttccaacaatggaagtcaaaccaaaagacataattcatgtagttaaagaccagcttatagggcaggggataatcgtgaaagacgctagactcaacggctcagtggcctcatacatactggctagccacaacggcatctcctacaaagatctcgacgtgatttttggcgtggagctgcccggaaacgaggagtttcaggtagtgaaggatgccgtgctggattgtctgcttgatttcctaccgaaggacgtgaaaaaagagaagctcagtccagatatcatgaaagatgcctatgtacagaagcttgtcaaagtttgtaatggtcacgactgttggagcctcatttcactgtcaaacaacacaggaaagaacctggagctgaagttcgtcagctccttgcgtaggcagtttgagttttccgttgattcattccaaatcgtcttagatccaatgcttgatttttacagcgataagaacgccaagctcactaaggagagttatcccgtggtggtggctgagagtatgtacggggacttccaggaggcaatgacccacctccagcacaagcttatttgtacgcgaaagccggaggagatacgaggaggagggctgctgaagtactgttcccttcttgtgcacggtttcaagcccgcgtgcatgagcgagatcaagaacctagaaaggtacatgtgctctcgcttcttcatcgatttcccccatatcgaggagcaacagaaaaagattgagagttaccttcataaccactttattggcgagggaatgactaaatacgactacttgatgactctccacggtgtggtgaatgaatctacggtctgtcttatgagttatgagcggaggcagatccttcaccttataacaatgatggcccttaaagtgttgggtgagctgaacattttaccgaatactcagaaagtgacgtgtttctaccaaccagccccctatttcgccgccgaagctagataccctatttacgtcatccccgagcctccacccgtgagcttccagccataccatccactgcatttccgaggcagcaacgggatgagctag

SEQ ID NO: 29926 - DNA, 1170 bp, Artificial Sequence
  Description of Artificial Sequence: Synthetic coding sequence
atgtctgagatcaggtttaccaatctgacctgggaccaggttattaccctggatcaggtccttgacgaggtgattccaatacacggcaagggaaacttccctaccatggaagtcaagccaaaggacataattcatgtagtaaaggatcagttgatcggacagggcatcatagtcaaagatgccaggctaaacggttccgtggccagttacatactggcgtcgcacaacggtatctcctacaaggacctggatgtgattttcggagtcgagctccccggcaacgaggagtttcaggtggtgaaggacgctgttctggactgcttgctggattttctgcccaaggatgtgaaaaaagagaaattatccccagacatcatgaaggatgcttacgtccagaagctggtgaaggtttgtaacggacacgactgttggtcacttatctcgctatcgaataacaccggtaagaacctggagttaaagtttgtaagctcactgcgtcgccagttcgagtttagcgtggacagttttcaaatcgttctggatcccatgcttgacttctatagtgataaaaacgctaaattgaccaaagagagttaccccgtggttgttgcggagtccatgtacggtgatttccaggaggcaatgacccatctacagcacaaactgatttgtactaggaagccagaagaaattcgcgggggtggactccttaagtattgtagcctgctggtgcatgggttcaagccggcatgcatgtctgaaataaaaaatctggagagatatatgtgctcaaggttttttattgacttccctcacattgaggaacaacaaaagaaaatcgagagctacctgcacaaccacttcatcggggaaggcatgactaaatacgactacctgatgaccctgcatggcgtggtgaacgaaagtactgtgtgtctgatgtcttacgaaaggcggcagatacttcatctgatcactatgatggcccttaaagttctcggagaacttaacattcttcctaatactcagaaagtgacctgcttctatcagcctgccccatatttcgccgccgaggctaggtatcctatctatgttatccctgaaccaccgcccgtctctttccagccataccatcctctacatttcagggggtccaacgggatgtcatag

SEQ ID NO: 29927 - DNA, 888 bp, Artificial Sequence
  Description of Artificial Sequence: Synthetic coding sequence
atgcaaatgtctgtgccgtgtgtgttatcctctctccagaaccacgaacctaataaacccttgttcacgactcagagccagctcctcagcaaagtgcttgaagtgttagatcccgacaggaagcttgaggacacctgggcctattgccaggacactcggaagggcatgaaggaacctacgaagttgctcaagaagcattcaactcaggtgtatttggggccatctaaaaagaccagtgtgtcaaatgccggacagtggctttatgaagagaagccccacaagatggatctcctgcacgagaatggcccaaggccaggtctgcacgaaaatgtgtgtaaagcggttagcgatttttgtaagtgggttaccacgttcgggatctctgacatcgacgaagaattcattttgaaacagtttgatatagactatgagacaaaaccatcccatgatgcacttcacacaatgaaactcaatcaggtgcccctcgaactgaaaaggtctgttgggctttccaaactccaggaaacagagttctttcagaaactcggctacgagagaaaactccaaaaaccacagaacccatacaagccaaagtgggtgaagatgcgctatggtgcctggtaccttaaccctaaactttggaaaaaacagcgtgtggacgagccgttggtcgatcctgaggtgagccacaaggcccaggaggaaaactttaaaaaagagctgcaagaacaagaggagctccttgcggatctgcatgggacggtcgcatttaaggatttcattctgagtcggggctatcgtacaccccgatttctggagaatatgtacatagggaaagaatgcaagcgcgcctgcaacaaaacaccaatcaagcggacgcaggcctag

SEQ ID NO: 29928 - DNA, 1056 bp, Artificial Sequence
  Description of Artificial Sequence: Synthetic coding sequence
atggccgatcgccgtcggcgactccggcctgggactctggctccggtacgcgagggcgtgaactgcagaagcagatgtttcactaagcataagaatgggctgaagtttccaacaagtctgcactcccgacaactggtctttcctcggaagggcttggacgacttcagaaaaggttgccccccctgcaccggcctggttactcaggttcccgttgaggggtttctgcctcagatctaccaccgcgcgcctcaacttgctccaaagaagagacaaatcaaactcctgaaagaagccgacgtactgagcaagctgtcacccgctcagcaagccaggaaggccttccttgaggatgtggaggctcatctcaccccacaccccctggcattgtacttgaacctggaagaggctatgcccatagaactgcttagcaaggtcctggaggtgcttgaccctgacaggaagcttgaagacacctgggcctattgccaagacacacggaaaggtatgaaggaacccactaagttgctcaagaagcacagtacccaggtctacctcgggccttctaagaagacctctgtttcaaacgccgggcaatggttgtatgaggaaaagcctcacaaaatggatctgttgcacgaaaacggaccgcgccctggcttgcatgagaatggaatttcagatattgacgaagagttcatcctcaagcagttcgacattgactacgagactaaacccagtcatgacgcccttcatactatgaaactaaaccaggtcccactggaactgaaaaggtctgtcgggttgagtaagctgcaagaaaccgagttttttcaaaagctgggctacgaacgtaagcttcaaaagccacaaaatccgtataaaccaaagtgggtgaaaatgcgttatggcgcatggtacctaaacccgaagctctggaagaagcaacgggtcgacgagcctttggtcgacccggaagtcagccacaaggcgcaggaggagaacttcaaaaaagagctgcaggagcagtccatttttaaaaaggccatggatatttag

SEQ ID NO: 29929 - DNA, 2376 bp, Artificial Sequence
  Description of Artificial Sequence: Synthetic coding sequence
atgggcgatcagcggctccaggactggctccgctctcccgggatggatagtaaaccctggtattgcaacaagcgacccagcaagtgcttcgccaagtgcaaacatcgccggctgcggttccctcccatggacacacagaactgggtttttgtgaaggaaggaatggatgactttcggtatggatgtccttctccagaggacacgctagtttgtcgcagggacgagttccttctccctaagattagcttgcgcggtccgcaggctgatcctaaatcaggacagaagaaactgttgaaaaaagccgcactgttcagcaagctcagccctgcacagctagcccgcaaagctttcgtggagcaagtcgaggcacagttgatggccaagcatcccctcgcaatgtatccaaacctgggcgaggatatgccccctgatctattgctgcaggtgttgaagcatttggaccccgaacgcgagttggaggacgcatgggcttgttgtgaaacgcaggaaaagactaccgaagtccctactgagccaggaaaacatccttgtggcgaattctgtctcaagccccccgaaacaccagtgtcacacctgttaccagaaccacccgaaaccggagtcagtcacctttcacccgaaccacctaaaactccggtgtctagcctccgcccggaaccccctgaaaccggagtaagtcacttgaggccagagcccccagagactggtgtgtcccacattagacccgggcctcccattacacgccggcggtccagtctcttacggcaattactgaagctagattcagaacgaaaactggaggacgcacgggccccgtgcgaagggcgtgagaaaactacagacgaacctacagagcccggcaaatacccctgcgggaaattctgcccaaggccttttgagacccccctatcacacctacgtcaggagccgcccaagacacccgtctctagtctgagaccagaaccaccggaaaccggcgagtcccatctgcggctggaacactccaagacacggcgaggcagctcactgagatctgagcccagtgagacaggagtctcacgacttaggctggcaccccccaaaacccggcgcggttctagtctacacgccgagccaagtaagacaggtgtgagccatctgtctcccgagcctcccaagactgaggtctcccacttacatccagtgcccccgaaaaccggtgtgtgtcacctcaggctggaaccacccgatacctcccaggtgtcaaatctcctgctctacatactgaaagtcttagattccggcagaactctgaaagacgtgtgggaccgttgtgaagcaagagtgaagaaaaccaaggagcccactgaaccccacaaatcaccttgcggagaaccctgtctgcagccccctgagacacaggtctctcacccccatcccgagcatccgaaaaccaggcggagatcctccctgcactctcagccccctaaaactaggcggacctcctccctccggagtgaaccccccaagaccagaagaacatcttccctgcggtctgaaccgccaaagacacgaaggacatcgagcctgggcccagaaccccctaagaccaggagggtgagttctttgcgaccagaactgccaaagtcccggcgcgtgtctagcttgcacccagagcccccgaaggcccctgaatctcaccaattctccgagccacctaagattagggcaagctacatcaaagaacttctgcaggaggacaccccaagtacgaaggagtgcgtgagcgattcactgcagtaccggtacacatcagagaagctgagggaattctttaaatgggctggagatctgggtgctgacgaggagtccatacgcaacctgtttgatttcactcccaaatatagagccacgcatgaggaccaaaagttcaagaaggtaaaagaatgctcaagcgaattaaagtactctatggaactggacgagaaggacgaagacaaatttttcagtcaggagaagtattggggccggaaatttcatactccttccaactcatataccgcccagcgcgtgaagatgaaatatggggcctggtacctgaagcccaaactttggaagaagcttcgcagtgacgaacccctgattgaccccaagctgctactcaagaagcctgatgagccagatgttctggacgacttatatggacctattgctttcaaagactttattttaagtaaggggtatgaaatgcccggtatcattcagcgtctgtttgcacgacgcgggtggacatatgatagcgtgaaaactcctatccagagagccatgattttctataagtataaagaaatcgtggaggcaagtgaggaggactag

SEQ ID NO: 29930 - DNA, 1938 bp, Artificial Sequence
  Description of Artificial Sequence: Synthetic coding sequence
atgggcgatcggcgcccccaggaccgcccgagaagtcaaggcatggattctaagccctggtactgtgataaacccccatccaagtatttcgcgaagaggaaacaccggcggttgcggttcccacctgtggatacccaaaactgggtctttgtgacagaaggaatggatgatttcaggtatgcctgccagtctccagaggacactctcgtgtgtcgaagggatgaatttctgttaccaaagatttccctccggggcccacaagccgatagaaagtccagaaagaagaagctgttaaagaaagccgccctgttctccgagctttctcctgttcagccggcccggaaggcattcgtcgaggaggtggaagcacagctgatgacaaaacatccactggcgatgtatccaaatctcggcaaggacatgccacctgatctgctgctgcaggtcctcaagcaactggaccctgaaagaaaattggaagacgcttgggccagatgcgaagcccgcgaaaaaacaactgaagtgccaactgaatcgggaaaatacccgtgtggtgagtcctgccctcgcccacccgagactcccgtgagtcgcctgcgtcctcaactgccaaagacccccgtgtcatcccggcgccccgagcctcctaagacccgtgtatcatcactgcggccagaaccacctaagacccgagtaagttccttgcacccagagccccccgaaacgagagccagccacctgagggtcgacccgcccgagacgggagtttcccatctgtgcccagagcctcccaagaccctggtgagctcagtgcatccagagccccccgatactggcgcctcccatttatgccccgaaccccctgagacacgggtgtcccatctgcacccagaacctccagagactggtgtgtcccacctccggcccgaaccctccaagacgcaggtgtcatccctctgccccgagcccccggaggctggggtgagccacctctgtctggagccccctaatacgcatcgggtcagttcttttctgttgcaggtgctgaaacttgactcagaaaagaagctggaagatgctcgggctcggtgcgaagggcaggagatgaccacagaagaactcaccaaacctggcaaatatcacttctgggagtcatgccctcgaccttttgagagtcgcatgccccatctgagactggttctgccaatcacgcgcagaatggcatcactgtgcctgaaaccaccaaaaacacgccgcgtgagtagtttgtgccctgagcctactaaaacaggcgctagtcacctgaaagaactgtttcaggaggacactccttcaacaatggagtgtgtctccgacagcctacaacggcgtcacacttcccgcaagctgcgagattttaaatgggccggcgatctaggagtgaatgaggagtctatctccagtctgttcgacttcacaccagaatgtcgaacaaccgatcaggaccaaaagattaagaaggctaacgaatgcgcctcgcggttgatgtatgggatggagcttgatgacatggatgaggtggaatttcttcgcattaagtattgggatcgcagacggcgagctgcaccacacagttatagtgctcagagagggagaatacggtatggaccgtggtactttgagccgaagctgggcaagaagctgaggtctgatgaacctctaattgacccaaaaccagtattggagaaacctgatgagccagacatccttgacgggctgtatggccccattgcctttaaggacttcattctctccaagggttaccggatgcctggtgtcatcgagaagctctttgcgaagaagggctggacatacgatagcgtcaagactcctatacagcgggcagtccaggtgtataagtataaggaggatgtgaccgatgcctccaaggaggactag

SEQ ID NO: 29931 - DNA, 3108 bp, Artificial Sequence
  Description of Artificial Sequence: Synthetic coding sequence
atgggtgatcagcgcccacaggacagaccctcaagcccgggtatggacagcacaccatggtattgtgataagcctccctctaagtactttgccaaacggaagcacaggcggctgaggtttccgccagtcgacactcagaactgggtcttcgtaacagaaggaatggatgacttcagatacgggtgtcaatcaccagaggacacactggtgtgtcgcagggatgaatttctgttaccaaagatatcgttgaggggtccacaggctgatcctaagagtaggaagaagaaactgcttaagaaagccgcgctgttttccaagctctctcctgctcagcctgccaggaaagcctttgtggaagaagtggaagcccagctgatgaccaaacatccgttggccatgtaccctaacctaggcgaggacatgccgcccgacctgcttctccaggtgctgaaacctcttgacccggagaggaaactggaagacgccggaagttgtgaagggcaagagaagaccactgacgaacccaccgagcccggcaagtacccatgcggtgagttctcacctaggcccccggagacgagggtgagctgcctgccaccagaaccccctaagacccctgtgtcaagcctgcgccccgaaccaccagaaaccggagtctcccacctccgtccacagcctcccaaaacacaggtctctagcttgcacctggaaccgcccgagacaggcgtgagccatctgcgacccgagcctcctaaaacgcaggtgagttcactgcacttggaaccaccggagactggtgtctcccacttgtacctggagccccctggcaccggagtgtctcatttatgccccgagccgcccaagaccagagtttctcacctccaccgagagcctccagagaccggggttcctgatctatgcctggagccacccaaaagcagggttagccatctccggcctgagccaagcgagactggcgtatcgcacctacaccctgagccacctaaaactctggtctcaagcttacacccggaacctccagaaaccggagtgtcccacttatgtcctgagccgccagagaccagggtgtctccactcagacagcttccacccgaggctggcgtgtcgcacctgtgtccagagcctcccaagacacgtgtgccacctttgcggcccgaaactccaaagaatggcgtcagtcctttattcccagagccccccaagacaaggatctctaacctgcggtcagaaccacctaagatcggcgtttcccatctatgccttgagccccctaaaacgcgcggctcccaccttcgccccgagccaccagagacgggtgtcagccatctgcggcccgagcccccaaagactagggtatctagcctgcatctagaaccccctgaaactggtgtgtctcatctatgtcccgagcctcccgagaaggatgtgagtcacttacgacccgagccccctgacaccggcgtttcccacctctgccctgaaccacccaaaacgagagtctcacatctgaggcctgaaccttccgaaacaggtgtctctcacttgagacctgaaccccctaaaatacttgttagcagcttgcaccaggcaccacccgagtcttctgtctcccatctcaggccggagccaccagagaccggtgtcagccatcttcgccctgagccacccaagacccgaatgtactccctgcggccagagccaccggacaccggagttagccacttgtgccctgagcctcccaaaactcgtgtatcatcactcccaccggaacccccagagacaggcgtgtcccatttgtgtccagaacctcccgaaactcgggtaagccacctgagaccagagcccccggagaccggcgtgtcacaccttcgtcccgagccccccaagaccagaatgtatagtcttcgccctgagcctcctaacactggggtgagccacctctgtccagagcctccaaaaacccgtgtgtctagtctgcccccagagcctcccgaaacgggtgtgagccacctgtgtcccgagccacccgaaacgcgcgtatcccacctgcgtccagaacctccagagaccggggtctcaaggctgcacccggaaccccctaaaacccgggtttcaagcctccatgctgagccaccagagtctcgcgtgtctcatctgtgcccagagcctccggagacgggcgtctcccatctgcggccagaaccacccaaaccaagggtgagcagtttaaggccagaacccctcgaaacaagagtctctcatctgcggccagagccacccgagacaggcgtctcccatctccacccggagcttcccaagcctcgggtttccagcttgcatttggagcctcctaaaacaaggagggtttcatctttacggctggaaccccccaaaactggaagagtgtctagcttgtgccccgagccaaccaaaactggtgcctcacacttaaaggaactattccaggagggtacatctagcacgatggaatgcgtgtctgattcgctacagcggcgccataccagccgcaagctgcgggattttaaatgggccggggatcttggagtaaacgaggaaagtatctcatctctgttcgactttactccagagtgcagggcgacctaccaagaccagaaaaataagaaagctaatgagtgcagctccgggctgaagtatagtatggaactagatgaaatggacgaagtcaagttctttagccaggagaaagacctagacgggaagatccagaacgcccctaacagccactctgcccagcacgtgaagatgggttacggggcctggtacttaaaacccaagcttgggaaaaaactgcgctcagacgaacctcttatcgacccaaagctggtcctggagaagcccgacgaaccagacattctcgacggactgtatggcccgatcgcattcaaagacttcattcttagcaagggctacgagatgccagggataattcagcgcctgtttgcccggaggggctggacatacgattcagtgaaaacccctattcagcgagccatgcaggtgtataaatataaggaagacgtgacagatgcatcagaagaggattag

SEQ ID NO: 29932 - DNA, 888 bp, Artificial Sequence
  Description of Artificial Sequence: Synthetic coding sequence
atgcagatgtcagttccttgcgtcttaagctctttgcagaatcacgagcctaataaacccctgttcacaactcagtcgcagctcttgagcaaagtgcttgaggtgcttgacccagaccgcaagttggaggatacatgggcctactgccaggatacccgcaaaggaatgaaagaacccaccaagctgctgaaaaagcacagtacccaggtttatctgggcccttccaagaagacaagcgtatccaacgctggccaatggttgtacgaagaaaaaccacacaaaatggatctactccacgagaacggcccaagaccggggctccatgagaatgtctgcaaagccgtttccgacttctgcaagtgggtaaccaccttcggaatctccgatattgatgaggagttcattttaaagcagttcgacatcgactacgagactaagccgtcacacgacgcactgcacacaatgaagctcaaccaggttcctctagaactgaaacggtctgtgggcctctcaaagctgcaggaaacagagtttttccagaaacttggttatgaacgcaaactgcagaaacctcagaacccatataaaccgaaatgggtgaaaatgcgctatggggcatggtacctgaatcctaagttgtggaaaaagcaaagagttgacgagcccctcgtagatcccgaggtgtcacataaagctcaggaggagaacttcaaaaaggaactccaagagcaagaagagctgctggcggacctgcatggaaccgtagcctttaaggattttattctgtcgcggggctacaggacccctagattcctggagaacatgtatatcggaaaagagtgcaagagggcctgtaacaaaacacccattaagcgaacgcaggcctag

SEQ ID NO: 29933 - DNA, 1182 bp, Artificial Sequence
  Description of Artificial Sequence: Synthetic coding sequence
atggcggaccgacgccgcaggctcagacccggtactctggcccccgtgcgcgagggagtgaattgtcgcagcagatgtttcacgaagcacaagaatggcctgaagtttcctacttctctccactcacggcaattagtcttcccaaggaaggggttggacgattttaggaaaggctgccctccctgtacaggtttggtgactcaggtgcccgtggagggatttttaccccaaatctaccatcgggcaccccagctggcccctaaaaaaagacagataaagttgctgaaagaggccgatgtcctttctaagctgtctcctgcgcagcaggcaaggaaggccttcctggaggacgttgaagcccatctgaccccacatccactggccctctacctgaacctcgaggaggccatgcctattgagctgctgtcaaaagtcctggaggttctcgacccagaccgaaaactggaagatacctgggcctattgtcaagatacgagaaagggcatgaaggaaccaacaaagctgctcaaaaagcattcaacccaggtatacctcgggcctagcaaaaagaccagcgtcagcaatgctggtcagtggctgtacgaggagaaaccccataagatggacttactgcacgagaacgggcctagacccgggttacatgagaacggcattagcgacatagatgaggagttcattttgaaacaatttgatatagactacgaaactaagccgagccacgacgctctccacaccatgaaattgaatcaggtaccactcgagctgaagagatccgtggggctgagcaaactgcaggagacagagttcttccagaagctgggttatgaacgaaagcttcagaagccacaaaatccatacaagcctaagtgggtaaaaatgagatatggagcctggtatctgaatcctaagctgtggaaaaaacagcgtgtcgacgaaccactggttgatccagaagtttcccacaaggcccaagaggaaaacttcaagaaggagctccaggaacaggaagaacttttggcggacctccacggaaccgtagctttcaaggactttatactttctcgcggctaccgtacaccccgattcctggaaaacatgtacatcggcaaggagtgcaaacgagcctgtaacaaaacacccattaagaggacgcaggcttag

SEQ ID NO: 29934 - DNA, 972 bp, Artificial Sequence
  Description of Artificial Sequence: Synthetic coding sequence
atggggaaccttctgaaggtgctgacacgggaaatcgaaaattacccccacttcttcttggacttcgagaatgcccagcctaccgaaggtgagcgcgagatttggaatcaaatctctgctgttctccaagacagtgagtccatattggccgacctgcaggcttacaaaggggcaggccccgagatccgggacgccattcagaatccgaacgacattcagctacaggagaaggcatggaacgcggtttgccccctcgtcgtgaggctcaagagattctatgagttcagcatcaggctggagaaggccctgcagtcgctgttggagtctctgacttgtccaccgtacaccccgacccagcacctggaaagagaacaggcccttgctaaggagtttgccgaaatcttgcactttaccctccgattcgacgagctgaaaatgagaaatcctgctatacaaaacgacttttcctactacaggcgaactattagccgaaatcggatcaacaacatgcaccttgacattgaaaatgaggtcaataacgagatggcaaaccgcatgagcctgttttacgctgaggctacgccaatgctgaagactctgtccaatgctacaatgcacttcgtatcagagaacaaaaccctgccaatcgaaaacaccaccgactgcctctcaaccatgacatcagtgtgcaaggtaatgctggagacccccgagtaccggtcaaggttcacgagtgaagagacccttatgttttgcatgcgtgtcatggtgggcgtcatcattctttatgaccacgtgcacccggtgggggccttctgtaaaactagcaagatcgacatgaaaggatgcatcaaagtgctgaaggagcaggctcccgattctgtggaaggcctgctgaacgcgctcagattcaccaccaaacatctcaacgacgaatcaaccagcaaacagatccgagccatgctccaatag

SEQ ID NO: 29935 - DNA, 972 bp, Artificial Sequence
  Description of Artificial Sequence: Synthetic coding sequence
atgggcaacttactaaaagtgttgacacgagaaatcgagaactacccgcatttttttttggattttgaaaatgcccagcccactgagggtgagcgtgaaatatggaaccagatcagcgccgtgctgcaggacagcgaatcaatactcgcagacctgcaggcttacaagggggcgggtccagagataagagatgctatacagaaccccaacgatatccagctccaggagaaagcctggaatgccgtttgccccctggtggtgcggttgaagaggttttacgaattctcgataaggctcgaaaaggcacttcagtctttgctcgagagcctgacctgtcctccttacaccccaacccaacatctcgaacgtgaacaggccttggcaaaggaatttgcagaaatactgcactttacactgcggtttgatgaactgaaaatgagaaacccggcaatccagaacgattttagttactatcgacgaactatttcccggaatcgcatcaacaatatgcacttggacattgagaacgaagtaaacaacgagatggcaaaccgcatgtcactcttttacgcagaggcaacccccatgctgaagacacttagtaacgccactatgcatttcgtgtcggaaaacaagaccttacccatagagaataccaccgattgcctctcaaccatgacgtccgtgtgcaaggtgatgttggagacgccagaatacagatctcggttcacttctgaggagactttaatgttctgcatgagagttatggtcggagttatcatcttatacgatcatgtgcacccggtaggagcattttgcaagacaagtaaaatcgacatgaagggttgtattaaggtcctgaaagagcaggctcccgatagcgttgaggggttgttgaatgctctgcgttttactacaaagcatttgaacgacgagtctactagcaaacagatccgcgctatgctccagtag

SEQ ID NO: 29936 - DNA, 972 bp, Artificial Sequence
  Description of Artificial Sequence: Synthetic coding sequence
atgggaaacctccttaaagttctgactcgggaaatcgagaattatccgcattttttcctcgactttgagaacgcacagccaaccgagggagagagagagatttggaaccaaatatccgccgtgctgcaggattccgagtctatcctggcagacctgcaggcgtacaagggtgctggcccagagattagagacgccattcaaaaccccaatgacatccagttacaagaaaaggcttggaatgccgtgtgtccactagtggttaggctcaaaaggttttatgaattttccatcaggctcgaaaaggctctccaatctcttttggagagtttgacctgcccaccctataccccgactcagcatctagagagggaacaagccctggccaaggaatttgccgaaatcctccatttcacactgcggttcgacgagctaaagatgcggaaccccgccatccaaaacgactttagctattatcggaggacaatctctagaaacaggataaacaacatgcacctggatatcgaaaacgaagtaaacaacgaaatggcaaatcgcatgtccctcttctacgctgaggccacaccgatgctcaagactcttagtaacgccactatgcatttcgtgtcggaaaataagactctaccaatcgaaaacacaacagattgtctttcaacaatgacgtcagtatgtaaggttatgttggaaacgcctgagtatagaagccgctttacctctgaggagacactgatgttctgcatgcgcgtcatggtgggagtcatcattctctacgatcatgtgcatccagtcggagcattctgtaaaacatcaaagatagacatgaaggggtgtatcaaggtgctgaaagaacaggcccctgactcagtagagggcctgctcaatgccttgcgtttcacaacgaaacacttaaatgacgagagtacaagcaaacagatcagagctatgttgcagtag

SEQ ID NO: 29937 - DNA, 285 bp, Artificial Sequence
  Description of Artificial Sequence: Synthetic coding sequence
atggggaatctcctgaaggtgctgacaagagagatagaaaactacccccacttctttcttgacttcgaaaatgctcaacccaccgaaggggagagggagatatggaaccagataagcgccgtgctccaagactcagagtcaatcctggccgatctgcaggcttataagggcgctggccccgaaattagggacgcaattcagaatcctaacgacatccaactgcaggagaaggcatggaacgcagtgtgtccactggttgtgaggctcaagcgtttctacgagtag

SEQ ID NO: 29938 - DNA, 264 bp, Artificial Sequence
  Description of Artificial Sequence: Synthetic coding sequence
atgggcaatttgctgaaggtgctgactcgcgagatcgagaattatcctcatttcttcctcgacttcgaaaacgcgcagccaactgaaggcgaaagggaaatctggaatcagataagcgctgtactacaagacagtgaatccatactggcagacctgcaggcatataagggtgccgggcctgagatccgcgacgctatccagaaccccaatgacatccagctacaggagaaggcttggaacgctgtatgtcctctagtggtctag

SEQ ID NO: 29939 - DNA, 654 bp, Artificial Sequence
  Description of Artificial Sequence: Synthetic coding sequence
atgcagaaggctagctggagaacttgttctcataccgaggagctggcaaccaaatatgagcgcgcaatccagcatcccgcagacgagaagcttcaagaaaaagcctggggtgcagtcgtcccactggtgggcaaggaaattctgcgaatttttagcgaagtaaggtcttcgatcaagcgatcgtctggcagcctcaataagtatcctattttcagtcaccccgcaagccgcgctcgccaggctctggcaaagcagttcgccgaaatcctgcatttcacacttagattcgatgaattaaaaatgaccaaccccgctattcaaaatgatttcagctactaccgccggactctttcgcggatgagaattaccatgtaccgagctgaaggagaaaacgaggtgaataatgaacttgccaacaggatgtctctcttttatgctgaagccaccccaatgcttaagaccttgtccgacgctacgaccaagttcgtctctgaaaacaagaacttgccaatcgagaacacaaccgactgcctctcaaccatggccagcgtttgccgcgtcatgctagaaaccccagagtaccggtcacgcttcacaaatgaagagacagtcagtttcctcgaaggaaacggggggtgtcacaataccttgtag

SEQ ID NO: 29940 - DNA, 975 bp, Artificial Sequence
  Description of Artificial Sequence: Synthetic coding sequence
atgggaaatcttttgaaagtcctgacctgtacagaccttgagcaaggccccaacttctttcttgactttgaaaacgcacagcctaccgaaagcgagaaagagatttacaatcaggtcaacgtcgtgttgaaagacgccgagggcattctggaggacctgcaatcttatcggggtgcgggacatgagatccgtgaggccatccaacatcccgcggacgagaaactgcaggagaaggcatggggcgccgttgtgccactggtcggaaagctgaagaagttctacgaattctctcagcgcttggaggctgccctgcgaggactgcttggagcactgactagtacaccttacagccccactcagcacctggaacgcgagcaagcactggcgaagcagtttgcagaaattctccatttcactcttagatttgacgagcttaagatgactaaccccgccatccaaaacgattttagttactaccggcggaccctgtccagaatgcggatcaacaatgtaccagccgagggagaaaatgaagttaacaatgagctggctaatcgaatgtctttattttacgctgaggccacgccaatgctaaagaccctgagcgacgctaccaccaagttcgtttcagaaaacaagaaccttcctattgaaaatacaacagactgcttgtccaccatggctagcgtgtgtagggtgatgttggagacaccggagtaccgctctagatttacaaacgaggagacagtgtcattctgcttgagggtcatggtgggcgtcatcatactgtatgatcacgtccacccagtgggggcgttcgccaaaacatctaagatagatatgaaaggctgcattaaagtactcaaagatcagccccccaactcagtggaaggcctcctaaacgctctccgctataccaccaaacacttgaacgacgagacaacatccaagcaaatcaaaagcatgctacagtag

SEQ ID NO: 29941 - DNA, 975 bp, Artificial Sequence
  Description of Artificial Sequence: Synthetic coding sequence
atgggaaacctgctcaaggtgctcacctgtacggatctggagcagggcccgaactttttcctggatttcgagaatgctcaacccacagaatcagagaaggagatttacaaccaggtgaatgtggtgctcaaagacgcggagggcatcctggaggacctacagtcgtatcggggagcaggtcatgaaatcagagaggcaatccagcacccagccgacgaaaagctccaggaaaaggcttggggtgccgtagttcccctggtggggaaactcaagaagttctatgaattcagtcagcgcctggaggcagcattaaggggacttcttggcgctctgacatccacaccttattcgccaacccaacacctcgaacgcgagcaggcgctcgccaaacagtttgcggagatccttcacttcaccttgagattcgatgagctgaaaatgacaaaccccgctattcaaaatgacttttcttactataggaggacattgtcccgtatgcgcataaacaatgtgcctgcagagggagagaacgaagtaaataacgaacttgcgaacagaatgtccctattctacgcagaggccaccccgatgctcaaaactctgtccgacgctacgaccaagtttgtatccgagaataaaaaccttcctatcgagaatacaacagactgtttgagcacgatggccagcgtctgtcgtgtgatgctggagacgccagagtatcgcagcaggtttacaaatgaggaaacagtaagcttttgtctaagagttatggtgggcgtgatcattctttatgatcatgtccacccagtcggggcatttgctaagacatcaaaaatcgacatgaagggttgcattaaagtgttgaaggaccagccacccaattcagtggaaggactccttaacgctctaaggtatacaaccaagcatttgaacgatgaaaccactagcaaacaaatcaagtcaatgctgcagtag

SEQ ID NO: 29942 - DNA, 192 bp, Artificial Sequence
  Description of Artificial Sequence: Synthetic coding sequence
atgggaaatctccttaaggtcctaacatgcactgatctcgagcagggaccgaacttctttcttgacttcgagaatgcccagcccactgagagtgaaaaggagatctacaatcaggtgaatgttgtccttaaggatgctgagggtattcttgaggatcttcagtcatacagaggcgccggccatgagatatag

SEQ ID NO: 29943 - DNA, 198 bp, Artificial Sequence
  Description of Artificial Sequence: Synthetic coding sequence
atggggaacttgctcaaagttctcacctgtaccgacctggagcaggggcccaacttcttcttggatttcgaaaatgcccagcccacagaatccgagaaagaaatctacaaccaggtcaatgtggtgctgaaggatgccgagggcattctagaggatctgcagtcctatcggggtgctggacatgaaatcagggaatag

SEQ ID NO: 29944 - DNA, 297 bp, Artificial Sequence
  Description of Artificial Sequence: Synthetic coding sequence
atggggaacttgttgaaagtactaacctgtaccgatctggagcaggggcccaacttttttctcgacttcgagaatgcccaacctacagaaagcgagaaagaaatatataatcaggtgaacgttgttctgaaagatgccgagggaatcctcgaggacctccagtcatatagaggagcaggacacgaaatacgtgaggcaattcagcatcctgctgacgagaaattgcaagagaaagcctggggggccgtggtgcccctcgtaggcaagttgaagaaattctacgagttcagccagtag

SEQ ID NO: 29945 - DNA, 207 bp, Artificial Sequence
  Description of Artificial Sequence: Synthetic coding sequence
atgggtaatttacttaaagtgctcacatgcaccgatttagagcaagggccgaattttttcctggactttgagaatgcacagcctacagaatctgagaaagagatctataatcaggtcaacgttgtgctgaaagacgctgagggcatcttagaggacttacagagttaccggggcgccgggcatgaaatacgggaagcaatccagtag

SEQ ID NO: 29946 - DNA, 147 bp, Artificial Sequence
  Description of Artificial Sequence: Synthetic coding sequence
atgggaaatctgctcaaagtgctgacttgtacagatctcgagcagggaccaaatttttttcttgacttcgagaacgcccagccaaccgagtcagagaaagagatctataatcaagttaacgtggtcctcaaggatgctgaaggatag

SEQ ID NO: 29947 - DNA, 975 bp, Artificial Sequence
  Description of Artificial Sequence: Synthetic coding sequence
atggggaacctgttgaaagtcttgacctgcactgacctggagcagggcccaaatttctttctggatttcgagaacgcccagcccacagaatccgagaaggagatttacaatcaggtgaatgtcgtcctgaaagatgccgaaggcatactcgaggatttacagagctaccggggtgctggtcatgagatcagggaagccatccagcacccagccgatgaaaaactacaggagaaagcttggggtgccgtagttccactcgtgggaaagctcaagaaattctatgagttcagccagcggctagaggctgctctgagaggactgttaggagcactcacctctactccatactcccccacacagcacctcgagagagaacaagcgttggctaagcagtttgccgagatccttcattttacactacgattcgatgaattaaaaatgactaaccccgccatccagaatgacttctcctactataggcgtactctcagccgcatgcgcataaacaatgttcccgcagagggagagaacgaggtaaacaacgagttagcaaataggatgtccttattttacgcggaagccaccccaatgttaaaaaccttatcagatgccaccaccaaatttgtttcagagaataaaaacttgccaattgaaaacacaactgattgcctgagtactatggccagcgtatgccgcgtaatgttggagacacccgaatataggagccgcttcaccaatgaggaaactgttagcttttgtctgcgggtaatggtaggcgtgatcatcctgtacgaccacgtacacccagtgggggcgttcgctaaaacctctaaaattgatatgaagggctgcataaaagttctgaaggaccagccaccaaattccgtagaaggccttctgaacgcgttgcgctatactaccaagcacctaaatgacgagactacctctaagcagatcaaatccatgctgcagtag

SEQ ID NO: 29948 - DNA, 468 bp, Artificial Sequence
  Description of Artificial Sequence: Synthetic coding sequence
atggggaatttgctaaaggtgcttacttgtacggacctcgagcaaggccctaacttcttcctcgactttgaaaacgctcaacccacagaatcagaaaaggagatctacaaccaagtcaatgtcgtccttaaggatgcagagggtatcttggaagacctgcagagctatcggggcgccggccacgaaatcagagaggcgattcagcatcctgccgacgaaaagttacaggagaaagcctggggtgctgtggtgccgctcgtgggcaagctgaagaagttctacgaattctcacagaggctggaagctgctcttcgaggtctgttaggagcactcacctctactccttattcccccacgcagcacctggagagagaacaggccttagctaagcagttcgccgagatcctgcacttcacgctgcggtttgacgagcttaaggtggagttgtccatcggacccgattgttag

SEQ ID NO: 29949 - DNA, 975 bp, Artificial Sequence
  Description of Artificial Sequence: Synthetic coding sequence
atgggtaacttgctaaaggtcttaacctgcaccgatctggagcagggccccaactttttcctggattttgagaatgcccagccgaccgagagcgaaaaggaaatttataatcaggtgaacgtcgtgctcaaggacgctgagggaattctcgaggatctccagtcctacagaggggccggccacgagatcagggaggcaatccaacaccccgccgacgagaaactccaggagaaggcctggggcgcagtggtaccgttggtgggcaagttaaagaaattctatgagtttagccagaggctcgaggccgcccttcgaggactgctgggcgccctcacatcaaccccttacagcccaacgcagcatctcgagcgcgaacaggcgctcgccaaacaattcgcagaaatccttcacttcactttacggttcgatgaacttaagatgaccaatcccgcaattcagaatgacttctcctattacagacgaaccctgagcaggatgcgcatcaataacgtgcccgccgaaggggaaaacgaggtgaataatgaactggctaaccggatgtcactcttctatgccgaggcgacgcccatgctgaagacccttagcgatgcaaccaccaaatttgtctcggaaaataaaaacctgcccatagagaataccactgactgtctctcgaccatggcatccgtgtgtcgagtgatgctggagactccagagtaccgatctaggtttactaacgaggaaactgtgtctttttgtcttcgggtcatggtgggtgtcataatcctgtacgatcacgtccatccggtgggcgcgttcgccaaaaccagtaaaatagatatgaagggctgcattaaagtattaaaagatcagccccccaatagcgtcgagggtctgctaaacgctctgagatacactacaaagcatctcaacgacgaaactacatcaaagcaaatcaagtctatgctgcaatag

SEQ ID NO: 29950 - DNA, 975 bp, Artificial Sequence
  Description of Artificial Sequence: Synthetic coding sequence
atgggaaatttactgaaggtgctcacgtgtactgatcttgagcagggtcccaatttttttcttgatttcgagaacgcacagcctaccgagtccgaaaaggagatctataaccaagtgaatgtggtattgaaggacgctgagggcattctagaggacctacagtcttaccgcggcgccggccatgaaattagagaggcaatacagcatcccgcagacgaaaaactgcaagagaaagcatggggggctgtagttccactggtcggaaagctgaaaaaattttatgagttctcccagaggctagaagctgccctacgagggctgcttggagcactcacgagcacgccttactcccctacacagcacctggagagagagcaggcgttggctaaacaattcgccgagattttgcatttcaccctgaggtttgatgaactgaagatgactaaccccgctattcagaatgatttctcttactatcggaggactctgagccgaatgagaattaacaatgtacccgccgaaggagaaaatgaagtgaataacgaactggcgaatcgcatgtctcttttttacgctgaggccacacccatgctaaaaactctgtccgacgcgaccactaaattcgttagcgaaaataagaacctgcccatcgaaaacacaacagattgtctcagcacaatggcgtccgtgtgtagagtgatgctggaaacaccagaatatcgctccaggttcacaaacgaagagacagtctcattttgccttcgggtcatggtgggtgtgattatcctatatgatcacgtgcacccggtcggggcattcgccaagacttcaaaaattgacatgaagggctgcattaaagttttgaaggaccagccgccaaactctgtggaaggcctgttaaatgccctgcgctataccacaaagcatctcaatgacgagacaacctctaaacaaatcaaaagcatgttacaatag

SEQ ID NO: 29951 - DNA, 303 bp, Artificial Sequence
  Description of Artificial Sequence: Synthetic coding sequence
atggggaatctccttaaagtcctcacttgcacggacctggaacagggaccaaactttttccttgatttcgagaacgctcagcctaccgaatccgagaaggagatctacaaccaggtgaatgtcgtgctgaaggatgctgagggtatcctggaggatctgcagtcctaccgtggcgctggccacgaaattagagaggctatccagcatcccgcagatgaaaagctccaagaaaaggcctggggtgccgtggttcctctggtgggaaagctgaaaaagttctatgaattctcacagcgactgtag

SEQ ID NO: 29952 - DNA, 240 bp, Artificial Sequence
  Description of Artificial Sequence: Synthetic coding sequence
atgggtaacctcttgaaggtcttaacctgtactgacttggagcagggacccaactttttcctggattttgagaatgctcagcctacagaatccgaaaaggaaatctataatcaagtgaacgtcgttctcaaggatgccgaaggaattcttgaggacttacagtcctataggggagcgggtcacgagattcgcgaagctatccagcatccagctgatgagaaacttcaggaaaaggcttag

SEQ ID NO: 29953 - DNA, 141 bp, Artificial Sequence
  Description of Artificial Sequence: Synthetic coding sequence
atggggaatctgctaaaagtgttgacatgtaccgatttggaacagggtcccaatttcttcctggattttgaaaacgctcagcctacggaaagcgaaaaagagatttacaaccaggtgaacgttgtactcaaggatgcatag

SEQ ID NO: 29954 - DNA, 975 bp, Artificial Sequence
  Description of Artificial Sequence: Synthetic coding sequence
atgggcaatctcctcaaggtcttgacgtgcacggatctggaacaaggcccaaacttctttctggatttcgagaacgcccaacccaccgaaagcgagaaagagatctacaatcaggttaatgtggtgcttaaagacgccgaaggaatcttggaagaccttcagagctaccgaggagcaggtcacgagatcagggaagccattcagcaccccgccgacgaaaagttgcaggagaaggcttggggcgccgtggttcctctcgtgggtaagctaaaaaagttttatgaattttctcagagattggaggccgccctgcggggactcctgggggcacttactagcacaccatattcaccgactcagcaccttgagcgagagcaggctcttgcaaaacagtttgccgagatcctccatttcactctccgatttgatgaactgaaaatgacaaaccccgccatccagaacgatttctcttattacagacgcaccctgagtagaatgcgaattaataacgtgcctgccgagggcgagaatgaggtgaataacgaactggccaatcggatgagtctgttctatgccgaagctacacccatgttgaagaccctcagcgacgcaacaacaaaattcgtgtccgagaataagaacctgccaatcgagaatacaaccgattgtctgtcaactatggcctcagtttgccgagtgatgctcgaaactccagagtataggtcgaggttcacaaacgaggaaaccgtttccttctgcctgagggtgatggtgggcgtcatcattctctatgaccacgtacatccagttggcgcctttgctaagacaagtaagatagacatgaaaggctgtatcaaggtgctcaaagatcaaccgcctaattcagtggagggcttattaaacgccctcaggtataccaccaaacacttgaacgacgagaccactagtaaacagataaaatcaatgctgcaatag

SEQ ID NO: 29955 - DNA, 975 bp, Artificial Sequence
  Description of Artificial Sequence: Synthetic coding sequence
atgggcaacctcttaaaagttctgacatgtaccgacttggagcaggggcccaatttctttctcgattttgaaaacgcacaacctacggaatcggagaaagaaatctacaaccaagtgaacgtcgtgcttaaggatgctgagggaatcctcgaagatctgcagtcttaccgtggtgctgggcatgagattagagaggcaattcagcacccagccgacgagaaattgcaagaaaaagcgtggggtgccgtggtgcccttggtgggcaagctgaaaaaattttatgagttctcgcagcgactggaggcagcccttcgaggactgctgggtgccctgacaagtactccttattctccaactcagcacctcgagcgcgaacaggcacttgcaaaacagtttgctgagatcttacacttcactttgcgcttcgacgaactgaaaatgaccaatccagccattcagaatgatttcagctactacagaagaaccctgagtcgcatgcgaattaacaacgtgcccgctgagggcgagaacgaggtgaataatgagttggccaatcggatgtctctgttttatgccgaggctaccccaatgctgaaaacgttgtcagacgctacaaccaaattcgtgtccgagaataaaaacctgcccatcgagaacaccaccgattgtcttagcaccatggctagcgtgtgtcgtgtcatgctggagacacccgaatatcggtccagatttacgaacgaggagacagtgagcttctgcctgcgcgtgatggtgggcgtgatcatactgtacgaccatgtacatcctgttggtgcttttgctaagacgagtaagatagatatgaaggggtgcattaaggtactcaaagaccagccgcctaattccgtcgaaggcctcctgaatgctcttaggtacaccactaagcacctcaatgacgagacaactagtaagcagataaaatcaatgctacagtag

SEQ ID NO: 29956 - DNA, 282 bp, Artificial Sequence
  Description of Artificial Sequence: Synthetic coding sequence
atgggtaacctgctcaaagttctgacatgtactgacttggagcaggggcctaattttttcctggacttcgaaaatgcccagcccaccgagagcgagaaagagatttataatcaggtgaatgttgtgttgaaggacgcagagggtattcttgaggacctccaatcctacaggggcgccggtcacgaaatccgggaagccatccaacaccccgccgatgagaaattgcaggaaaaggcttggggggctgtggtgccactcgtcggaaagttaaagaagttttag

SEQ ID NO: 29957 - DNA, 978 bp, Artificial Sequence
  Description of Artificial Sequence: Synthetic coding sequence
atggcccagtataaaggtaccatgagggaagccggtcgcgcaatgcacttgttgaagaaaagggagagacaaagagagcagatggaagtgcttaaacagcgtattgcagaggagacaatacttaaatctcaagtcgacaaaagattttctgcccactacgatgccgtagaggccgagttgaaatctagtactgttggcttagtgacattgaatgatatgaaggctcggcaggaggctcttgtcagagaacgagagcggcagctcgcgaagaggcagcacctcgaagaacagcgcctgcagcaggaacgtcagcgagagcaggagcaaagacgggagagaaaaaggaaaatctcttgcctttccttcgccctggacgatctggatgatcaggctgatgcagccgaggcaagaagggccgggaatctgggcaagaatccagatgtggatacaagcttcctgcctgatagagaccgagaggaagaggagaataggcttcgcgaagaattacggcaggaatgggaagctcaacgagaaaaggtaaaagacgaggagatggaagtgacattcagctattgggacgggagtgggcaccgacggacagtgagagtgagaaagggaaatacagtgcaacaattcttgaagaaggccctgcaagggttgcgtaaggattttcttgagcttagaagcgcaggggtcgaacagctgatgttcatcaaggaagatcttatcttgccacactaccacactttctatgatttcattatcgcccgcgctcgcggtaagtctggacccctgttcagctttgatgtgcatgatgatgtacgcctgctcagtgacgccaccatggagaaggatgaaagtcatgcaggcaaggtggtattacgcagctggtacgagaaaaataaacatatttttcctgccagcagatgggaggcttatgatcccgaaaaaaagtgggacaagtatacaatacgctag

SEQ ID NO: 29958 - DNA, 978 bp, Artificial Sequence
  Description of Artificial Sequence: Synthetic coding sequence
atggcccagtataaagggacaatgcgggaggccggtagggctatgcacctcctgaagaaacgtgagagacagcgggaacagatggaggtcttgaagcaacgaattgcggaagagacaattcttaagtctcaagtagacaaacgtttctctgctcactatgatgcagtggaagccgaattgaaaagtagtaccgtgggcctggtaaccttgaacgatatgaaagccagacaagaggcccttgtgcgagaacgcgaaaggcagttagcgaaaagacagcatctggaggagcagagactgcagcaagaaaggcagcgcgagcaggagcagcgcagagagagaaagcgcaagatttcctgtctgagtttcgctctcgatgaccttgatgatcaggccgatgctgctgaggcacgcagagccggtaatttgggcaagaacccagacgtagatacgagcttcttacctgatcgcgatcgggaagaggaggagaacagactgcgagaagagcttagacaggagtgggaggcccaaagagagaaggttaaggacgaggagatggaagtgaccttctcctactgggatgggagcggccatagacggactgtgcgagttagaaaggggaataccgtgcaacagttcctgaagaaggccctccagggcctgcgcaaggactttctggaattgcgtagcgctggcgtcgagcagttgatgttcattaaggaagatctcattctccctcattaccacactttctacgatttcattattgcacgcgcccgcggaaagtctggacctttgttctcgttcgacgtgcacgacgatgtgcggctgctctccgacgccactatggagaaggacgaatctcacgccgggaaggtggtgctgcgctcttggtacgagaagaataaacacatttttccggcctccagatgggaagcatacgatcctgagaagaagtgggataagtacaccatccgttag

SEQ ID NO: 29959 - DNA, 1269 bp, Artificial Sequence
  Description of Artificial Sequence: Synthetic coding sequence
atggtaatggtccttagcgagtctctgagtactcggggagcagactccatcgcctgtgggacctttagtagggaactacatacaccgaagaagatgagccagggccctactctgtttagctgcgggatcatggagaacgatcggtggcgggacctggaccgcaagtgccccttgcagatcgaccagccgtcaactagcatctgggagtgcctgcctgagaaggatagttccctgtggcaccgagaagcagtcacagcctgtgctgttacttccctaattaaggacctcagcatctcggaccacaacggaaacccgtcagcccctccctctaagaggcagtgcaggagtttaagtttttccgatgagatgagcagctgtagaacctcctggcggccactaggctctaaggtgtggacgcctgttgaaaaaaggagatgttattctggtgggtccgttcaacgatacagtaatggcttttccactatgcaaaggtcatcatctttctcattaccttccagagcgaacgtccttagctctccttgtgatcaagctgggctccaccaccgttttggaggccaaccctgtcagggcgtgccaggaagcgcaccttgcggacaggccggagacacctggtcaccagacctacatcccgtaggcggtgggagactggaccttcagagaagccttagttgtagtcacgaacagttttcctttgtggaatattgccctccttccgccaactccacgcccgcatcgactcctgaattggcacgcaggtcctccggactgtctcgttccaggagccagccctgtgtgctgaatgacaagaaagtcggcgtgaaaagaaggcgtcctgaagaggttcaggaacagcgtcctagcttagatctggccaagatggctcaaaattgtcagaccttctctagccttagttgtctctccgccggcaccgaggactgcgggccacaatcacctttcgcccggcatgtgagcaacacccgggcatggacagccctgctgtctgcatcaggaccagggggcagaaccccagccggcactcccgtgcctgagcctttgcccccgagctttgacgatcacctggcttgtcaagaagacctgtcttgtgaagaatcagactcgtgtgccctggatgaggactgcgggcgtcgggccgaaccagctgctgcgtggagagatcgaggcgccccgggtaactccctgtgtagcctagacggcgagctagatatcgaacaaattgagaagaactag

SEQ ID NO: 29960 - DNA, 1269 bp, Artificial Sequence
  Description of Artificial Sequence: Synthetic coding sequence
atggttatggtcctcagcgagtcactgagcacacgtggtgccgactcaatcgcctgtggaacgttcagcagggagctccacactcccaaaaagatgtcccaaggcccgactttgttcagctgcggcatcatggagaacgaccggtggcgcgacctggacagaaagtgtcccctacagatcgatcagccaagtacctcgatatgggaatgcctgcctgagaaagatagctctctgtggcacagagaagcggttacagcgtgtgcggtaacctctctcattaaagatctgtccatctccgatcacaacggaaacccttcggcacctccctccaaaagacaatgccgaagcctcagcttctctgacgagatgtcttcctgccgtacttcatggcggcctctgggatcaaaggtgtggacccccgtcgagaaacggcggtgctactcggggggatctgtccagaggtatagcaatggattctcaacaatgcagcgcagctccagcttcagcctcccatctcgagctaatgtgttgtcatccccttgtgatcaggcaggtcttcaccatcggtttggcggccagccttgtcagggcgttccaggctccgctccttgcgggcaagccggcgacacctggtcacccgatctgcaccccgttggcggcgggcgattggatctgcagaggtccctgtcttgctcacacgaacaattttccttcgtagagtactgcccaccatcggcaaacagcacccctgccagcacccctgaattggctaggagatccagtgggttgagccgatctcgctcacagccctgtgtgctgaatgataagaaggtgggggtaaagagaagaagaccagaggaggtacaggaacagcggccatccctggatttagctaagatggcccagaattgtcagactttttccagcttatcctgcttgagcgcaggcaccgaggactgcgggccgcagtctcccttcgctagacacgtgtctaacacccgagcctggactgcccttctctctgcaagtgggcctggcggcagaacccctgcaggcacccctgtacccgaacccttgcccccctcgtttgacgaccaccttgcctgtcaggaggatctttcatgcgaagaatccgattcttgtgccctggatgaagactgtggaaggcgggccgagccggcggctgcatggcgcgatcgaggagcgccaggaaactctctctgctctctggacggggagttggacatcgaacaaatagaaaagaattag

SEQ ID NO: 29961 - DNA, 1179 bp, Artificial Sequence
  Description of Artificial Sequence: Synthetic coding sequence
atgattaccctcattactgaacagctccagaaacagacccttgacgaactcaagtgtacgcggtttagcatttcgctgccactcccagaccacgcggacatcagcaattgcggaaactcattccagttagtgtctgagggagcatcatggcgaggcctcccacactgcagttgtgcagaatttcaagacagcctgaacttttcttaccacccaagcggattgtcactgcatctgaggccaccatccagggggaacagcccaaaagaacagcctttcagtcaggtgcttaggcccgagccgccagatcccgaaaagctacccgtcccccccgcccctccgagcaagcgtcactgccggtctttgagcgtgcctgtggatttaagtaggtggcagcctgtgtggcggcctgccccctcgaagctgtggacccctatcaaacaccgcggctccggaggcggcggtggtccacaggtaccgcatcaatctccacccaaaagggtgagttcactcagatttctgcaggcaccttctgccagttcccagtgcgcccctgcccataggccctacagcccgcccttcttcagtctggcactggcacaggatagcagccgcccatgtgcggcctcaccccagtccggatcctgggagtcggatgcggagtccctcagcccctgccccccccagaggcggttctccctctcaccctcacttggcccccaagcatctagattcctgccctccgcccggtccagtcctgcctcgagccccgagttgccttggcggccccgcgggctgaggaatctccccaggtcccgaagccagccttgtgacctcgacgccaggaagaccggagtaaaaagaaggcacgaggaagaccctaggagattgcgaccaagcctcgattttgacaaaatgaatcaaaaaccctattccgggggtctttgcctccaggagaccgctcgggagggctcgtcaatctctccgccttggtttatggcatgttccccacctcctctgagtgcgtcatgttccccaaccgggggttcttcccaggtgctctcagaaagtgaggaagaagaggaaggggccgtgcggtggggtcggcaggcgctgtcaaagcgaacgctgtgtcaaagagatttcggcgatctcgacctgaacctgatcgaggagaactag

SEQ ID NO: 29962 - DNA, 1179 bp, Artificial Sequence
  Description of Artificial Sequence: Synthetic coding sequence
atgataactctaatcactgagcaactacagaagcaaaccctcgacgaactcaagtgcacccgtttcagtatctccctcccattaccagaccacgccgatattagtaattgcggaaacagcttccagctcgtctccgaaggtgcatcctggcgcggcctgccccactgttcctgcgcggaatttcaagatagtcttaactttagttaccatccgtctggactcagtttacacttgcgaccacctagtcgcggcaatagtcctaaggaacagcccttttctcaggttctgagacctgagccacccgacccggaaaaactgccggtaccgccagcaccgccctcaaaacgccactgtcgatcactgtcagtcccagtggacctgagcaggtggcaacctgtatggcgacccgcaccaagcaagctttggacccccataaagcacagagggagcggcggcggaggcgggccccaagtcccacaccagagccctccaaaaagagtgagctcgctgcgctttctccaggctccgtcagctagcagccagtgcgcccctgcacatcgcccttactcccctcctttctttagtctggcccttgcacaggacagctctcggccttgtgcagccagcccccagagtgggtcctgggaaagtgacgccgagtccttgtctccttgtcctccacagaggcgcttctcattatccccaagcttggggccccaggccagtaggttcctgccatccgcaagatcgagcccggcttcatcacctgagctcccatggcgaccccgcggactgcgaaacttgccaagatcccgttcccaaccctgtgatctggatgccaggaagactggagttaaaagaagacacgaggaagatcctagacgattacggccatccctggactttgacaagatgaaccagaaaccgtactctggaggcctgtgcctgcaggagactgctcgagaaggatcatccatttcccctccctggttcatggcctgtagtccaccaccgttgtctgccagttgttcccccaccggaggatcgtcccaggtgctatcagagagcgaagaggaggaggagggcgcagttagatggggaagacaggccttgtcaaaaagaacattatgtcagcgcgactttggcgatctcgaccttaaccttatcgaggagaattag

SEQ ID NO: 29963 - DNA, 1158 bp, Artificial Sequence
  Description of Artificial Sequence: Synthetic coding sequence
atgtccctcattttaaatatcctgcgcgagatgctggagtacttcggggtgcccgttgagcaggttttgctgatctgggagaacaaagactatgggtccaccaggtcaatcgtgcgcataatcgggaagatgctgcccctagagccgtgccggcgcccaaacttcgaactcatccctctgctgaacagcgttgatagcgataactgcggaagcatggtgcccagttttgcggacatactgtatgttgctaatgacgaggaggccagttaccttcggtttaggaactccatctggaagaatgaagaagaaaaagtcgagatcttccacccactccgcctggtgagagatcctctgtccccagctgttcgccagaaggagaccgtcaaaaacgatcttccagttaatgaggcggccattaggaaaattgctgcactggagaacgagcttacgttcctgagatctcagattgccgctatcgtagaaatgcaggagctgaagaatagcacaaattcctcctccttcggtcttagtgacgagcggatctcgctcgggcagttaagtagtagcagggccgctcacctgtccgtggaccctgaccagttgccaggttccgtgctgtcacctccaccacccccgccactccccccacagttttcaagcctacaaccaccttgttttcccccagtgcagccagggagcaacaatatttgtgacagcgacaaccctgccactgaaatgtctaagcaaaacccagctgccaataaaaccaactattcccatcactccaagagtcagcggaataaggacatcccaaatatgttggacgtgctcaaggatatgaacaaggtgaagttacgagcaattgaacgcagcccgggtggtcgccccatacacaaacgtaagagacagaatagtcattgggacccagtatccctaatctcccatgctctcaaacagaagttcgcctttcaagaagatgattcattcgaaaaggagaatcgatcatgggagtcaagccctttcagctccccagagacgtcgcggtttggccaccacatcagccaaagcgagggtcagcgaaccaaggaggaaatggtaaacacaaaagctgtggaccagggcataagcaatacatccctgctaaactctcgaatctag

SEQ ID NO: 29964 - DNA, 1158 bp, Artificial Sequence
  Description of Artificial Sequence: Synthetic coding sequence
atgagccttattttgaatatcctcagggaaatgctggagtactttggagtgccggtggaacaggtgttactgatctgggagaacaaagactatggctccacaaggtcaattgttcgcatcatcggcaagatgttaccactagagccatgtcgacgtccgaacttcgaactgatccccttgctgaattcagtggacagtgataactgcggctccatggtgccatcattcgcagacatactctacgtggctaacgatgaggaggcatcatatctgcgcttccgtaactctatatggaagaatgaagaagaaaaggtggagatctttcacccgctccgcctggtgcgagaccccctgtctcccgctgtgcgtcagaaggagactgtgaaaaacgatctgcctgtcaatgaggccgctataagaaagatcgccgctctggagaacgaactgaccttcctgagaagccaaattgccgccatcgtggaaatgcaagaacttaagaactcaacaaattcttctagctttgggctgtctgatgaaaggatctcactggggcagcttagtagtagtagagctgcacacctgtctgtggatcccgatcaactccctggctccgtgctgtctccccccccgccccctccgctgccccctcaattctcctccctccagcctccctgttttccgccggtccagccagggtcaaataacatatgtgattccgacaatcctgcaacagagatgtcaaagcagaaccccgctgctaataaaacaaattattcccaccactcgaaaagtcaacgtaacaaggacattccaaatatgctcgatgtgctaaaagacatgaataaagtgaagctgcgagcgatagagcgctcacccggtggcagacctattcacaaaagaaagagacagaattcgcactgggaccccgtctcactcatttctcacgcgctcaagcaaaaattcgctttccaagaggacgatagctttgagaaggagaaccgatcttgggagtcctcacctttctcctcaccggaaacctcccgattcggtcaccacatatcgcaatcagaaggccagcgcaccaaggaggagatggtgaacaccaaagccgtggaccagggtatatccaacacaagcctcttgaactctaggatctag

SEQ ID NO: 29965 - DNA, 879 bp, Artificial Sequence
  Description of Artificial Sequence: Synthetic coding sequence
atgtccggcatggaggccactgtcacaatcccaatatggcagaataagcctcacggagctgcccgttcagtcgtccggaggatcgggactaatttgccactaaagccctgtgcccgagcctcgtttgagactctgccaaatatctccgatctgtgcctccgcgatgtgccgcccgtgcccactctggccgatatcgcctggatcgccgcggatgaggaagagacctacgctcgtgtacgcagcgataccagacccttgcgccacacctggaaaccctccccgctcatcgtcatgcagcgcaatgcgagtgtgcccaacctgaggggctccgaggagagattgctcgctttaaaaaagccagccctccccgctctgagtagaactacagaactccaagatgaactgagtcacctcagatctcagattgccaagattgtcgctgcagatgccgcctcagcaagcctaacccccgatttcctgtcacctggcagctcaaatgtctctagcccccttccctgttttggtagctctttccattccaccacaagtttcgtgataagtgatatcacggaagaaacagaagtagaggtcccggaattgccatccgttccccttctgtgctctgcctctcccgaatgttgcaagccagagcacaaagccgcctgtagttcttctgaggaggacgattgtgtgagcctgagtaaagcgtcctcattcgcagatatgatgggcatcctgaaggacttccatcgcatgaagcagtcccaggacttgaacaggtccctgctgaaagaggaggaccccgcagtgctgatctccgaggtcttgcgaagaaaatttgccctgaaagaggaggatattagccgtaagggaaattag

SEQ ID NO: 29966 - DNA, 879 bp, Artificial Sequence
  Description of Artificial Sequence: Synthetic coding sequence
atgtcaggcatggaggccactgtcactatccctatctggcagaataagcctcatggcgccgcccgtagtgtggttcggagaatcgggactaatctaccactaaaaccatgcgcaagagccagcttcgaaaccttgccaaatatttctgatctttgcctaagagacgtcccccccgtccctacattggcagacatagcttggatcgctgccgacgaagaggagacctacgccagagtccgctcagataccagacccctgcggcacacttggaagccgagtcctctcatcgtcatgcagcgcaacgcctcagtcccaaacctgaggggatcggaggagcgactcttggctctcaaaaaacccgcgctgcctgccctgtctagaacgaccgagcttcaagacgagcttagccatctgagatcccagatagcaaagatagtggcagctgacgccgctagcgcctcattgacccccgattttctgtcccctggctcgtcaaacgtgtctagccctctgccttgttttggatccagtttccattccacaacctcattcgtgatcagtgacattactgaggagaccgaggtggaggtgcccgagctgccttctgtacccctcttatgctcagccagcccagagtgctgcaaacctgaacataaagccgcatgctctagctcggaagaagatgattgtgtttcactgtcaaaggcgagtagtttcgctgatatgatgggcattttaaaggattttcacaggatgaaacaatctcaggacctgaaccgctctttgctgaaagaggaggaccctgcggtgcttatttcagaagtgctgcgccgaaagtttgctctgaaggaagaagacatttcacgtaaggggaactag

SEQ ID NO: 29967 - DNA, 879 bp, Artificial Sequence
  Description of Artificial Sequence: Synthetic coding sequence
atgagtgggatggaggccactgtcacaatcccgatttggcagaataagccccatggcgcagcgcgctcagttgtgcgcagaataggtacaaacctgccactaaaaccatgcgctcgcgcctcctttgagactttacccaacatttccgatctatgcctgcgagacgtgccccccgtgccaactcttgccgatatcgcctggattgccgctgacgaggaagaaacatacgcccgcgtacgctcggatactcgacctcttcggcacacatggaaaccgagcccgctcatcgttatgcagcgtaatgcgtcagttcccaatctgcgtggctccgaagaacggcttcttgccttaaaaaagccagctctgccggcactatcacgcacgaccgaactacaggatgagctctcccatctgcgcagccagatcgctaaaatagtggccgcagacgccgcgtctgcgagcttgacccctgatttccttagccctgggagctctaatgtgagttctccccttccttgtttcggatcctccttccactcgactacttcatttgttattagcgatatcaccgaggaaacagaggttgaagtgccggagctgccaagcgtgccgctgctctgcagcgccagccccgagtgttgtaagcctgagcacaaagcagcctgttcaagttcagaggaggatgactgtgtctcgctgtcgaaggctagttccttcgccgatatgatgggaattctcaaggactttcaccgaatgaagcaaagccaggacctaaatcgatctttattgaaagaggaagatcccgccgtgctcatctctgaggttctgcgtagaaaattcgccttgaaggaggaagatatttcccgcaaagggaactag

SEQ ID NO: 29968 - DNA, 843 bp, Artificial Sequence
  Description of Artificial Sequence: Synthetic coding sequence
atgagtgggatggaagcgaccgtcaccattcccatttggcagaacaaacctcacggggcggctaggagcgtggtgagaaggatcggcaccaacctccctttgaagccgtgcgcccgggcttcttttgaaactttacctaatatctctgatttatgtctgcgcgacgtccctcccgtgccaacattagctgacattgcatggatcgctgccgatgaagaggaaacatacgccagagtcaggtctgatacgcgtcctctccggcatacttggaaaccttcccccctgatagtcatgcagaggaatgccagtgtgcctaatctaagagggtcagaggagcgcctcttggcgttaaaaaaacccgctcttcctgcactgagccggacaactgagctgcaggatgagctgagtcatctgcgttctcagatcgctaagattgtcgccgcggacgccggatcctccaatgtaagcagccccctcccatgctttggttcaagctttcacagtactacttccttcgtgatcagtgatattactgaagagaccgaggtcgaggtgcctgaactcccctctgtgccactgctgtgtagcgctagccccgagtgttgcaaacctgaacacaaagccgcttgtagctcctccgaggaggacgattgcgtgagcctgtccaaggcctctagcttcgccgacatgatgggaatattgaaggattttcaccgcatgaaacagagccaggatctgaaccgcagcctgctaaaagaagaagatccggccgtgctcataagcgaagtgcttcggaggaagtttgctctgaaagaagaggacatttcccgaaagggcaactag

SEQ ID NO: 29969 - DNA, 459 bp, Artificial Sequence
  Description of Artificial Sequence: Synthetic coding sequence
atgagcggaatggaagctactgtgaccatcccaatttggcagaacaaaccccacggggcagctcggtccgtggttcgccggatcgggactaacctgccgctgaagccttgcgctagggcgtcctttgagactctgccaaacatatcagacctgtgccttagggacgtcccaccagtgcccacgctcgccgatattgcttggattgctgctgatgaagaggaaacgtatgcccgcgtacggagcgatacgcgcccgttgcggcatacatggaaaccatccccattaatagtgatgcagagaaatgcaagcgtgcccaaccttcgtggctccgaggaaaggctcttggcgctcaaaaagcccgcgctcccggctctgagcaggacaactgagctccaggacgaactgtcacaccttcgctcccaaatagctaaaatcgtcgcagccgacgctgctagttag

SEQ ID NO: 29970 - DNA, 618 bp, Artificial Sequence
  Description of Artificial Sequence: Synthetic coding sequence
atgtctggcatggaggcaacggtcacaattccaatttggcagaataagccccatggggctgcccggtctgtcgtgaggaggatcgggaccaacctgccactgaagccatgtgcccgggcctcttttgaaactctcccaaacatctccgatctttgcttacgcgacgtgccacccgtccccaccttagccgatatcgcgtggattgccgctgacgaggaagagacgtatgcgagggtacgcagtgacacgaggcccttacgacatacctggaagccaagccctcttatcgtaatgcaacgcaacgccagtgtgccaaatctgcgagggtcggaagagcggttgttggccctgaaaaagcctgccctgccagcactgagcagaactaccgagctgcaggacgaactgagccacctacgctcccaaatcgctaagatagttgctgccgacgcggtgacatctcctagacgccagcgctggcgcagccttagctttcatcagtctccttgtttcgtcctgcccgctttgaacgtcgctaatcagaatactaagcttccagccgtaagactgaaacgtatgacagccagtttgtgccctagacccgccgcgctccaaacctag

SEQ ID NO: 29971 - DNA, 618 bp, Artificial Sequence
  Description of Artificial Sequence: Synthetic coding sequence
atgagcgggatggaggcaactgtgactattcccatctggcagaacaaaccccacggagctgccagatctgtcgtgcggcgaatcggaacaaacctacctcttaagccttgcgctagggcctcttttgaaaccttgccaaacataagcgatctctgcctgagagacgttccacccgttcctactctggctgatatcgcatggattgccgcggatgaggaggagacatacgcaagagttcggtcagatacgagaccacttagacacacatggaaaccctccccacttatcgtcatgcagcgcaatgcatccgtccccaatctacgcgggtcggaagaacggctcttggccttgaaaaaaccagccctgcctgcactttcccgcacgactgaactccaggatgagttaagtcaccttcgaagccagatcgccaagattgtggccgcagatgccgtcacatcccctcgtagacagcgctggcgttctttgagctttcatcagtccccctgcttcgtcttacctgctctgaatgtcgctaaccagaacactaagctgccagctgtccggcttaaacgcatgaccgcgtcgctctgtccccggcctgctgccctgcagacatag

SEQ ID NO: 29972 - DNA, 333 bp, Artificial Sequence
  Description of Artificial Sequence: Synthetic coding sequence
atgagcggtatggaggctacagttactatccctatttggcagaacaagcctcatggggctgcacggagcgtcgttcggcggattggcacgaacttgccactgaagccatgtgcacgtgcctccttcgaaaccctccccaatatttctgatctgtgtcttcgggacgtgccacccgtgcccactttggcagacatcgcctggatagctgccgatgaggaagaaacatacgcccgtgtccgctccgatacccgtccgctacgccatacttggaagccctcaccactgatcgtcatgcagcggaatgcctccgtccctaatttgcgcgggtcttag

SEQ ID NO: 29973 - DNA, 513 bp, Artificial Sequence
  Description of Artificial Sequence: Synthetic coding sequence
atgtccggaatggaagccaccgtcacgatacctatctggcaaaataagccccatggcgccgctaggagcgtagtgcggcgaatcggtacgaacttaccactgaagccctgtgccagggcaagcttcgaaaccttaccgaatatctccgacctgtgtttacgggacgttcccccagtacccactcttgcagatatcgcttggatcgcagccgacgaggaggagacttacgcacgagtgagaagcgacacacggcccctgagacacacttggaaaccctctccacttatagtgatgcaaaggaatgcatctgtgccaaatctacggggctccgaagagcgcctccttgccttgaaaaagccagcactcccagcactcagcaggacaaccgagctccaggatgaactttcccatcttcggtcacagatcgctaaaattgtggcagctgacgctgccagcgcaagtctgacccctgacttcctgagtcccgggtcaagcaacgtctcttctccatag

SEQ ID NO: 29974 - DNA, 348 bp, Artificial Sequence
  Description of Artificial Sequence: Synthetic coding sequence
atgtcgggaatggaggctactgtcaccattcccatttggcagaacaagccccacggggccgcacgatcggtagttcgcaggatcggcacgaacttacctctgaaaccttgcgcgcgggcctcgtttgagacacttcctaacattagcgatttatgccttcgtgacgttccccctgtgccaactttggctgacatcgcttggatcgcggctgacgaggaagaaacctatgccagagtgagaagcgacactcgcccactgcgacacacttggaaaccatctcccctcatagtaatgcagcggaatgcgagtgtccctaacctgcgaggatctgaggaacgtctgctgtag

SEQ ID NO: 29975 - DNA, 1995 bp, Artificial Sequence
  Description of Artificial Sequence: Synthetic coding sequence
atgcacagaatgccagaccctggtaaattcaagttactggaacaagcaagggacgtgagggaacccgtcaggtacttttcgtctgttgaggaggttgcgtccgtattccctgataggatcttcgttatggaagcgatcacgttcagcgtgaaagtggtctctggggaatttagcgaagattctgaagtgtacaacttcaccttgcacgccggcgacgagctcaccctcatgggccaggctgagattttatgcgctaaaacaactaaggaacgaagcagattcaccacactgctgagaaaattaggaagagctggtgcactcgcaggggtgggaggcggcggacccgctagcgccggtgcagctggtggcacggggggcgggggggctcggccagtcaagggcaaaatgccatgcctgatctgtatgaaccataggacaaatgagtccctgtccctccctttccagtgtcagggccggtttagcacacgatccccactggagctccagatgcaggagggggaacacactgtccgagctatcatcgagcgtgtcaggctcccagttaatgttttggttccctcgcggcctccaaggaatccctatgacctccatcctgttagggaagggcattgctacaaactggtctcaataatttcaaagactgtggtgttggggctcgccctccgacgggagggaccagcacccctgcatttcttacttcttactgacacacccagattcgccttgcctcagggattattagcaggggacccaagggtagagagacttgtgcgagatagcgccagctactgccgggagaggtttgatccagatgaatattctactgcagtgagagaggctcccgctgaattggccgaggactgcgcatcacctaggcgcgcgcgtctctgtctccctgctcctagggcccctgggctagcaagagcccctggccccctggcccctgcccccgctggggaaggtgaccaagagtacgtgtcccccgactgggcggctgcccctgagcctgcagccccaccggcagaaatcccctacgaggaattgtgggcacaccaggggccagagggactagtcaggccacctcctggcttggatttaatctcctttggtgcagccgggccaccgcgcagagagccagaggcacccccaccaccagtccctcctaagtctgaagccgtcaaggaggagtgccggttgctgaatgccccacccgtccctccccgaggggggaacggaagcggcagactgtcctcctctccccccgtgccaccacgcttccctaaattacagccggtgcattctccctcaagctcactcagctactactcttcaggcctgcaagatggggccgggtctaggagtggttccggaagccccagtccagacacttactccttgtattgttatccatgtacatggggtgattgtaaggagccagtccttgagccttttgacccctttgaactgggccagggaagcagcccggaaccagagttgctccggagtcaggagccgcgggctgtcggaacgcccggccccgggccccgcctttcaccgctgggtccgtcaaaagcattcgaaccagaaggcctggtcctgcaccaggtgcccacacctctatcaccagctgccctccagggacccgaagccggcggggctctgtttctgacacaggggcggttggagggacctcctgcatctccaagggacggtgccacagggtttggagtccgcgacgcttcgagctggcagccccctgcggatctgtctgcgctgagcctcgaggaggtatcaaggagcctgagattcattgggctgtccgaagacgtcgtttcattctttgcgcgggaacgtattgacggttcaatctttgtgcaactgtctgaagatatccttgcggatgactttcatcttaccaaactacaggtgaaaaagatcatgcaatttatcaaaggttggaggccgaaaatttag

SEQ ID NO: 29976 - DNA, 2631 bp, Artificial Sequence
  Description of Artificial Sequence: Synthetic coding sequence
atggatcctgctcctagtttggggtgcagtttaaaagacgtgaaatggtcctcagtcgccgtcccgctcgacttgctggtttcaacataccgactaccccagattgccagactggataacggcgagtgcgtagagggcctcagagaaaatgactacctcctcatccactcgtgtagacagtggacaacgatcacggctcactcactggaagaaggacactatgtaattggacctaagattgagattccagtgcattacgcaggccagttcaagcttcttgagcaggacagggatatcaaagagccggtgcagtacttcaacagtgtggaggaggtggccaaggcgtttccagaacgggtctatgtaatggaagacattacctttaatgttaaagtcgcatcaggagaatgcaatgaagataccgaggtttataatataaccctgtgtacgggggatgagctgaccttaatgggccaggcagaaattctttacgcaaagacttttaaagagaaatcccgcctgaatacaatctttaagaagatcgggaagctcaactccatttctaagctgggcaaaggcaaaatgccatgcttgatctgtatgaaccatcgcacaaatgaaagcatttcgttgcccttccaatgtaaagggcgtttctccactaggagcccactcgagctgcaaatgcaggagggggaacacactattcgcaacatcgtcgaaaagacgcgcctgccagtcaatgtgacggtgccatccccacctccacgaaatccctacgacttgcatttcattcgggagggccacagatacaaatttgtgaatattcaaaccaaaacagtggttgtttgctgtgttctgcggaataataagatcttgcctatgcatttccctctgcacttgactgtgcctaaattctctctgccggagcaccttgtgaagggggaatcctggccagaaacactcgtacatcattggctggggatttgccaggagcagttcgatatcgatgagtatagccgggccgttcgcgatgtcaaaacggattggaatgaggagtgtaaatctcctaagaagggtcgctgtagtgggcacaaccatgtccccaacagcctgtcctatgcgcgcgacgagctgacccaaagcttccatcgtctctctgtgtgcgtctatggcaacaacctgcatggtaatagtgaagtgaacttacacggctgcagggatctcggcggtgactgggcgccctttccacacgacattctgccgtatcaggactcgggagactcagggagcgactatctttttccagaggcttccgaagagtcagctggcattcctggaaaatcagaactgccatacgaggaactgtggctggaagagggtaagccttctcaccagccacttacaaggagtttatcagagaaaaacagatgcgaccagttcagaggaagtgttcgttccaagtgcgctacatctccactcccaattccaggtactcttggcgctgccgtaaaaagctcagacaccgcactgccaccgccccctgttccacccaagtccgaggccgtgcgggaggagtgccggcttcttaacgctcccccggtgcctcctcgcagtgcaaaacccctgtcgacctcccccagtatacccccccgaaccgtgaagccagcccgacagcaaacaagatcaccatctcccacactgtcgtactactcctcgggccttcataatatctccgtcacaaagactgacactaatccaagcgagtcaacaccagtgagttgttacccatgtaacagggttaaaactgactctgtagacctcaagagcccattcggatcaccgtctgcagaggctgtctcctcaaggctctcctggcccaaccactacagtggcgcatccgagtcacagacccgaagcgactttttgctcgacccttcgcgctcatactcctatccccgacagaaaacacccggtacacccaaaagaaattgccccgcaccgttcgacttcgacggctgtgagctgctcgcatcccccaccagtcccgtgaccgcagaattttcctcatcggtgtccggttgccctaaatcagctagctactccctggagtccacagacgtcaaaagccttgctgctggggtcactaagcagtcaacctcttgccccgctttgccaccacgagctcccaaattagttgaggagaaggtcgcttcagagacctcccctctacccctgaagattgacggggccgaggaggatcccaaatctggctcacccgatctgtccgaggaccagtattttgtgaagaagggaatgcaggatatcttctccgcatcctatcccttttccagccctctccatctgcagctggccccgcgatcctgcggagacggatcaccatggcagccccccgccgacctttctggactgtccatcgaggaagtttctaaatctttgaggtttattggcttaagtgaggatgtgatttcttttttcgtcaccgagaagatcgatggaaatctactggtgcagttgaccgaggagattttatctgaagacttcaagctgtctaaattgcaggtaaagaaaatcatgcagttcatcaatggttggaggccaaaaatttag

SEQ ID NO: 29977 - DNA, 2628 bp, Artificial Sequence
  Description of Artificial Sequence: Synthetic coding sequence
atggacccggcccctagtctaggatgcagcctgaaagacgtgaagtggtccagcgtcgccgtgccactggatttactggtctccacgtatcgtctaccccaaatagctaggctggacaacggcgagtgcgtcgaaggactgcgggaaaatgactatctgctgattcactcctgccggcagtggactaccataacggcccattccctggaggaggggcactatgtgatcggcccaaaaatagagatacccgtccactacgcgggccaattcaaactgctcgaacaggacagggacatcaaggagccagtgcagtacttcaactccgtggaggaagtcgccaaagcttttccagagcgagtttatgtgatggaagacataaccttcaacgttaaggttgcatctggagagtgcaatgaggatactgaagtgtataacattacactatgtacgggagacgagcttaccctcatggggcaggcagagattctctacgcgaagacttttaaagagaagtctcgtctcaataccatttttaagaagatcggcaagttgaatagcatttctaagctgggaaaggggaagatgccttgcttaatatgcatgaaccataggactaacgagtctatttctttgccttttcagtgcaaaggcaggttttccacacgtagccccttggagctccagatgcaggagggcgagcatactattcgtaacattgtcgaaaaaacaagactcccagtcaatgttaccgtaccaagcccacctccgcggaacccttatgacctccacttcatccgggagggacaccgttacaaatttgttaacatccagaccaagacggttgttgtttgttgtgttctgagaaataacaaaatactccccatgcacttcccactgcacctgaccgtgcctaagttttctctgcccgaacacctggttaagggagagtcatggccagagacattagtacatcactggctgggcatttgtcaagagcagttcgatatcgacgagtactcacgggcagtcagagacgtgaaaacagactggaatgaggagtgtaagagccccaagaaaggccgctgctccggacacaatcacgtgcctaactctctaagctacgctcgcgacgaactgacccaaagctttcataggttgtcggtgtgcgtgtatggtaataaccttcatggcaactcagaagtcaacctacacggctgtcgcgatctcggaggagattgggcaccatttccacacgacattcttccctatcaggacagcggcgacagtgggtcagactacctttttcccgaagcaagtgaagagtccgccgggatacccggaaagtcggagctcccatatgaggagctctggcttgaggaggggaagccaagccatcaacctctcacaagaagcctgtcagagaagaaccggtgcgaccagttcagggggtcggttcgatccaaatgcgccacatccccacttcccatccctggaactctgggggccgctgtaaagagttcggatactgcattgcctcccccacccgtgcctcctaaaagcgaagctgtaagagaagagtgccggctgctgaatgccccaccagtgccgcctaggagtgccaaacctctgagcacgtctcctagtatcccaccccgcacggtcaaaccagcgaggcagcagactaggagtccaagccccaccttgtcctactattcaagtggcttgcacaatatagtgaccaaaaccgacactaatcccagcgaaagcacacccgtgagctgttacccttgtaacagagtgaagacagattcagtggaccttaaatcaccattcggaagtccctcagcggaggccgtctcgtccagacttagttggccgaaccactactccggagcatcagaaagtcaaactcgaagtgacttccttctagacccctcccgcagctacagctaccctcggcagaaaacacccggtactccgaagcggaattgcccggctccatttgacttcgacggatgtgagctgttagccagcccgacttcaccagtcactgcggagttttccagcagtgtcagtggctgccccaaatctgcgtcatacagcctggagtcaaccgatgtgaagtccttggcggctggcgtgaccaaacagtcaacgagttgccccgccctgcccccccgggctcccaaactcgttgaggaaaaggtggcaagcgagacatcaccattgcccctaaaaattgatggcgccgaggaggaccctaagtccggatcacctgatctgtccgaagaccagtatttcgttaaaaaaggaatgcaagacatattcagcgcctcctaccccttctcaagtccactacacctgcaactagcgccacgctcatgtggagacggcagtccttggcaacctcccgcagacctgagcggcctcagcatagaggaggtgtccaaatcgctgcgattcatcgggctctctgaggacgtcatctctttcttcgtgactgagaaaatcgacgggaacctgctggtgcaattgaccgaggagatcctgtctgaagactttaagttgagcaaacttcaggtgaagaaaattatgcagttcattaacggttggcgaccgaagatctag

SEQ ID NO: 29978 - DNA, 2625 bp, Artificial Sequence
  Description of Artificial Sequence: Synthetic coding sequence
atggaaaagctcgcagcgggtcttgccggtcttaggtggtccatgggggcctttccacttgatctcattgtgagcagatgtcggctgcccacgctggcttgtctgggacccggggagtatgctgagggggtgtccgaaagggacatcttgcttattcactcatgtaggcagtggactaccgtcaccgctcataccttggaagagggacattacgtgatcggtccaaaaatcgacattcctctacagtaccccgggaagtttaagctgctcgaacaggccagagacgtgcgggagccagtgagatatttctcctcagtagaagaagtagcctctgtctttccagacaggatattcgtaatggaagccattaccttttccgttaaggtcgtctctggggagtttagtgaggatagtgaagtctacaattttactctgcatgcaggagacgaacttactttgatggggcaggcggaaattctctgtgctaaaacgaccaaagaaagatcgagattcaccaccttgctcagaaagctcggaagagctggtgctctcgctggtgtcggaggtggtgggcccgctagcgctggcgctgctggcgggacaggcgggggaggtgcacgccctgtcaaaggaaagatgccttgtctgatttgtatgaaccataggacaaacgaatccctaagtcttccttttcaatgccagggccggttctcgacccgctctcctctggagttacaaatgcaggagggagagcacacagtacgcgctatcattgaaagagtacgtctccccgtaaatgtcttggtgcctagtcgcccaccgcgaaatccatacgatctgcacccagtgcgggagggtcactgttacaagctggtctccattatttctaagacagtggtgcttggtctggctcttcgaagggagggaccagctccgctgcattttctccttctgaccgacacccctcggtttgcactaccccagggcttgctggctggggatccgcgcgtggaaagattagtgcgagactcagccagttactgtcgtgagagatttgaccccgatgaatattcaactgccgtgagagaggccccagcggaactcgcagaggattgtgcctctccccggagagccaggttatgcctgccagccccgagagcacccggattggcaagagccccaggacctctagcaccagcacctgcaggggaaggcgaccaggaatacgtcagtcccgactgggctgccgcaccggagcctgcagcacctcccgccgaaataccatatgaagaactgtgggcccaccaaggcccagagggcctggttaggcctccgcccgggcttgatctgataagttttggtgccgcaggtcccccgcgcagggagccagaagctcctccccctccggtgcccccaaaatcagaagcagtaaaagaagaatgtcgcctgctgaatgcacctcctgtgccccctagggggggcaatggctcaggccgtttaagtagcagcccacccgtgccacctagatttccaaaacttcagcctgtgcactctccctcttcttccctctcttactactcaagtgggctgcaggatggcgcagggtcaagatccgggtctggatccccctctcccgacacctatagtctatactgctacccttgtacatggggcgactgtaaagtgggagagtcctcatcgaggccagcccctggaccacttccaagcacgactcaacccagtcaggccagtagggccctcaccgaacccctgagcggacgggccgcgagcctgctcggcgcagacactccagtcaagacctaccacagttgcccccctctcttcaagccctctcatcctcaaaaacgcttcgctccatttggtgctctcaatcctttcagcggacctgcctaccctagcggccccagcgccgccctctcatcagggccgagaaccacatctggcccggtagcaacgtctggccctgcatacagtccagggccagctagtccgggacaagcctatagtgccgcccccccatcgagctgtgctccatcctctagtagcagctcagagtggcaggagcctgtcctagaaccgttcgatccgttcgagctggggcagggctctagcccagagccagaacttttgagatcccaggagccccgagccgttggcacccccggaccaggcccacgcctctctcctttaggtccctccaaagcttttgagcccgaaggcctcgtgctccatcaagtgccaacacccctgagccccgcggctctgcagggacccgaggcggggggcgcccttttcctgacgcagggtcgactggagggtcctccagctagtccccgcgacggcgcaaccggcttcggggtacgcgacgccagctcatggcaaccacctgccgatctttccgctctctctctggaagaggtgtctcgttcactgaggttcattggactgtctgaagacgtggtgtcttttttcgctcgggagagaatcgacgggagtatttttgtccagctgtctgaagatatcctggctgatgatttccaccttacgaagctgcaggtgaaaaaaatcatgcagttcatcaaggggtggcgccccaaaatctag

SEQ ID NO: 29979 - DNA, 666 bp, Artificial Sequence
  Description of Artificial Sequence: Synthetic coding sequence
atgtttggcttccacaaacctaagatgtaccgatccattgagggttgttgcatctgcagggcaaagtctagttccagccgtttcacagactctaagcgctacgaaaaggatttccagtcttgctttggcttgcacgagactcgcagcggagatatctgcaatgcctgtgttctactcgttaagcgatggaagaagcttccagcgggaagcaagaaaaattggaaccacgtcgttgacgctcgagcaggacccagtctgaagaccaccctgaagcccaaaaaagtgaagaccttgagtggcaacaggatcaaaagtaaccaaattagcaagcttcagaaagagttcaaaagacacaactctgacgcccattcaactaccagctcggcctcccctgctcagtcgccatgttattctaaccagagtgatgatggcagcgataccgagatggcctcgggctctaacagaactccagtattctcatttctcgatctcacctactggaagaggcagaagatttgttgtggaatcatctacaaaggacgatttggtgaggtccttatcgacactcaccttttcaaaccctgttgttcaaacaagaaggctgcagcagaaaaacctgaggagcagggccctgagcctctccctatcagcactcaagagtggtag

SEQ ID NO: 29980 - DNA, 222 bp, Artificial Sequence
  Description of Artificial Sequence: Synthetic coding sequence
atggctagcgggagtaaccgcacccctgtattttcattccttgacctcacatattggaaacgccagaagatctgctgcgggattatctataagggcaggttcggcgaggtgctgatagatacccatttatttaaaccttgttgctccaacaaaaaagctgcagccgagaagcctgaagagcagggtccagagcccctgccaatctccacccaggaatggtag

SEQ ID NO: 29981 - DNA, 789 bp, Artificial Sequence
  Description of Artificial Sequence: Synthetic coding sequence
atgtcatacctccctactaatccacctggctctattctcgctggctctgcgtccttatctgccgtgactggtgtcccggaaggagaagctagatttacagaggattactgtcccgaagaaaagatgttcgggtttcataaacctaagatgtacaggagcatcgaggggtgctgcatctgtcgggcaaaaagctcctcgtctagattcacggactcgaagaggtacgagaaagatttccaatcatgttttggcctccacgagactcgctcaggcgatatatgcaatgcctgcgtgctgctggtgaaaaggtggaaaaaactccctgccgggtcgaagaagaactggaatcacgtagtggacgctagagctggtccgtcgctcaagactacattgaagcccaagaaggttaaaaccctgagcggaaataggattaagagcaaccaaatttcaaagctccagaaggagttcaagcgtcacaatagcgacgctcacagcacaaccagcagtgcctcaccagcacagtcgccatgttactccaatcagtcagacgatgggtcagatacagaaatggctagcggctccaaccgcacgcccgtgtttagctttttggatttaacatattggaaaagacaaaagatttgttgtggaataatctacaagggcagattcggggaggttttgatcgacacacatctcttcaagccatgttgttccaataagaaagcagccgccgagaaacctgaggaacagggccccgaaccgttgcctatatctacgcaggagtggtag

SEQ ID NO: 29982 - DNA, 666 bp, Artificial Sequence
  Description of Artificial Sequence: Synthetic coding sequence
atgtttggctttcataagccaaagatgtatcggtctatcgaagggtgttgcatttgccgcgctaaatctagctcctctcggtttactgactccaagagatatgaaaaggatttccagagctgcttcggacttcatgaaactagatcaggcgacatttgcaatgcctgtgtgctgctggtcaagagatggaagaaactccccgccggcagtaaaaagaactggaatcacgtcgtggatgctagagccggacccagcttaaagactacccttaagccgaagaaggttaagacactctcagggaatcggataaaatcaaatcaaatcagcaagctgcaaaaggaattcaaacggcataactctgacgcccactccactacgtcctcagccagtcccgctcagtcgccctgttacagcaatcagtcagacgatggctcagacaccgagatggcctcaggaagtaaccgtacgcctgttttttccttccttgatctcacctactggaaacgccagaagatctgctgtggcatcatttataaaggccgtttcggggaagtgctgatcgatacacatctgttcaaaccctgttgtagcaataagaaggctgccgccgagaaaccagaagaacagggccctgagccgttgcctatctcgacccaggagtggtag

SEQ ID NO: 29983 - DNA, 405 bp, Artificial Sequence
  Description of Artificial Sequence: Synthetic coding sequence
atgtttggattccacaaacccaaaatgtacaggtccattgagggatgctgtatatgccgagctaagagttcgtcgtctcggttcaccgatagcaagcgctatgagaaggactttcaaagctgtttcggcttgcacgagactcgcagtggggatatttgcaatgcttgcgtgttacttgtaaagcgatggaaaaagctcccagccggtagcaaaaaaaattggaaccacgttgtggacgcccgcgcaggacctagtctgaagactacactgaaacctaagaaggtaaaaaccctgagcggcaataggataaaatccaaccagatctccaagctccaaaaagagttcaagagacacaacagcgatgcccatagcacaacttcctcggcgagtccagcccagagctag

SEQ ID NO: 29984 - DNA, 384 bp, Artificial Sequence
  Description of Artificial Sequence: Synthetic coding sequence
atgtttgggtttcacaagcctaaaatgtataggtcaatagaagggtgctgtatttgtcgggcgaaatcatcatccagcaggtttaccgactctaagcgatatgagaaagacttccagtcttgttttgggctgcacgaaactagatcgggtgatatttgcaacgcctgcgtacttttggtaaagcgctggaagaagctgccagctggttctaaaaagaactggaatcacgtggtggacgctcgcgcaggcccttcactcaaaaccacactgaaacctaagaaggtgaaaacgttgtctggaaatcgtattaaatctaatcagatttctaagcttcagaaggagttcaagaggcataacagcgacgcccacagtactacttcctag

SEQ ID NO: 29985 - DNA, 984 bp, Artificial Sequence
  Description of Artificial Sequence: Synthetic coding sequence
atgaatatcctgtttctacagtggaaggtgaaattgcctccacagaaagaggtaatcacatctgatgagctgatggcgcaccttggaaactgcttactgagcattaagccccaggaaaagtctgagggcttgcagttaaatttccagcagaatgtggacgacgctatgaccgtgctgccaaaactagccaccggactggacgtgaatgtgcgctttacaggtgtttctgacttcgaatacaccccagaatgcagcgtgtttgacctgttgggtatcccgctgtatcatggctggctcgttgatcctcaaagcccggaggctgttagggctgtaggaaagttgtcgtacaatcagctggtggaacgaatcatcacctgcaagcactctagcgataccaatctcgttaccgaagggttgattgcagagcagttccttgagactaccgcagcccaactgacataccacgggctgtgtgagctgaccgcggccgctaaggaaggagaactctccgtgttcttccggaataatcatttctctaccatgaccaaacacaaatcccatttatatctactggttaccgaccagggcttcctccaagaagagcaagtggtatgggagtccctgcataatgttgacggggatagctgcttttgtgatagtgacttccacctcagtcacagcctgggcaagggtcccggagcagaaggcggctccgggtctcctgagacgcagctgcaggtagatcaagactatctgatcgcacttagcttgcagcagcagcagccgcggggacccctgggtctgaccgatctcgaattagctcaacagttacagcaggaagagtaccagcaacagcaagctgctcagcccgtcaggatgagaacccgggtcttgtctctgcagggtcgtggcgctacctccggcagaccagccggagagcggaggcagcggccgaaacacgagtcggattgtatcctactctag

SEQ ID NO: 29986 - DNA, 1554 bp, Artificial Sequence
  Description of Artificial Sequence: Synthetic coding sequence
atgttactggggcccccacccttcaatgagtcaaccaagccaagcccttcaccctgtcacagtttcgctagtcaggcatggctccggcaggttcctgaggtgtcgaagcacttgcagtgtccctctgctaaaagtctgcttactatggaatatcaccagcccgaggacccagctcctggcaaagccggcaccgcggaagccgtcataccagaaaaccatgaggtgttagctggacccgatgaacatccacaagacaccgacgcccgggatgcagatggagaagccagagagagggaacctgctgaccaggccctgctgccttctcagtgtggggacaaccttgagtcgcctctccctgaagcatcctctgcccctccaggtcccaccttaggaactctccctgaggtggagaccataagagcttgtagtatgccacaggagctgccacagtcccccaggacacggcagcccgagcccgatttttactgtgttaagtggataccttggaagggcgaacagacgcccatcattacgcagtcaaccaatggcccgtgcccactgctggctattatgaacatactgtttctgcagtggaaggtgaagcttcccccccagaaagaggtgattaccagcgatgagctcatggctcacctggggaactgccttctgtcaatcaagcctcaagaaaagtccgaaggcttgcaattgaatttccagcagaacgttgacgacgccatgaccgtccttcctaagctagccactggactcgatgtgaacgtgagatttacaggcgtgtccgattttgagtacacacctgagtgctccgtgttcgatcttctaggcatcccactgtaccacggatggttggttgatcctcaaagtccagaggcggtccgggccgtgggaaaactgtcctacaaccagctggtggagagaattatcacgtgtaaacactcatctgacacgaacctggtgacagagggcctcatagccgaacagttcttggagactaccgctgcacagctgacgtaccatggattatgtgaattaactgcagcagccaaggaaggtgagctgtctgtgttctttagaaacaatcacttttctacgatgacgaagcataagagccatctctacctgctcgtgactgatcagggtttcctgcaggaagagcaggtggtgtgggaatctctgcacaacgttgatggcgattcctgtttctgcgactccgattttcacctgtctcactccctgggaaaaggacctggcgccgaaggcggctccggctcacccgaaacccaactccaagttgatcaggactatttgattgcactgtccctccagcagcagcaaccaaggggaccactgggcctcaccgacctggagctggcccaacagctgcagcaagaagaataccaacagcagcaggcagcccagcccgtgagaatgcggacacgcgtattgagcctgcagggccggggtgctaccagcggacgacctgctggggaaaggcgccagcgacctaaacacgaaagcgattgcattttgctgtag

SEQ ID NO: 29987 - DNA, 1410 bp, Artificial Sequence
  Description of Artificial Sequence: Synthetic coding sequence
atggaatatcaccaaccggaggaccctgcaccaggcaaggccgggaccgccgaggcggtgatccctgagaatcatgaggtcctcgccgggcccgacgagcatccacaagataccgacgctagagacgctgatggagaagctagggaacgcgaaccagccgatcaagcattgctgccaagtcagtgtggtgataatctagaatcccctctcccagaagcctcatccgcacccccgggaccaaccctcggtaccctgcccgaagtagagacaatccgggcgtgttcgatgccacaggaactaccacagtcaccccgcactaggcagcccgaacccgatttctactgtgtgaaatggatcccctggaagggtgaacagactccaatcattactcagagcaccaacggaccctgtccgctgctggccatcatgaacattctattcctccagtggaaggtgaagctccctccgcagaaagaggtgatcacatccgacgagctgatggcgcacctgggcaattgtttactctccattaagccccaggagaagtctgaaggcttgcagctgaatttccagcaaaatgtggatgacgccatgacagtgttacctaagctggcgacaggactggacgtgaatgtaagatttacgggcgtgtcagatttcgaatatacacctgaatgcagtgtattcgatcttctcggaataccactgtaccacggctggctggtcgatccacagtctccagaggccgtgcgggccgtcgggaaactttcgtacaatcagctagtggaacgaataataacctgcaagcattcctctgacaccaatctcgtcactgaagggctaatcgccgaacaattcctcgaaaccacagctgcacagttaacataccacgggctgtgcgagttgacagcagccgcgaaagaaggcgaactgtctgtcttctttaggaacaatcattttagcactatgaccaagcataagagccatctgtacttgctcgtgactgaccagggctttctccaagaggaacaggtagtgtgggaatcgctccataacgtggacggtgacagttgcttctgtgactctgacttccacttatcccactccttgggtaaagggcccggcgccgaaggcgggtcaggtagccccgaaacacagctgcaggtagaccaggattatctgatcgctctatctcttcagcaacagcaaccaaggggtcccctcgggttgactgatctggagctggctcagcagctgcagcaggaggagtatcaacagcagcaggcggcacagcccgtgcggatgagaacgagagtgctctccctgcaaggccgaggcgccacctctggaagaccagccggcgaaaggcgccagcgacctaagcacgagtccgattgcatcttgttatag

SEQ ID NO: 29988 - DNA, 1125 bp, Artificial Sequence
  Description of Artificial Sequence: Synthetic coding sequence
atgccccaggaattacctcagagtccacggacacgccagcctgaaccagacttctattgcgtcaagtggataccctggaagggcgaacagacaccgatcatcactcaatccacaaacggtccctgccctttgcttgctattatgaacattctcttcctccaatggaaagtcaaacttcctcctcagaaagaagtgattaccagcgatgagctcatggcacacctggggaattgccttctgtcaataaaaccacaggaaaagtctgagggcctgcaactgaacttccaacagaacgtggatgacgctatgactgtgctcccaaaacttgccactgggttagatgtgaacgtcagattcacgggagtgtccgactttgaatacacgcctgagtgctccgtcttcgatctattgggcatcccgctgtatcacggctggttggtggatccacagtcaccggaggcagtcagagccgtgggaaagctctcatataaccagctggtggagcggattatcacctgtaaacactcatctgacacaaatctggtcacagagggcctgatcgccgaacaattcctggagactacagctgcccaattgacctaccacgggttgtgtgaactgactgccgccgctaaagagggcgagctgtcagttttttttagaaacaaccacttctcaaccatgacaaaacacaaaagtcatttgtacctcctggtgactgatcagggtttcctccaagaagaacaagtggtgtgggaatctctgcacaatgtggacggggactcatgcttctgcgactcagacttccacctttctcattctctgggcaaagggccgggggccgagggcggctcaggcagccctgaaacccagctgcaggtggatcaggattatctcattgctctgagtctgcagcagcagcagccaagaggtccacttggtctcactgacttggagctggcacagcagctgcaacaggaggagtaccagcagcagcaggccgcacagccagtgcgaatgagaaccagagtgctgtcgctgcaggggaggggagcaacgtcaggccgacctgccggtgaaagacggcagcgaccaaaacatgaatccgactgtatcttgctgtag

SEQ ID NO: 29989 - DNA, 1863 bp, Artificial Sequence
  Description of Artificial Sequence: Synthetic coding sequence
atggaatcatctccggaaagtctgcagcctctcgagcacggggtcgccgcgggccccgcctccggtacagggagcagccaggaaggcctgcaagagacgcgcctggcagcaggggacgggccaggagtttgggccgcagagacatccgggggtaatggccttggggctgccgccgccaggcgcagtctaccggattcggcgtcgcccgccgggagcccagaggttccgggcccctgctcgtccagcgcagggttggatctgaaggattctggcctcgagtcacccgccgccgcagaagcacccctaaggggacagtacaaggtcactgctagccctgagaccgcggtggctggggtgggtcatgaacttggaaccgcaggtgatgccggcgccaggccggatctggccggcacatgccaagcagagctgacagccgccggctcagaggaaccgtcttcagctggcggcctctcgtcttcctgctcggatccatcaccgcctggcgaatcaccttctctcgatagcctcgaatctttttcaaacctacactcattccccagcagttgtgaatttaattccgaggaaggtgccgaaaacagggtccccgaggaggaagaaggcgccgcagtgttgccaggtgctgtcccgctgtgtaaggaggaagaaggggaagagacggcccaggtgctcgctgcaagcaaggaacgatttccagggcagtctgtctatcacatcaagtggatccagtggaaggaagagaacaccccaataattacccaaaacgagaacggtccttgtccactactggccatcctgaatgtgctcctgctggcatggaaagtcaagttgcctcccatgatggagatcatcaccgcggagcaactcatggaatacctcggggattatatgttagatgcaaagcccaaggaaattagtgagatccagaggctcaactacgagcagaacatgagtgatgctatggctattctacacaaactgcagaccggccttgatgtgaatgtgaggtttacaggagtgagagtgtttgaatacactcctgagtgcattgtattcgacctgttggacatccccctgtatcacggatggctggtggacccccagatcgatgatattgtgaaagccgtcggcaattgttcgtataaccagctggttgagaaaatcatctcgtgcaaacagagtgacaactccgagcttgtcagtgaaggattcgtcgcagagcagttcctaaacaataccgccacccagttgacataccacggcctctgtgagctaacgagcacagtgcaggagggggagctgtgcgtgttcttccgtaataatcactttagtacaatgaccaagtacaaggggcagctgtacctgcttgtaacagaccaaggctttctgaccgaggaaaaagttgtctgggaatctttacataacgtcgatggcgacgggaatttctgcgacagcgagtttcatttaaggccacctagtgacccggagacagtctacaagggccagcaggaccagatcgatcaggattacttgatggccttgtccctccagcaggaacagcagtctcaggagatcaattgggagcagataccagagggcatcagcgacctcgagttagccaagaaactgcaggaggaagaggatcggcgtgccagccaatactatcaagagcaggagcaggcggccgcggcagcagcagccgctagtacccaggcccagggccagcccgcccaggcaagcccatccagtggacgacaatctgggaatagtgagagaaagcgcaaagagccaagggagaaagacaaggaaaaggagaaagagaaaaacagttgcgtgatactgtag

SEQ ID NO: 29990 - DNA, 1866 bp, Artificial Sequence
  Description of Artificial Sequence: Synthetic coding sequence
atggaaagcagcccagaatccctgcagccactggagcatggcgtggccgcgggccctgcaagcggaaccggtagcagtcaagagggcctgcaggagacccgcctcgccgctggagatggacctggcgtgtgggccgcagaaacatccggtggtaacggactgggcgccgctgctgctaggagatctctcccggatagtgcaagccccgccggttctccggaggtgcccgggccttgttcctcctcagctgggctggatctgaaggacagcggactggagtccccagctgcagcggaggcacctctccgtgggcagtacaaggtgaccgcttcacctgaaaccgccgtggccggggtgggtcacgaactcgggaccgctggtgacgccggagcgaggccggatctagcgggtacttgccaagccgagcttaccgccgcggggtccgaggagccaagcagcgctggtggactgagcagttcgtgttcggatccctctcctccaggcgagagccccagcctcgacagtctcgagtcattttccaatcttcactctttccccagctcgtgtgaatttaacagcgaggagggagctgaaaaccgagtgcctgaagaggaagaaggagctgctgtgcttccaggcgccgtgccgttgtgcaaggaagaagagggtgaggaaacagctcaggtcctcgctgcttccaaggaacgcttccctggccagagtgtttaccatataaaatggattcaatggaaggaggagaatacacctattatcacccaaaacgaaaacggcccctgtccccttctggcaatcctgaacgtgctgctgttggcctggaaggttaagctaccaccgatgatggaaataataacggcagaacagctcatggaatacctcggggactatatgctggatgccaagcctaaagagatctccgagattcagaggctcaattacgaacagaacatgtccgatgctatggctatcctccacaaactgcagaccgggctggatgtgaacgttaggtttaccggagtcagagtgttcgagtatacgcccgagtgcatagtatttgatttgctggacattcctctgtatcacggttggctcgtcgatcctcagatcgacgacatcgtgaaagctgtggggaactgttcatacaatcagctggtggagaagatcatctcatgtaagcagtccgacaacagtgaattggtctcggagggcttcgtggctgagcagttcctaaacaatacggccactcagctgacatatcacggactgtgcgaactcacatcaaccgtgcaagaaggggagctttgtgtctttttcaggaacaatcacttctcaactatgaccaagtacaagggccagctgtacctgctcgtcaccgatcaggggttcctgaccgaggagaaggtggtttgggagtcattgcacaacgttgatggtgatggcaacttttgcgacagcgagtttcatctacggccaccttccgaccccgagactgtctataaaggtcagcaagaccagatcgaccaggactatctgatggccttgagcctacagcaagagcagcaaagccaggaaatcaactgggaacaaatccctgaggggatcagtgacctggagcttgccaaaaaactgcaagaggaggaagatcgccgcgctagtcagtactaccaggaacaggagcaagccgccgccgcagccgccgccgccagtacccaggcacagcaaggacagcccgcccaggccagcccaagttccggaaggcagagtggcaacagtgaaagaaagcgtaaggaacctagggaaaaagacaaggaaaaggaaaaggaaaagaacagttgtgtcatattgtag

SEQ ID NO: 29991 - DNA, 2841 bp, Artificial Sequence
  Description of Artificial Sequence: Synthetic coding sequence
atgagcgtaagactcaggttcttatcccccggcgacacaggtgctgtgggcgtagttggtcgaagcgctagtttcgcagggtttagctctgcacagtccagaaggattgctaaatcaatcaacagaaacagcgtacggtcaagaatgccagccaagtcaagtaaaatgtatggcactttgcgtaaaggatccgtttgcgctgaccctaagccacagcaagtcaaaaaaatctttgaggcattaaagcgcggacttaaggagtatctttgcgtgcaacaggcagagctggatcacctgagcgggagacataaggacaccagacggaatagccggctggctttctactatgatctggataagcagactagatgtgtggaaagacacatccgcaaaatggagttccacattagtaaggtggacgagctgtacgaagattactgcattcagtgtagactacgggacggagcctccagcatgcagagagcgtttgctaggtgtccgccaagccgagccgccagggagtctctgcaggagctgggtcgatcactccacgagtgtgccgaggacatgtggctgatcgaaggagccctcgaggtgcacctgggagagttccacatccggatgaaaggcctggttggctacgcccggttgtgccccggtgatcattacgaggttctcatgcgcctcggcagacagcggtggaagcttaagggtcgaatcgaaagcgacgactcacagacttgggacgaagaagaaaaggccttcatccccacgctgcacgagaatctggacataaaagttacggaacttcgcgggctcggcagtcttgctgtcggagccgtcacatgtgacatcgccgacttttttacaacccggcctcaggtcattgtggtggatatcaccgaactgggaacaattaaattacagctggaggtgcagtggaatccattcgatacagagtcattccttgtaagtccaagcccaaccggcaagttctccatgggcagcagaaaaggatctttgtataattggaccccaccatctaccccttcattcagagagagatactacttgtctgtcctgcagcagccgacacagcaggcactcctgctgggtggcccaagggctactagcatcttgtcatatctttcagactctgacttgcgcggaccaagcctcagaagtcaaagtcaggagctccccgaaatggactctttctcctcagaggatccccgtgacaccgaaacaagcacaagcgccagcacttctgatgtcggttttctgccattaacgttcggaccacacgcaagcattgaggaagaagctagggaggatccgttgccacccgggttgttgcccgaaatggcacacctgtcaggcgggccttttgcagagcagccgggctggagaaatttgggaggcgaaagcccaagcctccctcagggcagcctatttcatagcgggactgcttcttcctcccaaaacggccatgaagaaggcgccacgggtgaccgggaagacggacccggcgtggcgctggaaggtccccttcaggaggtacttgagctgttgaggcctactgatagtactcagcctcagttacgagagctggagtatcaggtactgggcttccgcgatcggttgaaaccctgccgcgcccggcaggagcacactagtgcagagtcccttatggaatgtattctggaatctttcgcttttctgaacgcagatttcgctctggatgaactctccctcttcggagggtctcagggactgcggaaagacaggccattgcctccaccgagctcgcttaaagcttcctctcgtgagttaaccgcgggagctccagaactcgacgttttgctgatggttcatctgcaggtttgcaaggccttactacaaaaactggcatctcctaacctgagtcgacttgtccaagaatgtctcctcgaagaagtagcacagcagaagcatgtactggaaaccctgtctgttctcgacttcgagaaggttgggaaagcaacatccattgaagagataataccccaggcttcgaggacgaagggttgtcttaagctatggagaggttgcaccggaccggggcgtgtcctcagctgccctgccaccacactgctgaaccagctgaagaagacattccaacatcgggttaggggtaaatacccaggccagttggaaatcgcttgccggaggctgctggaacaggtcgtctcctgtggtggtctgctgccgggtgccggtctgccagaggagcagatcatcacttggttccagttccactcataccttcagcgccagtccgtgtccgacctggagaaacatttcactcagctcaccaaagaggtgacgctgatagaggaactgcactgcgcaggacaggctaaggtcgtgagaaagctccagggaaagaggctcgggcagctgcaacctcttccccaaactctgagggcctgggccctgttgcaactcgacgggactcccagggtgtgcagggcagccagcgctcgcctggccggtgctgttcgaaatcggtccttcagggaaaaagcccttctgttctacaccaatgccctcgctgagaacgacgccagattgcagcaggcggcttgcctcgccttgaaacatctcaaggggattgagtcaattgatcagaccgcgtctctgtgtcagagtgacctggaagccgtacgggcagctgccagggaaacaaccctgagttttggagagaaagggcgtctggcattcgaaaagatggacaagctgtgtagcgagcaacgagaggtcttttgccaggaagcagatgtggagatcacgattttttag

SEQ ID NO: 29992 - DNA, 2841 bp, Artificial Sequence
  Description of Artificial Sequence: Synthetic coding sequence
atgagcgttcgcctgagatttctgtcacctggagacaccggggcagtgggagtggtgggcagatctgcttcatttgctggctttagctccgcccaaagcaggagaatcgccaaatcgatcaaccgtaatagtgtgaggtccagaatgcctgccaagagctctaaaatgtacggtacactgagaaaaggtagtgtatgcgcagatccgaaaccccagcaggtgaagaagatctttgaagcccttaaacgtggcctcaaagaatatctttgcgtccagcaagcggagctggatcatctctccggccgtcacaaggacacacgaaggaattcaagattggcattttactacgacctagacaaacaaacccgatgcgtggagagacacattcggaagatggaattccacatctccaaagtagacgagctatatgaggattattgcatccagtgtaggctgcgcgacggcgcaagcagcatgcagagagcattcgctagatgccccccatctcgggccgcaagggagtctttacaggagctggggaggagtttgcacgaatgcgcagaggatatgtggctgatcgagggggcgctcgaggttcatctgggtgagttccacattagaatgaaaggcctggtcggctacgctagactgtgccccggagaccactatgaagtgctgatgcgtctggggcggcaacgctggaagctgaagggacggattgaatcggacgacagccagacgtgggacgaagaagagaaggccttcatcccgacactgcatgaaaacctcgatattaaggtcactgaactgagaggactgggctcactcgccgttggagccgtgacctgtgacattgcggattttttcaccacacgaccgcaggtaatcgtggtagacattactgagttagggaccatcaagctgcagctcgaggtgcagtggaaccccttcgatacagaatcgttcctggttagcccctcgcctactgggaagtttagcatggggtctcgtaagggctccctctacaattggaccccgccaagtactccgtcattcagggaacggtattatctgtcagtgctgcagcagcccacacagcaggcactgctgctcggaggccctcgcgccacatcaatactgtcgtacctgtccgattccgacctgagaggcccatcgcttagatctcagtctcaggaattgccagagatggacagcttttcctccgaagaccctagggataccgaaacctccacgtcggcttctacgtccgatgtgggattccttcccttaacatttgggccccacgcgtcaattgaggaggaggcacgtgaggatcccctccctcctggattgctcccagaaatggcccatcttagtggtgggccctttgccgaacaaccggggtggagaaacctgggtggggagagcccctctttgccgcaaggatccctgttccattcaggaacagcttcaagcagtcagaacggccatgaagagggagccactggcgaccgagaggacgggccaggcgtggctttggaaggaccccttcaggaggtgctcgaactgttgcgaccaacggatagcactcaaccccagctgagggaacttgaataccaggtactgggcttcagagatagacttaagccctgccgagctagacaggaacacacctccgccgaatcgctcatggagtgcattctggagtcctttgcttttctgaacgccgacttcgcactggatgagttgagtcttttcggaggaagtcagggcctcagaaaagatcgcccccttcctcctccctcttcgctgaaagcaagtagtcgggagctcaccgctggcgcacccgagctggatgtcctgttgatggtgcatctgcaggtgtgtaaggcactgctgcagaagctggctagtcccaacctatcacgcttggtgcaggagtgtctgctggaggaggtggcccaacagaagcacgtgctggagaccctgtctgtgctggattttgaaaaggttggtaaggccacttctattgaagagataatcccacaggcctcccggacaaagggctgcttgaaattgtggcgaggctgtaccggcccaggacgggtgctgagttgccccgctactacactgttgaatcaacttaaaaagacctttcagcacagagtgcgaggcaagtacccgggacaattggaaatcgcctgtcgcaggctcctggaacaggttgtgagttgcggtggcttgctgcccggggcaggactaccagaagaacagattatcacttggttccagttccattcatatctccagcgacagagcgtgagcgacttggaaaaacactttacgcagttgacaaaggaagtaaccctgattgaagagttacactgtgccgggcaggcgaaagtcgttagaaagctccagggcaagaggctcggccaactccagcctctcccacagactttaagagcgtgggccctgttacagctggacggaacccccagggtctgccgggccgcttcagcccgactggctggtgcagttcgcaacaggtcatttagagaaaaagcactgctgttctacaccaatgccctggcagaaaacgatgccagactacagcaggctgcctgtttagccttgaagcatctgaaaggaattgaatcaatcgaccaaacggcttccctctgccagtccgaccttgaagccgtccgtgccgctgctcgcgagaccacgcttagtttcggtgagaagggccggctcgcattcgagaagatggacaaactgtgtagtgaacagcgagaagtcttttgtcaagaggccgacgtagagattaccattttctag

SEQ ID NO: 29993 - DNA, 2853 bp, Artificial Sequence
  Description of Artificial Sequence: Synthetic coding sequence
atggtcactacgatgtccgtgcggctccgcttcctgtcacctggcgacactggcgcagtgggggttgtcggccggtctgcttcattcgctgggttcagcagtgctcaaagtcgtcgtatcgcaaagtccataaaccggaattccgtgcggtctagaatgcctgccaagagttccaaaatgtatgggaccctgagaaagggctctgtatgcgcagaccccaagccccaacaggtgaagaagatatttgaagcactcaaaagaggtctgaaggagtacctctgcgtgcaacaggccgagctagaccaccttagcggaaggcacaaagatacccgcaggaactctcgtctggccttctattacgaccttgataaacaaactcgctgtgttgaaagacatatccggaaaatggaatttcacatttctaaagtcgatgagctgtatgaagactactgtatccagtgtcgcctgagagacggcgcaagctccatgcaaagagcatttgcccggtgccctcctagccgggctgcaagggagtctctgcaggagcttggcagaagccttcatgaatgcgctgaagacatgtggctgatcgagggagctctggaagtgcatctgggagagtttcacatccgcatgaaagggctggtcggttacgctcgcctctgcccaggggaccactacgaagtgctgatgcgcttagggaggcagaggtggaaactcaagggccgaatcgaatcagacgactcacagacatgggacgaggaggaaaaagcgttcatcccaacgttgcacgagaatctggacattaaagtcactgagctgagggggctcggctccctggcagtgggcgccgtcacttgcgatattgccgacttctttaccacacgcccccaggtaatcgtcgttgacattacagagctcggcaccattaagcttcaactcgaggtgcagtggaatccattcgataccgagtcgtttctagtatctccaagtcctactggtaagttctcaatgggcagtcggaaaggctccctgtataattggacacctccgtccaccccatcttttcgcgagaggtactacttatctgtcctccagcagccaactcaacaggccttgttgctgggcgggcctcgggctacttcaatactctcctacctctcggatagcgatttgagaggaccatcactccggagccaaagccaggaacttccggaaatggattctttcagctcagaggaccctcgcgacacagagacatccacaagcgccagcacgagtgatgtgggcttcctgcccctcacctttgggccgcacgcatccattgaggaagaggcacgcgaggaccctctgccgcctggtttgttgcctgagatggcacatcttagcggaggccctttcgcagagcagcctggttggaggaatctgggaggagagagcccttctcttcctcaggggtctctgttccattccggtacggcatccagcagccagaatggacacgaagaaggcgcgaccggggatcgcgaagatgggccgggggtggcacttgaagggccgttgcaggaggtgttggagcttttgcgacctacagacagcacccagcctcagttaagggagttagagtatcaggtcttggggtttcgggatcgactcaaaccttgcagggctcggcaagagcacacatccgcggagtccctgatggaatgtattctagaaagctttgcttttctgaacgctgatttcgccctcgacgagctgtcattgttcgggggttcccagggtctgagaaaagaccgccccctgcccccaccgtccagcttgaaggcttctagccgcgagctgactgcaggggcccccgaactcgatgtgcttctaatggtacacctgcaagtgtgcaaagccctcctccaaaaacttgcatccccaaatctgagtcggttggtgcaggaatgcttgcttgaagaagtggcacagcagaaacacgtgctagaaactctgagtgtactcgactttgaaaaagtgggcaaggccacaagcatagaggagattattcctcaagcgtcaaggaccaagggctgcttgaaactgtggagaggttgcaccggacccgggcgtgtgctgtcatgcccagccacgaccctgctcaatcagcttaaaaagacattccaacacagagtccggggaaagtatccaggtcagctggagatcgcctgcaggcgcctgttagaacaggttgtctcttgtggcgggctgcttcctggtgctggcttgcccgaggagcagataataacgtggttccagttccattcttacctgcagcggcagtctgtttcagacctcgaaaaacatttcacccagctaacaaaagaagttaccctgattgaggaacttcactgcgccggccaggcaaaggtggttaggaaactacaggggaaaaggctgggccagttacaacccttgcctcagaccttgcgcgcttgggccctgctccagctggacggaacacctcgcgtctgtcgcgctgcgagtgcacgcctagccggcgctgtgaggaatcgatcatttagagaaaaagctttacttttttacactaacgcattggcagagaatgatgcccgtcttcagcaagccgcgtgccttgccctcaagcatttaaaaggcattgaatctatcgaccaaacagccagtctgtgtcagtcagacctggaggcagttcgggccgccgctcgcgagaccaccctgagcttcggagaaaagggacggctggccttcgaaaagatggataagctgtgtagtgagcagagggaagtgttttgtcaggaagccgatgtggagataacgatcttctag

SEQ ID NO: 29994 - DNA, 1269 bp, Artificial Sequence
  Description of Artificial Sequence: Synthetic coding sequence
atgaagaaaaatacttccaaaacaacaatgcggatcaataagcaagacgccttgtgcaccccacactcccacgatccacgtgacctgcagaatatgctggatggcggggagtacgccccctttgtgagtccgccaatgttagagtctaattttattcaggtcaaccgaagaggtgagtccatttacctgcataacagggcaaactgggtcacagtcggcatttgctttagcagcagtacacacaaaatcccaaatgtgatgctgctagctcacttgacgcccggcgcacaaaaggatacagagaccctcttcaagagcttacttacatctccccccgctgagaagctggtgctcaccagattcttgccgctgcagtttgtgacgctctcagtgcacgacgccgaaaacatgtctttaaaggtgaagctagtaagcggccgcgcgtattacctacagttgtgtacttccgcctacaagcaggatacattatttagtcagtgggtggcgctcatttccctgcttaatcaggaaaaagcaaaagtctccaaagtgagcgaagtgagcagcttgagcggaatcacaaattccacggatataaccggcagcatggacgttaccgacgttactacctttacggctattctgacgccatatatgtacgcgggaacgggtcccgaacatgtgcgggacagcattgactttcccgaattcacagacataacagacattaccgacgtgactgatcttccagaaaatgaggttccagaggtgcctgatgtccgaatagtgaccgaagtgattgaggtgagggaggccactgaagttacagatagcagtgacataacaaattgttcaggcgtgaccgtggtcttcgagaataatgatctcatcagagcaaaacaggaggagaaagagaaattgaaaaatattctcaagcctgggtgtctgcaggacacaaaatccaagtccgaactcaaggagagttcaaaacatgtcacaatctcaaacattactctgactttcgaggggaaaaggtactttcagacgactctgacgcccgttgagtcagaggccaacacaagcaaagaaatgaaggataaaactagtgaggaaaaaatgcctgattttcagagcactgctttgaaggccgaagaaagccgctccctgagaacggaatctaatacatccgtcctgagcccccatattaagtcaccatctaactttctgaaactggtcccgcatttgtccgccccatttagccgggagtag

SEQ ID NO: 29995 - DNA, 1785 bp, Artificial Sequence
  Description of Artificial Sequence: Synthetic coding sequence
atgaatgcggatttcctgctcccctattacactgcgcagagtgggtcctcaatgtcgatgttcaacaccacgatggggaagctgcagagacagctgtataagggcgagtacgacatcttcaaatacgccccgatcttcgagtcggatttcatccagatcaccaagcggggcgaagtcatcgacgtgcacaatagagtgaggatggtgaccatgggcatcgcaagaacctcaccaatcctgcctctcccagacgttatgctgctcgccagacccgcgacaggatgtgaggaatacgctgggcacggacaggcgaccaagcggaagaaacgtaaggcagctaagaacctcgaactaacgcggctgctgcctttgcgctttgttcgcatcagtgtgcaggatcacgagaaacagcaactgaggctgaagtttgccactggacgatcctgctaccttcagttgtgccccgccctggacacccgcgacgatctgtttgcctactgggaaaagttgatttacctactgcgaccccccatggaatcaaacagtagcacgtgtggcattcccgccgaggacatgatgtggatgcccgtcttccaagaggatcgccggtccctcggtgccgtgaatctacaggggaaaggagaccaggaccaggtgtcgatacagtcacttcacatggtcagtgaagtctgcggcgcaacctcggccgcctatgcaggcggggaaggactgcagaacgacttcaacaagccaaccaatgttctcaacgcatcaatcccaaagacctccaccgaactggctgaggagccagccacaggcggaattaaggaagccgcagcggcaggcgctgcggctggggccgcaaccggaacagtggcgggagcccttagtgtcgcagcagctaattcagcgccggggcaggtgtctgccgctatcgctggcgcagccacaatcggcgcaggggggaataaaggtaacatggcccttgccggcacagcttctatggccccaaacagcacgaaggtggccgtggctggagctgctggaaagagttccgaacatgtcagttccgcgtccatgtccctgagccgggaaggctctgtgtccctggcaatcgccggggtggtgctcacctcaaggaccgctgccgaagccgatatggatgcagccgcaggaccgccagtttccacacggcagagtaaatccagtttatctggccagcacggacgtgagagaactcaggcttctgcagagggatgcaaggaggggcgggaacgcagggagaaggatagagccttaggtcgctccagccatcggcggaggactggagagtctcgccacaaaaccagaggcgataagattgcccagaagtcaagttccagaagctcctttagccatcgtgccaatcgagatgataagaaagagaaggggtgtgggaaccctggaagttcccggcacagagactcccataaaggagtttctcacacccccatctcgaaggagtcacgaacttcgcataagagcgggcgaagcctgtggaccacatccagcggtagcagtaagggccttgggcgcgtctcttcctttctgcggaacgtccgggcgaacctgaccacgaaggtggtcggaacaccacacgggagggatgtgaatgtgatggcaaaaatggctgagagatccaccaacgtggctatcgctgagactgcagagggtggccagggcctcgaaaccgtgggttccatgacgcccgatattatggagacggtaacattcgaagctcactag

SEQ ID NO: 29996 - DNA, 1110 bp, Artificial Sequence
  Description of Artificial Sequence: Synthetic coding sequence
atggtatcagaagtttgcggagcaacatctgcagcgtacgcgggcggtgaggggcttcaaaacgacttcaacaaacctaccaatgtcctaaatgcttccattccaaagacatccacagaactagctgaagagcccgccaccggcgggattaaagaagccgcagccgccggggcagctgccggcgcagccacaggcactgtcgctggagccctttccgtggctgcagcgaacagtgcccctggccaggttagcgctgcgatcgcaggagctgcaaccattggtgcgggcggcaacaaggggaatatggcactagcgggaacagcttctatggcgcctaactctactaaggtggccgtcgctggcgccgcaggcaaaagcagcgagcacgtgtctagtgcctctatgtctctgtctagagagggttccgtctctcttgccatcgccggcgtcgtcctaactagccggaccgccgcagaggcggatatggatgcggcagcaggcccgccagtgtcaacgcgacagagtaagtcgtcactcagcgggcagcatggtcgcgaacgcactcaagcgtcggccgaaggctgtaaggaaggcagggaacggagggaaaaggatcgggccttaggcagatcaagtcacagacggcggacaggagagtcaagacacaaaacacgtggagacaaaatcgcacagaaatcgtcaagccggagcagcttcagccaccgcgcgaaccgggacgataagaaagagaaaggttgcggaaatccaggtagttcccgtcatcgcgattcacacaagggggtgtctcatacccctatctcaaaggagagcagaacaagtcacaagtcgggccgtagcttatggacaacctccagtggcagcagcaagggtctgggaagagtttcctcattcctgaggaacgtccgggccaaccttacaactaaggtcgttgggaccccacatggtcgagacgtgaatgtgatggcaaagatggccgagcggtccaccaatgtcgctatcgccgagaccgcggaggggggacagggtttggaaacagtcggaagcatgacacccgacattatggaaaccgtaacgtttgaggcccattag

SEQ ID NO: 29997 - DNA, 726 bp, Artificial Sequence
  Description of Artificial Sequence: Synthetic coding sequence
atggaagattgttgcatgctgccctactacacggcgcagtcttcacctgcaatgggtatgtttaatactagcatggggaagcttcagaggcagctgtacaaaggcgagtatactatatttcgctacgcgccgatgttcgaaagcgactttattcagatcagtaagcgcggcgaagtaattgacgtacataatcgggcccgtatggtgaccatgggcatagttaggactagcccttgcttgaccttgcccgatgtcatgctgctggccaggccggccgccgtctgcgacaacgcccggtgtggccctgccacccaaaagagagagtccccccccgcagagattcttgagctgactcgcctattgccactcatgtttgtgaagattactatccataactctgtgaaaaagcagctgcacctgaaactggccactggcaggtccttctatctgcaactgtgtccacctagtgacgcatctgaggatctgtttgtccactgggagaacctcgtgtacattttgcgcccccccgtggaagcttacagtgacactagggccattctcgcagggaatacccttgattcgtccgtgctggaagaggtccaacgcagtcctgtgggctacgccatgaagttctgtgaagaaaaagagcaatttaggatatctcgactacacatgaatgccgagatgttcgggagcacctactgcgattacacgatagagatctag

SEQ ID NO: 29998 - DNA, 696 bp, Artificial Sequence
  Description of Artificial Sequence: Synthetic coding sequence
atgggacccccactttggcccgacctgcaggagcctcctcctcctgggacaagcagccagattcggagccccctgttgtgcgacgtgataaaacctgccccccatcacgatgtcaccgtaagagttgtgccgccccctaggttcctaccactgctactgagacctctgccctctgatggagatatcgccatgcgtagggacaggggaccaaagcctgcacttggtggggcgggcgaggtggagcctggcgggatggccgcctcccctacaggacgaccgaggcggctccagcgttacctgcagagcggggaattcgaccaatttagggattttcccatcttcgaatctaactttgtgcaagttacacggctcggcgaagtagccaacgaagtgactatgggtgtcgctgcaagttcgccagcactcgaattaccggacctccttctcctagctggaccggccaaagaaaacggacatctgcagctattcggcttatttccactcaagttcgtgcaactgttcgtacatgataagtctagatgccagctcgaggtaaagctgaacacctccaggacattctatctccagctccgggccccattgaaaacccgcgatagggagtttggtcagtgggtgaggcttctgtacagattacgatttctctccgcatctgccgtcccatttactcaggagtag

SEQ ID NO: 29999 - DNA, 744 bp, Artificial Sequence
  Description of Artificial Sequence: Synthetic coding sequence
atggggccccctttatggcccgatctccaggagcctcctccacctgggacttcctcacaaatacggagccctctgctttgtgacgtaattaagccagcaccacaccatgatgtgacagtacgggtggtgcccccccctagattcctaccgctcctgctccgacctctgcccagcgatggtgacattgccatgcggcgagacagaggccctaaaccagccctcggcggtgccggtgaagtagagcccggcgggatggccgcaagccccacggggcgtcccagaaggcttcagaggtatctccagagtggtgaattcgaccaattccgcgacttcccaattttcgaatcaaacttcgtgcagttctgcccagatatttatcccgctccgaccagcgacctgtggccccaggttacacgactgggcgaggttgcaaacgaggtgaccatgggcgttgcagcaagctctcccgctcttgaactaccagatctgcttctgttggcgggcccagcaaaggagaacgggcacctgcaactttttggcttatttcctcttaagttcgttcaactttttgtacatgacaagtctcggtgtcagttagaggtgaagctcaatacttccaggaccttctacctgcaactcagggctcctctaaagactcgggacagagagttcggacaatgggtcagactcctgtacaggctgcggttcctcagcgctagtgcagtcccttttacccaagaatag

SEQ ID NO: 30000 - DNA, 2769 bp, Artificial Sequence
  Description of Artificial Sequence: Synthetic coding sequence
atgatctggctgcgtaataggcggtgcctagagcccttgcaggggacacccaaatgggtgccggtcctcggcgaactccagaagacgctacagaaaggggaatacctgccactgcgcccccttccgatgttcgagtccaatttcgtgcaagttacccaccagggagggcccgtgtttgttaaccatcgaaccaatcggctagcgatgggcgtggccgcctcgttacccggcttggttcttccagacatcctcctgatcggacagcctgctgaggatagggactgctccggcttggtgttgactcgcatgatacctctcgacctggtccatctctgtgtgcacgatcttagcgcatggcgactgaaactacgactggtctctggccggcaatactacttggctctggatgcccctgataatgaggttggcttcctgtttcattgctgggtacgactgattaatttactgcaggaaccggccccaacgtggacgccaagaacgacaaggacagctcccttggacatgccactggctgaggctcctgcctccacctggcaccttcaggaccagcctatctccaggcacgccgtgcgcgtcgcagagcgaaattttccacacaagacagtggcagcccaaagacagcgcaaggccaaggcactgaaaaggagctttaagtctcaggcagtcggcgacagcgtaccactaatttggtcccagctggagcatgccgacgtgcggaagaaaccggctgagaaaaaatcccattctgaccctcggcccgataggacgcatacgcagattagactaccggagaagacaagcatcacaacatggacgatctttagcatcatttcttctaccgcaaatcaaactcagtcttcgcccaaggcgtgtacatcagcaagcgacgaggcaaccgggcagggccatgttgtggagtccccctcccattgcgtctctgctgatagccctgatggcttctttctgggaagctgcagctcactggatccatgtctttggcatcaggatactgaagacctcatggatagcgggggatctactctctctagcgccgcttctggattagcaccctacccccctgcggcttgtttaagcaccccatactcttctataccccggggtagagaaaaggcgggtcccatgggaagccaccagggccccggaccacctccttgccagaaggccccctccggcctggtaactagttgcaaagccccttttttggtggaccagtcacagaaattgccagccgttccagcctcctcatggaaacctccacccggattggccccacctcaaaaggctcctgccgccagcgctcccccccgcaaagctcccgctgtgcccgctccatcgcagaaggctcccgccgttcctgcaccaagccaaaaggcccccgccattcccgcccccagccgcaaggcctctgcggccagtgctagcccccgaaaagcctctgccgtcccagcaccgccgcaaaagacgcctcccccatctcagaaagccccgagtgttcccactatcccacagaaagcggtcagccccactgctccaaagaaaaagtcgctgttattaccagcccccagccagaaagccctcccaacatcgccaaccgaataccaaatggcattgagtcctccggcaagtagaggtaagctgcccggtgattttgacgtgctgcctactggaattcctgggagggcagtgctggagaggagccagtcaggaggaaagcctgaacctgtagttactgtccggacccaggaaacagatgtggtggagatgactacccaggccaagtccccagaatccccattcactgtaaccaagaaagagtctaaagacatcttgatctcacagaccaaagaagtgaccctcgaagcttttagaggacaggggaaactggaggattgggcccattgggcgaagttggaagagaggtcgcctgaccttcctggcgtaagatccaaggagcttgaacagagaaaacgctgggtgaaggcgaaagagttggcagtggaagggccaagtcaggagcattcacgtccattttcagtcgaggcactgacccttaccaaactcatgattactgctaactctaaagagcaacccagcaagtccgcactcgttagtctccccagctggctcctggccacgccccaggcgtccgcgacaagcatgatggctagtgtccctagtagaccaggacagctgagtctactggagggcaagccagtggtagttagagagcagccggaaagccacacgtgggtcaaagaggggaagaggccctggggagaaatgaaggagcagccctggggcgagatgaaggagcccccttgggacccaaaaggacctcccaaggtgccatttcgctcaaagcccaccagcgcttctctaaaaagagagggcatctctcaggcccctatccccctcacagcctctccttgggaggaccttaggccctccccactgtctgaaacacttatcagtaagatggaggccactgccagggctagtcagcaaccaaaacgggtaagtcaggagcccatgcgtatgcctgcacagcatcctctggcaaccgtcggcagttcttccgagatcctgctccccatgctgttagaactcgagacagtgagaaatactgccaccaaggccgaggaaatccaagaggaaagcggagtcttgaatctactgccgagtctccagcacagccagcactcagaatggcctgatgcgggcgcatag

SEQ ID NO: 30001 - DNA, 1035 bp, Artificial Sequence
  Description of Artificial Sequence: Synthetic coding sequence
atgttgagtagcttcccccatcgtaaaacttggcggaagagcaaaaagacagttaaagtcacccgcagttaccccacgtttccatcgttgaacgcatgggaggagtttcgggggctcttacctgtggacggcgagcctaaccccggggccggcctgggcgtcgaagagggcctcctgtgccgcgtcgttcacagcccggagtttaatttgtttctggactccgtcgtttttgaaagtaacttcattcaggtgaagcgcgggcgaaactggcgtgatgtgtataaggcgagtaatacaatggctcttggcgtcacatcttctgttccttgcttgcctcttcccaacattttactgatggcgtctgtgaagtggcatcagggacagaatcagacttggaataggcccagtatagctccaaacatcttcctcaaacgcatcttaccacttcggttcgtggaactccaggtgtgcgaccactatcagagaatactgcaattgagaacagtaaccgagaagatctattatctgaagttgcaccctgaccaccctgagaccgtcttccatttctggatcaggttggtccaaatcctgcagaaggggctgtccataaccaccaaagaccccaggatactcgtgacgcactgtctggttccaaagaactgttcttcaccgtccggggatagtaaactagttcagaagaaactccaggcctcccagcctagcgaatccctgatccaactcatgaccaagggggagtccgaagctctcagtcagatcttcgcagatctacatcaacagaatcagctgtcattcaggtcttctcgcaaggtggaaacgaataaaaacagtagtggaaaagacagctcccgcgaggactcaatcccttgcacatgcgacctacgttggagagccagttttacctatggcgaatgggagagggagaatccttcaggcttgcagcccttatcactactaagcaccttagcagctagcacgggtccacagctcgcccccccaattggcaactctatctag

SEQ ID NO: 30002 - DNA, 903 bp, Artificial Sequence
  Description of Artificial Sequence: Synthetic coding sequence
atgtccaagatcagaggcctgcctccagaggtgcgggagccaggtcccggcgtggaactcggagttgaaaacggcctgctgtgtcagctgattcacagcccagaatttaatctgttttcaaactcagtggtgtttgaatcaaattttatccaggttacaaagcctggaaactggagggatgtatgcgagggatccgctacagtaatcttaggggttacaagcagtgtgcctagcctccccctgccaaatgtcttactgatggccaacgtaacatggccccagggccccttcaccacttggagcacccccggtgatgctccagtgataaatttaagcaggctgctgcccttgaagtacgtcgagttgaggatttacgaccggctgcagcgcatcctgcgtgtacgaacagtcacggaaaagatctactaccttaaactacatgaaaaacatcccgaaattgtatttcaattttgggtgaggctggtgaaaatccttcagaagggtcttagtatcactaccaaggacccccgtattaagttcactcactgcctagtccccaagatgcccacaaattctaccgagactactcccgaaaactccttgctgagcagtccgcagccaagcgagcctctggtcctgttggcggctgagcagacttctggatctttttcgcagctctccggaaaacctcagctgacggccgataggaacaatgataccgctattgaaatcgacaattgctcctcttataagatcccaagtcctgtggcaagtccgattaacctgaacataccaatgcgagccgcactcagccactccctttgggagcaagaggattggaatgaacatctcctgcaggtgcacattgctagttacttgggcgagcactttctgggagcgtag

SEQ ID NO: 30003 - DNA, 903 bp, Artificial Sequence
  Description of Artificial Sequence: Synthetic coding sequence
atgtctaaaattaggggcctgccccccgaggtgcgcgaaccaggaccgggagtggagctaggagtggaaaatggattgctctgtcagctgatccactctcccgagttcaatctctttagcaactcagtggtttttgagtcgaactttatccaggtgactaaacctggtaactggagagacgtttgtgaggggagtgcaaccgttattttgggagtgacctcatcagtcccctctctgccactaccaaatgtgcttctgatggccaacgtaacttggccccagggcccattcaccacctggagcactcctggcgatgcccccgtgataaatctgtcccgtttactcccacttaaatacgtggagttaagaatctatgatagactccagcgcatcctacgggtgcgaaccgtgaccgagaagatttattacttaaaactccacgagaaacaccccgagatcgtatttcagttttgggtgaggctcgtgaagattttacagaaaggtctgagtatcacaacaaaagacccccgtatcaagtttactcattgtctggtgcctaagatgcctacaaattctaccgagaccacccccgagaatagcctgctgagttctcctcagcccagtgagcccctggtactgttagctgctgaacagacgtctgggagcttctcccagttgagtggcaaaccccagttgactgccgacaggaataatgacactgctatagaaatcgataactgttccagttataagattccgtctcccgtggcgagtccgatcaacttaaacatacctatgcgcgctgcattgtctcatagcctgtgggaacaggaggattggaacgaacacttactgcaggtccatatcgcatcatacttgggtgaacatttccttggcgcttag

SEQ ID NO: 30004 - DNA, 903 bp, Artificial Sequence
  Description of Artificial Sequence: Synthetic coding sequence
atgagcaagatcaggggactgcctcctgaggtgcgtgagcccggtcccggggtggagctgggtgtcgagaatggactgctttgccaacttatccattctcccgaatttaatttgttctcgaactcagtcgtttttgaatctaattttattcaggtaacaaagccagggaactggcgggacgtgtgtgagggctcagctacggtgattctgggtgttacgtcctctgtgccgtccctacccctgccaaacgtcttactgatggccaacgtcacttggccacagggtccattcacaacttggagcactcccggcgatgctccagtcattaacctgtcaaggctgttgcctctgaaatacgtcgaactacgcatttacgacaggttgcagcggatcctgcgggttcgtaccgtcacagaaaagatatactacctgaaactgcatgagaaacacccagagattgtcttccagttttgggtgagactcgttaagatcctccaaaagggactgtcaatcaccactaaggacccacggatcaagtttacccattgtctcgtccctaaaatgccgaccaatagcaccgagacaactcccgagaactcgctgctgtcaagccctcagccttcagaaccactggtactgcttgcagccgagcagacatctgggagcttcagtcagctgtctgggaaaccacagctcactgcagacagaaacaacgacactgccatcgaaattgataattgttcatcctataaaatcccaagccctgtagcctccccaattaatttgaacatccctatgcgggctgcccttagccactccctctgggaacaggaggattggaacgaacaccttctgcaggtgcatatagcatcttatttgggcgaacactttttaggcgcatag

SEQ ID NO: 30005 - DNA, 930 bp, Artificial Sequence
  Description of Artificial Sequence: Synthetic coding sequence
atgtccaagattagggggctccctcctgaggtgagagagcccggccctggagttgaactgggcgtggagaacggcctgttgtgtcagctgatccattctcccgaattcaatttgttctcgaattcagtggttttcgagagcaatttcattcagacacacgttcccgaggccgatttccaggtcacaaagcctgggaactggcgggatgtgtgcgagggctctgcaactgtgatcttaggcgtgacttcttcagttccctcactccccctcccaaatgtgctcctgatggctaacgtaacatggccccaaggaccgttcactacatggagtactcccggggacgctccagtgatcaacctcagtcgactgctaccgctcaaatacgtggagcttaggatctacgataggctgcagcgcattttgagggtgagaaccgtcaccgagaagatctattacctgaagctgcatgaaaagcaccccgagatcgtattccaattctgggtgagattggtgaagatcctgcaaaaaggcctctccattacaaccaaagatcccaggatcaagtttactcattgtcttgttcccaagatgcccacgaatagcacagagactacaccagaaaatagtttgttgtcttcgcctcagccctccgagcccctcgtcctcctggccgccgagcaaacttccggtagttttagtcagctgtccggcaagccacagcttacggctgaccggaacaacgatactgccatcgaaatagacaattgttcttcatataagattccaagccctgtagcttcccctatcaacctgaacattcccatgagagccgcgttatcacactcactctgggaacaggaagactggaacgaacacctactccaggtccacatcgcctcctacttgggtgaacatttcctgggagcctag

SEQ ID NO: 30006 - DNA, 330 bp, Artificial Sequence
  Description of Artificial Sequence: Synthetic coding sequence
atgagcactaacatctgctcctttaaggactctgccgttgattttacgggtcgatgctattttacgaaaatatgtaaatgtaaactgaaggacatagcctgcctaaagtgcggtaatatcgtgggctaccatgtcattgtcccttgttcctcttgccttctctcctgcaataatggtcacttttggatgttccacagccaggccgtgtatgatattaatcgcctggatagcacgggtgttaatgtgttgctgtgggggaacctaccagagatcgaagaatcaactgacgaagacgtcctgaacatctctgccgaggaatgtattcgctag

SEQ ID NO: 30007 - DNA, 450 bp, Artificial Sequence
  Description of Artificial Sequence: Synthetic coding sequence
atgtctacaaacatctgttcattcaaggatcgttgtgtgagcatactatgttgcaagttttgcaaacaggtgctcagctcccgtgggatgaaggctgttctgctggctgatactgagatagatcttttcagcaccgatattccccctacaaatgcagtggatttcactggccgttgctatttcactaagatctgcaagtgtaagcttaaggatatagcttgtctcaagtgcgggaatatcgtaggttaccacgtgatcgtcccatgttcttcatgtttattatcctgtaacaacggccacttttggatgttccacagccaggccgtgtatgacatcaatagacttgattcgactggcgtcaacgtgctgctttggggcaacctgcccgagattgaagagagcactgacgaagatgtgcttaacatttctgcggaggagtgtatacggtag

SEQ ID NO: 30008 - DNA, 450 bp, Artificial Sequence
  Description of Artificial Sequence: Synthetic coding sequence
atgcctaccaccacagcactgcgttggacggcggccgcacgagttaggcgcaaaggtagaggtggctgggtccctgctgccctacgcagcgtgagccaagatggcgtccctggctgtacggttatggggggtgaaaccagatccccagagaatgccgtggacttcaccggaagatgttacttcacaaaaatctgcaagtgcaagctgaaggacatcgcttgtttaaaatgtggcaatatagttggctaccacgtgattgtgccatgctcttcttgcctgctctcatgcaacaacgggcacttctggatgttccacagtcaggcagtatacgatataaacagactggattccaccggagtcaacgtactattgtggggtaatctgcctgagattgaagaaagtaccgacgaggatgtgcttaacatttcagccgaggagtgtatacgctag

SEQ ID NO: 30009 - DNA, 330 bp, Artificial Sequence
  Description of Artificial Sequence: Synthetic coding sequence
atgtccacaaacatctgttcatttaaagactccgccgtggacttcaccggcaggtgctactttactaaaatctgtaaatgtaagctgaaagacattgcttgcctgaagtgcggaaatatagtgggataccacgtgattgtgccctgctcctcctgtctgccatcttgcaataatggccatttttggatgttccatagccaggccgtgtacgacatcaatcggctggattccactggagttaatatccttctttggggcaacctccccgagattgaggagagtactgatgaagacgtactgaatatctccgccgaagagtgtattcgctag

SEQ ID NO: 30010 - DNA, 450 bp, Artificial Sequence
  Description of Artificial Sequence: Synthetic coding sequence
atgagtactaacatttgttctttcaaagaccggtgcgtctcaatcctgtgttgcaagttctgtaaacaggtcctgtcatcccggggcatgaaagccgtcttactggccgatacggagatcgacctttttagcactgatatccctccaactaatgccgtcgacttcaccggaagatgctactttacgaagatctgtaagtgtaaactgaaggacattgcctgccttaagtgtggcaatattgtgggataccacgtaattgttccatgcagttcatgcctgccctcttgcaataatggccatttctggatgtttcacagccaggctgtctatgacataaacaggttggattccacgggcgtaaatatcctgctctggggcaacttgcccgagatagaagaatcgaccgacgaagacgtacttaacatctcagctgaagagtgcataaggtag

SEQ ID NO: 30011 - DNA, 363 bp, Artificial Sequence
  Description of Artificial Sequence: Synthetic coding sequence
atgaaggctgtcctattggccgataccgaaattgacctgttcagcacagatattcctccgacgaatgccgtcgacttcaccggccgatgctacttcacgaaaatatgtaagtgcaagctgaaggacatcgcgtgcctgaagtgtggtaacatagtggggtatcacgttatcgttccatgttcatcctgccttccatcttgcaataatggacatttttggatgttccatagccaggcggtttacgacataaatcggctggatagcacgggcgttaatatcctcctttggggcaatctgccggagatagaagaatcgactgacgaagacgttttgaatatttcagccgaggagtgcatcaggtag

SEQ ID NO: 30012 - DNA, 363 bp, Artificial Sequence
  Description of Artificial Sequence: Synthetic coding sequence
atgaaagccgttctgctcgcggacactgagattgacttgttctcaaccgacattccacccaccaatgccgtggactttactggcagatgttatttcactaagatctgcaagtgtaaactcaaggatatagcttgccttaagtgtggcaacattgtcggttatcacgtgattgtgccctgctcatcttgtctacccagctgtaataatggacatttttggatgtttcacagtcaggcagtatacgacatcaatagactagacagcacaggcgtcaatatcttgttgtggggaaatctgccagagatcgaagagtccacagatgaagatgtcctgaacatcagtgccgaggagtgcatccggtag

SEQ ID NO: 30013 - DNA, 222 bp, Artificial Sequence
  Description of Artificial Sequence: Synthetic coding sequence
taaggaaatatcgttgtttaccacgttattgtgccttgttccagttgcttactaagctgcaataataggcatttttggatgttccatagccaagcagtgtacgatataaataggctcgacagcactggcgtgaacgtcctcttgcgcggaaatcttccagagatcgaggagtccacggacgaagatgttcttaatatttcagccgaagaatgcattagatag

SEQ ID NO: 30014 - DNA, 450 bp, Artificial Sequence
  Description of Artificial Sequence: Synthetic coding sequence
atgagcacaaacatctgcagtttcaaggatagatgcgtatctatcctgtgttgtaagttttgcaagcaggttttgtcgtctagggggatgaaagctgtgctcctagcagacacagaaattgatctgttctctacggatataccccctacgaatgctgtcgactttaccggtaggtgctattttacaaaaatctgtaaatgcaagctaaaggacatagcatgcctgaaatgcggaaatattgtgggataccatgtgattgttccgtgttcgtcctgcctactttcctgcaataatcggcatttttggatgtttcatagtcaggccgtgtacgatataaaccgcctggacagtaccggcgtcaatgtgctgctccgaggcaaccttcccgaaattgaagagagtaccgatgaggatgtgctgaacatctccgctgaagagtgcattagatag

SEQ ID NO: 30015 - DNA, 549 bp, Artificial Sequence
  Description of Artificial Sequence: Synthetic coding sequence
atgaaaccctggtgggctcgcgactgggctctgccttctcgcggccaatgcgtctgccctggcgaaaccaacgcctgtctcgatgcagagcgcgcctgccgggaatgccctcgcgggttggaagagacgtgggatttattatcccagctgcagtctctcttagggacccatcttgacaaaggcgacttcgggcagctgtccggcccagagccccctggggaggtgggcaagcgagcaccagatggcgctagcagatcctccttggagcccatggaggatgctgcgccaattatctatcttttggcctccccggacccccgcatcaaacatcctcaggatctggcatccacgccttccccagggccaatgaccacgtcagtgtcctccctcagcgcctctcagcctcctgaacccagcctacttttggagagaccctctcccaagccacctgctctatttctaactcatcatacccctcttattctctggcccgcgctcctgttgctgcaaaagacctcccttctccttccatgcggaacacctctttag

SEQ ID NO: 30016 - DNA, 1026 bp, Artificial Sequence
  Description of Artificial Sequence: Synthetic coding sequence
atggctgcgctctatgcatgcactaagtgccaccagcgcttcccttttgaggccttgagccaaggtcagcagctatgcaaggagtgccggatcgcacatcccgtcgttaagtgcacttactgccgcactgagtatcagcaagaaagattagaatgtaacggtacaatctcagcgcactgcaacctgcatctcccgggttcctccgactctccggcctcctcctcaagggtcgctggaatcaccggcatcaagaccaacacaatttgcaagaaatgtgctcagaacgtccaactttatggtactccaaagccgtgtcagtactgtaacattattgccgctttcattggaaataaatgccagcggtgcaccaacagcgagaaaaagtacggccctccctacagttgtgaacaatgcaagcagcagtgcgctttcgaccggaaggacgacaggaaaaaggtggatgggaaactgctatgttggttatgtaccctaagctacaagagagtcttgcagaagaccaaagagcaacgcaagcacctttcttcttcctcaagagctggacatcaggagaaggaacagtacagcaggttgtccggtgggggtcactataatagtcaaaaaactctaagcacaagttccattcagaacgaaatcccaaagaagaagtcaaaattcgaaagcattaccacgaatggggattcatttagtcctgacttagcactggattcacccggcaccgaccacttcgtcattatcgcccaactgaaagaagaggtcgccacactcaaaaaaatgctgcatcaaaaagaccagatgattttggagaaggaaaagaaaatcacagagctaaaggccgacttccagtaccaagaaagtcagatgcgggctaaaatgaaccagatggagaagacacacaaggaggtgacagaacagttacaggctaagaaccgcgagctgctgaaacaagccgccgcgctgtccaaaagcaagaaatcagagaagtccggtgccattacatcaccctag

SEQ ID NO: 30017 - DNA, 2352 bp, Artificial Sequence
  Description of Artificial Sequence: Synthetic coding sequence
atggaggatgaacagcccgatagtctggagggctgggtgcccgttcgtgaggggctctttgcagaacccgagcgacacaggcttaggttcctggttgcctggaatggtgctgagggcaaattcgccgtcacatgccacgaccggacggcccagcagcgaagattaagggagggcgctagactggggccagagccagagcctaagcctgaggccgccgtaagccccagttcttgggccggtctcctcagcgcagccggactgagaggcgcgcataggcagttggctgcactgtggccacctctggaacggtgcttcccgagacttcctcccgagctggatgttggcggaggcggcgcctggggtctcgggctgggtctatgggccctgctgtggcccacccgggccggccccggcgaggcagccctccaagagctgtgcgggcaattggaaaggtatctgggggctgcagcagatgggtgcggcggggccacagtaagggacgccctgttccccgcagagggcggagccgccgattgtgagtccccaagggagtttagagagagggctctgcgtgccaggtgggtggaggcggatgctcgactcagacaggtaatccagggccacggaaaagcaaatacaatggtcgctctgatgaacgtctatcaggaagaagatgaagcataccaagagttagtcactgttgcgaccatgtttttccagtatctactgcagccctttcgtgcgatgagagaagtggctaccctgtgtaagctggacatcctgaagtctttggatgaagatgatttgggcccaagaagggtagtggccctcgagaaagaagcagaagagtggacccggcgagctgaggaagccgtggtgtccattcaggacattacagtgaattactttaaggagaccgtcaaagccttggctggcatgcagaaggagatggagcaggatgctaaaagatttggtcaggccgcgtgggccaccgcaatccccagacttgaaaagctccaactgatgctggctagggaaactctgcaactgatgcgtgctaaggagctctgcctaaatcataaaagggccgagatccaaggtaaaatggaggacctgccagagcaagagaagaacactaatgtagtggacgagctggaaatccagttctatgaaatccagctggaactgtacgaggtgaagttcgaaatactcaaaaacgaggagatcctcctcacaacgcagctggattcactgaagcgactgattaaagaaaaacaggatgaggtggtctattatgacccgtgcgagaaccccgaggaattgaaagtgatcgattgcgtggtgggcctgcaagacgacaaaaatctggaagtgaaagagctacggcggcagtgtcagcagctggaatcgaaaagggggaggatttgtgccaaaagggcaagcctgcgatcccgcaaagatcagtgcaaagagaatcaccgtttccgactccagcaagctgaagaatccatccgctatagtcgccagcatcactccattcaaatgaaacgggataagatcaaagaggaggaacagaaaaaaaaagagtggataaatcaagagagacaaaaaacactccagagactgaggtcattcaaggacaagcggctcgcccagagtgtgcgcaacacctctggtagtgagcccgtggccccaaacttaccaagtgacctgtcacagcagatgtgtttgcccgctagtcacgccgtaagcgtgatacacccatctagccgaaagactagaggggttcctcttagtgaggccggcaacgtcaagagccccaagtgccagaactgccatggaaacatccctgtgcaggtatttgtcccagtgggcgatcagacacactccaaatcttctgaggaactttcgctgcctcccccaccgcctccaccaccccctcctccacctcccccccccccaccacctccaccactacgggccctgagctcctcgagccaagccgctacacaccagaatctcggcttcagggcaccagtgaaggatgatcagcctcgacccctggtttgcgagtccccagcagagaggcctagggactccttagagtccttcagctgtcctggttccatggacgaagtgcttgccagcttgcgtcacggccgcgctcaaggcgtaaaactgaagaaggtgcacccagatctgggccctaatccaagctcaaaacccacctccaatcggcggacctctgatctggaacgaagcattaaggccgcactgcagcggattaaaagggtatccgcagactccgaagaggatagcgacgaacaggatccaggtcaatgggatggatag

SEQ ID NO: 30018 - DNA, 837 bp, Artificial Sequence
  Description of Artificial Sequence: Synthetic coding sequence
atggccgctctgtacgcctgcacgaaatgtcaccagagatttccgtttgaagccctctcccagggacagcagctgtgtaaagaatgccgtatcgctcaccccgttgttaagtgtacatactgtcggactgagtaccagcaggagtccaagacaaatacgatatgtaagaagtgcgctcaaaacgtccagctgtatggcaccccgaaaccttgtcagtactgcaatattatcgccgcctttattggaaataagtgtcagaggtgcaccaacagcgaaaaaaagtacggacctccctactcctgcgaacagtgtaaacaacagtgtgcgttcgaccggaaagacgaccgtaagaaggtggacgggaaacttctctgttggctgtgcaccctcagttataaaagagtgctgcagaaaacgaaagaacagaggaaacacctgtcgtcgtcgagtagagctggccaccaggagaaggaacagtactctcggctaagcggaggcgggcactataacagcttctctcccgacctcgccctggactcacccgggaccgatcacttcgtcattattgcacagcttaaggaagaagtcgctaccttgaaaaagatgttacaccagaaggatcagatgatacttgaaaaggagaagaaaatcacggagcttaaagcagactttcaataccaggaatcacagatgagggccaaaatgaaccagatggagaaaacacataaagaagtaactgagcagttgcaggccaagaaccgagagttgctaaagcaagcagcggccctctcaaagtctaagaaatcggaaaaaagcggcgcaattacctccccatag

SEQ ID NO: 30019 - DNA, 924 bp, Artificial Sequence
  Description of Artificial Sequence: Synthetic coding sequence
atggccgccctgtacgcctgtactaagtgtcatcagcgtttcccattcgaagcacttagccaaggacaacagctgtgcaaagagtgcagaatcgcccatccggttgtgaagtgtacatactgtaggaccgagtatcagcaggaatccaagactaacacgatctgcaaaaaatgtgcccagaacgttcagctgtatggaacccctaagccgtgccagtattgcaacatcattgctgcctttatagggaacaagtgccagcgatgcaccaacagcgagaaaaaatacggtcccccatattcatgcgaacagtgcaagcaacagtgtgcgtttgaccggaaggacgatcggaagaaggtggatggaaagcttctatgctggttgtgcactctaagttacaaacgcgtcctccagaaaactaaagagcagcgcaagcatcttagctcatccagccgcgccgggcatcaggaaaaggaacagtactcccggctgtcaggcggtggtcactacaactcccagaagactctgtctacgtcctcaattcaaaatgagattcccaagaaaaagagtaagttcgaatctataactaccaatggcgacagcttctctcctgacctggcactggactcccccggtaccgatcattttgtgatcatcgctcaactcaaagaggaagtcgctacactgaagaaaatgctgcaccagaaggaccaaatgatcctagaaaaggagaaaaagatcactgagctgaaggcagacttccaatatcaagagagtcagatgagagctaagatgaaccagatggagaagacccacaaggaagtcactgagcagttacaggcgaagaacagagaactgcttaaacaagccgccgcattatcgaagagtaagaaaagcgagaaatcaggggccattacctcaccgtag

SEQ ID NO: 30020 - DNA, 684 bp, Artificial Sequence
  Description of Artificial Sequence: Synthetic coding sequence
atggccgctctgtacgcttgtacaaaatgccaccaaaggtttccgtttgaagccctatcacagggccagcagctctgtaaagagtgcaggatcgctcacccggtagtcaaatgcacatactgcagaaccgagtaccagcaggaatccaagactaacaccatctgtaagaaatgtgctcagaatgtgcagctttatggaacagttgatggaaaactgctgtgctggctgtgtacccttagctataagcgagtgttgcagaagacaaaggaacagagaaagcacctgtcctcatcatccagagccgggcatcaggagaaagaacagtattcccgtctgtccggcgggggccattacaacagcttttcacccgacctggctttagattcccctgggactgatcattttgtgatcattgcccaactgaaagaggaggtcgctacgctcaagaaaatgctgcatcagaaagatcagatgattctagagaaggagaagaaaatcactgagctgaaggccgactttcagtatcaggagtctcagatgcgggcaaagatgaaccagatggagaaaacccataaggaggtgacggagcagctccaggctaagaacagggaactcctgaaacaggcagccgccttatcaaaatctaagaagtcagagaaaagcggggcaatcacaagcccctag

SEQ ID NO: 30021 - DNA, 1020 bp, Artificial Sequence
  Description of Artificial Sequence: Synthetic coding sequence
atggctgcctccgccctgtatgcctgtactaaatgtacccagaggtatccattcgaggagctgagccagggccagcagctgtgcaaggaatgccgcatagcacaccccatcgtgaagtgcacttactgcagaagcgagtttcagcaggagagcaagacgaacaccatctgtaaaaaatgtgcacagaatgtgaaacagtttgggacacccaagccgtgtcagtattgcaatataattgcagccttcattgggaccaagtgtcagcgctgcactaattccgaaaaaaaatatgggccaccacagacttgcgagcagtgcaagcagcagtgcgcatttgaccggaaagaggagggcagacggaaagtggacgggaagttactgtgttggttgtgtaccctaagctataagagggtactccagaagaccaaggagcagcgcaagagcctcgggtccagccatagtaacagttcctcatcgtcgctgaccgagaaggaccagcaccatcccaagcaccaccatcaccaccaccatcaccaccataggcactcttccagccaccataagatctcaaacctgtctccggaagaggagcagggactctggaagcagagccacaaaagcagcgccacaattcagaatgagacacccaagaagaaacccaagttggagtcaaaaccgtccaatggagattcctcaagcatcaaccagtccgcggattcaggagggactgataattttgtcctcattagtcaactcaaagaggaagttatgtcactcaaaaggcttctgcaacaaagggaccaaaccattttagaaaaggacaagaagctgaccgagttaaaagctgactttcagtaccaagaatctaacctgcggacaaagatgaattcaatggagaaggcacacaaagaaaccgtggaacagctgcaggccaagaacagagagctgcttaaacaagttgcagcgttatccaagggtaagaaatttgataaatcaggctcaatacttacatccccctag

SEQ ID NO: 30022 - DNA, 843 bp, Artificial Sequence
  Description of Artificial Sequence: Synthetic coding sequence
atgacttcgtatattcttatatccttcgtgctcctgatcggggtgggatgtatagagaaggatcagagttgtccagtctttggcgggagaaagcggctgcatctgctcttcgtcggtgggcagttaagacaagtcagaatgcttaggggcagccccgaggccagcaccgattgctgctggctgcaccaggctaccggaagtggcagtgttacccaagccggggtgcagtggtatgatcttggaagccttcagcccctgccccctcgatttaagaggttttcctgcctgtcacttcccagtagctgggattacaggtcttcttgggaactgccagatctacaggagggcaaaattcaggccataagcgactctgatggggtcaactacccgtggtacggcaataccactgagacctgcacaatcgtcggccctactaaacgtgactctaaattcattatttccatgaacgacaatttttacccttcagtgacttgggcagtgccagtatccgaatcaaacgtcgccaaactaactaacatttatcgagaccagtccttcacaacatggttggtagcaacgaacacatccaccaacgatatgatcatcctgcaaaccctacattggagaatgcagctctctattgaagtgaatcccaaccggccactgggccagcgtgcacgccttagagagcccatcgctcaagaccagcccaagattctgtctaaaaacgaaccaatccctccctctgcgctggtgaaacctaacgccaatgacgcgcaggtcttaatgtggaggccgaagtacggccagcccctggtagtgatcccaccaaagcaccgttag

SEQ ID NO: 30023 - DNA, 852 bp, Artificial Sequence
  Description of Artificial Sequence: Synthetic coding sequence
atgccaggctttttctgcgattgttggccatcactggaaatcagagcattactgtacgcaatggggtgcatccagagcataggcgggaaagcccgagttttccgggagggaatcaccgtgattgatgttaaagctagtattgaccccgtgcccacctccattgacgaaagctcatccgttgttctccgctaccgtacgcctcacttccgcgcttcagcgcaggtggtcatgccgcccatcccgaaaaaggagacctgggtggtgggatggatccaggcttgttcccatatggaattctacaatcaatacggcgagcagggcatgagctcttgggaactgcccgaccttcaggaaggtaagatccaggccatcagtgattccgacggcgtgaattatccatggtatggaaacacgactgagacctgtacaattgtcggccctacaaagcgcgattctaagtttatcataagtatgaatgacaacttttatccctccgtgacctgggcggtgcccgtatcagagagtaacgtggctaagcttaccaacatatatcgcgaccagagctttaccacctggctggttgcgacaaacacctccacgaatgatatgatcattttacagacacttcattggagaatgcagctctcgattgaggtgaacccgaatagacccctgggacaacgggcaaggctgagggagcccatagctcaagatcaacctaaaatactttccaagaacgagcctatcccaccatccgcgctagtcaagccaaacgctaacgacgcacaggtgctgatgtggaggcccaaatatggccagcccttggtggtaatcccacccaaacatagatag

SEQ ID NO: 30024 - DNA, 759 bp, Artificial Sequence
  Description of Artificial Sequence: Synthetic coding sequence
ggccagggcattgccgccgccctgattcatttacctagtacaggcaacaagcactggaggcctagaagcccagaggctagtacagactgttgttggctgcaccaagctactggaagcggtagcgttacacaggcaggagtgcagtggtacgatctgggttcactgcagccactaccacccaggttcaaacgcttcagttgtcttagcctcccatcctcatgggactatcgcagttcttgggagctgccagatctgcaggaaggcaagatacaggcaattagcgacagtgacggtgtaaactatccctggtacggcaatacaacagagacttgcacaattgtgggacctaccaagcgcgactccaagttcatcatctcaatgaacgacaacttttacccatccgtgacatgggctgtgcctgtatcggaatcaaatgtggcaaagctcaccaacatttacagagaccaatcctttaccacatggctggtggcgacaaatactagtacaaacgacatgatcattctccaaactctccattggaggatgcagctctccatcgaagtgaatcccaataggcccctgggccagagggctaggcttcgggaacctattgcccaggatcagcctaagatcctgtcgaagaacgaacccattccacctagtgctctggtgaagcccaacgcaaacgacgctcaggtgctgatgtggcgacctaaatatggacagcctctcgttgtcatacctcctaaacaccgctag

SEQ ID NO: 30025 - DNA, 786 bp, Artificial Sequence
  Description of Artificial Sequence: Synthetic coding sequence
atgggctgtattcaaagcatcacttgtaaggccaggatccgtcgcgaaaatatcgttgtctatgacgtgtgtgccacgatagaccaatgtcccacaagaattgaggaaaccagccctattgtgctgcgctacaagacgccctatttcaaggcaagcgcgcgggttgtcatgccaccgatcccaagacacgagacctgggttgtgggttggattcaggcatgcaatcaaatggagtttttcaatacatactctgacttaggaatgagtagctgggagctgcccgaccttagagagggaagagttaaggctattagcgactccgatggcgtctcctacccatggtatggaaacacaacagagactgtgacactggtgggaccaacaaacaagatctctaggttctccgtgagcatgaatgacaatttctaccccagcgtgacctgggcagttcccgtcagcgatagtaacgtgccattgctcacgcgtattaagcgagaccagtcatttacaacgtggctagtggcaatgaacactaccaccaaggaaaaaattattctccagacaattaaatggcgcatgagagtggacatcgaagtggatcccttacaacttctaggccagcgggccaggctcgtgggtcggacccagcaggaacaacccagaatccttagcaggatggaacctattccacccaatgcactcgttaaacccaacgccaacgatgcacaggtgctgatgtggcgtcccaagcgagggccacccctggttgtgattccccccaagtag

SEQ ID NO: 30026 - DNA, 786 bp, Artificial Sequence
  Description of Artificial Sequence: Synthetic coding sequence
atgggttgcatccaaagcatcacttgtaaagccagaattaggagagagaacatcgttgtatacgatgtgtgcgcaacaatcgaccaatgtcccactaggattgaagagacgagtcctattgtcctgcggtataagacaccctactttaaggccagtgcacgagtagtgatgccccctataccgcgccatgagacttgggtcgtggggtggatacaggcatgcaaccagatggagttctttaacacctactccgacttgggcatgagttcatgggagttacccgatttacgggagggaagggtcaaggctatctcagatagcgatggggtcagctatccttggtacggaaacacgactgaaaccgttaccctggtcggacctactaacaaaattagcagatttagcgtaagcatgaacgacaatttctatccttccgtgacctgggctgtgcccgtgtccgattccaatgtcccactactgactcggatcaaacgggaccagtcctttacaacctggctggtggctatgaacacgaccacaaaagagaagatcatcctccagaccatcaagtggcgcatgcgcgtcgacatcgaagtggaccctcttcagcttctcggtcaacgagcacgattagtgggacgcacacagcaggaacagcctcggattctctcgaggatggagccaatccctcccaatgccttagttaagcccaatgcgaacgatgcgcaagtgttgatgtggagaccaaagcgcggtccccccctggtagtgatccctcccaaatag

SEQ ID NO: 30027 - DNA, 1107 bp, Artificial Sequence
  Description of Artificial Sequence: Synthetic coding sequence
atggagaatatgcacctgaggcgggtgaggacaatgcctcgacactcacagagcctgaccatggcgccttattcgtctgtgtccctggtcgagcagttggaggatcggatcctgtgtcatgagaaaaccacagcagccctagtggagcacgccttccggattaaggacgacattgttaactccctgcagaagatgcagaacaaaggtgggggtgaccggctcgctaggctgttcctggaggagcatatccggaacataacagctatagttaaacagctcaacagagacattgaagtgctgcaggaacaaataagagcgcgggacaacatttcttacggaaccaacagcgccctgaagactttggaaatgcgtcaactttccggtctgggggacctgcggggtagagtcgctagatgtgatgcctctattgcccgtctgagcgcagaacacaagaccacatacgagggtctccagcatctcaataaggagcagcaagccgctaaactgatccttgagactaagatcaaagacgccgagggtcagatcagtcagttgcttaatagggttgacctgtccattagcgagcagtctacaaaactgaaaatgtcccatcgggactctaatcaccaactccagttgctggacacaaagtttaagggcactgtggaggaattatccaaccagatattgtctgcccggtcatggctccagcaggagcaagaacggattgaaaaggagttgctgcagaaaatcgatcaactgtcactcatcgtcaaggagaactcaggtgcctcggaacgcgacatggagaagaagttatctcagatgagcgcccggcttgacaaaatcgaggaagggcaaaagaaaacattcgacggccagcggacacgacaggaggaggagaagatgcacgggcggattaccaaactggaactgcagatgaaccagaacattaaggaaatgaaggctgaagtgaacgctggttttaccgcggtctatgaaagcatcgggtccctgagacaggtactagaggctaagatgaagttggacagagatcaactgcagaagcagatccagttaatgcaaaaacctgagactccgatgtag

SEQ ID NO: 30028 - DNA, 207 bp, Artificial Sequence
  Description of Artificial Sequence: Synthetic coding sequence
atggaaaatatgcatctccggagagtgcggacgatgccgcgccacagccagagccttacaatggccccatattcttccgtgtctcttgtagaacagctggaggatcggatcctgtgccacgaaaagacaacagctgccctggtggagcatgcttttcggatcaaagacgatatcgtgaatagccttcagaagatgcagaataaatag

SEQ ID NO: 30029 - DNA, 327 bp, Artificial Sequence
  Description of Artificial Sequence: Synthetic coding sequence
atggagaacatgcatctgcgacgggtgcgcactatgccccgccactctcagagtctaacaatggctccctattcgtcagtttccctggtcgaacagctggaggatagaatcctttgccatgaaaaaaccaccgctgcgctggtagagcacgcttttcgcattaaagatgacatcgttaattcgctgcagaagatgcagaacaaggggggcggtgatcgtctggcccgcctattcctggaagaacacatacgaaatattacggcaattgtgaagcaactgaatagggacattgaggtcttacaggaacagatccgtgctcgcgactag

SEQ ID NO: 30030 - DNA, 204 bp, Artificial Sequence
  Description of Artificial Sequence: Synthetic coding sequence
atggaaaatatgcatctccgcagggtcaggacaatgcctagacattctcagtccctgaccatggcaccgtatagctccgtctccctggtggagcagctcgaagaccggattctgtgccacgaaaagaccacggccgctctcgtagaacacgccttccggattaaggacgatattgtgaatagtcttcagaagatgcagaactag

SEQ ID NO: 30031 - DNA, 348 bp, Artificial Sequence
  Description of Artificial Sequence: Synthetic coding sequence
atggagaatatgcacctgaggcgtgtcagaacgatgcccaggcactcacaatcactaacgatggcgccgtattcatcagtgagtcttgtcgagcagcttgaggatcgtattctgtgccatgaaaagaccacggccgcacttgtggagcatgcctttcgcatcaaagatgacattgttaattcactccagaagatgcagaacaagggggggggggaccggcttgcccggctatttttggaggagcacataaggaatatcacagccattgtgaaacagctgaatcgtgatatagaggtcctccaggagcagataagagcacgcgacaatataagctatggaacgaattag

SEQ ID NO: 30032 - DNA, 177 bp, Artificial Sequence
  Description of Artificial Sequence: Synthetic coding sequence
atggagaatatgcacctgagacgcgttagaacaatgcccagacatagccaatcactgaccatggccccttatagcagtgtatcgcttgtggagcaactggaagataggatcctctgccatgaaaaaaccaccgccgcccttgtcgagcacgcctttcgaatcaaggacgatatctag

SEQ ID NO: 30033 - DNA, 402 bp, Artificial Sequence
  Description of Artificial Sequence: Synthetic coding sequence
atggagaatatgcacctgcgcagggttcggacaatgccaaggcacagccagtccttgaccatggccccctatagttctgtgtccctggtggagcaattggaagatagaatcttatgccacgagaagacgaccgccgccttggtggagcatgctttcagaattaaggatgacattgtaaactccctccagaaaatgcagaataaagggggcggtgaccgactggcccgtctttttctggaagaacacattaggaatattactgcaatcgtcaagcagctaaaccgcgatatagaggtattgcaggagcagattagagctcgagataatatctcatatggcaccaatagcgctctaaagaccctagagatgaggcaactgagtggactgggtgatctgagatag

SEQ ID NO: 30034 - DNA, 351 bp, Artificial Sequence
  Description of Artificial Sequence: Synthetic coding sequence
atggaaaatatgcacttacgcagggtgaggacaatgcccagacactcacagagcttgactatggctccttatagctctgtctctcttgtcgagcagttagaggatcgcattctctgtcacgagaagacaacggccgcgctggtggagcatgccttccgtattaaggatgacatcgttaattcactgcagaaaatgcaaaacaaaggcggcggcgatcgcctcgctcgcctgtttcttgaagagcacatcaggaatattacagccattgtgaagcagctgaatagggatattgaagtgttgcaggagcagatccgcgcccgggataacatcagttacggcacaaattcatag

SEQ ID NO: 30035 - DNA, 1359 bp, Artificial Sequence
  Description of Artificial Sequence: Synthetic coding sequence
atgcagttacaatttctcggaacattggcaagtagcgagaagcgaaaaaagtctcaaaggttgttcttcaagaacataaagagcaccaagaacaaggctgggaaggccagcattatgagtagcgatactaacgtgaataagagcgccagtcccaccgctaccgcagaggagcagccagtcgaacccgatgggccactcccgggttcagacaataaccaggaaaaaaaggtaaggctgtctccagccaagatgtctacaaaaaatagtacggacctcgtcgagtatgtcgacaagtcacacgcattcctgccaattattcctaacactcagagagggcaactggaagaccgcttgaataaccaagctaggactattgcgttcctattagaacaggcattcagaatcaaggaagatatcagcgcttgccttcaaggtacccacgggttccgcaaagaagagtctctcgcacgcaagctgttggagagccatatccagacaataacaagcatcgtgaaaaaactctctcagaatattgagatactggaagaccaaataagagctcgggatcaagccgccactggaactaacttcgccgtgcacgaaatcaacattaaacacctccagggagttggcgatttgaggggcagggtagcgcggtgtgactcttcgattgtgaagctgtccggtgacattcatttatttcgtcaggagcatcggcagattgaaaaggcgattcaggagttcgtgcctgccctggagacactgagcaagaacttggacatgaaagtgatgcagctcctagggaaaatcgagaccgcctctccggaacaaacttccaacttgaaaatggtgcagggggattatcgacacgaaatgaatctcctagagttcaaattccacagtctgtcatcaaatttgtatgaggaggtagaaaacaataaaaaatggacggagaaccagtttctgaagtaccgtaaggaccatctgggtcatattaacgaatgccttaaggtgctgcaggaaaagctcgagaagtcagagaacaaaatggaggagaaacttctccagctctctagcaaggttgagaacttcattaacactcagaaacaggagacccagcttagtaaggtgaaacacatggagaacaaactcagcaagaagatggagcagatggaaaagcagatatggggtgagctagagactatgcagaacgaatatcagagcgggttcaaatcaattcatgactcccttagcagtctgcaacagattcagaaaacaaaaatggatctggaaaagtacaaggtgcagaaagatcttaaaaagttacagaggaagatcgtcgaactgcaggaagtgtag

SEQ ID NO: 30036 - DNA, 1104 bp, Artificial Sequence
  Description of Artificial Sequence: Synthetic coding sequence
atgtccagaagtcgccacctgggtaaaattcgcaagcgcctggaagatgtcaaatcccagtgggtgagaccggcaagggcagacttcagtgataatgaatcagctaggttggccactgacgctttactggacggggggagcgaggcttattggagggtgctgtcacaagagggcgaggtggatttcctttcctccgttgaagcacagtacattcaggcccaggcacgcgaacctccgtgccctccagataccctaggaggcgccgaagccggcccaaagggtttggatagtagctctctccagtcaggcacctacttccctgtggcaagcgagggatccgaaccagcgttactccactcatgggcttccgccgaaaaaccctacctgaaagaaaagtcttcagccacggtctacttccaaaccgtgaaacataacaatatacgggacctcgtcaggcgttgcattacacgcactagtcaggtgctggtgatcttgatggacgttttcactgacgttgagatcttttgcgacatcttggaggcggctaacaagagaggagtgtttgtatgcgttctgctggatcaggggggggtgaagctctttcaagaaatgtgtgacaaagtgcagattagcgatagtcaccttaaaaatatctccatacggtctgttgaaggcgaaatatactgcgccaagagcggccggaaattcgctggccagatccgcgaaaagtttatcatctcagactggaggttcgtattgtcaggatcttatagtttcacgtggctttgtggccacgtacacaggaacatcctgagcaaatttactgggcaggccgtggaactgttcgacgaggagttccgacacctgtatgccagtagcaagccagttatgggccttaagtctccacggctcgtcgcaccagtcccaccaggtgccgcccccgctaatgggaggttgagcagcagctcaggttccgcttcggaccgtacttcctcaaaccctttttcaggacgatccgcaggctcgcaccctgtgccggagagcaaacagaataaaacgaaaacaaagaagcagactaccctgtggttcttgatggccttctag

SEQ ID NO: 30037 - DNA, 1305 bp, Artificial Sequence
  Description of Artificial Sequence: Synthetic coding sequence
atgagccgttcccgccacttggggaagattcgtaaacgacttgaggatgttaaatctcagtgggtgagacctgctagagccgacttttccgacaatgagagcgctcgactcgcgactgatgctctcttggatgggggctccgaggcgtactggcgcgtgctttcccaagagggcgaagtcgattttctgagttctgtagaagcacagtatatccaagcccaagctcgtgaacctccatgcccaccggataccctcgggggagcagaggccgggccaaaaggacttgactcatcatcactgcagtctgggacttacttcccagtggcaagtgaagggtcagagccggccctgctgcacagttgggcatctgcagaaaagccatatctaaaagaaaagagcagcgcgacagtgtacttccagaccgtgaagcacaataacataagagatctcgtccggcgatgtataacgaggacctcccaggttctggtcatcctgatggacgtctttactgatgtagaaatcttctgtgatatcctggaggccgctaataagagaggggtgttcgtatgcgtcctactggatcaaggcggggtcaagctattccaggaaatgtgtgacaaggtgcaaatttcggatagccacctcaagaacatctctattcgatccgttgagggcgagatttactgcgctaaaagcggccgcaagtttgctggccaaattagggagaagttcattatttccgactggcgcttcgtactgtctggcagttactctttcacttggctctgcggtcacgtacatcgcaacatcctgagcaagtttaccggacaggcagtggagctgtttgacgaggaattccgccacctgtatgcaagcagcaaacctgtaatgggcctcaaaagcccccgactggtagcgcctgtgcctcccggagccgctcccgcaaacggtcgactgtcaagctcatccggcagcgctagcgacaggacttcatctaacccttttagcggtaggagcgctggtagtcaccccggaactcggagtgtctcagcctcctcaggcccttgttctcctgcagctccccatccaccgccccccccacgcttccagccccaccagggaccctggggggcgccttctccccaggcccacctctctccaagacctcatgatggtccaccagcggctgtgtattcgaacctcggagcgtacaggcccacccgactgcaattagagcagttaggtttagtccctcggttaacccccacttggagacctttcctccaggcttctccgcacttctag

SEQ ID NO: 30038 - DNA, 1305 bp, Artificial Sequence
  Description of Artificial Sequence: Synthetic coding sequence
atgtccaggagccgccacttgggcaaaatccgcaagaggctagaggacgtgaaatcgcaatgggtccggcctgcccgtgcagatttttctgataacgaaagtgctcggttggccacagatgctctgttggacggcgggtctgaagcctactggagggttcttagccaggagggcgaagtcgatttcctgagcagtgtagaggcccagtacatacaagcgcaggcccgggagccgccctgcccccccgacaccctgggtggcgccgaggcgggcccaaagggcctggactcatcgagccttcagagtggaacatattttcctgtcgcaagcgaaggttcggagccggccctgttacatagctgggcatccgccgagaagccctacttgaaagagaagagcagtgcaacagtctacttccagacagtgaaacacaataatattagggatctggttaggagatgtatcactcgcacatcccaggtgctggtaatcttgatggacgtgttcaccgatgttgaaatcttctgtgacattctggaggcagccaacaagcgcggggtgtttgtgtgcgtactgcttgaccagggaggggtaaagctgttccaggagatgtgtgacaaggtgcaaatatcagacagtcacctaaaaaacatatccatcagaagcgtcgagggtgagatatattgcgctaagtcgggaaggaagtttgccgggcaaatccgagagaaattcataatctctgattggcgcttcgtgctatccggatcgtactctttcacttggctgtgtggacatgtacatcgtaacattctgagcaaatttactggccaggccgtggaactgtttgacgaagaatttcgacacctgtacgccagctccaaacccgtaatgggacttaaaagcccacgtctcgtggcacctgtgccaccaggggcagccccggctaatggtagactgagttcctccagcggttccgcttccgatcggacaagttccaatcctttctccgggaggagcgccggatcccacccgggaacccggtctgtgagcgcctcctctggaccctgctccccagccgcaccccacccacccccgccacctaggtttcagcctcatcagggtccatggggcgccccatccccacaggcacacctcagtccccgtccccatgatggccccccagccgccgtatacagcaacctcggcgcctaccggcctacgaggctccagcttgaacagctcggcctggtacctcgcttgacaccaacgtggagaccttttctacaagcaagccctcacttttag

SEQ ID NO: 30039 - DNA, 885 bp, Artificial Sequence
  Description of Artificial Sequence: Synthetic coding sequence
atgagtcgcagcagacatctggggaaaatccgaaaacgtctcgaggacgtgaaaagccaatgggtccgccctgcccgcgcagatttttccgataatgaaagtgcccgacttgcaaccgacgccctcctggacggtggctccgaggcttactggcgggtgctttcacaggagggagaagtcgacttcttgagcagcgtggaagctcaatacatccaggcacaagcccgtgagcccccctgtcctcccgatacattgggcggggctgaagccgggcctaaaggacttgacagttctagtctgcagagcggaacctattttccagtcgcatctgaagggtccgagcccgctctgctgcattcctgggcatccgccgagaaaccttacctgaaggaaaagtcttccgctaccgtgtacttccagacagtgaaacataataatataagagaccttgttaggaggtgcatcaccagaaccagccagaatatctcgattaggtcagtggagggggaaatctattgcgccaagtcaggaagaaagtttgcgggacagatcagagaaaaatttataataagcgactggcggttcgtcctgagcggttcgtattcctttacttggttatgcggccatgtgcaccggaacatcctgtctaaatttactgggcaagcagtggagctgtttgacgaagagttccgccacctctatgccagcagcaagccggtcatgggcctgaagagtcccagactggtcgctcccgtcccacccggtgctgctcccgcaaacgggcggctgtcatcatcctccggcagtgcgtccgacagaacgtccagtaacccattcagcggacggagcgctgggtcacaccccggaacccgcacagacgggtag

SEQ ID NO: 30040 - DNA, 1104 bp, Artificial Sequence
  Description of Artificial Sequence: Synthetic coding sequence
atgtcaagatctcgtcatctcgggaaaatccgtaaacggctggaggacgttaagtcacagtgggtgagacctgcaagagctgacttcagtgacaatgagtccgctcggctcgcgacggacgccttacttgatggtggcagtgaagcctactggcgggtactctcacaggagggggaggtcgatttcctgagctctgtggaggcgcagtatatccaagctcaagctagggagccaccctgccccccagataccctggggggagctgaggctggcccaaaaggcttggactcaagcagtctgcaatccggcacctactttccggtggccagtgaaggctcagaacccgccctcctgcactcctgggcatcagcagaaaaaccatatctgaaggaaaagtccagcgccacagtctattttcagaccgtgaagcataataacataagagacctcgtccgccgttgtatcactaggactagccaggtactggttatccttatggatgtcttcaccgacgtcgagatcttttgcgacatcctggaggccgccaacaagcgtggtgttttcgtctgtgttttgcttgaccaaggcggagtgaagctcttccaggaaatgtgcgacaaagtgcagatttcagactctcaccttaaaaacatctcaattagatcagtggaaggcgaaatttactgtgccaaatccggtagaaaatttgccggacagataagagaaaagttcatcatctcagactggcgcttcgtcctctccgggtcatactctttcacgtggctttgcggccacgtacatcggaatatattgagtaaatttaccgggcaggccgtggaattattcgatgaggagttccggcacctgtacgcatcaagtaaacccgtgatgggtcttaagtcaccgaggctagtagcgcccgtcccaccaggagctgcaccggcaaatggacggttgtctagtagttcagggtctgctagcgacagaaccagttccaatccgttctctgggaggagcgcgggatctcatccagtacccgaaagtaagcagaataagacaaagaccaaaaagcagaccacactatggtttctgatggcattttag

SEQ ID NO: 30041 - DNA, 885 bp, Artificial Sequence
  Description of Artificial Sequence: Synthetic coding sequence
atgtccagatctcgacacctcggcaagatcaggaaaaggctggaagatgtcaagagccaatgggtgagacctgccagggcggactttagtgacaacgagtcggctaggcttgctaccgacgctctcttggatggtgggagcgaggcttactggagagtactctcacaagagggagaagtcgacttcctctcctctgttgaagcacaatacatccaagcgcaggctagagaacctccttgtcccccggatacgctgggtggggccgaagcggggcccaaaggtctcgacagctcatccctgcagtctgggacctactttcccgtggcgagtgaaggctccgaaccagccttgctccatagctgggcatcagccgagaagccataccttaaggagaaaagtagtgccaccgtgtacttccagaccgtaaagcacaataacatccgtgaccttgtgagacgatgtatcactcgaacatcgcaaaatatttccatccgttccgtagagggagaaatttactgcgcaaagtctgggagaaaatttgcaggacagattagggagaaatttatcatcagcgattggcggttcgtgctctccggctcttactcattcacttggttatgtggacacgtccaccgtaacattctgtctaagtttaccgggcaggctgtagaactctttgatgaagagtttcggcatctgtacgcatcttctaagccggttatggggttaaaaagtcccagattggttgcaccagtgcccccaggcgccgctccggctaacggacggttgtccagcagcagcgggtccgcttcagatcgcactagcagcaatccttttagcggtcgtagcgccgggagccacccagggactagaactgatggttag

SEQ ID NO: 30042 - DNA, 3036 bp, Artificial Sequence
  Description of Artificial Sequence: Synthetic coding sequence
atggaaacatctagcatgctctcctccctgaatgatgagtgtaagagtgataactacattgagccccattataaggagtggtaccgcgttgcaatagatatcctgatcgagcacggtctggaggcttatcaggagttccttgtgcaagagcgggtttctgactttctggctgaggaggaaattaactatattctgaaaaacgtgcagaaggtggctcaatccaccgcccatggaaccgacgacagctgcgatgatacactaagttctgggacctattggccggtcgagtctgatgtggaggcccccaatctcgatctgggctggccctacgtgatgcctgggctgctggggggtacccacatagacttactgttccatcccccacgcgcccacttgctaaccatcaaggaaacaattcgcaaaatgatcaaggaggcccggaaggtgattgccctagtaatggacatttttactgacgtggacatattcaaggaaatagtggaggcgtctacaagaggggtgagtgtttatattcttttggacgaaagcaactttaaccacttcttaaatatgacagagaaacaggggtgctccgtgcagagattgcggaatatccgtgtgcgtactgtgaaggggcaggattatttaagtaaaactggcgcgaagttccacggcaagatggagcagaaatttctgctcgtggactgccaaaaagttatgtatggatcctacagctatatgtggtctttcgagaaggcacacctgtccatggtgcagatcattacaggacagctcgtggagagctttgatgaggaattccggactctatacgcacgcagttgtgtacctagctcattcgctcaagaagaaagtgctagagtcaagcacggcaaggctctttgggagaatggcacataccaacactctgtcagtagtttagccagcgtatcaagtcagcgcaacctgtttgggaggcaagacaaaattcataagctggactcttcttatttcaaaaaccgcggcatttacaccctcaatgaacacgataagtataacattaggtctcacggctacaaaccccatttcgtgccaaactttaacggcccaaacgctatcaggcagtttcagccaaatcaaattaatgaaaattggaagcggcattcctacgctggggagcagcctgaaaccgtgccttaccttcttctgaaccgcgccctgaacagaacgaataacccgccaggaaattggaaaaagccctccgactccctgtctgtcgcaagttcttctagagagggatatgtatctcaccataatacaccagcccaatcatttgccaatcgcctggcccaacgcaagactactaacttagctgataggaacagcaacgttcggcggagctttaatggaaccgacaaccatatccgtttcctgcagcagcgcatgcctactctagagcacacaaccaagtccttcctccggaattggcggatcgagagctacctaaacgaccactcggaggcaacgcccgactccaatgggagtgctttgggggacagattcgagggctatgacaatcctgagaatctgaaggccaatgccctgtacacccactcaagattaaggtccagcctggtattcaaacccacacttcccgagcaaaaagaagtgaattcttgtacaacggggagttcaaacagcacgatcatcgggtcccaaggatctgagaccccaaaagaggtgccagacacccccacaaatgtccagcacctgacggataaaccacttcctgaaagcatcccaaagcttccccttcagtcagaagcccccaagatgcacaccctgcaggtacccgagaatcatagcgtggcattgaaccaaactacgaacggacatacagaaagtaataattacatttacaaaactctcggtgttaacaaacagactgaaaatctgaagaaccagcagaccgaaaatctattaaagaggcgctcctttcccctgttcgataattccaaagctaacctcgatccaggcaattccaagcactatgtttacagcaccctcactcggaatcgagtcagacaaccggagaagcctaaagaggatctcttaaaatcaagcaagtcgatgcacaacgttacccataacttggaagaagacgaggaagaggtgacaaagcgaaactccccctccggcaccacgactaaaagcgtctccattgcagctctcttagacgtcaacaaggaagagtccaacaaggagctggcttctaagaaagaagtgaagggctctccttcttttttgaaaaagggcagtcagaagttaaggtcccttttgtctctgactcccgacaagaaagagaacctttcaaaaaacaaggcacccgcattttatcgactttgtagctcatccgacacacttgtgtccgaaggtgaagaaaatcagaagcctaagaaaagcgataccaaggtggactcctctcctcgcaggaagcacagttccagctccaattcccagggttccattcataaatctaaagaggatgttacggtgtcaccttctcaggaaattaatgcaccacccgatgagaataagagaaccccatctcctggtcccgttgaaagtaagttcctggaaagagccggggacgcatcagctcctagattcaacaccgagcaaatccagtatcgtgactccagagaaattaatgcagtggtcacacctgagcgcaggcctacttcttccccccgaccgaccagtagcgaacttctgcggtctcattctacagacaggcgagtctactccagatttgagcctttttgcaagatagaaagtagcatacagcctacaagcaatatgcccaataccagtattaaccggcctgagatcaaatcagctactatgggtaattcttatggacggtcaagcccgctgctcaactacaacacaggcgtgtatcggtcttatcagcccaatgaaaacaaattccggggtttcatgcaaaaattcggcaacttcattcataaaaataagtag

SEQ ID NO: 30043 - DNA, 2244 bp, Artificial Sequence
  Description of Artificial Sequence: Synthetic coding sequence
atgtttggtgggcctgggcctggcgtgctcggcgcccagggcatggcgggacccctcagaggccgggtcgaggagctcaagctaccttggtggcgcgagagctcacctttggtgctaaggcactctgaagccgctcgtttggctgcagatgcgcttctggaacgtggggaggccgcttaccttagagtcatttccgaggagcgggagctcccctttctaagcgctctggacgtggactatatgactagccacgtgagggggggtcctgaacttagtgaagcccagggccaagaggcctcaggccccgatcgccttagcttgctttccgaagtcacttcaggtacatattttcccatggcctctgatatcgaccctcccgatctcgacctgggatggcctgaagtgcctcaggcaacaggtttcagcccaactcaggccgtggttcacttccagcgagataaggctaagaatatcaaggatcttctgcgcttcctgttctcacaagcacacacagtggtggcagttgtgatggacattttcaccgacatggaactgctgtgtgatctcatggaagcttcaagcaggcggggagtgcccgtgtatttacttttagcccaagagcaccttcgacattttctagaaatgtgctataaaatggatttaaatggggaacaccttcccaacatgcgcgtgcggtcaacatgtggcgacacctactgtagcaaggccgggagaagatttacgggtcaggctctcgagaagttcgtgcttatcgactgcgaacaggtggtggccggctcttactcgtttacttggctgtgcagccaggcccatacgtccatggtcctccaactgagaggaagaattgtcgaggatttcgaccgggaatttaggtgtctatacgccgaaagtcagcctgtcgaagggttctgcggaggcgaggatcctctgagcccccgtgccttgcgtcctccacccgtggctctggccttccgtcccgacgtaccgtcacctacttcttccttgccatccagtacctctctgtcatcaatcaagcagtctcccctgatgggccggtcctcatatctggccctaccggggggcggggattgtagcgatacaggggttgtttcttccagtctaggaccggccagaagagaggcctcaggacagcccagtctgcaccgtcagctgagtgacccaaaccacggttccccgcctggcttatatcgggcaaatctgggaaaattgggggcctatccctggtcacagtctagtcccgccttgaatcacaactcaacctcgcctttgacattggccgtaggaagtccacttctgccccgttcgcggcctttacttcagtttcaccgcggggcgcccgcactctcccgattccccgaaaatggcctgccaggctcgcaagaaccgagcccgctccgcggccggtgggtacctggtaccactttggaaactgtggaggagaaggagaagaaggccagcccgtcccagagcagaggtcagctggatcttctggtgccctttcctcgcgctcgtgaagtcggcgacccagattcgggcgtcaccccaaacagtgggcctttgcggccaggagaacaggctccagaagataggcgactgtcccctagccaagctgattcacagctggacctgctctcccgggcgctgggcactggaggcgcacctgagttaggttcactgagaccaggggaccgcgcactggaggatcgaaggctctcactgaatcagtctagggggcagtccgatcttttaatgcagtacccgaaggcccaagggtctcgcgttccacttgaaacgaactccagcgcacggccggcacgtcgagcaccggacgagcgtcgtcagactcttggacattcacagctggaccttatcaccaagttcggacccttccgaggcgaagggccaggccccaacggccttccgatttctagtcctgcacgtacagcaggcgccgggagcggagatgagaagcgtctgactctcggccattccaagctcgatctgatcacaaaataccatcagcttcatggcgcaaggcagggcaccgagccaggaggccccaaggggggccaccttaacggcggtaatagcgatctggtgagggacgaaaagaggctgaccttggggcactccaaactggacctaattacaaagtacaataaatctaaattcaaacagctgaggtctcgcttcgagagttag

SEQ ID NO: 30044 - DNA, 1437 bp, Artificial Sequence
  Description of Artificial Sequence: Synthetic coding sequence
atggccgctagccagttggcagcattagaaggcgtcgacagcgggccgcgcgtcccaggagcatcaccaggattcctctatagtgagggccagagattggctctggaggccctgttaagcaaaggagccgaggcctttcagacctgtgttcagcgtgaggagctgtggcccttcctgtccgccgacgaagtgcagggactggccgccgccgcagaggactggactgtcgcaaagcaggagccatctggaatggccgagggggcaaccactaccgacgtcgacgccggcagtctgtcatattggccaggtcaatccgaacaacctgctccagtgctccgccttgggtggcctgtagactcggcttggaaggggatcacccgcgcacagttatatacacagcctcctggagaggggcaaccgcctctgaaggagctggtgcgtctggaaatccaggctgctcataagttagtggcggtagtgatggacgtcttcacagaccctgacttgctcctcgatctggtggatgccgctacacgcagatgggtgccagtgtacctgctgctagaccggcaacagcttcctgcgtttctggaactcgctcagcagctcggtgtaaacccatggaacactgagaacgtggacgtcagagtcgtgcgtggctgtagctttcagagccggtggcggagacaagtcagcggcacggtgagggagaaattcgtgctgttagatggagaacgtgttattagcggctcgtatagctttacctggtccgacgcccgactgcaccgcggacttgtcacactcctcactggggagatagtggacgcattctctctcgagtttcggacattatatgctgcttcatgtcctctccccccagccccccctcagaaacctagcgtaattggagggctgcaacggggtaggtcacctcaccgcgtttcccggcgtcgaagcgtcgcccccgctagccctccaccccctgacgggcctttagcccaccggctggccgcctgcagagtgtcaccagccacacccggtcctgctctgtcagatatactgcgaagtgtccaaagagcccggactccctcgggaccccctgctagacccagtcgcagcatgtgggatctgtccaggctctcccaactgagtggatctagtgacggggataatgaactgaagaagagctggggtagcaaggacacgcccgcgaaggcgctgatgcgacagagaggcactggcggcgggccatggggggaggttgatagcaggcccccatggggcggcgccctccccctgccccctgcccataggctgagatacttgtcaccagcccggaggaggttcggcggggacgccacgttcaaactccaggaacccaggggcgtgagacctagcgattgggcaccgagggccggactcggaggtcagccctag

SEQ ID NO: 30045 - DNA, 1503 bp, Artificial Sequence
  Description of Artificial Sequence: Synthetic coding sequence
atggctgaatcacagctgaattgtttagacgaggctcatgtaaatgagaaggtaacagaggcccaggccgcattttattactgtgagagacggagggcagcattggaagctcttctgggggggggagagcaggcgtacagggagcgtctgaaagaggagcagttgcgcgatttcctgagctccccagaaaggcaggcattgagggccgcctggtctccttacgaggatgctgtccctgctgccaacgccaggggtaaaagcaaagccaaggcgaaagcacctgcgccagcccctgccgaatccggcgaaagtctcgcatactggcctgatagatccgacactgaagtgcctcctctggatttggggtggactgatacggggttttataggggggttagtcgtgtcactttatttacccacccaccaaaggacgagaaagcgcctcacctcaaacaagttgtccgccagatgatccaacaagcccagaaagtgatagctgtggtcatggacctgttcacagatggcgatatcttccaagacatcgtggacgctgcatgtaagcggcgggtgcctgtctatataatactggatgaggcgggcgtaaagtactttcttgagatgtgccaggacttgcagctgacagactttagaatccggaacatccgcgttcggtctgtcactggtgtcggcttttacatgcctatggggcggatcaaggggacattgagttccagatttttgatggtggacggggacaaggtggcaactggatcataccgattcacttggtctagttcccatgtagatcgtaacttgcttctactgttgaccgggcagaatgtcgagcctttcgatacagagttcagggagctgtacgctatttctgaagaggtggatttgtataggcaactgtcattagccggacgcgttgggctccactacagttctacagttgccaggaagcttatcaatcccaagtacgccctagtttctggatgtaggcacccaccaggtgaaatgatgcggtgggcagcccggcagcagagggaagccgggggaaatccagaggggcaggaggagggggcatccgggggggagtccgcctggcggctcgagagctttctgaaagatttggttaccgttgaacaggtgcttccgcctgtcgagcccatccctctgggagaactgtctcagaaagatggaagaatggtatcacatatgcatcgtgatctcaaaccaaaaagccgggaggccccctccaggaacggcatgggtgaagctgcccggggagaggcagcgcctgctaggaggtttagttcaaggctgttctccagacgggccaagaggcctgcagcacccaacgggatggctagttctgtgtcgactgagacttcagaggtggagtttctgacaggaaagagaccgaatgagaactcatctgctgacatcagcggtaaaacaagcccctcatctgccaaaccttcaaactgtgtgataagttag

SEQ ID NO: 30046 - DNA, 2472 bp, Artificial Sequence
  Description of Artificial Sequence: Synthetic coding sequence
atggctttcagtcaagtgcagtgtctggatgacaatcacgttaactggagaagctccgaaagcaagcccgaattcttctactccgaagaacaacggctggccctcgaagcactcgtagctaggggtagggatgcattttatgaagtgctgaaacgtgagaatatccgcgactttctgtccgagcttgagcttaagaggatactggaaacgattgaggtgtacgatcctgggtccgaggatccccgaggcacaggcccaagccaggggccagaggataatggcgtgggcgatggcgaagaagcctccggagccgacggggtacccattgaggccgaacccctgccttctctggagtactggccccagaagtcagatagatcgatccctcagctggatctggggtggcccgacaccatcgcttacagaggggtgacccgggcaagcgtgtatatgcagccaccaatcgacggccaggcccacatcaaggaggtggttaggaagatgatatcccaggctcagaaagtgattgcagtggtgatggacatgtttaccgacgtggacattttcaaggacctgcttgacgccggctttaagcggaaagtggccgtctatattatcgtggatgagagcaatgttaagtatttcctgcacatgtgtgagcgtgcttgtatgcatctcggccaccttaagaatctgagggtgcgtagttccggcggaacagagttcttcacgcggtccgctacaaaatttaaaggcgctttggctcagaaattcatgttcgtcgatggcgaccgggcagtctgcggatcttactcattcacatggtcagctgcaagaaccgaccggaatgtgattagcgttttatccggccaggtcgtcgaaatgtttgatcgacagttccaggagctttatctcatgtcacactccgtgtctcttaaggggatcccaatggaaaaggaaccggaacctgaacccatagtcctcccctctgtggtgcctctggttccggctggcactgtcgcgaaaaaactcgtgaaccccaaatacgccctggtgaaagcaaagtccgtggatgagatcgccaaaatctccagcgaaaaacaggaggctaaaaaaccactcggcctaaagggtcctgctctcgccgaacacccaggggagctccctgagctgctgcctcccatccaccctggccttctgcatcttgagcgcgcaaatatgtttgagtaccttccgacatgggttgaacctgatccggaaccagggtctgatatcttgggatacatcaacatcattgatcctaacatatggaatccacagcccagtcagatgaatcggatcaagatcagggacacctcacaggcttcagcgcaacatcagctctggaagcaaagtcaggacagccggccaaggcctgaaccctgtccacctccggagccaagcgctcctcaggacggtgttccagccgaaaacggcttaccacaaggcgaccctgagccactgcccccagtgcctaagcctcgcactgtgccagtggctgacgtcttagccagggacagtagtgatatcggctgggtcctagaactgccgaaagaagaagctccgcagaacggcaccgaccacaggctgcctagaatggctggtccgggacatgctccgctccagagacagctgtctgtgactcaggatgatcccgaaagtctaggggtgggactgcccaacgggctggacggcgttgaggaggaagacgatgacgattacgtcactctcagcgaccaagacagccattcagggtcctctggccgcggccctggacctagacgtcccagcgtggccagtagcgtatctgaagagtactttgaagtgagggagcacagtgttcccctccgccgtcgccatagcgagcaggtcgccaatggcccgaccccccccccccgaaggcagctgtccgcaccacacatcacccgcgggacattcgttggaccgcagggggggagcccttgggctcagtcccggggcagggaagaggcggatgccctcaaacgaatgcaggctcagaggagcaccgacaaagaagcccagggacagcagtttcaccaccatcgagttcccgcctcaggcaccagagataaggatgggttccccggccccccaagatatagaagcgcagcagattctgtgcagtctagcaccagaaacgccggacctgccatggccggcccacatcattggcaggctaaaggcggccaggtgccgagactgctaccagatcctgggtccccgagactggctcagaatgctcgtccaatgactgacgggagggcaaccgaagaacaccccagtcccttcgggatcccctactctaaattgagccagagtaagcatctgaaagcccgcacaggcggctcccagtgggcctcttccgactcgaaacgcagagcccaggctcccagggacaggaaagatccctag

SEQ ID NO: 30047 - DNA, 2472 bp, Artificial Sequence
  Description of Artificial Sequence: Synthetic coding sequence
atggcctttagtcaagtgcaatgcctggacgataatcacgtaaattggaggtcatcagagagcaaacccgaattcttttactctgaggaacagcgactcgccttagaggcgctcgtcgcgagggggagggacgccttctatgaagtcttgaaacgggaaaacatccgcgactttcttagcgaactggaactgaaaagaatacttgaaactatcgaggtgtatgacccaggaagcgaagacccgcgggggaccggtccttcacagggccccgaagataacggggtgggcgacggagaggaagcaagcggggccgacggagtcccaatcgaggctgagccactgcctagcctggagtactggccgcaaaagtcagatcggagcattcctcagctggatctcggctggcctgataccattgcctatagaggcgtaactcgagcgtccgtgtacatgcagccacctatcgacggccaggcccacatcaaagaggtagtgagaaaaatgatttcccaagcccagaaagtgatcgcagtagtcatggacatgttcaccgatgttgacatttttaaggacttattagacgctggatttaagagaaaagtcgctgtatacataatagtcgacgagtcaaatgtcaagtacttcctgcacatgtgtgaacgagcctgcatgcacctaggccatttaaaaaatttacgcgttcgaagctctgggggcaccgaattctttactcgctctgctactaaattcaaaggagctctggctcagaaatttatgtttgtcgacggcgatagggccgtgtgtggcagctattctttcacgtggagcgccgccaggacagaccgaaatgtgatctccgtgctcagtggccaggtggtggagatgtttgaccgtcagtttcaggagctgtatctgatgagtcacagcgtctccctcaaaggtattcctatggagaaggagccagaacccgaacctatcgttctgcccagcgtcgtcccactggtacccgcggggacagtggccaagaagctggtgaacccaaagtatgcattggtgaaggcaaagtccgtcgacgagattgccaagatttctagcgaaaagcaggaggccaagaagccacttggcttgaagggccccgctctggctgaacaccccggtgagcttccagagctgctgcccccgatacatcccggcctccttcacttagagcgggctaacatgtttgaatatctccccacttgggtggaacccgacccagaacctgggtccgatattctggggtatatcaacatcatagacccaaatatctggaaccctcaaccttcccagatgaacagaatcaaaattagggacactagtcaggcgagtgcacagcaccaactgtggaagcaatcccaggatagcaggccacgtcctgagccttgtcctccaccagagccgtcagctccgcaggacggggtgcctgcagaaaacggccttccacagggggatcctgaacctctcccaccggttccaaagcccaggactgttcctgtggcagatgtgctcgctagagattcttctgatatcggatgggtgctggaactgccgaaagaagaagcccctcagaacgggaccgaccaccgcttacctcgcatggcaggccccgggcacgctcccctgcagagacagctctcagtcacacaggatgatccagaatctctcggcgtggggcttcccaatggacttgatggggtggaggaagaggatgacgacgattatgtcacattgtccgaccaagattcacattccggatcatctggacgagggcctggcccccgcagaccatcggtcgccagctctgtgtccgaagagtacttcgaggtacgggaacattccgttcctctgcgtcgccgtcattctgaacaggtcgccaacggcccaactccgcctcccagacgtcagctttcggcgccccatatcaccagaggcacctttgtcggaccgcagggtggttcaccgtgggcccagtcacgcggtagggaggaagcagatgctctgaaacgcatgcaggcgcagcgctctactgataaagaagcccagggccaacagttccatcaccatcgagtccctgctagtggaacccgagacaaagatggttttccaggacctccaaggtaccggagtgccgcagactcggtgcagagtagcacgagaaacgcaggacctgccatggctggacctcaccactggcaggcaaaaggggggcaggtgccacgactgctgccagaccctggtagcccaaggttggcacagaacgctaggcctatgacagatggcagagccaccgaagaacacccgagcccgtttggcatcccttattcaaagcttagccagtctaaacatctgaaagctcggaccggcggctcacaatgggcctcttctgattccaagcgacgtgcacaagcccctcgcgaccggaaggatccctag

SEQ ID NO: 30048 - DNA, 819 bp, Artificial Sequence
  Description of Artificial Sequence: Synthetic coding sequence
atggcattctcccaggtacagtgcttagacgataatcacgtgaactggaggtccagtgaaagtaaacccgagtttttctactccgaggaacagcgactcgctctagaagctctcgttgctcgcggccgagacgccttctacgaggtgctgaaacgagaaaatatacgggattttctctctgaactggaattaaagcggatcctggagactattgaagtatatgacccgggcagcgaagatccgagggggacaggtcctagtcaaggccctgaggacaacggcgttggcgacggtgaagaggcaagtggcgcagatggagtccctatcgaggccgaacccctgccatctctagaatattggccccaaaaaagcgatcgcagcataccacagttggatctgggatggccagacactatcgcctataggggagttactagagcaagtgtctatatgcaaccccctattgacgggcaagcacacataaaagaggtagtgcgcaaaatgattagccaggcccaaaaggtgatcgccgttgtgatggacatgttcacagacgtggatatttttaaagatctgttagatgccggatttaagagaaaggtggcagtatacatcatagttgatgagtctaatgtgaagtatttcttgcatatgtgtgagagggcatgcatgcacttgggtcatctcaaaaacctgagagtgaggtcctccggtggcacagagttttttacacgaagcgccacaaaattcaaaggcgcactcgctcagaagttcatgtttgtggacggcgatagggccgtgtgtggatcctacagatag

SEQ ID NO: 30049 - DNA, 879 bp, Artificial Sequence
  Description of Artificial Sequence: Synthetic coding sequence
atgggaaatcagctcgacaggatcacccacctgaattacagcgagctgcccaccggggacccaagcgggattgaaaaggacgagctgcgggtgggggtggcttactttttcagtgacgacgaagaggatctggacgagagaggccagcctgacaaatttggagtgaaagctccacccggctgcacgccatgtccagagtcaccttcccgccaccaccaccacctgctgcaccagctagtgttgaacgagactcagttcagcgccttcagaggccaggaatgtattttctctaaggtgtctggaggcccccagggtgccgatctgagtgtttacgcggtcactgcactgcccgccctgtgcgaaccgggcgatcttttggaactcctgtggctgcagcctgcacctgagcctcctgcaccggctcctcattgggcagtctacgtgggaggggggcagattatccacttgcaccagggagaaatccggcaggacagcctctatgaagccggcgcagctaatgttgggcgcgttgtgaacagctggtaccggtataggccgttggtcgccgaactcgtggtacagaacgcttgtggccacctcgggttgaaatctgaggaaatctgttggacaaactcagagagttttgcggcctggtgtcgtttcggcaagagggaattcaaggcgggcggcgaggttcctgccggcacacagccgccccagcagcagtattacctaaaggtgcatctcggggagaataaagtgcatacagccagattccatagcctggaagacctgatccgagagaaacggcgaatcgatgctagtggcaggctgagagtgctgcaggagttggcggacctcgtagacgataaggaatag

SEQ ID NO: 30050 - DNA, 879 bp, Artificial Sequence
  Description of Artificial Sequence: Synthetic coding sequence
atgggaaaccagttggacaggatcacccacttgaattacagtgagctgccaaccggagacccatctggtattgaaaaagatgagctgcgcgtcggcgtcgcttacttcttctctgacgacgaagaagacctcgatgaacgaggacaaccagacaaatttggagttaaagctccaccagggtgcaccccgtgtcccgaatctccatcccggcaccatcaccacctgctgcatcaactggtgctgaatgagactcagtttagcgcgttccgtgggcaggaatgcatcttcagtaaggtaagcggtggcccgcagggagccgacctgagcgtgtatgccgtaacagcccttcctgctctgtgcgagcccggcgatttactcgaactgctgtggctgcagcccgcacctgaaccacccgccccagccccccactgggcggtttacgtgggcgggggacagatcatccacctacatcagggcgaaattaggcaggactctctgtatgaagcaggcgcagcgaatgtcggcagagtggtgaactcctggtacagatatagacccttagtggccgagttggtggtacagaacgcatgtggccatctcggactaaagtccgaggagatctgttggacgaactctgagtcatttgccgcctggtgcagatttggaaagcgcgagttcaaagcaggcggtgaggtgcccgccggaacccagcctccacaacagcagtactacttgaaagtgcatttaggtgaaaacaaagtgcatactgcccggttccattcactcgaggacttgatacgcgaaaagcgccggatcgacgcatctggccgcttgagagtccttcaggagctggccgatctggtagatgacaaagagtag

SEQ ID NO: 30051 - DNA, 1068 bp, Artificial Sequence
  Description of Artificial Sequence: Synthetic coding sequence
atgggcaatcagctggatcggataactcatttgaattactctgaacttccaacaggagacccttctgggatcgagaaggatgagctgagagtgggagtggcttacttcttttcagatgatgaagaggacctggatgagaggggacagccagacaagtttggcgtgaaggcaccccccgggtgtacaccctgccccgagagcccttcaagacatcaccatcacctcctgcaccagctggtcctgaacgagactcagttcagtgcctttcgcggccaggaatgtatattctctaaagtaagcggcggtccgcaaggagcggaccttagtgtgtacgcagttacggctctccctgccctgtgcgaacccggagatctacttgagctgctttggctgcagccggccccggagcctcctgcccctgccccccactggtgggcatcccgagcaaggaggagcgccggtaggaccaggcgagcaagtccgcccggggcagcccttgctagtgggtctagtcggcgcgaggggcgctgcaggcaagcgaggtccccccgaagctcgtcaaccatcagcagatgcacttgggaacgaacccgaagcacccctccagggtttaccgcctggaagacaagctccgcacgttctgctgtgtctaccccggccgccgcctgtgagtgcagtagatccagcccaactagttggacgaccaggtcctcaagactaggtgctgccggaccaagtgcttcacctgcaccaagaagcctaccatttcccgcgcctggtctgcggagccagcgcttcagcacgagcgctccacccaggcatgctcgccctccacctgttgccagagctcgagctgctccaccccaccctcaggcttctggtagaaagtcacaagagctgccccagggcaggaagggagcagccgcaagcgcctggcttactgctactgcagtggtgaccgtgttaggggaccctgcctgcgcctttccactgcggtgtaaacccggtaccgggaagggactgaggggcgagagaacatggccctctcccagggtgcacggtcagtag

SEQ ID NO: 30052 - DNA, 594 bp, Artificial Sequence
  Description of Artificial Sequence: Synthetic coding sequence
atgcacctgttccagtctgaacgctggcctagcgggcgccggcccaagagactgagaggccatagagctgcttccgccctgagaaccaggagacctgctggcgctgccgtggctgctgcaagggccggcgctgccagagctaggccagctctcgggcgtctaagaggtcggagggccgatcaccccccggcgcccagaagggacccccccgggcaacctgaggccggagccgctaatgttggtcgggtcgtgaattcgtggtaccgataccggcctttggtggccgagttggtggtccagaacgcttgtggtcatttaggcctcaaaagtgaagagatatgttggacaaattcagaatcatttgcggcatggtgcaggtttggcaaaagggagtttaaggcaggcggggaggtccccgccgcggccccagcagccgcggtattgagccagggcgcccctggtcgagagcagggacctcaccgctttcactcccttgaggacctaatcagggaaaagcggtaccgaaggcagcgaccccctgcgtccgcaccaggggctagacgcccccgagggcggcaaggcgtggcagcttag

SEQ ID NO: 30053 - DNA, 993 bp, Artificial Sequence
  Description of Artificial Sequence: Synthetic coding sequence
atggcacctgaggagaacgccggcacggagctgctgttgcagtcattcgagaggaggttcctggcagctcgcaccctgcggtccttcccatggcagtctctcgaggccaagctacgggactcgagcgactcggagctgctccgagatatcctgcataagacagttaagcaccctgtttgtgtgaaacaccccccatctgttaagtatgcaaggtgtttcctgtccgagctgataaaaaaacacgaggctgtgcacactgagccacttgatgagctttatgaggcgttggcggagactctcatggccaaggaaagcactcagggacatcggtcgtatttactgccttctgggggctccgtgactctttccgagagtaccgccataatttcctatgggacaactggcctcgtaacttgggacgccgcgctatatttggcagaatgggcgattgaaaaccccgcggtttttacaaatcgaacggtgctggaactggggtctggagctgggctgaccggtctggcgatctgcaagatgtgcagaccccgggcctatatctttagcgattgtcattctagagtcctcgagcaactgcggggaaacgttctactcaatggattaagcctcgaagccgatattactgcaaaacttgattctcctcgagtgacagttgctcagttggattgggacgtcgctaccgtacatcagctctctgcttttcagcccgacgtcgtgatcgccgctgacgtgctctattgtcctgaggcgattatgagcctggtgggcgttctgcgccgcttagctgcatgccgcgagcatcagcgggctcctgaggtctacgtcgcattcactgtacggaatccagagacatgtcagctgttcaccaccgaacttgggcgtgctggaattcggtgggaagtggagccaaggcatgagcaaaaacttttcccgtacgaggagcacctggagatggccatgcttaatcttactctgtag

SEQ ID NO: 30054 - DNA, 891 bp, Artificial Sequence
  Description of Artificial Sequence: Synthetic coding sequence
atggctccggaggagaacgccgggactgagctgctgttgcagagtttcgagcgaaggttcctggctgcccgtacactaaggagcttcccttggcagtccctggaggccaagctccgggattcctctgacagcgaactgttacgcgacatactgcataaaaccgtcaagcatccagtctgtgttaaacacccaccttctgtgaagtatgcccggtgtttcttgtcggagttgatcaaaaagccttctggcggcagcgtaacactctctgaatccacagccattatttcttatggcacgacaggcctggtgacctgggacgccgctctctacctggctgagtgggcaatcgagaacccggctgtgtttacaaatagaacagtgctggaactcggatctggagcagggctgacaggactcgcaatctgcaagatgtgccgaccccgagcttatatcttttccgattgtcactctcgcgtgctcgagcagcttcgtgggaacgtcttactgaacggattgagcttggaagccgacattaccgccaaactagactcacctcgggtaacggttgcacagttggactgggatgtggcaaccgtccaccagctgtctgccttccagcccgacgtggtgatagctgccgacgtcctatactgccccgaggccatcatgtctctggtgggagtgcttcggaggctagctgcatgtcgtgagcaccagagagcgcccgaggtttatgtggcttttacagttagaaacccagagacatgccagctcttcaccacggagctgggtcgtgcaggaatcagatgggaagtggagccgcgtcacgaacagaagcttttcccttacgaggagcatctagaaatggccatgcttaatttgaccttatag

SEQ ID NO: 30055 - DNA, 390 bp, Artificial Sequence
  Description of Artificial Sequence: Synthetic coding sequence
atgccgccaagtaccctgcagaacggaccctcaagaacgaggcaacctagtctcacagatgttctctactgccccgaagcgatcgttagcttagtgggagtccttcagcgacttgctgcttgtcgggaacataagcgggctcccgaagtgtacgtagcttttaccgttcgaaacccagaaacctgccagctgtttactaccgagctgggggaaccccccagacctccaggccccacctggtgcccctcttgcccgtgtcgcacgcccgttgaagtgaaggagctgggagcaggagaaaagcttggttgctctactttaccccattatgccggtaactctggacgagggagaccaggctgggaccagatgggctcagggtcttcaagttag

SEQ ID NO: 30056 - DNA, 462 bp, Artificial Sequence
  Description of Artificial Sequence: Synthetic coding sequence
atggcccccgaggaaaatgcaggaaccgaactcctcctgcagggtttcgagcgaagattcctagccgttcgcactctccgcagcttcccctggcagagcctggaagccaaactccgggactcatctgacagcgagttactgcgggacatcctgcagaagactgtgagacaccctgtctgtgttaagcaccccccctctgtgaagtacgcgtggtgcttcctttctgaactgattaaaaaaagctccggaggtagtgtaactctgagtaaatctacggctattataagccatggtaccaccggcctggtaacctgggatgctgccctgtacctggcagaatgggcaattgagaacccagctgcgtttatcaatagacgcgctgtgttgccaagatcccaccgggttgctggccggggccctgctgaggctggctgtcttccaggagcgcaagccggctcctag

SEQ ID NO: 30057 - DNA, 993 bp, Artificial Sequence
  Description of Artificial Sequence: Synthetic coding sequence
atggcacccgaagaaaatgcggggacagagttgttgttacaaggctttgagagaagatttttggccgttcggacgttacgcagctttccatggcagagtcttgaagccaagctgcgggactccagcgattccgaactgctgcgcgacatacttcagaaaaccgtgcgccacccagtctgcgtaaagcacccaccaagcgtgaagtacgcttggtgttttctgagcgagcttatcaaaaagcatgaggccgtgcataccgaaccgcttgataagctatatgaagtgctgactgaaacactgatggcaaaagaatcaacccaggggcatcggtcctatctgttgtcctccgggggatccgtcaccctgagtaagtctactgccataatctctcatggcacaactggcttagtaacatgggacgccgccctgtatctggcggagtgggccatcgaaaaccccgctgcattcatcaaccgcaccgtcctagaactcggcagtggggccggcttgaccggcctggctatctgtaagatgtgcaggccccgtgcctacatcttttctgacccccactctagggtccttgaacagttgagggggaatgtgttgctgaacggactttccctggaggccgacataacaggaaacctggattcccccagggtgactgtggcacagctggattgggatgtcgcaatggtgcatcagctttcggcattccagccagacgtggtaatagccgccgacgtgctgtattgcccagaggctatcgtaagccttgtgggtgtcctgcagcgtctggctgcctgtagagagcataaacgcgcaccagaggtgtacgtggccttcactgtcagaaatcccgagacatgccagctgttcactactgagttgggcagggacggtatcaggtgggaagcagaggcccaccacgaccagaaacttttcccctacggcgagcatctcgagatggctatgctcaatctgacgctgtag

SEQ ID NO: 30058 - DNA, 891 bp, Artificial Sequence
  Description of Artificial Sequence: Synthetic coding sequence
atggccccggaagaaaacgctgggacagaactacttctgcagggtttcgaaagacgctttctggctgtgcgtacactacgcagttttccatggcagagtctcgaggctaagctcagggacagcagcgactccgaattgctccgcgacatattgcaaaagacggttagacaccctgtgtgtgtgaagcacccaccaagcgtaaagtatgcatggtgtttcctttccgagctcatcaaaaaaagttctggcggctctgtgaccctgtccaagtctacagcaattatttcgcatggcaccactggcttggtaacgtgggacgctgccctctacctggccgaatgggcaatcgaaaatcctgcggccttcataaaccgcactgtgctggagctggggagcggcgctgggttaacggggctggccatctgtaaaatgtgcaggcctagggcttatatcttttccgaccctcactcccgcgttctggagcaattgcgtggaaacgtgcttcttaacggattgagcttagaagccgacatcaccgggaacctggattccccccgagtcactgttgctcagcttgactgggacgtggcaatggtgcatcaattgtctgctttccaacctgacgtcgtgatagctgctgacgtgctgtactgtcccgaagccattgtctctctggtcggtgtcctgcagcggttagcggcatgccgggagcacaagcgagcccctgaagtgtatgtggccttcaccgtgcgcaaccccgaaacctgccagcttttcactacggaactgggcagggatggaatcaggtgggaggccgaagctcatcacgatcagaagctattcccctacggcgagcacctcgaaatggccatgctgaatttaaccctgtag

SEQ ID NO: 30059 - DNA, 462 bp, Artificial Sequence
  Description of Artificial Sequence: Synthetic coding sequence
atggcgccagaggaaaatgccggaaccgagttgcttttacaaggcttcgagcggcggttccttgcagtcaggacacttcggagtttcccctggcagtccctggaggcaaagctgagggacagttctgacagcgaactgctgcgcgacatcctgcaaaagacagtgcgccaccccgtgtgcgtaaagcatcctccctcggtgaagtacgcttggtgttttctcagtgaacttattaagaaaagcagcggagggtccgtcacactctctaagagcactgccataattagccatggaacaacaggactcgttacttgggacgcagctctgtacctcgcagagtgggcaatcgagaacccagctgcttttatcaatcgaagggcagtgttaccaaggagccacagagtggccggcagagggcccgccgaggctggttgcctcccgggtgcccaggccgggagctag

SEQ ID NO: 30060 - DNA, 993 bp, Artificial Sequence
  Description of Artificial Sequence: Synthetic coding sequence
atggccccagaagagaatgccggaacagaacttctgctgcagggcttcgaacgccgctttctggcagtgagaaccctgcgatcctttccctggcagtcgctggaggcgaaactccgggacagctctgacagcgagctgttgagggacatcctgcagaaaacagtcaggcaccccgtgtgcgtgaaacatcccccttctgtgaaatacgcctggtgctttttgagtgagctaattaagaagcatgaagccgttcatactgaaccactggataaactgtacgaggttcttgcagagaccttaatggccaaagaatcgacccaagggcaccggagctatctcctatcgagcggcggctctgtgaccctcagtaagtctacagctatcatcagtcatgggactacgggcctcgtcacatgggacgctgctttgtacctcgccgagtgggccatagagaacccggctgcattcatcaacaggacggtgctggaactcggcagcggggcaggcctgacagggctcgctatctgtaagatgtgtagaccaagagcttacatttttagtgatccccattcccgaattctggaacagctgaggggcaatgtgctgctgaacggcctgtctctggaggcagatataactggtaatctcgactcccctagagttacagttgcccagctggactgggacgtcgccatggtccatcagctatccgcctttcagccagatgtcgtgatcgccgctgacgtgctctattgtcctgaggctatcgtgtcgctggtcggtgttctgcaacgtctggccgcgtgcagggaacacaagcgagcccctgaggtgtacgttgcgttcaccgtccgaaatcctgaaacctgtcagttgttcaccactgagctcggacgcgacggtatcagatgggaggcagaagcccaccacgaccagaagttgttcccgtacggggaacacttggaaatggctatgttgaacctgaccttgtag

SEQ ID NO: 30061 - DNA, 462 bp, Artificial Sequence
  Description of Artificial Sequence: Synthetic coding sequence
atggcccctgaggagaatgctggaactgaattgctactccagggcttcgagcggcgtttcttggctgtgcggacgcttagaagctttccttggcaatcacttgaggccaagttaagagactcaagtgattccgagttactgagagatattctgcagaagacagtgaggcaccccgtctgcgtgaaacatcccccatccgtcaagtacgcgtggtgtttcctgtccgagctcattaagaagtcctcaggaggatccgttaccctaagcaagtccacagcaatcatctcacacgggacgaccggcctggtgacgtgggacgctgccttgtatttggcagaatgggccattgaaaatccagcagcattcatcaacaggagagccgtgctgcctcggtctcacagggtggcaggtagaggtcctgccgaggccggttgtttgcctggagcacaagccggatcgtag

SEQ ID NO: 30062 - DNA, 891 bp, Artificial Sequence
  Description of Artificial Sequence: Synthetic coding sequence
atggcacctgaagagaatgctgggactgagctcctactgcagggattcgaacgacggttcttggccgtaagaacactccgttctttcccttggcagagcctggaagccaagcttcgggattccagcgactccgagctgttaagagatatccttcaaaaaacagtccggcatcctgtttgtgttaaacatcctcctagtgtgaagtacgcgtggtgcttcctctccgagctgattaagaagagctcaggcggctccgtgaccctgtctaagtccactgcaattatctctcatggcaccacaggtctcgtgacctgggacgccgccctttatctggccgagtgggccatagaaaatccggccgctttcatcaacagaacagtacttgagctgggctccggagccggtcttactggactggctatctgtaaaatgtgtaggcctagagcttatattttctcggacccccattccaggatcctggagcagctgagagggaacgtgctgctcaatggcctgtctctggaagcagatatcactggtaacctcgatagcccacgagtcacggtggcccagttggactgggatgtggcgatggtgcatcaactgagcgcctttcagccagatgtggtcattgcagcagatgtgctgtattgtccagaagccatagttagcctggttggcgtgctgcagagactggctgcctgtcgggaacacaaaagagcgccggaagtctatgtagcgttcacagtgaggaacccagaaacttgtcaactgtttaccactgaattaggtcgcgatggtattcgatgggaggccgaggctcatcatgaccaaaaactgttcccctatggggagcacctggagatggcaatgctgaatctcacactctag

SEQ ID NO: 30063 - DNA, 390 bp, Artificial Sequence
  Description of Artificial Sequence: Synthetic coding sequence
atgcctcctagcacactgcagaacggccctagtagaaccagacagccaagtctgaccgatgtgctttactgccctgaagctattgtgagtctcgtgggggtgctgcagaggctggcggcctgcagggaacataaacgggccccggaggtgtatgtcgcttttaccgtgcggaaccctgagacttgccagctctttaccaccgagttaggtgagccaccgcggcctccgggccccacatggtgccctagctgtccttgtcgtacaccagtcgaagtcaaggagcttggggccggggagaaattgggctgttccacacttccacattacgcaggcaatagcggaaggggacgcccaggatgggaccagatgggctccggctcctcaagttag

SEQ ID NO: 30064 - DNA, 888 bp, Artificial Sequence
  Description of Artificial Sequence: Synthetic coding sequence
atggctcccgaggagaatgccggaaccgaacttctgcttcagggcttcgaacgtagattcctggccgtccgaactctcagaagttttccatggcaaagtctggaagctaaactgagagactcttctgattctgagctgctcagagacattctgcaaaaaacggtcagacatcccgtttgtgtgaagcaccccccctctgtgaaatacgcctggtgctttctaagcgagctaatcaagaagagctcaggtgggtcagtcacgctctcgaagagcactgcaatcatttctcacggcaccacaggcctggttacgtgggacgctgcattgtatctcgctgaatgggcaatcgagaatcctgcagccttcatcaaccgcactgttttagaactcggatctggtgcaggccttaccgggctggccatatgtaaaatgtgcaggccaagggcatacatcttttctgacccccattctcgtatcctcgagcagctcagaggtaatgtgcttctgaatggtttgagtctcgaggccgacatcaccggcaatctggacagtcctcgcgtgaccgtggcccagcttgactgggatgtggctatggttcaccagctctctgcatttcagcccgacgtcgtaatcgctgccgacgtgctgtattgccccgaagccatcgtgagcctcgtgggggttttgcagaggctggccgcctgtcgcgagcacaagcgcgctccagaggtctatgtggcctttactgtgcggaatccagagacatgtcaactcttcacaaccgagctcgggcgtgatggaatcaggtgggaggccgaggcgcaccacgaccagaagctctttccctatggagagcatcttgaaatggccatgctgaatctgacatag

SEQ ID NO: 30065 - DNA, 450 bp, Artificial Sequence
  Description of Artificial Sequence: Synthetic coding sequence
atggcccccgaagaaaatgccgggaccgagctgctgctgcaagggtttgaaaggaggttcctcgccgtccgcaccctcagatcttttccctggcagtctctggaggctaagctgcgggactcttctgacagtgaactgctaagagatattctgcagaaaacggttaggcaccctgtctgcgtcaagcaccctcctagcgttaagtatgcctggtgttttttgagcgaactgattaaaaaaagtagcggcgggtccgtaacgctttcaaaaagtaccgcaatcatcagtcatgggaccacggggctagtgacttgggatgccgccttgtacctcgcggaatgggcgatcgagaacccggcggcctttatcaaccgccgtgctgtcctcccacgcagccatagggtcgccgggagagggccagcagaggccggttgcctgcccggcgcatag

SEQ ID NO: 30066 - DNA, 396 bp, Artificial Sequence
  Description of Artificial Sequence: Synthetic coding sequence
atggctccagaagaaaatgcaggatcagagctcctgctgcagtcttttaaacgacgtttccttgctgcacgtgcgttgagaagcttccggtggcagtcactcgaggcaaaattacgcgacagcagcgacagcgagcttttacgcgacatcctccaaaagacatgctgcatagctcagaagcccagctgcagatggtctggctcttgtggcggctggctccctgccggcagcacatcggggctcctcaattcaacctggcccctcccatctgctactcaaagatgtgctagctgttcgccaccatcttatgccggactggggagtgatggcaaaaggaagctcatcatgacgcgaaactgtttccctaccgagagtacttggcgttggcagtcatag

SEQ ID NO: 30067 - DNA, 498 bp, Artificial Sequence
  Description of Artificial Sequence: Synthetic coding sequence
atggcacctgaagagaacgcggggagcgaacttttgctccagagcttcaaaaggcgatttctggctgccagggccctccgctctttccgctggcagtctctcgaagctaagctgagggacagcagtgatagcgagctgcttagggatattctgcagaagcacgaggcggtacataccgaacccctcgacgagctctacgaggtcctggtggaaacattaatggctaaagagagtacccagggccacagaagctacttgctcacttgttgtatcgctcagaaaccaagctgtaggtggtcaggaagctgcggaggctggctccccgctggctccacaagcggcctgctgaattccacttggcccttacccagcgcgactcagagatgcgccagctgcagtcccccatcctacgcaggcctcggctcagacggcaagcgtaagctgatcatgactaggaactgctttcccacggaatccacatggcgctggcaatcctag

SEQ ID NO: 30068 - DNA, 477 bp, Artificial Sequence
  Description of Artificial Sequence: Synthetic coding sequence
atggcccccgaggagaacgccggctcagaactcctgctgcagtcctttaagcgtcgcttcctggccgcaagggctttgcggagctttcgatggcagtccctggaggccaagctccgagattcttctgattctgagctgctgagggatatcctacagaaaacagtcaagcaccctgtgtgtgttaagcaccctccaagtgtgaagtacgccagatgtttcctcagtgaactgatcaaaaagacgtgctgcatcgctcagaagcctagttgtaggtggtctggctcctgtgggggttggctcccagctggatccacgtctggacttctaaactcgacatggcctttgcctagtgccactcagaggtgcgcttcttgctctccacccagctacgctggcctgggtagcgatggtaagcggaaactgatcatgaccagaaactgtttcccgacggagagtacctggaggtggcagagctag

SEQ ID NO: 30069 - DNA, 555 bp, Artificial Sequence
  Description of Artificial Sequence: Synthetic coding sequence
atgtcaggagcaagagccgcccccggagccgccggcaatggggcagtgcgcgggcttagagtcgacggcctaccccctttaccgaaatccctgtccgggctgttgcacagcgcctcagggggcggggcaagcgggggctggaggcacttggaacggctatatgcacagaaatccaggattcaggatgagctatccagaggggggccaggaggcggcggagctagagctgccgcgctgcctgctaaacctcccaatctggacgccgcattagcattgctgagaaaagaaatggtggggctgcgccagttggatatgagtcttttatgccagctgtacagtctttacgagtctatccaggaatacaagggggcctgccaggccgctagctctcccgactgtacatatgctttagagaacggctttttcgacgaggaggaggagtatttccaggaacagaacagcctgcacgatagaagggatcgtggtcccccccgggacctgagcttgcccgtgagctccttgtcaagctccgattggattttggagagcatctag

SEQ ID NO: 30070 - DNA, 531 bp, Artificial Sequence
  Description of Artificial Sequence: Synthetic coding sequence
atgaacggcctgccaagcgcagaggcacctgggggagcagggtgtgccctggcaggtctgccacccctgcctagaggattatctggactcctgaacgccagcggcggatcctggcgcgagttggagagggtgtacagccagaggagtagaattcatgatgagttgtcaagagccgcaagagccccagacgggcctaggcacgctgcaggagcggccaacgccggaccagccgccggcccacggcgccctgtaaacttagacagtgctctggctgcgctgaggaaggagatgctgtggggactctacgaaagcatccaggattataaacacctctgtcaggatctgagtttttgccaagacctaagctcctcgctccactccgactcctcatatccccctgatgctggattaagcgacgacgaagagccccccgatgctagcctgccccctgaccctccacccctcacagtgcctcaaacgcacaacgcacgggatcagtggcttcaggacgcttttcacatcagcctatag

SEQ ID NO: 30071 - DNA, 489 bp, Artificial Sequence
  Description of Artificial Sequence: Synthetic coding sequence
atgaacgggttgccatctgctgaagcgccgggtggagctggctgtgcgttggctgggttacctccattaccgcgcggtcttagtggactcttaaatgcgtctggggggtcctggcgcgagcttgaacgcgtgtacagtcagcgctcccgcgtcgtcctctccacatctacccagcggtggccccgctgtgctcggaggtgttgtcttcaggtgggcctgagacaactcgatatgtccctgttgtgccagctttgggggctttatgagtccatccaggactacaaacatctttgccaggatctcagtttctgccaggacctaagttcgtccttgcatagcgactcatcttacccacccgatgcaggcctgagcgacgacgaggagccgcctgatgcctcattgcccccagatccaccaccgctgactgttcctcaaacccacaatgcacgggaccagtggcttcaggacgcatttcatatctcgctttag

SEQ ID NO: 30072 - DNA, 465 bp, Artificial Sequence
  Description of Artificial Sequence: Synthetic coding sequence
atgaacggcctgccgtccgctgaagctccggggggtgcgggatgtgccttagccgggcttccacctctccctagggggttgtccggtcttctgaatgcaagcggggggagttggagagagttagagagggtgtactcccagcggagccgtatccatgatgagcttagccgtgcggcaagagccccggatggacctaggcacgccgctggcgctgctaatgctggccctgccgccgggccgcgccggcctgttaatcttgatagcgccctggcggctctccggaaagagatgctaagcgcagggggggctgctgctgtcggacatgtgcttgtcgtcccggcggtaggtccggtaagagttaaccccggactgcagactcccgtccccagacctgagctcctgcccgggcccgtcatcctgccgcccttcgggcagttgctcccgacgggctgtgggcctgtctag

SEQ ID NO: 30073 - DNA, 570 bp, Artificial Sequence
  Description of Artificial Sequence: Synthetic coding sequence
atgaacggcttgccatctgcggaggctccggggggcgctggttgcgccctcgcgggactgcccccactaccacgaggactgagtggtcttctcaacgcaagcggtgggtcatggagggagctggagagagtgtactcgcagaggagccgcatccacgatgagctctctcgggctgcgagagccccagatggacctaggcacgcagcaggggccgccaatgccgggccggccgcaggcccacgccggccagtcaacctagactcagcacttgccgcactccggaaagaaatggtgggcctgagacagctggacatgtcactgctgtgccaactttggggattgtatgagagcatacaggattataagcatctgtgccaggacttgagcttttgccaggatctgagctcatccctgcattcagatagcagctaccccccagacgccggactcagcgatgacgaggagccaccagatgccagcctgcccccagatcctccaccattgaccgtgccacagacccacaatgcccgggatcaatggttgcaagatgctttccacatcagcctgtag

SEQ ID NO: 30074 - DNA, 2517 bp, Artificial Sequence
  Description of Artificial Sequence: Synthetic coding sequence
atgaacattgacgttgagttccatatccggcacaactatccgtggaacaagttgcctgctaatgtcagacagtctcttggaaattctcagcgggagtacgaaaagcaggttgtgctgtatagcatccgcaatcagctaagatataggaacaatctcgtcaagcatgtaaagaaggatgaaaggcgatattatgaggaactgctgaagtattctagggaccacctgatgctctacccataccacctgtccgacatcatggtgaaaggtctgaggattacccctttcagctattacaccggcatcatggaggatatcatgaactccgagaagtcttacgactccctgccaaactttaccgccgccgattgccttcgtcttctggggataggtcggaatcagtacatcgacttgatgaatcagtgccgaagctcaaaaaaatttttcaggcggaagaccgccagggatcttctgcccattaagcctgtggagatagccatcgaagcctggtgggtggtccaagccggttatatcactgaagacgatataaaaatatgtactctccctgaaaagtgcgctgtggacaaaattatcgactcaggaccacagctttccggttccctggactacaatgtcgtgcactcactttacaacaaaggctttatttaccttgatgtaccaatcagtgatgatagttgcatagccgtgccaccgctcgagggtttcgtgatgaacagggtgcagggagactactttgagacgttactgtacaagatctttgtgagtattgatgaacataccaatgtggctgagctggcaaatgtcctggaaattgatctgtctctggtgaagaacgccgtttcaatgtactgtcgcctagggtttgcccacaagaagggacaggtgataaatctggatcaattgcacagttcttggaagaatgtcccgtccgtgaaccgtctgaaaagcacactggacccccagaaaatgctcctgtcctgggatggaggagagtccaggtctccggtccaggaggccagctcggcaaccgacacagacacaaatagccaggaggatcccgccgatacggcaagtgtctctagcctgtcgctaagcactggtcacactaaacggattgcctttcttttcgactctactctgactgcctttctcatgatgggaaacttgtcgcctaatttaaaatcccatgcggtgacaatgttcgaggtcggcaagctgtccgatgagagtttggactcatttctcatcgagctggaaaaggtgcagtcgacgggggagggcgaggcgcaacgctacttcgaccacgcgctcaccctacgcaatacaattctcttcctgcggcataataaggatctggttgcccagacagcacagcccgatcaaccaaattacggctttcctttggatttgctgagatgcgagagcctactagggctcgacccagctacttgtagccgggtgcttaacaaaaattacacactgctggtgtctatggctccactgaccaatgagatacggcctgtctcctcctgcactcctcagcacattggacccgcaatccccgaggtgtcaagtgtctggtttaagctgtacatttaccatgtcaccggacagggcccaccatctcttctcttatccaaggggaccagactccgcaagctcccggatattttccaaagctatgacaggcttctcatcacttcatggggccacgatcccggtgtagtgcccacttccaatgttctcaccatgttaaatgatgccctgacccacagcgccgtgttaatacaggggcatggacttcatgggatcggcgaaaccgtgcatgttcctttccctttcgacgaaaccgaacttcagggcgaatttacccgagtcaacatgggcgtgcacaaagctctgcaaattctacggaaccgagtcgatctgcagcacctgtgcggctatgtcacgatgctgaatgcttcctctcaactggccgatcggaagctgagcgatgcttcagatgaacgaggagagcccgacctggccagcggctcagacgtcaacggatccacagaaagttttgagatggtgattgaggaggctactatcgacagcgctaccaaacagacttcaggcgctactaccgaggccgactgggtgccccttgagctatgcttcgggatcccgttgttctccagcgagctcaatcgtaaggtttgccgcaagattgccgctcatggcctctgccgtaaggagagccttcagaacctgcttcattcttcccgcaagctatccctgcaggtgctgaacttcgtgcacagcttccaggaaggagccagtatactggatatccataccgaaccatccttttcaagcctcctgtcacagtcctcgtgtgccgacatgggggtgccccttccagctaagaatcttatctttaaggatggggtgctctctgaatggagcgggcgcagtccaagctctctcctcatcgctaacctgcacctacaatag

SEQ ID NO: 30075 - DNA, 276 bp, Artificial Sequence
  Description of Artificial Sequence: Synthetic coding sequence
atgaatatagacgttgagtttcacattaggcacaattatccatggaataaactacccgccaacgtccggcagtccttgggcaacagccaaagagagtacgagaaacaagttgtgctgtacagtatccgcaatcagctgaggtataggaataatcttgtcaaacatgtaaagaaagacgaacggcgatactatgaagaactgcttaaatatagccgagaccatctgatgctgtatccttatcacctttctgatagcgtgtgttatgtttgcctctag

SEQ ID NO: 30076 - DNA, 819 bp, Artificial Sequence
  Description of Artificial Sequence: Synthetic coding sequence
atgatgcgacgaactctggagaacagaaacgctcagacaaaacagttacaaactgctgtcagtaacgtggaaaagcacttcggtgagctctgccaaatttttgccgcgtacgtgcggaagaccgctcgattgagagacaaggccgacctgcttgtgaacgagatcaatgcttacgcagccaccgagactcctcatctcaaactaggtttgatgaacttcgcggacgaatttgcaaagttgcaggactatcgtcaggccgaggtagaacgccttgaggctaaggtagtggaaccattgaagacttacggaactatagtgaagatgaaacgcgacgatttgaaggctactctcaccgcccggaaccgggaggctaagcagctcacccagctcgagcggaccagacagagaaacccttccgaccggcacgtgatcgcccaagccgaaactgagctccaacgcgccgcaatggacgctagtcgcacctcccggcacctggaagagactattaacaatttcgagcggcagaagatgaaggatatcaaaaccattttcagtgagtttatcactatcgaaatgctgttccatgggaaggcactggaagtgtataccgccgcttatcaaaacatccagaatatcgacgaggacgaagatttggaggtttttcggaattcgctgtacgcccccgactattccagcaggcttgatatcgtcagagctaactctaaaagcccgctccagagaagcttatctgccaagtgcgtttccggcacaggacaacaggaggcaggctgggccgcaacctgccaaacattaatctag

SEQ ID NO: 30077 - DNA, 756 bp, Artificial Sequence
  Description of Artificial Sequence: Synthetic coding sequence
atgatgcggcgaactctggaaaatcggaatgcccagaccaaacaattacagacagccgttagcaacgtggagaagcatttcggcgaactgtgtcagatctttgctgcatatgtgcgcaagacagcaaggctgcgcgacaaggccgatctcctcgttaacgaaattaacgcctatgccgctactgagacaccgcatttaaaactcggcctaatgaacttcgcggatgagttcgcaaagttgcaggactatcggcaggcagaagtggaaagactggaagcaaaggtcgtggaacccctcaaaacatacgggacgatcgttaagatgaagcgtgatgatctcaaagcaacactgactgcacggaatagagaagcaaaacagttgacacagctcgaacggacccgacagaggaacccatctgaccgccacgtgatagcccaagccgagaccgaactccagcgtgctgcaatggatgcctcccgcacttcacggcatttggaggagaccatcaacaacttcgagagacagaagatgaaggacataaaggtgttccgcaattccctttacgcccctgattactcctccagactggacatcgtgcgcgcaaatagcaagagtccgctacaacgaagcctgtcagccaaatgcgtgtccggaactggccaagtgagtacatgtcgactaagaaaagatcagcaggccgaggatgacgaagacgatgaactggatgttaccgaagaagaaaactttctaaaatag

SEQ ID NO: 30078 - DNA, 870 bp, Artificial Sequence
  Description of Artificial Sequence: Synthetic coding sequence
atgatgcgccggacattggaaaacaggaacgcacaaacgaaacaactacagacagccgtaagcaacgtggaaaagcattttggcgaactttgccagatttttgccgcttacgttaggaaaaccgctcggctgcgggacaaggcggacctgctcgttaatgaaattaatgcttacgctgccacagagacgccccatttgaaactagggctcatgaatttcgccgatgagttcgccaagctgcaggactatcgccaggcagaggttgaaaggctcgaggccaaagtagtggaacctctgaaaacctacggcactatagtcaagatgaagcgagatgatctaaaggcgacactcacagccagaaatagagaagccaaacagctgacccaactggagagaactcggcaacggaacccctctgataggcacgttataagtcaggccgagacagagcttcagcgggccgccatggatgcatcaagaacctctcgtcatcttgaggagacaattaacaattttgaacggcagaagatgaaagatatcaagaccatttttagcgaattcatcacaatcgaaatgttgtttcacggaaaagctctggaggtgtacacagcagcctatcagaacatccagaacatagatgaggacgaagatcttgaggtcttccgcaacagcctgtacgctccagactattcttccagattggacatcgtccgcgctaattcaaagagtccactgcagagatctctctccgccaagtgcgtgagcggcacaggtcaagtttcgacatgcaggctgcggaaggatcagcaagcagaggatgatgaagatgacgagctggacgtcaccgaagaggagaacttcctgaaatag

SEQ ID NO: 30079 - DNA, 789 bp, Artificial Sequence
  Description of Artificial Sequence: Synthetic coding sequence
atgatgaggcgaacactcgagaacaggaatgctcaaaccaaacagcttcaaactgccgttagcaacgtggaaaagcactttggagaactgtgccagatcttcgccgcttacgtgcgaaagacagctcgcttacgagacaaagccgatctgcttgtgaacgagatcaatgcatatgccgctacggaaactccgcatctgaagctgggcctgatgaattttgcggacgagtttgctaagctgcaggattacaggcaggccgaagttgagcggttagaagccaaagttgtggagcccttaaagacttatggaaccatcgttaagatgaaacgggacgatctgaaagccacgctgacggctcgaaacagggaggctaaacaactgacacagctggagcgcacccgccagcgcaacccatcggataggcacgtcatcgcacaggcagagaccgagctccaaagggcagctatggacgcaagtaggacatcccgacatcttgaagagactattaataactttgaaagacagaaaatgaaagatataaagactatcttctcggagttcattacaatagaaatgctatttcatggcaaagccttggaggtgtacacggcggcctatcaaaatatacagaatattgatgaggatgaagatctggagaggtggagctttgccatgcttccgcgtctggtcctcaactcctggggctcatctgatcctccagccctggccagccagtctgtgaggttctctgagatcttatgtatgcatcagatcatccatctggtgtag

SEQ ID NO: 30080 - DNA, 309 bp, Artificial Sequence
  Description of Artificial Sequence: Synthetic coding sequence
atgcagagagtgagcgggcttctgtcatggactctgagcagagtgttgtggctcagcggactctcagagccgggagcggcacgacagcctcggatcatggaggagaaggccctcgaagtttacgacctcatccggacgataagggaccccgagaagcctaacaccctggaggagctggaagtcgtctcagaaagttgcgttgaggtccaggagattaatgaagaggagtacctagtgatcatccgttttacaccaactgtcccacattgcagcctggccaccctgatcgtgggcaacttacacttttag

SEQ ID NO: 30081 - DNA, 483 bp, Artificial Sequence
  Description of Artificial Sequence: Synthetic coding sequence
atgcagcgtgtttccgggctgttatcctggacgctctctagagtgttatggctgtcggggctgagcgagcccggagcagcccgacaaccccgtattatggaggagaaggcgctcgaggtgtacgacctaatacgcactattcgcgatcccgagaaaccaaatactttagaggagctcgaggtggtctcagagagctgtgtcgaagtccaggagattaatgaagaggaatacctggttattattcggttcacgccaacagtgcctcactgcagccttgctactctcattggactgtgtctccgggtgaaattgcagagatgcctcccgttcaagcacaagctggaaatttatatttctgaggggacccattcaacagaggaagacatcaataagcagattaatgataaagaacgcgtggccgccgccatggagaacccaaatctgcgggaaatcgtagaacaatgcgtcctggagcccgactag

SEQ ID NO: 30082 - DNA, 309 bp, Artificial Sequence
  Description of Artificial Sequence: Synthetic coding sequence
atgcagagggtatccgggttacttagctggacgcttagtagggttctctggcttagcggtctctcagaaccaggtgctgcacgccagcccaggataatggaggaaaaagctctggaggtgtatgatctcatccggacaatcagggaccccgagaaacccaatactcttgaagagttagaggtcgtctctgagtcctgtgtggaggtccaagagataaatgaggaagagtacctggtcattattagatttacccctacagtgccacactgctctctggcgacactcatcgtcgggaacctacacttctag

SEQ ID NO: 30083 - DNA, 1557 bp, Artificial Sequence
  Description of Artificial Sequence: Synthetic coding sequence
atggaatgtgacttaatggagacagatatcttagaatccctggaagatcttggatataaagggcccctgcttgaagacggagcgctcagtcaggcggtctccgcaggggcttcaagtccagagtttaccaagctttgcgcttggctggtgtctgagttacgggtcctgtgtaaactggaagagaatgtgcaggctaccaactcccccagcgaggccgaggaattccaacttgaagtgtccgggctgttgggggagatgaattgcccatatctgtccctgacctcgggagatgtgacaaagcggctattaatccagaaaaattgtcttctgctgctaacctatctgatctcggagctggaggccgcgagaatgctctgcgtgaacgccccaccgaagaaagcacaagagggcggagggtccgaggttttccaggagctcaagggaatctgcatcgcactggggatgagcaagcctcccgcaaacatcactatgttccagttcttctctggtattgagaagaagctgaaagaaaccctggctaaggtcccgccaaaccacgtgggcaaacctttacttaaaaagcctatgggccccgctcactgggagaaaatagaggccataaatcaagccatcgctaacgagtatgaagttcggagaaaactgcttatcaagcgactggatgtgacagttcagagcttcgggtggtcagaccgcgcaaagagccaaaccgaaaagctggcaaaagtgtatcagcccaagagatccgtcctaagccccaagacaacaatttctgtggcacaccttctcgcagcaagacaggatttaagtaagatcctacgtacgtcttctggtagtattcgggaaaagacagcctgcgccatcaacaaagtgctgatgggacgagtgccagatagaggtggcagaccaaacgagattgagcctcctccccctgagatgcctccttggcaaaagcggcaggacggcccgcagcaacaaaccggaggtcggggaggaggcaggggagggtatgagcactcctcatatgggggccgaggaggtcacgagcagggcggcggtcggggggggaggggaggatacgaccacggcggccgggggggagggcgcggaaacaaacatcaggggggatggaccgatggcggatctggcggcggaggaggatatcaggacgggggctaccgggatagcggcttccagcccggcgggtaccatgggggtcattcatcgggaggttaccagggagggggatatggagggtttcagacaagcagcagctatactggcagtgggtatcagggtggcggctaccagcaggacaatcggtaccaagacgggggccaccacggcgacaggggaggggggaggggcggccggggaggccggggcggccgcggaggacgggcaggccagggagggggttgggggggtaggggctcacagaactatcatcagggaggccagtttgagcagcactttcagcacggcggctaccagtacaatcacagcgggttcgggcaaggcaggcactataccagctag

SEQ ID NO: 30084 - DNA, 1560 bp, Artificial Sequence
  Description of Artificial Sequence: Synthetic coding sequence
atggagtgcgatctgatggagacggatatcctggagagcctggaagatctgggctataagggacccctgctcgaggacggagccctgtcacaggcagtgagcgccggagcaagctctcctgagtttacaaagctgtgcgcctggctggtgtctgaactgcgtgtgctgtgtaagctggaagaaaatgtgcaggccacaaattctccctccgaagccgaggaatttcagctagaagtatctggcctgctgggtgagatgaactgtccgtacctgagcttgacctccggtgatgtgaccaagcgcctcctcatccagaaaaattgcttgctgctgttgacatacttgatatccgagttagaggctgcccggatgttatgcgtgaatgccccacctaagaaggcccaagagggcggaggctcagaggtcttccaggagctgaaagggatatgcatcgccttgggcatgagcaagcctcccgcaaatattactatgttccaattttttagcggaatcgagaagaagaagctgaaagagacactcgcgaaggtgcctcccaatcatgtcggtaaaccgctgctgaagaagccaatgggacccgcccactgggaaaagattgaggcaattaaccaagctattgcaaacgagtacgaagtgagacgaaagcttctcatcaaacgcttagacgtcacggtccagagtttcggctggtcagatagggcgaaatcacaaaccgagaagcttgctaaggtttaccagcccaagcgctcagtactttctcctaagacaacgatttccgtggctcatttattggctgccagacaagacctcagcaagatccttagaacctcatccggcagtatcagggaaaagacagcttgtgccatcaacaaagtacttatgggcagggtgcccgatcggggcggccgcccgaatgagatcgaacctcccccccccgaaatgcccccttggcaaaagcgccaggacggaccccagcagcagaccgggggtcgaggaggcggacgaggagggtatgagcacagctcatatgggggaaggggaggccacgaacaagggggtggtcgggggggtagagggggttacgatcatggaggccgtggcggcggtagggggaacaagcaccagggcggttggacggacgggggctccggcggaggggggggataccaggacgggggctaccgggactcggggtttcagcccggcggctatcatggagggcactcatctggtggctaccagggaggaggttatggtgggttccagaccagtagcagttacactggcagtggctaccaaggcggagggtatcagcaggataacagataccaggatgggggccaccacggcgacagagggggaggaaggggcggacgaggcggccgtggaggccgcggcggaagagcaggccagggcgggggatggggaggaagaggaagccagaactaccatcagggagggcagttcgaacagcactttcaacacggcgggtatcagtataatcatagtggctttggccaggggcggcattatacttcgtag

SEQ ID NO: 30085 - DNA, 972 bp, Artificial Sequence
  Description of Artificial Sequence: Synthetic coding sequence
atgggccccgctcattgggagaaaatagaagccatcaatcaagcaatcgccaacgagtatgaagtgcgacggaaactcctgattaagcgcttagatgtcacagtgcaatcgtttggatggagtgatcgagcaaagtcccagactgagaagctggcgaaggtgtaccagcccaagagatccgtactttcacccaaaaccaccatcagtgtcgctcatctcttggccgcacgacaggacctctccaagatccttaggacatcatcaggcagcattcgcgagaaaacggcctgtgcaatcaataaagttttgatgggaagagtgcctgatagggggggacggccaaatgaaatagaaccccctccccctgagatgccaccttggcagaagcgccaggacgggcctcagcagcaaacagggggacgtggtggggggagaggcggatatgagcattcttcgtacgggggtagaggagggcatgagcagggtggcggcaggggtggcaggggggggtatgaccacggagggcgcggcggcgggcggggtaataaacatcaggggggttggacggacggcggttctgggggaggtggcggctaccaggacggtgggtacagggattccggattccagccagggggctaccacggaggccactcttcgggcggataccaaggagggggctacggtggctttcagacgtctagctcctacacggggtccgggtatcagggaggaggctaccagcaggacaatcggtatcaggatggtggccaccatggcgaccgcgggggcgggcgtgggggtagaggaggacggggcggaagaggagggagggcagggcagggcggcggctggggcggtcgcggaagtcagaactatcaccagggtgggcagtttgaacagcactttcagcacggtgggtaccagtacaaccattccggttttggacagggaaggcactacacctcctag

SEQ ID NO: 30086 - DNA, 1302 bp, Artificial Sequence
  Description of Artificial Sequence: Synthetic coding sequence
atgagaggccccgagccaggcccacagcccactatggaaggggatgtcctggatacactggaagccctcggctacaagggtcccctgctggaggaacaggccctgacaaaagctgctgagggtgggctttcttcccctgaattttcggagctgtgcatctggcttggcagtcagataaagtccctctgcaaccttgaagagagtatcacctccgcagggcgggatgatttagaatcattccagcttgagatatccggatttctgaaagagatggcctgcccgtactcagttcttatcagcggggacatcaaggatcggcttaagaagaaagaagattgcttgaaattgctgttgttcttaagtacagagttgcaggccagtcaaatcttgcagaataagaaacacaaaaatagccaacttgataaaaacagtgaggtctaccaggaggtgcaggcgatgtttgatacattagggatccctaaatctaccacgtccgatattccccacatgttgaaccaggttgagtccaaggtcaaagatattctgtccaaagtccagaaaaatcacgtagggaagccgcttctcaaaatggacctgaactccgaacaagccgagcagctcgaacggattaatgacgcgctctcttgcgaatatgaatgtcgccgaaggatgctgatgaaaagactcgatgtgacagtccaaagcttcggttggagcgatcgggccaaggttaagaccgatgatattgcacgaatctatcagcctaagcgctatgccctgtcaccaaagaccacaataactatggcccacctgttggccgcaagggaggatctgagcaaaatcattcggactagcagtggaacatcaagggagaaaacagcgtgcgctattaacaaggtgcttatgggcagggtccccgacagaggggggaggcccaatgagatcgagccccctccacccgagatgccgccttggcaaaagcgtcaggagggaggtggtggccgcggaggatggggaggtggaggaggtggcggcggccgcggtggagggggtggcggcggaggaagggggggatggggaggaggaggcggtggatggggtggcggaggagggggaggaggaggttggggcggcggaggaggcggcggcagaggaggcttccaaggacgcggtgattatggaggccgcggcggttatggcgggcggggtggctacggtggccgtggctacggtgacccctacggcggaggcggaggaggtggcggaggtggcggaggcgggggcgggtaccgccgttactag

SEQ ID NO: 30087 - DNA, 993 bp, Artificial Sequence
  Description of Artificial Sequence: Synthetic coding sequence
atgaggggacctgagcccggacctcagcccaccatggagggggacgttctggacaccctggaggccttaggttataaggggccacttcttgaggaacaggccctgacgaaagccgctgaaggaggtctgtcctcacctgaattctctgagctatgtatttggcttggctctcaaataaagtccctgtgcaatttggaagagtccatcacgagcgccggcagggatgacctggagtcattccagctagagatttcaggtttcttgaaggagatggcttgtccctattcagtgctgatctccggggacataaaggacaggctgaaaaaaaaagaggactgccttaagctcctgctttttctttcaaccgagctgcaggccagtcaaatcctccaaaacaagaagcataagaattcccagctggataagaacagtgaggtgtatcaagaggtacaagcgatgttcgacacccttggtatcccgaagtccaccacttctgacattcctcacatgttaaatcaggttgaatcgaaagtcaaggatattctttcgaaggtccagaagaatcatgtcgggaagcctctcctcaagatggacctgaatagcgaacaagcagagcagctggagcgcattaatgacgctctttcttgcgaatacgagtgcagaaggaggatgctgatgaaacggctggacgttaccgtgcaatcattcggttggtctgaccgcgctaaggtgaagaccgacgatattgcacgtatttatcagcctaagaggtacgccctcagcccgaagacaaccatcaccatggcccacttgttggccgcacgggaggacctgtccaaaatcatccggacctcaagcggaaccagtcgggaaaagactgcttgtgccatcaacaaggtcggtgtgtctttctctaccgtggaaaacgaattgatgatcagctacctgatgttcttgcagatcctggtgtatttttcctttatgtcttggtag

SEQ ID NO: 30088 - DNA, 549 bp, Artificial Sequence
  Description of Artificial Sequence: Synthetic coding sequence
atgatgcaagaaagtcccgaccccgaggatgacgagacaccaacacaatctgaccggctttctatgctgtctcaagaaattcagacccttaagaggtctagcacaggcagctacgaggagcgggtcaagagactgagcgtgtccgagctcaacgaaatcttggaggagatagagacggccattaaggagtacagcgaggagttagttcagcaacttgctcttcgcgatgaactggagtttgagaaagaggtaaagaatagcttcataagtgtgctgatagaagttcagaataagcagaaagaacacaaggagaccgcaaagaagaaaaaaaagctgaagaacggctctagtcagaatggtaagaacgagcgcagccatatgcccgggacatacttaacaactgtcatcccatatgagaagaaaaatggaccccccagcgtggaggatttacagattctcacaaagatcctgagagccatgaaagaagacagtgaaaaggtgccatcccttctgactgattatattctcaaggtgctctgccctacgtag

SEQ ID NO: 30089 - DNA, 1062 bp, Artificial Sequence
  Description of Artificial Sequence: Synthetic coding sequence
atggccgctgacggcgattggcaagatttctacgagtttcaggagcccgccaggtccttgttggatcaggagaactgtaatgcaagccccgagccaggtgcggaagcgggcgccgaggccgggggaggagccgatggcttcccggccccagcatgcagcctggaagaaaaattgtctctgtgtttcagaccgtccgaccctggcgctgaaccccccaggacagccgtccgtcccataacggagagatctcttctgcaaggggacgagatttggaacgctctgacagataactacggcaatgtaatgcctgtggattggaaatcttcacacacgaggacactgcatcttctgaccctgaaccttagcgaaaagggggtttccgattctctgctcttcgacacttccgacgacgaagagctcagggaacagctcgacatgcacagcattattgtcagttgcgtaaacgacgaaccgctgtttacagcggatcaggtcatagaggaaattgaagaaatgatgcaggagagtccagatcctgaggatgacgaaactccaacccagtccgatagattaagcatgttatctcaagagattcagactctcaagcgctcttctaccggatcatacgaggaaagggtgaagcgcttatctgtgagtgagctaaatgagatcttggaggagattgagacggccatcaaggagtatagcgaagagctggttcagcaacttgctttgcgagacgagcttgagtttgagaaggaggtgaagaactctttcatttcagtgttgatcgaagtgcaaaataagcagaaggaacataaagagacagcgaaaaaaaagaagaaattgaaaaacgggtcttcccagaatggaaagaatgaacgttcacacatgccagggacatacttaacaacagtgatcccgtatgagaaaaaaaacggccctccttctgttgaggatttgcagattctgacgaagatcctacgggccatgaaggaagacagtgaaaaagtgccatctctcttaactgattacatcctcaaggtgttgtgccccacatag

SEQ ID NO: 30090 - DNA, 1143 bp, Artificial Sequence
  Description of Artificial Sequence: Synthetic coding sequence
atggcagccgatggtgactggcaggacttctatgagtttcaggagcctgcaagatcattgctcgaccaggaaaattgcaatgcctctcccgagcccggtgccgaggcgggtgccgaggcgggcggtggtgcagatggatttcccgcccctgcatgttccctggaggagaagctttctttgtgttttagacccagcgatccaggagccgaaccccccaggactgccgttagacctattacagagagaagcctgttacagggcgatgagatctggaatgctctgaccgacaattatggcaacgttatgccagtggattggaaatccagtcacaccaggacccttcacctcctgaccctgaacctgagtgagaagggggttagtgacagcctgctctttgatacatcagacgacgaagaactcagagaacagctcgatatgcattcaatcatagtgtcttgcgtgaacgatgagcccctgtttactgccgatcaggttatcgaggagatcgaagaaatgatgcaggagagccctgacccagaggatgacgaaacccccacacagagcgaccgattgagcatgctgtcccaggagatccagaccctcaagagatcctcaactggttcgtacgaggagagggtgaaacgactttctgttagcgagctcaatgagatactggaggaaattgaaaccgctattaaggagtactctgaagaacttgttcagcaactcgcattgcgcgacgaacttgagttcgagaaagaagtgaaaaattcgtttatctcagtgctgatagaagttcagaataagcagaaggaacataaggagactgcgaaaaagaaaaagaagctgaaaaacgggtcctcccaaaacggaaagaatgagagaagtcacatgccaggcacccgcttctcgatggaggggatttccaatgtaattcagaatggactgcgacacacgttcggtaatagtggaggcgaaaagcagtatctgacaacagtgattccttacgagaagaaaaacgggcctccttcagtcgaagacctacagattctgacaaaaatcctccgtgcaatgaaagaagattcagagaaagtgccatccctgctgacagactatatcctgaaggtgctttgccctacctag

SEQ ID NO: 30091 - DNA, 423 bp, Artificial Sequence
  Description of Artificial Sequence: Synthetic coding sequence
atgatcgaccagttgcaggggacttggaaatcaataagctgcgaaaattcagaggattatatgaaagaactagggatagggagagccagtagaaagctgggcagattggccaagccaacggtgaccattagcactgatggcgacgtgatcaccatcaagactaagagcatattcaagaataacgaaatctcttttaaattgggggaggaatttgaagaaatcaccccaggcgggcacaagaccaaatccaaagttacactggataaggagagcttaatccaagtccaagactgggatgggaaagagacaacaataacccggaagctggttgacgggaaaatggttgtggaatcaactgttaactcagtgatttgcacaagaacgtatgaaaaggtgtcctcaaactccgtgtccaactcgtag

SEQ ID NO: 30092 - DNA, 2208 bp, Artificial Sequence
  Description of Artificial Sequence: Synthetic coding sequence
atgacccccgagcttatgattaaagcgtgctctttttacacagggcatcttgtgaaaacccatttttgcacatggagagacatcgcaaggaccaatgagaacgtggtgctagcagagaagatgaatcgggcggtgacgtgttataacttcaggctgcagaagagtgtgttccaccattggcatagctatatggaggaccagaaggagaagctaaagaatatcctgttgcgaattcagcagataatttactgccacaagctgactataatactgaccaagtggcgaaatactgccagacataaatctaagaagaaggaggatgaactcatactgaaacatgagctgcagctcaagaagtggaagaaccgactcatactgaagagggctgccgccgaagaaagtaatttccctgagagaagttccagcgaagtgtttctggtggatgaaactctgaaatgtgacatctcactgctgcctgaaagggcgatactgcagatattcttttatctgagcctaaaggacgttattatttgcggacaggtaaatcacgcttggatgctaatgacgcagcttaactctctctggaacgcgatagatttctcttctgtgaagaacgtcatccctgacaagtacattgtgtccacattgcagagatggcgtctgaatgtgctgagactgaacttcagaggatgcttactgcggcccaagaccttcaggagtgtgtcccactgtcgtaacctccaagagctgaatgtctcagactgtcccacatttacagacgagagtatgagacatatatccgagggatgtcctggcgtcctctgtctgaacctgagtaacactaccattaccaatcgcaccatgcgattgcttccccgacatttccataacctccaaaatttgtctctggcatattgcaggcgcttcacggataagggtctgcaatacttgaacttgggcaatggatgccacaaactaatttatctggacctgtctgggtgtacacagatctctgtacagggtttccgatatattgctaactcctgtactggaattatgcatctgacgataaacgatatgcctacgctgaccgacaattgcgtgaaggccctggtagagaagtgctcacgcattacgagtctggtgttcactggcgccccccatatttccgattgtacttttcgggctcttagcgcgtgcaagctgcgcaaaatacggtttgagggaaataagcgtgtgactgatgcttcattcaagtttatcgacaagaactatcccaatctcagtcacatctacatggctgactgtaagggtatcactgactcttcgctccgatcactgtctcctctcaagcagttgaccgtgctcaatttggccaattgtgtgcggatcggggacatgggtctcaaacaattcttggacggtcctgcttcaatgaggattagagagctgaacctatctaattgcgttcggctctctgacgctagcgtgatgaagctgtccgaacgatgccctaaccttaattacctcagcctgcgtaattgtgaacacctgactgcacagggtattggatatattgtcaacatcttctctttggtgtccattgatcttagcggcacagacattagcaatgaaggactgaatgtgttgtcccgacacaagaagctcaaggaactgtccgtgagtgaatgctataggataaccgacgacggcatccaagccttttgtaaatcgtccctcattctggaacacctggacgtctcgtactgcagccagctgtcagacatgattatcaaagcactggccatctattgcatcaacctgactagcctgtccattgcgggttgccctaagatcacagacagtgctatggaaatgttgtctgccaagtgccactacctccacatcttggatatctctggatgtgtgctactgactgatcaaatcctcgaggaccttcagattggttgcaagcaactcagaattctgaaaatgcaatactgtaccaacatctctaagaaagccgcacaaagaatgagctccaaagtgcagcaacaggagtacaacaccaatgatccacctcggtggttcggatatgaccgcgaaggcaatcccgtgaccgagttagacaacattacgtcttccaaaggggcacttgaattgactgtcaagaagtccacatatagctctgaggaccaggcggcatag

SEQ ID NO: 30093 - DNA, 1371 bp, Artificial Sequence
  Description of Artificial Sequence: Synthetic coding sequence
atactccttcgaatacagcaaatcatctactgtcataagcttacaatcattctgactaaatggcgcaacaccgctaggcacaagtccaagaagaaggaagacgagttgatactaaaacacgaactccaattaaagaagtggaagaacaggttaattctcaagcgcgcagctgccgaggagagtaatttcccagaaagaagttcctcagaggtgtttctggttgatgaaacactgaaatgcgatatctccctgctccctgaaagggccattctgcagatatttttttacctatcgctgaaggatgttatcatatgtggtcaggttaaccacgcctggatgctgatgacacaactcaactccctatggaacgccatcgatttcagtagcgtgaagaacgttattccggataaatatattgtcagtactttgcaacgctggagactaaatgtgctaagactgaacttccgagggtgcctgctacgccccaagaccttccggtccctcagccctctaaagcagctcaccgtcctcaatcttgctaactgcgtgaggatcggagatatggggctcaaacagtttctggatggtcctgcctccatgcggattagagagttaaacctgtccaattgcgtgaggctgtcagacgcctccgttatgaaactgagtgagaggtgcccgaatctgaactatctgtccctacgcaactgcgagcacctgacagcacaggggatcggatacattgtgaacattttttccctggtttcaatcgatctgagcgggacagacatctccaacgagggtctgaacgtgctctccaggcacaaaaagctgaaggaattaagcgtgagtgaatgctacaggatcaccgatgatgggatccaggccttctgtaaatccagcctcatcttagagcacctcgacgtgtcctattgttcacaactgagcgacatgatcattaaagcactcgccatctactgtataaacctgacctcccttagcattgccgggtgcccaaagatcactgattccgccatggagatgctgagcgccaaatgtcactacttgcacattttggacatttctgggtgcgtgcttctgacggatcagattctggaggatttacaaatcggctgcaaacaactccgtattctgaaaatgcagtattgtactaatatttccaagaaagccgctcaaagaatgagctccaaagtgcaacagcaggagtacaatacaaatgatccgccacgttggtttggatatgaccgggaaggcaatcccgtaacggagctggacaatattacttccagtaagggtgctctggagctaaccgtcaaaaagagcacctactcaagtgaagaccaggcagcttag

SEQ ID NO: 30094 - DNA, 2124 bp, Artificial Sequence
  Description of Artificial Sequence: Synthetic coding sequence
atgactcctgagctgatgattaaagcttgctcattctatactggtcacctggtaaagactcacttctgcacatggagagatatcgccaggaccaacgagaatgtggtgctggctgaaaaaatgaatcgtgcagtcacttgttacaacttccgcctccaaaagtccgtgtttcaccactggcatagctacatggaagaccaaaaagaaaaactgaaaaacatccttctgcggatacagcagataatttattgtcacaaactgacgattatactaacaaagtggcggaacacagctaggcacaagagcaagaagaaagaggatgagcttattttgaagcatgagctgcagttaaagaaatggaaaaatcgcttgattttaaaaagggctgccgcagaggagtccaatttcccggagcggagcagctccgaagttttcctggtggacgaaaccctgaaatgcgacatatcactcctacctgaacgggctatcctccagatttttttctacttatccctgaaggacgtgattatctgtggtcaggttaatcacgcttggatgcttatgacccagctgaacagtctgtggaacgccatcgactttagttccgtcaaaaatgtgatcccagataaatatatagtaagtaccctgcagcgctggcgcctgaatgtgctccggctcaacttccgtggatgtctccttaggcccaagacgttccggtcagtgagtcactgtcgaaatttacaggaactcaatgtgtctgactgccccacatttacagacgaatcaatgcgacacatttctgaaggctgccctggcgtcctgtgcctgaatctatcaaatacaacgataacgaatagaactatgcgtttgctgccaagacacttccacaacctgcagaacctgtctttagcatattgtagaagattcactgacaaaggccttcagtacctcaacctcggcaacggctgccataaactgatttatttagatttgtccggctgcactcaaataagcgtccagggcttccgatacatcgccaacagttgtacgggaatcatgcacttgaccatcaacgatatgcctactttgacggacaactgcgttaaggccttggtagagaaatgctcaaggatcaccagtctggtgttcacaggagccccacatatctccgattgtacatttcgcgctctgagtgcatgtaaactgcggaagattcgatttgagggcaataagagagtgaccgatgcatcctttaagttcatcgataaaaattaccccaacttatcacatatttacatggccgactgcaaaggcatcacggattcatcactacggtcactgtcgcccctgaagcaacttactgtgctgaatctggccaactgcgtgagaattggcgatatgggtttaaagcaatttcttgatggacccgcatcaatgagaatcagggagcttaatctgtccaactgtgtgcgtctaagtgatgcctccgtcatgaagctgagcgagcggtgtccaaatctgaactacctgtcattgcgcaactgtgagcatttgactgctcaagggatcggatatatcgtgaatatattcagcctagtgagcatcgacttgtctgggaccgatatcagtaacgaagctttctgtaagagtagcctgatcctggagcacttggacgtgagctattgctctcagctctccgatatgatcattaaagctctggcgatttattgtattaatttgacctctctaagcatcgctggctgtcccaagattaccgactcagctatggagatgctctcagccaagtgccactatctccacatccttgacattagcggctgtgtgctgctgacggaccagatcttagaggaccttcagatcggctgcaagcagctgagaattctcaagatgcaatattgcactaatatttcgaaaaaggccgctcaaagaatgtcatcaaaagttcagcaacaggaatacaataccaacgatccacccaggtggttcggatatgacagagaaggcaacccggtcaccgagctcgataacatcacgtcatctaagggcgcgctagaattgactgtgaagaaatctacctacagctctgaagaccaggcagcctag

SEQ ID NO: 30095 - DNA, 1362 bp, Artificial Sequence
  Description of Artificial Sequence: Synthetic coding sequence
atgaccccggaacttatgattaaggcctgctccttctacaccggccacttggtaaaaacgcatttctgtacgtggagggacattgcaagaactaacgaaaatgtggtgctcgccgaaaagatgaatcgggccgtcacatgttacaatttccgccttcagaagtctgtgtttcatcattggcattcatacatggaggatcaaaaggaaaagttgaagaacatcttgctgaggatacaacagattatctactgtcacaaattgactataatcctaacaaaatggcgtaacacggcacgacacaagtcaaagaaaaaagaggatgagttaattctgaagcatgaattgcagctgaaaaagtggaaaaaccggttaatcctaaaaagagcggccgcagaagagtctaatttccccgaaagaagttctagcgaggtgtttctcgttgacgagactctgaagtgtgatataagtctccttccggaaagagccattctccagatcttcttctacctctctttaaaggacgtcattatctgtgggcaagtaaatcacgcctggatgctcatgactcagctgaattcactctggaacgcaattgacttctctagcgtgaagaacgtgatccctgacaaatatatagtcagcacactccagcgttggagattgaacgtgctgcgactgaatttccggggttgtctgctccggcccaagacattccgctccgtcagtcactgtcgtaacctacaggagcttaacgttagcgactgccctaccttcaccgatgagtccatgagacacatttccgaggggtgtccaggggtcctctgtctcaacctctcaaatactactatcacaaacagaaccatgaggttgctgcccagacattttcacaacctgcagaatctgtcactcgcatattgcaggaggttcacagataagggactgcagtatctgaatcttggaaatggatgtcataagctcatctacctggatttatcagggtgcacccagatcaccgattccgccatggagatgctctcggcaaaatgccactatctccacatcctcgacatttcaggttgtgttctgctgacagaccagatcttggaagacctgcagatagggtgtaagcagttgcgcatcttaaagatgcagtattgcactaacatctccaagaaggccgcccaacgcatgtctagtaaggtacagcagcaagagtacaatacaaatgatccacctagatggttcggatacgatagggaaggcaaccctgtaactgaactggataatatcacaagttccaagggtgccctggaactgacagtgaagaaatccacctatagctctgaggaccaggccgcgtag

SEQ ID NO: 30096 - DNA, 2073 bp, Artificial Sequence
  Description of Artificial Sequence: Synthetic coding sequence
atgactccagagctcatgattaaggcttgctcattttacactggccatctggtaaagacgcacttctgcacgtggagagatatcgctcgcacaaatgagaatgtagtacttgccgaaaaaatgaaccgagcagtcacatgttacaactttaggctccagaaatcagttttccatcactggcattcttacatggaggaccagaaggaaaagcttaaaaatattttattacggatccagcagatcatatactgccataagctgaccatcatcctcacaaaatggcgcaacacagcccggcataagtcaaaaaagaaagaggatgaactcatcctgaagcacgagctgcaactaaaaaagtggaagaatcgcctcatacttaagagagctgctgcggaggagtctaacttccctgaaaggtcaagttcagaggtgttcttagttgatgaaaccctcaagtgcgacatttcgctactgcctgaacgagccattctgcagatttttttctatctatcactcaaggacgtgatcatttgtggacaggtcaaccacgcctggatgttgatgacacagctcaactccctgtggaacgctatcgacttcagctcagtgaagaatgtgattccagacaagtacattgtgtctaccctccaaagatggcgccttaacgtgctgcggctcaatttcagaggttgtctgctgcgcccgaaaaccttcagaagcgtttctcattgtcgcaatctccaagagctgaacgtgtccgattgcccgacctttacggacgagagtatgaggcatataagtgagggatgcccgggggttctgtgcctaaacttgtctaacacgaccatcacaaaccgtacaatgaggcttttacctcgacattttcataacctacaaaatctttccctggcctactgtcggcgtttcactgataaaggtctgcagtatcttaacctgggcaatggctgtcacaagcttatctatctggacctgtcaggctgcactcagatttccgtgcagggattccggtatatagcaaattcatgtacgggtattatgcatctaactatcaacgacatgcccactctgaccgacaactgcgtcaaagccctggtcgaaaagtgcagtcggataacctccctggtctttaccggggcgccacatatctccgactgcactttccgcgccctttctgcttgtaagctccgcaaaattaggttcgagggaaacaagagggtgacggatgctagtttcaagttcattgacaagaattatcctaacctgtcccatatctatatggctgactgtaagggcatcaccgatagttctctccgtagtttgtccccgctcaagcagctcactgtgctaaacttggcaaactgcgtccggatcggtgatatgggactgaagcagttcctggatggcccagccagtatgcggatcagagagttgaatttaagcaactgcgttcgcctgagcgatgcgtccgttatgaagctttccgaacggtgtcctaatctcaattacctctccctgcggaattgtgagcacctaaccgctcaaggaattggttatatagtgaatatcttttcactagtctcaatagacctgtccggtactgacatctctaacgagggtttaaatgttctgtcgagacataagaagctgaaggagctgagcgtgtcggaatgctatcgtatcaccgacgatggcatccagatcaccgatagcgccatggagatgctcagcgctaaatgccattaccttcacatcttggacatttccggatgtgtcctcctaactgaccagattctggaggatctacaaataggatgcaaacagctgcgaattctgaaaatgcaatactgcaccaacatttcaaaaaaggcggcacagcggatgtctagcaaggtgcagcagcaagaatataatacgaatgacccacctagatggttcgggtatgatcgcgaaggtaatcctgtgactgaattagacaacattacttctagtaaaggggcactggagttgacagtgaaaaagtccacttattcttccgaggaccaggccgcatag

SEQ ID NO: 30097 - DNA, 2124 bp, Artificial Sequence
  Description of Artificial Sequence: Synthetic coding sequence
atgactcctgagttgatgatcaaggcttgctcattctacaccgggcaccttgtgaagacacacttttgcacttggagagacatcgcgcgcaccaatgagaatgtcgtcctcgcggaaaagatgaatcgggctgtaacctgttataatttccggctgcagaagtcagtctttcatcattggcattcatatatggaagaccaaaaggagaaattaaaaaacatccttctcagaattcaacaaattatttattgtcacaaactcactataattcttacaaagtggaggaacaccgctcgccataagagcaagaagaaggaagatgagctcatcctcaagcatgaattgcagttgaagaagtggaaaaacagacttatcctgaaacgcgctgcggccgaagaaagtaacttccccgaacggtcaagcagcgaagtgttcctcgtggatgaaaccctgaagtgcgacatctctttactgccggaacgtgctatactacagatcttcttctacctttccctaaaagatgtcattatatgtggccaagtcaaccatgcctggatgttaatgacacagcttaattcattgtggaacgcaatcgattttagcagtgtgaaaaacgtaattcctgacaagtatatagtgtcgacactccaacgctggcggctgaacgtccttcggctgaacttccggggttgcctgctcagacctaaaactttcaggtctgtgtcacactgccgaaatttgcaggagctgaatgtctcggactgcccgaccttcacagacgagagcatgagacacataagcgagggttgtccaggcgtgctgtgtctgaacttgagtaacacgactatcacaaataggaccatgcgcctgcttccacggcacttccacaatcttcagaacttatccctggcctactgccgtagattcacagacaaaggcctacagtatctgaacttgggcaacggctgccataagctcatctatctcgacctgagcggctgtacacagatcagcgtgcagggcttcagatacatcgcaaacagctgcactggtattatgcaccttacgatcaatgatatgccaacactcaccgacaactgtgttaaggcactcgtcgagaagtgctcccggatcacgagtctggtgttcaccggcgcgccccacatctccgattgcacattccgggccctgtcagcctgtaagttgagaaagatccgctttgaaggaaataagcgggttacagatgccagcttcaagtttatcgacaagaattatccgaacttgtcgcacatctatatggctgactgcaaggggatcacggactcttctcttcggagtctgtctccattgaaacagctcaccgtactcaacctagccaattgcgtgagaatcggtgatatgggcctcaaacagttcctagatgggcccgctagcatgaggatacgcgagcttaatctgagcaattgcgtgcgactgtcagatgcttccgtcatgaagctctctgagcgatgcccaaatctgaattatctcagcctgagaaattgcgaacatcttacagcgcaaggaattggttacatcgtcaacatattcagcctggtgtccatcgacctgagtggcactgacattagtaacgaagccttctgtaagtcctcccttatcttggaacacctggatgtcagctactgctctcagctatcggacatgattattaaggctctggctatttactgtatcaatctgaccagtctgtccattgctggttgcccgaaaatcaccgactcagctatggagatgttgtccgccaaatgtcattacttacacattctcgacatctctggatgcgtattgctcaccgaccagattctggaggatctgcagatcgggtgtaagcagctgagaatcctcaagatgcagtattgtaccaatatatctaaaaaggcagcgcaacgcatgagtagcaaggtgcagcagcaggagtataacacaaacgacccccccagatggtttggttatgatagggagggaaatccagttaccgagctggataatatcacgtcgtctaagggcgcgctggaactgaccgtaaagaagagcacctactcctccgaagaccaggcagcttag

SEQ ID NO: 30098 - DNA, 2208 bp, Artificial Sequence
  Description of Artificial Sequence: Synthetic coding sequence
atgacacccgagctcatgataaaggcatgcagtttttacacaggccatctggtgaagacccacttttgcacctggcgtgatattgctagaacaaacgagaatgtggtgctggccgaaaaaatgaacagggccgttacatgctacaatttcaggctccaaaagtctgtgttccatcactggcactcctatatggaggatcagaaagagaaactcaagaatatactcctgaggatccaacaaataatctattgccataagctgacgataatcctgacgaaatggcgcaacaccgctaggcataagtcaaaaaaaaaggaggacgaactgattttgaaacacgaactgcaattgaaaaagtggaaaaaccggctgattttgaagcgcgctgccgctgaagagtccaattttcctgaaagaagcagttctgaagtattcctggtggacgagacactcaagtgcgacatctcgctcctgcccgaaagggcaatcctgcagatttttttttatttgtccctcaaggatgtaatcatttgcgggcaggtaaatcacgcatggatgctaatgacacaactgaattcactgtggaacgccatcgactttagttccgttaaaaatgttattccagataaatacatcgtatctacattgcagaggtggagactaaatgtcctccggctcaacttccgagggtgtctgctcaggccaaagacctttcggtcggtatcccattgtagaaatctccaggagctgaatgtctctgactgcccaaccttcactgatgaatctatgaggcacatctcggaaggttgtcctggggtgctgtgcctgaatctgtctaacaccactataaccaaccggacaatgagacttcttccaaggcatttccataacctgcagaacctgtcgttggcctactgtagaaggtttaccgacaaaggtctgcaataccttaacttgggcaacgggtgtcataagctgatatatctcgacctgtctggctgcacccagatttcagttcaggggtttagatatattgcaaattcttgcaccggaattatgcatcttacgattaatgacatgcctaccctcaccgataattgcgtgaaggcactagttgagaaatgttctcgtatcacatcgctagtgttcactggcgccccgcatatttcagactgtaccttccgcgcactgagcgcctgcaagctgaggaaaatcaggttcgaaggcaataagagagtaaccgatgcttccttcaaattcatagacaaaaattaccccaatcttagtcatatatacatggctgattgcaaagggatcacggacagctccttgcgctccctgagcccactgaagcagcttaccgtgctcaacctagctaattgcgtgcggatcggggatatgggtctgaagcagtttttggacgggccggcctcgatgaggatcagggaactaaatcttagcaactgtgttcgcttgtcagatgcttccgttatgaagttgagtgagagatgccccaatttaaactacctctccttgcggaattgcgagcatttgacagctcagggaatcggctatattgttaatattttcagtctggtgtctattgacctgagcggaacggatatatctaatgaaggattgaatgtgctgagccggcataagaaactcaaagaacttagtgtgagcgaatgttatcggataaccgatgatgggattcaggccttttgtaagagctcccttatccttgagcacctggacgtgtcgtactgctcccagctgtccgacatgattatcaaagccctcgcaatctactgtatcaacctcacttctctgtccatcgccggctgtccaaaaatcaccgactctgctatggagatgctctcggcgaaatgtcattaccttcatattctcgacatctccggctgcgtactgctcaccgatcagatcttggaagatctccagatcggctgtaagcagctgagaatactgaaaatgcagtactgcaccaacatcagtaaaaaggcggcacaaagaatgtcctccaaggttcagcagcaggagtacaacacaaatgatcccccgcgatggtttggttacgaccgggaagggaatccagtgaccgagctagacaatatcaccagctccaagggagcccttgagctaacggtcaaaaagtccacctacagttcagaagaccaggccgcctag

SEQ ID NO: 30099 - DNA, 2073 bp, Artificial Sequence
  Description of Artificial Sequence: Synthetic coding sequence
atgacaccagaactgatgatcaaagcctgctctttttatacaggacacctggtcaaaacacatttttgtacttggagagacatcgcgcggaccaatgagaatgtggtcctcgccgaaaagatgaatcgggcagtcacatgttacaattttcggttgcagaaatccgtttttcaccactggcactcttatatggaagatcagaaagaaaagctgaagaacatactcctccggatccagcagataatttactgtcataagctgactatcatcctgacgaagtggagaaacacggctaggcacaaatcaaagaaaaaggaagatgagctcatactgaagcacgagttacaactgaagaagtggaaaaacagactgatacttaaaagggcagctgccgaggaatcgaactttcccgagcgtagttcttctgaggttttcctagtagatgagacacttaaatgtgacatttctctgctgccagaacgcgctattctgcagatcttcttctatctgagcctgaaggacgtgattatctgcggccaagtcaatcacgcttggatgctcatgacgcagctcaatagcttgtggaatgcgatcgacttcagtagtgttaaaaatgttatccctgataagtacattgtctccaccctgcaacgatggcgtctcaatgtgctgcgcctgaacttccgcggatgcctgcttaggcctaaaacgttcagatcggtgtctcactgccgaaacttacaggaactcaatgtatctgactgtcccacatttactgatgagtccatgagacacattagtgagggatgccccggggtgctgtgtcttaacttgagcaatacaacaatcaccaaccgcaccatgcggctgcttccccgccactttcacaatctgcaaaatttatctctcgcctactgtcgacgctttactgataagggcctgcagtacttgaatctcggaaacgggtgtcataaactgatttatttggacttgtctggatgcacccaaatctccgtgcaggggtttcggtacattgccaactcctgtacggggatcatgcatctgacaatcaacgatatgcccaccctgacagacaattgcgtcaaagcacttgtggaaaaatgctcgcgcattacttctctagtattcactggcgcaccacacatcagcgattgcacttttcgcgcgctctcagcctgtaagttacgcaaaattcgcttcgagggtaacaaacgcgtcacggacgcttccttcaagtttatcgataaaaactaccccaatctgagtcatatatacatggctgactgcaagggaataactgactcaagcttgaggtctttgtctcctttgaagcagctaacagtgcttaatctggcgaactgtgtgaggattggcgacatgggcctcaaacagttcctagacggacccgcgagtatgagaatacgggagttgaacctgagcaactgtgtgagactgtctgacgcttccgtaatgaagctctctgagagatgcccgaacctaaactatctttctctccgaaattgcgagcacctgacagctcagggcattggctacattgtgaacattttttccctcgtaagcatcgacttatccgggaccgatatcagcaacgaagggctgaacgttctgtcccgtcataaaaagctgaaggaactgtccgtgagcgagtgttatcggataaccgatgatggcatacagatcacagattccgctatggagatgctatctgcgaaatgccactatttgcacatcttagacatcagcggatgcgtgctccttactgaccagattttagaggatctgcaaattggctgtaagcagctgcgaattctgaaaatgcagtactgcaccaatatatcaaaaaaggcagcccagcgaatgagtagtaaggttcagcagcaggagtacaatacgaatgaccccccgagatggtttggttacgatcgagaaggaaacccagtgaccgagcttgacaacatcacatcctctaagggcgctctggagctcacagtgaagaagtcaacatacagttcagaagaccaagctgcctag

SEQ ID NO: 30100 - DNA, 1362 bp, Artificial Sequence
  Description of Artificial Sequence: Synthetic coding sequence
atgacaccagagctgatgatcaaggcctgcagcttctacacgggccacttagtcaaaacccacttctgcacttggcgggacatcgccaggaccaatgaaaacgttgtcctcgcagagaaaatgaaccgggccgtcacatgctacaacttccgcctgcagaaaagcgtctttcaccactggcatagctacatggaggaccagaaggagaaactgaaaaacatactgcttcggattcaacaaattatctattgccataaactgactatcatcctgaccaagtggaggaataccgcccgccacaaatccaagaaaaaagaggacgagttaattctaaaacacgaactgcagctgaagaaatggaagaatagattaattctgaagagagcagctgcagaagagtctaattttcccgaacgatcaagctctgaagttttcctggtggatgagaccctgaagtgcgacatatcccttttgccagaaagagccatcctgcagatattcttttacttatccctgaaggatgtgatcatttgtggccaagtgaatcatgcatggatgctcatgactcagctgaactcgttgtggaacgcgatagatttcagctcagtgaaaaatgtgattcctgataagtacatcgtctcgacactgcaaagatggagacttaacgttctaaggctgaactttcgcggctgcctcctccgtcctaaaaccttccgcagtgtaagccactgcaggaacctccaggaactgaacgtctccgactgcccgacatttactgatgagtccatgcgacacatctcagagggatgcccaggcgtactttgcctgaatctctctaataccaccatcacaaatcgcaccatgcggctgctgccccgtcactttcacaatctgcagaacctgtctctggcgtattgccgccgcttcaccgacaaggggcttcagtacctgaatctcggtaatggctgtcataaactcatctacctcgacctcagcggttgcactcagatcaccgactcagccatggagatgcttagcgccaagtgtcactatcttcacatcctggacattagcggctgcgtgcttctaacagaccagattctggaggacctgcaaatcggatgcaaacagctgaggatccttaaaatgcagtattgtaccaatatttccaagaaggccgctcagagaatgtcctccaaggttcagcagcaggagtacaatactaacgaccccccaaggtggttcggatatgatagagagggcaacccagttacggagctggacaacatcaccagcagcaagggagccctcgaattaaccgtgaagaagagtacatattcgtccgaagatcaggccgcttag

SEQ ID NO: 30101 - DNA, 1440 bp, Artificial Sequence
  Description of Artificial Sequence: Synthetic coding sequence
atgtcttcccccggaatcgatggagacccaaagcccccctgcctccctaggaacgggctggtaaaactccccggtcagcctaatgggctcggagccgcctcaattaccaagggaacgccagcaactaagaataggccttgccagcccccacctcctcccacactgcctcctccttcactcgccgcacctctgtcaagagccgcactggcaggcggtccctgtactccagccggcggccccgcctcagccctggccccaggacatcctgcggagcggccacctttagccaccgatgagaaaattcttaatggtctgttttggtacttttccgcatgcgaaaaatgtgtgttggctcaggtgtgtaaagcctggcgtcgagtgttataccaaccaaagttctgggccggtcttacccccgtcctgcatgccaaggagctctacaatgtgctgccaggcggagaaaaggagttcgtaaacctccagggattcgctgcacgcggttttgaggggttttgcttggtgggtgtttctgacctggacatctgtgagttcatcgacaactatgccctgagtaagaagggcgtgaaagccatgtctctgaagagaagcactatcactgacgcaggccttgaagtaatgctggagcaaatgcagggagtggtgcgattagaactgagtggatgcaacgactttacggaagccggcttatggagttccttaagcgccaggatcacatctctctccgtgtcggattgcatcaacgttgctgatgacgctatcgcggcaatctctcaactgcttcccaacctggccgagctctccctgcaagcctatcatgtgacagacaccgcattagcgtacttcaccgcgaggcaaggtcacagtactcatacactgcgtcttctgagctgttgggagattacaaatcacggcgtcgtcaacgtggtgcacagccttccgaacctaactgccctgtctctgtcaggttgctccaaggtcacagatgatggcgtcgaactggtcgcagagaacctgaggaaactcagatctctggacctgagctggtgccctaggattactgatatggccctggagtacgtagcgtgtgaccttcaccgtctggaggagctggtcctggaccgatgtgtaagaataaccgacaccggcctgtcttacttgagtacaatgtctagtctaagatcactgtatctgaggtggtgttgccaggtgcaggatttcggcctgaaacacttgctggcgcttgggtctctacgacttctgtcacttgccggttgccccctcctgaccacaactggactgagtgggctggtgcaactccaggagctggaggaattggaattaacaaattgccccggcgcaacacctgaactgtttaaatatttttctcagcatcttccccgctgtctggtgatcgaatag

SEQ ID NO: 30102 - DNA, 1440 bp, Artificial Sequence
  Description of Artificial Sequence: Synthetic coding sequence
atgagctcccctggcatcgatggcgaccccaaacctccttgtctgccccggaacggtctggtgaagctgcccggtcagccaaacgggctgggcgctgcctcaatcacaaaagggacccctgccacaaagaaccgcccttgtcagccccctccccctcccaccctgcctcccccctctctggctgcgcccttatctcgcgcagctctggccggaggcccatgtactccagccggcgggccggccagcgccctggcccccggccaccctgcggaaaggccaccccttgctacagatgaaaaaatcttaaatgggctattttggtactttagcgcttgcgagaaatgtgtgctggctcaagtttgtaaggcctggcgacgggttctctaccaaccaaagttctgggcggggctcacccctgttctgcacgcaaaagagctgtataacgtgcttccagggggggagaaagagttcgtcaatcttcaaggttttgccgcccgtgggttcgagggcttttgtcttgtgggagtgagtgatttagacatctgcgagtttatcgacaactacgccttatcaaaaaagggcgtcaaagcaatgtctctgaagcgctcgacgataacggatgcagggctggaagttatgctcgaacaaatgcagggcgtggtgcgactcgaattgtctggttgtaatgacttcacggaggcaggcctctggagcagcctctcagccagaatcacaagcctttccgtatctgactgtattaacgtagctgacgatgcaattgcagctatcagccagctgctcccaaatttggctgagctatcattacaggcataccacgtgactgacacagccttggcatatttcaccgcccgccaaggccacagtacccacacactgagacttctgagctgctgggagattaccaaccatggcgtggtgaatgttgttcactccctgccgaacttaacagcgctgagcctgagcggctgcagtaaagttacagacgatggagtcgagctggttgccgaaaatcttcggaaattaaggtcgcttgacctctcctggtgccccagaatcactgacatggccctagaatacgttgcgtgcgacctgcaccggctggaagaactcgtgctcgacagatgcgtgcgaatcaccgatacaggcctgagctatctttctaccatgagctccctgcggtccctgtatctgagatggtgctgtcaggtccaagacttcggattaaagcatcttttagcactgggcagtctaaggctgttgtcactggctggctgcccgctgctcaccaccactggactgtccggcctggtacagctccaggaactggaggagctcgaactcacaaactgcccaggcgctacaccagagctgttcaaatacttctcccaacatttgcccaggtgtctggtgatagagtag

SEQ ID NO: 30103 - DNA, 780 bp, Artificial Sequence
  Description of Artificial Sequence: Synthetic coding sequence
atgcatgcagttccccggggttttgggaaaaaggttcgcgtaggtgtgcagagctgtccgcctcttcttggacctggggtgcctcctgctctgctccgagttctggtgagtgccgaagaaccagctctgcccggaacccctcgggcagattgggtacaactgctgcttagacacgctccacagcgcgcccgccacccccagctcgccccaactctccagccccggacagagtgtagaggtcttggcgggggcagacacaggccagctggcctccctgccgcacctgacgcacgcaccgctgctcagaggccttacgggctgcgagccggccagtatcgcccagccgtgcctgcagttgccgtaccagtggccggacagccaggacacgacggcgagggcggtgtgcatgcacgcgctctgcgccacgtagaagctctgcaggcagctgagggtccacaggcaggagctgccctgttgcagcggcagcgtcccgtgctccctggcgcagaacccgtgcctctggctgccgcaccagttccaggtcttagccagcgccaccccccggcccgctgtcgggctgggctgcacgggtccctgccagcaggttgccacgtgccccctgtgcaccgtggggtccctcgtcatttacaagaacctgcagctgttgctagcccccagctgcctgggcgagctgccagagtgaagcgacggcacctgccctctgctcccagaggacccgatcggcgacatccgggccggcctcctggagctccaggttag

SEQ ID NO: 30104 - DNA, 2418 bp, Artificial Sequence
  Description of Artificial Sequence: Synthetic coding sequence
atggcttcttcaggtgaggatatctctaacgatgacgatgacatgcaccctgccgctgcgggcatggcagatggtgtgcacctgctcggcttctccgacgagatccttctccacatcttgtctcacgttcctagcacagacctgattctgaacgtgcgccggacctgcaggaaacttgccgctctttgcctcgataagagccttatccacactgttctgctccagaaggattatcaggcaagcgaggacaaagtgcgacaactggtgaaggagattggtcgcgagatccaacagctctcgatggcagggtgctactggctgccagggagtacggtggagcatgtcgccaggtgcaggtctctggtgaaagtcaacctcagcggctgtcacctgactagcctgcgccttagtaaaatgctgagcgcgctgcagcacctgaggtccctggccattgacgtgagtccagggttcgatgcgtcacaacttagctctgaatgcaaggccactctgagccgcgtgagagagctgaagcagaccttgttcaccccctcttatggagtggtgccgtgctgtacctctctggagaaactcctactgtattttgaaatcctcgatagaaccagagaaggggcaatcctttcaggccagctcatggtgggacaatcgaacgtgccgcactaccagaatttgagagtattctacgccagactagcccccggatacattaaccaagaagtggtacgcctgtatctggccgttttaagtgatcgcaccccccagaatctccacgcttttcttatttctgtgcccggctctttcgcagagtctggcgctaccaaaaatctcttggacagtatggcccgtaatgtcgtcttagacgccctgcagctgcccaagtcatggcttaatgggagtagcttgctacaacacatgaaattcaataacccattctatttttcattcagcagatgcaccctgagtggaggacacctgatccagcaggtgatcaacggggggaaggaccttcgcagtttagcatcacttaatctgtccggctgtgtgcactgtctcagccctgacagcctcctgagaaaggcagaagatgacatagattcctccatcctggaaacactggtagctagctgttgcaatttgcgccatcttaacctgtccgcagcacaccaccatagtagcgagggccttggacggcacctgtgtcaactgctcgctagattgcgccatctgagatccctgagcctgccagtgtgtagcgttgcagactcagccccgagggccgacagggccccagcacagcctgcgatgcatgctgtcccgcgaggattcggcaagaaggtgagagttggggtgcaaagctgcccttctccgttctcgggacaggcttgtccccagccctcaagtgtgttctggagccttctgaagaacctgccatttctggagcatttagagcttatcggatccaatttctcttcggcgatgccacgaaacgagccagctatccggaacagtttacccccctgcagtcgggcccagagtgtgggcgactcagaggttgctgccatcggccagctggcattcctccgtcacctcaccctggctcaattgccctccgtgcttactggctcaggcctggtaaacattggtctgcagtgccagcagcttaggagtctctctctggctaacctcggaatgatggggaaggtagtgtacatgcccgcattaagcgacatgctcaagcactgtaagcgcctcagagacctgcgccttgaacagccatactttagcgctaacgcgcagttcttccaggccttgtcccagtgtccctcacttcaacggctgtgtctagtttcaagatcaggtacactccaaccagatgcagtgctggcttttatggcaaggtgtctccaggtggtcatgtgccacctcttcaccggagaatcgctggccacatgtaagtcgctccaacagtcacttctccgccgctggggagaagtgaccgggcggagaccccagcttttcaccgagctacgagaagagccaagtgcgaggacatctcgagccactggcagaaggcagccttgtctccctgatagcggcgtggtgtgttgcccatgtggtcgtcccctggctgtgtccggtatcattttagtgggggtgtcaccgtcacttgtcgtgaaaacaacttgtgtgtatagggtattgttcaagaatctggattacgccagcatcttctttctcgtctgcctgttcgagacagagagccattcagtcgtgcaagctggggttcaatggcgtgatctatcaagtctgcagccactgctgtcagggctgcagccccagcctcctgaacaactggaaaacgaactggagattggcttttcctactgcttcgtcatatag

SEQ ID NO: 30105 - DNA, 2157 bp, Artificial Sequence
  Description of Artificial Sequence: Synthetic coding sequence
atggctagcagtggcgaagacatttccaacgacgacgatgacatgcatccagccgctgcgggcatggcggacggcgtgcacttgcttggtttctcagacgaaatcctgctccacatcctctctcacgtaccatccacggatcttattctcaacgtgcgcagaacgtgtcgcaaactcgctgccctatgtctcgataaatcgctcattcataccgttctcctgcagaaagactaccaagcaagcgaggacaaggttcgccagttagtgaaggagattggaagagaaattcaacagctcagcatggccgggtgctattggctgcccgggagtaccgtggagcatgtagccaggtgccggagcctggtgaaagtgaatctctcggggtgccacctgacttccctcaggctgtccaagatgttgtctgccctccagcatttaagatcacttgctatcgatgtcagccccggatttgacgcctctcagctgtcctccgagtgtaaagcaaccctgtcgcgggtgcgggaactgaagcagaccctattcactcccagttatggggtggtgccttgctgtacctctttggagaaactgttactatatttcgagattctcgatcgcactagagagggcgctatcctgtctggccagctgatggttggccaatctaatgtgccccactatcagaacctccgagtgttctacgccagactcgcccctggctacatcaaccaggaggtagtgcgactgtatttagccgtgttgagcgacaggaccccgcaaaacttgcatgcttttctgatatctgttccagggtccttcgccgagagcggcgccacaaagaacctacttgactccatggcacgcaatgtggtgctggacgccttacagctaccgaagtcctggctgaatgggtcttctctgttgcagcatatgaaattcaacaatcctttctatttcagcttctcaaggtgcacactgtcagggggacatctgatccagcaggttattaacggcggaaaagacctcaggtctctcgcctctttgaatctttccggatgtgtgcactgtctgtcaccggatagcctgctccgaaaagcagaggatgacatcgatagtagcatccttgagacactggtcgcatcttgttgcaatctgcggcatctaaatctgtctgctgcccaccatcactcgagtgaaggattgggacgacatttgtgtcaacttcttgctcgactgcgccatctgagatcattgtctttacccgtgtgctcagtggccgactctgcccctagagctgacagggccccagcacagccggctatgcacgcggtccccagaggctttgggaaaaaagtgagggtgggggttcaatcgtgccctagccctttctccggccaggcctgtccccagccttctagtgtgttctggagcctgctgaaaaatttgccatttcttgaacacttggaattgatcggtagcaacttttctagcgctatgcctcgtaatgagccggcgatcaggaattcgctgccgccttgttccagagcgcaatctgttggcgattccgaggtggcggctattggccagctagccttcctgcgccatctgacgttggctcagctgccctctgtgctgaccggctctgggctggttaacatcggcctccagtgccaacagctgcgcagcttgtccctggcgaacctgggtatgatgggcaaggttgtgtacatgccagcactatccgatatgcttaaacactgcaaacgcctgagggacttgcgcttggaacaaccatatttcagcgccaatgctcagtttttccaggcgttgagccaatgccctagcttacagagactttgcctggtgtcgagaagtgggacccttcagcctgacgccgttcttgcttttatggctcgctgtctgcaggttgtgatgtgccacctctttacaggcgagagcctggcaacttgcaaaagcctgcagcagtctttgctacgatcatttcaggctgagagacctgcactgaacgtggtcatttttccgctgctccacgagggcctgacagacgtaattcgggatgtgccacttgttcatctggacgagattacgctttttaaatcacgtgtggccgaagagccacccaatctatggtggtag

SEQ ID NO: 30106 - DNA, 2406 bp, Artificial Sequence
  Description of Artificial Sequence: Synthetic coding sequence
atggctagctcaggcgaagacatctcaaatgatgatgacgacatgcaccccgccgccgctggcatggcggatggcgtccacctcctcgggttttcagatgaaatcctcctgcatatcctcagtcacgttcctagtaccgatctcatattgaacgtgcgacggacctgtcgtaagctggccgccctctgtctggacaagtctctaatccacactgtgttgctccagaaggactatcaggccagcgaggataaggtgcgacagcttgttaaagagattggtcgggagatccaacaactatccatggccggctgttattggctacccggttctacagttgaacatgtagcacgctgtcggagcctggtcaaggtcaatctcagcgggtgtcacctaacttctctccggctgagcaagatgttgagcgctctacagcaccttaggtctctggcaattgatgtaagccctggatttgatgcatcacagctgtcatcagagtgcaaagccaccctgtctcgagtgagggagctgaaacaaacccttttcacacctagctacggcgtggtgccttgctgtacctccctggagaagctgctcctgtatttcgaaatcctggaccgtacacgcgagggagccatcctctccggccagcttatggttgggcagagcaatgttccgcattatcaaaatctgcgtgtcttttacgcaaggctagctccaggttacatcaaccaggaggtagtgaggctgtacctagccgtgctcagcgatagaacacctcaaaatctacatgcgttcctcatctcagtacctggaagctttgccgaaagcggagccacaaaaaatctcttggactccatggcacgcaacgttgtattagatgcgctgcagctaccaaaaagctggctcaacggatcaagcctccttcagcacatgaaatttaacaacccattttactttagctttagtcggtgtacactgtcgggaggccacctgattcagcaggtgataaatggagggaaagacctgaggtcactagccagtttgaacctctccggatgcgtgcattgtcttagcccagacagtttgttaaggaaggcagaggacgatattgatagctcaatcttggagactttggtcgcttcttgttgcaatctccgccatctgaacctgtccgcggcacaccaccatagcagcgagggtctgggaaggcacctctgccagctgctggctcgtctcaggcacctgagaagcctgtcgctgcccgtctgtagtgtggcagactctgctcccagagcggaccgagcgcccgcacaacccgctatgcacgcggtgccaagggggttcggaaagaaagttcgcgttggagtgcagtcgtgcccttccccgttctcaggccaggcatgtcctcagccctcctccgttttctggagtttactaaaaaatctcccctttctcgaacacctcgagctcattgggagcaattttagctccgctatgccccgtaatgagcccgccattcggaacagtctgccaccttgtagtcgcgcacagtctgtgggtgattctgaggtggcagccatcggacagctggccttcctgcgacatttgactttagcccaactccccagcgtgctgactgggagtggcctagtaaacatcggcttacagtgccagcagctgcggagtctgagcctggccaacttagggatgatgggaaaggtggtatatatgccagcactctccgacatgttgaaacactgtaagaggctccgcgacctacgcctggagcagccttatttctcagccaacgcccagttctttcaggccttatctcaatgccctagcctgcagcggttatgcttggtgtcaagaagtggtactctgcaaccggatgccgtccttgcgtttatggccaggtgtctgcaggttgttatgtgccacctgttcacaggagaatcacttgcgacgtgtaagtctctccagcagagccttctccgacggtggggcgaagtcaccggacgcaggccccaactgtttactgaattgcgggaagagccgagcgcgcgcacttcccgcgccaccggtcgaagacaaccctgtctccccgattccggagtggtctgctgcccatgtggtcggcctttggccgtcagcggaatcattctggtgggtgtgtcaccctcactggtggttaagactacctgcgtataccgcgtgttattcaagaatttagactacgcctctattttttttttggtatgcctgtttgagactgagagccattccgtcgttcaggcaggtgtacagtggcgtgatctctcttccctgcagccacttctgtccggcctccagccacagcctccggagcagctgggattgcaggtgtgtactacaattccggggtag

SEQ ID NO: 30107 - DNA, 726 bp, Artificial Sequence
  Description of Artificial Sequence: Synthetic coding sequence
atgcacatcacacaactcaacagagaatgcttactgcatctcttcagtttcctcgataaagactcccgcaaatccctcgcccggacctgttcacagttgcacgatgtattcgaggaccccgccctttggtcactgctgcactttaggtctttaactgagctccaaaaggacaacttccttttaggccccgcccttcgttcgctgtcgatctgttggcacagctctcgcgtgcaggtgtgcagtattgaagactggttgaagagcgcattccagcgatcaatctgttcccggcacgaatctcttgtcaacgatttccttctacgggtgtgcgaccggttgtctgccgttcgctctccccggaggcgcgaagcaccagcaccctcctccggtaccccgatcgcagtaggccccaagtccccacggtgggggggccccgaccactcagaatttgctgatttgcggagcggtgtgacaggcgctagggccgctgcacggaggggcttaggaagcctgagggctgagcgcccaagcgaaaccccccccgccccaggagtctcttggggtccccccccccccggggctcctgtcgtaatcagcgtgaagcaagaggaaggcaagcaaggcaggacaggaaggaggtcacaccgggcggcaccgccatgtggcttcgcaagaactcgggtgtgtcccccaaccttcccaggagccgatgccttccctcagtag

SEQ ID NO: 30108 - DNA, 1620 bp, Artificial Sequence
  Description of Artificial Sequence: Synthetic coding sequence
atggccgcccccgcatcaaggcaagtccgcagaagggcaagagctgctcccagacctcggtccgccgaggactggtggtgggaccgtcttgcaccgagaggcagtggctaccatctgctgcaaagtgatagcatgctattggtgctgagtgaaccaggccctgcacggccaagggctcaacggcgagcttctcgccgcactcctagacagccaccaagggggccaagtgcagccgccaagcctaaggcaggcttgagatcggaagccgccgctgcccctgctcctgcgcccgctccaacgcctacacctgaagaaggccccgatgctggctggggtgacagaatcccactggagatcctggttcagatcttcgggcttctagtagccgcagatggaccaatgccttttctgggtagggccgctagagtatgcaggaggtggcaggaggctgcgagtcagcccgccctgtggcacactgtgactctcagctctccattggtgggccggccagcaaaggggggggtgaaagcagagaagaagctgttggcatctctggagtggctcatgccgaaccggttctcacagcttcagagattaacactgatccactggaagtcgcaggtccaccccgtcttaaagctggtgggtgaatgttgccccagattgacattccttaagctatccggctgccacggtgtgacagccgacgccctggtaatgttggccaaagcatgctgtcagctgcactccctcgacttgcagcactccatggtggagtctaccgcggtcgtatctttcttggaagaagccggatctagaatgcggaaactttggctcacctactcttcccaaacaactgccatcctgggagcactcctgggctcatgttgcccccagctccaagtcctggaggtgagcaccggaatcaatcgtaatagcatccctctacagctgcctgtagaggctttacagaaaggatgccctcagctgcaagtgctccgcctcctcaatctgatgtggctgccgaagccccctgggcgaggagtagcccctggacctggctttccatccctcgaagaactttgccttgcgagcagcacttgcaacttcgtgagcaacgaggtgttaggacgcctgctgcacggaagccccaatctgagactactcgatcttcgcggatgtgctcggattacccctgccgggctccaggatttgccctgcagggagctggaacagctgcacctgggattatacggcacttctgatcgtttaaccctggcaaaagagggctcccctttcctgactcagaagtggtgtcataccttgcgggagttagatctgtctggccaaggattcagcgagaaggaccttgagcaggcgctcgccgccttcctaagcacacctggaggcagtcacccagcactttgttctctgaatttacgggggacacgggtgacgcccagcacagtgagtagcgtgattagttcctgtcctggccttctctacttgaacctcgagtcctgccgatgtctccccaggggactcaaacgagcgtacagaggcctggaggaggtgcagtggtgccttgagcagctgctcacatcgccaagtccatcgtag

SEQ ID NO: 30109 - DNA, 1602 bp, Artificial Sequence
  Description of Artificial Sequence: Synthetic coding sequence
atggcggccccagcatccagacaggtgaggcggcgcgcccgcgcagccccacgaccccgcagcgccgaagactggtggtgggaccggctcgctccacggggttcgggctaccatctcctccaatcagactctatgttactggtcttatccgagcctggacccgcccggcctagagcccagcgccgggctagcaggcgcactccccgccagcccccacgcggcccctccgccgcagcgaagcctaaagctggactgcggtcagaagccgcggctgcccctgccccagcgcccgcccccactcccactcccgaagagggccctgacgccggatggggcgatcgcattcctttagaaatcctcgtgcagatatttgggttgttggtcgctgccgatgggccaatgccctttctgggcagagccgcaagagtttgcagacgctggcaggaggcagcatcacagccagccctctggcacaccgttacattgagtagccctctggtcggccgaccagcgaagggcggtgttaaagcagagaagaagctgctcgcatcactggagtggttgatgccgaaccgcttttctcagctgcaacgcttaacattaatccactggaagtctcaactagtgggggagtgctgtccacgcctgacgtttctgaaactatctggatgccacggcgttaccgccgacgccttagtaatgctggcaaaggcctgctgtcaactgcactcactggacctccagcacagtatggtggaatctactgccgtggtatcattcctggaggaggcaggctcccggatgcggaaattgtggctgacatatagttctcagaccacggccatcctgggcgccctgctgggttcttgctgtccacagcttcaggtgctcgaagtcagcaccggtataaacagaaactctatcccgcttcaactgcccgtcgaggcgctgcagaagggttgtccgcagctgcaggtgctgagacttctcaatttaatgtggctccccaagcctcccggcaggggagtcgcacccggccccgggtttccatctttagaagaactctgtctggcaagctcaacctgtaatttcgtgagcaatgaggtgctcggtcgactactgcacggttcacctaacctgcgattattagacctgcgggggtgcgctaggattacccccgcggggctgcaggacctcccctgccgggagctggaacagctgcacctgggattatacggtacttctgaccgcctcaccctggctaaggaaggaagtccctttctcacgcagaagtggtgccatactcttcgggaactcgatctgtctgggcagggtttctcagagaaagaccttgaacaggccctggcagcctttctgtcaacccccggcggttcacaccccgcgttgtgttcgctaaatctgaggggcacacgagttaccccatccacggtgtcgagcgttattagtagttgccccggcctcctctaccttaacctagagagctgccggtgcttaccgagggggctcaagagagcttatcgagggctggaagaagttcaatggtgtctggaacagttgttaaccagcccttcaccttcctag

SEQ ID NO: 30110 - DNA, 1125 bp, Artificial Sequence
  Description of Artificial Sequence: Synthetic coding sequence
atggcagagcctggggagggcctccctgaggaagtcttggccttgatctttaggcacctgtcacttagggacagggcagcggctgcacgggtctgtcgcgcttgggcggccgctgctacatgtagtgctgtctggcacgacactaagattagctgtgaatgcgagctggaaggaatgctgcctccatacctttccgcgtgtctagatcatatccacaacctacgtctggaatttgagccatctaggaaaccctcgcgccgcgcggctatcgagcttcttatggtattagccggccgcgcacccggactgcgcggcttgaggctagagtgcaggggtgagaagcctctgtttgacgcaggtagggatgtgctagaagctgtgcatgcagtttgcggagctgccagtcagctgcggcaccttgatcttaggcggctgtcttttactctggacgacgcactggtgctgcaggctgctagatcctgtcccgaactgcactccctgttcctcgataattcaacactggtcgggtccgtcggcccaggatctgtgctcgaactattggaggcatgtccgcggttaagagcattgggcctgcacctggcttccctcagtcatgccattctcgaggccttggctgcaccagaccgcgccccattcgctctgttggcccttaggtgcgcctgcccagaagatgcaagggcctctcctttgcctaacgaggcctgggtcgcgctccgaagacgacatcccggtctcgccgtggagctggaattggagcctgctttacctgctgagtctgtgacacgcgttttgcagcccgctgtgcctgtggcagcactgaggttaaatctgtccggagacaccgtgggaccggtccgctttgcagcccatcactacgcggctactctgtgcgctttggaagttagggcggccgcttctgcagagctgaatgctgccctggaggaattagccgcccgttgtgcagccctgcgtgaggtccactgtttctgtgtggtgtctcatagcgtgctggatgccttcagagcccactgtcctcggctgcggacgtacacattaaagctgaccagagaaccccatccctggcgccctacgctcgtggcctag

SEQ ID NO: 30111 - DNA, 492 bp, Artificial Sequence
  Description of Artificial Sequence: Synthetic coding sequence
atggcagagcccggtgaaggcctgccagaagaagtcttagcccttattttccggcacctaagcctgcgcgatcgggctgctgcggccagggtttgtcgggcatgggctgcggcagccacatgtagtgccgtctggcatgacacaaagatcagttgtgagtgcgagctcgaaggaatgttacctccttatctgagcgcttgtttagaccacatacacaatctcaggctcgaattcgagcctagtaggaaaccctcaaggagagcggctattgagcttctgatggtgctggcaggacgagcaccgggactgcgggggctaaggctggagtgcaggggggagaagcctctgttcgatgccggcagggacgtgcttgaggccgtccacgccgtgtgcggggcggcctctcagcttagacaccttgacctcagacgtctaagcttcactctggacgatgcacttgtcctgcaggccgcaaggtcttgccctgagtag

SEQ ID NO: 30112 - DNA, 1125 bp, Artificial Sequence
  Description of Artificial Sequence: Synthetic coding sequence
atggctgaacccggagagggtctccccgaggaggtgctggccctcatttttcggcacctgagcttgagggatcgggcagctgcagcccgagtatgtcgcgcttgggccgctgctgctacttgtagcgccgtctggcacgatactaaaattagctgcgaatgtgagttggaaggcatgctccccccatacttgtcagcatgcttggatcacattcacaatcttcgcctcgaattcgaaccgtcccgcaagcctagtcgccgggccgctatcgaactgctgatggtactcgctggacgcgcacctgggttaaggggccttagactggagtgtagaggggagaagcccctctttgacgcgggccgggacgtgttggaggctgtgcacgcagtgtgtggggcggctagtcagcttcgacatcttgatcttcggaggctgagcttcacgcttgacgatgctctggttctccaagctgctcgctcgtgcccagaattacactcacttttccttgacaactctaccttagttggatcggtgggccctggatccgtgctggagctgttggaggcttgcccaagattacgtgcattggggctgcatctagcctctctctcacatgctatccttgaggcccttgccgcacctgacagagctcctttcgctctcctggcgctcaggtgcgcttgtcccgaggatgcgagagccagccctctgcctaacgaagcttgggtggctctcaggcgcagacaccccggcttggcagtggaactggagctggagccagctcttcctgctgagtcagtcacgcgggtgctccaacctgccgtcccggtggcggccttgagactgaacttgagcggagatacggtgggacccgtccggtttgctgcacaccattatgccgccacgctttgcgcattagaagttcgggcagctgcctccgcagagctgaacgcagcgctggaagagctggccgcacgctgcgctgccctccgcgaagttcactgcttctgtgtggtctcccacagcgtgctggacgcatttagggcgcactgtcccagacttagaacttataccttgaagctcacacgagaacctcacccttggcgacctactctggtggcatag

SEQ ID NO: 30113 - DNA, 390 bp, Artificial Sequence
  Description of Artificial Sequence: Synthetic coding sequence
atggcagagccaggcgagggtctccccgaggaggtgctggctctgatctttcgccacctctcacttcgggatagagccgcagcagcccgcgtttgtcgggcgtgggctgcggccgctacgtgcagtgccgtgtggcacgacactaagatctcgtgcgagtgtgagctcgaaggaatgctcccaccatacttgtccgcttgcctagatcacatccataatttgcgactggagtttgaaccaagcaggaaaccctcgcggagagccgccatcgagttactgatggtgcttgctgggcgagctcccgggctgcgggggctccgcttagagtgcaggggagagaaacccttgttcgatgcggggagagacgttcttgaagcagtgcatgcctag

SEQ ID NO: 30114 - DNA, 1701 bp, Artificial Sequence
  Description of Artificial Sequence: Synthetic coding sequence
atggacgaaggtggtactcctctgctcccagacagcctcgtgtaccagatctttcttagcctgggcccagccgatgtgttagccgcgggcctcgtgtgcagacagtggcaggctgtgagtcgcgatgaattcttatggagagaacaattctaccgatattaccaggtggcgcgcgacgtacccaggcatccagccgcaatgtcctggtacgaggagttccaacgtctgtatgataccgtcccgtgcgtggaggtccaaactcttcgcgagcatacggatcaagtcttacacctgtccttctcccactcagggtaccagtttgcaagctgttctaaggattgtacagtgaagatttggagtaatgacctgacaatcagcctgttgcattcagccgatatgaggccctacaattggagttatacgcagttcagccagtttaataaggatgactctctgctgttggcttctggggttttcctgggtccgcacaatagcagctccggagaaatcgctgtcatatctttggacagcttcgctctcttgtcccgggttcgtaataaaccatatgatgtcttcggatgttggctgactgaaacctcccttatttcagggaacttgcaccggataggagacattacttcgtgttccgtgctgtggctaaacaatgcatttcaggatgttgagtcggaaaacgttaacgtcgttaagcgcctgtttaagatccaaaacctgaacgcctccacagtgaggactgtaatggtcgcagattgttcacggttcgattctcccgatctgttattagaagccggggaccctgctacctcgccctgtcgcattttcgatctgggcagcgacaatgaggaggtggtcgctgggcctgcccccgcacacgcaaaagagggactccgccactttctagaccgcgtgctcgagggccgggctcagccacagctgagcgaacggatgctggagaccaaggtagctgaactgcttgcccagggccacactaagcctcctgagcggtctgctaccggtgctaaatccaagtacctgattttcacaaccggttgccttacatatagtccccatcagataggcattaagcagattctgcctcatcagatgacaacagctggaccagtgctaggcgaaggcagaggttctgacgcctttttcgatgctttggaccatgtgatcgatatccatggccatattattggaatgggcctgtcaccagataatcgctatctctacgttaactcccgtgcttggcccaatggcgctgttgtggcggaccccatgcagcctcccccaattgccgaagagatcgatctgttagtattcgacttgaaaactatgcgggaggtgcgccgcgctctccgcgcccacagggcctatacaccaaacgatgagtgttttttcatcttcctggatgtgagtcgggatttcgtagcttctggcgccgaggaccggcatggttacatatgggatcgtcactacaacatctgtctcgcgagactgcgtcatgaggacgtggtgaactctgtggtcttttcaccacaagagcaggagcttctcctgaccgcttccgatgatgcgacgatcaaggcttggcgcagcccacggactatgcgtgtgctccaggccccacgtccaagacctcgaacattcttttcctggttggcctcccagaggcggtag

SEQ ID NO: 30115 - DNA, 603 bp, Artificial Sequence
  Description of Artificial Sequence: Synthetic coding sequence
atggatgagggtgggacacccctgctgcctgacagtctcgtctaccagatttttttgtcgctcgggccggccgacgtactagctgctggattagtgtgtaggcagtggcaggccgttagtcgggacgagttcctgtggcgagagcagttctataggtattatcaggtagcaagggacgtgcccagacatccagccgcgatgtcctggtacgaggaatttcagagattatacgacacagtaccttgcgtggaggttcagactctcagagaacatactgaccaggtcctccatctgagtttttcccactcggggtatcagtttgccagctgcagcaaggattgcaccgttaaggcgattaccacagccgctccagccgagcaaatttggtcaaacgacttgactatcagcctcctccatagtgccgacatgcgcccttacaactggtcctacacccagttctcacagttcaataaagacgatagcctactgctcgcttccggtgtatttcttggtccccacaacagttccagtggtgagatcgctgtgatttccctggatagtttcgccttgctttcccgcgttcgcaacaagccctacgattag

SEQ ID NO: 30116 - DNA, 804 bp, Artificial Sequence
  Description of Artificial Sequence: Synthetic coding sequence
gacagcctctcaagtccaggtctgcccaccgattcgtttgccctgttaagtagagtgagaaataagccatacgacgtgttcgggtgttggctcacagagaccagtctaatatcagggaatctgcaccgtataggtgatatcacttcctgttccgtgctctggctcaataacgcctttcaggacgtcgaatccgaaaacgtgaatgtggtaaagagattgttcaaaatacagaatctgaatgcgtccaccgtgaggaccgtgatggtggccgattgcagccggttcgactcacctgacttactactagaggccggagatcccgctacatccccctgtcggatttttgatctgggatccgataacgaggaagtagtggcgggccctgcccctgcccacgccaaggagggccttagacacttcctggatcgagtgcttgagggaagagcgcagccacagctgtccgaacgtatgctggaaaccaaggtcgctgaactgctcgcccaggggcacacaaaaccccccgagaggagcgcaactggagctaagtccaagtatctcatttttacaaccggatgcctgacttacagcccccaccagatcggcatcaagcaaattctgccccatcagatgacgacagcaggaccagtgctgggagaggggaggggcagtgacgcattctttgacgcactggatcatgttatcgacattcacgggcacattattggaatgggactatctcccgataatcgttacctctacgtcaacagcagggcttggcctaacggcgccgtggtggctgactag

SEQ ID NO: 30117 - DNA, 390 bp, Artificial Sequence
  Description of Artificial Sequence: Synthetic coding sequence
atggatgaaggaggcacgcctttgctgcccgatagtctggtgtatcaaatttttcttagcttgggcccggcggatgtcctcgccgccgggctcgtttgtaggcagtggcaggcagtctccagagacgagttcctctggcgggaacagttttatcgatattatcaggtcgcccgagacgttcccaggcatcctgctgccatgtcgtggtacgaggaattccagagactctacgatactgtaccctgtgtggaagttcagaccttgagagagcatacagatcaggtgctgcatctgtctttcagccactccgggtaccagttcgcgagctgttctaaggattgtacagtaaagatctggagcaatgatctcacgatctctctgctgcactag

SEQ ID NO: 30118 - DNA, 1467 bp, Artificial Sequence
  Description of Artificial Sequence: Synthetic coding sequence
atggagcttcccctgggaaggtgcgacgattcacggacatgggatgatgactctgaccccgagagtgagaccgatcccgatgctcaagcaaaggcttatgtggcgagagtactgagccctcctaagagcggcttggcgttttctagaccctctcagctgagcacacctgctgcttccccgtccgcttcggaaccccgcgctgcatctcgcgtaagtgccgtgagtgaaccaggcttgttgagcctgccaccagaactcctacttgagatttgcagttacttagatgctcggttggtactgcatgttctgtcaagagtctgtcacgccctgcgtgacctggtaagtgaccacgtgacgtggcggcttcgggccctcagaagggtccgggcaccttaccctgtcgtggaggagaagaactttgactggcctgccgcctgtattgcgctcgagcaacacctgtccagatgggctgaagatggccgatgggtcgagtacttttgtctagcggaaggacacgtggccagcgtggatagcgtgctgcttctgcaggggggctcgctgtgtcttagcggctccagggatcgcaacgtgaacctgtgggacctgagacagttaggcacagaaagtaaccaagtgctaattaagaccctgggcaccaaacgaaattccacacacgagggctgggtttggtcgcttgctgcccaggaccatcgtgtgtgctccggctcgtgggactctaccgtgaagctgtgggacatggctgccgacggccagcagtttggcgagattaaggcatctagtgctgtgctgtgcctctcatatttgcctgacatattggtcaccggaacatatgacaagaaggtgacaatctatgatccgagggacagaatggagacgcgtgatgccctgatgggatggggcgggccatccagggggtcagacattccacctcacaggccgatcacacatgaggccggacccgccctgttgaagcaccaacaacttcacagcaggcctgtgctgacactgctggcagatgaccgtcacattattagcgggtccgaagatcatacactcgtggtcgtggatcgccgggcaaattcagttctgcaaagactccaactggattcgtacctgctctgcatgtcttaccaggaaccccagttatgggcaggcgacaaccaggggttgctgcacgttttcgccaatcgtaatgggtgtttccagctcatccgatcttttgacgtgggccattcattcccgattactggaatacagtacagcgtcggggccctatataccacatcaactgataagaccatacgagttcacgtgcctacagatccccctcggacaatttgcacgaggagacacgacaatggcttgaaccgcgtgtgcgccgagggcaaccttgtggtggccggctcaggcgacctctctctggaagtttggaggctgcaggcctag

SEQ ID NO: 30119 - DNA, 1377 bp, Artificial Sequence
  Description of Artificial Sequence: Synthetic coding sequence
atggaactccccttgggtcgatgcgatgacagcaggacttgggatgacgatagcgaccctgaatccgagacagaccctgacgctcaggcaaaagcctacgtggcaagggtgctctctccccctaaaagcggcctggcgtttagcaggcccagccagctgagtacaccagctgcatcacctagcgcctcagagcccagagcggcatcccgcgtctcggcggtatctgagcccgggcttctttcgctccctcctgaactgcttctagagatctgcagttacctcgatgcccgtcttgtcctgcacgtattgtcgagggtgtgtcatgccctcagggacctggtctctgaccacgtcacctggcgcctacgcgcactgaggagggttagggccccttaccctgtggtcgaagagaaaaacttcgactggcccgccgcctgcatcgctctggagcaacacctgtctcgatgggccgaggatggccgatgggtggaatacttttgtctggctgaagggcacgttgcatccgtggactctgttttgctgctacagggggggtccctgtgtctatccggttctcgggaccggaacgttaatctgtgggatttgcgccagctcggtactgaatcaaatcaggtcctcatcaagacgctggggactaaacggaatagcactcatgagggctgggtgtggtccctcgctgcgcaggatcaccgtgtgtgcagcgggagctgggacagcaccgtcaagttgtgggacatggcagctgacggacagcagtttggtgagattaaagcctcaagcgctgtgctatgtctgtcttacctgccagacatcctcgtcaccgggacttacgacaagaaggttaccatctatgacccccgcgctggccctgctctgctgaagcaccagcagctacattctcgccctgttctgactctcctcgcggacgaccgacacattataagcggctcagaggaccatacattggttgtcgtggaccggcgcgctaattctgtattgcagagattgcagctggactcgtatttattgtgtatgtcttaccaggagccacagttgtgggccggcgacaaccagggtctactgcacgtgtttgcgaacagaaacgggtgcttccagctgattagatcttttgatgtcggacactcttttcctattacgggaatccagtactctgtgggcgcactgtataccacaagcaccgacaaaacaattcgtgtacacgttccaactgaccccccaagaacaatttgtacccgccgccatgataacgggctgaacagggtttgtgctgagggcaacttggtagttgccggctcgggagacctctccctcgaagtgtggaggctccaggcgtag

SEQ ID NO: 30120 - DNA, 591 bp, Artificial Sequence
  Description of Artificial Sequence: Synthetic coding sequence
atgcgtgcctcctctgccgttttgtgtttatcctaccttcccgacatcctggtcactgggacctatgataagaaggttaccatatacgaccctcgcgctggccccgccctgctcaaacatcaacaactgcacagtcgcccagtactcacactcctcgccgacgaccggcacatcatatccggtagcgaggatcacacgctggtcgtggtggaccgccgagcaaattctgtgttgcaaaggttgcagctggactcctacctgctttgtatgagctaccaggagccccagttgtgggccggtgacaatcaaggactgttacatgtattcgcaaacagaaacggctgctttcagctgattaggtctttcgacgtcggccattcctttcctattaccgggattcagtactcagtgggcgctctgtacaccacttcaacagacaagacgatacgcgttcacgttccaactgacccgccgaggactatttgcacccggagacacgacaatggcctcaaccgcgtctgcgccgaaggaaacctggttgtggcaggttctggtgacttgagcttagaggtgtggagattgcaagcctag

SEQ ID NO: 30121 - DNA, 468 bp, Artificial Sequence
  Description of Artificial Sequence: Synthetic coding sequence
atgcacaagaatagcaagcgtaacaataacttgagagtttcacacactgaggctaattcagtggacgccgagaaggaaaagaacgaaagtcaaaataacttcttcgagcttttacccgcagagattactttcaagatcttcagccagctcgacattagatctctgtgcagagccagtctgacctgtcgctcttggaatgacactattagaaattcagactcgctgtggaagccacactgtatgaccgtgcgagcagtgtgcagacgtgaaattgacgacgatctggaatcaggctatagctggcgggtcatcctactcagaaattaccagaaaagtaaagtcaaacatgaatggttgtccggcaggtacagtaacatttgttctccgatctccctgccggagaagatcatgtatccaatggatgccgatacctggggcgagatcttggaagctgaactcgagcgatag

SEQ ID NO: 30122 - DNA, 744 bp, Artificial Sequence
  Description of Artificial Sequence: Synthetic coding sequence
atgtggcctctgctgaccatgcacatcacccaacttaatagagagtgtttactgcatctgttttctttcctcgataaagatagtaggaaaagcctcgcccggacctgttcccaactccatgatgtctttgaggatcccgcactgtggagcctattgcactttcggtctctcacagagctccaaaaggataatttcttgttaggcccagccctgcgaagtttatctatctgctggcattcctccagggttcaagtgtgctccatcgaagactggctcaagtccgctttccaacgcagcatttgtagccgccatgaaagcttagtcaacgactttctgctgagagtgtgcgaccgattatccgcagttcgctctccaagaagacgggaggcccctgctccaagcagcgggacccctatcgccgtgggacccaaatcaccccgttggggtgggcctgatcacagtgaatttgccgatttaaggtccggagtaaccggcgctagggctgcagcccgtaggggactggggtctctgcgggccgaaaggccatctgaaaccccccctgctccaggcgtctcttggggcccccccccacccggcgcccctgtagtgatttcggtgaagcaggaagagggcaagcaggggagaacgggccggcgcagccaccgggccgcccccccgtgtggctttgccaggactcgggtctgtccgcctaccttcccaggggcagacgcttttccacaatag

SEQ ID NO: 30123 - DNA, 177 bp, Artificial Sequence
  Description of Artificial Sequence: Synthetic coding sequence
aattcgacagatccagtgaaagctgcgcaattcgagatgtcaaatcccagccatttgcttttttttctcccttgtcccttctctcctgtgtcttctctgttcgctttcgtaaatgcgaagcttaagtggcggctgggacttaaaactcccgagcagactaagccacccggcccatag

SEQ ID NO: 30124 - DNA, 2073 bp, Artificial Sequence
  Description of Artificial Sequence: Synthetic coding sequence
atgcagcctcccccgagaaaagtgaaacctgcccaggaagtgaagctcagattccttgagcagctctccatcctgcagacctggcaacagcgcgaggctgatctcctcgaagatatccgatcatattccaagcagcgggctgcaattgagagagagtacgggcaggctctgcaaaagttggctggaccgttcctcaagagagagggccatcgcagcggagaaatggattcccgcggccggactgtgttcggcgcctggaggtgcctgcttgatgccaccgtagccggagggcaaacaaggctacaggcctcagataggtaccgagatctggcaggggggacaggacggtctgccaaagagcaggtcctgaggaagggcaccgagaacttacaacgagcacaggctgaagttctgcagagtgttcgcgagctctcccggtcccgcaagttgtacggacagagagaacgggtttgggcactggctcaagaaaaagcagctgatgtgcaggcccggttgaaccgttccgaccatggcatttttcattcgcgcacgtcccttcagaagctatctacaaaactttctgcccagagtgctcagtattcacagcagcttcaagcggcgcgcaatgagtacttgctgaacttagtcgctactaacgctcacctggatcattattaccaagaagaactccctgccttgctgaaggctctggtgagcgagctctccgagcatctgagagaccccttgacatcgctgagtcataccgagcttgaggccgcagaggtgatcctagaacacgcgcaccgaggagagcagacaacatcacaggtttcatgggagcaggacctgaagctgttcctacaggagcctggagtcttttctcccacccctccacaacaatttcagccggctgggaccgatcaggtttgcgttctggagtggggcgctgaaggtgtggccggaaaatcagggttggaaaaagaggtccagaggctcacatctagggccgccagagattataagattcagaatcacgggcatcgcgtcctgcagcgcctcgagcaacgccgtcagcaagcaagcgagagagaggcccctagcatagaacaacgcttgcaggaggttcgcgagtccatccgtagagcacaggtgtctcaggtgaagggggccgctcggcttgctctccttcagggggcaggcctcgatgtcgagcgatggcttaaacctgcaatgacacaggcccaggacgaagtagaacaggagagaaggctgtcagaggctagactgtcccaaagagacctaagccccacggcagaggatgctgagttgtctgacttcgaggagtgtgaggaaactggagaactgtttgaggaaccagcgcctcaagctcttgctactagagccctgccttgccctgctcacgtggttttcaggtaccaggccggcagagaagacgagctgactattacagaaggcgagtggttagaagttatagaagaaggtgatgccgacgagtgggtgaaggcacgtaaccagcatggagaggttggcttcgtgccggaaagatatcttaattttccggacctgagcctgcctgaatccagccaggactccgataacccgtgtggcgccgagccaacagcctttctggcccaggcgttgtactcctacactggccagtccgccgaagaactgtcttttccagagggggctctgatcaggcttctacccagggcacaggacggggtggatgatggtttttggagaggagaattcggcgggcgggtcggcgtctttccgtcactcctcgttgaggaactgttaggacctcccggcccaccagaactgtcagatccagagcagatgctcccgagcccttctcctccgtcatttagccccccggcacctacatcagtgctggacgggccacccgctccggttctacccggggacaaggcccttgactttcctggcttcctggatatgatggctccaaggttaagaccaatgcggccccctccgccccctccggccaaggccccagacccaggacatcctgacccccttacttag

SEQ ID NO: 30125 - DNA, 2055 bp, Artificial Sequence
  Description of Artificial Sequence: Synthetic coding sequence
atgcagaaactagccagccaatatttaaagcgcgactggcctggtgttaaagccgatgaccgtaatgattatcggagcatgtaccctgtgtggaagtctttcctggagggaacaatgcaggtcgcccagtctcgaatgaatatctgtgagaactataaaaactttatctctgaacccgccagaacagtgaggagcctgaaagagcagcaactaaagcggtgcgtcgatcagctgacaaaaattcagaccgagctccaagaaacagtgaaagacctcgccaaggggaagaagaaatacttcgagaccgaacaaatggcgcatgccgttagggagaaagcagacatcgaggccaaatcaaagttgagcctctttcaatctcggatcagccttcaaaaggcgtcagtgaaactcaaagcgagacgttcagagtgtaattccaaagctacccatgctcgcaacgattacctcctgactcttgccgccgccaacgcccaccaggaccgctattaccagacggatctggttaatattatgaaagcactggatggtaacgtttatgatcacctcaaagactatctgattgcctttagcagaaccgaactggaaacttgccaggcagtgcagaacacatttcagtttcttctggagaacagctccaaagtggtcagagattataacctgcagttgtttctacaggagaacgcagtgttccataaaccacagccctttcagttccagccgtgcgactccgacacaagtaggcagctggaatccgaaaccggcactacagaagagcacagcctgaacaaggaagctagaaaatgggccacgcgcgttgccagggagcataagaacattgtgcaccagcagagggttctgaatgaccttgagtgtcacggtgccgccgtgtccgagcagagccgcgccgagctagaacagaagatcgacgaggccagggaaaatattcgaaaagccgaaataattaagcttaaggctgaagctcgcctggacctgctgaagcagatcggcgtgtccgtcgacacatggttgaagagcgccatgaaccaagtgatggaagagttagagaacgaacgttgggcccggcctcctgcggttacctctaacgggactttacacagtctgaatgctgatacggagcgggaggaaggagaggaatttgaagacaacatggacgtcttcgatgacagttctagtagtcctagcggcaccctgcgcaactaccctctgacctgtaaagtggtgtattcctacaaggcctcacagcctgacgagttgacgatcgaggaacatgaggtgctggaagttattgaagatggggatatggaagactgggttaaggcccgtaacaaggttggtcaagtcggctatgtgcctgagaagtacctgcaattcccaaccagtaactcgctcctgtcaatgctccaatccctggccgccctggatagccggtcccacaccagctcaaatagcactgaggcagagctcgtgagtgggagcctcaacggggatgcctcagtgtgcttcgtgaaagccctgtacgactatgaagggcagaccgatgacgagttgagcttccctgagggtgcgatcattcgcattctaaataaagaaaaccaagatgacgatggtttttgggaaggagagttcaacgggcggatcggggtgttcccctccgtgttggtggaggagctgagcgcttctgaaaatggggacaccccgtggatgcgggagatacagatttcccccagtcctaagccccatgcttctctcccccccctgcccctgtacgaccagcctccctccagcccttatccctcacctgataaacggtctagcctgtattttccccggtcaccttctgccaatgagaaaagcttgcatgcagagagcccaggctttagccaggctagcagacatacgccagagacgtcttacggaaagttgcggccagttcgcgccgcgccaccccctccaacgcagaaccatcggcggccggcagagaagatcgaagatgtcgagatcacactggtttag

SEQ ID NO: 30126 - DNA, 2223 bp, Artificial Sequence
  Description of Artificial Sequence: Synthetic coding sequence
atgcagccacctccacggaaggttaaagtgacacaggaactaaagaatatccaggtcgaacagatgacgaagttgcaggccaaacatcaggcagaatgcgatttactcgaagatatgcggacttttagtcagaagaaagccgccatagagcgagaatatgcacagggaatgcagaaactggcctcacaatatttgaaaagggactggcctggtgtaaaggctgatgatagaaacgactatcggtcaatgtacccggtctggaaatcctttctggagggaaccatgcaagtggctcagtctcgaatgaatatatgcgaaaactataaaaactttatctccgaaccagcgagaacagtgcgttctctgaaagagcagcagctgaagcgctgcgtggatcaactgactaaaatccagactgagttacaggagaccgtcaaggatctcgccaagggaaagaaaaagtatttcgaaactgagcagatggctcatgccgtgcgcgagaaggcagatattgaagctaagagtaagctgagtctgttccagtccaggatatcattgcagaaagcctctgtgaaactcaaggcgcgtcggtccgagtgcaatagcaaggctacccacgctcgcaacgattacctcctgacgctcgctgccgctaatgcacaccaggacagatattatcagaccgacctggtgaatattatgaaagcactggacggaaacgtgtatgaccatctgaaagactacctgatcgccttcagtcgcactgaactcgagacctgccaggcggtccagaatacatttcagtttttactcgaaaactccagtaaggtggttagagactacaacctgcaactgttcctgcaggagaatgcagtgttccacaagccacagccctttcaatttcagccttgtgactcagacacatccagacaactagagagcgaaaccggtaccactgaagaacactcattgaacaaagaggcccggaagtgggcgactagagtggcgagggagcacaaaaatatagtgcaccagcaacgagtactcaatgacctcgaatgtcacggcgcggcagtctccgagcaatctcgggccgaactggaacaaaagatcgacgaggccagagagaacatcagaaaagctgagataatcaaattaaaggctgaggcgagactggacctgttgaagcaaatcggtgtgagcgttgatacttggctgaaatctgctatgaaccaggttatggaagaactggagaatgagaggtgggcacgccctccagcagtgactagcaatggaactctgcactccttgaatgctgataccgagagggaagaaggcgaagagtttgaggacaatatggacgtttttgatgactcctcaagttctcctagtggcacattgaggaattatcccctgacatgcaaagtggtgtatagttacaaagcctctcagccagacgaactgaccatagaggaacatgaagtgcttgaggtgattgaagatggagatatggaagactgggtgaaagcccgcaataaagtcggccaggtcggctatgtgcccgaaaagtatctgcagttccccactagtaactccttgctcagcatgctgcagagccttgctgcattagattcccgcagccacacgtcttccaacagtactgaggctgaactcgttagcgggagtctcaatggggatgcatcggtgtgtttcgtgaaggcactgtacgactatgaaggacaaaccgacgacgaattgagctttccagagggagcaattattcggatcctgaacaaggagaaccaggacgacgacggcttctgggagggggaattcaatggacgtattggagtatttccctctgtactggtcgaggaactgtctgcatcggaaaacggcgacactccctggatgagagagatccagatttcgccttccccaaaaccacatgcttccctgccacccctgcctctctacgatcagcccccctcttccccatacccttccccagataaaaggagctccctctattttcctagatcgccttcggccaacgaaaagtccctccatgcagagagcccaggcttttcccaggctagtaggcacacccctgaaacctcctacggcaagctgaggcctgtgcgagcagccccccctcccccaacgcagaaccacaggcggcctgccgagaaaattgaagacgtggagattactctggtctag

SEQ ID NO: 30127 - DNA, 1548 bp, Artificial Sequence
  Description of Artificial Sequence: Synthetic coding sequence
atgcagaagctggcttcgcaatacctgaaacgagattggcctggcgtgaaggccgacgaccgcaatgactatcgtagtatgtaccctgtctggaagtctttcctggagggaacaatgcaggtggctcaatcacgcatgaacatttgcgagaactataaaaactttataagcgagccagctaggaccgtaaggtctctcaaagagcagcagcttaagagatgcgtagatcagttgaccaagatccagaccgagctgcaagaaactgtgaaagacctagccaaaggcaagaaaaaatacttcgaaactgagcagatggctcacgcggtccgcgaaaaggctgatatagaagctaagagtaagctgtctctgttccagtcgcggattagtcttcagaaagcttcggttaagctcaaggccagacgctcagagtgcaactctaaggccactcatgctaggaatgattacttgctgactctggctgcggcgaacgcacatcaggatcgttattaccagaccgatctggtgaatattatgaaggccctggacggaaatgtgtatgatcacctgaaggactaccttatcgcattctctcgaactgagctcgaaacttgtcaggccgtccaaaatacattccagttcctgttagagaactcgagcaaggttgtcagagactataacttgcagttgtttcttcaagagaatgcagtcttccataaaccccagccatttcagtttcaaccgtgcgactccgatacctcaaggcagctggaaagcgaaacagggacaaccgaagagcatagcctcaataaagaggcacgtaagtgggcgactcgagtggccagagagcacaaaaacatcgtccatcagcagcgtgtgctgaacgacctggagtgccatggagcggcagtgagcgaacagtccagagcggagctggagcagaagatcgatgaagcccgggaaaacattcgcaaggccgagataattaaactgaaagctgaggcgcgacttgacctgttgaaacagataggagtgagcgttgacacatggctcaaaagcgctatgaaccaggttatggaagagctggaaaatgaacgatgggcgcgtccacctgccgtgacctcgaatggcacgcttcattccctcaatgcggacactgaacgtgaagaaggtgaagagtttgaagataacatggacgtctttgatgactcatcctctagcccctcgggaacgctccgtaactatcctctaacctgcaaagtagtctactcatataaagcatctcagccagatgaactgacaatagaagagcacgaggtactagaagtgattgaggatggggatatggaggattgggttaaggcccgcaataaagtcggccaggtcggctacgtgcccgaaaaatatctccagtttccgacaagcaacagtttactgtccatgttgcagagcttggcggctctagatagccgttctcacacaagcagtaacagcaccgaggctgaactcgtgtccggctcacttaatggggacgccagtgggaaagactag

SEQ ID NO: 30128 - DNA, 1854 bp, Artificial Sequence
  Description of Artificial Sequence: Synthetic coding sequence
atggatctgaaaacagcagtgttcaatgcagcacgggatgggaaactgcgcctgctcacgaaattactggcctccaagtccaaggaggaggtgtcttctttgataagtgagaaaaccaatggcgctactccactgctaatggccgctcggtatggccacttggatatggtcgaatttctcctagagcagtgtagcgctagcatcgaggttggggggtccgtgaacttcgacggggaaaccatcgagggggcccctcccctgtgggccgcatctgccgcaggccacctgaaggtcgtacaatctttactcaaccatggcgcatccgtgaacaataccaccttgaccaactcaacgcccctccgcgccgcttgtttcgacggccacctcgagattgtgaaatatctcgtggagcataaagccgacctggaagtgagcaatcgtcacgggcacacatgtctaatgatcagctgttacaaggggcacaaagagatcgcccagtatctgctcgagaaaggtgcggatgtgaatcggaagtccgttaagggaaacaccgcactgcacgactgcgctgaatcagggtcactggatattatgaagatgttgctgatgtactgcgccaaaatggagaaagacggctacggcatgaccccgctgctgagtgcttctgtgactggccatactaatatcgttgacttccttacgcaccacgcgcagaccagcaaaaccgaaaggattaacgcccttgagctgctgggcgcaacgtttgtcgacaaaaagagagacctccttggagccctgaagtattggaagaaagctatgaatatgcggtacagcgatcggaccaatatcatcagtaagccagtcccacaaacactcattatggcttacgattatgcgaaagaggttaactctgcagaggagctggagggcctgatcgcagatccggatgagatgagaatgcaggccctgctcattagagaacggatactgggaccaagccatccggacaccagctattacatacgctaccggggagccgtctacgccgactccggtaattttaagaggtgtatcaatctttggaaatacgcccttgacatgcaacagagcaacctggacccattgtcacccatgactgccagctcacttttgtcttttgcagaacttttttcatttatgctccaggaccgggctaaaggtctcctgggaactacagttactttcgacgatctaatgggcattctttgtaagtccgtactggagattgaaagggctataaaacagacccaatgtcctgccgatcctcttcaacttaacaaggcgctgtccattatactgcatctcatttgtctgttggagaaggtgccatgtaccctggagcaagaccacttcaagaagcaaaccatctatcgttttctgaaattacacccgcgaggcaaaaacaacttttctccacttcatttggccgtagacaagaacactacctgtgtgggtagatatccggtctgcaaattccctagtctgcaagtaactgccattctgatcgagtgcggggctgacgttaacgtgcgtgatagcgacgacaacagtcccttacacatcgcggccttgaacaatcaccccgatatcatgaaccttttgatcaaaagtggtgctcacttcgatgccacgaacctacacaagcagaccgcctccgatttgctcgacgaaaaggagattgccaaaaacctgatccagccaatcaaccacacaacgttacagtgcctcgcagcacgcgtgattgtgaatcaccgcatctactacaagggccacattcccgagaagctggaaactttcgtgagccttcaccggtag

SEQ ID NO: 30129 - DNA, 5433 bp, Artificial Sequence
  Description of Artificial Sequence: Synthetic coding sequence
atggagacacttgattcccagcgagtgcaggaccggctgttggcggcccccgggtgcagcagcccttcaggacagcaagagctgttctcttcacatgtgatgcaggaagagagtgctaacgacatggagtgtgagcagctcccagctgagattctcaggcaagtcacagtccaccgcgaccctatttatggcttcggcttcgttgccggcagcgagcgcccggtggtggtgaggtccgtgagacccgggggcccttccgaaaacaagttacttgccggtgaccaaatcgtcgccatcaatgaagaggacgtcagcgaagcaccacgcgagaggctgattgagctgatccgatctgctaaggagttcatcgtactgacagtgttacatacccaccagtccccgaagagtgcatttattagtgccgcaaagaaggccaaactccgatccaatccggtcaaagtgaggttcagtgagcaagtagccgttggcgagacagacgcaaaaatgatgaagaaggaggctctattgctgattcctaacgtcctcaaggtcttcttggagaacggacagatcaagagtttcacgtttgacgggcgtacgactgttaaagacgtgatgctcacacttcaggaccgcctttccctccgtttcattgaacacttcgccctggtcttggaatacgccggcccagagcaaaaccataaattcctcctcctgcaggataaacaaccactggcgtacgtggtacagagaacacattatcacgggatgaaatgtctctttcgaatttctttcttccccaaggacccagtagagctgttacgcagggaccctgctgctttcgaatacctctacatacaaagcaggaacgatgtgattcgcgagcgtttcggaatggaccccaaacccgagatgttgttggggctggccgcattacacatctatatcaccgtctccgctaccaggccaagtcagaagatttccctgaagaatgtagagaaggaatggggtctggaaccgtttctccctccaagcctgctgcaggtgattaaggagaagaatctgaggaaatccctatcccagcagctcaaagcccatcagacacatccatcttgcgggaccaaggggagtgccattcaggccaaattacagtatctccggatcctcaatgagttacctacctttaccggtgtgctgttcaatacagtgggtttagacgagaaacagagcgccaccacccttctggtgggacctagacatggaatttctcacgtaattgacctgaaaactaacctgacaacagtattgtctgaattttccaagatctcaaaaatacagctttttcgcgagaaccagggcgtggctagggtggagacatctattatggacgcaaagcctctggttctgcttatggagtggccggaggcaaccaattttgcctgccttattgccggctattgccgcttactgctggactcccggaagatggtgttctccaggcccgcatcacagcccctgccgcctcctatgattaaggctgactatatgcactctgctcaccgcccagtgaccgggggtcacctaggtaagaaagagtcctcttatgttggctcagttggcactagtccccgaaagtcctccagatgcaccccaccccctgcggattctgagcttgtatctttttgctatcttcacatgcgggagcagcggaaagagcaggagtctcgaactgacgttaacgaaaacctgattttttttgaagagacccgcccaaggaccaagtcagatcccacgagtaaatcaagcggccagggctatgaggtagtgcctgacgattttgacgctgcaagtctcgaccacgaaccgtgtgcctccagggcaaggagttataccctggacaactcactgggagcagaagccctgaacttctactgtgactcttgcaaagcaaaattgcaggaacagcttgggccccggaaagggggcaagcctggttcatccagagacaacatcgtagacctcatgtcactgcctccaccaggtagcgaggaagaggaggaagaagaggacgagacaacctcactgcttcctgccatagccgctcctccaccaggtttcagagataactccagtgatgaagatgatcccaaacgacgtgcggtccagagccaggagcagggccggcacttgcgaggattgctctatgacgagatccctgtaacccttatcgatagcgtccagactcgcactgtgagggatcatgcccaggagctcgacgacgcactagtctctaccctgcaagctctagaagcgcttgccgcctcagaagacggcccacacccaccacccccacagacagctggactcatagtattagccacgatcacacctgaaagctccctcgacagcgggcacgaaacgaattcttctgaattaaccgatatgtcagagatgatgtccgcgatgaagcagcaccaaaataccacttattttctagcacaacatcttaacaaagatagtctgttggcccggaaggacctgccctttcgcattcagtcttgcgccgcacaggctgtgttgacagcgccatacagcctaggaaggcccgatccgaacccaagcctgcaacccatcgccactggccagtcccctgggccacctggagctaggcgcaagctacctcagtccgaagggcaggtccagggcgagagaacttattccttggctgtgcaccccgcactgagccctcagctgagcgaacagaagaacctgagcctgctgtctcccgtgcctgaagataaagggccaggacacacccgcgcaggcctcgagatgagccttagagccgccacatcaagcctgtctgaggagcaagtatcagagcttcgtgataatttacccaaggaggtccgactgagccctaaattgatcctggatcctaagtctagcgtcacccccgctataatctccgccgccctccaacaagttgttcacaataaaagcctggttacagcaggcggcgcgctgggcaaccctccatctcggggagagaggcgcctggaagccagcatggggcgccctgaagtctcaatgatgtcatctagcgcatcaaaaaaccttaagtttaagatttccccatccgctccagaaacatcctggaactctcaacatcagctcggcgccgaggtctcgtccagccctcgagcgcctaccgggtctagagcagactcactgcatttgtctcagcaggaagacagtctgccagtccagaattttcccccaaaaagctatctgctgcgcacaagtagggagtctgtaggtaaacaagcgactggcgaggtcgccggaaaaggaggaccggtgggaggaaagcccacattgcaaaaacaggggacaattagcagccagggcgagaaggctcagctcgaaagtactcccaaacgcagtaagcttgaggaaacaagcctcgttccccgtgcaacttaccccatggccctccagagtccttcgtgccaatcccgaagtcactctccctcctgccaaccacatggtcattccccttctagccaaagcagaggccagagtccaagttgtcagccgcgaggacagtctccattgcggtctcaggctgcatccaggcaggtgagtaccatgccatcgcgtaagcttgagacgacactgaacggggctcattctactagtgaaggacccgcaaagccgaagtcatcccgtggccctttccgactgaggaacctgttttcagctactttccccacccgccagaagaaagagactgatgaaagacaagctcagctccagaaggtgaaacagtatgagctcgagttcctggaggagctgttgaagccaccttctcagggggaactccctggcactgaatacttgcagcctccagctcccgggcgctgtagttgccagctacggagttcccccgtgcagcaggggcctggcatgagcagggagcagagaaggagctgcgactgcaagagaatctgcaggggcggtcgacctcaggcaacgcagactcccgtcccatccctaagggggcgtgagcgcgatcgcgtccttccctcacagcgccagccggaagcaggacctggtgtgtcattgagttcacctatcaatgttcagcgcatcaggtcaacctccctggagtcacgagagtgtcggtctgaccctgaaagcggggtaagctgcctgaccacctgcgctagtgggggggaatgcctcggtgcacccaactaccgtaagctcatgcggcgctattccatttccgagctggaccaaggcgaccgtgctagtctcacgagcgacgtgtacccgcaccctccactcggcatgttaccacgcgaggccaaagaagtggaggcttcgctccctatagccttgggccccaaatcccggtcactagaaagtccgactctcggagatcctagctatgttcaagtggcccccgaaaccaaaggacccagacagatggcggtttttagcttgccagaggaggtttacagaaaacctgcagagttggacgaagattctgagtcttctaagtgctgcagtatccgttattgcttctactatcggaagtgtgatatggccgacgacgcctctgacgggaaagatgaactgtcatactccatccctatgaaaatcctgcccggaatgaagctggatgagcaggtcgttccagtggtgtcccgtaccctgcaggtgctggacgccgctacctgctcatcctcgtcgccagaggcctcaagaactcaggaaatcgacctgcgagtcagtacattcgagggctcgcttgccaagataaatgcactccgggctcatgcctacgggctacccgatgggttcctcgcagcccgtttggacacaaacgaactgctgacggttctacgccagtgcgtggccagtccagaggctagggcacctaagccctacgtctcacaaatttccgagtacaaacttgagcttgcccttaagtttaaagagcttcgggcttcttgcagaagggtggctaatgtggacaaaagtccaacccacatgctggccgcgattaccgggagtttccaggtcttgagcagcctcattgaaactttcgtgcgtctcgtctttattgtgcggagcgaggcccagcgccaggagctcctggcaaaagtagaggaagttgtgagaaattatactttcctgctacgggcggctgaagagtctaccgctaggaacctgaaccagcagcagcagcagcagcagcagcagcagcagcagcagcagcagcagcagcagcagcagcagcagcagcagcaacagcaggtagccgccgctgccggtgccgcgaccgaacacccacctgggtcacccacaagcgcaaccgtaatgagtacattcacccactccctcaagactcttatcaagtag

SEQ ID NO: 30130 - DNA, 1650 bp, Artificial Sequence
  Description of Artificial Sequence: Synthetic coding sequence
atggctgtacctcctagagggcgggggattgaccccgctcggactaatcccgatacctttcctccttccggagctcgttgcatggagcctagcccagagaggccggcctgttctcagcaggaacctactctcggaatggatgctatggcttccgaacacagagacgtactggttctgcttccctccagagagcagctacggcttgcggtgggagtcaaggccaccggccgcgagctttttcaacaggtttgcaatgtggcaagcatccgcgatgcgcaattcttcggcctctgtgtcgtgcgcaacaacgagtacattttcatggacctcgagcagaaactcagcaaatacttttctaaggattggaaaaaggaacgaaatgaaggcaacgaaaagccacgcgccccttttgtggcatttctaagggttcagcactatgtggaaaatggaagggtgatttcagatcaccgggctcgtcacctgtattattgtcacctcaaggagcgggttctacgatcacaatgcgctcaccgagaggaagcatattttttattagccgcctgcgcactacaggcagatctgggggagcatcgcgagagcgcgcacgcagggcggtatttcgaaccacacagttactttccccagtggattatcacaaaacgcggcatcgattacatcctgcgacatatgccaactctgcaccgggagcggcagggtttaagccctaaggaggcaatgctgtgctttattcaggaggcctgtagactcgaagacgtacccgtgcatttttttaggttacataaggataaaaaagaggggcgacctacggtgatactaggtctggcgctccggggcgtgcacatctaccagggtaaaaagcttgagattcagctcgacggtttgcctgctgcgcagaagctggtgtactatactggatgcacgtggcgatctaggcatctcctacaccttcttcgcgctagccatcagctgcatctcagggtacgacctacactgcagcagctgcgccagcgcgaagaggcggaggagaaacaacactatcgagaatcctatattagcgatgaactcgaacttgacttggcaagccggagttttcccggtagcggggtgtcttcacagcattgtccacattgcctctcgaggcactcagccgatagtcatgggagctcatacactagcgggatcaaagcaaattcttggcttcgcgagtccagggaaatgtcagtggatgtacctctggaggtccacgggctgcatgaaaaggagccgtctagctccccgcggacatcccgatctcacccatctactaggggggactctcaggcaactagacaggagccttgtacgcaagttcgcacgagagggcagtccgcagaagccgtgcaccaaatccaggagatgacagcgggagtgtctgaggaacagcatagccacggactagacgatatgcagctccaccagcttgctctccaccctgccccgacatcgctttcccacaccttccatagagcactcgactgcaggttagcaggaccctgcgagacgagagccactcttcccagcaaacgtagcagcaattgcttggccttggacctttttggggaggccccccctcaagagttcgttgtgtag

SEQ ID NO: 30131 - DNA, 1446 bp, Artificial Sequence
  Description of Artificial Sequence: Synthetic coding sequence
atggatgacgtcaaagctacagggcgggaacttttccagcaggtgtgtaacgttgcgagtattcgggatgcccagttcttcggattgtgcgtcgtgaggaacaatgagtatatttttatggacctcgagcagaagttgtctaagtatttttctaaggattggaaaaaggaacgaaatgaagggaacgaaaagccccgcgcgcctttcgttgccttcctgagggtacagcactatgtggaaaatggccgagtaatctccgaccaccgcgcgcgacatctttattactgtcatctgaaggagagggttctacgtagccagtgtgcccatcgcgaggaagcttatttcctgcttgctgcatgcgccctacaagcggatttgggtgagcaccgggaatcagctcacgccggccgatacttcgagcctcactcttattttccccagtggattattacaaaaagaggaattgattacattttgcgacatatgcctaccttgcaccgggagcgccaagggctttcgccaaaggaggctatgctctgtttcatccaggaagcttgtagacttgaggatgttcccgtgcacttctttaggttacacaaggataagaaagagggaagaccaacagtgatcctcggcctggccctgcgaggggtccatatctatcagggaaaaaaactagagatccagcttgatggtctacccgctgcccaaaagctggtgtattacacaggctgcacttggcggtctcgtcatctgctacacctcctccgtgcatctcaccagctccacttaagagtgcgccccaccctccaacagctgcggcagcgagaggaagccgaagagaagcagcattaccgagaaagttatatcagtgacgagctcgaactcgacctggccagcaggagcttcccgggctcgggggtgagttcacagcactgcccccactgcctgagtcggcatagcgcagacagccacggcagctcctacacaagtggtatcaaggctaattcttggctgagagaaagcagggagatgtcagtggatgtcccgctggaggtgcacgggctccacgaaaaggagccctcctcatctccccggacctcccggtcacacccttccactaggggggattctcaggcgacccgccaagaaccctgcacccaggtccgcacaagggggcagagcgccgaagccgtgcatcaaattcaagagatgacagccggggtcagtgaagaacaacactcgcacggtctggatgacatgcagctccatcaactggccttgcaccccgctcccacttcactctcacatacattccatcgcgcactcgattgcagactggcaggcccctgcgaaactcgcgcaaccctgccgagcaagaggtcctctaactgcctcgccctggacttgttcggtgaagctccaccccaggagtttgttgtgtag

SEQ ID NO: 30132 - DNA, 963 bp, Artificial Sequence
  Description of Artificial Sequence: Synthetic coding sequence
atgcctacattgcaccgggagcgccaggggctcagtccgaaggaggctatgctgtgcttcatccaggaggcttgtcgcttggaggacgtccctgtccatttttttaggttgcacaaggacaagaaggagggacggccaaccgtgatcttgggactggccctcaggggagtgcacatctatcagggcaagaagttagaaatccagctcgatggcctcccagccgcccagaagcttgtatattatacgggttgtacctggcgcagtcggcacctgctgcacctgctccgcgcatcccaccagctgcatctaagggtaagacccacactgcagcagctgaggcaacgagaagaagccgaagaaaagcaacattaccgggaatcatatataagcgatgagctggaactggatcttgcgtctagatcctttccaggcagcggcgtgagcagccaacactgtcctcactgtctaagcagacattccgccgatagccacggctccagctacacaagcggaatcaaagccaattcatggcttagagaatcaagagagatgtctgtcgacgtgccactcgaggtccacggattgcacgagaaggaaccttccagcagtcctcgtactagtaggagccatccatcaacgaggggagatagccaggcgacaaggcaagagccatgcacccaagttcggacaaggggccagtcggccgaggccgtccaccagattcaagaaatgactgccggcgtatccgaggagcaacacagtcacggccttgatgacatgcaactgcaccagttggcccttcatccagcccccaccagcctaagccataccttccatcgcgcgctggactgtcggctggctggcccctgtgagactagggccaccttgccatccaagaggtcaagtaactgtctggctttggatctcttcggagaggctcccccacaagagtttgtagtttag

SEQ ID NO: 30133 - DNA, 1395 bp, Artificial Sequence
  Description of Artificial Sequence: Synthetic coding sequence
atggacgggacagaagggagcgctggacagccagggccggctgagcggtctcaccgttcctcagtctcatctgtgggggcacgggctgcagatgtacttgtgtatctggcggatgatacggtcgtgccactcgccgtcgaaaatctgccgtcccttagcgcccacgagttgcatagagctgtccgcgaggtactccagttgcccgatatcgctttagacgtgtttgcattatggctggtgtcacccttgctggaggtacagctgaaaccaaagcatcaaccttacaagctaggaagacagtggccagaactgctgctcaggtttacatccgcaccagacgacgacgtggcgatggatgaacccttcttacagtttagacgtaacgtgttttttccaaagaggagagagctccagatccacgacgaagaagttcttaggctgctgtacgaggaagccaaaggtaacgtgctcgccgcccggtacccatgcgacgtggaagactgcgaggccctcggtgcactagtctgcagggtacagctggggccttatcaacccgggaggcctgcggcctgcgatctgagagagaaacttgactcgttcctacctgctcacctttgcaaacgggggcagagtctttttgctgccttgcgtggccgcggcgcacgtgccggacccggggaacaaggccttttgaatgcttaccggcaagtacaggaggtgtcgtcagatgggggctgtgaggctgccctggggacccattacagagcctatctgctcaagtgtcacgaacttcccttttacggctgtgcctttttccatggcgaggtggataagccagcccagggattcctacaccgcggagggcgtaagccagtgtctgtggccatctccctggagggcgtgcacgtgattgattcgcgtgagaaacacgttctgctgggcttgagatttcaggaactgtcgtgggatcacaccagtcctgaagaagaggagccaattctgtggctcgagtttgatggcgatagtgaaggtacccctgtgaacaaactgctcaaaatttactccaaacaggcggagcttatgtcatccctgatagaatactgtatcgagctgtcccaggccgccgagcccgctggtcctcaggattccgccacaggatcgccctctgaccctagctccagcctcgccccagtccagcgccctaagttgcggaggcagggcagtgtggtctcgtccaggatccagcacctcagtacaattgattacgtggaagacggtaaaggaattcggcgggtaaagcccaaaagaaccacttccttcttcagcagacagttgagtctgggtcaggggtcctataccgttgttcagccaggcgacagtttggaacaagggtag

SEQ ID NO: 30134 - DNA, 1293 bp, Artificial Sequence
  Description of Artificial Sequence: Synthetic coding sequence
atggatggcaccgagggatccgctggacagcccggcccagccgaaaggtcgcaccgtagctcggtatccagcgtgggcgctcgcgccgctgacgtgttggtgtacttggctgatgacacggtcgtccctctcgcagtggagaatcttccctctctctcagctcatgaattgcacagggctgtccgagaggtgctgcagctccccgatatcgccctggacgtctttgctttgtggctggtgtcacccctgttagacgaaccattcctgcagttccggcgcaatgtcttttttccaaaaaggagagaacttcaaatacatgacgaagaggtgctgagactgctctacgaggaggctaagggaaacgtgctcgcagctcgatatccttgtgatgtggaagactgtgaggccctcggtgcgttggtatgcagagtccaacttggaccctatcagcccggaagacccgccgcgtgcgatctgagagaaaaactagatagcttcctgccggcacatctgtgtaagcgagggcagagcctcttcgccgccctgagaggacgcggcgcgagggcgggtccaggagagcagggcctgctgaacgcctacagacaggtgcaggaagtttcttcagacggaggctgcgaagccgctttgggaacacactaccgagcctacttgttaaagtgccacgagttgcccttttacggttgcgcttttttccacggcgaggtggacaagcctgcccaaggtttccttcataggggaggcagaaagcccgtctctgtggctatcagcctggagggcgtgcacgtcatcgattcccgtgaaaagcatgtgttgctaggcctcagatttcaagaactctcctgggaccatacgagcccggaggaggaagagcccatactctggctggagtttgatggagattcagaaggaactcccgtgaacaagctccttaaaatctatagtaaacaggccgaactgatgtcgtccctgatcgaatattgtatcgagctcagtcaagccgcagagcctgcagggcctcaagattctgccaccggatccccatcagacccttcctccagtctcgctcctgttcaacgaccaaagctgaggcgccagggaagtgtcgtatcctctcgtatccaacacctctcgacaattgactatgtggaggacggcaagggtattcgcagagtcaaacccaagcgcactactagctttttttcgcgccagttatccctgggacaaggatcctacactgtggtacagccaggagacagcctggaacagggctag

SEQ ID NO: 30135 - DNA, 273 bp, Artificial Sequence
  Description of Artificial Sequence: Synthetic coding sequence
atggatgggaccgaggggagtgccggccagccaggccctgcggagaggagtcaccggagctcagtcagctctgtgggcgccagggcagctgacgtgcttgtttacctagcagacgatacagttgtgcccttggcagtcgagaaccttccatccctctctgcccatgaactgcaccgagctgtacgcgaggttctgcaacttcccgatatcgctcttgacgtttttgccttatggctggtcagccccttgttagaggtacaactgaagccatag

SEQ ID NO: 30136 - DNA, 1875 bp, Artificial Sequence
  Description of Artificial Sequence: Synthetic coding sequence
atggcgccccggcgcctcctgttagtgggcgagggcaattttagttttgcggccgcgctgagtgagacactggatcaatctacccagcttaccgccacatgcttgcaacgaccagccgaactggcccgggatcccctagcatgggaaaatctgcagtgccttagggaacgcgggattgacgttcggtttggcgtagactgtacacagctcgccgatgtgttcgagctgcatgagagggaatttgaccagatatactttatttttcctcactgtggccgcaaagcaggggtggccaagaaccgcgagctgcttgcaaagtttttccagtcttgtgctgacgtgctagccgaagaaggtgaagtacacgtggccctctgtagagggcaagggggcacgcctgctgataaaccccagcgggaatggcacaactcttggcaggttgtcgcaatggcagcactgggaggcctcatcctaagcgacgtgtaccctttctcctgtaaagccgtcgcagggtataaatgcactggctaccggtcgcaggataagagttttcacgttgagggcgctctgaatcacatattcaccaggtctctgccattcgaggggagccaacctagaatctttaggatcaagctaggcaatcaatggttctctttccctgagcccgaagccctggtcgggaagttaaatcgcggctttctggaggcacctagctgccacccgattaagacaatcaacgagaagctcatagccgaattaggtaaagtgtttcccctgaagcggctaaaatgcagctaccccctgcttcctcaggaagggacgtccgtcctgcccttctggaactgcgacttcctgagtgctgccttctggatctccctgcacgaggataactcaaatagcgaaagcctgacaggaggcacctctcaggacgttgaagatttcttagtcagcttcagcgaattgagcctcctgaaaaaccctggccgtgacggtaaggaagaggcctgtgaaggcacttgcggccaggcgaaaatttgcctgagacccagtctgttagtgcacgtacaggatgtgattgaagtgcccgatttcctgtcggggtcattacatatcctatctgggcccgtgtttcagaagtgccacatacttccttttactatgcccgcgttccacgagacactgtttattctcggagtgaatcagaacctaaaagatgggtgcctccaatcccttttagaccatctgaagggtattttggactccctactaactcagacgctaccagaatcaagtaagttaagcagcctcgtcaaatttgttttgcaaagtaacggtaaagattacatgattcgcgtcaaaacgcataatttctcacccgattgtacagaggacttgatcatcgggagcgtgattacatccgcaaccagcgttatccacaaagaccagtgctttgtttttgtaagcatgaatctggacttactggcgatgttggtctggtgtatctccgactggcgaatgctttggaccttcgataataggttcctgaaaaactttgtcccagggaaaatcgagccctttaagagtcacagtctgtaccccccatgctatgtgcatgacgtgtctttctggattgaccaaaagaagggctttgatgagcttgagtttcacacagtagctcgtgctgtgagtcaggatacaattattagcatccagttcctaagccggttccagcacccaaagactcagcaagtatctctgtgttaccggcttacgtaccaaacctgtgataaggcactgacgcagcaacaggtggccagtatgcaatcccagttccgaaaagagatccagcagcatttgtatgtgatacctcgctag

SEQ ID NO: 30137 - DNA, 1428 bp, Artificial Sequence
  Description of Artificial Sequence: Synthetic coding sequence
atggccgctctaggagggctcatcctgtctgatgtctacccgttctcttgcaaggctgtagccggctacaagtgcaccggctatagatcacaggataagtcattccacgtggaaggagcccttaatcatatattcactagaagcctccccttcgaaggcagccagcccaggatcttcaggattaagctcgggaaccagtggttcagttttcctgaacccgaggcattggtggggaagctgaaccggggatttttagaggccccgtcttgtcacccaataaagacaattaacgagaaactgatcgcagagttgggtaaagtgtttccgttgaagcgcctcaaatgtagttaccctctccttccccaagagggtacaagcgtccttcctttctggaattgtgactttctgtccgcagccttttggatcagcctgcacgaggacaactcaaactccgagagccttactggagggacaagccaagatgttgaggacttccttgtttctttttccgaactttccctcctgaaaaaccctgggagggacggcaaagaggaagcctgcgagggaacttgcggccaggccaagatttgtctgagaccttccctgctagtacacgtgcaagatgtgattgaggttcctgacttcctcagcggctccctccatattttgagcggtccagtgttccagaaatgccatatcctcccctttacaatgccagcctttcatgaaactctgttcatactaggtgtaaatcaaaacttaaaagatggttgccttcaatcccttcttgatcacctgaaaggcatactggacagcttactgacccagactttacctgagtccagcaagttatcctccttggtgaagttcgtgttacagagcaacggcaaagactacatgatcagagtcaaaactcacaacttcagcccagattgcaccgaggacctgatcataggctctgtcattacctccgctaccagcgtgatccacaaagaccagtgtttcgtctttgtttccatgaatctggacctccttgccatgctagtgtggtgtatttccgactggcggatgctgtggactttcgacaatcggtttctaaagaatttcgtccctgggaagatcgaaccgttcaaaagccactcgctttatcctccttgctacgtgcacgacgtgtctttttggattgaccaaaaaaaaggttttgatgaactggaatttcacaccgtagcgagggctgtctcacaggatacgattataagcatacagtttctgtcacgattccagcatccgaagacacagcaggtgagcctgtgttacagactgacttaccagacctgcgataaggctttgactcagcagcaggtggcctcaatgcagagtcagtttaggaaggagatacagcagcatctatacgttatcccaagatag

SEQ ID NO: 30138 - DNA, 1656 bp, Artificial Sequence
  Description of Artificial Sequence: Synthetic coding sequence
atgtccggaggagaacaaaaacccgaaagatactatgtgggggtggatgttgggaccgggtccgtacgcgccgctctggtggaccagtccggagtcttactcgcgttcgctgaccagccaatcaagaactgggaaccacagtttaaccaccatgaacagtcatctgaggatatctgggccgcatgctgcgtcgtcaccaagaaagtggtgcaaggcatcgatctaaatcagatcaggggcctggggttcgatgcaacatgcagcttagtcgtgctggataagcagtttcacccgctccctgtaaaccaagagggcgattctcacaggaacgtaatcatgtggctggaccatcgagccgtgagccaggtgaaccgcataaacgagacgaagcattcagtgttgcaatacgtggggggcgtcatgagcgtagagatgcaggcgcccaaacttctatggctgaaggagaacctccgcgagatttgttgggataaggccggtcacttcttcgatctgccagactttctgagctggaaggcgaccggtgtgaccgccagatccctgtgttctttagtgtgcaaatggacttatagcgccgagaaaggctgggatgattcgttctggaagatgatcggcttggaagacttcgtcgccgacaactactcaaaaatcggtaaccaggtccttccgcctggagcctccctgggcaacgggctcactcccgaagccgctcgggaccttggcctcctcccagggattgccgtggccgcatccttgatagatgcgcacgccggtggattgggcgtgatcggcgccgacgttcggggacatgggctcatctgtgaaggtcagccagtaacctcgcgactggccgtcatctgcggtacatcgtcatgccacatgggaatctctaaggacccaatctttgtacccggggtttgggggccatatttttcagccatggttcccggattttggctgaatgagggcggtcagtccgtgactggcaaactaatagatcacatggtgcaaggacacgccgcattcccagagctgcaagtgaaggctaccgcccgctgccagtccatttacgcgtatctgaacagccatctcgacttgataaaaaaggcacagccagtcgggttcctaacagtggatctccacgtgtggccggactttcacggtaaccgtagccccctcgccgatctgaccctgaagggaatggtgactggtttgaagctctcacaagacctggacgatctcgcaatcctttatttggccactgtacaggcaatagccctaggcaccagatttataatcgaggccatggaggcagctggacatagcatcagtacattgtttctttgtggggggttatccaaaaacccgctcttcgtgcagatgcatgccgacatcactggaatgccagtggttttgagtcaggaggtagagtctgtccttgtcggtgctgcagttctcggagcctgtgcctcgggagatttcgctagcgtgcaggaagcaatggcgaaaatgagtaaggtcggaaaagttgttttcccccgccttcaggataagaagtattacgacaaaaagtaccaagtctttctgaaactcgtggagcatcagaaggaatatctggccattatgaatgatgattag

SEQ ID NO: 30139 - DNA, 558 bp, Artificial Sequence
  Description of Artificial Sequence: Synthetic coding sequence
atgagcggtggtgagcaaaaacctgagcgttactacgttggtgtcgacgtggggacagggagcgtgcgggctgccttggtggaccagtccggagtcctcctggcattcgcagaccagccgattaaaaattgggagccacagttcaatcaccatgagcaaagctccgaggacatctgggccgcgtgttgcgttgtcacaaaaaaggtagtgcagggaatagacttgaaccagattagggggcttgggttcgatgcaacctgctctttggtagttttggataaacaattccacccactgccagttaaccaggagggggatagccaccggaacgtcattatgtggctagaccatagagccgtttcacaggtcaatcgcatcaatgagactaagcactctgtcctccaatacgtcggaggcgtcatgtccgttgagatgcaggctcctaagcttctgtggttgaaagagaacctgagggagatatgttgggacaaagcaggtcatttctttgatctccccgactttctatcctggaaagcaaccggtgtcaccgcaaggtag

SEQ ID NO: 30140 - DNA, 1392 bp, Artificial Sequence
  Description of Artificial Sequence: Synthetic coding sequence
atgtccgggggcgaacagaaaccagaaaggtattacgtgggtgtggacgtagggacgggctctgtccgggccgctttggtggatcagagtggtgtcctgctcgcattcgccgaccagccaattaagaactgggagccccaattcaatcatcatgagcagtcctctgaagacatctgggctgcgtgctgtgtcgtcaccaagaatctccgtgaaatctgttgggataaagcggggcatttttttgacttaccagatttcctttcttggaaggcaactggtgtgaccgcacgctcgctgtgtagcctagtgtgcaaatggacctacagcgcagaaaagggatgggatgatagtttttggaagatgattggattagaggactttgtcgctgataattactccaaaattggcaatcaggtgctgccacccggcgcgagtctcggcaacggactgactccggaagccgccagagatctaggcctgctcccaggaatcgcggtggccgcgtccttgattgatgcccacgctggcggcctcggggtgatcggcgctgacgtgaggggacatggattgatttgtgagggacaaccagtgacctcaagattagcagtcatctgcgggacctcatcctgtcatatgggcatctcgaaggatcccattttcgtccctggggtgtggggcccatacttctccgcaatggtgcctggcttttggttgaacgagggcggtcagagcgtcaccggcaagcttattgaccacatggtccagggccacgctgccttccctgaactccaggtgaaagcaaccgccaggtgccagtctatctatgcttatctcaactctcatctggacctgattaagaaggcccagccagtgggcttcttgactgtcgatctacacgtctggccggatttccacgggaacagatcacccctggccgatctcaccctcaaggggatggtgaccggcctcaagctctcacaggatctcgatgaccttgctatcctgtatctggccactgtccaggcgattgccctggggacccgtttcatcatagaagcaatggaagcagcagggcactccatcagtacactctttctctgcggcggacttagtaagaacccattatttgtacaaatgcatgctgacattacgggtatgcccgttgtcctgagtcaggaagtagagagcgtgttagtgggggcagcagtgttgggggcatgcgcatccggggactttgcaagtgtccaggaggccatggccaagatgagcaaggtcggtaaagtcgtgtttccccggttgcaagacaagaagtattatgacaagaagtaccaggttttcctgaagcttgtagaacaccagaaagagtatctggcaattatgaacgatgactag

SEQ ID NO: 30141 - DNA, 1728 bp, Artificial Sequence
  Description of Artificial Sequence: Synthetic coding sequence
atgtccggcggcgaacaaaaacctgaaaggtactacgtgggtgtggatgtgggtaccggcagcgtgcgggcggccctagtggaccaatctggagttttactcgccttcgcagatcaacccataaaaaactgggagccgcagtttaaccatcacgagcagtctagcgaagacatctgggcagcctgctgtgtggtaacaaagaaagtcgtacaagggatcgacctgaatcaaattagggggctgggattcgacgccacatgcagcttggtcgttctggataagcagttccaccctctgccggtgaaccaggaaggtgactcccatcgaaacgtgataatgtggttagaccatcgtgctgtttctcaggtgaaccgcattaacgagaccaagcatagtgtgctgcagtacgtaggtggggtaatgtcagtggaaatgcaagcccctaaactactctggcttaaagagaatttacgagagatatgctgggacaaggccggccacttctttgatctgcccgattttttatcttggaaagcgaccggcgtaactgcgcggagcctttgttctttagtgtgcaaatggacatactccgccgagaagggttgggacgactccttctggaaaatgatagggctggaagattttgtcgccgacaactattctaaaatcggtaaccaagttcttccacccggggcaagcctggggaacggactgaccccggaggctgcacgagacttaggtttgctgcccggcatcgccgtggcagcgtctcttatagacgctcatgccggcggcttgggtgttattggcgccgatgtgcgcggtcacggcctgatctgtgagggccagcctgtgacatcacggctcgccgttatctgcggaacttcctcttgccatatgggaatcagcaaagaccccatatttgtaccaggagtctggggtccatacttttcggccatggtgcctggcttctggctaaacgagggcggacagtccgtgactggtaagctcatcgatcacatggtccagggacacgctgccttcccagaactgcaagttaaggctacagcacggtgccagagtatctatgcgtatctgaattctcacttggacctcatcaaaaaagcccagcctgtaggatttctcactgtagatttgcatgtgtggcccgacttccatggcaatcgctccccactcgccgatttgactcttaagggcatgcgtaccacagggtacctttacatcccagccctggccgctctccactccccatcttccctgttgtccccacaagtcactggtctgaagttaagtcaggaccttgacgatctcgccattctatacctggccactgtccaggcaatcgctctaggaactaggttcattatcgaagccatggaggctgccggacatagtatttcaacactgttcctgtgcggcgggctgagcaaaaatcccctgttcgtgcagatgcacgctgatattacaggcatgcctgtggtgttgtcacaggaagtggaatccgtgctggtcggggccgcagtcctgggagcgtgtgcctcgggagattttgcctctgtacaggaagcaatggcaaagatgtctaaagttggaaaggtggttttcccccgtctacaagataagaagtactacgacaaaaagtaccaggtatttctgaagttggttgagcaccagaaagaataccttgctattatgaatgacgactag

SEQ ID NO: 30142 - DNA, 3432 bp, Artificial Sequence
  Description of Artificial Sequence: Synthetic coding sequence
atgcatgtcatgaactgcgtcagtctggtgtctgacaaagagaacgggaacatagcaacagctcccggattcatgatcggtcaaacaccaccgcccgcacccccgccaccaccccccccccctcccccctcgcctccatgctcatgcagtcgagaggagtgcccctcaagtccgcccccccccccccccccaccacttcccggcgagcctcccattcccccccccccacctggtctgccgccaaccacacacatgaacggctactctcacctcggaaagaagaagcggatgcgatctttcttctggaagactatccccgaagaacaggtcaggggcaagacaaatatttggacattggctgccaggcaggagcatcactatcagattgacacgaaaactatcgaggagttgtttggtcagcaggaggacacaactaaaagtagcctgcctagacgtgggcgcacccttaacagcagtttcagagaggcaagggaagaaattactatcttagatgccaagaggagcatgaacatcggcatctttctgaagcagtttaagaagtctcctcgtagcatcgttgaggacatacaccagggaaaatctgaacattatgggtcagaaacactgcgtgagtttctcaaatttcttccggaaagcgaggaagtcaagaagctgaaagccttctccggggatgtgtctaaactgagtctggctgactcgttcctttacggcctcatccaggtacctaattactcattacggatcgaggccatggtgctgaagaaagaattcctgcccagctgttcatcgttgtataccgatattactgtcctgcggacagctatcaaggaactgatgtcatgcgaggaactacactccatcctccatctggtgttacaggcggggaacattatgaatgcgggtggctatgccggcaacgccgttggatttaagctgtcaagcctgctgaagctcgcggatacgaaagctaataaacccggaatgaacctgctgcatttcgtggctcaggaggcccagaagaaagacactatccttctcaatttctccgaaaagttacaccatgtccagaagaccgctcgtctctcactggagaacacggaagcggaactgcacttgttatttgtcagaaccaagtccctcaaagaaaatatccagagagatggcgagttatgtcagcaaatggaagactttcttcaatttgcgatagagaaattacgtgaactggaatgttggaagcaggagttgcaggacgaagcctacacgcttatcgatttcttttgcgaggacaaaaagactatgaaactggatgagtgcttccagatatttagagatttctgtacaaaattcaacaaggccgtgaaagataaccatgacagggaggcccaggaactccgacaactgcagaggctgaaggagcaggagcagaaacagaggtcctgggctactggtgaactgggggcattcggtagaagttcttctgagaatgatgtggagctccttacaaaaaagggcgcggagggcttgcttccatttttgcacccacgccctattagccctagttccccctcctataggcctccaaacaccaggcggtcaaggctttctctaggccccagcgctgatcgtgaactgctgacctttctggaaagttctacaggttcacctgaggaaccaaataagttccattcactgccccgatcttccccaaggcaagcgcgccctacaatcgcttgcctggagcctgccgaagtcagacatcaggactctagcttcgcccacaagccccaggcctcaggtgggcaggaagaggcacctaatccaccaagtgcacaggcccaccagctggcggctgcccagcccgagaaccacgcctcggctttcccaagagctagacgccagggcgtgtctgtgttgcggaaaagatactctgaaccggtgagtctcggttctgcacagtcacctccactatcacctctggccctgggaatcaaggaacacgaactagttacagggcttgcccaattcaatctccagggatcccaaggcatggaggagacatcccaactcacattatctgacttctctcccatggaactggaatccgtcggccatcgggggcctcaaagcctctccgcctcctcttcgagtctgacccccatgggaagggacgctctcggctcacttagtcctgccctggaggacggcaaggccgcaccagatgaaccagggtcagcggcactcggctctgtgggctctagtgatccagagaacaaagatcctcgacctctgttttgcatatccgatacgaccgactgctctctgacgcttgattgttccgagggcaccgattcacgcccccggggaggggaccctgaagaaggcggggaaggcgatgggtcaatgagttcgggggtgggcgagatgggggatagtcaggtgtcgagcaacccgacttcgagtccacccggcgaggctccggctccagtctccgtagactccgaaccctcctgcaaggggggtttgccacgcgacaagcccaccaaacgaaaggatgtcgtggcaccaaagaggggttccctgaaagaggcatcaccgggcgcatctaaacctggaagcgcacgacgctcccagggggccgtggccaagtcagtgaggaccctcacggccagtgaaaatgagtccatgagaaaggtgatgcccatcaccaaatcctcgcgtggcgccggatggcgtcgtcctgagctttcctccagagggccgtcccagaatccaccaagttctactgacacagtttggagcaggcagaatagcgtccggcgggcttccactggggctgaggagcaacggttgccccgaggcagttcgggaagcagtagcactagacccggaagagatgtgcctttgcaaccgcgaggatcttttaaaaaaccgtccgcaaagcccctaagaaacctgccgcgccaaaagcccgaggaaaataaaacatgcagagctcactccgaaggtcctgagagcccaaaggaggagccgaaaactccatccgtcccctccgttccccacgaactcccccgggttccctcgtttgcgcgcaacactgtggcctcctcatcacggtccatgcgcacagaccttcctcccgttgcaaaagctcccggtataactagaaccgtttcccagagacaactgagagtgaaaggagatccagaggacgctgctcccaaagacagctcgactctgaggcgggcctcatctgcgcgagctccgaagaagcggccagagtctgctgaaggcccctccgcaaatacagaggcacctctcaaagcccgtggcgcgggcgaacgtgcctcgctgcggcggaaggactcttcacgcacaacattggggagaatcttgaaccctctccgcaaatag

SEQ ID NO: 30143 - DNA, 3432 bp, Artificial Sequence
  Description of Artificial Sequence: Synthetic coding sequence
atgcacgtcatgaattgcgtgagcctcgtctcagacaaggagaatggcaacatagccactgcaccagggttcatgatcggtcaaactccgcctcccgctccacctcctccacctcctcctcctcccccatctcccccctgttcatgctcacgcgaggaatgtccttcctctcctccaccacctccccctcccccactgccaggggagccccccatcccacctccacctcccgggttacctccgaccacacatatgaatggctattcacatcttggcaagaaaaaaagaatgaggagctttttctggaaaaccattccggaggaacaagtgcggggcaaaacaaacatctggaccctagccgcaaggcaggagcaccattatcagattgacaccaagacaattgaggagctcttcgggcagcaggaagacacgaccaaaagctctttgccacgcaggggccgcacactgaattcatctttccgcgaagcccgggaagaaatcacaatcctcgacgcaaagcgctcaatgaatatagggatttttctaaaacagtttaagaagtcgccgcggtcgattgtagaggatatacatcagggaaaaagtgagcattatggtagcgagactttgcgggagttcctcaagtttctgcccgagagcgaagaagtgaagaagctcaaagcattttctggtgacgtatctaagctcagtttggctgactccttcttatatggcctgatccaggtcccaaactactcactgaggatcgaggcgatggtgctaaagaaggagttccttccaagctgttcgagcctttatacagacatcacagtgctccgaaccgccattaaggagttgatgtcctgcgaggagctgcactctattctgcatctagtcttacaggccggaaatatcatgaatgccggaggttatgccggcaacgccgtgggattcaaactgagctcgcttctgaagttggctgacacaaaggccaacaaacctgggatgaatctactgcactttgtggcccaggaggcccagaagaaggatactattctgttgaacttttcagagaaactccatcacgttcaaaagactgctcggttatcgctcgagaacaccgaagccgaattgcaccttctgtttgtgcggacaaagagcctaaaggagaacatccagcgagacggagagctgtgccaacagatggaggacttccttcagttcgccatcgagaaactcagagagctcgagtgctggaagcaggaacttcaggacgaagcttacacattgatagatttcttttgcgaagataagaagaccatgaaattggatgagtgctttcaaatctttcgcgatttctgcactaagttcaataaagccgtcaaagacaaccacgatagggaagcccaggaactgcgccaactgcagcggctgaaagaacaagagcagaagcaacggtcctgggccactggcgaattaggagccttcgggcgcagctcctccgagaacgatgtggaactcctcaccaaaaagggggccgaagggctgctgccttttctccatcctcgtcctatctctccctcatctccctcttatagaccccctaacacccgccggagtcggctgtctctgggcccctccgccgaccgtgagcttctcaccttcttggagagttccaccggaagtcccgaggaaccgaataaattccatagcctccctcggtctagcccaaggcaggcgcgacccacaatagcctgtctggaacctgccgaagtgcggcaccaggactctagcttcgcccacaaacctcaggcctccggcgggcaggaagaggcacctaatccaccatctgcccaggctcatcaactggccgccgcccaaccagagaaccacgcttcggccttcccccgggctcgccggcagggcgtgtcggtactcagaaaaagatattctgagccggtgtcgttagggtccgcccagtccccaccactcagtcctcttgccctgggcatcaaggaacatgaattggtgacaggattggcgcaattcaacctacaaggctcccaaggcatggaggagacatctcaattaacccttagcgatttcagcccaatggagttggaaagcgtcggacacagagggccacagtcattatcagcttcgtcatctagcctgactccaatgggaagagacgcgctgggcagtctgtcccccgccctcgaagacggaaaagccgctcccgatgaaccaggatctgcagccctgggcagtgtgggctcttccgatcccgagaacaaagacccccgccccctattttgtatttcggatacgaccgattgttcgctcacactggattgctccgagggaacagactctaggccacgcggaggggaccccgaggagggtggagaaggtgacggtagtatgagctcaggcgtgggcgagatgggggattcccaggtgtcgagcaacccgactagctctcctccaggcgaagcacctgctcccgtctctgtagactcggagccttcttgtaagggaggtttgccccgcgacaaaccgactaaacgcaaggacgttgtggcgcctaagcgcggaagtctaaaagaagccagcccaggggccagcaaacccggaagcgctagaaggtcccagggcgccgtcgccaagtcggtccgtactctgaccgcttctgagaacgagagtatgcgaaaggttatgccgataacaaagagtagtagaggcgctgggtggcgacggccagagttatcctccagggggccttcccaaaatccaccctccagtacggacactgtctggtcacgccagaatagcgtacggcgagcttccaccggcgccgaggagcagagacttcccagaggaagctcgggatcttccagcacacgcccgggaagggatgttccattgcagccaagagggagcttcaagaaaccctccgccaagcccctgcgcaatcttcctcggcagaaaccagaggagaacaagacatgccgggcccactctgaaggccccgaatcccccaaggaggaaccaaaaacgcccagcgtgcctagcgtcccccacgagctaccccgcgtcccatcctttgctcgcaacaccgtggcttcttccagccgctctatgcgaacagacctgcctcctgtagctaaagctcccgggattacgagaacagtgagccagcggcagctgcgggtaaaaggcgatccagaggacgccgcacccaaggattccagcacactgcgtagagcatcctccgctcgcgcacccaaaaaaagacctgagtctgccgaaggcccttccgcaaacacagaagccccactcaaagcccggggagcaggcgaaagagcatcacttaggaggaaggactcttcaaggacgaccctgggtcggattctgaaccccctcaggaagtag

SEQ ID NO: 30144 - DNA, 2250 bp, Artificial Sequence
  Description of Artificial Sequence: Synthetic coding sequence
atggaggaagagagtggagaagagctgggcttagaccgttccacacccaaagactttcacttctaccacatggatctgtacgatagtgaggaccgactccatttatttccagaagaaaacacccgcatgaggaaggtagtccaggcagaaatggccaacgagtccaggggggccggtgacgggaaggcacaaagagatctacaggaggaagtcgacgagctcgtgcacttgtacggcctcgaagacgaccatgaactgggtgatgagttcgtggacgaaaacattccacggacaggcgtgagtgagtacccgccatatatgatgaaacgacgggacccggcgcgcgagcagagagactggagactgtccggagaggcagctgaggccgaggatctgggctttggagggtgggggtccgcaggacaatgtcaagacctgcgcgaggcttaccgttatacacatggacgggcttctgaggagtacgagtgctacgtgatccctgaggaggaagacgaggaggaggcagcggatgtgttctgcgtgacctgcaaaacacctatccgggccttccagaaggtgttcgacgagcataaagagcacgaggtgattcccttaaacgaggccctcgagagtgcaaaagatgagatccacaagaatatgtacaagctggaaaagcagatcatcgagatggagaatttcgcaaatcacctggaggaggtgtttatcacagtcgaagagaacttcgggaagcaggaacagaacttcgaaagccattataacgagattctagaaactctggcgcaaaagtacgaggaaaaaattcaagctctgggcgaaaagaagaaagaaaaacttgaggcactatatggacaattggtgtcctgcggcgagaacctggacacctgcaaggaacttatggaaaccatcgaggaaatgtgtcatgaggagaaggtggactttatcaaggatgctgtcgccatggctgacaggctcggcaaattccttaaaaccaagaccgatgtagagatcagtgcccagccggaattcgaagatcagactctggacttctcagatgttgagcagctgatggggagcatcaacactattccagcccctagcgcaccggtgattaatcctcaggtccctaacagcgccaccggtagtagcgtgagagtatgttggagcttatactccgatgacacagtagaatcgtaccagctgtcataccgtcccgttcaggatagttctcctggtactgatcaggccgagttcactgtcaccgtgaaggaaacatactgctccgtaactaacctggttcctaatactcagtacgagttttgggtgactgcccacaatcgagcaggcccctccccttcatctgagcgggcagtgtacatgacggctcccagcccccctattattaagaccaaggaaatcagatcttgcgaagaagctgtactcatctgttgggagtccggcaacctgaatcccgtggattcttacactgtggagcttacgcaggccgaatcccccgaagcatctggtgtgacagagagcgtggttggtattccaacttgcgaatctgtggttcaactacaaccagggcgctcttatataatttacgtgcgggcacttaacatgggaggcccaagcgtgcggtcagaaccagctaccgttcacaccattgggagctactttagactgaacaaagacacctgtcatccgtggcttacaatatcagaagacggcttgaccgccgtgcgctcagaaaggcgcacccccgcgcgcgaactcagcccttcagatactcatttcactcgctgtgtggcagttatgggaaatttgatacccgtgagaggccatcactattgggaggtcgaggtggacgaacacctcgactaccgggtgggagtcgcttttgcggatgtgcggaaacaggaggacctgggagcaaattgcctctcttggtgcatgagacacacattcgcctcctcacggcacaagtatgagtttctccataaccgcacaaccccagatatacggatcaccgtcccaccaaagaagattgggatcctccttgattacgagcactcaaaactgagttttttcaatgtagacctctctcagcatttgtatacatttagttgccagctccacgaattcgtgcatccatgcttctctctggaaaaacctggttgtcttaaggtgcacaatggaatcagcatgccaaaacatgtgactttttactag

SEQ ID NO: 30145 - DNA, 306 bp, Artificial Sequence
  Description of Artificial Sequence: Synthetic coding sequence
atggaggaggaaagtggtgaagagctggggctggatagatctacgcctaaagactttcacttttatcatatggatctgtatgactcggaagacaggctacatctgttccctgaagagaatacaaggatgcgaaaggtcgttcaagccgaaatggccaatgagtcacgaggtgcgggagacggaaaggctcaacgagacctccaggaagaagtggatgaattggtgcacctgtacggtctcgaggatgatcatgaattgggcgatgagttcgttgacgagaacataccacgtacaggggtgagttag

SEQ ID NO: 30146 - DNA, 975 bp, Artificial Sequence
  Description of Artificial Sequence: Synthetic coding sequence
atggcatccgaagccctgcaccaggtgggagacggcgaagaagcggttctcaaaaaggaaaatttcaacatgatgaacgcactggatcagctacctaagcctttttccaatccgaagagtatgaacaggaccgtcacaacgaagggcctgcctctggcttccaaaggaaatcttgtcaacttcctggaagacgacacaataaacctgctgaaacccctgccagtggaggatagcgactgctcctcagacgagacctccatctccgccttctcgtccacgctgttgaatcctattaaactggcggtgacgcaacctaactcctcttttttcgctgggatgctagaaggtgaattgaacaaactgagtttttccccaatggctaaaaatgccgagaacgaggatctcgctttaggaccttgcccctgtccctccaagtcacagatggccacaaggggcctgcttgacctcgataatcccgagctagagaccgagacttcatctactcatagtgaatcaagcgtggtggtggaccttcctgacacccccttcattttcgagcacacagtgaacaactcaacagcggtgatcagctggacttatgctctggggaagcagcccgtgtccttttaccagctcttgctacaggaggtcgctaaaacacaggagaacgagctaccagaggccaagaaccggccctggatcttcaataagattttaggcaccaccgtgaagctgatggaactgaagccaaatacctgctactgcctcagcgttcgcgctgccaatactgccggggtgggaaaatggtgtaagccctacaagtttgcaacattggcaaccgactttagctctttccctgagaattatcccatccagatcactgtgagacgaaaggagcctaggcagaagatagtgtccattgggcctgaggaaatgcgcagacttgaggatctggaatacttatttccttgctag

SEQ ID NO: 30147 - DNA, 1383 bp, Artificial Sequence
  Description of Artificial Sequence: Synthetic coding sequence
atgtttgaaaaatatccaggcaaaatggagggtttgtttagacataacccttataccgcgttcccccctgccgttcccggtctgccaccaggcctgcccccggcagtcagctttggttccttacagggcgcgttccagcccaagagcacaaatcccgagctacctcctagacttgggccggtaccatccggcctctcgcagaaggggacccagatccccgatcattttagacctcctctccgcaagcccgggaaatggtgcgctatgcatgtgagagtggcttatatgattctcaggcaccaagagaagatgaaaggagatagtcacaaactagacttccgcaacgacctgctgccttgccttccaggcccctacggcgcattaccgccaggccaggagctgagtcaccccgcaagcttgtttacagctacaggcgccgttcatgccgccgccaatcctttcacagcggcgcccggagcacacggcccattcttgagtccgagcacccatatagaccctttcggcaggcctacctcattcgcctctctcgcagctctatctaatggtgcattcggcggtctggggtcccctactttcaactccggagcagtattcgcacagaaagaatcccccggggccccccctgcatttgccagcccaccagacccctggggaagattgcaccgttcacctctcacatttcccgcatgggtacggcccccggaggcagcccggacccccggcagcgacaaggagcgccctgtcgaacggagagaaccgtcgataaccaaagaggaaaaggacagggatcttcccttcagcagacctcagttgcgggtgtctccagctacacccaaagctcgagcaggagaggagggaccgaggcctaccaaagagtccgttagggtcaaagaagaaaggaaagaggaggctgcagccgccgcagctgctgccgcagccgctgctgcggcagctgctgcagcggccacaggtccccagggcctgcatctactattcgagagacctcgtcccccccccttcctgggcccatcccctccagaccgctgcgcagggttcttggagccaacatggcttgccgcacccccaaggctcgccaggcctccccgattttacgaagctggtgaagagctaacgggccctggggccgtggccgctgcccgtctctatggcctggagcctgctcaccccctcctttactctcggctggcacctcctccaccccccgctgctgctcccggcactccgcacttgctctcaaaaacaccgcccggcgctctgctgggcgcgcctcctccgctggtacctgcccccagaccgtcaagccccccacggggcccaggccccgctcgggcagaccgctag

SEQ ID NO: 30148 - DNA, 1200 bp, Artificial Sequence
  Description of Artificial Sequence: Synthetic coding sequence
atgcacgttagagtcgcgtacatgatcctccggcatcaggagaagatgaagggggactctcacaagctcgacttcagaaacgacctgctgccttgcctgcccgggccctatggcgcactgccacctggtcaagaactctcccatcctgcatcgctgtttaccgccaccggcgcagttcatgctgccgcaaatcccttcaccgccgcaccaggtgctcatgggccttttctgtcaccctcaacgcatattgatccttttggccgtcctacttcatttgcttcactggctgctctgtctaacggggcttttggaggactcggtagcccgacatttaattcaggcgccgtattcgctcagaaggaaagtcccggcgcacctcctgcttttgcttcgccacccgatccgtgggggcgtctacatcgcagccccctaactttcccggcctgggtgagacctcccgaagctgctcggacccctggatctgacaaagagaggcctgtggagcgacgcgaaccctctattacaaaggaggaaaaagaccgtgatctgcccttttcgcgcccgcaactgcgggtgtcccctgccactccaaaggcacgggccggagaggaaggccctagacctacaaaggaatccgtgagggttaaagaggagcgcaaagaagaagcagctgccgcagccgctgcggcagccgctgccgccgcagctgcagctgcagctgctacagggcctcaaggactccatctcctttttgagaggccacggcctcccccatttctgggaccatccccgcccgataggtgcgctggttttttggagccaacctggttggcggctcctccacgtctcgccagacccccgcgcttctacgaggctggagaagagctcactgggcccggagctgtcgccgcggcacgcctatatggactggaacctgcccatcctttgctgtatagtcgactcgccccccctccacctccggccgccgcacccggaacaccacacttgcttagtaaaaccttctgtacttttctgcaagggtgcccctcacagcaatttccctcctggttaatcaagccctccgactggtgttgcgtcccttctttgtggcctttatgtggagaacgcggtctgcagggggaagagccagggagagacagccaggccagtccttgggaggggggggcctctcgtaggtag

SEQ ID NO: 30149 - DNA, 2919 bp, Artificial Sequence
  Description of Artificial Sequence: Synthetic coding sequence
atggaagctaaagaggaagaggtgattgatggctttgctattgcctccttcagcaccttggaggctctggagaaagacatggccctcaagccgcatgagaggaaagagaaatgggagaggaggctgatcaaaaagccccgtgaatcggaaacctgcccccccgcggaaccatccgaaaatcgcagaccattggaagcaggaagtccaggccaagatcttgaacctgcctgcgatggagcccgtaaggttccactgcaaccaagtaaacagatgaaagttacagtctcaaaaggaggagatcgcgatagtgatgacgactctgtgcttgaagccacatcttcacgagatccactgtcagacagtagcgcgcatgcagtgagtggcaggggttattcatgcgactcagagtccggccctgatgataaggcatctgtggggtccgaaaaactttttgcccccggtaccgacaaaggtcctgccctggaaaagagtgaagctaaagccgggccagtacctaaagtgagcggattggagcgatctcgggaattaagcgccgaatcctttctcccaactgcttctcctgcgccgcatgccgccccctgccctgggccaccgccggggtcacgcgctaaccccctcgtcaaaaaagagcctcctgctccgcatcgacataccccacaaccacctccaccacagccccgcggcctgctgcctacccacgtgccggcttcactgggcgcctttgcaggccactctcaggctgcagctaacgggctgcatggactatctcgatcatctagtgccccgctcggactagggaaacatgtgtcattatcaccacatggccccggcccccatctcagtaccagccatttagctctgcgaagtcaagcccagcaccagctccacgccgcaatgttcgcggcaccgcccactctgcccccaccacccgcgctgccagctagctcgctggtgttgcccggccaccccgcggaccacgagctcctccgccaagaactgaacaccagattcctcgtgcaatccgcggagcgccccggcgccagcctcggacccggtgcccttctgcgcgctgagtttcaccagcaccaacacactcaccaacacacccatcagcacacacaccagcatcagcatacgttcgctccttttccagcaggcctgcctccaacgccccccgctgccccaccaccttttgacaagtacgctcctaagctagacagcccctatttccggcactccagtgttagctttttcccttcctttcccccagctattccgggcttaccaacgctgctcccacacccaggccctttcggttctctgcagggagcattccagcccaaggtttcagatccctaccgggcggttgtgaaggtgagtacatgttgggagggcccatggcagggccggacactcgtgccacctggcagaccccgaggtgctcgagactcacggtcccttcagaagacctgggtcggcgttgcccccgccccattatcggcttctattctgtctcagaagccaggcagatggtgtgccgtgcacgtacagattgcctggcagatctaccggcaccagcagaaaattaaagagatgcagctcgatccacacaaactcgaagtgggagccaaactggatttgtttgggagacctccagcccctggagtgtttgctgggttccactatccacaggatctcgcgagacctctcttcccctccacgggcgccgcccaccctgcctccaatccattcgggccctctgctcatccagggtcctttctcccgacgggccctcttaccgatccattctcgcgtccgagcacatttggcggcctgggatccctcagctcccatgcctttggggggctaggctctcatgctcttgcacctggaggttctatatttgcccccaaagaaggatcctcagtccatggcttgccatcgccacatgaggcttggaacaggcttcatcgggctcctccaagtttcccggcacctcctccctggcccaagagcgtggacgccgaaagggtctcggcattgactaaccacgaccgggagcccgacaatggcaaagaagaacaggaacgcgatctgttggaaaagaccagattactgtcacgtgccagccctgctacacccgctggacatccagtgtccggtctgctgcttagagctcagtcggaacttggaagatccggagcaccagcagaaagagaagcagagccacgggttaaggagtcaaggagcccagctaaagaagaggctgccaaaatgccagccagagcaagccctcctcactccaaggctgccccaggcgatgtgaaggtgaaggaggaaagaggggaggatgaggcctccgagcccccggcaggagggttacacccggctccactacagttggggttgggacgagaaagacttggggctcccggcttcgcctgggaaccattccgagggttggagctccctcgacgcgcatttccagctgctgcgcccgcccctggtagcgccgccctactagaaccaccggagcgcccttatcgtgaccgcgagcctcatgggtatagtccggagcggctcagaggtgagctggaaagggctcgggcacctcacttgccgcccgccgcccccgctctggacggggcgttactcccttctctcggagcactccactttcctcgccttagccccgcagcccttcacaacggactgctggctcggacgccgccagccgccgctgctttgggagctcctcccccattggtgaccgccgctggcccccctacccctccagggccgcccagaagtaggactactcccctaggtggacttggccccggtgaggctagagactactccccctctcgcaacccccccgaggtcgaggccagatag

SEQ ID NO: 30150 - DNA, 3138 bp, Artificial Sequence
  Description of Artificial Sequence: Synthetic coding sequence
atggaggcaaaagtacgaccctccagacggagccgagcacagagggatagagggagacgacgagaggccgcgcgcgatgccagggcacaatcccctagctccggtgatgagcctgagcccagccctggcaaggaaaatgcaggccttagaggagctccacctaggggtgcagcccccgctccacgtacagccaggccacctcgtcggaggcggagagagtcttcatcacaggaggaggaggttatcgacggttttgcgatagcctcattttccactctggaggccctcgaaaaagacatggccctcaaaccccacgaaaggaaggagaaatgggagcgccggctgatcaaaaaacctcgtgaaagcgagacgtgcccccctgctgagcccagcgaaaataggaggccgctcgaggcaggtagccctggccaggacctcgaacccgcctgtgacggcgcccggaaggttcccctccagccgtctaagcaaatgaaagtcaccgttagcaaaggtggcgatagagactccgacgacgacagtgtgctggaagcgacttcatcccgcgatccattatcagattcatctgcccatgctgtgtcaggcaggggctattcctgcgactccgaaagcggcccggacgataaggcatcagtgggatcagaaaaactgtttgcgcccggtactgacaaaggtcctgccttggaaaagagcgaagctaaagccggtccagttcctaaagtgagcggtctggaacgctcccgtgaactgagcgccgaatccttcttgccaacagcctcaccagcaccccacgccgccccctgtcccggacccccccccggctccagggctaatcccctagtgaaaaaagagccaccagccccacatcgccacaccccccagcctccccctccccagccgagagggctcctccctacccacgtacctgcatccttaggagcgtttgctggacactcacaggccgccgctaacgggctgcatggattaagtcggtccagcagcgcacctttagggctggggaagcacgtatcccttagtccccatggtcccggtccccacctcagtaccagccatctggctttgcggagtcaggcccagcaccagttgcacgctgcgatgtttgctgcccctcccacacttccaccccccccagctctgcccgcgtcgagccttgtactccccgggcacccggcagaccacgagctcttgaggcaagaactgaacactagatttctggtgcaaagcgcagagaggccaggcgccagtctgggcccaggggcccttctccgggcagagttccaccagcatcagcacactcaccaacacacgcatcagcacactcatcagcatcagcatacgtttgctccttttcctgcaggtctccctcccaccccaccggcagctccacccccctttgacaaatacgcccctaagctcgatagcccgtactttaggcactccagcgtgtcctttttcccctctttcccacctgcgattccaggcctgcccacattattgccccaccctggccctttcggctccctgcagggcgccttccaaccaaaagtttccgatccctaccgtgccgtggtgaaggtttccacttgctgggagggaccctggcagggccggactttagtcccccccggacgccccaggggtgcccgagatagtcgcagtctgcagaaaacctgggtcggtgttgctccagcccccctctcagcgagcatcctttcccagaagcccggaaggtggtgtgccgtccacgttcaaatagcctggcagatctatcggcaccagcaaaaaataaaagagatgcaactcgacccccacaaactagaggtgggagcaaaattagaccttttcgggcgaccgcccgcaccaggcgtcttcgctggattccactacccacaggaccttgcgaggcccctctttccctccacgggggcggcccatcccgctagtaaccctttcggcccaagtgcacaccccggaagctttctccccactgggccattgacggatccgtttagccgccccagcacattcggcggcctgggcagcttgagttctcacgcttttggaggactggggtctcacgctttagcacctggaggttcaatctttgctcctaaggaaggatctagcgtacacggacttcctagcccccacgaagcttggaacagacttcatcgtgctcctcccagctttccagccccaccaccctggcctaagtctgttgacgccgagcgcgtgtccgccctcactaatcatgaccgcgagcccgataacggcaaagaagagcaagaacgggacctccttgaaaaaactaggctcctgtctcgggcgtcaccggctactcctgccggtcacccggttagcgggctgctgcttagagcccagagcgaactaggaagatctggggcccctgcagagagagaggctgagcccagggtgaaggagagcaggagtccagccaaggaggaggcagcaaaaatgcccgctcgggcttccccaccacatagcaaagccgcgccgggagatgtgaaggtgaaagaagagcggggtgaagatgaggcctctgaaccaccagcaggagggttacacccagctccactgcagttgggcctaggaagggagagactgggagcccccgggttcgcctgggagccctttagggggttggagttacctcgcagggccttcccggcagccgctccggctcccggttctgccgctctgttagagccacctgaaagaccttaccgcgatcgggaaccacacgggtatagcccggagagattgagaggcgagctggagcgcgctagggcaccccatctccctccagccgctcctgcgctggatggcgcactcttgccatctctgggcgcactccactttccgcgtcttagccccgctgctctccataacgggttactcgcgcgaactccaccggcagccgcagccctgggggctccacctcccttagtcactgcagccgggccaccaaccccacctgggcccccaaggtccaggactactcctctgggagggttgggtcctggcgaggcacgagactacagcccttccaggaatccaccagaggtagaggctcgatag

SEQ ID NO: 30151 - DNA, 1746 bp, Artificial Sequence
  Description of Artificial Sequence: Synthetic coding sequence
atggatatcatcaaaggaaacctcgatggcatctctaagccagcatcgaacagtaggatcagacccggatccagaagctccaatgcgagtcttgaagtgctcagtactgaacctggcagtttcaaagtagataccgccagtaatctcaattcaggtaaggaggaccactcagagtctagcaacaccgagaaccgacgaacaagtaacgatgacaagcaggaaagttgttccgagaagatcaaactggcagaggagggatccgacgaagatctggatcttgtgcagcaccagatcatatcagaatgctcggatgaaccaaaattaaaagagctcgacagccagctccaggatgccatacagaaaatgaagaagctggacaaaatacttgccaagaaacagcgtagggaaaaagagattaaaaagcagggcctggagatgcggatcaaactgtgggaggaaattaagtcagccaagtactctgaggcctggcagagtaaagaggaaatggaaaatactaagaaatttctgagtctgacagccgtaagcgaagagacagtaggcccaagccatgaggaagaagataccttctcctcggtgtttcacactcaaatccccccggaagaatatgaaatgcagatgcagaaactcaataaagatttcacatgtgatgtcgagcggaacgaatcactgattaagagtggcaaaaagcccttctctaacacagaaaaaattgaattgcggggtaagcacaaccaggactttataaaaagaaacatcgaactcgctaaagagtctcggaaccccgtggtgatggtggaccgagagaaaaaaagactggtggagcttctgaaggatctggacgagaaggattccggattgagttcttcagagggcgatcagtcaggctgggttgtgccggtgaaagggtatgagttagcagtgactcaacaccagcagctcgctgagatcgatattaagctgcaggaactgtctgcggccagccccaccatatcctcgttttcacctcggcttgaaaatagaaacaaccagaagcctgacagggacggcgagaggaatatggaggtcacaccgggagaaaagatcctacgtaacaccaaagagcagagggacttgcacaatcggttaagagaaatcgatgaaaagctgaagatgatgaaggagaacgtgctggagtccaccagctgcctatctgaggaacagctcaagtgcctcctggacgagtgtattctgaaacaaaaaagcatcatcaaactgagcagcgaaagaaagaaagaagatatagaggatgttacgcccgtttttcctcagctttctagatccattatttcaaaactgctcaatgagagcgagactaaagtccaaaaaacagaagtggaagacgccgacatgcttgagtcggaggagtgtgaagccagcaaggggtactatctgacaaaagccttgaccgggcataacatgtccgaggccctggtgaccgaagccgagaacatgaagtgtctccagttctcgaaggatgttatcattagcgatactaaggactacttcatgagcaagaccctgggaattgggagactcaagcgaccatcattcctagacgatcccctgtacggaatttctgtcagcctgtcttcagaggaccagcacctcaagctgtcctcacccgagaataccatcgctgatgagcaggagaccaaggacgcagctgaggagtgcaaagaaccctag

SEQ ID NO: 30152 - DNA, 48 bp, Artificial Sequence
  Description of Artificial Sequence: Synthetic coding sequence
tgagagcaggagacgaaggatgctgcggaagagtgcaaagagccgtag

SEQ ID NO: 30153 - DNA, 7920 bp, Artificial Sequence
  Description of Artificial Sequence: Synthetic coding sequence
atgtcctcttctcattcgcgcgccgggcagtctgccgccggagcagcgcccggggggggggttgatacccgcgacgccgagatgcccgcaactgagaaagatctagctgaggatgctccgtggaagaaaatccagcagaatacattcacgagatggtgtaatgaacatttaaagtgcgttagcaaaaggattgcaaatctccagacggacttaagtgatggcctccggctgatagccctactggaagtcctcagtcagaaaaaaatgcaccgcaaacataatcagagacccacattccggcagatgcaactggagaatgtgtccgtggctttggagtttctcgaccgtgaaagtatcaaattggtatctattgactcaaaagccattgtcgatggcaacttaaagctgatactgggactcatctggacactgatcctccactatagcatctcgatgccaatgtgggacgaggaggaagacgaggaggctaagaaacagactcctaagcaaagattgctcgggtggatccagaataaactgccccagctcccaatcactaacttctcgcgggactggcagagcgggcgagcattgggggcactggttgatagctgcgcgcccggactctgcccggattgggactcatgggatgcaagtaaaccagtcacgaatgcgagggaagcaatgcagcaggccgacgattggctgggcattcctcaggttattacacccgaggaaattgtagaccccaatgttgacgaacactcagtgatgacctatctgagtcagtttcccaaggccaaactgaaacctggcgccccattgaggcctaaactgaaccctaaaaaagcccgcgcttacggacctgggatcgaacccacaggtaacatggttaaaaagagggctgagttcaccgttgagacacggagcgctggccaaggggaagtcttagtctacgtggaggatccggctgggcaccaggaagaagctaaggtcacagccaacaatgataaaaaccggacgttttcggtgtggtatgtgccagaagtgacaggtacacacaaggtgactgtcttgttcgccggacaacacatagctaagagccctttcgaagtgtatgtggataaatcgcagggcgatgctagcaaggtcaccgcacagggcccaggtctcgagcccagtggaaatatagccaataaaaccacatatttcgaaatttttaccgccggcgcaggcaccggggaggtagaggtggtaatccaagatccaatgggacagaagggtactgtcgaaccgcagctagaggccaggggagattccacttataggtgctcctatcaaccgacgatggaaggcgttcatactgtgcatgtcacattcgcaggcgtcccaattccgagaagtccctacaccgtgacagttgggcaggcttgcaacccctctgcctgccgagcggtcggacggggcttacaacccaagggcgtccgcgtaaaggaaacagcagattttaaggtctacacaaaaggggctggatctggcgaactcaaagtcacagtgaaaggccctaaaggcgaggaaagagtgaagcaaaaagatctaggggatggtgtttatgggttcgaatattatccaatggttccgggaacctacattgtcaccatcacttggggagggcagaatatcgggaggtctccctttgaagtgaaggtcggaactgagtgtggaaatcaaaaggtccgcgcttgggggccaggactcgaagggggagtcgtgggaaaatctgccgatttcgtcgtggaagctataggtgacgatgtggggacactggggttctctgtagaaggtccgtcacaggccaagatagagtgtgacgacaaaggagacggatcttgtgatgtgcggtactggccacaagaagcaggagagtacgcggtgcacgtgttgtgtaattctgaggatatccggctgagtccattcatggccgatatccgcgatgcgcctcaagacttccacccagaccgtgtgaaagccagaggacccggccttgaaaagaccggcgtcgcagtgaacaagccagccgagttcactgtggatgctaaacacggtggaaaggcccccttgagggtgcaggtgcaggataatgagggctgccccgtggaggccctggtgaaagacaacggaaacggtacatactcctgcagctatgtgccccgcaagccagttaagcatacagccatggtgagttggggtggagtttctatcccaaacagcccttttcgagtgaacgtgggtgccggtagccaccccaataaagtcaaggtatacggacctggggtcgcaaaaaccggactcaaagctcatgagcctacatactttaccgtcgactgtgccgaggccggtcagggcgacgtttcgattggcataaagtgcgcccccggcgtggtagggcctgccgaggcagacatcgatttcgatataatccgcaacgacaacgacacatttaccgtaaagtatacacccagaggggctggctcatacaccattatggttcttttcgccgaccaggctactcccacatctcccatccgggtaaaagttgagccctcacacgatgcttctaaagtgaaggccgagggcccgggccttagcagaaccggagtggaattgggcaaacctacccacttcacagttaatgctaaagcggccggcaaaggaaagctggatgtgcagttcagcgggctcaccaagggcgacgccgtcagggacgtcgatatcattgaccaccacgataacacatacacggtcaagtacactcccgtacagcagggacccgtgggcgtgaacgttacctacgggggggaccccattcccaaatctcctttctctgtggctgtttcaccaagtctcgacttgtctaaaatcaaggtgagtggcttgggagagaaggtggacgtggggaaggatcaagaattcacagtgaaatcaaagggcgcaggcgggcaaggcaaggttgcttcaaagattgtcggccccagcggagcggctgtgccctgtaaggtcgaacccggcctcggtgcagacaacagcgtggtgcggttcctgcctcgtgaggaggggccctatgaggtcgaggtgacatacgatggggttcccgtgccaggcagtccgtttcctttagaggcagtggccccaactaaaccatcaaaagtcaaggcattcggacctggactgcaaggaggtagtgcaggcagcccagctagattcaccatcgatacgaaaggcgctggaaccggcggactcgggctgaccgtggagggaccctgcgaagcccaactggaatgcttagataacggggatgggacttgtagtgtcagctacgttcccacagagcctggggactataatatcaatatcctgtttgctgatacacacattcctggctctcccttcaaagctcacgttgttccctgctttgatgcaagcaaggtcaaatgctcggggccgggtctggagcgtgcaaccgccggcgaagtgggtcagtttcaagtggattgttcgagcgctggctctgccgagctgacaatagagatctgttcagaagccggactgcccgccgaagtctacatacaggaccatggagatgggacgcacaccattacatacatccccttatgcccaggggcctacacggtgactattaaatatggagggcaaccagtgcccaattttccctcgaaattgcaagtggagcctgccgttgatactagtggggtgcaatgttacggccccggcatagagggacaaggcgtatttcgtgaagccacaactgagtttagcgtggacgctcgcgccctgacacagaccggcgggcctcatgttaaagctcgagtagccaacccttccggtaatctgactgagacttacgtccaggacaggggcgacggtatgtataaggtagagtacacgccatacgaggaaggactccactcagtcgatgtgacctacgacgggtccccggtccctagctccccttttcaggttccagtgaccgagggctgcgatccgagccgagtcagggtacacggccccggcattcagtcgggaacaacgaacaagcctaacaaattcacagtagagactcgcggggccggaacaggtggactgggactggctgtcgagggcccttccgaggctaaaatgagctgcatggataataaggacggttcctgctctgtggaatatatcccctacgaagctggcacctactccctgaacgtgacttacggggggcatcaggtgccaggatctccattcaaggtaccggtccatgatgttaccgacgccagcaaagttaaatgttccggtccaggcctgtcacctgggatggtgagagccaacttaccccagagctttcaggtcgatactagtaaggctggcgtggcacccctccaggtgaaggtacaggggcctaaagggcttgttgaaccagtagatgtggtcgacaatgccgacgggacccagaccgtgaactatgttccatcgcgcgaagggccatattcaatttcggtgttgtatggcgatgaggaagttcctcgcagtccattcaaggtcaaagttctgcctacccacgacgcttctaaggtcaaggctagcggtccaggcctgaacacgacaggcgtccccgcaagcctgccagtcgagtttaccatagacgcaaaagatgctggggagggactactggcagttcagatcacggatcccgaaggtaagccaaagaagacacacattcaagataatcatgacgggacctacaccgtggcatatgtccccgatgtgacggggagatatacaatcctaatcaaatacggcggcgacgagattccattctccccgtaccgagtgcgggctgtgcctaccggtgacgctagtaagtgtacggtcaccggcgccggaattggacccacaattcagatcggcgaagagactgtgataacagtcgatactaaggccgccggtaaagggaaggtgacttgcaccgtgtgcacaccagacggctcagaagtggatgtggacgtggtggagaatgaagatggcacctttgacatcttctacaccgcaccacagccagggaagtacgtgatctgcgtgagattcgggggagaacatgtgcctaattcccccttccaggtcactgctttggccggcgatcagccctctgtccaacccccacttcgtagccagcagctggccccccagtacacatatgcccagggggggcagcagacatgggctcccgagaggcctctggtgggcgtcaatggcctggacgtcactagcctgcgcccgtttgacttagtgatcccattcacgattaagaaaggggaaattaccggtgaggtccggatgccctcgggcaaagtcgctcaacctaccattactgataacaaagacggaaccgtcacagtaagatacgccccctccgaagcaggtctgcacgagatggacatccgctatgacaatatgcacatcccaggctccccccttcagttctacgtggactacgtgaactgcggccacgtcaccgcttacggtccaggactgacacacggcgtggttaataagcctgccacttttacagttaatacaaaagacgccggtgaaggaggactgagcctggccatcgaaggaccatctaaagccgagatttcttgtacagacaaccaggatggaacctgcagtgtgagctatcttccggtgctcccgggcgattactctattctcgtgaagtacaacgagcagcacgtcccaggctcacccttcactgcacgcgtgaccggtgatgattccatgagaatgagtcacttaaaagttggctccgccgcagatattcccattaacatttcggagactgacttaagtctgctgactgccacagtagtgcccccgagtggccgagaagaaccgtgcctgctgaagcgtttgcgcaacggccatgtgggaatctcgtttgtcccaaaagagacaggcgagcacctggtgcacgtcaagaaaaatgggcagcacgtcgcttcaagcccaatcccggttgtgatttcccaaagcgaaatcggtgacgcctcccgagtgcgcgtttcaggacaggggctgcacgaaggccacacttttgaaccagcagaattcatcatcgacacacgtgacgctggctatggcggcttgagcctctcgattgagggacccagtaaggtcgatattaatacggaggacctggaagatggtacctgtcgcgtgacatactgcccgacagagcctgggaactatatcattaacatcaagttcgctgaccagcatgttcccgggtcaccattttccgtgaaagtgaccggcgaaggcagagtaaaggaatcaattactcggcgacgtagagcaccgtccgtggcaaatgtaggctcccactgtgatctgagcctaaaaatcccagagatttcgattcaagacatgaccgcccaggtgacatcaccctctggcaaaacacatgaagcggaaatcgttgagggcgagaaccacacatactgcatccggttcgtcccggccgaaatgggcacacacaccgtctcagtaaagtacaaagggcagcatgtcccaggctccccttttcagtttacagtgggtccgcttggggagggaggggcccataaagtgagagcggggggaccgggactggaaagagccgaggctggggttcctgcagaattcagcatctggacacgtgaagcgggcgccggaggactggccattgccgttgagggccctagtaaagccgagatctcgttcgaggataggaaggacggcagctgcggggtcgcctacgtcgttcaagagccaggagattatgaggtctcagtgaagttcaacgaagaacacatccctgacagtccatttgtcgtccctgtcgccagcccctcaggggatgcacgtcgccttacagtgtcttcccttcaggaatcaggcctgaaagtgaatcagcccgcctccttcgctgtgtccttaaacggcgctaaaggcgcaattgatgccaaggtgcacagcccaagcggagcattggaggaatgttacgttacagagattgatcaggataaatatgcagtgaggtttataccaagagagaacggggtatacttgattgatgtgaaatttaacgggacgcatattccaggaagcccctttaagatccgcgtgggcgaacctggccacggcggagaccctggattagtgtctgcatacggagctggcttggaggggggggttaccgggaacccagccgagtttgtggtcaatacaagtaacgctggggctggggccttgagtgtgacaatagacggaccatcgaaggttaagatggattgccaggagtgtcctgagggctatagggttacttacacacccatggcccccggaagctacctaatctccatcaagtatggtggaccctaccatataggcggcagcccttttaaggcaaaggtgacaggaccacgcctggttagcaatcactcactgcacgagacatctagtgtgttcgtggactcactaactaaagctacctgtgcccctcagcacggcgctccaggccctggcccggcagacgcttctaaggtggttgccaaagggctgggactgagtaaagcatatgtcggtcagaaatccagttttacagtcgactgctctaaggctggaaataatatgctgttagtcggagtgcacggaccacggaccccatgtgaggagatcttagtgaaacacgtgggatctcgtctgtacagcgtgagctatctcctgaaggacaaaggagagtacacacttgtcgtaaaatggggcgacgagcatattcccggctctccctacagagtggtggttccttag

SEQ ID NO: 30154 - DNA, 3642 bp, Artificial Sequence
  Description of Artificial Sequence: Synthetic coding sequence
atgaggagccgcaaccagggcggcgaatcggcaagcgatggccacatcagctgcccaaagccctcaatcattgggaacgcgggagaaaagtccctgagtgaagacgctaagaaaaagaagaagagtaaccgaaaagaggatgatgtgatggcctctggcacggtcaaacgtcaccttaagacctctggtgaatgtgaaagaaaaactaagaaaagtctggagcttagcaaggaggatctgatccagctgctctcgattatggagggggaacttcaagcgcgcgaggacgtgatccacatgctgaaaaccgagaaaactaaacccgaggtgctggaagcccactatggaagtgccgagcccgagaaagttttgcgcgtccttcacagagacgccattttagcacaggaaaaaagtataggagaagatgtatacgaaaagccaatctccgagctcgaccgtctggaggaaaaacagaaagaaacctacaggcggatgctcgaacaacttcttctcgccgagaaatgccaccggaggaccgtatacgaattggagaatgaaaagcataagcacacagactacatgaataagtctgacgactttactaatctcctggaacaggaacgcgagagactgaagaagctactggaacaggagaaggcataccaagctcggaaggaaaaagaaaacgctaaaagactaaataaactgagagatgaactggtaaagctcaaatcctttgctcttatgctcgtggacgagcgccagatgcacatcgagcagctcgggctccaaagccaaaaggtacaggaccttacacagaaactgagagaggaagaggagaagctgaaggctattactagtaagtcaaaggaagatcggcaaaaattactgaagcttgaagttgattttgaacataaggcctctagatttagccaagagcacgaggagatgaatgctaaactggcgaaccaggagtcacacaaccggcagctgcggttgaagttagtgggcttaactcaaagaatagaggagctggaggagaccaacaagaatctgcagaaggccgaggaggaattacaggagctcagggacaaaatagctaagggcgaatgtggtaactcctcgctgatggccgaagtcgagaatctgagaaagagagtacttgagatggaggggaaagatgaggagatcactaagactgagtcccagtgcagagagcttagaaaaaaattacaggaggaggagcatcactcgaaggagctgcggcttgaggttgagaaactgcagaaaaggatgagtgagcttgagaagttggaggaggccttctccaagtccaagtcggagtgcactcaactgcacctgaacctggagaaagaaaagaatttaacgaaggatttgttgaacgagctagaggttgtgaagagtagagtgaaggagctggagtgcagcgagagccgactcgaaaaggcggagctgagcttaaaggatgacctgacaaagcttaaatcctttacagttatgctggttgatgagaggaaaaacatgatggaaaaaatcaaacaagaagagaggaaagtggacggccttaacaagaacttcaaagtggagcagggtaaagtgatggatgtcactgagaaacttatcgaggaatccaaaaaactactaaaacttaagtccgaaatggaagagaaggtgtacaacctcaccagagagagggacgaactgatcggcaaacttaagagcgaagaagagaagagttccgaattgtcctgctctgttgatctgctgaaaaagcgtttggacggaatcgaggaagttgagagggagatcacgcgtggacgaagccgaaagggcagcgaattgacatgtcctgaggacaacaaaattaaggaattaacacttgagattgagcggctcaagaaacgcctccaacagctggaggttgttgaaggagatctgatgaaaactgaagacgagtacgaccagctggagcaaaagttccgcacagagcaagacaaagctaacttcttgagtcaacagctggaagagattaagcaccaaatcgccaagaataaagccatcgagaagggtgaagtcgtgtcccaggaggcagaattaaggcaccgtttccgactcgaggaggctaagagccgcgacctgaaggctgaagtacaggctttgaaagaaaaaatccacgagctgatgaataaggaggatcagctgagtcagctgcaagtggattatagtgtgcttcagcagcgttttatggaagaagaaaataagaataaaaatatgggacaggaggtcctaaacctcaccaaggagttggagctctcaaagcgctacagccgagccctgcggccttccgtcaatggacgccggatggtggacgttccagtcacatccactggagtgcagacagacgcggtgtctggcgaggcggccgaagaggaaactccagcagtattcattagaaaaagtttccaagaagaaaaccatatcatgagtaacttaagacaggtgggtctgaagaagcccgtggaaaggagctccgtactggatcgatacccaccagcggccaatgagcttaccatgcggaaatcctggattccctggatgcgtaaaagggaaaatgggccctctattacccaagagaagggccctagaacgaactccagccccggccatcctggagaggtagtcctgtcgcccaaacagggccagccactgcatatccgggtgacacctgaccacgaaaattcaactgctacactcgagatcacctcccctacaagtgaggagttcttttcgtcaacaactgttatcccaacactggggaaccaaaagcctagaattacaatcatccccagcccaaacgtgatgccacaaaagcagaagagcggggacacgacactaggcccagagagagcaatgtccccagtgactattactactttttcaagggagaaaacacctgaatccggacggggtgccttcgcggacaggcccacgagccctattcagatcatgaccgtgagcaccagcgcagcccctgccgagattgctgtgagccctgagtctcaggagatgccgatgggtcggacgattctaaaagtgactcccgaaaaacagaccgtccccactcccgtgaggaaatataattccaacgctaacattatcaccaccgaagacaataagatacacatccacctcggctcccagtttaagcgatccccaggcacctcaggagagggcgttagtcctgtcatcacggtgcggcccgtcaacgtcacagctgagaaagaggtcagtacaggcaccgtgttaaggtcaccacggaaccacctctcctcccggccgggcgcctccaaggtcacatctaccatcaccattactcccgttacgaccagcagtgcccgtggcacacagagcgtgtcagggcaggatggctcctcacaacgccccacaccgactcgaattccaatgtcaaagggcatgaaagcaggcaaacccgtcgtggccgcccccggggcaggcaatttgactaagtttgaacctagggccgagacacaaagcatgaaaatagaactcaaaaagtctgccgccagcagcaccacgtccctgggggggggcaagggctag

SEQ ID NO: 30155 - DNA, 3345 bp, Artificial Sequence
  Description of Artificial Sequence: Synthetic coding sequence
atgctgaagaccgagaaaacaaagccggaggtgctggaagcgcattatgggtctgcagagcctgagaaggtgctgcgggtgctccacagagacgccattctggcgcaagagaaaagtatcggagaagatgtgtacgagaaaccaatatcagagctggataggctggaggagaagcagaaagagacttacaggcgtatgctggaacagctgctgctcgcagagaagtgtcaccgtcggacagtttacgagctagagaatgagaaacacaaacatactgactacatgaataagtcagatgatttcacaaatctgttggaacaggagcgggaacgacttaagaagctcttggaacaggagaaggcataccaagcccgaaaagagaaagaaaatgccaaaaggttaaacaagctgcgggatgaactcgtgaagctgaaatcattcgccctaatgcttgtcgatgagcgacagatgcacatcgagcagttaggactgcagtctcagaaagtgcaggatttgacccagaaactgagggaggaagaggaaaaactgaaggccattacctcaaaatccaaggaggaccggcagaaattgctgaaacttgaagtagacttcgagcataaagcgagccgattttcacaggagcacgaagaaatgaatgctaagctcgccaatcaggagagccacaatcgtcaactgagactaaaactggtcgggctgacgcagaggattgaggagctagaggagacaaacaaaaacctgcagaaggctgaagaggaactgcaggagttgagggacaaaatcgcaaagggtgaatgtggaaattcatctttgatggccgaggtggagaatctcaggaagcgtgtacttgagatggagggaaaagacgaggaaataacaaaaaccgaaagccagtgccgagagcttaggaagaagctgcaggaggaagagcaccattccaaggagctgcgtcttgaggtcgaaaaacttcagaagcgaatgagcgaacttgaaaaacttgaggaggcattctcaaaatctaagtctgagtgcacgcagctgcatttgaacctcgagaaggagaagaatctgaccaaagacctgttaaatgagctggaagtggtgaagagtcgagtcaaggaactggagtgttctgagtcccggctggaaaaagctgagctttctctgaaggacgacttaaccaaactcaagtcctttactgtgatgctggtagatgaaaggaaaaacatgatggagaagatcaaacaggaagagcgcaaagtcgacggtctgaataagaattttaaggtcgagcagggtaaggttatggatgtcaccgaaaaattaattgaggaatcgaagaagctgctcaagctgaagagtgaaatggaggagaaggtgtataacctgacccgggaaagggatgagctgattggtaaactcaaatccgaagaggaaaaatcaagtgagctgagctgcagtgtcgatctgttgaagaaacggctcgatggaattgaagaggtggaacgtgaaatcacaagaggcaggtctcgcaagggatcggagctcacctgccctgaggacaacaagattaaggaattgaccttagagatagaacggctcaaaaaaaggctgcagcaactcgaggtggtcgaaggtgaccttatgaagacggaagatgagtacgaccagctggagcagaagttcagaacagaacaagacaaggctaattttctcagccagcagctcgaagagattaagcatcagattgctaagaacaaggctattgaaaagggcgaggtggtgagccaagaagccgaactccgacacagatttcggcttgaggaagccaagtcccgagatctaaaagcggaggttcaggccctcaaagagaaaatccatgaactgatgaacaaggaagatcagctgtcgcagctgcaagtggactactcagtcttacagcagcgatttatggaggaggagaataagaacaagaatatgggtcaggaggttctgaaccttactaaagagctggagctgtctaagcgatatagtcgcgcactgcggccctcagtcaatgggagacgcatggtggacgtccccgtgacctcgacaggcgtccagacagacgccgtgagcggtgaggcagctgaagaggagactcccgcagtgtttatcaggaagagtttccaggaggagaaccatattatgtcaaatctcagacaggtaggccttaagaagcctgtcgagcgatcatctgtgcttgacagataccctcctgccgccaacgagctgactatgcgaaaaagttggataccatggatgcggaagagggagaatgggccttcaatcactcaggaaaagggtccccggactaactcctcgcccggccatccaggcgaagtagtcctcagcccaaaacaggggcagcccttacacatacgggtcacccctgaccatgaaaacagcaccgcaaccctcgaaatcacctccccgacatctgaggagtttttttcaagcaccactgtgatcccaacattaggcaaccagaaacccaggatcactattattccaagcccgaatgtgatgcctcagaagcagaaatctggagatacaaccctcgggccggaaagggctatgtcgcccgtgacaataaccacattcagtagggagaagacgcctgagagcgggcggggagccttcgcagaccggcctacttcccctatccagatcatgaccgtctctacatccgccgcccctgccgaaatcgcggtgtcaccggagtcccaggagatgcccatggggcggacaatcctgaaggttacccctgaaaaacagactgtccctacccctgtgcgcaaatacaatagcaacgcaaacatcatcacaaccgaagataataagatccatatccacctgggcagccagttcaaacgctctccaggcacctccggcgagggagttagtcccgtgatcactgtgagacctgtcaacgtcaccgccgagaaagaggtctcaacaggaaccgtccttagatccccaaggaaccaccttagctctagaccaggcgcgagcaaggtgacctcaacaattacgatcactccagttaccacgagttccgctcgcggcacacagtcagtgagtggccaggacggctcttcccagaggccaactcccaccaggatccccatgagtaaggggatgaaagccgggaaaccggtggtcgctgcccccggagccggaaaccttactaagttcgagcctcgtgctgagacccaatctatgaaaattgagctaaagaagagtgccgcttcatcgaccaccagtctggggggtggtaagggctag

SEQ ID NO: 30156 - DNA, 3534 bp, Artificial Sequence
  Description of Artificial Sequence: Synthetic coding sequence
atgcggtccagaaatcagggtggcgagtcagcttccgatggccatatctcatgccccaaaccctctatcatcggaaatgcaggtgaaaagtccctgagcgaagacgctaagaagaaaaaaaaaagcaatcgaaaggaggacgatgtgatggccagcggaacagtgaaaagacatttgaaaacctcaggcgagtgtgagcgaaagacaaagaagtctctggagctgtctaaggaagatctgattcagctgctatccattatggagggcgaactgcaggctcgtgaagacgttattcacatgcttaagacggaaaagaccaaacccgaagtgctcgaggcccattacggctctgcggagcctgaaaaagtactgcgggtgttgcacagagatgccatccttgctcaggagaaatcaatcggagaggacgtatacgagaagcctatatccgaactcgatcgcttggaagaaaagcaaaaggagacataccgaaggatgttagagcaactgttgctcgcagaaaagtgccatagacgaacagtgtatgagctggagaacgagaaacataagcacaccgattacatgaacaaaagtgatgacttcactaatctactggagcaagagcgagagagactcaagaaactcctggaacaggaaaaagcctaccaagctagaaaagagaaagaaaacgcaaagcgcctcaacaagctaagagatgaactggtaaagctcaagtcctttgccctgatgcttgtcgacgaaaggcaaatgcatatcgagcagctcgggctgcagtcgcagaaggtgcaggatttgacacaaaagctgagggaagaggaagagaaactcaaggccattaccagcaagagcaaagaggacaggcaaaaattgttgaaactggaggtagactttgagcataaggcctcacgattcagtcaggaacacgaggaaatgaatgcgaaactggccaaccaagagagccataacagacagttgcggctgaaactggtaggcttgacccagagaatcgaagaactggaggaaaccaacaaaaaccttcagaaggcagaggaggagctgcaagaactgcgggataaaattgcgaagggcgagtgtggcaatagttccttgatggccgaggttgagaatctgaggaagagagtcctcgagatggagggcaaggatgaagaaatcacaaagaccgaatcccagtgtcgcgagctgaggaaaaagcttcaggaggaggagcaccatagtaaagaattgagacttgaggtggaaaagctgcagaagcgaatgagtgagctcgagaaactggaggaggccttttccaagtctaagtcagaatgcacccaactgcacttaaatctcgagaaagagaaaaatctgacaaaagacctgttaaatgaactggaggtggtcaaatcgcgggtgaaggagctggagtgtagcgagtccaggctcgaaaaagcagaactttctctcaaggacgatttgactaaactgaaaagtttcactgttatgctagtggatgaacgcaagaacatgatggaaaagatcaaacaggaagagcgcaaggtagatggtctgaacaagaatttcaaggtcgagcaggggaaggtgatggacgtcaccgagaagctgattgaggaatcaaaaaaactgctcaagcttaaatctgagatggaggagaaggtttataatctcacccgggaaagggatgagttgatcgggaaactgaagtctgaggaggaaaagtcatccgaattgagctgctcagtggacctcttaaagaaacgtctggacgggattgaagaagtggagcgggagataactagaggtaggtccagaaagggaagtgagctgacttgccctgaagacaacaagatcaaagagctgacgcttgaaattgaacggcttaagaagagactacagcagctcgaagtcgtggagggggacttaatgaagactgaagacgagtatgaccagctggaacaaaaattccggaccgaacaggataaggcaaactttttgtctcagcaattggaggaaattaaacaccagatagcgaagaacaaagccatagagaaaggagaggtcgtaagccaggaggccgaacttcggcacaggtttagactcgaggaggcaaaatctcgcgacctgaaggcagaggtgcaggccctgaaggaaaagattcacgaactgatgaataaagaggaccaactgtctcagctgcaggtcgattattcagtgctccagcagcggtttatggaagaggagaataagaacaaaaacatgggacaggaagttctgaacctcacaaaagagctcgaactgagcaagaggtactcccgtgccctgagaccatccgtcaatggacggcggatggtcgatgtaccagtgacctccaccggagtacagactgatgcggtgagcggtgaggcggctgaggaggaaacgccagctgtgttcatccgcaagtcctttcaggaggagaaccacatcatgagcaacctcaggcaggtgggcctgaagaagcctgtggagcggagctcagtgttggataggtatccaccggccgctaatgagctcaccatgaggaagagctggatcccatggatgcggaagagggagaatggacctagcatcacccaagagaagggtccgaggactaattcctcacccgggcaccccggagaggttgtcttaagtccaaagcagggacagccactacacattagggtgactcctgaccacgaaaactccactgcgactcttgagatcacttccccaaccagtgaagaatttttctccagtacaactgtaattccaactctaggaaatcagaagccaagaatcaccatcattccatccccgaacgttatgcctcagaagcaaaagtcgggtgataccaccttgggccccgaaagagccatgagccctgtgactattactacattcagccgcgaaaagacacctgagtccgggcgcggcgcatttgctgaccggccaacatctcccattcagatcatgacggtcagtacttcagctgcccccgccgaaatcgccgtctcaccagaatcacaagaaatgcctatggggcgcaccatccttaaggttacgcccgagaagcagactgtgccaacacccgttcgaaagtacaactctaacgccaatattatcaccactgaggataacaaaatccatatccacttggggtcacagttcaagcgcagcccgggaacatcaggcgagggagtctctcccgtgattactgtgcggcctgttaacgttaccgcagaaaaggaagtatccactggtaccgtgctgaggtctcccaggaatcatctgtcgtcacggccaggcgcatctaaggtgacctcaaccatcaccatcacccccgtcactaccagctcagctaggggcactcaatcagtgtcaggtcaggacggcagttcgcagagacccactcccactagaattccgatgtcgaaggagtccattatcatccaccaactgcgcatgaactcaagatag

SEQ ID NO: 30157 - DNA, 279 bp, Artificial Sequence
  Description of Artificial Sequence: Synthetic coding sequence
atgggggttcacgtcgagacaatctcacccggagatggtatgctggaagatggcaaaaaatttgactccagcagggaccggaataagccttttaaatttatgctcggcaagcaggaggtcataagagggtgggaggaaggagtggtgcagatgtccgtggggcagcgggcaaaactgaccatctctccggattacgcctatggggctacaggtcaccccggcatcatccccccacatgccacactggtattcgacgttgaacttctgaaattagaatag

SEQ ID NO: 30158 - DNA, 327 bp, Artificial Sequence
  Description of Artificial Sequence: Synthetic coding sequence
atgggcgtgcatgtagagactattagtcccggggattggagaacttttcctaaacgaagccagacctgtgtgatgcactataccgggatgctggaggacggaaaaaagttcgatagctcccgcgaccgcaataaacccttcaagttcatgctgggaaagcaggaagtgatcagaggttgggaagagggagtcgtgcaaatgagtgtcggtcagagagcgaaactgacaattagccctgactacgcctacggggcgaccggacatcccgggattattccaccacatgccacgctcgtgttcgacgtcgaactgctgaagctagaatag

SEQ ID NO: 30159 - DNA, 774 bp, Artificial Sequence
  Description of Artificial Sequence: Synthetic coding sequence
atgccaaaaaccatgcactttctctttaggttcatcgtattcttttatttgtggggcctgttcacagcgcagcggcaaaagaaggaggagtctaccgaggaggtaaaaatagaggtgttgcaccggcctgagaactgctccaagacttccaagaagggtgacctacttaatgcacattacgacggttacctggctaaggacggaagtaagttttactgttctcggacgcagaacgaagggcatcccaagtggttcgtactgggggtgggccaggtcataaaaggcctggatattgccatgacggacatgtgcccaggcgaaaagagaaaggtagtgattccccctagtttcgcctacggcaaggaaggctacggcattcttgaagaagtcttcctcctccagaatatcttagtgtcttgtcatcgaaccacattgcatgttctgaaatgcatgttgcttgtgaataacaacacctgcgccgaagggaagattccacccgacgctaccctgattttcgaaatcgaactatatgccgtgactaagggaccaagaagtatcgaaacgtttaaacagattgatatggataacgaccgtcaactatccaaggccgagattaacctgtatcttcagcgggagtttgagaaggacgagaaaccacgcgataagagctatcaggacgcggtccttgaagatatcttcaagaaaaacgaccatgacggagacggctttatttcgcccaaagaatacaatgtgtatcagcacgatgaactgtag

SEQ ID NO: 30160 - DNA, 669 bp, Artificial Sequence
  Description of Artificial Sequence: Synthetic coding sequence
atgcccaaaaccatgcatttcctgttccggttcatcgttttcttctatttatggggcttgttcaccgcacaacgacagaaaaaggaagagagtaccgaagaagtgaagattgaggtcctccaccgtcccgagaattgttcaaagacaagcaagaagggcgatttgctaaacgctcattacgatgggtacctagcaaaggacggtagcaaattctattgctctaggacccagaatgagggccacccaaaatggttcgtactgggcgtcggccaggttatcaaaggactggatatagctatgactgacatgtgccctggagagaagaggaaagtggtaattcctccttcctttgcatacggcaaggagggatacgcggagggcaagattccaccggatgccacactcatctttgaaatagagctgtatgcggttaccaaaggtccccgctccattgagactttcaagcagattgacatggacaatgacagacagctctcaaaagctgagataaatttgtacctccagcgcgagttcgagaaggatgaaaagcctagagataagagttatcaggacgcagtattagaagacatctttaaaaaaaacgaccacgatggcgacggttttataagtcccaaggagtataacgtttatcagcacgatgagctgtag

SEQ ID NO: 30161 - DNA, 666 bp, Artificial Sequence
  Description of Artificial Sequence: Synthetic coding sequence
atgcccaagaccatgcacttcctgttcagattcatcgtctttttttatctgtgggggttgttcactgcacagcgacagaaaaaagaggagtctaccgaagaagtaaaaatcgaggttttgcacagacctgaaaattgtagcaaaacttctaagaagggcgatctgctaaatgcccactatgatgggtacctggccaaggatggatccaaattctattgctcccgtacccaaaatgagggccacccgaaatggttcgtactaggggtgggtcaggtgataaaagggctcgacattgccatgactgatatgtgccctggcgaaaaaagaaaggtcgtgataccacccagcttcgcctacgggaaggaaggatacgaaggcaagatccctccagacgccactctgatctttgagatcgagttatatgcagtaaccaagggaccgagaagcatcgagacgtttaagcagattgacatggacaatgatagacagctatccaaggctgagatcaacctttacttacaacgagagtttgaaaaagacgaaaagcccagagacaagtcatatcaggacgcagtcttggaggatatttttaaaaaaaatgatcacgacggagacggcttcatctctcccaaggagtataatgtgtaccagcacgacgagctctag

SEQ ID NO: 30162 - DNA, 1050 bp, Artificial Sequence
  Description of Artificial Sequence: Synthetic coding sequence
atggagacacccccggtaaacaccatcggggagaaggatacctctcagcctcagcaggagtgggaaaagaacctgcgggaaaacctcgactctgtaatccaaatcagacagcagcctcgtgatccccctaccgaaacattagagttggaggtaagtcccgatccagcttcccaaatcttggagcacacacaaggggctgagaagctggtagctgaactggagggagactcacacaaaagtcatggcagtacctcgcagatgcccgaaactctccaggctagcgatctttggtactgccctgacggctccttcgtgaagaagatcgtcatacgcggacacggacttgacaagcctaagcttggatcttgttgccgggtcctggcattgggctttccctttggctccggacctcctgaggggtggacagaacttacgatgggtgttggcccatggagggaagaaacttggggcgagctcatcgaaaaatgtctggaatctatgtgccagggggaggaagctgagctccagctgcccggtcactctggcccgccagtacgacttaccttagcttctttcactcaggggagagattcctgggaacttgaaaccagcgagaaggaggcacttgcgagggaagagcgggcaagaggaaccgagctgttcagggcagggaaccccgaaggcgctgcccgctgttacggaagagccctgcgattactcttaactctcccaccaccgggaccaccagagcgaactgtccttcacgcgaacctcgcagcttgccagcttctcctcggacagccacagttggccgctcagtcttgtgatcgcgtcttagaaagggaacccggccacctcaaagccctgtacagacgtggggtagctcaggctgccctgggcaatctggaaaaagcgaccgcggacctaaaaaaagtgctagctattgacccaaagaatagagccgctcaagaggagttaggcaaggtggttatccagggcaagaaccaagatgcaggtctggctcagggactccgtaaaatgttcgggtag

SEQ ID NO: 30163 - DNA, 423 bp, Artificial Sequence
  Description of Artificial Sequence: Synthetic coding sequence
atgccactgcctgagccaagtgaacaagagggcgagtccgtgaaggcgtcccaagagccctcacccaaaccagggacagaagtgatcccagccgcacctcgtaaaccaaggaagtttagtaagctagtcctcctaaccgcgtctaaggattccacgaaggttgctggcgctaaaagaaagggagtccactgtgtgatgtccctcggtgtgcctggtcctgcgactttagccaaggcactcctgcagacccacccagaagcccagcgcgcaatcgaagctgccccccaggagcccgagcagaagaggtcccggcaggaccccggaaccgaccgaaccgaggactcaggacttgcggccggtccccccgaagctgctggggagaatttcgccccatgttcagtggcaccaggtaagtctctgtag

SEQ ID NO: 30164 - DNA, 423 bp, Artificial Sequence
  Description of Artificial Sequence: Synthetic coding sequence
atgcccctgccagaaccgtctgaacaggaaggcgagtctgtgaaggccagtcaggaaccttccccaaaacctggcacggaagtgatccctgccgcaccacggaagccaaggaaattcagcaaactggtgctcctcacagcatctaaagacagtacaaaagtggctggggcaaagagaaagggtgtgcactgcgtgatgtccctcggagtccccggacccgcaaccctggccaaagccttgcttcagactcatcccgaagctcagcgcgcaatcgaggctgcaccccaggaaccagagcagaagcgatcacgccaggacccaggcacagacaggacagaagactctggcttggcagctggtccaccggaagccgccggcgaaaattttgctccatgctccgttgccccgggtaaatcgctgtag

SEQ ID NO: 30165 - DNA, 735 bp, Artificial Sequence
  Description of Artificial Sequence: Synthetic coding sequence
atggatatggcctggcagatgatgcaacttctccttcttgccctggtgactgccgccggcagtgcccagcctagatctgctcgcgcccgaactgacttactgaatgtgtgcatgaatgctaaacaccacaagactcagccctcaccagaggacgagctgtatggtcagtgctccccatggaaaaagaatgcgtgctgtacagctagtacaagccaggaactgcacaaggatacatccaggctgtataacttcaattgggatcattgcggcaagatggaaccgacatgtaagcggcactttatccaagattcttgcctcgagtgctctcccaatctgggcccttggataagacaagtgaatcagtcttggcgcaaggaaaggatccttaatgtacctctgtgtaaagaagattgcgagaggtggtgggaggattgcaggaccagctatacgtgcaaaagcaattggcacaaaggttggaattggacgtctggcataaatgagtgccctgctggcgcactgtgttctaccttcgaatcttacttcccaacacctgccgctctgtgtgaggggctatggtctcattcatttaaggtgtctaattatagcagaggctctggaagatgtattcagatgtggttcgacagcgctcaaggcaatccaaacgaagaggttgcgaagttctatgcggcagccatgaatgcaggggccccgtcacgcgggatcatcgacagctag

SEQ ID NO: 30166 - DNA, 864 bp, Artificial Sequence
  Description of Artificial Sequence: Synthetic coding sequence
atggacatggcctggcaaatgatgcaactgttgctcctggctctggttacagctgccgggtctgcacagccaaggagcgcccgggcgcgcaccgacctactaaatgtttgcatgaacgctaagcatcacaagactcagccctctccggaggacgagttgtacgggcaggtcggtgcaccccaaggaccatcgcctgggtctgtgcctctggatgacttgcctggcgccgaagagcctgagtatgggggagacggctgtggtggagaacgtctgtcacccgtgtccagtcccccatcagcagtccccggccggcgaatgcctgctgcccggcctgccccagctcggagctgcacccggacccctccggcctgtactacgctcaccggtattaccgtggtccggtggaatcccccggcgtctgccacattaagtaggaccgccgtgtcagagtgttcccctaatctgggcccttggattaggcaggtgaatcaaagttggcgcaaggagagaattctgaatgtgcccttgtgcaaagaagattgtgaaagatggtgggaagactgtaggacctcatatacatgcaagtctaattggcacaaaggctggaactggacttcaggtatcaacgaatgccctgctggtgcactgtgctccacctttgagagctactttcccacccctgctgctttgtgtgagggcttgtggtcgcatagctttaaggtgtccaactattctagaggatcaggcaggtgcatccagatgtggttcgactctgcccagggaaaccccaacgaggaagtcgcgaaattctatgctgccgctatgaacgcgggtgcacccagtagaggaattatagactcatag

SEQ ID NO: 30167 - DNA, 1380 bp, Artificial Sequence
  Description of Artificial Sequence: Synthetic coding sequence
atgaccctttccactgagatgagtgatgcgagcggtctggccgaagagacggacattgatgtagtaggcgaaggcgaagacgaagaagacgaggaggaagaggatgacgacgaagggggcggcggaggaccccggttggcggtaccagcacagcggagacgtcgacgccgatcttatgctggagaggatgaacttgaagatctcgaggaagaggaggatgatgacgatatactcctggctccaccggcaggcggcagcccggcacctccaggaccggccccagccgccggcgctggagcaggaggaggagggggggggggtggcgccggcggcggaggctctgccggcagcggtgccaagaaccccctggtgaaacccccttactcttacattgccctaatcacaatggctattcttcagtctcccaaaaaaagacttacgttgtccgagatctgtgagttcattagcggaagattcccttactaccgggaaaagtttcccgcatggcaaaacagcattaggcacaacctgtccctgaacgactgcttcgtgaaaatcccacgggagccaggcaaccccggaaaggggaactactggaccctggacccagaaagtgctgacatgttcgataacggttcctttttgaggcgccggaaacgcttcaagaggcagccactgttaccacctaatgctgccgccgccgagtccctgctgctgaggggggctggggctgcaggaggcgctggcgatccagccgccgctgcggcgttgttccctccagcgcccccccctccccctcacgcatacggttacggaccctatggctgtggatacggcctgcagctgcctccttatgcgcctccttccgccttattcgctgccgctgcacgccgaagacgacggcggctgccgccggccttggcacccgctgccccagccacagcaagaaggggtcgccgagcaggacctgaccgactgcggttaccggctgcacccgcccggcggcggccaacccgtcctcccgctggcctacgggggcagggcggccggcccggcaggctttcagctggggccctcgctcttctccaccgtgaacatcataggggccagctcggtcccggccgacggtgtaggcgccgacgggcagggcgaaggcggcgaagcggtctggccctcgccctggcaggcggtggggcagctagctcacgcatccagaggcgccggttaaggggcgccggcggcagaggtcccggcggccgcgcccacccaatacctcgcggtcggcggggtcgaagacggctacttagcctgctggtccggagactgggtgactctgccccaagagactgcccggtgcaatgtagagagctgtactgctag

SEQ ID NO: 30168 - DNA, 2202 bp, Artificial Sequence
  Description of Artificial Sequence: Synthetic coding sequence
atggccgaggtgggcgaggactcaggagctcgtgccttgctggcgctcagatctgccccttgcagccccgtgctctgtgcagcagccgctgcggctgcatttccagccgcagcaccgccacctgcgcctgcacagccccagccgcctcctggccctcctcccccccccccaccccctctgcctcctggggcaatcgctggagccgggagctcagggggttcatctggagtctccggggatagcgccgtggccggggcagctccagccctcgtggctgcagcggccgcctccgtgcgccaatctcctgggcctgctcttgccagattagaaggccgcgagtttgagttcctgatgcggcagccatccgtcaccattggccgaaactcctcgcagggttcagttgacctctccatgggactatcgagctttatttcccggaggcacttacagctgagttttcaagagccacatttttaccttcgctgcttgggaaaaaacggcgtgtttgtggatggcgcatttcaaaggcgcggagctccagccctgcagctccccaaacagtgcacgtttcgtttcccaagcaccgcaatcaagatccagtttacctccctatatcataaagaggaagccccagcttcacccttaagacccctgtaccctcaaatatcccccctgaagatccacatccccgagcccgacctaaggagcatggtgagtcccgtcccgtcaccaaccggtacaatttcagtccctaattcctgccccgcaagtcccaggggtgcaggatcctcttcatatcggtttgttcaaaatgtgacttctgacctgcaactcgcggccgaatttgccgccaaggccgccagcgaacaacaggcagacacctccggaggagactcgccgaaggacgagtcaaagccccccttttcctatgctcagctcatcgtccaggccatctctagtgcacaggaccgccagctgacactctccggcatctacgcacacataacaaaacattacccgtactatcggacggcagataaagggtggcagaatagcattcgccataatctgagcctaaatcgttacttcataaaagtgccgcggtcacaagaagagcccggaaaggggtctttctggcgaattgaccctgccagcgaggccaagctcgtggagcaggctttcaggaaaagacggcaaaggggggtgagctgcttccggactccatttggacccctatcttctagaagcgctcccgcctcaccaacccacccaggcctgatgagtccacggagtgggggcttgcaaacaccggaatgcttgtctcgggagggctctcccatccctcatgatcccgagtttggttcaaagttggcctctgttcccgaatatagatacagccaatcggctcccgggagtccagtgtccgcacaacctgtcatcatggccgtgcctcctaggccgagttctctcgtagccaagcccgtggcatacatgcctgcaagcattgttacatcccaacagcctgctggtcacgcaatccacgtggtacagcaggctcctaccgtgaccatggtgagagttgttactacttctgcaaacagcgcgaacggttatatcctaacatcccaaggcgcggctggcggaagccatgatgctgcaggcgcagccgttcttgatcttggtagtgaggcccgcggactggaggagaaacccaccatcgcattcgctactatccccgcggccggcggggtgattcagacagtggcctcacagatggccccaggggttcccgggcacacggtcacgatcttgcagccagccactcctgtgacactcgggcagcatcacctgcctgtcagggcagttacccaaaacgggaaacatgccgtgccaacaaattctctagcaggaaacgcttatgccctgacatcacccctgcaattgcttgccacccaggcctcaagttccgcccctgtagtcgtcactcgggtctgcgaagtcggcccgaaagaaccagctgcagcggtggctgctaccgccaccacaacgccagccaccgctaccactgcctccgcctctgcctcaagcaccggagaaccagaagtgaagaggtcaagggtagaagaaccatccggcgccgttactacccccgctggagtgattgctgccgcagggcctcagggaccaggcacaggcgagtag

SEQ ID NO: 30169 - DNA, 1713 bp, Artificial Sequence
  Description of Artificial Sequence: Synthetic coding sequence
atggcgtactgcctgggtgtgaattttgtgccctcacgattttgctatcagctgcatcggctgctgttgaggtgcacttttcgtttcccatctactgctatcaagatacagtttacatcactgtaccacaaagaggaagctccagccagccctctccgccctctctatcctcagatttcaccactgaagatacacattccagagccggaccttaggtcgatggtgtcccccgtcccttcaccaaccggcactatcagtgtccctaactcttgtcctgccagccccaggggcgccggctcatctagctataggttcgtgcagaatgtgacaagtgaccttcagctcgctgccgagtttgcagctaaggccgcctctgaacagcaggctgatacctctggcggggatagtcctaaagacgaatctaagccccccttttcttacgctcaacttatcgtccaggccatttcatccgcccaggatcgccagctcacgttatcggggatctacgcccacataacaaagcattatccatattatcgaacggcagataagggatggcagaatagcatcagacataatttgtctttaaatcggtacttcattaaggttccaaggtcacaggaagaaccaggaaaaggaagtttttggcgtatcgacccagcctctgaggctaagctcgttgagcaagcttttaggaaaagacggcagagaggcgtgagttgttttcgcaccccttttggacctttatcaagccgaagtgctcctgctagtccaactcaccccggtcttatgtccccacgctcaggcggcctccagacaccagaatgtctcagtcgcgaagggagcccaataccacatgatcccgagttcggatccaaactagccagcgtgcctgagtatcggtatagccagagcgccccaggctctcctgtaagcgcccagcccgtaattatggctgtacccccgcgaccatccagtctagtggcaaagcccgtggcctacatgccagcctcaattgtgactagccagcagccagctggccatgctatccatgtggtgcaacaagcgccaaccgtcacaatggtgagggtggtgaccaccagtgccaactctgccaatggatatattctgacctcccagggtgccgccggcgggtcacacgatgcagctggcgccgcggttttagacctaggctctgaagcccgggggttagaagaaaaacctacaattgctttcgctacaatacctgctgccggcggagttatacaaactgtggctagccagatggcccccggagtgccggggcacacagtgaccatccttcagcctgcgacacctgtaactctcggccagcatcatttgccggtccgcgcagtcactcagaatggaaagcatgcggtgcctacgaattctctggcgggcaacgcatacgccctaacatccccgctgcagctgctggccacccaggcttcttcctcagctcccgtggtggtgacccgcgtctgtgaggttggaccaaaagagccggccgcagcggtcgccgccaccgcaactactacccccgctacagctacaacagcaagtgcctccgcgtcgagtacaggcgagcccgaggtgaagcgctctcgcgtggaagaaccaagcggggccgtgacaactccagctggagttattgctgcagccggaccgcagggaccaggaaccggcgagtag

SEQ ID NO: 30170 - DNA, 1470 bp, Artificial Sequence
  Description of Artificial Sequence: Synthetic coding sequence
atggtctctccagtacctagtcctacaggcacaatatctgtaccaaattcatgccccgcaagccctaggggagcgggcagctctagttacagattcgtgcagaatgtgaccagcgatctccagttagccgcagaattcgcggccaaagctgctagcgaacagcaggccgataccagtggtggagacagtcctaaagacgagtctaaacctccattcagttacgcgcagctcatcgtgcaggctatttcctctgctcaggatcgccaactgacactatcagggatttatgcccacataaccaagcactatccttactatcgcactgcagacaagggatggcagaacagcataaggcacaatctgagtctcaatcgctattttataaaggtgcctagatcccaggaagaacctggaaagggctcattttggcgcatagaccctgcaagcgaggctaaactcgttgaacaggccttccggaagcgtcggcagcgcggcgtaagctgtttccgcaccccgtttggacctttgtcgtctcggtcggccccagccagtccgacccatcctggtctcatgtccccgcgcagcgggggtctgcaaacaccgcccattccccacgatcccgagtttggttcaaagctcgcatccgttcctgaataccgctattcacagtccgcacctggctcccctgtgtcagctcagccagtcatcatggccgtcccgcctcgcccttcctcactggtggccaagcccgtggcatacatgcccgcctcgattgtcacatcccagcagcctgccggccatgcaattcacgtggttcagcaggcgccaaccgtgacaatggttagagtcgtgaccacatccgctaactccgcgaatggctatattctgacttcacagggagcagcgggtggcagccacgatgcagccggggcggcagtgttagatttgggcagcgaggctagaggactggaagagaagcccaccatcgctttcgcaacaatccctgccgccggtggcgtgattcagactgttgcctcccaaatggctccaggagtcccaggtcatacggtcacaatcttgcagcccgctactcctgtaactctgggacagcatcacctccccgtgagagctgttactcagaacgggaaacatgccgtgcctacaaattcactggccggcaatgcatatgcactaacgagtccacttcaacttctcgccacacaggcctccagctcagctccagtagtggttacccgggtgtgcgaagttggccccaaggaaccagcagctgcagtggccgcgactgccacaaccacaccagctaccgcaacgacagcttccgcttctgcctcgagcactggcgagccagaggtaaagaggtcccgtgtagaggagcccagcggagctgtgaccactccagctggagtgatagcagccgccggcccgcaaggacctggcactggggaatag

SEQ ID NO: 30171 - DNA, 1752 bp, Artificial Sequence
  Description of Artificial Sequence: Synthetic coding sequence
atgcgccagccctccgtgaccattgggcggaattcttcccagggttcagtagatctgagcatgggcctgagttccttcatatcacgcaggcatctgcagctcagcttccaggaacctcacttctacctgcgatgtttaggcaagaatggcgtgtttgtggatggcgcctttcaaaggagaggagcacccgccctacagctgcctaaacagtgcactttcaggttccctagcacagccattaagatccaattcacaagtttgtaccacaaggaggaagcccctgcaagcccactgagacccctttatccccagatttcaccgctgaaaattcacatcccagagccagacctgagaagcatggtttccccagtcccgtctccgacaggtacgattagtgtgccaaattcttgtcctgccagccctcggggggcaggctcttctagctacaggttcgtccagaacgtaactagcgatctgcaattggcggcagagtttgccgctaaagccgcgtctgagcaacaggcagatacctcaggcggtgatagtcccaaggatgagagtaagccccctttcagctacgctcaattgatcgtgcaggctatatcttctgctcaggatcggcaactgactctgtctggcatttacgcgcatattacaaagcactatccatactacagaaccgccgacaaaggctggcaaaactccattagacacaacttgtctttgaatcggtattttataaaggttcctaggagccaggaggagcccggaaagggctcattctggcggattgaccccgcgagcgaggctaagctagtcgaacaagcatttcggaagaggaggcagcgcggagtatcgtgttttcgaactccattcgggccgttgagctctcgatccgctcctgcgagccctacccaccctggcctgatgagccccaggtcagggggtctccaaacccctgagtgtcttagtcgagagggtagccccatcccacatgacccggagttcggctctaagttggccagcgttccagagtacaggtacagccagagcgctcccgggagccccgtgtccgcacaaccggtgattatggccgtacctccaaggccctcatccctcgtcgccaaacccgtcgcttatatgccagcttccatagtgacaagtcaacagcctgcagggcacgcaatccacgtggtgcagcaggcgccaacggtcactatggttagggtggtgacgacatccgccaattctgccaacgggtatatcctgacttcgcagggcgctgcaggcggctcacacgatgccgccggagcggctgtgttggacttgggctcggaggccagggggttagaagaaaagcctacaatcgcatttgccactatccctgcggcaggaggagtgattcagacagtggcatcccagatggccccaggggtgcctggccacacagtcacaatcctgcaacccgccactccagtgaccttgggccagcaccacctgccagtgagagccgtcacacaaaatgggaagcatgcagttccgacaaatagcctggcgggcaacgcttacgcgctgacaagcccccttcagctgttagctacccaagcctcatcctcagctcctgtggtggtcacgcgcgtgtgcgaggtgggccctaaggaaccactgccaccacctcccctgcctccccctctcccactggaaagcccccgttctaagggaccgggctggaggagtcccgttgtgttatag

SEQ ID NO: 30172 - DNA, 1947 bp, Artificial Sequence
  Description of Artificial Sequence: Synthetic coding sequence
atggtgagcctgcccccacctcagagtgatgttacacttccaggccccacgaggctagagggtgaaaggcaaggagatctcatgcaggcgcccgggttacccggctctcccgccccacagagtaagcatgctggattttcttgctccagcttcgtgagtgacgggccacctgagcgaacaccatctctaccaccacatagtcccaggattgcatcccctggccctgaacaagtgcaggggcactgtcctgcgggccccggccctggcccttttagactgagtcccagcgataagtaccccgggttcggctttgaggaggccgccgcgagctcacctgggaggttcttaaagggcagccatgccccctttcacccatataagaggcctttccacgaagatgtctttcctgaggccgagaccacacttgcccttaaggggcacagcttcaagacaccgggccctttagaagcattcgaggagatccccgtggacgtggccgaagcggaagccttcctcccagggttttccgccgaagcttggtgcaatggattaccctatccttcacaggaacatggtcctcaggttctcggatccgaggtcaaagttaaacctccagttttggaatctggcgctggcatgttctgttaccaaccccccttgcaacacatgtactgcagcagccagcctccttttcaccagtattccccagggggtgggagctatcccattccctacctgggttccagtcattatcaataccaacgtatggcgccccaggccagcaccgatggacatcaaccccttttcccgaaaccgatctatagttactccatcctgattttcatggccctgaagaactccaaaacaggctcactaccggttagcgaaatctataatttcatgaccgagcactttccctacttcaagacagccccagacggctggaagaactccgtgcgacataatctcagtctgaataaatgttttgagaaggtggagaacaagagtgggtcctcttctcgcaaaggctgtctatgggccctgaaccccgccaagatagacaaaatgcaggaggagttacagaagtggaagcgcaaagatcccattgcggttcgcaagagcatggccaagccggaggagctggactcccttattggcgacaagcgagagaagcttggttcaccgctgctcggatgccccccccccgggctgtccggctcagggccaatacggcccttggccccaccagctggactttcaccaccgctgcactccctgcatcccgctccgggacctattcctggtaagaatccgcttcaggatctgctgatgggacacacaccatcttgctacggccagacctacctgcacctttctccgggactggcgcctcccgggccgccacaaccactttttccccaacctgatggccacttggagctcagggcacagcccggtactccccaggacagtcctcttccggctcacaccccaccctctcatagtgcgaagctgctggccgaaccatctcctgccagaactatgcacgacactctgcttcctgatggagatctcggaaccgacttagatgccataaacccctcgctgaccgactttgatttccaaggcaatctgtgggaacagttgaaggatgactccttggccttggatcccctcgtcctggtcacatctagtcctacttctagctccatgccaccgccccagcctcctccacactgctttcctccaggcccttgcttgactgagactggaagcggagctggagacttggcggcccccggatcaggcggttctggagccttaggagacttgcacctgaccacattatatagcgctttcatggaactggaaccaacacctcctactgcacccgctggaccatctgtttacctgagcccgtcttcgaagcctgtcgccctggcttag

SEQ ID NO: 30173 - DNA, 1191 bp, Artificial Sequence
  Description of Artificial Sequence: Synthetic coding sequence
atgcccaatcccaggccaggaaagccgtcagccccatccctagctcttggcccttccccaggggccagtccaagttggcgtgcagctcctaaggcctcagatcttcttggcgcccgcggacctgggggtaccttccaggggagagacttacgcggcggcgcgcatgccagcagtagctcccttaaccctatgcctccgagtcagttgcaactgtcaacggttgacgctcacgccagaacccccgtactgcaggtgcacccattagaaagcccggcaatgatctcgctgaccccgcccaccactgcaacaggggtcttcagcctgaaggcccgaccaggcctgccgcccgggattaacgtggcaagcctggaatgggtaagccgagaaccagccctcttgtgtaccttcccaaaccctagtgccccccgcaaggactcaaccctgtccgccgtgcctcagtcctcctaccctctgcttgctaacggtgtgtgtaagtggcccggctgcgagaaggtatttgaagaacccgaagactttttgaagcactgccaggctgaccacttgctggatgagaaaggccgggcccagtgtttgttgcagcgggagatggtgcagtcactagagcagcagctggtgctagagaaggagaaactttccgccatgcaggcccacctggcaggcaaaatggccctgaccaaagccagtagtgttgccagctccgacaagggttcatgctgtatcgtggccgcaggctctcaaggtccggtggtaccagcgtggagtggtcctcgggaggctccagactccctctttgcagtgcgaagacatctgtggggatcacatggcaactctacctttccggaatttctccataatatggattacttcaaattccacaatatgagaccacctttcacctacgcaaccctaatccgatgggcaatcctcgaagcccccgagaaacagcgtacgcttaacgagatctaccactggttcacaagaatgtttgcgttctttcgcaaccatcccgcgacctggaaaaacgcaattaggcataatctctccctccacaaatgctttgtaagggtcgaaagcgaaaagggggccgtttggacagtcgatgaattggaattccgtaagaagcggagccagcggccttcccggtgcagtaatcctacacccggcccttag

SEQ ID NO: 30174 - DNA, 2052 bp, Artificial Sequence
  Description of Artificial Sequence: Synthetic coding sequence
atgcaggagctggaaagcttacttgcacaacagaaaaaggccctagccaagtcgattactcaagagaaaaacagggtgaaagaggcgctggaggaggagcagacccgggtgcaggagcttgaggaaagactcgcgaggcagaaagagatctctgaatctaatattgcatatgaaaagaggaaggccaaagaggctatggaaaaggaaaagaagaaggttcaggacttagaaaataggttaaccaaacagaaggaagagctggaactgaaggagcaaaaagaagacgtactgaataacaaattgtccgatgctctggcaatggttgaggagactcagaaaacgaaagccaccgagtctctgaaggccgaaagcttagctcttaaattaaacgagacgctagcagagcttgagactaccaaaaccaagatgatcatggtagaggaaaggctaatcctgcagcagaaaatggtcaaggcgctgcaggatgaacaggaatcccagaggcatggctttgaagaagaaataatggaatataaggagcaaattaagcagcatgcccagaccattgtctccctcgaagagaaacttcagaaggttacacagcaccacaaaaaaattgagggtgagattgcgactttaaaagataatgacccggctcctaaggaagaaagaccccaggaccctcttgttgcccccatgactgagagctcagctaaggacatggcctacgaacacctcatagacgacttgctggccgctcagaaagaaattttgtcccagcaggaggtaatcatgaagctcagaaaagatctaactgaagcccactcccggatgtccgacctcaggggtgaattgaatgagaagcagaagatggagctcgagcagaatgtggtgctggttcagcagcagtcgaaggagctttccgtgttaaaagaaaagatggcccagatgtcatctctggtggagaaaaaagaccgtgagttgaaagcactggaagaggctttgcgagctagccaggaaaagcataggcttcaactaaacacggagaaagagcaaaagccccgcaaaaagacccaaacttgcgatactagcgtccaaattgagcccgtgcacacagaggcattcagcagcagccaggaacagcaaagcttctccgatctgggagttaggtgtaaaggatcccgccatgaggaggtgattcagcgtcaaaagaaggcgctgtctgaacttagggctcggattaaggagttagagaaggccaggagccctgatcacaaggatcaccagaatgaaagctttctagatctgaagaatctgagaatggagaataatgttcagaagatcctgttggacgctaagccagatctgcctactctctcccgcattgaaattctcgccccacagaacggactctgcaatgctaggttcgggtcagccatggaaaaatctggcaaaatggatgtagcagaagccctggaacttagcgaaaaactatatctagacatgagtaagacactcggctccctgatgaacattaagaacatgtctggccacgtgagcatgaaatatctgagcagacaggagagggaaaaagtaaatcagctacggcaaagagacctggacctggtctttgacaagatcacacagttgaagaatcagctcggaaggaaagaggaactcctccgtggctacgaaaaggacgtggaacagctgcgtagatccaaagtgtcaatagagatgtatcaaagccaggtggctaagctcgaagacgacatttacaaggaggcagaggagaaagctttacttaaagaggcgttagagagaatggagcatcaattatgtcaagaaaagcgcatcaatagagcaattcggcagcagaagcggcgagtttttgtagagatggtaaaaaaccgcatgcagaattccaactcccaggttggcacacggaaggcttcgctgaagatggatcaggaacgagagatgcttcgcaaagaaacttcaagtaagagcagccagtctcttctgcacagtaaaccttccgggaagtactag

SEQ ID NO: 30175 - DNA, 4239 bp, Artificial Sequence
  Description of Artificial Sequence: Synthetic coding sequence
atgaaagcttatctgaagtctgccgaaggctttttcgtgttaaacaaatccaccacaatcgggagacatgagaacagtgacctggttctgcagagtcctgacattgacaatcaccatgctttgatcgagtataacgaagctgagtgcagcttcgtcctgcaagacttcaattcccgcaatggtacgttcgttaacgagtgccacatacagaacgtggcagtgaagctgattcccggagacatactgagatttggaagtgctggccttacttacgagcttgtcatagaaaaccctcctcccgtgtcctttccgtggatgaggggtcctgcaccctggcctggaccgcagccccctagggcaactcagcagcctaatcaggctcctccaccctcccacattcctttccaccagggcgttcagcccgcacctatgcagcgtagttggtcccaggccttccctagacccacagttgtgctgccggcgtctcaccgtagacccgtgtctgccaataaagagatgttcagtttcgtggtggacgatgcacggaagcccccagtgattaagcaagtttggactaacgccatgaaactttctgaaaaaagcgtagccgaaggtatcccaggtgcagttccacctgctgaaatctacgtggaagaagatctcgcccagcaagacaaggatgaaataatcctgctcttggggaaggaagtgtcgagactgtccgactacgagatcgaatctaagtacaaagacgttatcattgctaacctgcagaacgaagtggccgaattgagccagaaagttagtgaaacgaccacaagcaggcagaatgaaaaggagatttcccaaaaatgccaagtgctcgacgaggacattgatgccaagcaaaaggagatccagagtcttaagtcacagattagcgctctccagaagggatactccaaagtgctctgccagactctgtctgagcggaactcagaaatcacgtctcttaagaacgaaggcgagaacctgaaaagggataacgccataacgtctggaatggtttcgtccctgcaaaaggatattctggcgaaagacgagcaggtacagcaattaaaggaagaggtctctcatcttaagagtcaaaataaggataaagatcatcagctggaagccctgggcagtcggtgctctgtgctgaaagaggagctgaaacaggaagatgcacacagagagttacgtgaggcccaggaaaaggaactaaagttatgcaaaactcagattcaggatatggagaaagagatgaaaaagctgcgcgcggagctgcgtaaatcttgtacagagcagtctgtgatcagcagaacactgagagagaaatctaaggtggaagagaaattacaggaggactcaaggcgaaaactcttacagcttcaggagatgggcaatagagaaagcgtgattaaaatcaacttggagcgtgcggtgggtcaattagagcactttcggtctcaggttatcaaggccacttacggccgcgccaagcccttccgcgataagcctgtgaccgatcagcagcttatagaaaagatcacacaggttaccgaggataatatcaacttccagcagaaaaagtggaccctgcaaaaggagacgcaactgtccaactctaagcaggaagagaccacagaaaacatcgaaaaactgcgaacaagtcttgactcatgtcaagcctgtatgaagatatcatgctgcagtcatgacctgaaaaaggaggtagacttattgcagcacctccaggtgtctccgcccgtgtcagggttgcaaaaagtggttctggacgtcctgcgacacgctctcagctggttggaggaggtggaacagttgctgcgcgacctggggatcctgccctcgtcacctaataaggatcaggttcaacagttttccggaaatagtgcagtttttactgccggcaaggccgccggcgcttctggccgcgagggtgaggctgaaagaggcgaggcccgcgcaagaggcgaggcacagtcccagaatcaggccaccgacggtcgtgaggggggcaaggcactcgaggagtatattacccaggagaggaaccgggcaaaggaaactctcgaggaagagagaaagcgtatgcaagagttagaatccctcttggcacagcagaaaaaggctttggctaagtcaatcactcaagaaaagaacagagtgaaggaggccctcgaagaggagcagacacgagtacaggagcttgaggagcgcctggccagacagaaagaagtgctggaaagctcgatcgcacatgaaaagcggaaggccaaagaagccctggagtccgaaaaaagaaaagtccaagacttggagaaccatcttactcaacaaaaggagatcagcgaaagcaacattgcctatgagaagaggaaagctaaggaggcaatggaaaaagagaaaaaaaaggtgcaagacctggagaatagactgacgaagcaaaaagaagaactggagctcaaagagcaaaaagaagacgtgcttaataataaactttccgatgccttggccatggttgaagagacccagaaaacgaaggctaccgaaagcctgaaggcagaatccctggctttaaaactgaacgagaccctggcggagttggagactaccaaaacaaagatgatcatggtggaggaacgcctcatccttcaacaaaaaatggtgaaagcacttcaggacgagcaggaatctcagcgccatggctttgaggaagaaattatggaatataaggagcagatcaagcagcatgcccagactattgtctccctggaagagaagttacagaaggtgactcagcaccataaaaagattgagggcgagattgccaccctgaaagacaacgacccggccccaaaagaagaaaggccccaagatccgctggtagcccccatgaccgaatctagtgcgaaggacatggcgtacgaacacctgatcgatgacctactggcggcacagaaggagatactgtcacagcaagaagtgatcatgaagctgagaaaagatcttacagaggcccactccagaatgagtgaccttaggggcgaattgaatgaaaaacaaaagatggagttagagcaaaatgtggtcctggttcagcagcagtctaaggaactctctgtgctgaaggaaaaaatggcccagatgtctagtctggtggaaaagaaagacagagagctgaaggccctcgaggaggccctccgcgcctcccaagagaagcatcgcctacagcttaatactgagaaagaacaaaagccaaggaagaaaacacaaacctgcgacaccagtgtacagatcgagcccgtacatactgaggccttctcctcctcccaggagcaacagtcattctcagatctgggtgtgcgctgcaaaggctcacggcacgaggaggttatccaaagacagaaaaaagccctctcagagttgcgggcccgcattaaggagctggagaaagcccgaagccccgatcacaaagatcatcagaatgagtctttccttgacttaaaaaatttacgcatggaaaataatgtgcagaaaatccttctagatgcaaagcctgacctccctaccctatctagaatagaaatcttagccccacagaatgggctttgcaatgcaaggttcggatctgcaatggaaaagtctggaaaaatggatgtcgccgaggccctggaactgagcgagaaactgtacctggacatgagtaagaccctggggtccctgatgaacatcaaaaatatgtccgggcacgtttctatgaagtacctgtctcgccaggaaagagaaaaagtgaatcagctgaggcagagagatctggacttggttttcgacaagattacccagctgaagaatcagctggggaggaaagaggaactcttaagaggctatgagaaggacgtagagcagctgagacgcagcaaggtgtcaatcgagatgtatcagtcccaggtggcaaagttagaggatgacatctacaaggaggcggaagagaaggccctcctgaaggaagctctggaaaggatggaacaccagttgtgtcaggagaagaggatcaacagagccataagacagcagaaggttgggactcgcaaggcatcccttaaaatggatcaggaacgcgagatgttgcggaaggaaacctcatccaaaagtagtcaaagtctgcttcactccaagccatccgggaagtattag

SEQ ID NO: 30176 - DNA, 4362 bp, Artificial Sequence
  Description of Artificial Sequence: Synthetic coding sequence
atgaaagcatatctgaaatctgctgaagggtttttcgttctgaacaaatccaccaccatcgggaggcatgagaacagcgaccttgtgctgcagagccccgacattgacaatcatcatgccttgattgaatacaacgaggccgaatgctccttcgtcttgcaggactttaactctagaaatggcacctttgtaaatgagtgccacatccagaatgtggctgtgaagctgattccgggcgacatcctgcggtttgggagtgctggactgacatatgagcttgtaatcgagaaccctcctcctgtgtctttcccctggatgagaggtcctgcaccttggccaggcccccaacccccaagagccacacagcaacctaaccaagcaccaccccccagccatataccctttcaccagggcgtgcagccagcgccaatgcaaaggagttggtcacaggcatttcccagacctacggtggtgctgcctgcctcccaccggagacccgtgagcgctaacaaggagatgttctccttcgttgtggacgatgctagaaaacccccagtcattaagcaggtatggactaatgctatgaagctctcggagaaatcagtcgccgagggcatccccggtgccgtgcccccagccgaaatatatgtggaagaagacctcgcacagcaggacaaagatgagatcatcctgctccttggcaaggaggtcagcaggttgtccgactacgaaattgagagcaaatataaggatgttatcatcgctaatctacagaatgaggttgctgaactttcccagaaggtttcagagacaactacatcaagacaaaatgaaaaggaaatatctcagaaatgtcaggtcctggatgaggacatcgatgcgaagcagaaggaaatccagagccttaaatcccagatctccgccctccagaagggatactctaaggtactttgtcagacgctatcagagcggaattccgagataacctcgctcaagaatgagggtgagaaccttaaaagagataacgccatcacatctggaatggttagctccctgcagaaggacattctcgccaaagatgaacaagtccagcagttaaaggaggaagtgagccatcttaaatcacaaaacaaggacaaggaccatcaactcgaggccctcggcagtaggtgtagcgtccttaaagaagagctgaagcaagaggacgcacaccgagaactacgggaggctcaggaaaaggaattaaagctgtgtaagacgcagatacaggatatggagaaagagatgaagaagcttagggcggagctcagaaaatcgtgtaccgagcagagtgtgatttctcgcaccttaagggaaaagagcaaagtggaagaaaaattgcaggaagactcacggcgcaaactgttgcaactgcaggagatgggaaaccgcgagagtgtgataaagatcaacttggagcgggcagtcgggcagctcgagcatttcaggagtcaagtcataaaagctacctatggtagggcaaagccgtttcgagacaaacccgtgacggaccaacagctcattgaaaaaatcacccaggtgacagaggacaatattaattttcagcagaagaaatggaccttgcagaaggagacgcagctgtccaacagcaagcaagaagagactaccgagaatattgagaaactgagaacttctctcgactcctgtcaagcgtgcatgaagatcagctgttgtagccatgaccttaagaaagaggtcgacctgttgcagcatctgcaggtgtccccacctgtttcaggactgcaaaaggttgtcctcgacgtgttgagacatgcactgtcctggctggaggaagtggaacagttgctccgagacctcgggattctgcctagcagccccaataaagaccaggtgcagcagttttcagggaatagcgcagtattcaccgccggcaaggcggctggcgcgtccggccgggagggcgaagctgagagaggtgaagcccgagctagaggcgaggcgcaatctcagaatcaggcgacagacggtcgggaggggggcaaagcattagaggagtacattacgcaggagagaaatcgcgcaaaggaaacattggaagaggagcgcaagcggatgcaggagctggaaagtcttctagcccaacagaagaaggctttagccaaatccatcacacaagagaagaatagagtgaaggaggcgcttgaggaagagcagactcgggtccaggaactggaggaacggctcgcaaggcaaaaagaggtgcttgagtcaagcatcgcacatgaaaagcgaaaagcaaaagaagccttggagtcagaaaagaggaaagtgcaggaccttgagaaccacctcacccagcagaaagagatcagcgagtccaatattgcatatgaaaaacgcaaagccaaggaggctatggagaaggaaaagaagaaggtccaagacctcgagaaccgcttgaccaaacagaaggaggagctcgaactgaaggaacaaaaggaagatgtgctgaacaataaactctccgatgcgctggcgatggtcgaagaaacacagaagactaaggcaactgaaagcctgaaagctgagagcctggccttgaagctgaacgagacactcgctgagctggagaccacaaagacaaagatgataatggtggaggaaagattgattctacaacagaagatggtcaaagccctgcaggatgaacaagaatctcagaggcacggttttgaggaagaaattatggagtataaggagcagatcaagcagcacgctcagacgatcgtttccctggaggagaaactgcaaaaggtgactcagcaccacaagaagattgagggggagatcgcaaccctgaaagataatgaccctgcgccgaaagaggagaggccacaggacccccttgtggccccgatgacagaatcgtcagcaaaagacatggcctacgagcacttaattgacgacctgcttgctgcccagaaggagatcttatcacaacaggaagtcattatgaaattgagaaaagatctgacagaggctcatagtcgcatgtccgatcttagaggggaactgaatgagaagcagaaaatggaactcgagcagaacgtggtgttggtgcaacagcaatccaaggaattgagtgtgctcaaggagaaaatggctcagatgagcagccttgtcgagaaaaaggacagggagctcaaggccctggaagaggcactgcgcgcttcccaggagaagcatcgtctgcagcttaatacggagaaggaacaaaaaccccgtaagaagacgcaaacatgcgatacttccgttcagatagagccagtacatacggaggctttctcaagttcccaggaacagcagtcattcagcgatctgggagtgaggtgcaagggatcaaggcacgaagaggtgattcagaggcagaagaaggcccttagcgagctgagggcgagaatcaaggaactcgagaaagccagatctcccgaccataaggatcaccaaaacgagtcatttctggatctgaagaacctccggatggagaataatgtacagaagatcttgcttgatgccaagcctgatcttcctaccctatcgcgcattgagattcttgcaccccagaatggactgtgtaatgccagatttgggtccgccatggaaaagagcggcaagatggacgtcgcagaagctttggagctgtccgagaagctgtatctcgacatgagtaagacccttgggtcactcatgaacatcaagaacatgagcggccacgtgtctatgaagtacttgtccaggcaggaaagagagaaggtaaaccagctccggcagcgggacctcgacttagtcttcgacaagattacacaactgaagaaccaactggggcgtaaagaggagctcctgcggggatatgagaaagatgtcgaacagcttcgccgttcaaaggtgtccattgagatgtatcagtcacaagtcgctaagctggaggatgatatctataaggaggccgaggagaaggctctcctcaaagaagccctggagcgcatggaacatcagctgtgtcaagagaagcgcataaacagagccattcggcagcaaaaaatgcgcaaacttaggctccgggagctccggggggcgcaggtgcacacggccgccggtaaagattcctgggacctgactccagatcccagtgatcctggatcacccgctgtttgtcgcgtaggtcgcaaatgcaggggtgctcgtactgaaaaaagaaagaggattgataccctgcagctgtgccttcagcgcgagcggcaggctgggcccgctccccctgcctgctcattgaatggatag

SEQ ID NO: 30177 - DNA, 951 bp, Artificial Sequence
  Description of Artificial Sequence: Synthetic coding sequence
atgatcttgaggccaccccgaccttgtgggaccatttccgctctgcagaagggctattccaaagtgctttgccagaccctctctgaaaggaactccgaaattacatcgctgaagaatgaaggcgaaaacctgaagcgtgacaatgcaatcaccagcggaatggtgagctctttgcaaaaggacatcctagcaaaagatgagcaggtgcagcagctgaaagaagaagtgagtcacctcaaaagccagaacaaagacaaggaccaccagctcgaagcactgggatcgcggtgcagcgttctcaaggaggaattgaaacaagaggatgctcaccgcgagttgcgcgaagcccaagaaaaggaactgaagttgtgtaagactcagatacaagatatggagaaggagatgaagaaactccgggccgaattgagaaaatcttgtaccgaacaaagtgtgatatcacgaacacttcgcgaaaaatcgaaactcgagcactttcgtagccaagtcattaaagcaacctacggccgcgctaagccatttagggataaacccgtcacagaccaacagctaatcgagaagatcacacaggttacagaagacaacattaatttccagcagaaaaaatggaccttgcaaaaggaaacccagttgtctaacagcaagcaggaggagactaccgaaaatattgaaaagctgagaacctccctcgacagttgtcaagcctgcatgaaaatctcttgttgctcccatgacctaaagaaagaggtggacctgctgcaacacctgcaggtatcaccacctgtgtctggcctgcaaaaggtcgtgctcgatgtgctgaggcatgccctgtcctggttggaggaggtcgagcaactcctgcgggatcttggcattttaccttccagtcccaataaaggatattgggacttctttagccatatggtggcatag

SEQ ID NO: 30178 - DNA, 4131 bp, Artificial Sequence
  Description of Artificial Sequence: Synthetic coding sequence
atgaaagcctaccttaagtcagccgagggtttcttcgtcctcaacaagagtactactattggccgccacgagaattcagacttggtcctccaatcgccagacatcgataatcaccacgctcttatcgagtataacgaggcggagtgttcgttcgtgctccaggactttaatagcaggaacggcaccttcgtcaacgagtgtcacattcagaacgtagccgtcaaactcattcccggggacattttgaggttcgggtcagccggcctcacttacgagctggtcattgaaaatcctcccccggtctcattcccctggatgaggggtccagccccttggcccggtccacagccaccccgagctacccaacagccaaaccaggcacctccgccaagccacatcccctttcaccagggggtgcagccagctcccatgcagcgcagctggtcccaagcgttcccacggccaacagtggttcttcccgcttcacatcgtcgccctgtgtccgcaaacaaagaaatgttcagctttgtggtagacgatgcccgtaaaccacctgtaatcaaacaggtttggactaatgccatgaaattgtccgagaagagtgtggccgagggcattcccggagctgtgccgcccgctgagatttatgtggaggaggatctagcccagcaggataaagatgagatcatcctgctgctgggaaaggaagttagtcgcctttccgattatgaaatcgaatctaaatacaaagatgtgataattgcaaatcttcaaaatgaagtggccgagctgtcccagaaagtttccgagacaactacctctcgccagaacgaaaaagaaatatcccagaaatgtcaggtcctggatgaagatatagatgccaaacagaaagaaattcagtctctgaagtcccagatcagcgccttacagaagggctacagcaaggtcttgtgccagaccctgagcgagcgaaattctgaaattacatccctgaagaatgaaggcgaaaacttaaaacgggataatgctattacgtccggaatggtcagctccctgcagaaagatatcctggcaaaggatgaacaagttcagcagttaaaagaagaggtttcacacttaaagagccaaaataaagataaagatcaccagttggaagcactgggctcgcgctgctctgtcctcaaggaagagctaaaacaggaagatgcccatcgcgaacttcgcgaagcacaggagaaggagctaaagttatgcaagacccagatacaggacatggagaaggaaatgaagaaattgcgcgcagagcttagaaaaagctgcacagagcagtccgtgattagcagaaccctcagagaaaaatccaaggtggaggaaaaactgcaggaagacagtcgcagaaagctgttgcagctccaagagatgggaaatagggaatcagttataaaaattaacctggagagagcagttgggcagctggaacatttccggagtcaggttatcaaagcaacgtatggtagagctaaacctttccgagacaaacccgtgacggatcaacaacttatcgagaaaatcacccaggtgactgaagataacattaatttccagcagaaaaagtggactctgcagaaagagacgcagctctctaatagcaagcaggaggaaaccacagaaaatatagagaagctccggacctcacttgacagctgtcaggcctgcatgaaaataagttgctgctcacatgacctaaagaaggaagtggacctcttgcagcacctgcaggtgtcaccccccgtgtctgggctgcagaaggtggtgttagatgtacttagacacgcgctgagttggctggaggaagtggaacagctgctgcgtgaccttgggatcctccctagctcccccaataaggatcaggtgcagcagttttctggcaatagcgctgtgttcacagctggtaaagccgctggcgcaagtggacgggagggcgaagcagaaaggggagaggctcgggctcggggcgaagcacagagccagaatcaggcgactgatggccgtgaaggaggcaaggcccttgaggaatatattactcaggagagaaatcgcgccaaagagacccttgaagaggagcgcaaacgcatgcaagagttggagagtttgctcgctcagcagaaaaaggccctggccaagagcattacccaggaaaagaaccgggtgaaggaagctctggaggaggaacagacacgggtgcaagagctcgaagagaggttggcccggcagaaggaaattagtgaatctaatattgcatacgaaaaaaggaaggcaaaagaagccatggagaaggaaaagaagaaagtgcaagacctagagaaccggctgacaaaacagaaggaggagctggaactgaaggagcagaaggaggacgtcctgaacaataagttaagtgacgccctggctatggtcgaagaaacccagaagacgaaagccacggagagcctgaaagcagagagcctggccctcaagctgaatgaaacgctggccgaactggagaccaccaaaaccaaaatgataatggtggaagaacgacttattcttcagcagaagatggttaaagcactacaggacgaacaagagtcacagaggcacggcttcgaagaggagattatggaatataaagaacagatcaagcagcatgctcagaccatcgtcagcctggaagagaagcttcaaaaggtgactcagcatcataagaagattgaaggtgaaatcgccaccctgaaggacaacgaccctgcccccaaagaagagagaccacaggatccccttgttgctcctatgacagaaagctctgcaaaggatatggcttatgagcacctgattgatgacctattggcagcccagaaagagattctcagtcagcaggaggtgatcatgaagctcaggaaggatctaacagaggcgcatagccgaatgtccgacctccggggggaactgaacgagaaacagaaaatggaattagagcagaatgttgtgcttgtacagcagcagagcaaggaattgtctgtactgaaagagaagatggctcagatgtcaagccttgtggagaagaaggaccgcgaacttaaggccctcgaggaagctttaagagccagtcaggaaaagcataggctgcagctgaatactgagaaggagcaaaagcctcgcaaaaagacccagacttgtgataccagcgtacaaatcgaaccagtgcacaccgaagcgttcagcagcagccaggaacaacagagcttcagcgatttaggagtgaggtgcaaggggtcccggcacgaggaagttatccaacgccagaagaaagcgctctctgagctgagagctcgaatcaaggagctggagaaagcacgatcacccgatcacaaggaccaccaaaatgagagcttcctcgatctgaaaaacttaagaatggagaataacgtccagaaaatcctcctcgatgcgaaaccagacctacctaccttgagccgtatcgagatcctggctcctcagaacgggctgtgcaatgcccggtttggaagcgcaatggaaaaatcaggcaagatggatgtggcagaggccctggagctgtctgagaaactctatctggatatgtctaagaccctcggttcactgatgaatatcaagaacatgtcggggcatgtgagcatgaaatatctgtccaggcaggagcgggagaaggtgaaccagctgcggcagagggacctcgatcttgtgtttgacaagatcacccagcttaaaaatcagttggggcgtaaggaagagttgctccgcggctacgagaaggacgtggaacagcttcggcggagtaaggttagcatcgagatgtaccaatctcaagtagccaagctggaggacgatatctacaaggaagctgaagaaaaggctctgctcaaagaggccctcgaacgaatggaacaccagctgtgtcaggaaaaaagaataaatagagctatcagacagcagaaagtgggaacccgaaaggcctccttgaaaatggatcaggaacgtgagatgctccggaaagagacatcctcaaaatcctcgcaaagtctgctccattcaaagccgtcaggaaaatactag

SEQ ID NO: 30179 - DNA, 1656 bp, Artificial Sequence
  Description of Artificial Sequence: Synthetic coding sequence
atgtcttgggggaccgaattgtgggatcagttcgactccctggacaagcatacccagtggggaatagatttcctagagaggtatgcgaagttcgttaaggagcgtatcgagattgaacagaattacgctaagcaacttcgcaacctggtgaaaaagtattgtccaaagcggtcaagcaaagatgaggagccacggttcacctcgtgtgttgcattctttaatatcctgaatgagcttaatgactacgccggccagcgcgaagtggtcgcagaggagatggcacatcgagtctacggggagctcatgaggtacgctcacgatcttaagaccgagagaaagatgcacctgcaggagggcaggaaagcccagcaatacctcgatatgtgctggaaacagatggataatagcaagaaaaagttcgagcgggagtgccgcgaagccgagaaggcccagcagagctacgagaggctggacaatgacaccaacgcaacaaaagccgacgtcgaaaaggctaagcagcagctcaatcttcgcacccatatggccgacgagaataaaaacgagtacgccgcacagctgcagaattttaacggcgagcagcacaagcacttttatgtagttattccccagatatacaagcagcttcaggaaatggatgagcggagaaccattaaactgtcagagtgctaccgagggtttgcagacagcgaacggaaggtgatcccgataatatcgaagtgcctggaagggatgattctcgctgcgaaaagcgtggatgagagacgagacagccagatggtagtggactcgttcaagtctggcttcgagccgccaggagactttccatttgaggattactcccagcacatctaccgaacgatctccgacggaacgattagcgcatcaaaacaggaatcaggtaagatggatgctaagacaacagtaggcaaagccaagggcaaactttggctgtttgggaaaaaacctaagggacctgctctggaggatttctctcatctgcccccagagcagagaaggaaaaaattgcagcagcgcattgacgaactcaatagagaacttcagaaggaatcagaccaaaaagacgcactgaataaaatgaaagacgtttacgagaagaatccccagatgggagatcctggcagcctgcagccaaagctggcagaaactatgaacaacatcgatcgcctgagaatggagatccataaaaacgaagcctggctttctgaggtcgaagggaaaaccggaggaaggggggacagacggcacagttcggacataaatcacttggttacgcaggggcgcgaaagtcccgaaggttcttataccgatgacgccaaccaggaggtccgaggcccaccccagcaacacggccatcacaacgagtttgacgatgaatttgaagatgacgaccctctgcccgccattggacactgtaaagcaatttacccattcgatggccacaacgaggggaccctcgctatgaaggaaggggaagtgctgtacattattgaggaagacaaaggagacggttggacgcgagccagaagacagaacggggaggagggctacgtcccaactagctacatcgacgtgacccttgagaagaacagcaaaggtgctgtaacgtatatctag

SEQ ID NO: 30180 - DNA, 1818 bp, Artificial Sequence
  Description of Artificial Sequence: Synthetic coding sequence
atgtcgtggggcaccgaactgtgggaccaatttgacagtctggataagcacacccagtggggaatagactttcttgagcggtatgccaagttcgtgaaagagcgcatcgaaatcgagcagaattacgccaagcagctgcgaaatttggtgaagaaatattgccccaagaggtcctctaaagatgaagaacctaggtttacttcatgcgtggctttttttaacattttaaatgaattaaacgattatgcaggacagcgggaggtggtagctgaagaaatggctcatagggtgtatggcgagctcatgaggtacgctcatgatctgaaaacagaaagaaagatgcacctgcaagagggcaggaaagcccagcagtatctggatatgtgctggaaacagatggataattccaagaagaaatttgagagggagtgccgcgaagccgagaaagctcagcaatcctatgagaggctggacaatgacactaacgccaccaaagcggacgtggagaaagcaaaacagcaattgaacctgagaacacacatggctgatgagaacaagaacgaatatgcagcacagcttcaaaactttaatggggagcagcataagcatttctacgtggtgatcccacagatctacaagcagttgcaggaaatggatgagagacgaactatcaagctctcagaatgctacagaggctttgctgacagcgaacgtaaggtaattcccattatctccaagtgcctggaagggatgattctcgccgctaaaagtgtcgacgaacgtcgagacagccagatggtggttgactcctttaaatcgggattcgagccgccaggggatttcccattcgaggattattcacaacacatttacagaacaattagtgacggaaccatctctgctagcaagcaggagagcggtaaaatggacgccaaaaccacagtgggcaaagccaaggggaagctgtggttgtttggcaagaagccgaagccccagagtcccccactgaccccgactagcctgttcacgtccagtactccaaacgggagccagttcttaacattcagcatagaaccggtgcattattgtatgaatgaaatcaaaaccggaaaaccccgcatcccctcgtttcgatccctgaagagaggctggagcgtaaaaatggggcccgccctggaggatttcagtcacctcccacctgagcaacgaagaaagaagctccaacaacgcatcgacgagctcaaccgggagcttcagaaggaatcagatcagaaagacgccttaaataagatgaaagacgtctatgagaaaaacccacaaatgggcgatcccggttccctgcagccaaaactggcagagactatgaataacatcgatcgcctgaggatggagattcacaagaacgaggcatggttaagcgaggttgagggaaaaacgggaggaagaggagacaggcgtcattcaagcgatataaaccatctggtgacccagggacgtgaatcccccgagggaagctacacagacgacgcaaaccaagaagtgaggggccccccccaacagcacggccatcacaacgagtttgacgatgaatttgaggatgacgacccgcttccagccataggacattgcaaggcaatctaccccttcgacggacataacgagggtacgctggcgatgaaagagggggaagtgctgtacattatagaggaagataagggagacggctggacccgggctcggcgccaaaacggggaggagggatacgttcccacatcttacattgacgtgaccttagagaaaaactccaaaggatcgtag

SEQ ID NO: 30181 - DNA, 1815 bp, Artificial Sequence
  Description of Artificial Sequence: Synthetic coding sequence
atgtcctggggaacggagctgtgggaccaatttgactcgctagataagcatacacagtggggcattgatttcctggagcgatatgcaaaatttgtgaaagaacgcatcgagattgaacagaactacgctaaacaactgaggaatctggtgaagaagtactgcccgaaaaggtcttccaaagacgaggaaccgcggttcacaagttgcgttgccttcttcaatattcttaatgaactgaatgattacgccggccaacgggaggtggtggccgaggagatggcccatcgcgtctacggggaactgatgcgttacgcccacgaccttaagactgaaagaaagatgcacttgcaggagggaaggaaagcccagcaataccttgacatgtgctggaagcagatggacaacagtaagaaaaaatttgaacgcgaatgccgggaggctgaaaaagcccagcagtcatatgaacggttggacaatgataccaacgccaccaaagccgacgttgagaaagccaagcagcagctgaatcttcgcacacatatggcagacgaaaacaagaacgagtacgccgcccagctacagaatttcaatggagagcaacacaagcacttctacgtagtgattcctcagatttacaagcaactgcaggagatggatgagcgccgcacaatcaaattatcagaatgctaccgcggctttgcagacagtgaacggaaggtgatcccaatcatatctaagtgccttgagggaatgattctagcggcgaagagtgttgacgagaggagggacagtcaaatggtcgtcgactcctttaagtctggattcgaaccaccaggagacttcccgttcgaggactacagccagcacatctaccgcacaatctccgacggcactatttctgcgtcaaaacaagaaagcggaaagatggacgctaaaacaacagtggggaaggctaagggtaagctgtggctgttcggaaagaagccgaagccgcagagtcctccattgactccgacctccctgttcacatcttccacaccaaacgggtctcaattccttactttctcaattgaacctgtgcactactgtatgaacgagattaagactggtaaacctcggattccctcattcagatcattgaagaggggtggaccagctcttgaagatttctcccatttaccgccagaacagcgaaggaagaagctgcagcagaggattgatgaactcaatcgagagctgcagaaggagagtgaccaaaaagatgccttaaacaaaatgaaggacgtctacgagaagaatccccaaatgggtgatcctgggtccctgcaaccaaagctagccgagaccatgaataacatagataggttacgcatggagattcacaagaacgaggcttggctaagcgaagttgaagggaagactgggggccgcggagaccgcaggcactcctcggatattaaccatctggttacacagggtcgggaaagtcctgaggggagctacaccgatgacgcgaaccaggaggtgcgcggccctccccagcagcacgggcaccataatgaattcgacgatgagttcgaagacgatgacccattgccagccattggacattgcaaagcaatctaccctttcgacgggcataacgagggtactctcgctatgaaggagggagaagttctctatattattgaggaggataaaggtgatggttggacacgtgccaggcgacagaatggggaggaaggatatgtcccaacttcatatatcgatgtgaccttggagaagaactctaaaggtgccgttacttatatttag

SEQ ID NO: 30182 - DNA, 1803 bp, Artificial Sequence
  Description of Artificial Sequence: Synthetic coding sequence
atgtcctggggcaccgaactctgggatcagtttgacagcctggacaagcacactcagtggggtatcgatttcctggaacgctacgctaagtttgtgaaggagcgaattgaaattgagcagaattacgccaagcaactccgcaatttggttaaaaagtactgccctaaaaggtcaagcaaagacgaggaaccacggtttacatcatgcgtggccttcttcaacattctgaatgagctgaacgactatgctggacagagagaggtcgtagctgaggaaatggcccaccgggtttatggagaactgatgcgatatgcacacgacctgaaaaccgagagaaagatgcacttgcaggaaggcagaaaggctcagcagtacttggatatgtgttggaagcagatggataactccaagaagaagtttgaacgggagtgtagagaggctgaaaaggcgcagcaatcctatgaacggctggacaatgacacgaacgcgaccaaggctgacgtggaaaaggccaaacagcaactaaacctgaggacacacatggcagatgagaacaaaaacgagtatgcagcacaactgcaaaacttcaacggggaacagcacaaacatttttacgtggtcattccacaaatctataagcagttacaggaaatggacgaaagacggacaattaagctttcggagtgctatcgcggcttcgctgatagcgagcggaaggtcattcctatcattagcaaatgtctggaaggaatgattcttgccgccaagagcgttgacgaaagaagagattcccagatggtagtggattcattcaagtctggtttcgaaccccctggtgacttccctttcgaagactactcccaacacatctaccgcaccatcagtgacggcactatcagcgcctccaagcaggaaagtggcaaaatggacgcaaagacgacggtgggtaaagcaaaaggtaaactgtggctctttggcaagaaacctaagccacagtcccctcccctcactccgactagcttattcacctccagcaccccaaacggctctcagttcctgacatttagcatcgagcctgtgcattattgcatgaacgaaattaaaacaggtaaaccacggattcccagctttaggagtctgaagcgcggcgggcctgcacttgaggacttcagtcacctcccccctgagcagcgaagaaagaaattgcaacagcgaatagacgagctgaatagagagttgcagaaggagtctgaccagaaggacgccctgaataagatgaaggatgtttatgaaaaaaacccacaaatgggcgaccctggaagcctgcagcccaaactggctgagaccatgaataacattgacaggcttcgtatggaaattcataaaaacgaagcctggcttagtgaagtggaaggcaagacagggggcaggggcgacagacgccatagttcagacatcaaccatctggtgacccagggacgagaatctccagagggcagttacacggatgatgcgaatcaggaggtgcgcggcccaccacagcagcatggccaccacaacgaattcgacgacgaatttgaagacgacgaccctctgccggccattgggcactgtaaagcaatctatcccttcgatggccacaacgagggaactctggcaatgaaggagggagaagtgctgtatatcattgaagaggacaaaggggatggttggactagagccaggcgtcagaatggagaggaaggttatgtgcccacctcctatattgacgtgacgttggagaaaaattctaagggctcttag

SEQ ID NO: 30183 - DNA, 1257 bp, Artificial Sequence
  Description of Artificial Sequence: Synthetic coding sequence
gataatagcaagaaaaagtttgagagagagtgccgcgaagccgagaaggcccagcagtcctacgaacgactggacaacgacacaaacgccactaaggctgacgttgagaaggctaaacagcaattaaacctgcgtactcatatggccgacgaaaacaagaatgaatacgccgctcagctgcagaatttcaacggcgaacagcacaagcatttctatgtcgtgattccccagatttacaaacaactacaagaaatggacgagcgaagaaccatcaagctgtcggaatgttatagggggtttgcagacagcgagaggaaagtgataccaattattagcaagtgcttggaaggcatgatcctggctgcgaagtcagtcgacgagcgcagagatagtcagatggtggtggattcattcaaatcagggttcgagcctccaggtgattttccattcgaagattactcccaacacatttacaggacaatcagcgacggaactatttcggcctccaaacaagaaagtggtaagatggatgctaagactaccgtggggaaggcaaaaggtaagctgtggttgttcggaaaaaagcccaaaggccccgccctggaggattttagccacttgccccccgagcagcgtcggaagaagctgcaacaaagaattgatgagctgaaccgggaattgcaaaaagagtctgaccagaaggatgcccttaacaagatgaaagacgtttatgagaaaaatccccaaatgggtgatcccggctctctacagccaaaactggcagagactatgaacaatattgaccggctgcgcatggaaatccacaaaaatgaagcctggcttagcgaagtggaaggtaagaccggtggccggggtgacagaagacactcatcagatattaaccacctggtcacccagggtagggaaagccccgagggaagttacacagacgatgctaatcaggaggtgaggggaccaccccagcagcacgggcaccacaatgaattcgatgatgaatttgaggatgatgatccactgcccgcgataggtcactgtaaagcaatctaccccttcgatggccacaatgagggaacattggccatgaaagaaggcgaggttttgtacatcattgaggaagacaagggcgatggatggactagggctaggcgacaaaatggcgaggaggggtatgttcccaccagctacattgacgtgaccctggagaagaactctaaaggtgctgttacttacatatag

SEQ ID NO: 30184 - DNA, 747 bp, Artificial Sequence
  Description of Artificial Sequence: Synthetic coding sequence
atggacgcaaagacgacggtgggaaaagccaaaggaaagctctggctgttcggcaaaaaaccaaaaccccagtcccccccgctgacccccactagcctctttacgtccagcacccccaatggctcacaattcctgacttttagcatcgagccagtccactactgcatgaatgagattaagactggcaaacctaggataccatcatttcgctccttgaagcgagggtggtcagtgaaaatgggaccagcgctcgaagatttcagccacctccctccagagcagcgacggaaaaaactccagcaacgaattgacgagcttaaccgcgaattacagaaagagagcgatcaaaaggacgccctgaacaaaatgaaggatgtttatgagaagaacccccagatgggggacccgggctctctacagccgaaacttgctgaaacgatgaacaatatcgataggctgagaatggagatacataaaaacgaagcttggctgtctgaagtcgaggggaaaacaggtggccgaggagacaggcgtcatagtagtgatattaatcatttagtcactcaaggccgggagtctccagagggcagctacacagatgatgctaaccaggaggtgaggggaccacctcaacaacatggccatcataacgagttcgacgacgaattcgaagacgacgatcccttgccagccattggtcactgtaaagcaatctaccccttgatggacatcatgaaggtgctgtag

SEQ ID NO: 30185 - DNA, 3054 bp, Artificial Sequence
  Description of Artificial Sequence: Synthetic coding sequence
atgggcaagaagagcagagcagtcccggggcgacgtccaattttgcagcttagtcctcccgggccgagaggtagtaccccgggccgcgatccagagcccgaacccgataccgagcccgacagcacagctgcggttccaagccagccagcgccaagtgcagccaccacaactacaacggctgtcacggcagccgcagcctcagacgatagtccctcggaggacgagcaagaagctgtgcaggaggtcccacgggtagtccagaatcctccaaagcctgtaatgacgacacgccctaccgccgtaaaggccaccgggggcctttgcctgctgggagcctacgcagactctgatgacgacgataatgatgtcagcgagaaacttgcccagtctaaggagactaatggaaaccaaagcaccgatatcgactctaccctggcgaattttcttgccgagatagacgctattactgcgccacagcccgcggccccggttggcgcatctgcgcctcctccgactcccccacgtccagagccaaaagaagccgcgacatctacacttagctcttctacttctaatggtaccgatagtacacagacctcaggctggcagtacgatactcagtgttcactggcgggcgtggggatcgaaatgggagactggcaggaggtgtgggatgaaaacacaggctgttactattattggaatacccagacgaacgaagtcacctgggaactcccacagtacctggctacccaggtgcagggtctccagcactaccagcccagcagtgtccctggggctgaaactagtttcgtcgtgaacacagatatctactccaaagagaagaccatttctgtgagctccagtaagtcaggcccagtcatcgccaaacgcgaggttaaaaaggaggttaatgaagggattcaggctctgtcgaactcagaagaggagaaaaagggcgtggccgccagcctgctcgcacccttgcttcctgagggaatcaaggaggaggaagagcgatggcggcgcaaggtgatttgtaaagaggaacccgttagtgaggtgaaggagacctctacgacagtggaagaagcaaccacaattgttaagccgcaggaaattatgctggacaacattgaggatccctcccaggaggatctgtgtagtgtcgtgcaatccggtgagtctgaagaggaggaagagcaggacacactggagctagaattggtgctggagcgcaaaaaggctgaactcagagctctggaggaaggagatggttcggtttcagggtcctcaccaaggagcgacatatctcagccagcatctcaggatgggatgcggcgtctaatgtcaaagcgcgggaagtggaagatgttcgtgagggccaccagccccgagtctaccagtaggagcagctccaagacaggacgcgacacaccagagaacggcgaaactgcaatcggcgcagaaaactctgagaagatcgacgagaactctgataaagagatggaggtcgaagagagtccagagaaaatcaaagtgcagacgactccgaaggtggaggaggaacaagatcttaagtttcagatcggcgagctggcaaatacacttacttcaaagtttgagtttttaggcatcaatcgacaatccatctctaatttccatgttttgttgctgcagaccgaaacccggattgcagattggagagaaggcgctctgaatggcaactacttaaaacgcaagctacaagacgccgccgaacaactaaagcagtacgaaatcaacgcaaccccaaaggggtggagctgtcattgggatcgcgatcatcgccggtacttttacgttaatgagcagagtggcgagagtcagtgggagtttcccgatggcgaagaggaggaggaggaaagccaagctcaggagaacagagatgaaacactcgccaagcaaaccttaaaggacaaaacaggcacagattcaaattcaactgaatcgtctgagacaagcaccggctctttatgcaaagagagtttctctggtcaggtgagctcttcgtccctcatgccgctcacccctttttggaccctcttgcagtccaatgttccggtgcttcagcctccattgcccctggagatgccgccgcctcctccgccaccaccagagtcacctccgccacctccgccaccaccaccacccgcagaggacggggagatccaagaagtcgagatggaggacgaaggctcagaggagccgcccgcaccagggacagaagaggatacccctctgaaaccttcagcccagactaccgttgtcaccagccagagctcggttgatagcacaatttcttcctcttctagcacaaaaggcataaaaagaaaggccacagagatttccacggccgtggttcagcgtagcgcaactattggtagcagccccgtactgtactctcagtccgctatcgccactggtcaccaagctgctggaatcggcaaccaagcgactgggatcggccatcaaaccatccccgttagcctaccggcggcagggatggggcatcaagcaagaggcatgagcttgcagagcaactacctgggtctggctgcagcccccgcaataatgtcttatgctgagtgctcagtaccaattggagtaactgctccctctttgcagcctgtgcaggctaggggagccgtgcccacagcaacaattattgagccccctccacctccgccaccaccgccacccccgccaccacctgcaccgaaaatgccaccgcctgaaaagaccaagaaaggcaggaaagataaggctaaaaagtctaaaaccaagatgcctagcctcgtcaaaaagtggcagtcaatccagagagaattggacgaggaagacaattccagctccagtgaggaagaccgggagagcaccgcacaaaaacgcatcgaggagtggaagcagcagcagctggtctccggcatggccgagcgaaacgctaacttcgaagctctgcccgaggactggcgagccagactgaaacgtagaaagatggcgccaaatacctag

SEQ ID NO: 30186 - DNA, 3279 bp, Artificial Sequence
  Description of Artificial Sequence: Synthetic coding sequence
atggggaatgcaggatctatggactcccagcagacagacttcagggcccacaatgtgccccttaagctgccaatgcctgaaccgggggagctagaggaaaggttcgctatcgtgcttaacgccatgaacctgcctcctgataaggctcggcttcttcggcagtatgataacgagaagaagtgggagctcatttgcgatcaggagagatttcaagttaagaatccgccacacacttatatccaaaaactgaaggggtatcttgatccggcggttactaggaaaaagttcaggcgccgggttcaggagtcgacccaggtgctgcgagagcttgaaatttcccttcgcaccaaccacatcggatgggtgcgcgaattcctcaacgaagaaaataaaggactggatgtcctggtggagtaccttagtttcgctcagtacgcggttaccttcgactttgagtccgtcgagtccaccgtggaatcttccgtagacaaaagcaaaccttggtccagatctatcgaggaccttcatagaggatccaatctaccctcccccgtcggaaactccgtcagccggtccggccgccactcggcgctcaggtataatacactgccttccaggagaacgctgaaaaacagtcggcttgtttctaagaaagatgacgtgcatgtgtgtatcatgtgcttgagggctatcatgaattaccagtacggcttcaacatggtcatgagccatccccatgccgttaatgagatcgcactgtctctgaataacaaaaatccgaggacaaaagctctggttctagagttgctagcagcggtctgtctcgtgagaggtggacacgaaatcatactctctgccttcgataacttcaaggaagtatgcggcgagaagcagagatttgaaaagctcatggagcattttcgcaatgaggataataatatagacttcatggtcgcgtccatgcaatttatcaacatagtggtacacagtgtcgaagacatgaactttcgcgtccatcttcagtacgaatttacaaaattgggtcttgatgaatatctggacaagctcaaacacacagaatccgacaaactacaggtgcagatccaagcttacctggacaatgtttttgatgttggtgcgctgctggaagatgctgagacaaagaacgctgccctggagagagttgaggagttggaagagaacataagccatctctctgagaaacttcaggatactgagaacgaggccatgagtaaaattgtagagctggaaaaacagctaatgcagcgcaataaggaactggatgtggtgcgcgagatctacaaggacgcaaacacacaggtgcacaccttacgcaaaatggtgaaggaaaaggaagaagcaattcaaagacaaagcacactggagaagaagattcatgaactggagaagcagggtacaattaaaatccagaagaaaggagatggggatatcgcgatcttgccggtggttgctagtgggacattgtctatgggaagcgaggtggtcgctggtaatagcgtgggcccaaccatgggagcagcatcctcaggacccctacctccccccccgccacccctgcctccgagcagcgacactcctgagaccgtgcagaacggccccgtgaccccccctatgccaccccccccaccgcctccccctcccccgcccccccctccgccgccccctccccccccgcctctgccaggccctgccgctgaaactgtaccggctccccctcttgcaccgcccttgccgtccgccccccccctgcctggaacgtcatcacctaccgtagtctttaattccggcctggcggcagtgaaaatcaaaaaaccaattaagacaaaattccggatgccagtgtttaactgggtggcactgaagcctaaccagattaacggaactgttttcaatgagattgatgatgaacggatactcgaggacctcaacgtggacgaattcgaggagatttttaaaaccaaggcacaggggccggcgatagatctttcgagcagcaaacagaagattccgcagaagggctctaacaaggttaccctgctcgaagctaaccgggctaagaatctggctattaccctgcgcaaagccggcaaaactgccgacgaaatttgcaaagcaatacatgtctttgatctgaaaactctacctgtggactttgtggaatgcttgatgaggttcctgccaacagaaaatgaagttaaggtattgcggctatacgagagggagcggaaacccctcgaaaacctctccgacgaggaccgcttcatgatgcagttttccaaaatcgagcggctcatgcagaaaatgaccatcatggccttcatcggcaattttgccgagagcattcagatgctcacaccgcagctccatgcaataattgccgcaagcgtgtccattaagagctcacagaagttaaagaagatcctggaaatcatcttagccctcggtaactacatgaactcttccaagcgcggtgccgtgtacggcttcaaactgcaaagtctggacttgctactcgataccaagtcgaccgataggaaacagactctcttgcactatattagcaacgtggtcaaggagaaataccaccaggtgagcctgttttataacgagctgcactacgtggagaaggccgcagcagtaagcctggaaaatgtgctcttagacgttaaagaactccagcgcgggatggacctcactaaacgcgaatacaccatgcacgaccacaacactctgctgaaagaatttatcctgaacaacgaaggaaaattaaagaaacttcaagatgatgctaagatcgcacaggacgctttcgacgatgtggtaaaatactttggcgagaatcctaagactactccccccagcgtcttcttcccagtttttgtccgcttcgtaaaagcctataagcaggccgaagaggagaacgagctgagaaaaaaacaggaacaggctctaatggagaagctgctggaacaggaggcactgatggagcaacaggatcccaagtcaccgagccataagtcaaagagacaacagcaagaactgatagcagaactccgtcgccggcaagtgaaagataacaggcacgtttatgaaggcaaggacggcgcgatcgaagacataatcaccgatttaaggaaccagccttatcgccgagccgacgcagtgaggcgctctgtgcggcgaagatttgacgatcagaatcttcgcagcgtgaatggcgcggaaatcacaatgtag

SEQ ID NO: 30187 - DNA, 1707 bp, Artificial Sequence
  Description of Artificial Sequence: Synthetic coding sequence
atggggtcggaggtcgtggcggggaatagtgtgggccctaccatgggagccgcctcaagcggtcctctgccgccccccccacccccactccctccctcaagtgacacccccgaaactgtgcagaacggaccagtgactcctccgatgcctccccccccgccgttgccaggccccgccgccgaaacagtaccagcgccaccgctggccccaccactgccatctgcaccccccctaccgggcacaagctctcctaccgtggtctttaatagtggcttggcggccgtgaagatcaaaaagccaatcaaaactaagttcagaatgcctgtgtttaattgggttgcattgaagccaaatcagatcaatggcacggtgtttaacgagatcgatgacgagcgtatcctggaggatctgaacgttgatgaatttgaagaaatcttcaagaccaaagcccagggccctgccatcgacctctcctcatcaaagcaaaagattccccagaagggatcgaacaaggtaactctgctcgaggctaatcgtgccaagaatctggccatcaccctgcggaaggcagggaaaaccgctgacgaaatctgtaaggccattcacgtgtttgacctcaaaacattgccagtcgatttcgtggaatgtttaatgaggtttttacccactgaaaatgaagtcaaggtgctcagactctacgaacgggagaggaaacccctggaaaatttatcagacgaggacaggttcatgatgcaattctctaagattgaacgactgatgcagaaaatgacaatcatggctttcatcggaaactttgccgagtcaatccagatgctcactccccagctacacgctataatcgcagccagcgtgtccatcaagtccagccagaagctcaaaaagatacttgaaattatacttgccctgggcaactacatgaattcttccaagcgaggcgccgtctatggtttcaagctccagtcactagacttactccttgacacaaaaagtaccgatcgaaaacaaacccttctccattacattagcaatgtggtcaaggaaaaataccaccaagtctccctgttctataacgagttacactacgttgagaaagccgcagcagtgtccctcgaaaatgtattgctggacgtgaaagagctgcaacgcggcatggatttgacaaagagggaatatactatgcacgatcacaacacattgctgaaggagtttatcctgaataacgaagggaagctgaagaagctgcaggacgatgctaagattgctcaggacgccttcgacgatgtggttaaatattttggagagaaccctaagacaactccgcctagtgttttctttccggtatttgtacgtttcgtgaaagcatataaacaggccgaagaagaaaatgaattgcggaagaaacaagaacaggccctgatggagaaactcctggagcaggaggcattgatggagcagcaggaccctaaatcaccttcacataagagcaaacgccagcagcaagaactgatcgcggaattgagaagacggcaagtgaaagacaaccgccatgtgtatgaagggaaggatggagccatcgaagacattataaccgcgctcaaaaaaaataacatcacgaagtttcccaacgtgcactcccgcgttcggatctcttcttcaacacccgtcgtggaggacacacaaagctag

SEQ ID NO: 30188 - DNA, 3087 bp, Artificial Sequence
  Description of Artificial Sequence: Synthetic coding sequence
atggggaaccttgaatccgccgagggggttcccggcgaaccaccctcagttccactgctcctcccacccgggaagatgcctatgcctgaaccatgcgagttggaggaacgtttcgccctggtgctgagttctatgaatctgcccccggataaggcccggttgctgcggcagtatgataacgaaaaaaaatgggacctgatatgcgatcaggaacggttccaggtcaagaaccctccgcacacatatattcagaagttgcaaagtttcctggatccatccgtcactaggaagaaatttcggcggagggtgcaggagtccaccaaagtgctgagggaattagagatttccctccgcaccaatcacataggttgggtgcgggagtttctcaacgatgagaataaggggcttgacgtcctggttgattacttgtcctttgcacagtgttccgtgatgttcgattttgaaggcctcgagagcggcgacgacggggcctttgacaaactgcgcagttggtcccggagcatcgaagacctgcaacctccctctgcgctcagtgccccctttactaactccctggcaaggtctgccaggcagtcagtgcttcggtatagcactctccccgggcgcagggccttgaagaattcccgcctcgtgtcccagaaggatgacgtgcacgtctgcatcctttgtcttagggctattatgaattaccagtacggctttaaccttgtaatgtctcatcctcacgctgttaatgaaatagccctctcactcaacaataagaacccaaggacaaaggcccttgtgctggagctgctagctgccgtgtgcctggtccgcggtgggcacgagataattctggcggcgttcgacaacttcaaggaagtgtgcaaggaactgcatcggtttgagaaattgatggaatatttccgtaatgaggacagtaacatcgacttcatggtggcgtgtatgcaattcataaacattgtggttcactctgtagaagacatgaactttcgggtccacctgcagtacgaattcaccaagttaggtctggaagagttcctccaaaaatccagacatactgagtccgaaaagctgcaggtccagattcaggcctacttggacaacgtgttcgacgttggagggttgttggaagacgccgagactaaaaacgtcgcccttgagaaggtggaagagttagaagaacacgtgagccacctgactgaaaaattgctggatctcgagaatgagaacatgatgcgtgtcgcagagctcgagaagcagctgctccagcgcgaaaaggagctggaatcaataaaggagacgtacgagaacactagccaccaggttcacaccctgcggcggctgattaaagagaaggaagaagcatttcagagacggtgtcacctagagccgaacgtccgaggactcgagtccgtggactctgaagccttggccagggttgggccagccgaattgagcgagggcatgcctccgagcgacttggatcttctggcccccgcaccgcctcccgaggaagtccttccactgcctccgccaccagcaccccctctaccccccccacccccacccctgcctgacaagtgcccacctgcaccacccctgccaggcgcggcaccctccgtcgtgctcacagtggggttgtccgcgattaggattaagaaacctatcaagacaaagttccgccttcctgtattcaactggaccgctctgaaacccaaccagataagcggaaccgtgttcagcgaattagatgacgagaaaatcttggaggacctcgacctggataagtttgaggagctgtttaagacaaaagcccaaggcccggccctggatcttatttgttcgaagaacaagaccgctcaaaaagctgcctcaaaagtaacgctgctggaagctaaccgggccaagaacctggccattaccctgcgcaaggcagggcgatctgccgaggaaatttgtcgggctattcatactttcgacctccagaccttaccagtggacttcgtagagtgcctcatgaggtttctgccaacagaggctgaggtcaagctcctaaggcaatacgaaagagagaggcagcctctggaggaactggctgccgaggatagattcatgttactgtttagtaaagtcgaacggcttacacagcggatggccgggatggcgtttctaggcaattttcaggacaacctgcaaatgctcaccccccaactgaatgcaataattgcggcctcggcttcggtgaaatcttcacagaagctgaagcagatgctggagatcatcttggccctgggtaattatatgaactctagcaaacggggagccgtctacgggttcaagctgcagtcactagatctcctgctggacaccaaaagtaccgacagaaaaatgaccctgctccatttcattgcccttaccgtgaaggagaagtaccccgacctcgctaatttttggcacgagctccacttcgtcgagaaggcagccgcagtttcattggaaaatgttcttctagatgtaaaggagctaggacggggaatggagctcatcagacgggagtgttctattcacgacaattcagtgctgagaaactttttgtccacgaatgaagggaaactggacaagctgcagcgggatgccaaaaccgccgaagaggcttataatgctgtagtgcggtacttcggggaatctcctaaaaccacaccgccctcggttttctttcctgtgtttgtgcggtttatccgcagttacaaggaggcagagcaggagaatgaagcaagaaagaaacaggaagaggtgatgcgagaaaaacagctggcacaggaggctaagaaactagatgccaagacaccttcccaacgtaacaagtggcagcagcaggagctcatagcggaacttcgcaggagacaggctaaggaacatagacctgtttacgagggtaaggacggaacaatcgaggacattattactgtactgaagagtgtgccctttacagcgagaacagcaaagcgcggctctagatttttctgcgacgcagcacatcacgatgaaagcaattgctag

SEQ ID NO: 30189 - DNA, 3084 bp, Artificial Sequence
  Description of Artificial Sequence: Synthetic coding sequence
atgggtaatctggagtctgccgagggggtgccgggggaacccccttctgtgcctctcttgctccccccagggaagatgccaatgccagagccatgtgagctcgaagaacgatttgcattagtactgtcctccatgaacttgcctcctgacaaagccaggttgctgcgtcagtacgataatgagaagaaatgggatctgatttgcgaccaagagaggttccaagtgaagaacccacctcatacttatattcagaaactgcagtctttcctggacccatcagttactaggaagaaattccgacgacgagtccaagagagcactaaagtgctcagggaattggagatcagcttgcggaccaatcacatcggatgggtgcgtgagttcctgaacgacgagaacaaaggattggacgtcctggttgattatctgtctttcgctcagtgttcagtgatgttcgacttcgagggcctggagtccggagatgacggagccttcgataagctcagatcctggtctcgcagtattgaggacctgcaacccccaagcgcactgtcagcaccatttaccaattcccttgcaaggtcagccaggcaaagtgtcctgaggtacagcacgcttcccggtcgtcgtgccttaaagaacagccgactcgtcagtcagaaggatgatgttcacgtctgtatcttgtgtcttcgggccattatgaattatcagtacggattcaatttggttatgtcacatcctcacgcagtgaatgaaatcgctctctcactgaacaacaagaacccacgcaccaaggcccttgtcctggagctgctcgctgcagtctgtcttgtgcgcggagggcacgagatcattctagctgcatttgataacttcaaagaggtctgtaaagaactacacaggtttgaaaagttaatggaatattttaggaatgaggattcaaacatcgacttcatggtggcttgtatgcagtttatcaatattgttgttcacagcgtagaagacatgaattttcgcgtccacctacagtatgaatttacaaagctcgggttggaggagttcttgcagaaatctaggcacacagaatccgagaagctgcaagtgcagatccaggcctacctagataatgtgtttgacgtgggagggctgctcgaggatgccgaaaccaagaacgtggccctcgagaaggtcgaagaactggaagaacatgtttctcatctgaccgaaaagttgctggatctggaaaacgaaaatatgatgagagttgcagaactggagaagcagctgctgcagcgagagaaggaactggaaagcattaaagagacttatgagaacacgagccaccaagtccacactctgcgacgcttgatcaaggagaaggaagaagcattccagcgtagatgtcacctcgaaccgaacgtgcgtggtctcgagagcgttgactcggaggctctggcacgggtgggtcccgctgagcttagcgagggcatgccaccttctgacctggatctgctggcccccgctccacctccggaagaggtgctgcccctgcccccaccaccggcaccaccacttccacctcctccacctccgctaccggacaagtgcccccccgcccctcccctgcctggtgcagccccatccgttgtcctcaccgtgggtctgagcgcaatccgcattaaaaaaccaattaagacgaaatttagactccctgtgtttaactggacagcattaaagccaaatcaaataagcgggaccgttttctcagagctcgatgacgagaaaatcctagaagacctggaccttgacaaattcgaggagctatttaagacaaaagctcaggggcctgctctggacctcatctgtagcaaaaataagacggcgcagaaagcagcctccaaagtgacgctcctcgaagcgaacagagctaagaatctggccatcactttgagaaaggctggtcgttctgctgaagagatctgtcgagccattcatacgtttgacttgcagacgctgccagttgactttgtcgagtgtctgatgcggttcttgcccactgaagccgaagttaaattactccggcagtacgagcgggagcgacaacctctcgaagagctggcagcagaggaccgtttcatgcttctgttcagtaaggtggaacgtctcacccaacggatggccgggatggcatttctaggaaactttcaggataatctgcagatgctaactcctcagctcaacgccatcatcgccgctagcgcatcagtgaagtcatcccagaaattgaaacagatgctggaaattatattggccctgggcaactacatgaattcaagtaagcgtggcgcagtatatggcttcaagctgcagagcctggatttgctgctggacaccaaaagcaccgaccgaaaaatgacgttgctccactttattgctctgacagtcaaagaaaaatatccggatctcgccaacttctggcacgagcttcactttgtggaaaaagccgccgccgtctctctggagaacgtgctgctcgatgtgaaggaattgggaaggggaatggagttgatcagaagagagtgctctatccacgataacagcgtattgcgaaactttctgtccactaatgaagggaagctcgataagctgcagcgagacgccaaaaccgcggaggaggcctacaacgctgtggtcaggtatttcggggagtctcctaaaactacgcccccctctgttttctttcctgtgttcgtaagatttattcgcagctacaaggaggcggaacaggagaatgaagcaagaaaaaaacaagaggaagtcatgcgagaaaagcagctggctcaggaagcaaaaaaactggatgcaaagaccccatcccaacgcaataagtggcaacagcaggagctgatagcagaacttcgacgcagacaggccaaggaacaccgacccgtttacgagggtaaggacgggacaatcgaagacatcatcaccgggttgcattgccagccaatggtcgttagacatcaggctcgcagtgccgcccccccatccggtccaccaagggcccctgggcctcactag

SEQ ID NO: 30190 - DNA, 2931 bp, Artificial Sequence
  Description of Artificial Sequence: Synthetic coding sequence
atgggtaaccttgaatctgccgaaggcgtcccgggggagccaccctctgtgccactcttacttcctcctggtaaaatgcctatgcctgagccctgcgagctagaggaacgattcgccttggtgttgagtagtatgaacctcccccctgataaggctcgtctgctgcgccagtatgataacgagaagaagtgggacctgatatgcgatcaagagaggttccaggtcaaaaaccctccgcatacttatattcagaagttgcaatcctttctcgaccctagcgtgaccaggaagaaatttagacggagggtccaggagtccacaaaagtattgcgagaattagaaatcagcctaaggacaaatcacatcggatgggtgcgcgagtttctaaacgatgagaataaaggactcgacgtgttagttgactacctgagctttgcacagtgtagcgtcatgtattcaacactgcctggacgccgtgctctcaaaaactcacgcctggtgtctcagaaggacgatgttcatgtctgcattttatgtttacgggcgatcatgaactaccagtatggctttaatctcgtcatgtcgcatccccatgcagtgaacgagatcgccctgagtctgaataataagaatcctcgcactaaggctctggttctagaactcctggccgccgtgtgcttggtacgcggaggtcatgagatcattcttgccgcattcgacaacttcaaggaagtatgcaaggaattacatcgtttcgaaaagctaatggagtatttcaggaatgaagacagcaatattgatttcatggtggcgtgcatgcaatttataaacatcgtcgttcatagcgtcgaggatatgaactttagagtccatctgcagtacgagttcacgaaactcggattggaagagtttttgcaaaaatcccgccatactgagtccgaaaagctgcaagtccagatccaggcttacttagacaacgtcttcgacgtggggggattgcttgaagatgccgaaacaaagaacgtggccctcgaaaaggttgaggaactggaggagcatgtttctcacttaacagaaaagctattggatctcgaaaatgagaatatgatgcgggtagccgaattggaaaagcagttactgcagagggagaaggaactcgagtcaatcaaggagacgtacgaaaacactagtcaccaggtacacacattgcggaggctcataaaagaaaaggaggaggcctttcagcgccggtgccatcttgagccaaatgtgcgcggactggaaagtgtggacagcgaggccctggctcgagtgggacctgccgagctgtcggaaggcatgccaccttccgacctggatttgttagcccccgcacctcctcccgaagaggtgctgccactgccccccccccctgccccccctttgccaccccctccgccaccactccctgataagtgtcctcccgcacctcccttaccgggggccgctccctctgtggtccttacagtgggcctcagcgctataaggatcaagaaacccatcaaaaccaagtttcgccttccggtcttcaactggacggcgttgaagcctaatcaaatctccggcaccgttttttctgagcttgatgacgaaaaaatcctagaagacctagatctcgacaagtttgaagagctctttaaaactaaggctcaggggcctgcactcgacttaatctgctccaaaaataagaccgctcagaaagccgcttccaaagtgacgctattagaggccaacagagccaagaatctggcaataactctccggaaagccggtagatctgcagaggaaatttgccgcgccatccatacctttgatctgcagactctaccagtcgactttgtggagtgtcttatgcgtttcctaccgaccgaagctgaggtcaagctgctcagacaatacgagagggagcgccagcctttggaagagctggctgccgaagatcgattcatgctcttgttcagcaaggtggagaggctcacacagaggatggcggggatggcttttctgggaaactttcaggacaatctccagatgctaacacctcaattaaatgcaattattgccgcgtccgcctcggtgaagtcttcacagaagctgaagcaaatgttggagatcatactcgccctcggcaattatatgaacagtagcaaaaggggcgccgtctacggcttcaaactgcagagtctggatctgcttctggatacaaagagcaccgacagaaagatgacacttctccatttcatagcactgacggtgaaagagaagtaccctgacctggccaacttttggcacgagctccatttcgttgagaaagcagcggctgtcagtctggaaaacgttcttctggacgtgaaggagctgggtcggggaatggagttaattcgccgagaatgctcaatacacgataatagcgtgctgcgcaacttcctgtccacaaacgagggcaaactggacaagctgcaacgcgacgctaaaactgccgaggaagcttataacgctgtggtgagatactttggcgagtccccgaaaactacaccgccttcagtgtttttccccgtctttgtcaggtttatcagaagctacaaggaagccgagcaggagaacgaggctaggaaaaaacaggaagaggtaatgcgcgaaaagcagctagcccaggaggctaagaagttggacgctaaaaccccatctcagaggaataagtggcagcagcaggaattaatagccgagttacgccggcgtcaggccaaggaacatcgacccgtgtatgagggaaaagatggcacgatagaagacatcatcacaggacttcactgccaacccatggtggtccgtcatcaggcccgctccgcggcgcctccttccggccctccccgcgcaccaggaccgcactag

SEQ ID NO: 30191 - DNA, 3084 bp, Artificial Sequence
  Description of Artificial Sequence: Synthetic coding sequence
atgggaaatctggaatctgcggagggtgtccctggcgagcccccctccgtgccactccttcttccgcccgggaaaatgcccatgcccgaaccttgtgaactggaagaacggttcgcgctcgtgttgagttcgatgaatctgcctccagataaggcacgactactgaggcagtatgataacgaaaagaagtgggacctaatctgcgaccaggagcgcttccaagtgaagaaccctccgcacacttatattcagaaactgcaaagtttcctagacccttccgtgacaagaaagaagttcagacgtcgcgtgcaggaaagcaccaaggtcctcagagaactggagatatcactcagaactaatcatattgggtgggttagagagttcctcaatgatgagaacaagggcctagacgtgctggtcgactatttgtcctttgcacaatgctcagttatgtttgattttgaagggctggagagcggggacgacggagctttcgataagcttcgcagctggtcccgtagtatcgaagatctccagccccctagcgctctgagtgccccctttacaaacagtttagctagaagtgcaaggcagagcgttctcaggtacagcacactgccaggtcgcagagctcttaaaaactctcgactggttagtcagaaggatgatgtgcatgtctgtatcctatgcctgagagccattatgaattaccagtatgggtttaacctagtgatgtcccatcctcacgctgttaacgaaatcgctctgagcttgaacaataaaaatccacgcaccaaagccttggtactagagctccttgctgcagtttgtctcgtgagaggaggccacgaaatcatcttagcagcttttgacaatttcaaagaggtgtgcaaagaacttcacaggtttgagaaactgatggagtattttcgaaatgaagatagcaacatcgacttcatggtggcctgcatgcaattcatcaatatcgtcgtccactcggtcgaagacatgaatttcagagtgcatctgcaatatgagttcactaagctggggctagaggagttcctgcagaagtccaggcataccgaaagcgaaaaactgcaggtgcagatacaagcctacttagataacgtgttcgacgtgggcgggctgctggaggatgctgagaccaaaaatgtcgctttggagaaagtggaggaactggaggagcatgtgtcccacctgacagagaaactgctggatctcgaaaatgagaatatgatgcgggtggccgagcttgaaaagcagttactgcagcgcgagaaagaacttgaatcaatcaaagaaacatatgaaaacacgagccaccaggtgcacaccttgcgccggctaataaaggaaaaggaagaggcattccagcgacggtgtcacttagagcctaacgttagaggactggagtcagtcgattccgaagctctcgcccgcgtgggtcccgcggaactgagcgagggcatgcctcccagcgacttagatctgctggcaccagctccccccccagaagaggtgctgcctttacctccaccacccgcccctcctttgcctccacccccaccccccctacccgataaatgtcctcctgccccacctttgcccggcgccgccccctccgttgtgctcacagtgggcctgagcgccatccgaattaagaaacctatcaagaccaagtttaggctgccggtttttaactggactgcccttaaacccaaccagatttctggcaccgtatttagcgaattggacgatgaaaaaattcttgaagacttggacctggacaagttcgaagagctctttaagacaaaagcccagggaccagcgttggacctgatctgcagcaagaacaagacagcgcaaaaggctgctagtaaggtaaccctgctcgaagcaaatcgtgcaaaaaatctcgctatcactttacggaaggctggacgctcagcggaagagatatgtcgcgcaattcacacttttgatctacagacccttccagtggactttgtggagtgcctgatgcgttttctacccactgaggccgaagtaaagctcctaaggcagtacgaaagagaacgccaacccctcgaagagctcgccgctgaagaccgcttcatgctcctgtttagcaaggtggaacgcctgactcaaaggatggccgggatggcatttcttggcaacttccaggataatctgcaaatgctgaccccccaactgaatgcaatcatcgcagcttctgcttccgtgaagagttcccagaaactgaagcagatgttggaaattattctcgccctgggaaactatatgaattcctccaaacgcggggctgtctatggatttaaactgcagtccctggacctgttgttggacacgaagagcacggacaggaagatgactttgcttcacttcattgcactgactgtcaaagagaaatatccagacttagccaacttttggcatgagctgcatttcgtcgagaaagctgctgccgtaagcctcgagaatgttttactagatgtcaaagaactggggcgtggaatggaactcattaggcgggagtgcagcatacacgataattcagttcttcggaatttccttagtaccaacgaaggcaagttagacaagctgcagcgcgatgccaagaccgcagaggcttataatgccgtcgttagatactttggggaaagccccaagacgactcctccatcagttttcttccccgtgtttgttaggttcattagaagctacaaagaggctgagcaggagaacgaagcacggaaaaagcaggaggaagtgatgcgcgaaaaacagctggcccaagaggccaaaaaattggacgccaagacaccctcccaaagaaacaagtggcagcaacaagagctgattgccgaactccgccggagacaggctaaggagcaccgacccgtttatgagggtaaggatggaactatcgaggacatcattaccgttctgaagagcgtgccctttacagcccgcactgcaaaacggggaagtcgattcttttgtgatgcggctcaccatgatgagagtaactgctag

SEQ ID NO: 30192 - DNA, 1227 bp, Artificial Sequence
  Description of Artificial Sequence: Synthetic coding sequence
atgtccaagagggacattgtcctcaccaacgtgacagtggtgcaacttctgcggcagccctgcccagttacgagggcccctccacctcccgagccaaaagccgaagtggagccgcagcctcagccagaacctacccccgtccgcgaagagataaaacctcctccaccccctctgccgccacacccagccactccacctcctaagatggtatcagttgctcgggagcttaccgtaggaattaacgggttcgggcgcattggcagattagttctgagggcttgcatggagaaaggcgtcaaagtggttgcagtcaacgaccctttcattgatcccgaatacatggtgtacatgtttaagtatgacagcactcacggtcgctataagggatcagtggagtttagaaacgggcagctcgtggtggacaatcatgaaatcagtgtttatcaatgcaaagagccaaagcagatcccatggcgcgctgtggggtctccatacgttgtggagagtactggtgtctatttgtcaattcaggctgcttctgatcacatcagcgctggcgctcagcgggtggtgatctccgcgccctctcccgatgccccaatgtttgtgatgggggtgaacgaaaacgattataatccaggctctatgaacatcgtgagtaatgctagttgtaccacaaactgcctggctccattggcaaaagtgatccacgagagatttggtatcgtcgagggacttatgacgacagtgcactcctatacagcaacacagaaaaccgtcgacggcccatctcgtaaggcctggagagatggcaggggcgcccaccagaatatcattcccgccagcaccggggccgccaaggccgtcaccaaagtgataccagaattaaagggaaagctgaccggaatggcctttagggtccctacacctgacgtttctgtggttgacctaacgtgcaggctggcacagcccgctccgtactcagccattaaggaggccgttaaggcggccgcaaagggcccaatggcggggatcttagcctacacggaagacgaggtggtctcgacagatttccttggcgatacccattccagtatcttcgatgctaaggccggcattgcactaaatgataattttgtcaagttgatctcgtggtacgacaatgagtacgggtacagtcaccgcgtcgtcgacctcctcaggtacatgttctcacgcgataagtag

SEQ ID NO: 30193 - DNA, 2811 bp, Artificial Sequence
  Description of Artificial Sequence: Synthetic coding sequence
atggctgcagcaagggacccacctgaggtgtccctcagggaagcaacacagaggaagctgcgacggttttctgagctgcgcggaaagcttgtcgccaggggcgagttttgggacatcgtcgccattacagccgcggacgagaagcaggagctggcctacaaccagcagttaagcgaaaagttgaaaaggaaggagcttccacttggagtgcagtatcatgtctttgtcgatccggctggagcgaagataggtaacgggggctccaccctctgtgctctgcagtgcctcgagaagttatatggagataaatggaacagcttcacaatactgctcatacattccgacgaatggaaaaaaaaggtgtccgaatcttacgttatcactattgaaaggttggaagacgaccttcagatcaaggaaaaggagctgactgaattgcgaaacatctttggctccgatgaagcatttagcaaagtgaatctcaattacagaaccgaaaatggtctgtcgctgttacacttatgctgtatctgtgggggaaaaaaaagtcacattcggacactgatgctgaaggggcttcggccaagcaggctcaccaggaatggattcaccgccctgcacctagccgtttacaaagacaacgctgagcttatcactagcctgctccatagcggagccgatatccagcaggtgggatacggcgggctaaccgccctccacatcgctaccatcgcggggcacttagaggccgccgacgtcctgctgcaacacggtgccaacgttaacattcaggacgccgttttcttcacccccctgcatatcgccgcgtactacggtcatgagcaggtgacaaggttgctgctcaagtttggcgccgatgtaaatgtctctggggaggtcggtgacagaccattgcaccttgctagcgccaagggtttcctaaacattgcaaagctgctgatggaggaaggttcgaaagcagacgtgaacgcccaagataatgaggaccatgtgccccttcacttctgctctcgttttgggcaccatgacatcgtgaaatatcttctgcagtcggatcttgaggtgcagcctcacgtcgtgaatatctacggagacactcctttacacctggcctgctataatggtaagtttgaagttgccaaggagatcattcagatctcaggcactgagagccttactaaggagaatatatttagcgaaacagcttttcactcagcctgcacctacggcaaaagcatcgacctcgttaagtttctgctggaccagaatgtcataaatataaaccaccaggggcgagacgggcataccgggttgcattctgcatgttatcacggccatatccgattggtccagttcctgctggacaacggagcggatatgaacctggtggcgtgcgatccttccaggtcatctggagaaaaagacgagcagacatgcttgatgtgggcttacgagaaggggcatgatgctatcgtgactcttctgaagcactacaaacgacctcaggacgagctgccatgcaacgaatacagtcagccggggggcgatggttcctacgtttcggtcccctccccgctcggcaaaatcaagtccatgacaaaggaaaaagctgatattcttctcctccgggctggcctgccttctcactttcacctgcagctgtctgaaattgaattccatgaaatcattgggtctgggtcttttggaaaggtgtacaagggacggtgcaggaataagatagttgcgatcaaacgctatagggcgaacacatattgctcaaagtccgacgttgatatgttctgccgggaagtgagtattctttgccaactgaaccatccctgtgtcattcagttcgtcggagcatgtttaaatgacccctctcagttcgcaattgttactcagtacatatcaggtggtagtctgttttctctgttgcatgagcagaagcgaatccttgatctgcagagcaagctaattattgctgttgatgtcgcgaaaggtatggaatatctccacaatcttactcagcccatcattcacagggatttgaattctcataatatactgttgtacgaggatggacacgccgtcgtggctgattttggggagagccgattcctgcagagtctcgacgaggacaatatgactaaacagccgggaaatctgcggtggatggcgcccgaggtgttcacccaatgcacccgctacacaatcaaggccgatgtctttagctatgccctatgcctgtgggagattctcacgggtgaaatcccattcgctcatcttaaacccgcagccgccgccgcagatatggcctaccatcacattcgccctcctatcggctattctatccctaaaccaatctccagtctcctgattagagggtggaacgcttgtcctgagggccgtcctgagttcagtgaggttgtcatgaagctggaggagtgcctgtgcaatatcgagttaatgtcacctgccagttccaattcgtccggcagtctgagtccttccagtagcagtgactgcctggtcaataggggaggccccgggcggagccacgtagctgctctgcgaagtagatttgagctggagtatgctcttaacgctcggtcgtacgcggccctgagccaatcagccggccaatacagcagccaaggtctgtccctggaggaaatgaaaagatccctgcagtacacacccattgacaagtacggctacgtctcagaccctatgtcaagtatgcacttccactcctgccggaactcttccagttttgaagacagtagttag

SEQ ID NO: 30194 - DNA, 2532 bp, Artificial Sequence
  Description of Artificial Sequence: Synthetic coding sequence
atggccgctgcacgcgatcctccagaggtgtccctccgcgaggctacacaacgaaaactcaggagattcagtgagcttagaggcaagttggtggctaggggcgagttttgggatattgtggccataactgccgcagatgaaaagcaggaacttgcatacaatcaacagttgtctgaaaaattgaaaagaaaagagttgccgctgggagtgcagtatcacgtctttgtggacccggctggagctaaaattggaaatggtggctcgactttgtgcgccctacagtgtctggagaaactttatggcgacaaatggaattccttcacgattttattaatacattccgacgagtggaagaagaaggtcagcgaatcctacgtgataacaattgagcgtctggaagatgatctgcagattaaggagaaggagcttaccgagctgaggaacatatttggctccgacgaggctttttcaaaggtgaacttgaattaccgcacagaaaatggcctgtccttgcttcacctgtgctgtatctgcgggggtaagaagtcccacatcaggacgctcatgctgaagggtctcagacccagtcggctgacccgcaatggtttcacggctctgcacttggccgtctataaggacaatgctgagctgataaccagtctgcttcactcgggagctgatatccaacaggtgggatacgggggactgaccgccttgcacatcgctactatcgctggccaccttgaggctgctgacgtcctcctgcagcacggcgctaacgtgaacatccaggatgctgtatttttcaccccgctccacattgcagcgtactatggtcacgaacaggttacacggctgttactcaagttcggggccgatgtaaacgtcagcggggaggtaggtgaccgccccctacatcttgcctccgcaaaggggttccttaatatcgctaagttgctgatggaggagggaagcaaagctgatgtcaacgcccaggataatgaggaccatgttcccctgcatttttgctccaggttcggccaccacgacatcgtcaaatacttgcttcagtcggatctggaagtgcagccacacgtggtgaatatctatggtgatacaccactccacctggcctgctacaacgggaaattcgaagtggcgaaggagatcattcagatttccggaactgagtccctgacaaaagaaaatattttttccgaaaccgccttccattccgcttgcacctatgggaaatccattgatttagttaagtttctgttagaccagaacgttattaatatcaaccaccaggggcgggatggacatacaggtctccactccgcctgctaccatgggcacattcgtctggtccagtttcttttggataacggagccgacatgaacttagttgcatgcgacccatcccggtcatcaggggagaaagatgaacaaacctgcctgatgtgggcgtatgagaagggacacgatgcaattgtgacattactcaagcattacaagcgcccgcaggacgagctcccatgcaacgaatacagtcagcctggcggagacggcagctacgtgtccgtgcctagcccactgggcaagataaagtccatgacaaaagagaaagctgacatacttctcctgagggctggattgcctagtcacttccatctccagctaagcgagatcgaatttcacgagattatcggttctgggtcatttggaaaagtatacaaaggcagatgcagaaataagatagttgcaataaagcgataccgggcaaacacttactgctctaagagtgacgttgatatgttctgcagggaggtctcaattttgtgccagctgaatcatccctgcgtgattcagttcgtgggtgcctgcctgaatgacccctctcagtttgccatcgtgactcagtacatttctggcggcagcttattctccctgttacatgaacaaaagaggattctggacctccagagcaaactcattattgccgtggacgttgcgaaaggtatggagtatttgcacaaccttacccaaccaataatccatcgggaccttaattctcacaacattctgttgtatgaagatgggcacgcagtggtcgccgactttggcgaaagccggtttctccagtccctggacgaggataatatgactaagcagccggggaacctgcgctggatggcgcccgaggtattcacccagtgtaccagatacacaatcaaagccgatgtcttcagctacgccctgtgtttgtgggagattctgaccggtgaaattccctttgcccacctgaaaccggccgctgccgccgctgatatggcataccaccacatacgaccaccaatcggatactctatcccaaagcccatttctagcctcttgatccggggttggaatgcctgtcccgaagccaaaagtcgtccgagtcattaccccgtgtccagtgtgtacaccgagacactgaaaaaaaaaaatgaagatcgattcggcatgtggatcgagtacttgaggagatag

SEQ ID NO: 30195 - DNA, 444 bp, Artificial Sequence
  Description of Artificial Sequence: Synthetic coding sequence
atgagcttccgttttggccagcacttgatcaaacccagcgtggtgttcctcaagacagaattatcattcgctctggtgaatagaaaacctgttgtccctgggcatgtcctagtgtgtcctctcaggcccgtcgaacggtttcacgacctgcgaccggacgaggtcgccgacttgtttcaaaccacacagcgggtggggaccgttgtcgagaagcacttccacggcacaagcctgacttttagtatgcaggatggcccagaggcagggcagaccgtcaagcacgtgcatgttcatgtgctcccccggaaggctggcgatttccataggaacgactcgatctatgaagaactgcagaagcacgataaagaagacttcccagcttcctggcgtagtgaagaggagatggctgctgaagcagcggccctaagagtgtacttccagtag

SEQ ID NO: 30196 - DNA, 930 bp, Artificial Sequence
  Description of Artificial Sequence: Synthetic coding sequence
atggaacagttactgcgcgccgaactcagaacagccaccctgcgtgccttcggaggcccaggcgccgggtgtatctccgaaggccgggcttacgacaccgatgctggaccggtcttcgtgaaggttaataggagaactcaagcgagacagatgtttgaaggggaggttgctagcctggaggcactcagaagcaccggcctcgtgagggtgccacgccctatgaaagtcatagacctcccagggggtggcgccgcctttgtgatggaacacttaaagatgaagtcactctcgagccaggcctcaaagctgggggaacagatggctgacctgcacctgtacaatcaaaagctcagagagaaactgaaagaagaggagaacaccgtcggccgccgcggggaaggtgccgagccccagtatgtggataagttcgggtttcacacagtgacctgctgcggttttattccccaggtcaacgagtggcaggatgactggcctacattctttgccagacatcgactgcaggcacagctagacctcattgaaaaagattacgctgacagagaagcccgcgagctgtggagcaggcttcaggtcaaaatccctgacctgttctgtggattagagattgtccctgccctgctccacggagatctttggtccgggaacgtggctgaagacgatgtgggtcctatcatctatgaccctgcttccttttatgggcactccgaatttgaattggccattgctctaatgttcggagggtttccacggtcgttttttactgcctaccataggaaaatccccaaagcccctggatttgatcaaaggctgttgctgtaccagttgtttaactatttgaaccactggaatcatttcggaagagagtacagatctccaagccttggaaccatgcggagactgctgaaatag

SEQ ID NO: 30197 - DNA, 609 bp, Artificial Sequence
  Description of Artificial Sequence: Synthetic coding sequence
atggagcagctgctacgcgccgagttgcgcacggctacacttcgtgcatttggaggcccgggcgcaggatgtatctcggaggggagagcatacgacactgatgcgggtcccgtcttcgtcaaggtgaaccgcagaactcaggcacgtcagatgtttgagggggaggtcgcgagccttgaggcgctgcgaagcaccgggttagtgagggtgcctcgtcctatgaaagtcatcgatcttcccggaggcggtgcagcctttgtgatggagcacctcaaaatgaaatcgttgagttcacaagcttccaaactgggcgagcagatggcggatcttcatctctacaatcagaagctacgtgaaaagctcaaggaggaagaaaataccgtgggaagacgcggggagggtgcagaaccacaatacgttgacaagtttggtttccacactgtaacttgctgcgggtttatacctcaggaaccactggaacccagctctttgaaatctgttaagtttcagcgcagactatggactgcacagctgccttgcgcctcactcgaggaggccaatatcggtccctactttggcttcgtccgaaacaccgcgccgattatctag

SEQ ID NO: 30198 - DNA, 534 bp, Artificial Sequence
  Description of Artificial Sequence: Synthetic coding sequence
atgcaggcaaggcagatgttcgagggcgaagtggccagtctcgaagcccttagaagcaccggtctagtgcgggtacctcgcccaatgaaagtaatcgatctgcccgggggaggcgccgcattcgtgatggagcaccttaaaatgaaatctctgagttctcaggcgtccaaactgggggaacagatggccgacttgcacctctacaaccagaagttgagggagaaactaaaggaggaggaaaatacggtgggacgccgcggcgagggagcagagccccaatacgtagataaatttggattccatacagtaacctgctgcggctttattcctcaggtcaacgagtggcaggacgactggcccacattcttcgcgcgccaccgtctccaggcccagctggacctcatcgagaaggattatgcagatcgcgaggcacgagagctgtggtcccgtcttcaggtgggaacagccgtgacaagtctggggaaaagctggtccagccacgatcccgcagcctttgtccgcgttcatttgtag

SEQ ID NO: 30199 - DNA, 1212 bp, Artificial Sequence
  Description of Artificial Sequence: Synthetic coding sequence
atgcccgagccactcgcacccgagagttaccctgagtctgtgtgcgaagaagacgttacactggccctaaaggagctggatgaaaggtgcgaggaagaggaggctgatttcagcggcctgtccagtcaggacgaggaggagcaggacggcttccccgaagtacagacatcacctctcccaagcccgttcttgagcgcgatcatcgcggcctttcagccagttgcatatgacgacgaggaggaggcatggcgatgccacgtgaatcaaatgctgtccgacaccgacggatcatctgccgtgttcacatttcacgtcttttcaagactgttccagaccatccaacgtaaattcggagaaatcaccaatgaagccgtgtcattccttggggatagcttacagagaatcggaacaaagttcaaatcttctctcgaggttatgatgctttgtagtgaatgccctaccgtgtttgtggatgcggagacccttatgtcctgtggtttgcttgagacgctcaaatttggtgtgctggaacttcaggaacatctagacacctacaatgtcaagcgcgaggcagccgagcagtggttggacgattgcaaaaggacttttggggccaaggaggacatgtataggattaacacagatgcgcaagagctggagctgtgtcgacgactgtacaagctgcacttccagctcttgctgttatttcaggcctactgtaaactaatcaaccaggtgaacacaatcaagaatgaggctgaagtgatcaacatgtcggaagaacttgcccagctcgagagcattctgaaagaagcagaatctgcgtccgagaatgaggaaattgacatttcaaaagcagcacagaccacgatcgagacagcaattcattcgttgattgagacactgaaaaataaggagttcatctccgctgtcgctcaggtcaaggccttccgtagcctgtggccatcagacatctttgggtcatgcgaagacgacccggtacagaccctgctgcatatttattttcaccaccagacactgggccagactggctcttttgcagtgatcggctcgaacctggacatgagcgaggcaaactacaagttgatggagttgaacttggaaattcgcgaaagtttaagaatggtacaaagttatcaactgctggcccaggcaaaacccatgggcaatatggtcagtaccggattttag

SEQ ID NO: 30200 - DNA, 9042 bp, Artificial Sequence
  Description of Artificial Sequence: Synthetic coding sequence
atgtccaatatcacgatcgaccctgacgtcaagcccggcgagtacgtaataaaaagtctctttgcagagtttgccgtacaggccgagaaaaagattgaagtggtcatggcggagcctctcgagaagcttctgagccggtcccttcagcgcggggaggatttgcaattcgaccaactgattagtagcatgagtagtgtggccgagcattgcctgccaagcttactcaggaccctgttcgattggtacaggcgtcagaatgggacggaggacgaaagctacgaatatcggcctaggtcatctaccaaaagtaagggtgacgagcaacagagggagcgcgattacttactggaacggcgggacttggccgtcgactttattttttgtctggttctggtggaagtgttgaagcagatccccgtccaccccgtgcccgacccgctagtccatgaggtcttaaatcttgctttcaagcatttcaagcacaaagaagggtactccgggactaacacaggcaatgtgcacattattgccgatctttacgccgaagtcattggcgtcttggctcagtctaaattccaggcggtaaggaagaagtttgtcaccgaactgaaggagctcaggcagaaggaacagagtcctcatgtcgtgcagtctgtgatttcccttattatgggaatgaagttctttagggtaaagatgtaccctgtggaggacttcgaggcctcgttccagttcatgcaggagtgcgcccaatactttcttgaggtgaaagataaggatatcaaacatgctcttgccgggctttttgttgaaattctgattccggttgctgctgcagtgaagaacgaggtgaatgtgccatgcctgaagaactttgtagagatgttgtaccaaaccaccttcgagctctcctccaggaaaaagcattcccttgcactctatccattgattacttgtctgctctgcgtatcccaaaagcaattcttcctcaacaattggcacatcttcctccagaactgtcttagtcatctgaaaaacaaagatcctaagatgagccgagtcgcactggagagcctttatcggttgctctgggtctatgtgatcagaatcaaatgcgagagcaataccgtgactcagagccggctgatgtcgatcgtgtctgccctgtttccgaaaggcagtcgctcggtagtacctcgcgacacacctctgaatatcttcgtgaagatcattcagtttattgcccaggaaaggctggatttcgctatgaaagagattattttcgacctcctctccgtgggcaagtctacaaagaccttcacaatcaatcctgagcgcatgaacattggcctccgcgtgttcctggtgatagcagactctttacagcagaaggacggcgagcctccaatgcccaccactggggtgattctgccgagcgggaataccctgcgggtgaagaagatatttctgaacaaaacactgacagatgaagaggcaaaagtgatcgggatgtcggtgtactaccctcaagtgcgcaaagctctggactccatcttgcgccatctcgacaaagaggtaggaagacctatgtgcatgacttctgttcaaatgtccaacaaagaacccgaggacatgatcacaggcgaaaggaaacctaagatcgacctgttccggacttgtatcgcagccatcccacgcctgatccccgatggcatgagtcggactgatttaatcgagttgctggctcggttaacaatccacatggatgaagaactgagggcactggccttcaacactttgcaggccctcatgctcgactttccagattggagagaagacgtgctctcagggtttgtgtacttcatcgtgcgggaggtaacagatgtgcacccaacgctgctcgacaatgccgtgaaaatgctggtacagctgatcaatcagtggaagcaggctgcccaaatgcacaataaaaatcaagacactcagcatggggtcgctaatggcgcctcccaccccccaccactggaaaggagcccttatagcaatgtctttcatgtggtggagggattcgccctggtgatactatgtagctcccgtcccgcaactaggcgtttggctgtctctgtgctgagagaaataagggcccttttcgctctgctggaaatccctaaaggcgatgacgagctggccatcgacgtgatggatcgcctaagtccctcaatcctggaatcatttatccacttaacaggagctgaccaaacaacactactgtactgccctagctctattgatcttcagacactcgccgaatggaactcatcaccgattagtcaccagttcgacgtcattagcccttctcacatatggatatttgcccatgttacacagggccaggatccttggataatctcgctgtcgtcctttctaaaacaggagaatttgccgaagcattgtagtacagccgtgtcatacgcatggatgtttgcatacacgcgcctgcaactgctgtcacctcaggtggatatcaattcacccattaacgccaagaaggtgaatacgaccacttccagcgattcctacataggtctgtggcgaaactacctcatactatgctgctctgcagcaacctcgagtagtagcacttccgcgggaagtgtgcgatgctctcctccagagaccctcgcctcgacccctgactcagggtactcaatcgactcaaagatcataggaatcccctctccgtcatctctgttcaagcacattgtgcccatgatgaggtcggaaagcatggagatcacggaatctcttgtgttggggttgggccgcaccaaccccggcgcgttccgcgaactaatcgaggaactgcaccccatcattaaggaagcacttgagagaaggccggagaatatgaagagacgacgcaggcgcgacatcttaagggttcagctggtccgaattttcgaactgctcgctgacgccggggtcatctcacatagcgcaagcggcggattagacaatgaaactcactttttgaacaatacattgctggagtatgtggatctgacaagacagctgcttgaagccgagaacgagaaagactctgacacgctgaaggatatcagatgccatttttccgcgttggtggctaacattatacagaatgtaccagtgcaccagaggcggagcatcttccctcagcaatcactgcggcatagtctgttcatgctgttttcccattgggctggtccgttctcaatcatgttcacaccactggatcgctactcagatagaaacatgcaaatcaatcgccatcagtactgtgcactgaaagctatgtcagccgttctgtgttgtgggcccgtggctgacaatgtggggttgtcctcagatggatacctatacaagtggctggataatatccttgatagcctggataaaaaggttcaccagctgggctgtgaggccgttaccttgttgctagaactgaacccagatcaatcgaatctcatgtattgggcagtcgatagatgttataccggaagcggacgggttgccgccggctgttttaaagccatcgccaatgtgttccagaaccgtgactaccagtgcgatactgtgatgttgttgaatttgatactcttcaaagcagccgacagctcaaggtccatttacgaagttgccatgcagcttttgcaaatcttagagccaaaaatgtttcggtatgcccacaagcttgaagtacaacgtactgacggcgtactttctcagctgagtcctttgccccatttgtacagtgtgtcatattatcagctctctgaggaattggcccgcgcctatcccgagctgactctggctatcttttcagaaatttctcaacgaattcaaacggcccatcctgccggcagacaggttatgttacattatctcctgccttggatgaacaacatcgaactcgtggatctgaagcctctgcccactgcccggaggcacgatgaagatgaagatgattccctgaaggatcgggagttaatggtgacgtccagaagatggttacgcggggagggatggggctctcctcaggccactgccatggtgttgaacaatttaatgtatatgacagctaaatatggagatgagcttgcatggtcagaagtcgaaaacgtgtggactacactggccgacggttggcccaaaaatcttaagataatccttcactttctgatctctatctgcggcgtaaacagcgagcctagcctgcttccatacgttaagaaagttatcgtgtaccttgggcgcgacaagactatgcagctgctggaagagctcgtgtctgagctccagctcactgaccccgtgtcatccggggtcacacatatggacaatcccccttactaccgtatcacatcttcatacaagatcccctctgtgacgagcggcactacctcttcttctaacaccatggtagcaccgaccgacggcaatcctgataacaaaccaattaaagaaaacatcgaggagagttacgtccacttagacatatactctgggctaaactcccacctcaatcgacaacaccatcgactcgaaagcagatattctagcagctctggaggcagctatgaagaagagaagagcgattccatgccgctgtactctaactggagactgaaggtcatggaacacaatcagggggagccgctgccttttccccccgccgggggctgctggtcacctttagtggactacgtgcccgagacaagttcccctggccttccactacaccgctgtaatattgctgtgatactgctgacagacctgataatagaccattcagtgaaagtggagtggggatcatatctgcacctgctgctgcatgcgatctttatcggctttgatcactgccaccccgaggtgtacgagcactgtaaaagactgttgttgcaccttctcattgtgatgggccccaattcaaacatacgaactgtggcctctgtactgcttcggaataaggagttcaatgagccccgcgtgctcactgttaagcaggtggctcacctggactataactttacagccggcattaacgactttatacccgattaccaacctagtcctatgactgacagcggactatccagctcttcaacgagctcctcgatcagtcttggaaataactcggccgcgattagtcacttgcacactactatcttgaatgaagtggacattagcgttgagcaagacggaaaagtgaaaacactgatggagttcattactagtcggaagcggggccctctgtggaaccatgaagatgtgtctgccaagaacccatcaataaagagcgccgagcagctcaccactttcctcaagcacgtcgtttccgtattcaaacagtcaagttctgaaggtattcacctggagcaccatctcagtgaggtcgcactccagacagcccttagttgctcgagcagacactacgccggcaggtctttccaaattttcagagccctcaaacaaccactgaccgccacaactctgagtgacgtgttgtcacgtcttgtggaaactgttggagaccccggcgaagatgcgcagggcttcgtcattgaactgctgctaaccctggagtccgctatcgacactcttgcagagaccatgaagcattacgacctcttgagcgctctctcccaaacatcttaccacgatccaatcatggggaataagtacgcagctaaccgaaagagcaccggacaactgaacttgtcaacctctcctattaacagctcatcctatcttggttataacagtaacgctcggtcaaactctctgcgactatctctcattggagatcgtcgcggggaccggcgccggtccaacactctcgacatcatggacggccggatcaaccactcgagttccctggcccggacccgctcactgagctccctcagggaaaaagggatgtacgacgtgcaatcaaccactgagcctacaaatctgatggctacaatattctggatcgcagcctctctcctcgaatccgattacgagtatgagtacctgctcgccctgagattgctgaacaaactgcttattcacctgccactagataagtcagagtcgagagagaagattgaaaatgttcagagtaaacttaagtggactaatttccctggactccagcagctgttcctgaagggttttacctctgcctccacacaagagatgaccgttcacttgctgtcaaagttaatttcagtgtctaagcacacccttgtagatccctcgcagctttcaggatttcctttgaacatcctatgcctgctgccccaccttatacaacacttcgattctcccacacagttctgcaaggaaactgcttcacgaattgcaaaagtgtgcgccgaggaaaagtgtcctaccctggtgaaccttgcacacatgatgagcctctattctactcacacttactcccgtgattgttctaattggattaatgtcgtgtgtcgttatctacatgactcctttagcgacactaccttcaacctcgtcacgtacctggccgagctgcttgagaagggcctgtcatctatgcagcagtcactgctacagataatttactctctgctcagtcatattgatctttccgcggctcctgcaaaacagtttaacctcgagatcatcaagattatagggaaatatgtgcagtccccttattggaaagaggccctgaacatcttaaaactggtggtgagtaggagcgcttcacttgtggtcccctctgatattcccaaaacttacgggggagacactggctctcctgagatcagttttacaaaaatcttcaataacgtgtctaaagaactgccagggaaaaccctggattttcatttcgacatctctgagacgcccataatcgggaacaagtatggcgaccagcattcagccgccggtaggaacggcaaacctaaagtaatcgctgtgacaaggtccacaagttctacttcctctgggtctaattcaaatgctctcgtgccagtaagctggaagagaccacagcttagtcagcgccgcacacgcgaaaaattgatgaacgtgctgtcgctgtgtggccctgagtctggactgcccaaaaatccctcagtggtattttcatctaatgaagaccttgaagtcggggaccagcagacgagtctgattagcaccactgaagatataaatcaagaggaagaggttgccgtcgaggacaacagctcagagcagcagttcggagttttcaaagatttcgattttctcgatgtggagctggaggacgccgaaggcgagagtatggataatttcaattggggagtaaggcgtagatctttagatagcatagacaaaggggatacaccctccctgcaggagtatcaatgcagttcctctacccccagcctaaatcttacaaatcaggaggacaccgatgagtctagcgaagaggaggctgctcttacggccagtcagatcttaagccgtacccagatgttaaattccgattccgctacggacgagactattcccgatcacccggaccttctgcttcagtcagaagattcaacaggcagcatcacaaccgaggaggtccttcagatcagggacgagacccccaccctggaggcctctctggataacgcaaactccaggctgcctgaggacaccacctctgtgttgaaagaagaacacgtgactactttcgaagacgagggtagctacataatccaagaacagcaggaaagcctggtgtgccagggcattcttgacctcgaggaaacagagatgccagagccactcgcccctgaatcttaccctgaatctgtatgcgaggaggatgtgaccctggccctcaaagagttggatgaacggtgtgaggaggaggaagcagatttctcaggtcttagtagtcaggatgaggaggaacaggacggttttcccgaagtgcaaacatcccccctccctagccctttcctgtccgcaattatcgccgctttccagccagtcgcctatgatgatgaggaagaggcgtggagatgccacgtgaatcagatgctgtccgacacagatggttcctctgctgtgtttactttccacgtgttcagccgactgtttcagactatccagcggaaattcggtgagataactaacgaggccgttagcttcctcggagactctctgcagaggatcggcaccaagttcaaatctagcctcgaggtcatgatgctttgcagtgaatgtcctacagtgttcgtggatgccgagaccttaatgagctgcggattgctggagacactgaaatttggcgtgctggaattgcaggagcatttagacacctacaacgtgaagcgggaggcggctgagcagtggttggatgactgtaagcgcactttcggtgctaaggaagatatgtacagaattaatacagatgcgcagcagatggagattctcgctgagctcgagctgtgtcgtcggctctacaagctacacttccaacttctcctgttgttccaggcttactgcaagttgattaaccaggtaaatacaattaaaaacgaagccgaagtgattaatatgtccgaggaactcgcccagttggaatccattctgaaggaggcggagtccgcgtcagagaacgaagaaatcgatatttccaaagctgcacagacaactatcgaaacagccattcattctctgattgaaactcttaaaaataaagagttcataagtgcggtcgcccaggtgaaggcctttcgctctctctggccctctgacatatttggtagctgcgaggatgatcctgtgcagactttgctgcacatttattttcatcaccagaccttggggcagacaggcagcttcgccgtcatcgggtccaatctggatatgtccgaagccaactataaactaatggaactgaacctcgagatccgagagtctctgcggatggtgcagagctaccagctgcttgcccaagccaaacctatgggcaacatggtgtcgacagggttctag

SEQ ID NO: 30201 - DNA, 9042 bp, Artificial Sequence
  Description of Artificial Sequence: Synthetic coding sequence
atgtccaatatcaccatagatcctgatgtgaagcccggggaatacgtgatcaagtcgctgttcgctgaattcgctgtgcaggcagagaaaaaaatagaggtggtgatggccgagccacttgaaaagcttttgtccaggtctctgcagcgcggggaagacctacagttcgaccagttgataagttctatgagctcagtcgcggaacattgtctgcccagtctcctccgcacattgttcgactggtataggcgccaaaacggaaccgaggacgagtcctacgagtataggcctcggtctagcacaaaatctaagggcgatgagcaacagcgtgaacgcgattatttgctcgaacgccgcgatctggcagttgacttcattttttgtctggtgcttgtggaggtcctgaagcagattcccgtgcatcccgttcctgacccactggtgcacgaagtgttgaacttagccttcaagcattttaaacataaagagggatactctggaaccaacactggaaacgttcacattattgcggatctgtacgccgaggtgatcggagtgctcgcacagtccaagtttcaagccgtacggaagaagttcgtgaccgagcttaaagagttgcggcaaaaagaacagtccccgcatgtggtgcagtctgtgatcagtttgataatggggatgaaattctttagagtcaaaatgtaccctgtagaggatttcgaggcttcgtttcaatttatgcaggaatgtgcccagtacttcctcgaggtgaaggataaggacatcaaacatgccctggccggactattcgtggagatcttgattcccgtcgccgcagcagtgaagaacgaggtgaacgtgccttgcctcaagaactttgttgaaatgctgtaccagacaactttcgaactgagcagtcggaagaaacactctcttgcactgtatcctctgatcacatgcctgctgtgcgttagccagaagcaattcttcttgaacaactggcacatttttctgcagaactgcttgtcacacctaaaaaataaggatcctaagatgtctcgggtggctttggagagtctgtatcgtctcctgtgggtgtatgtcatcagaataaagtgtgagtccaacacagtcacccaaagccgactcatgtccattgtgtcagctcttttccctaagggctccaggtccgtggtgcctcgcgacacccctcttaatatattcgtgaagatcatccagttcatcgctcaagaaaggcttgacttcgcaatgaaagagattatcttcgaccttctgtccgtcggaaaatctactaaaacattcactatcaatccagaacggatgaacattggcctcagggtcttcctggtcatcgcagattcgttacaacagaaggacggagagccccctatgcccaccacaggggttattctcccttcgggcaacacccttcgagtgaagaaaatttttctgaacaagactctaaccgatgaggaggcaaaagtcatcggaatgagtgtgtattacccccaggtgcgcaaagccctggacagtatattgaggcatttagacaaggaagtaggaagacccatgtgtatgacaagcgtccagatgagcaacaaagagcccgaggatatgattacaggggaacgaaagcccaaaatcgacctgtttaggacatgtatcgccgctattccacgtcttatcccagatggaatgtctcggacagacctgatcgaactgctggcaagactgaccattcacatggacgaggaactccgcgcactggcgttcaatacactgcaagcactgatgctggacttccctgattggcgggaggatgttctgagtggttttgtttacttcattgtccgggaggttactgacgtgcaccccaccctgctggataacgccgttaagatgcttgtccagctcatcaatcaatggaagcaggctgcccaaatgcacaacaaaaaccaggatacacagcatggagtggcaaatggcgcatcgcaccctccaccactggagcggagcccctattcaaatgtgtttcatgtagttgagggatttgcactagtcatcctttgcagctctcggcctgccactaggcgcctggctgtcagcgttctgagagagattagagccctcttcgctctgcttgagattccgaaaggcgacgatgaactggcaatagacgtcatggacagactgtcgccatctatactcgaatcatttatacatctgaccggcgccgaccagacaaccctcctttattgccccagcagcatcgacctgcaaactctcgcggagtggaacagctctccaatttcccatcagttcgatgtgatatcaccctcgcatatttggatattcgctcacgtcactcagggccaggatccatggattatttccctctcgtctttcctgaagcaggaaaacctgccaaagcactgctcaacggcagtaagctatgcttggatgttcgcctacaccagactgcagctgctgagcccccaggtcgacataaacagtcccatcaacgctaagaaggtgaacacaactacatccagcgacagctatattggactctggaggaattacctgatcctttgctgttctgctgctacttccagtagcagcacgagcgcaggaagcgtgcgttgttcaccccccgaaaccttggcatccactcccgacagtggatatagcatcgattcaaaaattataggcattccttctccatcttctctcttcaaacatatcgttcctatgatgcggagtgagagtatggagatcacagaaagcctcgtccttgggttgggacggacaaacccaggcgccttccgcgaactgatcgaggaactccacccgatcataaaggaggcgttagagaggaggccagagaatatgaagcgccgtcgacggagggacatcctgcgcgttcagttggtccgaatcttcgagttgctggctgacgctggtgttatctctcacagcgcaagtggaggattggacaacgagacacattttcttaataacacgctgcttgagtacgtggatttaactcgccaactgcttgaagctgagaacgagaaggacagcgatacgttgaaggacattcgatgccatttttccgctctcgtggccaacataatccagaacgtacccgtccatcagcgccgttcgattttcccacaacagagtctgcggcactcactgtttatgcttttttcacattgggctggaccattctcaattatgtttacccccttggatcgctactccgaccgaaatatgcagattaacaggcatcagtattgtgccttaaaagcgatgagcgcagtgctgtgctgtggaccggttgcggacaatgtgggcctcagctccgatggctacttgtacaaatggctcgacaacatcctcgactctcttgataaaaaggtgcatcagctaggatgtgaagctgtgaccctcttgctggagctgaatcctgatcagtctaacttgatgtattgggccgtcgatcggtgttacacaggaagcgggagagtggccgccggatgtttcaaggccatcgccaacgttttccagaaccgggactaccagtgtgataccgtgatgcttctaaacctgatcctctttaaggccgctgatagttcgcgatctatatatgaggtcgctatgcagctgcttcagattctcgagcctaagatgttccgatatgcacataaactggaggtgcagagaactgatggcgtcctgagtcagctgagccctctgccacacctgtatagcgtttcctactaccagctatctgaagaacttgcccgagcttatcctgaactcactcttgcgattttctctgaaatctcacagcgcatccagacagcccaccccgcgggacgccaggtcatgttgcactatctgttgccttggatgaacaatattgagttagtggaccttaaaccactgcctacagcgcggcgccatgatgaggacgaagatgatagccttaaagatcgggaactgatggtgacatccagacgctggctgagaggcgagggttggggctcccctcaggcgaccgccatggtactgaataatttgatgtacatgactgccaagtatggagacgaactggcctggagcgaggtcgagaacgtgtggactaccctggcagacggttggccaaaaaaccttaagattatcctgcactttctaatatcaatctgtggcgtaaattccgagcctagtttgctcccttacgtcaaaaaggttattgtgtaccttggaagggataagacaatgcaacttcttgaggaactggttagcgaactacagttgaccgaccccgtgtcatccggagtcacccacatggacaatcctccctactatcgcatcacttcctcctacaagattccttccgtgaccagtggtacgacaagctcctcaaatactatggtggctccgactgacgggaatcctgacaacaaaccgatcaaggaaaatatcgaggaatcctatgttcatctggatatctattccggtctgaatagccatttgaaccgccaacaccaccgactcgaatcaagatacagctcatcctcaggcgggtcatacgaggaggagaagtcagattctatgcccctgtattccaactggagacttaaagtgatggagcataatcagggtgagcccctgcctttccctccagccggaggctgctggagcccactggtagactacgtccctgagacttcctcacctggcttaccgctccatcgctgtaacattgctgtaatcctgttaaccgacctgatcattgatcactcagtaaaagtagaatggggcagctacctacacttgctgctccatgccatttttatcggctttgaccattgccaccctgaggtgtacgagcactgtaagaggcttctcctgcatctcctgattgtcatggggccaaattctaatattcgtacggtggcgagcgttttactgcgtaacaaagagtttaatgaacccagggtgcttacagtgaaacaggtggcgcatcttgactacaacttcaccgcagggattaatgactttatccctgattaccagccttcacccatgactgactcgggcctctccagctccagcacgtcatccagcatttcactcggcaacaattccgctgcaatttcccatctgcatacaaccattctgaatgaagtggacatcagtgtagagcaagatggcaaagtcaaaacacttatggaatttatcacctcacggaagaggggcccactttggaaccacgaggacgtgtccgccaaaaatccctctattaagagcgccgagcagttaaccacatttctcaaacacgtcgtcagtgtcttcaagcagagcagttcagagggtatccacctggagcaccacctgagcgaagtggctctacagactgcgctgtcctgctcctcacgacactacgctgggcgctctttccagattttccgggccttgaaacaacctctaaccgctaccacactgagtgatgtcttgagtaggctggttgagaccgtgggggatcctggggaggacgctcagggtttcgtcattgagctgctcctcacacttgaaagcgccatcgacacattggccgagacgatgaagcactatgatctgctgtcggcgctctcacagactagctatcacgacccgattatgggaaataaatacgccgctaatcggaagagcaccggccagttgaacttgtcgacatcacccattaattcgagttcctacctcggatacaactctaatgcgaggtccaattcattgcggctgagtctgattggcgataggcggggcgataggaggcgtagcaatactctcgacatcatggatgggcgcatcaatcattcctcttctctggcccggacccgttcactgagtagcttgcgcgaaaaggggatgtacgatgtgcagagtaccactgaaccaaccaacctcatggccacaatcttctggattgccgcctcgctgctcgagagcgattatgagtacgagtatctcctggcactacggttgctgaacaagctgcttattcatttacctctggacaagtcagaaagccgcgagaagatcgaaaacgtgcagtccaaactgaagtggacgaactttccgggcctgcagcagctttttttaaaggggttcacgtccgcctctacccaggaaatgactgtgcaccttctttcgaagttgataagtgtgagcaaacatactttggtcgaccccagtcagctctcaggctttcctctgaatatactctgtctcctcccccatctcatccagcacttcgacagtcccacccaattctgtaaggaaaccgcctcacgcattgccaaagtgtgtgctgaagaaaagtgccccactctagtgaacttggcccacatgatgtcactctattccacccacacatatagtcgggactgctccaattggattaatgtggtctgtagataccttcatgactctttctctgacaccacattcaatctggtaacttatcttgcggagctgctggagaagggactttcgtctatgcagcagagcctgctgcagatcatttattctcttctgtcacatatcgaccttagcgctgcaccagctaagcagttcaacctcgagataataaagattatcggcaaatacgtccagtctccatattggaaggaagccctaaatatcctaaagctcgtcgtttctcgaagcgcaagtctggtcgtgccctcagacatccccaagacttacgggggcgatactggttcaccggagattagcttcaccaagatctttaataacgtctctaaggagctaccggggaagaccctggactttcattttgatatttctgagacacccattatcgggaacaaatacggagatcagcattccgctgctggccgcaacggcaaacccaaagttattgctgtcacacgatccacaagtagcacttcgagcggttcgaattcgaatgcgctcgtaccggtgtcttggaagagaccccaactctctcagagaaggactcgggagaagcttatgaacgtgctcagtctatgcgggcctgaatctggcctgcctaagaacccctcagttgttttctcttcaaacgaagatctggaggtcggagaccaacagacatcattaatctctacaaccgaggacataaatcaggaggaggaggtggccgtcgaggacaattccagcgaacaacagttcggtgttttcaaagactttgacttccttgatgtcgagctggaggacgcagaaggggaaagcatggacaattttaattggggcgtgaggagaaggtcgttagactcaattgataaaggcgacaccccaagcctgcaagagtaccaatgttcctccagcacaccaagtctaaacctgacaaatcaggaagacacagacgagtcttctgaggaggaggcggctcttacggcaagccagattctgtctcgcacacagatgctgaactccgacagtgccacggatgagacgattcctgaccacccagacttacttctccagagcgaagattctactggttccattacaaccgaggaagttctgcagataagggacgaaacccccacactggaggcctcacttgataatgcgaattccaggttacccgaggatactacttcagttctcaaggaggaacacgtgacgacgtttgaagacgagggttcctatatcattcaggagcagcaggagagcctcgtctgtcaaggcattctcgatctcgaagaaacggagatgccagaacccctagcccccgaaagttaccctgagtctgtctgtgaggaggatgtaacattagctctgaaagagctggacgagagatgcgaggaagaggaggctgacttctcaggactctcatcacaggacgaggaagagcaagacggctttcccgaggtgcagactagtcccctcccaagtccgttcctcagcgctattattgccgcgttccagcccgtggcttatgatgatgaggaagaagcatggcgttgccatgttaaccagatgctctccgacaccgatggcagtagtgctgtgtttacctttcatgtgttcagtaggctttttcagacaattcagcgaaaattcggcgaaatcacgaacgaggcagtctcttttctaggcgacagcctccagcgcattggcacaaaattcaaaagttcccttgaggtgatgatgctttgttccgaatgtccaactgtttttgtggatgccgaaaccctgatgagctgcggacttctggagaccctcaaatttggcgtcttagagctccaagaacacctggatacttataatgttaagcgggaagcagctgagcagtggctcgacgattgtaaacgcacatttggagccaaagaagacatgtatagaatcaacactgacgcacaacagatggagatcctggcagagcttgagctttgtagacgcctgtacaaactccactttcagctactcttgctgtttcaagcctactgcaaactgatcaaccaggtaaacacgattaagaacgaagccgaggtgattaacatgtcagaggaactggcccaactggaaagtatcctgaaagaggctgaatcagctagtgagaatgaggaaatcgacatctccaaagctgcgcagactacaatagagaccgcgatccattcactcatcgaaacattaaaaaataaggagtttatctctgccgtcgcccaggtcaaggcgttccggtccctgtggccatctgatatcttcgggtcgtgcgaggacgaccccgttcaaaccttactgcacatttactttcatcaccaaacacttggtcaaactggcagctttgcagttattgggtccaacttagatatgagtgaagccaattacaagctaatggagctgaatttggaaatcagggaaagtctgcggatggtgcaatcttaccaacttttggcacaagcaaaaccgatgggcaacatggtctccacaggattttag

SEQ ID NO: 30202 - DNA, 1212 bp, Artificial Sequence
  Description of Artificial Sequence: Synthetic coding sequence
atgcccgaacccttagcaccggagagctaccccgagtctgtctgcgaagaagacgtcaccctggccctgaaggaactggacgaacgatgcgaggaggaggaagctgactttagcggcctgtcctcacaggacgaagaggagcaagatgggtttccagaggttcagacaagccccctgccctcccccttcctaagcgccatcattgcagcctttcagcccgtggcctatgatgacgaagaggaggcttggaggtgtcacgtaaatcagatgctatccgataccgatggatcctctgctgtcttcacattccacgtgttttcccgcttatttcagacaatccaaagaaaatttggtgaaattacgaacgaggctgtgtcttttcttggtgactcactccagcgaatagggaccaagttcaagtcgagccttgaagttatgatgctgtgcagcgagtgtcctactgtttttgtagacgctgaaacactgatgtcgtgcggtctactagaaaccctcaaattcggggtgctggaactgcaggagcacctagacacatacaacgtcaaacgcgaggctgccgagcagtggctcgatgattgtaaacgcacgttcggggcaaaagaggatatgtatcggatcaataccgatgcccaggaactggagctgtgtcgccgactgtataaactgcactttcagctgctccttctatttcaagcctattgtaaacttataaatcaggtaaacactattaaaaacgaagccgaggttataaacatgagtgaggaactggcccagctagaaagcatcttgaaggaagcagagagcgcttctgagaatgaagagatcgatatttctaaggctgctcaaaccacaatcgagacagctatccatagcctgatcgaaacattgaagaacaaggaattcatctctgcagtcgctcaggtgaaagcctttcgctctctctggcctagtgatattttcggatcgtgcgaggacgaccccgtgcagactttgcttcacatctattttcatcaccaaacactaggacagaccggctccttcgctgttattggctctaatctagatatgagcgaagccaattacaagctgatggaactgaacttggaaatccgggagagcctcagaatggtgcagtcctaccagctgcttgcgcaggcaaagcctatgggaaacatggtatcaaccggtttctag

SEQ ID NO: 30203 - DNA, 9042 bp, Artificial Sequence
  Description of Artificial Sequence: Synthetic coding sequence
atgagcaacatcaccattgatcccgatgttaagcctggtgaatatgtgatcaagagtctttttgctgagttcgctgtccaggccgaaaagaaaattgaagtggtgatggcagaacctctggagaaactgctgtctcggagccttcagcgtggggaggacttacagtttgatcaattgatctctagcatgagctcagtggcagagcattgtttaccctctctcctgcgtacgttgttcgactggtacaggaggcagaatggcaccgaagacgagtcttacgagtatcgtcctagatcaagtactaaatccaaaggcgacgaacaacagcgggagcgggattacctcctggagcgtcgagacctcgccgtggattttatcttttgcctcgtgttggtggaggtgttaaagcagatcccagtccacccagtgccagatcctctggttcacgaggtcctgaatctggcattcaagcacttcaaacacaaagaagggtattctggcacgaacacaggcaacgtgcatataatcgcagacttatatgcagaggtcatcggggttttggcccaaagtaaattccaggccgtgcgaaaaaagttcgtgacggaacttaaggaactgcgtcaaaaggagcagtctcctcatgtggtgcagagcgtcatctcacttatcatgggcatgaaattcttccgcgtgaaaatgtatccagtggaagatttcgaggcttcctttcagttcatgcaggaatgtgcgcagtattttctggaggtgaaagacaaagacattaaacacgcactggcaggcctgtttgttgaaatcctcattcctgtggctgccgcggttaagaatgaggtgaatgtcccctgtctcaagaactttgtcgaaatgttatatcagaccacttttgaactgtccagccgaaagaagcattccttggcgctctatcctctgatcacctgcctgctctgtgtttcacagaaacagttttttctgaataattggcatatattcttgcagaattgcttgtctcatctgaagaacaaggatcctaagatgtcccgagtcgccctggagagtctgtacaggcttttatgggtgtacgtaatcagaatcaagtgtgaaagcaacaccgtgactcaaagtcgcctgatgtctatcgtctctgccctctttccaaagggttcacgatccgtcgtacctcgggatactcctttgaatattttcgttaagatcattcagtttatagctcaggaaagacttgactttgctatgaaagagataatcttcgacttgttgagcgtaggcaaatctacaaagacattcaccatcaaccctgaacgaatgaacatcggactgcgagtgttcctagtgatagcagacagtctacaacagaaggacggcgagccccctatgccaacaacgggggtgatacttccctctggtaacactctacgcgtgaaaaaaatcttcttgaataaaacccttacagatgaggaggcaaaagtaattggcatgtcagtgtattaccctcaagtgaggaaggctctggacagcattctgaggcatctcgacaaggaagttgggagacccatgtgtatgacaagcgtccagatgagcaacaaggagcctgaagatatgattaccggcgagcgcaagcccaagatagatctgtttagaacatgcatcgctgccatacctcgactgatacccgacggaatgagtcggaccgacctcatcgagctgctggcgaggctgaccattcacatggatgaagagctgagagctctggcctttaataccctccaggctcttatgctcgattttccagattggagggaggatgtgctaagcgggtttgtatactttatcgttcgggaagtcacagatgtgcatccaaccttactcgataatgctgtgaaaatgcttgtgcaacttatcaaccagtggaaacaggccgctcagatgcacaataaaaatcaagatacacagcacggcgttgccaacggtgcctctcatcctcctcctctagaacgctcaccgtatagtaacgtcttccatgtggtggaaggttttgcactggtgatcttgtgtagctcacgacctgccacccgtaggctggcagtttctgtactgcgggagataagggccctgtttgctctactcgaaatacccaagggtgatgatgagctagccattgacgtaatggaccgcctgtctccttccatccttgagtcattcatccacctgaccggtgcagatcagaccaccctgctgtattgcccaagtagtatcgatctccaaaccctcgctgagtggaacagctctccaatcagccaccagttcgacgtgatctctccatctcatatctggatctttgcccacgtgactcaggggcaggacccatggatcataagcctttcatcgttcctcaagcaggaaaacttgccaaagcattgtagtacagccgtgtcttacgcttggatgtttgcatatactagactgcagttgttatccccacaagtagatattaacagtccaatcaatgcgaagaaagttaacacaaccacatcaagcgattcctatatcgggctctggagaaattacctgatcctgtgctgttctgccgcaacgagtagttcctccaccagtgcagggtctgtacggtgttctccgccagaaactttagcttccactcctgatagcggatacagtattgacagtaagatcatcggcataccctccccatccagcctattcaagcatattgttcctatgatgcgctccgagtctatggaaatcactgaaagcctagtcctgggattaggccgcactaatcctggagcttttagagagctcatcgaagagttgcatcctatcattaaggaagccctggagcgcagacctgagaacatgaagaggcggcgtaggcgcgacattctgcgagtccagctggtaagaatctttgagctactcgccgatgccggggtgatctctcattccgcaagtggcggcttggataatgagacgcattttttgaacaacaccctcttagaatacgtggacctcactagacaactgctcgaggccgaaaacgaaaaagattccgatacactaaaagacattcgctgtcacttctccgcactggtcgctaacatcatacagaacgtgcctgtgcatcaacgcagaagcattttccctcagcagagtctgcgccactccctctttatgttgttttcgcactgggcaggacctttcagcataatgttcacacccctggataggtatagcgatcggaatatgcagataaatcgccaccagtattgcgcactgaaagcaatgagcgctgtcctctgttgtgggcccgtcgccgacaacgttggcctttcctctgatgggtacctgtacaaatggctggataatatcctggacagtctggataaaaaagttcaccaactgggttgtgaggctgtgacactgctcttggagctgaacccagaccaaagtaatcttatgtactgggccgtcgacaggtgctatactggctccggaagggtggccgccggctgcttcaaggccatcgccaatgtcttccagaacagggactaccagtgtgacactgtaatgcttctcaaccttatcctctttaaggctgctgactcttctaggagcatttacgaggtcgccatgcagcttttgcagattctagaacctaagatgtttcggtatgcccataagctcgaggtccagcggaccgacggggtgttatctcagttatcacctctgccccacctgtactccgtttcctattatcagctctcagaagagcttgcacgcgcctatccagagctgacattggcaattttcagcgagatttctcaacgcattcaaacggcgcacccggccggtcgccaggtcatgctgcattaccttctcccttggatgaacaacatcgaactggtcgacctcaaaccactgcccacagccaggcggcatgacgaggatgaagatgactcactcaaggatcgtgagctaatggtaacctcacggcggtggctgagaggagaagggtggggctctccgcaggccaccgcaatggtgctaaacaacttaatgtatatgaccgcgaagtacggtgatgaattagcctggagtgaagtggagaatgtgtggacgactctggcagatggttggccaaaaaacttgaagatcatcctccactttcttatatcgatttgtggggtcaactcggagccctctctgctgccgtatgtgaagaaggtaatcgtctatctcgggcgagacaaaacgatgcagttacttgaagaacttgtgagcgagctccaactgactgatcccgtcagcagcggcgttacacacatggataaccccccttattaccgcattacctctagctacaagatcccatcagttactagtggtacaacgagctcctcgaacaccatggtggcccccacagacgggaatcccgataataaacctataaaagagaacatagaggagtcttacgttcacctggacatatacagcggattaaactcccatctgaaccgccaacatcatcgcctggagtcacgatacagcagctctagtggcgggtcttacgaagaggagaagtccgacagcatgccactctatagtaactggaggctcaaggtcatggagcacaaccaaggcgagcctcttccctttccccccgccggcggctgctggtcgcccctagtcgactatgttccagagacgagcagcccgggcctccccctccaccgctgtaatatcgcggtgattctgctgaccgacctgatcattgaccactccgtgaaggtcgagtggggatcttatctgcatctcctgctgcacgccatcttcatcggctttgatcactgtcatcccgaggtgtacgaacactgtaagaggcttctgctacacctgctcatcgtcatggggcccaattcaaacatccgtactgtagcaagcgtgctcctcaggaataaagagttcaacgagcctcgtgtgctcactgtcaaacaggtggctcacctagattacaattttactgccggcatcaacgacttcatccctgactaccagcctagtcccatgaccgactctggactttcgtcctcttccacatcctcctcgatcagcctgggaaacaattcggcagcaataagccacctacacacgaccatcctgaatgaagtagatatcagtgttgaacaggacgggaaagtgaagacgctcatggagtttatcacctcccgcaaacggggcccactgtggaatcatgaggatgtatcagctaagaatccgagtattaaatctgctgaacagttgacaaccttcctaaaacacgtggtgtcagttttcaaacagtcgtcctcagaagggatccatctggagcaccacctttccgaggttgccctccaaacagctctgagctgcagttcccgtcattatgctggacgttcttttcagatctttagagccctaaaacaacccttgactgccacgaccctctccgacgtactttctcgcctggtggagacagtgggagatcccggggaggacgcccagggattcgtgatcgaactcctccttacacttgaatccgccatagatacactagcagaaacaatgaagcattatgatctactgtccgctctcagtcagacttcatatcatgacccaatcatgggtaacaagtatgccgcaaatcgcaaatcaactggccagcttaaccttagtacttcccctatcaacagctcctcctatctgggatataactccaatgccagaagtaatagcctgcgactgagtctcatcggggatcgtagaggcgaccgaagaagaagtaacactctggacattatggacggccggatcaaccacagttcctcccttgcgagaactagaagtttatccagcctccgcgaaaagggaatgtatgatgtgcagagcaccacggagccaaccaatctgatggctactattttttggatcgctgcatccctgttggagagcgactacgagtatgaatacctccttgcacttcgcctccttaacaaactgcttatccatctcccactcgacaaatctgagtcacgcgagaagatagagaacgtccagtcaaagttgaagtggaccaattttcccggccttcagcagctgttcctcaagggtttcacatcagcgtctacacaagaaatgacagtgcacttattgtcgaaacttatatcagtgagtaagcatactctcgtggatccaagccagctgtccgggttcccccttaatattctctgcctattgccccatttaatccagcatttcgactcccccacacagttttgcaaggaaacagccagccggattgcaaaggtttgtgctgaggaaaaatgtccaactttggtgaacttagcgcatatgatgtctctgtactctactcatacctactcccgggactgcagcaactggattaatgtggtctgcaggtatctccatgattccttctcagacacgacttttaatcttgtgacatatctcgctgagttgctcgaaaaaggactgtcctccatgcagcaatccctgctccagattatttattcactccttagccacatcgacctgtctgccgctcccgccaaacaatttaatctggagattataaagatcatcggcaaatacgtgcaaagtccctattggaaagaggcgctcaatattctcaagctcgtggttagccgaagcgctagcctggttgtgccatcagatatccccaagacctacggcggcgatacaggctccccagagatctccttcactaaaatctttaacaacgtgtcaaaggaactccctggcaagacacttgattttcattttgacatatctgaaacgcccataatcggaaacaagtatggggaccaacatagtgctgcgggtcgaaatggtaagcccaaagtgattgctgttacaagaagcacctcatcaaccagctccggtagcaattccaacgccctggtgcctgtaagttggaagaggccgcagctcagccagcgtagaacccgcgaaaagttgatgaacgttctctccttgtgcggccccgaaagtggcctgccaaagaacccgtccgtggtgttcagcagtaacgaggacttggaggtaggagatcagcaaactagcctgatcagtacgacagaggatattaatcaggaggaggaagtcgcggttgaggataatagttcagaacagcagttcggcgtgtttaaagatttcgattttctggacgtggagctggaggacgccgaaggggaatcaatggacaatttcaattggggagtgcgacgccggagtctggatagcatcgataaaggagatacaccctctttgcaggaatatcagtgctccagttctactcctagtttaaacctgacgaaccaggaagataccgacgaaagctctgaggaggaggccgctttgactgcgagtcagattctgagtaggacgcagatgctgaattccgactcagcaaccgatgaaacaataccagaccatcccgatcttcttcttcagagtgaggactccactggcagcataaccacagaggaggttctgcagattcgggacgaaacccccaccctcgaggccagtctcgataatgcaaattcacgattgcctgaggataccacgagcgtgctaaaggaagagcacgtgactacctttgaagacgagggctcctatatcattcaggaacagcaggaatcactagtctgtcaagggattcttgacctcgaggagacagagatgccggagcccctggcgcccgaaagctatccggagtctgtctgcgaagaagatgtcacccttgcacttaaagaactggacgagcgttgtgaggaggaggaagcggactttagcgggctatcctcgcaagacgaggaggaacaagatggatttcctgaagttcagaccagccccttgcccagtcctttcctgtcggccattatcgctgccttccagcccgtggcttacgacgacgaggaggaggcctggcgttgccatgtcaatcagatgctcagcgatacagacggctctagtgccgtgttcactttccatgtgttttcaagacttttccagaccatccagaggaagtttggtgaaatcaccaacgaagcagttagctttttgggcgactctctccagaggatcggtacaaaatttaagagcagtctggaggtgatgatgctgtgttccgaatgcccaactgtatttgtcgatgccgaaactctaatgtcctgcggtctactggaaacactcaagttcggcgttctcgaacttcaggaacacttggatacgtataatgtgaagcgtgaggccgctgagcaatggctggatgactgtaagaggaccttcggggcaaaagaggacatgtaccgtatcaacacagatgctcagctgaacgagattctggtggagctcgaactctgccggcgactatacaagctgcactttcagctgctcctgctttttcaggcctactgcaaactgatcaaccaagttaatacaatcaagaacgaagccgaggtgatcaatatgagtgaagagttggctcagttggagagcatactgaaggaagcagagagcgcctccgaaaacgaggagatcgatatttctaaggccgcccagactaccatcgagaccgctattcatagcttaatcgagaccctaaaaaacaaagagttcatttcagcggtggcacaggtcaaagctttcagatccctatggcccagcgacattttcggttcctgtgaggatgaccccgtgcagacattactgcatatttactttcaccaccagactctcggacagaccggttctttcgcggtgattggatcgaatctggatatgtctgaagcaaattataagttgatggagttaaatctcgagattcgggagagcctgaggatggtccagagttaccagctcctggcgcaggccaaacctatgggcaacatggtttcaacgggcttttag

SEQ ID NO: 30204 - DNA, 549 bp, Artificial Sequence
  Description of Artificial Sequence: Synthetic coding sequence
atgcgcgagcccatttatatgcactccacaatggtatttctgccatgggaattacatactaaaaagggccctagccctccggaacagttcatggccgtgaagctgtctgactcccgcattgcattaaagtctgggtatggaaaatatttgggcatcaatagcgatgagctggtcggccactcagacgctatcggcccacgagagcagtgggagcccgtttttcagaacgggaaaatggcccttctggccagcaactcttgtttcattcgctgcaatgaggctggcgacattgaggcaaagtcaaaaactgctggggaagaggaaatgatcaagattcgctcatgcgccgagaaagagacgaaaaaaaaggacgacataccagaggaggacaaagggaatgttaagcagtgtgagattaactacgtcaaaaagtttcagtctttccaagaccataagctgaagatcagtaaggaggaaagtaaaattctcaaaaaagctcagaaagatggcttcctgcacgagacccttttggaccgcgaacccaattag

SEQ ID NO: 30205 - DNA, 549 bp, Artificial Sequence
  Description of Artificial Sequence: Synthetic coding sequence
atgagagagcctatttacatgcattccaccatggtattcctcccttgggaactgcatacaaagaagggaccttcgccccctgaacagtttatggcagtaaaacttagtgacagccgtatagctctgaagagcgggtacgggaaatatcttgggatcaatagcgacgagctggtgggccattctgacgccatagggcctcgcgagcagtgggaaccagtgttccagaacgggaagatggccctactagccagcaactcctgctttatccgctgcaatgaggcaggtgatatagaagcaaagagtaagaccgccggagaggaagagatgatcaagatcaggtcgtgcgctgaaaaagagacaaagaagaaagacgacattcctgaagaggataaaggaaatgtgaaacagtgtgaaattaattatgttaaaaaatttcaatctttccaggaccacaagctcaaaatttcaaaggaggagagtaagatcttgaagaaagcccaaaaggacgggttcctgcatgagaccctcttggacagggagcctaactag

SEQ ID NO: 30206 - DNA, 369 bp, Artificial Sequence
  Description of Artificial Sequence: Synthetic coding sequence
atggatgaagggacgtatatccacgccctggacaatggcctgttcaccctgggtgcaccacacaaagaagacatcgacgagggaccaagtccaccggagcagttcatggccgtgaaactgagcgactcccgcattgcgctaaagagtggatacggtaagtatctcggtataaattcagacgaactcgtcggccactctgatgctattggtccgcgggagcagtgggaacccgtttttcagaatgggaaaatggctctattggcatccaactcatgtttcattaggtgtaacgaagcaggggatatagaggctaaaagtaagacagccggagaggaagaaatgataaaaatgttaagccaccacctttag

SEQ ID NO: 30207 - DNA, 837 bp, Artificial Sequence
  Description of Artificial Sequence: Synthetic coding sequence
atgggcaagggaaacgaggactcagacctgcactgcagctcaatccaatgctcaactgatcaacctcccttccagcagataagtttcactgagaagggttcagatgagaaaaagccatttaaggagaaaggaaagaccgcttttagtcattccagcgagaaacacattcagaggcaaggttccgagcctaaccccaataaagagaattctgaggaaactaagctgaaggctgggaattccacggccggaagtgagcccgaatcttcctcctaccgcgaaaattgccgaaagcggaagatgtccagcaaggactcttgccaggatactgccggaaactgccccgaaaaggagtgcagcctctccctgaacaagaagagtcggagcagtacagccgtacacaatagcgaaattcaggagacttgtgacgctcaccacagagggcacagcagggcttgcactggacattctaagcgtcaccggagcagagcacttggagttcaaacaccctcaatccggaagtcactggtcacgagtgtccgtgcaatgagtgaagctgtctaccaggatctagcacaagtctgggctcaacagatccactctcctctcacatgcgaacaactcacgttactgacccgcctcaggggccccctttgcgcccaggtccagacgctctacagcatggccacccaggctgcgtacgtgtttcctgcagagtcttggcttgtcccggctacactcccgggtccaggcgaatccgcgttggatcgggaagcacaccccttccccggccaggaaatcacagaaaccgttagtggatctgacgaagctaaactctag

SEQ ID NO: 30208 - DNA, 849 bp, Artificial Sequence
  Description of Artificial Sequence: Synthetic coding sequence
atgggaaagggaaacgaggacccagatctccactgttcatccatccagtgtagcaccgaccaaccaccattccagcagattagttttactgagaagggctccgatgaaaaaaagccctttaaaggtaagggaaagacagccttcagccacagtagcgaaaaacacactcagcgccaagcagggagcgacccaaaccccaataaggagaacagtgaagagactaaactcaaggccggtaactctactgctggctccgagcccgaaagctctagctaccaggagaattgtcggaaacggaaaatttcttctaaggatatctgccaggaccgggctggaaactgcccagaagaggagtgcaatctgactttgaataagaaatccagatcttctacagctgtgcataattctgagattcaggagacttgtgacgcccaccacagggggtcatcacgggcatgcaccggcagatcaaagcggcataggagccgagccctcgaagttcaaacgcccagcctgcgtaagtctttggtgacaagcgttcgggctatgagcgaggctgtctaccaggacctagctcaagtgtgggcacagcagattcacagtcctttgacctgtgagcagctcaccctgctgactcggctgcggggtccgctctgtgcccaggtgcaaaccctctatagcatggctacccaagctgcctatgtctttcctgctgagagctggctcgtccccgccaccctgcctggcccaggagactcggccctggaccgggaggcacatccattcccaggccaagaaattacggagcctgtgtctgggagtgacgaggcaaaactgggagcaccttag

SEQ ID NO: 30209 - DNA, 984 bp, Artificial Sequence
  Description of Artificial Sequence: Synthetic coding sequence
atgggccgtacctctaaggacaagagggacgtgtactatcgcttagctaaagagaatggctggagagcacgcagtgcatttaaattgcttcagctcgataaggagttccaactatttcagggtgtgacccgggccgtcgacctgtgcgcggcccccggtagttggagccaagtgcttagtcaaaaaattggggggcaggggagcggccacgtggttgctgtggacctgcaggcaatggccccactgcctggtgtcgtgcagatccagggcgatatcacccagctgagtaccgccaaggagataatccaacacttcaaaggctgtcccgccgaccttgtggtctgtgacggcgcccccgatgttacaggactgcacgacgtggacgaatacatgcaggcccaattgcttctggctgccctgaacatcgccacacatgtgctaaagcccggagggtgctttgttgccaagatcttcagggggcgcgatgttaccctgctttactcacagctacaagtctttttttcttccgttttgtgcgcaaaaccgcggtcgagtaggaatagcagtatagaagccttcgcagtgtgccaaggctacgatccacctgaaggatttattccggacctgtcaaagcccctgctcgatcattcttacgatttcaaccagctggacggccctaccaggattatagtcccatttgtcacatgtggtgatctgtcaagttacgatagcgacaggtcttaccctctcgaccttgaggggggcagtgagtataaatacacacctcccacccagccccccatcagtcccccataccaggaggcatgcaccctcaaaagaaagggtcagctggcaaaagagataagacctcaggattgtcctatcagccgggtagacacattcccgcaacccctcgccgctccacagtgccatacgctgctggctcccgagatggaggacaatgaaatgtcttgctccccttag

SEQ ID NO: 30210 - DNA, 984 bp, Artificial Sequence
  Description of Artificial Sequence: Synthetic coding sequence
atgggccggacctccaaagacaagcgggacgtctattaccggctggcaaaggagaatggctggcgcgcccgtagcgcattcaaactactgcagttagataaagagttccaattatttcagggggtaacaagagcagtcgacctctgcgccgcacctgggtcatggtctcaggttctatcacaaaagatcggcgggcaggggagcgggcatgttgtggccgtcgatctgcaggccatggctcctttacccggcgtagtgcagatacaaggagacattacacagctgtctactgctaaggaaataatacagcatttcaagggttgccctgccgatctcgtcgtgtgcgacggcgcccctgacgtcaccggtctgcacgacgtggatgaatacatgcaggcccaactgctactggcagcccttaacattgctactcacgttctgaaacctggcggctgctttgtcgctaagatctttagaggtcgcgacgtgactttgctgtatagccagttacaggtattcttctccagtgtattgtgcgctaagccaaggtcatctcgaaattcctctatcgaggcgtttgccgtgtgtcagggatatgacccacccgaagggtttatccccgacttaagtaagccgctccttgaccacagttacgattttaatcagctagacggacccaccaggatcatagtccctttcgtgacctgcggcgatctttcctcctatgactctgaccgcagttacccgttagacctcgagggggggtctgaatacaagtacaccccacccacacaaccaccaatatctcctccgtaccaggaagcatgcacgctcaagaggaaaggccagctggctaaggagatccgcccccaggactgccctatatctagagtcgacaccttcccacagccgcttgccgctccccagtgtcatactcttctggcgcccgaaatggaggacaacgagatgtcatgttccccttag

SEQ ID NO: 30211 - DNA, 411 bp, Artificial Sequence
  Description of Artificial Sequence: Synthetic coding sequence
ttacttggggagagggctattcctcgcgcaggtagtcaggcaggatggcggcccactctggggtccgtgggcggcagggtagggtcaccgtcctctgctgagtgttgcagaccctttcctggccagcggagatggaattttgtggctctgcagccaccggcaaggcgttgggacctgaccatgttgccccggctagttctcaatagctgggcccaagccattcttcctcctcaaccccccaaggtgttgggattgcaggatcccggggcatccttcggcagccgcctacaccccgcactggagagatccccagggatgatctacagttgggctgtcttcctgtatcctggcgtccatcccgtgcatcctcgaaacacagacttaatcaccgtgactaaaagcgacggatag

SEQ ID NO: 30212 - DNA, 450 bp, Artificial Sequence
  Description of Artificial Sequence: Synthetic coding sequence
atgaagcctgcgggtaacggattcccaagccccttggctggacccggctcccgccgcggttgtgtcccaggcctcaccacctggatccgggcgagagctcgggagactggaagtagaaggggccgaaatgtcttctcccccgagcgtgctgccgggtcaggcggctgtttctgctcaggaagaatcccccgcgtatcagccgtcgatgcgttgagggttgccggtgctcggagagctgcagtctcccgcgggaaagcaggggtacctctgcggtatcgggagcgacatctagaactgagtgagtggcctagaaagcccgctcgcgcccacttccctgccaggaccggatgctggtggttctggtggctgctcagtggtggaactcctgggaccagcaaaggtgggttcatctggctgtatctgacctggcaattcttgctgaacaagtag

SEQ ID NO: 30213 - DNA, 747 bp, Artificial Sequence
  Description of Artificial Sequence: Synthetic coding sequence
atgggcatcatggctgcatccaggcctctcagccggttctgggaatggggtaaaaatattgtgtgtgtcgggagaaattacgccgaccatgtaagagagatgcggagtgcggtattgtccgagccagttctctttctgaagccatcgacagcctacgcccccgagggaagtcctattctgatgcccgcctataccaggaacttgcaccatgagttggagctcggcgtagtgatgggcaaacgctgtcgggccgttccagaggccgctgctatggactacgtgggggggtacgctctctgcctggatatgaccgccagggacgtgcaagacgaatgtaaaaaaaaaggtctgccttggaccctggccaagtcctttacggcatcatgccccgtgagtgcatttgtgccaaaagaaaagataccagaccctcacaaactcaagctttggctgaaagtgaacggggaacttcgccaggaaggagaaaccagctcgatgatttttagtatcccttacattataagctatgtgtctaagattataacactggaggagggcgatattatccttactgggacgcctaagggtgtgggaccagtgaaggagaacgacgagattgaggcaggcatacacgggctccgtcagggcctaacactgtcacccaagctggagtgcagctctgcgataaccgcgcactgtagtcttgagcttccgggaagctcgaatcctcctagtgccagtagattctag

SEQ ID NO: 30214 - DNA, 681 bp, Artificial Sequence
  Description of Artificial Sequence: Synthetic coding sequence
atggggataatggcggcgagccggcccttgtcaaggttttgggagtggggaaagaatatcgtctgtgtcggcaggaactatgctgaccacgttagggagatgagatctgccgttctgtcagagccagtgttgtttctgaaacccagcacagcctacgcccccgaagggtcaccaatcctcatgcccgcctacacgcgtaacctacaccatgagctcgagctaggggtggttatgggcaaacgctgccgcgccgtgccggaggcggccgcaatggattatgtcggaggatacgccctctgcctggacatgaccgcgcgcgatgtgcaagatgagtgtaagaagaagggtctgccgtggactctggccaagtctttcacagcctcctgccctgtttcagcttttgtcccaaaggagaagatacccgaccctcataagctcaagctgtggttgaaagtcaatggagagctacgtcaggaaggagagaccagctcaatgatttttagcatcccctatattattagctacgtctccaagattattactctggaagaaggagatattatccttacagggactcctaaaggagtcggccccgtcaaggagaatgatgagatcgaagctggaatccacgggctgccaaaggtgtctagtgccacattgcctgtgcgcctccaggaatag

SEQ ID NO: 30215 - DNA, 675 bp, Artificial Sequence
  Description of Artificial Sequence: Synthetic coding sequence
atggggataatggctgcctctagacccctgagcaggttttgggagtgggggaagaacatcgtgtgcgtcggtcgcaactatgcagaccatgtgcgggagatgcgatccgccgtgctgagcgagcccgtgctgttcttgaagcccagcaccgcctacgcccccgaaggaagcccaattctgatgccggcctatactcgcaatctccaccacgagcttgagctgggtgtggtgatgggaaagagatgcagagcagtgcccgaggccgccgcaatggattacgtcgggggctatgcattatgtcttgacatgacagcaagagatgtccaagacgaatgcaagaagaaaggtctgccctggactttagcaaagtctttcacggcatcgtgcccagtgtctgcttttgtgccgaaagagaaaattcctgacccacacaaattgaagttgtggttgaaagtcaatggggagcttcggcaggagggggaaacctctagcatgattttttccattccctatatcatctcctacgtatctaagatcattaccctggaggagggagacattatcctgaccggaacaccgaaaggggttgggcccgttaaggagaatgatgagattgaagccggaatccacgggctcgtgtcaatgacttttaaagtcgagaagcccgaatactag

SEQ ID NO: 30216 - DNA, 1134 bp, Artificial Sequence
  Description of Artificial Sequence: Synthetic coding sequence
atgtataccttcgtagttagggatgagaacagcagcgtttatgcagaagtttctcggctcctgctggccacaggacactggaaaagactgcggcgcgataatccaagattcaacctcatgctcggagagaggaatagactacctttcggcaggctcgggcacgagcctggtttagtacaactcgttaactactaccggggtgccgataagctttgcaggaaggctagtctcgtgaagctcatcaagaccagccctgagttagccgaatcctgtacatggttccctgaatcttacgtgatctaccctaccaatttaaagaccccagtggcaccggctcagaacggcattcaacctcccatcagcaatagtcgcaccgacgagagagagttcttcctggcaagttataacagaaaaaaagaggatggcgagggcaatgtctggattgccaaatcctccgcaggggccaaaggtgagggaatcctaatctcatccgaggcatccgagctgctggatttcatcgacaaccaggggcaggtgcatgttattcagaagtatttggaacaccctctgctgcttgagcccggacataggaagtttgacattcgatcttgggtgctggtggaccaccagtacaacatttatctttacagggaaggcgttttgagaacagcttcagagccataccacgtcgataattttcaagataagacgtgccatctcaccaaccactgcattcagaaagagtattcaaagaactacggaaagtacgaagaaggcaatgagatgtttttcaaggagttcaaccagtatctcacctcggcacttaatattacactggagagtagcattctgttacagattaagcacatcatacgcaactgtctgttatcagtggagcctgcaatctctactaagcacctgccttatcaatcattccaactgtttggtttcgatttcatggtcgatgaggaactgaaagtgtggctcattgaggtgaacggggcacccgcatgcgcacagaaactgtatgcagagctgtgtcagggtattgtcgacatagcgattagctcagtgtttcctcctcccgatgtggaacagcctcaaacacagcccgctgcttttatcaagctgtag

SEQ ID NO: 30217 - DNA, 384 bp, Artificial Sequence
  Description of Artificial Sequence: Synthetic coding sequence
atgctggtgtccggccgacgcaggttgctgaccgttctcctgcaggcccagaagtggccttttcaaccatcccgagacatgcggctggtgcaattccgggctcctcacctcgtaggcccgcacctggggctcgagactgggaacggaggcggggtgattaacttgaatgcttttgatccaacgctgcccaaaactatgactcagttcctcgagcagggcgaggcaacactctctgtggccagaagagctctggctgcccaactgccagtgctaccccgttcggaggtcactttcttggcccccgtcacacgaccggacaaggtcgtatgcgtgggaatgaactacgtggatcactgtaaagagcagaacgtgcccgtgccatag

SEQ ID NO: 30218 - DNA, 246 bp, Artificial Sequence
  Description of Artificial Sequence: Synthetic coding sequence
atgctggtgagtggtcggaggaggttgcttacagtgctcctacaggctcagaaatggcctttccagccttcaagagacatgaggcttgtgcagtttcgggcaccccacctggttgggccccacctcggcctcgaaacagggaacgggggaggcgtgataaacctcaatgcattcgatcccacactaccaaagacaatgactcagtttcttgagcagggcgaggcgaccctgagcgtggccaggtag

SEQ ID NO: 30219 - DNA, 945 bp, Artificial Sequence
  Description of Artificial Sequence: Synthetic coding sequence
atgctcgtgagtggccgacgtcgtcttctgacagtcctgctccaggcccaaaaatggccctttcagccatctcgcgatatgaggctcgttcagttcagagccccacatctagtcgggccacacctgggtctggagacaggaaatggtggtggagtgattaatctcaatgccttcgacccaacactccccaagactatgacccagtttctagagcagggggaggcgacactgtccgtggcccggagggctctcgccgcacagctgccagtgttaccccgatccgaggttaccttccttgctcctgtcactcgaccagataaagtggtgtgcgtgggcatgaactacgttgatcactgcaaggaacagaacgtgcctgtgcctaaggaaccaataatctttagtaagttcgcctcgtcgattgttggtccatacgatgaggtggtgttgccacctcaaagtcaggaggtagattgggaggtcgagcttgctgtggtcatcggcaagaaaggaaagcacatcaaggcgaccgacgcaatggcccacgtcgccggtttcaccgttgcccacgacgtctccgccagagattggcagatgcggaggaacggcaagcagtggctactgggaaagacattcgacaccttctgcccactgggacccgccctcgttaccaaagattcagtagccgacccccacaacttaaagatatgttgtagagtcaacggagaggtggtacaatctggcaacaccaaccagatggtcttcaaaacagaggacctaatcgcatgggtgtcgcagtttgtgaccttctaccctggggacgtcattctgactggcacaccaccaggggttggcgtctttagaaaacctccagtgttcctcaaaaaaggcgatgaggtccagtgtgaaatcgaggagctaggcgtgatcattaataaagttgtgtag

SEQ ID NO: 30220 - DNA, 945 bp, Artificial Sequence
  Description of Artificial Sequence: Synthetic coding sequence
atgctggtctctggtcgtcggcggctgctgacggcattgttgcaagcacagaaatggccatttcagccgagtcgtgatatgcggctggtacagtttagggcgccacatttagtgggcccacaccttggtcttgaaacaggaaacggcggtggggtgatcaatcttaatgcctttgaccctactttgccaaaaactatgactcagttcctggagcaaggcgaagcaactctgtcagtcgctagacgagcactggctgcgcagcttccggtccttccctggtccgaggttacttttctagcccccgtcacctggcctgataaggtagtttgtgttgggatgaactacgtggatcattgcaaagaacagaatgtccccgtgcctaaggagccaatcatcttttccaagtttgcatcctccatcgtgggcccctacgacgaggttgtgctgccaccccagtctcaggaagtggattgggaagtggagttggccgtggtgatcggcaagaaaggaaaacacattaaggccactgatgcgatggcccacgttgccggcttcacagttgcccatgacgtgtctgcaagagactggcttactagacggaatggcaaacaatggcttctgggcaagaccttcgacaccttctgtccactggggcccgctctcgttactaaagattccgtggctgatcctcataacttgaaaatctgctgtcgtgtaaacggggaagtagttcagtcatccaacactaatcagatggtctttaaaaccgaggacctgatagcttgggtgtcacaattcgtgaccttctaccccggagacgtgattctgaccggcactccacccggtgtcggggtgttcagaaaaccaccagtcttcctgaaaaaaggagatgaggtacagtgcgaaatagaagaactgggcgtaattattaataaggtggtgtag

SEQ ID NO: 30221 - DNA, 945 bp, Artificial Sequence
  Description of Artificial Sequence: Synthetic coding sequence
atgttagttagtggccggaggagactgctaacagccctgttgcaagcccagaaatggcctttccagccatctagagatatgcgtctggtacagtttcgtgcacctcacctggtggggccacaccttggactggagaccgggaacgggggaggggtgattaacctgaacgcttttgatcccaccctgccgaagaccatgactcagtttctcgagcagggggaggcaacactgtcagttgcccgcagagcactggctgctcagctccctgtcctcccttggagtgaagtgacattccttgccccagtaacatggcctgataaggtggtgtgcgtaggcatgaattacgtcgaccactgcaaggaacagaacgtgcccgtaccaaaagaacctattatctttagtaaattcgcctcttccatcgtgggcccttacgatgaagtcgtactgccccctcagtcccaagaagtggactgggaggtggagctcgcggtagtaatcggcaaaaagggcaaacacatcaaggccactgatgctatggcccatgtggcaggctttactgtggcgcacgatgtgtccgcgcgcgattggttgactagacgcaacggcaagcagtggttgctgggtaagaccttcgatacgttctgccccttgggtcccgcgttggtgacaaaggattcagttgctgacccccacaatctcaagatctgctgtcgtgtaaatggtgaggtagttcagtcaagtaataccaatcaaatggtgttcaagaccgaggacctgattgcctgggtcagccagttcgttactttctaccccggcgatgtgatcctaacaggcaccccgccaggcgtcggggtcttccgtaaacctccagtcttcttaaagaagggtgatgaagtgcagtgtgagattgaggaattaggtgtgatcatcaacaaggtggtttag

SEQ ID NO: 30222 - DNA, 945 bp, Artificial Sequence
  Description of Artificial Sequence: Synthetic coding sequence
atgctggtcagtggccggcggaggctcttgacagctctgctgcaggcccagaagtggccttttcagccaagcagggatatgcggctggtgcagtttagagcaccacatctggtaggcccacacctgggactggaaacgggcaatggggggggagtgattaatctgaatgcgttcgacccgaccctgcctaagaccatgacccagttcttggaacaaggggaagccaccttgagtgtcgcgcgcagggctcttgcggcgcagctgccggtgctcccatggtcggaagtcaccttcctggcccccgtgacctggccggataaggtagtgtgtgtggggatgaattacgttgatcattgtaaggaacaaaatgtccccgtgcctaaagagcccatcattttttctaaattcgcatcatcaatcgtgggcccatacgacgaagtcgtgttgcccccccaaagtcaggaggtggattgggaggttgaacttgctgtggtgatagggaagaagggcaagcacattaaagccaccgacgctatggcgcacgtcgcaggctttacagtcgctcacgacgtctctgcaagggactggctgaccaggcgcaatggaaagcagtggcttctgggaaagacatttgatacattctgtcccctgggccccgccctagtgaccaaggacagcgtcgccgatccgcataaccttaagatctgctgccgggttaacggagaagtggtgcagagctcaaatactaaccaaatggtgttcaaaaccgaggacctcatcgcatgggtgtcccagttcgtcacattttatccaggcgatgtgatactgaccgggactccaccaggcgttggggtgttcagaaaaccaccagtcttcctgaagaaaggggacgaggtgcaatgtgaaatagaagagctgggcgttatcatcaataaagttgtgtag

SEQ ID NO: 30223 - DNA, 468 bp, Artificial Sequence
  Description of Artificial Sequence: Synthetic coding sequence
atggccacacgcaaccctccaccgcaagactatgaaagcgatgacgacagctatgaagtgctcgatctgacagaatacgcccggaggcaccagtggtggaatcgagtgtttgggcactcttctggtccaatggtggagaaatattcagtggccacccaaatcgtgatgggtggggttacaggctggtgtgcaggcttcctcttccaaaaagtgggtaagctggccgccacagcggtcgggggtggcttcctcctgctccagattgcaagccactcaggatacgtccagatcgactggaagagggtggaaaaagatgtcaacaaggctaagagacagatcaagaagcgggcaaataaggcggcccctgagattaataatctgatcgaagaagctacagagtttattaaacagaatatcgtaatctcctccgggtttgtgggcggtttcctgctgggactggcctcttag

SEQ ID NO: 30224 - DNA, 339 bp, Artificial Sequence
  Description of Artificial Sequence: Synthetic coding sequence
atggagctcgtgctggtgttcctctgttcgctgcttgcaccgatggttctggcttcagccgccgaaaaagaaaaagaaatggacccattccactatgactaccagaccttacggatcggcggtctggtgtttgcagtggtgctcttttccgtggggatcctattgatcctccgcccccaggagatgaggaagccgcgctggcgtaccagttcaccaccgatgcagcagagccccagaaagcagcgaaccgaagtccagccaagtggaggacgcagacagcctcaaggcggacgcgggccagtcctactatggcagaagatcccgctgtggggtcagtag

SEQ ID NO: 30225 - DNA, 339 bp, Artificial Sequence
  Description of Artificial Sequence: Synthetic coding sequence
atggaactcgtactagtttttctgtgcagcctgctagctcccatggttctcgcctctgccgcagagaaagaaaaagaaatggacccctttcattatgattatcagacacttagaataggtgggctcgtctttgccgttgttttattctccgtgggtatcctcctcatcctgcggccgcaggaaatgcggaaaccacgctggagaacgagcagtcctccaatgcagcagagtccacgcaaacagcgcacagaagtgcaaccatctggagggagaaggcagccccaaggcggacgagggcctgttctcctatggcaaaagatcccattgtggggccagtag

SEQ ID NO: 30226 - DNA, 3537 bp, Artificial Sequence
  Description of Artificial Sequence: Synthetic coding sequence
atgggccaagatgcggaagacacttcagaggaacctccagaaaaggaggagctcgcgggcgtgcaggaagccgagaccgcaacagattgcccagaggtgcttgaggagggttgcgaggaagctaccggagtcacaggcggggagcaggttgatctcagcgaaccccccgaccatgagaaaaaaactaaccaagaggtagcagctgccaccctggaggaccatgctcaagatgaatcagccgaagaatcctgtcagatcgtgcccttcgaaaatgactgtatggaggactttgtcacttctctaaccgggtcaccatacgagttttttcccactgagtccacaagtttttgctctgagtcgtgcagccccttgtcagaatctgccaaggggttagagagcgaacaggccccaaaactcggcctgagggctgaagagaatccgatggtgggcgctttatgcggccagtgcggctcactgcagggaggtgccgcagaaggaccagccgcacccgatgtggtggtggtgctggaggaggaagctttggacgatgcgttggcaaatccatacgttatgggcgtcggcttacctgggcaggcagcacccggagagggtggccaagctgcctctgacgccttgggagggtacggcagcaaagaagaactcaattgtgaggcagagggcggcctagtgcccgctgatagaaagaacacctcgacacgcgttcgtccacattctggaaaggtggccgggtacgttccagagacggtccccgaagagactggacccgaagcggggagttcagcacctggtatcggaggagctgcagaggaggtggggaaaacattgttgagcctcgagggaaaaccactggaggcgagtcgagccctgcctgctaaaccacgcgcgttcaccctttaccccaggagcttctcagtggagggccgggaaatacctgtcagcgtgtatcaggagcctgaggggagcggcctggatgatcaccgcattaagcggaaggaggacaacctctcactgtcttgtgtcattggatctagcggctccttttcgcaacgaaatcatctccctagtagtggtactagcacgccatcctctatggtggatattccacctccgtttgatctggcctgcatcacgaaaaaacctatcactaaatcatccccatctcttctcatcgagtctgattcgccggataaatacaaaaaaaagaaaagttcatttaagaggtttttagcactgacattcaagaaaaagactgaaaacaaactacacgtagacgttaatgtgagctcatctcgaagttcttcagaatctagttaccacggcccgtcacgaatcctggaagttgaccgcagatctttgtccaatagtcctcaacttaagagccgcacaggcaaattaagagcctcagaatcccctagctcactgatcttctatcgagatggcaagaggaaaggagtcccttttagccggaccgtctccagagtggaaagcttcgaggatcggtcccgacccccatttctgccattacccctcaccaagccccgaagcatctctttcccaagcgctgataccagcgactatgaaaacatcccggccatgaatagtgattacgagaacatccagatacctcccaggcgccccgcccgcgcaggagcttttaccaagctgttcgaagaccaaagccgcgcgctgtcaaccgccaatgagaacgacgggtacgtggacatgtcatccttcaacgctttcgaaagtaaacagcaatccgccgaccaagatgccgagtccgcctacacagagccctacaaagtgtgcccaataagttcagcagcccccaaggaagacctcaccagtgatgaagagcagcgatccagcgaggaggaggattctgcatctcgcgacccatcagttacccacaaagtggagggccaatcccgcgccctcgtcatcgcccaagagcttttgtccagtgaaaaagcatatgtggaaatgctgcagcacctgaacctggacttccatggcgcggtcatgagggcactagacgatatggatcacgagggtagagacacattggcccgggaggagttacgtcagggcctttcggagttacctgcaatacacgatctgcatcagggcatcctcgaagagctggaagagcgcctcagcaactgggagtctcagcagaaagttgctgatgtctttctggcacgcgagcagggattcgaccatcatgctactcacatcctgcagttcgatcggtacctgggcttgctgtccgagaattgcctgcactccccgagactcgccgcagccgtgagggagtttgagcagagtgtgcagggtggctcccagacggcgaaacatcgcttattacgggttgttcagaggctcttccagtatcaagtcctgttgacagattacctcaataacctctgccctgatagcgcagaatatgataacacccagggcgcactgtccctcatcagcaaagtgaccgatcgggccaacgacagtatggagcaaggagagaatctgcagaagttggttcacatcgagcacagcgtccggggtcagggagacctgttgcagccaggccgggaatttctcaaggaaggtactctgatgaaggtgacaggtaaaaacagacggccgcgtcacctttttttgatgaacgacgtgctgctgtacacgtacccgcagaaggacggcaagtatagactaaaaaataccctggcagttgcgaacatgaaggtgtcgagacccgtaatggaaaaggtgccgtatgcactcaaaatcgagacatccgaatcttgtctgatgctgtctgcatcttcctgcgctgaacgcgatgagtggtacggatgtctcagcagagcgcttccagaagattacaaagctcaggccttggcagccttccaccactccgtcgagatccgcgaacgactgggagtgtctttaggagagagacctccaacactggtcccagtcacccatgtgatgatgtgcatgaactgcggttgcgatttttctctgactctgaggcgtcaccactgccacgcatgtgggaaaatcgtatgtaggaactgttcccggaataaatatccacttaagtacctgaaggaccggatggcgaaagtttgcgacgggtgcttcggcgagctcaaaaagcgcgggagggcagtgcctggactaatgagagagagacctgtctccatgagcttcccgcttagctccccccgtttttcaggcagtgctttcagtagtgtgtttcagtcaattaacccatccacctttaagaagcagaaaaaggtccccagcgcccttacagaggataaagtagccctagaaagtatgccccttctcgggttcacgattgcacccgagaaagaggagggttccagcgaagtgggcccaatctttcacctctaccataaaaagactctgttctatagcttcaaggccgaagacactaattccgcccagagatggattgaggcaatggaggacgcaagcgttctgtag

SEQ ID NO: 30227 - DNA, 24 bp, Artificial Sequence
  Description of Artificial Sequence: Synthetic coding sequence
tgagagaaacagtcccagtgctag

SEQ ID NO: 30228 - DNA, 354 bp, Artificial Sequence
  Description of Artificial Sequence: Synthetic coding sequence
atgtcctggaggggcaggtctacctattactggcctagaccaagacggtacgtgcagccacctgaaatgataggtcccatgcgccccgaacagtttagtgacgaggtggaacctgctaccccagaggaaggcgagccggctacacaatgccaagaccccgccgcagcgcaggagggagaagatgagggcgcgtcagcgggccaaggccccaagcccgaagcccactctcaggagcagggccaccctcaaactgggtgtgagtgtgaagatgggcccgacggtcaagagatggatccacccaatcctgaggaagtgaaaacacctgaggaaggagagaaacagagccaatgttag

SEQ ID NO: 30229 - DNA, 354 bp, Artificial Sequence
  Description of Artificial Sequence: Synthetic coding sequence
atgtcatggcgggggagaagcacgtactattggcctcgccctcggaggtacgtccaaccacctgaaatgatcggaccaatgagaccagaacagttctcagatgaggtggagcccgccaccccagaagaaggggaaccagccacccaatgccaagaccctgcggcggcccaggaaggcgaggatgaaggggcaagcgcagggcaaggccctaagcctgaagcccatagccaggagcagggtcatccacagaccggctgcgagtgcgaggacggacctgacggacaggagatggacccccctaaccctgaggaggttaaaaccccagaggagggcgaaaagcagagccaatgttag

SEQ ID NO: 30230 - DNA, 354 bp, Artificial Sequence
  Description of Artificial Sequence: Synthetic coding sequence
atgagctggcgcggcagatccacatattactggcccagaccacgacgttacgtgcagcctcccgagatgattggacccatgaggccggaacagttctccgacgaagtggaacctgctacaccagaggagggcgaacccgctactcagagacaagatccagctgccgcacaggagggggaagacgagggagcctctgcgggtcaggggcctaaaccggaggctcacagccaagaacaaggccacccacagactggatgtgagtgcgaagatgggcctgatggacaggaaatggatccaccaaatccggaggaagtgaagactccggaagagggagagaaacaaagccagtgttag

SEQ ID NO: 30231 - DNA, 354 bp, Artificial Sequence
  Description of Artificial Sequence: Synthetic coding sequence
atgtcttggagggggcgttccacgtattattggccgaggccccggcggtacgtccaaccacctgagatgatcggtcccatgaggcctgagcagttctcggatgaggtggagcccgccacgcccgaggagggggagccagccacccagagacaagaccccgcggcagcccaggagggtgaggatgaaggcgcctcagcgggacagggccccaagcccgaggctcactcgcaggaacagggacatccccagaccggatgcgagtgtgaagacggccctgacggtcaggagatggatcctcccaacccagaagaagttaagacgccggaagaaggagaaaaacagagccagtgctag

SEQ ID NO: 30232 - DNA, 354 bp, Artificial Sequence
  Description of Artificial Sequence: Synthetic coding sequence
atgtcatggcggggaaggtctacctattactggccacgtccccgccgctatgtccagccaccagagatgatcggtccaatgcgacccgagcaattcagtgatgaggtcgaaccggcaaccccagaggaaggagaacctgcgactcagcggcaggaccctgcggccgcccaggaaggtgaggacgaaggcgctagtgctgggcagggccccaagcccgaagctcattcccaagagcagggtcacccgcaaaccggttgcgaatgcgaagatggccccgatggccaagaaatggacccgcccaatcccgaggaggtgaagacacctgaagagggcgaaaagcaatcacagtgctag

SEQ ID NO: 30233 - DNA, 354 bp, Artificial Sequence
  Description of Artificial Sequence: Synthetic coding sequence
atgtcatggcgcggtcggtctacatattattggcctaggccgcggcgctacgtgcagcctccagaaatgataggacctatgagacccgagcagttctcagacgaggtagaacccgctaccccagaggagggggaacccgctacccagcgccaggacccagcagcggctcaggagggtgaggacgagggcgcatccgctggccaggggcctaaaccagaggccgattcgcaggagcagggccaccctcagacaggttgcgaatgcgaagatggaccagacgggcaagaaatggatccaccaaatccggaagaggtcaaaacccccgaagaaggggagggccagtcacaatgctag

SEQ ID NO: 30234 - DNA, 1131 bp, Artificial Sequence
  Description of Artificial Sequence: Synthetic coding sequence
atgttcggcgcggccggccgccagcctatcggagctcctgccgcaggaaattcttggcacttctcgagaactatggaagaactcgtccacgatctcgtgtccgccttagaggaaagctcagagcaggcccgtggtgggtttgccgagacgggcgaccacagtcgatcaatttcttgtcctctaaagcgtcaggctcggaaacgccgtgggcgtaagagacggagttacaacgtgcaccatccgtgggagaccgggcattgcttgtcagaagggagcgattcttctctcgaggagccaagtaaggattaccgggagaatcataataacaacaaaaaggatcactcagatagtgatgaccagatgctcgtcgccaagcgccgtccaagcagcaatcttaacaacaacgttcgaggcaaacgaccactgtggcacgaaagtgacttcgctgtggataatgtcgggaatcgcaccctgcgaagacgccggaaggtcaagcgaatggctgtggacctgcctcaagacatctccaacaagagaaccatgacccagccaccagagggctgtcgcgaccaggacatggattccgatcgcgcgtaccaatatcaggagttcacgaagaataaggtcaaaaagagaaagctgaaaattatcagacagggtccaaaaattcaggatgagggtgtcgtgttagagagtgaggaaaccaaccagacaaacaaggataagatggagtgcgaagaacaaaaggtctcagacgaacttatgtcagaaagcgacagtagttctctatcgagtactgatgcggggctgttcactaatgacgaggggagacagggggatgacgagcaatccgactggttctacgaaaaagagtcgggaggcgcatgtggcatcactggagtcgtgccgtggtgggaaaaggaagaccctactgagctcgacaagaatgtccccgaccctgttttcgagagcattctgaccggatcttttccgctgatgtcgcatccatctcggagaggctttcaggcgaggctcagcaggctgcatggtatgtcaagcaagaacattaaaaagagtggcggcactcctacttccatggccaccaattggacaagtgaaattccactgtag

SEQ ID NO: 30235 - DNA, 1587 bp, Artificial Sequence
  Description of Artificial Sequence: Synthetic coding sequence
atgttcggtgcagcgggtagacagccaattggcgccccagctgccggtaactcctggcacttttcccgtacaatggaggagctggtccacgacttagtctctgctctcgaagaatcatctgagcaggcacggggaggttttgccgagacaggtgaccattctaggtccatttcatgtcccctcaaacggcaggcccgtaaacgtcgaggaaggaaacgacgcagctataatgtgcaccatccctgggaaactggccactgcctttcggaggggtcagacagcagccttgaagagccatccaaagactaccgtgaaaaccataataacaacaaaaaggatcatagcgattccgatgaccagatgctggtggctaagcgccgccccagcagcaacctgaataacaatgtgagagggaagcggcccctgtggcacgaatctgacttcgcggtggataacgtgggaaatcggaccctgcgccgaagaaggaaggtcaagcgaatggcggtcgacctgccccaggacatatcaaacaaaagaaccatgacacaaccacctgagggatgtcgcgaccaggatatggacagcgaccgtgcctaccagtatcaggaattcactaaaaataaggtcaagaaaaggaaacttaagatcattagacagggcccaaaaattcaagacgagggcgtggtcctcgaatcggaagagactaatcaaactaacaaagacaaaatggaatgtgaggaacagaaagtatcagatgaactgatgtcggagtcagattccagctcattgtcaagcaccgacgccggactattcacaaatgacgagggccgacagggcgacgacgagcagtcagactggttttacgaaaaggagtctggcggtgcttgcggcattactggggtcgtcccttggtgggagaaggaggaccccactgaactcgataaaaacgtccctgatccagtattcgagagcattcttaccggttcattcccattgatgtcacaccctagcaggcgcggattccaagcacgacttagtcgcttacacggtatgtcaagtaaaaacatcaaaaagagcggaggaactccgactagtatggtgccgatcccaggaccagtcggcaataaaaggatggtgcatttctcacctgacagccaccaccatgaccactggttttctcccggtgctcgaaccgaacatgaccagcaccagctacttagggataatcgggcagaacggggtcataaaaagaattgttcggtgagaaccgcctctagacagacttccatgcatctcgggagtctgtgcacgggtgacattaaaaggcggcggaaggccgcaccccttcctggcccaacaactgccggcttcgtgggagaaaacgcccaacccatcctggagaacaatatcggaaacagaatgctgcagaacatgggatggactcccggatccgggctgggcagagacggtaaggggatctcagaacccattcaggcgatgcagaggccaaaagggttaggccttggcttccccctacctaagtcaacatctgccactacgacacctaacgctggcaaatccgcctag

SEQ ID NO: 30236 - DNA, 1578 bp, Artificial Sequence
  Description of Artificial Sequence: Synthetic coding sequence
atggctgtgcccggggaagcggaggaggaagccacggtgtacttagtcgtgtctggaatcccatcagtgttgaggagtgctcacctaaggagctatttctcccagtttcgggaggagcggggcggtggcttcctatgctttcattataggcacagacccgagcgcgctcccccacaagccgccccgaattccgccttaattcccactgaccctgccgctgagggtcagctgttatcacaaacaagcgccactgatgtaaggcccttgagcacacgcgattctacccccattcaaacaaggacctgttgttgcgttataagcgtgcgcggcttagcccaggctcagagactgatccgcatgtactctggaaggcgttggcttgatagtcatggaacatggcttccaggaaggtgccttatccggcggctgcggctccccactgaggcttcaggactgggatcattcccctttaaaacccggaaagaactgcaatcatggaaagccgagaacgaggcctttacccttgctgatttgaaacagctgcccgagctgaacccccctgtactcatgccacggggaaacgtgggaactccactccgcgtattcttggaactgatacgggcttgtaggctccctcctcgaatcatcacacagcttcagctgcagttcccaaagaccggctcttctcgccgctacggcaacgtcccgttcgagtatgaggatagtgagacagtggaacaggaagaactggtatacaccgccgaaggcgaagagatcccccaaggcacttatctcgcagacattcctgcctctccatgcggcgaacccgaggaagaagtaggcaaggaggaagaagaggagtcacacagtgatgaagacgacgatcgcggcgaggaatgggagaggcacgaggccctgcacgaggacgtgactggccaggagcgtacaaccgagcagttgttcgaagaggagattgagctgaagtgggaaaaaggcggaagcggactagtcttctatactgacgcccagttctggcaagaggaagagggcgatttcgacgagcagaccgccgacgactgggacgtggacatgtctgtgtactacgatcgcgatggcggcgacaaggatgcccgcgattctgttcagatgcgactggagcagagactccgagacgggcaagaggatggcagcgttatcgaaagacaagttggaacttttgagaggcatacaaaaggcatcggtcgaaaggtaatggagcgtcaaggttgggcagaggggcaaggattaggctgtcgatgttcaggcgtgcccgaggcactggactcagatgggcaacaccctagatgtaagagagggctcggctaccacggagaaaaactacagccttttggccagctaaagaggccaaggaggaatgggctggggctgatatccactatttacgatgagccattgcctcaagatcagaccgaatccttgctgagacggcaaccgccaacttccatgaagtttcgcacagacatggcctttgtgcggggtagtagctgtgcaagcgacagcccatctctccccgactag

SEQ ID NO: 30237 - DNA, 714 bp, Artificial Sequence
  Description of Artificial Sequence: Synthetic coding sequence
atgccccgcggtaacgtgggtacccctctgcgtgtgtttctggaattaataagggcttgtcgcctccctccacggatcattacacagctgcagttgcagttccccaagactggctctagccggagatacgggaacgtcccttttgagtatgaagattctgaaaccgtagagcaagaggagctagtctatactgctgagggagaggaaattcctcagggaacctatttggccgacatacccgcaagtccgtgtggcgagccggaagaggaagtagggaaagaagaggaagaagagagtcactccgacgaggatgacgatagaggagaggaatgggagcggcatgaggccttacatgaggacgtgacgggtcaggaaagaactaccgaacagttgtttgaggaagaaatcgagctgaagtgggagaaagggggaagtgggctcgtattctacacagatgctcagttttggcaggaggaagaaggtgactttgacgaacagaccgccgacgattgggatgtcgatatgagtgtgtactacgacagggacggaggggataaagacgctcgcgattcagttcagatgagactcgagcagcggttgcgcgatggtcaagaggacggttctgtgattgagaggcaggtcggaacttttgaacgccataccaagggtatcttcactaaaagccccctgccctccccacctctcgggtactag

SEQ ID NO: 30238 - DNA, 231 bp, Artificial Sequence
  Description of Artificial Sequence: Synthetic coding sequence
tgatttgatgaacagacagcggatgactgggatgtcgacatgtctgtgtattacgaccgtgacggaggggataaagatgcccgtgactccgtacagatgagactggaacaaaggttgagagacggtcaggaggacggatcagtgattgagcggcaagtcggaacatttgaaaggcatacaaagggcatttttactaaaagtcctttgccatctccaccgctcgggtattag

SEQ ID NO: 30239 - DNA, 387 bp, Artificial Sequence
  Description of Artificial Sequence: Synthetic coding sequence
atgcggctggaacaacgtcttagggatggccaggaggatggttccgtgatcgagagacaggtcggaactttcgaaaggcatactaaagggatcggccgcaaggtgatggagcgccaaggctgggccgaaggacaaggcctgggctgtcggtgctccggcgtgcccgaagccctggactccgatggccagcaccctcgttgtaagagaggtctggggtaccatggggaaaaactgcagccctttggccagctcaagcggcctagacgcaatggtctgggcctgatttccactatatatgacgaacccctcccccaggatcaaaccgagtccctcctccgtcgacagcccccaacatccatgaaattcaggaccgacatggcattttag

SEQ ID NO: 30240 - DNA, 1524 bp, Artificial Sequence
  Description of Artificial Sequence: Synthetic coding sequence
atggctgtgccgggggaagccgaggaggaagctactgtctacctcgttgtgtcaggcattccctcggtgctgagaagtgcacacctgcggagctacttttctcaatttcgagaagagcggggtggcgggtttctttgcttccattaccggcaccgacctgagagagccccccctcaggcggctcctaacagcgccctcatccccaccgatcccgctgcagaggggcagctactgagccaaacctctgccaccgatgtgagaccactcagtacacgtgactctacccccatccaaaccagaacgtgttgttgcgtgatcagcgtgcggggcttagcccaggcgcagcgcctcatccgcatgtatagcggccggcgctggctcgatagtcatggtacttggctgccgggaaggtgtttgatccgcaggctgcgccttcctactgaagccagtggactcggcagttttcccttcaaaacccgcaaagagctgccagagcttaacccaccagtgctcatgcctagaggaaacgtgggaactccacttagagttttccttgaactgatcagggcctgtcgcctccctcctcggataattacgcagctccagctgcagttcccgaaaacaggcagttctcgccgatacggaaacgtaccctttgaatacgaggacagtgaaaccgtagagcaggaggaactggtatacactgcagaaggcgaagaaatcccacagggcacgtatctggccgacatacccgcctccccttgtggagaacccgaggaggaggttggaaaggaggaagaggaggaatcacacagcgatgaggatgatgatcgaggcgaggaatgggaacgccacgaagctctccatgaggacgtcactgggcaggagaggacgacagagcagctattcgaggaagagattgagttaaagtgggagaaaggtggctccggtctcgtattttacacggatgcccaattctggcaggaagaagaaggtgattttgacgaacagaccgctgatgattgggatgtggatatgtctgtctattacgacagagacgggggcgataaagacgccagagactcagtgcagatgcgactagagcaaagactgcgcgacgggcaggaagacgggagcgtgatcgaaaggcaggtgggaaccttcgagcggcatacaaaaggcataggccggaaagtgatggagagacaaggctgggccgagggacaggggctgggatgccgttgctctggggtgcccgaggctcttgattcggacggacagcatcccaggtgcaaaagagggcttgggtaccacggcgaaaaactgcaacctttcggccaactgaagcggccacggaggaatggcctcggtttgatatccactatctatgacgaacctctgcctcaggaccagacagagtcactgcttaggcgacagccccctacctcaatgaaattccgcacagatatggcattcgtccgaggttcctcctgcgcctccgacagcccctctctgcctgactag

SEQ ID NO: 30241 - DNA, 420 bp, Artificial Sequence
  Description of Artificial Sequence: Synthetic coding sequence
atggacgggctcaaggtgggacacgaccctgccaaagaatttaccaatcactggtggaatgagttgtttaataagaccgcagcaaatttggtggtagaaaccgggcaagacggcgtccagatccgcagcttgtccaaggagacaaccagatataatcacccaaagcccaatctgctctaccagaagtttgttaaggtcctagaggccgttgggaacagagttcaccctttctcacttccctggtttccttggggcctcaattcttgtttagtgtgtcttattaactctcagaacttcccaaacatcgtcggcagttgtgatcagccttgctgttgcctgcttcgcctgcctaggccctcagcaggcatagaaatattcagatttagaggctcatgccacctcctgcgagaacaacagtag

SEQ ID NO: 30242 - DNA, 1338 bp, Artificial Sequence
  Description of Artificial Sequence: Synthetic coding sequence
atgaacgtgaccccagaggtgaaaagtcgggggatgaagtttgcagaagaacagttgttgaagcatggctggactcaagggaaaggtcttggtagaaaagagaatggaattacgcaagccttgcgagttacactcaagcaggacactcacggtgtcggccacgacccagctaaagaatttacaaatcattggtggaacgaattgttcaacaaaaccgcagctaaccttgtggtcgaaacaggccaggacggagtgcagatacggagtctgtccaaagagaccacccgctataatcacccaaagccaaatcttctctatcaaaagttcgtgaaaatggccacgctgacttcagggggagaaaaaccaaataaagacctggagtcatgtagtgatgacgacaatcaggggtccaagagccccaagatccttaccgatgaaatgctgcttcaggcttgtgaaggtcgtactgctcataaggccgcgagactggggattacgatgaaggctaagctcgcacgcctggaggcccaagaacaggccttcctggccaggctgaagggacaagatcccggagccccacaactgcagtccgagtccaagcctcccaagaaaaaaaaaaaaaaaaggcgtcagaaagaggaggaagaggccactgcctcagaacgcaatgacgccgatgaaaaacaccccgagcacgccgagcagaatatccgaaaaagcaaaaagaaaaagagacggcaccaagagggcaaggtctccgacgagagggaggggacaaccaaggggaatgaaaaagaagacgccgctgggactagcgggctgggtgaattaaattccagagaacaaacaaatcaatcgctgcgcaaaggtaagaagaagaaaagatggcaccatgaagaagagaaaatgggcgttctcgaagagggcgggaaggggaaggaggccgcagggtccgtgcgtacagaggaggttgaatcccgggcttatgccgatccttgtagccggcgaaagaaacggcagcagcaagaagaagaagacttgaatctggaggatcgaggggaagagacgttgggaggtggaaccagggaggctgaatcccgagcatgctcagacggcagatcacgaaaatcgaagaaaaaaagacagcagcaccaggaggaagaagacatcctggacgtacgagatgagaaggatgggggcgctagggaagccgagagtagagcacacactggctccagctcacgcggcaagcggaaacgccagcagcatccaaagaaagaacgtgcaggggtgagtacagttcagaaggccaagaagaagcaaaagaaacgcgattag

SEQ ID NO: 30243 - DNA, 1113 bp, Artificial Sequence
  Description of Artificial Sequence: Synthetic coding sequence
atgaatgtcacacccgaggtcaagagccggggcatgaaatttgctgaggagcagcttctgaagcacggttggacacaaggcaaaggtctgggtcggaaggagaatggaatcacacaggccctccgggtcaccctgaagcaggatacacatggagtggggcatgaccctgccaaggagtttaccaatcattggtggaatgagcttttcaacaagacggcagcaaacctagtcgtggagacagggcaggatggggtgcaaattcggagcctctcaaaagaaactacccggtacaatcaccctaagccgaatttactctatcaaaagtttgttaaaatggcaacactgaccagtgggggggagaaacctaacaaggacttggaatcctgctcagatgatgataaccagggttccaaatcccccaagatccttaccgatgaaatgcttctgcaagcttgcgaggggagaacagcccataaggcagcccggctcgggatcacgatgaaggccaagttagcgcggctggaggctcaggagcaagcgtttttggccaggcttaaggggcaggaccccggggcccctcaactccaaagcgaatccaagcccccaaagaaaaagaagaaaaaacggcgacagaaggaagaggaagaggccactgcgtcagagcggaacgatgctgatgaaaaacaccctgagcatgcagaacaaaacattaggaagtcaaaaaaaaagaaaaggcgccaccaggagggaaaggtgagcgatgagagggagggcactaccaagggcaacgagaaggaggacgcggctgggacctccggtttgggagaactgaatagcagggagcaaacaaaccagtcattgaggaaagggaaaaagaagaagaggtggcatcacgaagaggaaaagatgggagtgcttgaggagggcggcaaaggaaaagaagctgcggggtctgtccgaacagaggaagtggaaagtcgggcctacgccgacccttgctcacgccggaagaaacggcaacagcaggaggaggaggacctgaacttagaggacaggggcgaagaaacctttcgctggtggaaccaaggcagtcgggagcaatctatgcaatag

SEQ ID NO: 30244 - DNA, 1128 bp, Artificial Sequence
  Description of Artificial Sequence: Synthetic coding sequence
atgttccccaggtcaggaccttcgaacgacgaagtcaagtctagaggtatgaaatttgccgaagagcagctcctgaagcacgggtggacacagggaaagggcctgggccgaaaagaaaatgggatcacccaggcattgcgggtgacactgaagcaggacacccacggggttggccacgatcccgccaaggaattcacaaaccattggtggaatgagctgttcaataagacggctgcgaacctggtagtcgaaaccggtcaggatggagtgcaaatccggtcactcagcaaagaaaccacgaggtataaccatccaaaacctaatctactgtaccagaaatttgtcaagatggctaccctgacatcaggcggcgagaaaccaaataaggacttggaaagttgtagcgacgacgacaaccaggggagcaaaagcccaaagatactgaccgatgaaatgttgcttcaggcatgtgaggggcgcactgcacataaggccgctcggctgggcatcaccatgaaagcaaagctggctcggctcgaagctcaggagcaggcattcctcgctcgcttgaaagggcaagatcctggggctccccagctgcagtcagagagcaaaccacctaaaaagaagaaaaagaagcgacgtcagaaggaggaagaggaggccaccgccagtgaacggaatgacgcagacgagaaacatcccgagcacgcagagcagaatattagaaagtctaaaaagaaaaagcgtcgacaccaggaaggaaaggtgagcgatgaacgggaaggtacaactaagggcaacgaaaaagaggatgctgcaggcacgtctggacttggcgagctgaactcccgagaacaaacaaaccagtccctccgcaaaggtaaaaaaaaaaagcgctggcaccatgaggaagaaaagatgggggtgttggaagagggtggcaaaggcaaagaagcggcgggctccgttcggaccgaggaggtagaaagccgtgcctacgcagacccatgttctcgcagaaaaaaaaggcagcagcaagaagaggaagacctcaacctagaagaccgcggcgaggaaacctttcgctggtggaatcaaggctcgcgggagcagtcaatgcaatag

SEQ ID NO: 30245 - DNA, 1218 bp, Artificial Sequence
  Description of Artificial Sequence: Synthetic coding sequence
tgaagcctggtgcttggtgtaatcacgtgcgcacctgaacggctaaatttcccagcttccgcctgcgcactgaagagagcagcctggctgctgcggggccgcggtgtctttcataatggtctaaagatctgcgaaaaatttggacctaacctagacacctgccccgaaggcacaatcctgggcctacggctagattccagtggaggactccacctgcatgtaaacggtgtggatcagggtgtggctgtgcctgatgtgcctcagccttgccacgcgttggtagacctgtacgggcagtgcgagcaggtcaccatcgtcaacccggagccaggagctgccagcggaaagtctgctggaacccaaggggacatggagaaggccgacatggttgatgggatcaaggagagcgtctgctggggacctcctccggctgcctcacccctaaaaagttgcgagtatcacgccctgtgcagcagattccaggagctgctgttgctgcctgaggactacttcatgccaccacccaaaagatcactgtgttattgcgaaagttgcagaaagctgaggggggatgaagctcacagacgccgcggagagcctccccgggagtacgctctgccatttggttggtgtcgtttcaacctccgagtgaacccccggctggaagccggcactctcacaaagaagtggcatatggcataccacggctctaatgtggccgccgtgcgccgagtcttagacaggggtgaactgggcgccggcaccgctagcattttaagctgcaggccattgaagggggagcctggagtggggtttgaagaaccgggcgaaaactgcgcgccaccacgagaggagcaaccgccgccagtgctgctttcaccttctttacagtacgcaggggcggaaactctggccagcaaggttcagttcagggaccccaaatcacaacggacacatcaggcgcaagttgcctttcagagatctctgtccctatgcccccatgaggccgctttcagcggggctactggtcgggaatggggacgagtgggtgcaaggaaaatgggcgcctcggtccagttgctcctgacactgatcagtaaggaaccaatcaacacagtgtctgagcccccaccccggccactctctagagcacccctgtctggggccagagtgccatggggagccactaggtgggcgagggagatcaaggagagctag
